United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 30

SEQ ID NO: 1319624 - RNA, 14 nt, Human
cuggaggagcccag

SEQ ID NO: 1319625 - RNA, 15 nt, Human
cuggaggagcccagg

SEQ ID NO: 1319626 - RNA, 16 nt, Human
cuggaggagcccaggc

SEQ ID NO: 1319627 - RNA, 19 nt, Human
cuggaggagcccaggccag

SEQ ID NO: 1319628 - RNA, 21 nt, Human
cuggaggagcccaggccagga

SEQ ID NO: 1319629 - RNA, 16 nt, Human
cuggaggcaccuggug

SEQ ID NO: 1319630 - RNA, 16 nt, Human
cuggccaacgggguga

SEQ ID NO: 1319631 - RNA, 20 nt, Human
cuggcauuagaauuauuuaa

SEQ ID NO: 1319632 - RNA, 22 nt, Human
cuggcauuagaauuauuuaaac

SEQ ID NO: 1319633 - RNA, 13 nt, Human
cuggccaagcuga

SEQ ID NO: 1319634 - RNA, 14 nt, Human
cuggccaagcugag

SEQ ID NO: 1319635 - RNA, 15 nt, Human
cuggccaagcugagg

SEQ ID NO: 1319636 - RNA, 16 nt, Human
cuggccaagcugaggu

SEQ ID NO: 1319637 - RNA, 17 nt, Human
cuggccaagcugaggug

SEQ ID NO: 1319638 - RNA, 18 nt, Human
cuggccauggagaaagcu

SEQ ID NO: 1319639 - RNA, 19 nt, Human
cuggccauggagaaagcug

SEQ ID NO: 1319640 - RNA, 20 nt, Human
cuggccauggagaaagcuga

SEQ ID NO: 1319641 - RNA, 21 nt, Human
cuggccauggagaaagcugac

SEQ ID NO: 1319642 - RNA, 23 nt, Human
cuggccauggagaaagcugacuu

SEQ ID NO: 1319643 - RNA, 13 nt, Human
cuggccauggccu

SEQ ID NO: 1319644 - RNA, 14 nt, Human
cuggccauggccug

SEQ ID NO: 1319645 - RNA, 15 nt, Human
cuggccauggccugc

SEQ ID NO: 1319646 - RNA, 16 nt, Human
cuggccauggccugca

SEQ ID NO: 1319647 - RNA, 22 nt, Human
cuggccauggccugcaaacugg

SEQ ID NO: 1319648 - RNA, 20 nt, Human
cuggccauggccugcaaacu

SEQ ID NO: 1319649 - RNA, 13 nt, Human
cuggcccaccagg

SEQ ID NO: 1319650 - RNA, 14 nt, Human
cuggcccaccaggg

SEQ ID NO: 1319651 - RNA, 14 nt, Human
cuggcccaccccac

SEQ ID NO: 1319652 - RNA, 16 nt, Human
cuggcccaccccaccc

SEQ ID NO: 1319653 - RNA, 13 nt, Human
cuggcccagccuu

SEQ ID NO: 1319654 - RNA, 21 nt, Human
cuggcccagccuuuguucccc

SEQ ID NO: 1319655 - RNA, 15 nt, Human
cuggcccagccuuug

SEQ ID NO: 1319656 - RNA, 13 nt, Human
cuggcccagggcc

SEQ ID NO: 1319657 - RNA, 14 nt, Human
cuggcccagggccc

SEQ ID NO: 1319658 - RNA, 15 nt, Human
cuggcccagggccca

SEQ ID NO: 1319659 - RNA, 12 nt, Human
cuggcccagggc

SEQ ID NO: 1319660 - RNA, 11 nt, Human
cuggcccaggg

SEQ ID NO: 1319661 - RNA, 16 nt, Human
cuggcccagggcccag

SEQ ID NO: 1319662 - RNA, 16 nt, Human
cuggccucaaagcaag

SEQ ID NO: 1319663 - RNA, 21 nt, Human
cuggccucaaagcaagcauuc

SEQ ID NO: 1319664 - RNA, 14 nt, Human
cuggccucccccac

SEQ ID NO: 1319665 - RNA, 15 nt, Human
cuggccucccccacu

SEQ ID NO: 1319666 - RNA, 16 nt, Human
cuggccuccccugcca

SEQ ID NO: 1319667 - RNA, 17 nt, Human
cuggccuccccugccac

SEQ ID NO: 1319668 - RNA, 18 nt, Human
cuggccuccccugccacc

SEQ ID NO: 1319669 - RNA, 21 nt, Human
cuggccuccccugccaccagg

SEQ ID NO: 1319670 - RNA, 17 nt, Human
cuggccucccccacuuu

SEQ ID NO: 1319671 - RNA, 13 nt, Human
cuggccuccugcc

SEQ ID NO: 1319672 - RNA, 14 nt, Human
cuggccuccugccu

SEQ ID NO: 1319673 - RNA, 16 nt, Human
cuggccuccugccucu

SEQ ID NO: 1319674 - RNA, 15 nt, Human
cuggccuccugccuc

SEQ ID NO: 1319675 - RNA, 15 nt, Human
cuggccucugcuuuc

SEQ ID NO: 1319676 - RNA, 20 nt, Human
cuggagcccacuguacuugc

SEQ ID NO: 1319677 - RNA, 17 nt, Human
cuggagcccacuguacu

SEQ ID NO: 1319678 - RNA, 16 nt, Human
cuggagcccacuguac

SEQ ID NO: 1319679 - RNA, 15 nt, Human
cuggagcccacugua

SEQ ID NO: 1319680 - RNA, 13 nt, Human
cuggagcccacug

SEQ ID NO: 1319681 - RNA, 12 nt, Human
cuggagccagcc

SEQ ID NO: 1319682 - RNA, 22 nt, Human
cuggagccagccgagcaggagg

SEQ ID NO: 1319683 - RNA, 14 nt, Human
cuggagccagccga

SEQ ID NO: 1319684 - RNA, 22 nt, Human
cuggagcauuguguauagaacu

SEQ ID NO: 1319685 - RNA, 14 nt, Human
cuggagcauuucuc

SEQ ID NO: 1319686 - RNA, 21 nt, Human
cuggagcccacuguacuugcu

SEQ ID NO: 1319687 - RNA, 16 nt, Human
cuggagcuagaauuug

SEQ ID NO: 1319688 - RNA, 17 nt, Human
cuggagcuagaauuuga

SEQ ID NO: 1319689 - RNA, 22 nt, Human
cuggagcuagaauuugauaugu

SEQ ID NO: 1319690 - RNA, 12 nt, Human
cuggagcucugc

SEQ ID NO: 1319691 - RNA, 12 nt, Human
cuggaggaccug

SEQ ID NO: 1319692 - RNA, 14 nt, Human
cuggaggaccugag

SEQ ID NO: 1319693 - RNA, 15 nt, Human
cuggaggaccugagc

SEQ ID NO: 1319694 - RNA, 16 nt, Human
cuggaggaccugagcc

SEQ ID NO: 1319695 - RNA, 17 nt, Human
cuggaggaccugagccu

SEQ ID NO: 1319696 - RNA, 18 nt, Human
cuggaggaccugagccug

SEQ ID NO: 1319697 - RNA, 19 nt, Human
cuggaggaccugagccugc

SEQ ID NO: 1319698 - RNA, 20 nt, Human
cuggaggaccugagccugcc

SEQ ID NO: 1319699 - RNA, 22 nt, Human
cuggaggaccugagccugccga

SEQ ID NO: 1319700 - RNA, 21 nt, Human
cuggaggaccugagccugccg

SEQ ID NO: 1319701 - RNA, 12 nt, Human
cuggacagcuug

SEQ ID NO: 1319702 - RNA, 14 nt, Human
cuggacagcuugug

SEQ ID NO: 1319703 - RNA, 17 nt, Human
cuggacagcugugccuc

SEQ ID NO: 1319704 - RNA, 18 nt, Human
cuggacagcugugccucg

SEQ ID NO: 1319705 - RNA, 19 nt, Human
cuggacagcugugccucgc

SEQ ID NO: 1319706 - RNA, 20 nt, Human
cuggacagcugugccucgcu

SEQ ID NO: 1319707 - RNA, 23 nt, Human
cuggacaugaagauucuuuccca

SEQ ID NO: 1319708 - RNA, 14 nt, Human
cuggaccacugggc

SEQ ID NO: 1319709 - RNA, 15 nt, Human
cuggaccacugggca

SEQ ID NO: 1319710 - RNA, 12 nt, Human
cuggaccagccu

SEQ ID NO: 1319711 - RNA, 16 nt, Human
cuggacucaccucccc

SEQ ID NO: 1319712 - RNA, 21 nt, Human
cuggagacuuagggcaccagg

SEQ ID NO: 1319713 - RNA, 16 nt, Human
cuggagagaacagguu

SEQ ID NO: 1319714 - RNA, 14 nt, Human
cuggagagaacagg

SEQ ID NO: 1319715 - RNA, 20 nt, Human
cuggagagcauagggucugg

SEQ ID NO: 1319716 - RNA, 12 nt, Human
cuggagaggccc

SEQ ID NO: 1319717 - RNA, 23 nt, Human
cuggagcacaauaaauggcugua

SEQ ID NO: 1319718 - RNA, 16 nt, Human
cuggagcagaagcagc

SEQ ID NO: 1319719 - RNA, 17 nt, Human
cuggagcagaagcagca

SEQ ID NO: 1319720 - RNA, 13 nt, Human
cuggagcagacca

SEQ ID NO: 1319721 - RNA, 15 nt, Human
cuggagcagaccacc

SEQ ID NO: 1319722 - RNA, 18 nt, Human
cuggagcagaccaccccg

SEQ ID NO: 1319723 - RNA, 22 nt, Human
cuggagcagaccaccccgccug

SEQ ID NO: 1319724 - RNA, 13 nt, Human
cuggagcagaagg

SEQ ID NO: 1319725 - RNA, 22 nt, Human
cugcucuuucucugccagugac

SEQ ID NO: 1319726 - RNA, 12 nt, Human
cugcucugauga

SEQ ID NO: 1319727 - RNA, 22 nt, Human
cugcucugagaauuguugagau

SEQ ID NO: 1319728 - RNA, 20 nt, Human
cugcucugaugaagaggagu

SEQ ID NO: 1319729 - RNA, 23 nt, Human
cugcucuuggcuggacccagcca

SEQ ID NO: 1319730 - RNA, 14 nt, Human
cugcucuuucucug

SEQ ID NO: 1319731 - RNA, 15 nt, Human
cugcucuuucucugc

SEQ ID NO: 1319732 - RNA, 16 nt, Human
cugcucuuucucugcc

SEQ ID NO: 1319733 - RNA, 17 nt, Human
cugcucuuucucugcca

SEQ ID NO: 1319734 - RNA, 18 nt, Human
cugcucuuucucugccag

SEQ ID NO: 1319735 - RNA, 19 nt, Human
cugcucuuucucugccagu

SEQ ID NO: 1319736 - RNA, 20 nt, Human
cugcucuuucucugccagug

SEQ ID NO: 1319737 - RNA, 21 nt, Human
cugcucuuucucugccaguga

SEQ ID NO: 1319738 - RNA, 18 nt, Human
cugcuuugggcugcccug

SEQ ID NO: 1319739 - RNA, 11 nt, Human
cugcuuucugu

SEQ ID NO: 1319740 - RNA, 13 nt, Human
cugcuuucuguuc

SEQ ID NO: 1319741 - RNA, 15 nt, Human
cugcuuucuguucca

SEQ ID NO: 1319742 - RNA, 19 nt, Human
cugcuuugggcugcccugg

SEQ ID NO: 1319743 - RNA, 20 nt, Human
cugcuuugggcugcccuggu

SEQ ID NO: 1319744 - RNA, 14 nt, Human
cugcuuucuccuuu

SEQ ID NO: 1319745 - RNA, 21 nt, Human
cugcuuugggcugcccuggug

SEQ ID NO: 1319746 - RNA, 22 nt, Human
cugcuuugggcugcccuggugc

SEQ ID NO: 1319747 - RNA, 23 nt, Human
cugcuuugggcugcccuggugcu

SEQ ID NO: 1319748 - RNA, 12 nt, Human
cugcuuuucaau

SEQ ID NO: 1319749 - RNA, 15 nt, Human
cugcuuuucaaugug

SEQ ID NO: 1319750 - RNA, 18 nt, Human
cugcuuuucccuuuguga

SEQ ID NO: 1319751 - RNA, 19 nt, Human
cugcuuuucccuuugugag

SEQ ID NO: 1319752 - RNA, 23 nt, Human
cuggaauaauccuaaacauauga

SEQ ID NO: 1319753 - RNA, 22 nt, Human
cuggaagcauuuguuucuacuu

SEQ ID NO: 1319754 - RNA, 21 nt, Human
cuggaagugcuaauuuugaaa

SEQ ID NO: 1319755 - RNA, 22 nt, Human
cugcuuuucccuuugugaguca

SEQ ID NO: 1319756 - RNA, 14 nt, Human
cuggaauguaauca

SEQ ID NO: 1319757 - RNA, 15 nt, Human
cuggaauguaaucaa

SEQ ID NO: 1319758 - RNA, 20 nt, Human
cuggaauguaaucaauguuu

SEQ ID NO: 1319759 - RNA, 14 nt, Human
cuggaauaaguuca

SEQ ID NO: 1319760 - RNA, 15 nt, Human
cuggaauacaugaaa

SEQ ID NO: 1319761 - RNA, 21 nt, Human
cuggaauguaaucaauguuuc

SEQ ID NO: 1319762 - RNA, 18 nt, Human
cuggacacucagaccuga

SEQ ID NO: 1319763 - RNA, 13 nt, Human
cuggacagcccca

SEQ ID NO: 1319764 - RNA, 14 nt, Human
cuggacagccccac

SEQ ID NO: 1319765 - RNA, 15 nt, Human
cuggacagccccacc

SEQ ID NO: 1319766 - RNA, 16 nt, Human
cuggacagccccaccc

SEQ ID NO: 1319767 - RNA, 18 nt, Human
cuggacagccccacccug

SEQ ID NO: 1319768 - RNA, 19 nt, Human
cuggacagccccacccugg

SEQ ID NO: 1319769 - RNA, 13 nt, Human
cuggacagcugug

SEQ ID NO: 1319770 - RNA, 14 nt, Human
cuggacagcugugc

SEQ ID NO: 1319771 - RNA, 15 nt, Human
cuggacagcugugcc

SEQ ID NO: 1319772 - RNA, 16 nt, Human
cuggacagcugugccu

SEQ ID NO: 1319773 - RNA, 16 nt, Human
cugggagcuuuuguag

SEQ ID NO: 1319774 - RNA, 14 nt, Human
cugggagcucugca

SEQ ID NO: 1319775 - RNA, 15 nt, Human
cugggagcucugcag

SEQ ID NO: 1319776 - RNA, 13 nt, Human
cugggagcucugc

SEQ ID NO: 1319777 - RNA, 23 nt, Human
cugggaaggcuacuucggggcug

SEQ ID NO: 1319778 - RNA, 23 nt, Human
cugggagcuccacucugcuucuc

SEQ ID NO: 1319779 - RNA, 16 nt, Human
cugggaaggcuacuuc

SEQ ID NO: 1319780 - RNA, 23 nt, Human
cugggaacaucacauuccucugc

SEQ ID NO: 1319781 - RNA, 21 nt, Human
cugggaacagugugcaaggca

SEQ ID NO: 1319782 - RNA, 19 nt, Human
cugggaaccccuuucccac

SEQ ID NO: 1319783 - RNA, 17 nt, Human
cugggaaccccuuuccc

SEQ ID NO: 1319784 - RNA, 18 nt, Human
cugggaaccccuuuccca

SEQ ID NO: 1319785 - RNA, 17 nt, Human
cugggaacucaucuggu

SEQ ID NO: 1319786 - RNA, 16 nt, Human
cugggaggcucuggag

SEQ ID NO: 1319787 - RNA, 15 nt, Human
cugggaggcucugga

SEQ ID NO: 1319788 - RNA, 16 nt, Human
cugggaggcagugaug

SEQ ID NO: 1319789 - RNA, 17 nt, Human
cugggaggcucuggagc

SEQ ID NO: 1319790 - RNA, 16 nt, Human
cugggaggcuccccuu

SEQ ID NO: 1319791 - RNA, 22 nt, Human
cugggagggacaugcuuagcag

SEQ ID NO: 1319792 - RNA, 11 nt, Human
cugggagggca

SEQ ID NO: 1319793 - RNA, 13 nt, Human
cugggagggcagc

SEQ ID NO: 1319794 - RNA, 15 nt, Human
cugggagggcagcag

SEQ ID NO: 1319795 - RNA, 17 nt, Human
cugggagggcagcaggg

SEQ ID NO: 1319796 - RNA, 19 nt, Human
cugggagggcagcagggcu

SEQ ID NO: 1319797 - RNA, 20 nt, Human
cugggagggcagcagggcua

SEQ ID NO: 1319798 - RNA, 17 nt, Human
cugggccccugccucuc

SEQ ID NO: 1319799 - RNA, 16 nt, Human
cugggccccugccucu

SEQ ID NO: 1319800 - RNA, 12 nt, Human
cugggccccugc

SEQ ID NO: 1319801 - RNA, 20 nt, Human
cugggcaccggggccucgga

SEQ ID NO: 1319802 - RNA, 22 nt, Human
cugggagggcagcagggcuacc

SEQ ID NO: 1319803 - RNA, 17 nt, Human
cugggaggcuccccuuc

SEQ ID NO: 1319804 - RNA, 23 nt, Human
cugggaguugaucgccuuuccca

SEQ ID NO: 1319805 - RNA, 21 nt, Human
cugggauuacaggcgugagcc

SEQ ID NO: 1319806 - RNA, 15 nt, Human
cugggauagaggggu

SEQ ID NO: 1319807 - RNA, 19 nt, Human
cugggauuacaggcuccug

SEQ ID NO: 1319808 - RNA, 20 nt, Human
cugggauuacaggcuccugc

SEQ ID NO: 1319809 - RNA, 21 nt, Human
cugggauuacaggcuccugcc

SEQ ID NO: 1319810 - RNA, 22 nt, Human
cugggauuacaggcuccugcca

SEQ ID NO: 1319811 - RNA, 23 nt, Human
cugggauuacaggcuccugccac

SEQ ID NO: 1319812 - RNA, 20 nt, Human
cugggaucacauguggacuu

SEQ ID NO: 1319813 - RNA, 20 nt, Human
cuggcucuugauaccccccu

SEQ ID NO: 1319814 - RNA, 21 nt, Human
cuggcucuugauaccccccuc

SEQ ID NO: 1319815 - RNA, 22 nt, Human
cuggcucuugauaccccccucu

SEQ ID NO: 1319816 - RNA, 23 nt, Human
cuggcucuugauaccccccucug

SEQ ID NO: 1319817 - RNA, 14 nt, Human
cuggcugccuuaga

SEQ ID NO: 1319818 - RNA, 19 nt, Human
cuggcugccuuagaaccuu

SEQ ID NO: 1319819 - RNA, 21 nt, Human
cuggcugcugaucgccuuccc

SEQ ID NO: 1319820 - RNA, 20 nt, Human
cuggcugcugaucgccuucc

SEQ ID NO: 1319821 - RNA, 12 nt, Human
cuggcuguuuga

SEQ ID NO: 1319822 - RNA, 14 nt, Human
cuggcuucacagau

SEQ ID NO: 1319823 - RNA, 16 nt, Human
cuggcuucccaucccc

SEQ ID NO: 1319824 - RNA, 15 nt, Human
cuggcuuuucacugc

SEQ ID NO: 1319825 - RNA, 16 nt, Human
cuggcuuuucacugcu

SEQ ID NO: 1319826 - RNA, 12 nt, Human
cuggcuucuggc

SEQ ID NO: 1319827 - RNA, 13 nt, Human
cuggcuucuggcc

SEQ ID NO: 1319828 - RNA, 17 nt, Human
cuggcuucuggccagga

SEQ ID NO: 1319829 - RNA, 19 nt, Human
cuggcuucuggccaggaag

SEQ ID NO: 1319830 - RNA, 18 nt, Human
cuggcuucccauccccag

SEQ ID NO: 1319831 - RNA, 20 nt, Human
cuggcuucccauccccagcg

SEQ ID NO: 1319832 - RNA, 22 nt, Human
cuggcuucccauccccagcgau

SEQ ID NO: 1319833 - RNA, 21 nt, Human
cuggcuucccauccccagcga

SEQ ID NO: 1319834 - RNA, 17 nt, Human
cuggcuuuucacugcug

SEQ ID NO: 1319835 - RNA, 19 nt, Human
cuggcuuuucacugcuggc

SEQ ID NO: 1319836 - RNA, 20 nt, Human
cuggcuuuucacugcuggcu

SEQ ID NO: 1319837 - RNA, 22 nt, Human
cuggcuuuucacugcuggcugc

SEQ ID NO: 1319838 - RNA, 19 nt, Human
cugggaacaccauagguca

SEQ ID NO: 1319839 - RNA, 14 nt, Human
cugggaaaugagau

SEQ ID NO: 1319840 - RNA, 16 nt, Human
cugggaaauauucccu

SEQ ID NO: 1319841 - RNA, 18 nt, Human
cugggaaauauucccuag

SEQ ID NO: 1319842 - RNA, 17 nt, Human
cuggguaggaaagagga

SEQ ID NO: 1319843 - RNA, 15 nt, Human
cuggguaggaaagag

SEQ ID NO: 1319844 - RNA, 14 nt, Human
cuggguaggaaaga

SEQ ID NO: 1319845 - RNA, 17 nt, Human
cuggguagcgggggagg

SEQ ID NO: 1319846 - RNA, 16 nt, Human
cugggguggccaccag

SEQ ID NO: 1319847 - RNA, 16 nt, Human
cuggggugggcaguuu

SEQ ID NO: 1319848 - RNA, 18 nt, Human
cuggggugggcaguuuuu

SEQ ID NO: 1319849 - RNA, 19 nt, Human
cugggccccugccucucug

SEQ ID NO: 1319850 - RNA, 16 nt, Human
cugggccuuggccugg

SEQ ID NO: 1319851 - RNA, 17 nt, Human
cugggccuuggccugga

SEQ ID NO: 1319852 - RNA, 18 nt, Human
cugggccuuggccuggag

SEQ ID NO: 1319853 - RNA, 19 nt, Human
cugggccuuggccuggagc

SEQ ID NO: 1319854 - RNA, 20 nt, Human
cugggccuuggccuggagca

SEQ ID NO: 1319855 - RNA, 14 nt, Human
cugggccuugggcu

SEQ ID NO: 1319856 - RNA, 15 nt, Human
cugggccuugggcuc

SEQ ID NO: 1319857 - RNA, 17 nt, Human
cugggccuugggcuccg

SEQ ID NO: 1319858 - RNA, 14 nt, Human
cugggcgcuggucc

SEQ ID NO: 1319859 - RNA, 12 nt, Human
cugggcucagug

SEQ ID NO: 1319860 - RNA, 19 nt, Human
cuggguaggaaagaggaag

SEQ ID NO: 1319861 - RNA, 15 nt, Human
cugggguggccacca

SEQ ID NO: 1319862 - RNA, 15 nt, Human
cuggguugcagacag

SEQ ID NO: 1319863 - RNA, 17 nt, Human
cuggguugccuuuauuu

SEQ ID NO: 1319864 - RNA, 13 nt, Human
cuggguuggaaaa

SEQ ID NO: 1319865 - RNA, 18 nt, Human
cuggguuggaaaacagua

SEQ ID NO: 1319866 - RNA, 13 nt, Human
cugguccagggcu

SEQ ID NO: 1319867 - RNA, 14 nt, Human
cugguccagggcua

SEQ ID NO: 1319868 - RNA, 18 nt, Human
cuggguugcagacaggaa

SEQ ID NO: 1319869 - RNA, 14 nt, Human
cugguccccuccuu

SEQ ID NO: 1319870 - RNA, 17 nt, Human
cugguccccuccuuccc

SEQ ID NO: 1319871 - RNA, 19 nt, Human
cuggucccggggccagcac

SEQ ID NO: 1319872 - RNA, 9 nt, Human
cuggucccu

SEQ ID NO: 1319873 - RNA, 20 nt, Human
cuggucccggggccagcacu

SEQ ID NO: 1319874 - RNA, 16 nt, Human
cugguccuuucuuccg

SEQ ID NO: 1319875 - RNA, 15 nt, Human
cugguccuuuuuggu

SEQ ID NO: 1319876 - RNA, 22 nt, Human
cugguccuuuuuggucgaggag

SEQ ID NO: 1319877 - RNA, 13 nt, Human
cuggucgcuccug

SEQ ID NO: 1319878 - RNA, 14 nt, Human
cuggucgcuccugc

SEQ ID NO: 1319879 - RNA, 15 nt, Human
cuggucgcuccugcc

SEQ ID NO: 1319880 - RNA, 16 nt, Human
cuggucgcuccugccc

SEQ ID NO: 1319881 - RNA, 18 nt, Human
cuggucgcuccugcccac

SEQ ID NO: 1319882 - RNA, 23 nt, Human
cuggucgcuccugcccacggagu

SEQ ID NO: 1319883 - RNA, 19 nt, Human
cuggucucaaacuccugac

SEQ ID NO: 1319884 - RNA, 14 nt, Human
cuggugcuggaggu

SEQ ID NO: 1319885 - RNA, 17 nt, Human
cuggugcuuaugcucuu

SEQ ID NO: 1319886 - RNA, 19 nt, Human
cuggugcuuaugcucuuaa

SEQ ID NO: 1319887 - RNA, 21 nt, Human
cuggugcuucuccucuccuag

SEQ ID NO: 1319888 - RNA, 20 nt, Human
cugguggcccgacagccugg

SEQ ID NO: 1319889 - RNA, 21 nt, Human
cugguggccccguuucuggug

SEQ ID NO: 1319890 - RNA, 22 nt, Human
cugguggccccguuucuggugg

SEQ ID NO: 1319891 - RNA, 20 nt, Human
cugguggccccguuucuggu

SEQ ID NO: 1319892 - RNA, 13 nt, Human
cuggugggccaac

SEQ ID NO: 1319893 - RNA, 21 nt, Human
cugguggggauaggccagccg

SEQ ID NO: 1319894 - RNA, 22 nt, Human
cugguggggauaggccagccgc

SEQ ID NO: 1319895 - RNA, 14 nt, Human
cugguggggcagcu

SEQ ID NO: 1319896 - RNA, 15 nt, Human
cugguggggcagcuc

SEQ ID NO: 1319897 - RNA, 16 nt, Human
cugguggggcagcucc

SEQ ID NO: 1319898 - RNA, 20 nt, Human
cugguggggcagcuccucug

SEQ ID NO: 1319899 - RNA, 17 nt, Human
cugguggggcagcuccu

SEQ ID NO: 1319900 - RNA, 18 nt, Human
cuggugggugccuaggcc

SEQ ID NO: 1319901 - RNA, 21 nt, Human
cuggugggugccuaggccugg

SEQ ID NO: 1319902 - RNA, 16 nt, Human
cuggugguauuuucaa

SEQ ID NO: 1319903 - RNA, 18 nt, Human
cugguggucuguuggcag

SEQ ID NO: 1319904 - RNA, 20 nt, Human
cugguggucuguuggcaggc

SEQ ID NO: 1319905 - RNA, 22 nt, Human
cugguggucuguuggcaggcug

SEQ ID NO: 1319906 - RNA, 23 nt, Human
cugguggucuguuggcaggcugg

SEQ ID NO: 1319907 - RNA, 15 nt, Human
cuggugguauuuuca

SEQ ID NO: 1319908 - RNA, 16 nt, Human
cugguucucaauucca

SEQ ID NO: 1319909 - RNA, 20 nt, Human
cugguucucaauuccaacag

SEQ ID NO: 1319910 - RNA, 11 nt, Human
cugcccugccc

SEQ ID NO: 1319911 - RNA, 21 nt, Human
cugcccugccaccugucuguc

SEQ ID NO: 1319912 - RNA, 20 nt, Human
cugcccugccaccugucugu

SEQ ID NO: 1319913 - RNA, 18 nt, Human
cugcccugccaccugucu

SEQ ID NO: 1319914 - RNA, 17 nt, Human
cugcccugccaccuguc

SEQ ID NO: 1319915 - RNA, 16 nt, Human
cugcccugccaccugu

SEQ ID NO: 1319916 - RNA, 15 nt, Human
cugcccugccaccug

SEQ ID NO: 1319917 - RNA, 14 nt, Human
cugcccugccaccu

SEQ ID NO: 1319918 - RNA, 13 nt, Human
cugcccugccacc

SEQ ID NO: 1319919 - RNA, 11 nt, Human
cugcccugcca

SEQ ID NO: 1319920 - RNA, 20 nt, Human
cugcccucugcauccucugg

SEQ ID NO: 1319921 - RNA, 17 nt, Human
cugcccucugcauccuc

SEQ ID NO: 1319922 - RNA, 13 nt, Human
cugcccugcccac

SEQ ID NO: 1319923 - RNA, 21 nt, Human
cugcccagugcacuugcugga

SEQ ID NO: 1319924 - RNA, 18 nt, Human
cugcccgggagcucagga

SEQ ID NO: 1319925 - RNA, 12 nt, Human
cugcccuccugu

SEQ ID NO: 1319926 - RNA, 16 nt, Human
cugcccuccugugcuc

SEQ ID NO: 1319927 - RNA, 19 nt, Human
cugcccuccugugcucagc

SEQ ID NO: 1319928 - RNA, 20 nt, Human
cugcccuccugugcucagcc

SEQ ID NO: 1319929 - RNA, 21 nt, Human
cugcccuccugugcucagccc

SEQ ID NO: 1319930 - RNA, 22 nt, Human
cugcccuccugugcucagcccu

SEQ ID NO: 1319931 - RNA, 23 nt, Human
cugcccuccugugcucagcccug

SEQ ID NO: 1319932 - RNA, 14 nt, Human
cugcccaggcacug

SEQ ID NO: 1319933 - RNA, 19 nt, Human
cugcccaaccugcucuccu

SEQ ID NO: 1319934 - RNA, 17 nt, Human
cugcccaaccugcucuc

SEQ ID NO: 1319935 - RNA, 17 nt, Human
cugcccaacccuucccu

SEQ ID NO: 1319936 - RNA, 20 nt, Human
cugcccaacccuucccucac

SEQ ID NO: 1319937 - RNA, 13 nt, Human
cugcccaaagcag

SEQ ID NO: 1319938 - RNA, 23 nt, Human
cugcccaaagcagcacuuauaaa

SEQ ID NO: 1319939 - RNA, 18 nt, Human
cugcccaggccugccugu

SEQ ID NO: 1319940 - RNA, 15 nt, Human
cugcccaggcacugc

SEQ ID NO: 1319941 - RNA, 16 nt, Human
cugcccaggcacugca

SEQ ID NO: 1319942 - RNA, 20 nt, Human
cugcccaggcacugcuaggc

SEQ ID NO: 1319943 - RNA, 19 nt, Human
cugcccaggccugccuguu

SEQ ID NO: 1319944 - RNA, 16 nt, Human
cugcccagugcacuug

SEQ ID NO: 1319945 - RNA, 19 nt, Human
cugcccagugcacuugcug

SEQ ID NO: 1319946 - RNA, 20 nt, Human
cugccagcauuucccuuccu

SEQ ID NO: 1319947 - RNA, 13 nt, Human
cugccacacuuca

SEQ ID NO: 1319948 - RNA, 17 nt, Human
cugccacacuucaggcu

SEQ ID NO: 1319949 - RNA, 22 nt, Human
cugccacacuucaggcucuucu

SEQ ID NO: 1319950 - RNA, 19 nt, Human
cugccaccacgcccggcua

SEQ ID NO: 1319951 - RNA, 21 nt, Human
cugccacagccuccccugcca

SEQ ID NO: 1319952 - RNA, 22 nt, Human
cugccacagccuccccugccag

SEQ ID NO: 1319953 - RNA, 23 nt, Human
cugccacagccuccccugccagg

SEQ ID NO: 1319954 - RNA, 13 nt, Human
cugccaccaggcc

SEQ ID NO: 1319955 - RNA, 14 nt, Human
cugccaccaggcca

SEQ ID NO: 1319956 - RNA, 15 nt, Human
cugccaccaggccac

SEQ ID NO: 1319957 - RNA, 17 nt, Human
cugccaccaggccaccu

SEQ ID NO: 1319958 - RNA, 18 nt, Human
cugccaccaggccaccuc

SEQ ID NO: 1319959 - RNA, 23 nt, Human
cugccaccaggccaccuccccag

SEQ ID NO: 1319960 - RNA, 12 nt, Human
cugccagccccu

SEQ ID NO: 1319961 - RNA, 14 nt, Human
cugccagccccugc

SEQ ID NO: 1319962 - RNA, 16 nt, Human
cugccagccccugcca

SEQ ID NO: 1319963 - RNA, 16 nt, Human
cugccaggagacaggu

SEQ ID NO: 1319964 - RNA, 17 nt, Human
cugccagcucuguauca

SEQ ID NO: 1319965 - RNA, 20 nt, Human
cugccaggagcacggcucug

SEQ ID NO: 1319966 - RNA, 15 nt, Human
cugccaggagcuuug

SEQ ID NO: 1319967 - RNA, 11 nt, Human
cugccaggagg

SEQ ID NO: 1319968 - RNA, 16 nt, Human
cugccaggaggaccca

SEQ ID NO: 1319969 - RNA, 18 nt, Human
cugccaggaggacccagg

SEQ ID NO: 1319970 - RNA, 19 nt, Human
cugccaggaggacccaggg

SEQ ID NO: 1319971 - RNA, 21 nt, Human
cugccaggaggacccagggcu

SEQ ID NO: 1319972 - RNA, 22 nt, Human
cugccaggaggacccagggcuc

SEQ ID NO: 1319973 - RNA, 23 nt, Human
cugccaggaggacccagggcucu

SEQ ID NO: 1319974 - RNA, 13 nt, Human
cugccaggaggga

SEQ ID NO: 1319975 - RNA, 18 nt, Human
cugccaggagggacaaag

SEQ ID NO: 1319976 - RNA, 20 nt, Human
cugccaggagggacaaagga

SEQ ID NO: 1319977 - RNA, 21 nt, Human
cugccaggagggacaaaggag

SEQ ID NO: 1319978 - RNA, 22 nt, Human
cugccaggagggacaaaggagc

SEQ ID NO: 1319979 - RNA, 23 nt, Human
cugccaggagggacaaaggagcc

SEQ ID NO: 1319980 - RNA, 14 nt, Human
cugccucucugcag

SEQ ID NO: 1319981 - RNA, 21 nt, Human
cugccucucgcuccucaaccc

SEQ ID NO: 1319982 - RNA, 14 nt, Human
cugccucucuagga

SEQ ID NO: 1319983 - RNA, 13 nt, Human
cugccucucugca

SEQ ID NO: 1319984 - RNA, 12 nt, Human
cugccucucugc

SEQ ID NO: 1319985 - RNA, 19 nt, Human
cugccucuucccucuuccu

SEQ ID NO: 1319986 - RNA, 18 nt, Human
cugccucuucccucuucc

SEQ ID NO: 1319987 - RNA, 12 nt, Human
cugccucuuccu

SEQ ID NO: 1319988 - RNA, 19 nt, Human
cugccucuuaaauaaaccu

SEQ ID NO: 1319989 - RNA, 20 nt, Human
cugccugacauuuggagugu

SEQ ID NO: 1319990 - RNA, 23 nt, Human
cugccugacauuuggaguguucc

SEQ ID NO: 1319991 - RNA, 19 nt, Human
cugccugagucgugaccug

SEQ ID NO: 1319992 - RNA, 21 nt, Human
cugccugagucgugaccugcu

SEQ ID NO: 1319993 - RNA, 20 nt, Human
cugccugagucgugaccugc

SEQ ID NO: 1319994 - RNA, 15 nt, Human
cugccuaagugcagc

SEQ ID NO: 1319995 - RNA, 11 nt, Human
cugcccuggga

SEQ ID NO: 1319996 - RNA, 12 nt, Human
cugcccugggag

SEQ ID NO: 1319997 - RNA, 13 nt, Human
cugcccugggagg

SEQ ID NO: 1319998 - RNA, 15 nt, Human
cugcccugggaggca

SEQ ID NO: 1319999 - RNA, 22 nt, Human
cugcccugggaggcagugaugg

SEQ ID NO: 1320000 - RNA, 12 nt, Human
cugccucaggac

SEQ ID NO: 1320001 - RNA, 13 nt, Human
cugccucaggacu

SEQ ID NO: 1320002 - RNA, 14 nt, Human
cugccucaggacug

SEQ ID NO: 1320003 - RNA, 22 nt, Human
cugccucaggaggcaggaccuu

SEQ ID NO: 1320004 - RNA, 23 nt, Human
cugccucaggaggcaggaccuuc

SEQ ID NO: 1320005 - RNA, 17 nt, Human
cugccuuaucuugcacc

SEQ ID NO: 1320006 - RNA, 18 nt, Human
cugccuuauucagggaag

SEQ ID NO: 1320007 - RNA, 19 nt, Human
cugccuuauucagggaagg

SEQ ID NO: 1320008 - RNA, 20 nt, Human
cugccuuauucagggaagga

SEQ ID NO: 1320009 - RNA, 21 nt, Human
cugccuuauucagggaaggag

SEQ ID NO: 1320010 - RNA, 15 nt, Human
cugccuucaccuuca

SEQ ID NO: 1320011 - RNA, 16 nt, Human
cugccuuagucucagu

SEQ ID NO: 1320012 - RNA, 20 nt, Human
cugccuuagucucaguuugu

SEQ ID NO: 1320013 - RNA, 23 nt, Human
cugccuuagucucaguuugugug

SEQ ID NO: 1320014 - RNA, 15 nt, Human
cugccuuaucuugca

SEQ ID NO: 1320015 - RNA, 13 nt, Human
cugcggguggggc

SEQ ID NO: 1320016 - RNA, 21 nt, Human
cugcggguggggcuuggggcu

SEQ ID NO: 1320017 - RNA, 22 nt, Human
cugcgguagaugggagggaggc

SEQ ID NO: 1320018 - RNA, 19 nt, Human
cugcgugucaccugugcuu

SEQ ID NO: 1320019 - RNA, 22 nt, Human
cugcgugggugugugcguguuu

SEQ ID NO: 1320020 - RNA, 12 nt, Human
cugcuaaauaaa

SEQ ID NO: 1320021 - RNA, 15 nt, Human
cugcuaaauaaaauu

SEQ ID NO: 1320022 - RNA, 23 nt, Human
cugcuaaauaaaauuuguugcau

SEQ ID NO: 1320023 - RNA, 16 nt, Human
cugcuaaggucuugga

SEQ ID NO: 1320024 - RNA, 13 nt, Human
cugcuccagaccu

SEQ ID NO: 1320025 - RNA, 14 nt, Human
cugcuccagaccug

SEQ ID NO: 1320026 - RNA, 15 nt, Human
cugcuccagaccuga

SEQ ID NO: 1320027 - RNA, 19 nt, Human
cugcuaacggugcucaggg

SEQ ID NO: 1320028 - RNA, 18 nt, Human
cugcuaacggugcucagg

SEQ ID NO: 1320029 - RNA, 21 nt, Human
cugcuccagaccugauccugg

SEQ ID NO: 1320030 - RNA, 22 nt, Human
cugcuccagaccugauccugga

SEQ ID NO: 1320031 - RNA, 14 nt, Human
cugcuccagacagg

SEQ ID NO: 1320032 - RNA, 19 nt, Human
cugcuccccuaaagccuca

SEQ ID NO: 1320033 - RNA, 12 nt, Human
cugcucccucag

SEQ ID NO: 1320034 - RNA, 13 nt, Human
cugcucccucaga

SEQ ID NO: 1320035 - RNA, 14 nt, Human
cugcucccucagac

SEQ ID NO: 1320036 - RNA, 14 nt, Human
cugcuccuucccca

SEQ ID NO: 1320037 - RNA, 15 nt, Human
cugcuccuuccccau

SEQ ID NO: 1320038 - RNA, 23 nt, Human
cugcuccuuccccaucguugccc

SEQ ID NO: 1320039 - RNA, 14 nt, Human
cugcucgcucccug

SEQ ID NO: 1320040 - RNA, 17 nt, Human
cugcucggggugcacag

SEQ ID NO: 1320041 - RNA, 13 nt, Human
cugcucggggugc

SEQ ID NO: 1320042 - RNA, 16 nt, Human
cugcucugaacacgaa

SEQ ID NO: 1320043 - RNA, 19 nt, Human
cugcucugaacacgaagcu

SEQ ID NO: 1320044 - RNA, 12 nt, Human
cugcucugagaa

SEQ ID NO: 1320045 - RNA, 13 nt, Human
cugcucugagaau

SEQ ID NO: 1320046 - RNA, 15 nt, Human
cugaucccagagagc

SEQ ID NO: 1320047 - RNA, 22 nt, Human
cugaucagugggccuccaagga

SEQ ID NO: 1320048 - RNA, 20 nt, Human
cugauacuuugacaguguuu

SEQ ID NO: 1320049 - RNA, 18 nt, Human
cugauaaaagauggccau

SEQ ID NO: 1320050 - RNA, 19 nt, Human
cugauaggguuugugacag

SEQ ID NO: 1320051 - RNA, 20 nt, Human
cugauaggguuugugacagg

SEQ ID NO: 1320052 - RNA, 23 nt, Human
cugauaggguuugugacagggcg

SEQ ID NO: 1320053 - RNA, 13 nt, Human
cugaucucguuuu

SEQ ID NO: 1320054 - RNA, 15 nt, Human
cugauguacucuaaa

SEQ ID NO: 1320055 - RNA, 16 nt, Human
cugauguacucuaaau

SEQ ID NO: 1320056 - RNA, 18 nt, Human
cugaugucaauuucugug

SEQ ID NO: 1320057 - RNA, 19 nt, Human
cugaugucaauuucugugu

SEQ ID NO: 1320058 - RNA, 20 nt, Human
cugaugucaauuucuguguu

SEQ ID NO: 1320059 - RNA, 22 nt, Human
cugaugucaauuucuguguugc

SEQ ID NO: 1320060 - RNA, 13 nt, Human
cugaugucuccua

SEQ ID NO: 1320061 - RNA, 15 nt, Human
cugaugucuccuaag

SEQ ID NO: 1320062 - RNA, 18 nt, Human
cugaugucuccuaagcac

SEQ ID NO: 1320063 - RNA, 21 nt, Human
cugaugucuccuaagcaccug

SEQ ID NO: 1320064 - RNA, 18 nt, Human
cugaucccagagagcccg

SEQ ID NO: 1320065 - RNA, 20 nt, Human
cugaucccagagagcccgag

SEQ ID NO: 1320066 - RNA, 12 nt, Human
cugaucccucua

SEQ ID NO: 1320067 - RNA, 13 nt, Human
cugaucccucuac

SEQ ID NO: 1320068 - RNA, 21 nt, Human
cugauccuggaggcccaguuc

SEQ ID NO: 1320069 - RNA, 21 nt, Human
cugaucccagagagcccgagg

SEQ ID NO: 1320070 - RNA, 13 nt, Human
cugaucgccuucc

SEQ ID NO: 1320071 - RNA, 15 nt, Human
cugaucgccuucccc

SEQ ID NO: 1320072 - RNA, 16 nt, Human
cugaucgccuucccca

SEQ ID NO: 1320073 - RNA, 17 nt, Human
cugauucaauuugaugu

SEQ ID NO: 1320074 - RNA, 17 nt, Human
cugauucacaucucauu

SEQ ID NO: 1320075 - RNA, 21 nt, Human
cugauucacaucucauuuuuc

SEQ ID NO: 1320076 - RNA, 16 nt, Human
cugauucaauuugaug

SEQ ID NO: 1320077 - RNA, 17 nt, Human
cugauucgaaugacacu

SEQ ID NO: 1320078 - RNA, 19 nt, Human
cugauucgaaugacacugu

SEQ ID NO: 1320079 - RNA, 12 nt, Human
cugauguugugu

SEQ ID NO: 1320080 - RNA, 21 nt, Human
cugauuaaaaugcuuccuccc

SEQ ID NO: 1320081 - RNA, 16 nt, Human
cugauuaaaugacacu

SEQ ID NO: 1320082 - RNA, 15 nt, Human
cugauuaaaugacac

SEQ ID NO: 1320083 - RNA, 13 nt, Human
cugagucccaucc

SEQ ID NO: 1320084 - RNA, 17 nt, Human
cugagucguacagaaag

SEQ ID NO: 1320085 - RNA, 18 nt, Human
cugagucguacagaaagc

SEQ ID NO: 1320086 - RNA, 19 nt, Human
cugagucguacagaaagcu

SEQ ID NO: 1320087 - RNA, 20 nt, Human
cugagucguacagaaagcug

SEQ ID NO: 1320088 - RNA, 21 nt, Human
cugagucguacagaaagcugc

SEQ ID NO: 1320089 - RNA, 23 nt, Human
cugagucguacagaaagcugccu

SEQ ID NO: 1320090 - RNA, 17 nt, Human
cugagucgugaccugcu

SEQ ID NO: 1320091 - RNA, 20 nt, Human
cugagucgugaccugcuagg

SEQ ID NO: 1320092 - RNA, 21 nt, Human
cugagucgugaccugcuaggc

SEQ ID NO: 1320093 - RNA, 16 nt, Human
cugagggcagucgaua

SEQ ID NO: 1320094 - RNA, 12 nt, Human
cugagggcaguu

SEQ ID NO: 1320095 - RNA, 19 nt, Human
cugagggcaguucgcagcc

SEQ ID NO: 1320096 - RNA, 21 nt, Human
cugagggcaguucgcagccac

SEQ ID NO: 1320097 - RNA, 22 nt, Human
cugagggcaguucgcagccacc

SEQ ID NO: 1320098 - RNA, 20 nt, Human
cugaccaugcucaucugcug

SEQ ID NO: 1320099 - RNA, 21 nt, Human
cugaccaugcucaucugcugg

SEQ ID NO: 1320100 - RNA, 22 nt, Human
cugaccaugcucaucugcuggu

SEQ ID NO: 1320101 - RNA, 10 nt, Human
cugacccagu

SEQ ID NO: 1320102 - RNA, 12 nt, Human
cugacccagugc

SEQ ID NO: 1320103 - RNA, 13 nt, Human
cugacccagugcc

SEQ ID NO: 1320104 - RNA, 18 nt, Human
cugacccagugcccccac

SEQ ID NO: 1320105 - RNA, 23 nt, Human
cugacccagugcccccacugacc

SEQ ID NO: 1320106 - RNA, 20 nt, Human
cugacccagugcccccacug

SEQ ID NO: 1320107 - RNA, 21 nt, Human
cugacccagugcccccacuga

SEQ ID NO: 1320108 - RNA, 15 nt, Human
cugaggcuuuggauu

SEQ ID NO: 1320109 - RNA, 17 nt, Human
cugaggcuuuggauuug

SEQ ID NO: 1320110 - RNA, 18 nt, Human
cugaggcuuuggauuuga

SEQ ID NO: 1320111 - RNA, 21 nt, Human
cugaggcuuuggauuugacau

SEQ ID NO: 1320112 - RNA, 17 nt, Human
cugagggaaaggccagc

SEQ ID NO: 1320113 - RNA, 18 nt, Human
cugagggaaaggccagca

SEQ ID NO: 1320114 - RNA, 20 nt, Human
cugagggaaaggccagcacu

SEQ ID NO: 1320115 - RNA, 21 nt, Human
cugagggaaaggccagcacuc

SEQ ID NO: 1320116 - RNA, 11 nt, Human
cugagugacuc

SEQ ID NO: 1320117 - RNA, 21 nt, Human
cugagugacucuauauagcug

SEQ ID NO: 1320118 - RNA, 14 nt, Human
cugagugccuuuug

SEQ ID NO: 1320119 - RNA, 21 nt, Human
cugagugggaagcccauccug

SEQ ID NO: 1320120 - RNA, 18 nt, Human
cugaguuuuccauggcag

SEQ ID NO: 1320121 - RNA, 19 nt, Human
cugaguuuuccauggcagg

SEQ ID NO: 1320122 - RNA, 20 nt, Human
cugaguuuuccauggcagga

SEQ ID NO: 1320123 - RNA, 22 nt, Human
cugaguuuuccauggcaggaag

SEQ ID NO: 1320124 - RNA, 13 nt, Human
cugaguuuugugu

SEQ ID NO: 1320125 - RNA, 14 nt, Human
cugaguuuuguguu

SEQ ID NO: 1320126 - RNA, 17 nt, Human
cugaguuuuguguuugu

SEQ ID NO: 1320127 - RNA, 19 nt, Human
cugaguuuuguguuuguug

SEQ ID NO: 1320128 - RNA, 20 nt, Human
cugaguuuuguguuuguugu

SEQ ID NO: 1320129 - RNA, 21 nt, Human
cugaguuuuguguuuguugua

SEQ ID NO: 1320130 - RNA, 19 nt, Human
cugauaaaaccauguagaa

SEQ ID NO: 1320131 - RNA, 23 nt, Human
cugauaaaaccauguagaaaauu

SEQ ID NO: 1320132 - RNA, 15 nt, Human
cugagugccuuuugg

SEQ ID NO: 1320133 - RNA, 16 nt, Human
cugagugccuuuuggu

SEQ ID NO: 1320134 - RNA, 17 nt, Human
cugagugcuugcuuuuc

SEQ ID NO: 1320135 - RNA, 13 nt, Human
cugaguggcaggg

SEQ ID NO: 1320136 - RNA, 16 nt, Human
cugaguggcaggggac

SEQ ID NO: 1320137 - RNA, 18 nt, Human
cugaguggcaggggacag

SEQ ID NO: 1320138 - RNA, 13 nt, Human
cugagugggaagc

SEQ ID NO: 1320139 - RNA, 15 nt, Human
cugagugggaagccc

SEQ ID NO: 1320140 - RNA, 17 nt, Human
cugagugggaagcccau

SEQ ID NO: 1320141 - RNA, 23 nt, Human
cugauugaccguguuggucugua

SEQ ID NO: 1320142 - RNA, 18 nt, Human
cugcaaaaggacucucag

SEQ ID NO: 1320143 - RNA, 22 nt, Human
cugcaaacaccaacauguuggg

SEQ ID NO: 1320144 - RNA, 18 nt, Human
cugcaaaccugaccccug

SEQ ID NO: 1320145 - RNA, 20 nt, Human
cugcaaaccugaccccugcu

SEQ ID NO: 1320146 - RNA, 13 nt, Human
cugcacaaagccc

SEQ ID NO: 1320147 - RNA, 22 nt, Human
cugcaauuggcaccgaagccca

SEQ ID NO: 1320148 - RNA, 18 nt, Human
cugcacaaagcccuucca

SEQ ID NO: 1320149 - RNA, 20 nt, Human
cugcacaaagcccuuccaug

SEQ ID NO: 1320150 - RNA, 21 nt, Human
cugcacaaagcccuuccaugu

SEQ ID NO: 1320151 - RNA, 14 nt, Human
cugcaauucaaaag

SEQ ID NO: 1320152 - RNA, 18 nt, Human
cugcaauucaaaaguucc

SEQ ID NO: 1320153 - RNA, 21 nt, Human
cugcaauucaaaaguuccaag

SEQ ID NO: 1320154 - RNA, 22 nt, Human
cugcaauucaaaaguuccaaga

SEQ ID NO: 1320155 - RNA, 15 nt, Human
cugcaauuccccucu

SEQ ID NO: 1320156 - RNA, 16 nt, Human
cugcaauuccccucug

SEQ ID NO: 1320157 - RNA, 17 nt, Human
cugcaauuccccucugc

SEQ ID NO: 1320158 - RNA, 20 nt, Human
cugcaauuccccucugcugc

SEQ ID NO: 1320159 - RNA, 24 nt, Human
cugcaauucaaaaguuccaagagu

SEQ ID NO: 1320160 - RNA, 18 nt, Human
cugcacagugcaucucag

SEQ ID NO: 1320161 - RNA, 18 nt, Human
cugcacagugacuucuga

SEQ ID NO: 1320162 - RNA, 19 nt, Human
cugcacagugacuucugag

SEQ ID NO: 1320163 - RNA, 20 nt, Human
cugcacagugacuucugaga

SEQ ID NO: 1320164 - RNA, 21 nt, Human
cugcacagugacuucugagau

SEQ ID NO: 1320165 - RNA, 14 nt, Human
cugcacagugacuu

SEQ ID NO: 1320166 - RNA, 16 nt, Human
cugcacagugacuucu

SEQ ID NO: 1320167 - RNA, 21 nt, Human
cugcacagugcaucucagccc

SEQ ID NO: 1320168 - RNA, 22 nt, Human
cugcacagugcaucucagccca

SEQ ID NO: 1320169 - RNA, 22 nt, Human
cugcacagugacuucugagauc

SEQ ID NO: 1320170 - RNA, 17 nt, Human
cugcaccaguugcugcu

SEQ ID NO: 1320171 - RNA, 19 nt, Human
cugcaccaugcugcugggg

SEQ ID NO: 1320172 - RNA, 20 nt, Human
cugcaccaugcugcugggga

SEQ ID NO: 1320173 - RNA, 23 nt, Human
cugcaccaugcugcuggggaaga

SEQ ID NO: 1320174 - RNA, 21 nt, Human
cugcaccaugcugcuggggaa

SEQ ID NO: 1320175 - RNA, 16 nt, Human
cugcagggccaagcac

SEQ ID NO: 1320176 - RNA, 23 nt, Human
cugcagggaaaauuauuugcaua

SEQ ID NO: 1320177 - RNA, 15 nt, Human
cugcagggacugcca

SEQ ID NO: 1320178 - RNA, 17 nt, Human
cugcagggacugccagu

SEQ ID NO: 1320179 - RNA, 12 nt, Human
cugcagggaaaa

SEQ ID NO: 1320180 - RNA, 22 nt, Human
cugcagggaaaauuauuugcau

SEQ ID NO: 1320181 - RNA, 14 nt, Human
cugcaggcugagug

SEQ ID NO: 1320182 - RNA, 21 nt, Human
cugcaggcccuggccuccccu

SEQ ID NO: 1320183 - RNA, 16 nt, Human
cugcaggcugagugca

SEQ ID NO: 1320184 - RNA, 15 nt, Human
cugcaggcugagugc

SEQ ID NO: 1320185 - RNA, 21 nt, Human
cugcagccccacccagaugcc

SEQ ID NO: 1320186 - RNA, 16 nt, Human
cugcacuuacuugcuu

SEQ ID NO: 1320187 - RNA, 20 nt, Human
cugcagagcaggaaacauga

SEQ ID NO: 1320188 - RNA, 23 nt, Human
cugcagaagacaguauggcagcu

SEQ ID NO: 1320189 - RNA, 13 nt, Human
cugcagaagacag

SEQ ID NO: 1320190 - RNA, 16 nt, Human
cugcagaaccggagag

SEQ ID NO: 1320191 - RNA, 19 nt, Human
cugcagaaccggagagcca

SEQ ID NO: 1320192 - RNA, 21 nt, Human
cugcagaaccggagagccagc

SEQ ID NO: 1320193 - RNA, 22 nt, Human
cugcagaaccggagagccagcu

SEQ ID NO: 1320194 - RNA, 18 nt, Human
cugaagugagcacagccu

SEQ ID NO: 1320195 - RNA, 19 nt, Human
cugaagugagcacagccua

SEQ ID NO: 1320196 - RNA, 21 nt, Human
cugaagugagcacagccuagg

SEQ ID NO: 1320197 - RNA, 16 nt, Human
cugaagugcuuagugu

SEQ ID NO: 1320198 - RNA, 22 nt, Human
cugaauaaauuguacagccggc

SEQ ID NO: 1320199 - RNA, 21 nt, Human
cugaauaaauuguacagccgg

SEQ ID NO: 1320200 - RNA, 15 nt, Human
cugaauaccacucug

SEQ ID NO: 1320201 - RNA, 17 nt, Human
cugaauaccacucugua

SEQ ID NO: 1320202 - RNA, 18 nt, Human
cugaauaccacucuguaa

SEQ ID NO: 1320203 - RNA, 19 nt, Human
cugaauaccacucuguaau

SEQ ID NO: 1320204 - RNA, 20 nt, Human
cugaauaccacucuguaauu

SEQ ID NO: 1320205 - RNA, 21 nt, Human
cugaauaccacucuguaauug

SEQ ID NO: 1320206 - RNA, 23 nt, Human
cugaauaccacucuguaauugca

SEQ ID NO: 1320207 - RNA, 22 nt, Human
cugaagucacugcacagugcau

SEQ ID NO: 1320208 - RNA, 17 nt, Human
cugaagucacugcacag

SEQ ID NO: 1320209 - RNA, 16 nt, Human
cugaagucacugcaca

SEQ ID NO: 1320210 - RNA, 21 nt, Human
cugaaguaaaacaaacaauac

SEQ ID NO: 1320211 - RNA, 17 nt, Human
cugaagguuguggccuu

SEQ ID NO: 1320212 - RNA, 22 nt, Human
cugaaggugaaacauuuucucc

SEQ ID NO: 1320213 - RNA, 16 nt, Human
cugaagguuguggccu

SEQ ID NO: 1320214 - RNA, 21 nt, Human
cucuuuggcgaccuccuuuca

SEQ ID NO: 1320215 - RNA, 18 nt, Human
cucuuuggcuccccugua

SEQ ID NO: 1320216 - RNA, 23 nt, Human
cugaaccuauuucuuaaacacuu

SEQ ID NO: 1320217 - RNA, 17 nt, Human
cugaacuugcauuguga

SEQ ID NO: 1320218 - RNA, 18 nt, Human
cugaacuugcauugugau

SEQ ID NO: 1320219 - RNA, 14 nt, Human
cugaauuuaaauag

SEQ ID NO: 1320220 - RNA, 18 nt, Human
cugaauuuaaauagcuuu

SEQ ID NO: 1320221 - RNA, 13 nt, Human
cugaauuucccuc

SEQ ID NO: 1320222 - RNA, 23 nt, Human
cugaauuuaaauagcuuuuuucu

SEQ ID NO: 1320223 - RNA, 17 nt, Human
cugacagacagcccucc

SEQ ID NO: 1320224 - RNA, 19 nt, Human
cugacagacagcccuccau

SEQ ID NO: 1320225 - RNA, 13 nt, Human
cugacagaggggg

SEQ ID NO: 1320226 - RNA, 15 nt, Human
cugaaucugcuacca

SEQ ID NO: 1320227 - RNA, 17 nt, Human
cugaaucugcuaccaaa

SEQ ID NO: 1320228 - RNA, 22 nt, Human
cugaaucugcuaccaaaacagu

SEQ ID NO: 1320229 - RNA, 17 nt, Human
cugaauacccuuuucug

SEQ ID NO: 1320230 - RNA, 22 nt, Human
cugaauaccacucuguaauugc

SEQ ID NO: 1320231 - RNA, 15 nt, Human
cugaauagauaugaa

SEQ ID NO: 1320232 - RNA, 15 nt, Human
cugaauagcagaagg

SEQ ID NO: 1320233 - RNA, 17 nt, Human
cugaauauacagcaggu

SEQ ID NO: 1320234 - RNA, 21 nt, Human
cugaauauugccauuaugcuu

SEQ ID NO: 1320235 - RNA, 19 nt, Human
cugaauccaaacuaaucca

SEQ ID NO: 1320236 - RNA, 20 nt, Human
cugaauccaaacuaauccau

SEQ ID NO: 1320237 - RNA, 16 nt, Human
cugacauuccuugcug

SEQ ID NO: 1320238 - RNA, 18 nt, Human
cugacauuccuugcugaa

SEQ ID NO: 1320239 - RNA, 12 nt, Human
cugaccacagca

SEQ ID NO: 1320240 - RNA, 14 nt, Human
cugaccacagcaca

SEQ ID NO: 1320241 - RNA, 15 nt, Human
cugaccacagcacag

SEQ ID NO: 1320242 - RNA, 18 nt, Human
cugaccacagcacagcca

SEQ ID NO: 1320243 - RNA, 22 nt, Human
cugaccaccuuuguuucucccc

SEQ ID NO: 1320244 - RNA, 13 nt, Human
cugaccacucaga

SEQ ID NO: 1320245 - RNA, 14 nt, Human
cugaccacucagag

SEQ ID NO: 1320246 - RNA, 15 nt, Human
cugaccacucagaga

SEQ ID NO: 1320247 - RNA, 16 nt, Human
cugaccacucagagac

SEQ ID NO: 1320248 - RNA, 15 nt, Human
cugaccaugcucauc

SEQ ID NO: 1320249 - RNA, 17 nt, Human
cugaccacucagagaca

SEQ ID NO: 1320250 - RNA, 22 nt, Human
cugaccacucagagacaugcag

SEQ ID NO: 1320251 - RNA, 23 nt, Human
cugaccacucagagacaugcaga

SEQ ID NO: 1320252 - RNA, 13 nt, Human
cugaccagaacua

SEQ ID NO: 1320253 - RNA, 12 nt, Human
cugaccagcagc

SEQ ID NO: 1320254 - RNA, 16 nt, Human
cugacauucaccugcc

SEQ ID NO: 1320255 - RNA, 17 nt, Human
cugacauucaccugccc

SEQ ID NO: 1320256 - RNA, 23 nt, Human
cugacauucaccugccccaacuc

SEQ ID NO: 1320257 - RNA, 15 nt, Human
cugacauucugauuc

SEQ ID NO: 1320258 - RNA, 13 nt, Human
cucuucagucucu

SEQ ID NO: 1320259 - RNA, 19 nt, Human
cucuuccagucuuccugac

SEQ ID NO: 1320260 - RNA, 19 nt, Human
cucuucuccacuggaugga

SEQ ID NO: 1320261 - RNA, 14 nt, Human
cucuucuccacugg

SEQ ID NO: 1320262 - RNA, 22 nt, Human
cucuuccagucuuccugacacu

SEQ ID NO: 1320263 - RNA, 23 nt, Human
cucuuccagucuuccugacacuu

SEQ ID NO: 1320264 - RNA, 15 nt, Human
cucuucuccacugga

SEQ ID NO: 1320265 - RNA, 17 nt, Human
cucuucuccacuggaug

SEQ ID NO: 1320266 - RNA, 13 nt, Human
cucuucuccuuuc

SEQ ID NO: 1320267 - RNA, 15 nt, Human
cucuucuccuuucac

SEQ ID NO: 1320268 - RNA, 16 nt, Human
cucuucuccuuucaca

SEQ ID NO: 1320269 - RNA, 13 nt, Human
cucuucucuccag

SEQ ID NO: 1320270 - RNA, 14 nt, Human
cucuucucuccagc

SEQ ID NO: 1320271 - RNA, 15 nt, Human
cucuucucuccagcu

SEQ ID NO: 1320272 - RNA, 19 nt, Human
cucuucucuccagcugacu

SEQ ID NO: 1320273 - RNA, 22 nt, Human
cucuucucuccagcugacuaaa

SEQ ID NO: 1320274 - RNA, 21 nt, Human
cucuucugggagggcagcagg

SEQ ID NO: 1320275 - RNA, 22 nt, Human
cucuucugggagggcagcaggg

SEQ ID NO: 1320276 - RNA, 15 nt, Human
cucuucugggccuga

SEQ ID NO: 1320277 - RNA, 19 nt, Human
cucuucuggggcaggcugg

SEQ ID NO: 1320278 - RNA, 21 nt, Human
cucuucuggggcaggcugggc

SEQ ID NO: 1320279 - RNA, 23 nt, Human
cucuucuggggcaggcugggcca

SEQ ID NO: 1320280 - RNA, 13 nt, Human
cucuuaagaagac

SEQ ID NO: 1320281 - RNA, 19 nt, Human
cucuucaguuaagccuuug

SEQ ID NO: 1320282 - RNA, 20 nt, Human
cucuucaguuaagccuuugg

SEQ ID NO: 1320283 - RNA, 23 nt, Human
cucuucaguuaagccuuuggaaa

SEQ ID NO: 1320284 - RNA, 22 nt, Human
cucuguuccuucccugugccuc

SEQ ID NO: 1320285 - RNA, 13 nt, Human
cucuguucuuccu

SEQ ID NO: 1320286 - RNA, 15 nt, Human
cucuguucuuccuca

SEQ ID NO: 1320287 - RNA, 18 nt, Human
cucuguucuuccucagcc

SEQ ID NO: 1320288 - RNA, 19 nt, Human
cucuguucuuccucagcca

SEQ ID NO: 1320289 - RNA, 20 nt, Human
cucuguucuuccucagccag

SEQ ID NO: 1320290 - RNA, 22 nt, Human
cucuguucuuccucagccagcc

SEQ ID NO: 1320291 - RNA, 20 nt, Human
cucuguugcaagugcaauaa

SEQ ID NO: 1320292 - RNA, 21 nt, Human
cucuguucuuccucagccagc

SEQ ID NO: 1320293 - RNA, 19 nt, Human
cucuggagcccacuguacu

SEQ ID NO: 1320294 - RNA, 13 nt, Human
cucuggagccagc

SEQ ID NO: 1320295 - RNA, 15 nt, Human
cucuggagccagccg

SEQ ID NO: 1320296 - RNA, 15 nt, Human
cucuggagcccacug

SEQ ID NO: 1320297 - RNA, 21 nt, Human
cucuggagccagccgagcagg

SEQ ID NO: 1320298 - RNA, 23 nt, Human
cucuggagccagccgagcaggag

SEQ ID NO: 1320299 - RNA, 19 nt, Human
cucuguucugcacacagca

SEQ ID NO: 1320300 - RNA, 15 nt, Human
cucuguuccuucccu

SEQ ID NO: 1320301 - RNA, 20 nt, Human
cucuguucugcacacagcac

SEQ ID NO: 1320302 - RNA, 21 nt, Human
cucuguucugcacacagcacg

SEQ ID NO: 1320303 - RNA, 13 nt, Human
cucuuucagcucc

SEQ ID NO: 1320304 - RNA, 14 nt, Human
cucuuucagcuccu

SEQ ID NO: 1320305 - RNA, 15 nt, Human
cucuuucagcuccug

SEQ ID NO: 1320306 - RNA, 18 nt, Human
cucuuuccaugacaucaa

SEQ ID NO: 1320307 - RNA, 12 nt, Human
cucuuucaaaac

SEQ ID NO: 1320308 - RNA, 22 nt, Human
cucuuucaagcagucgugccug

SEQ ID NO: 1320309 - RNA, 11 nt, Human
cucuuucagcu

SEQ ID NO: 1320310 - RNA, 12 nt, Human
cucuuucagcuc

SEQ ID NO: 1320311 - RNA, 21 nt, Human
cucuuguaauccgaaucucuu

SEQ ID NO: 1320312 - RNA, 20 nt, Human
cucuuguauaagauccuaga

SEQ ID NO: 1320313 - RNA, 21 nt, Human
cucuuguauaagauccuagau

SEQ ID NO: 1320314 - RNA, 12 nt, Human
cucuuucucugc

SEQ ID NO: 1320315 - RNA, 13 nt, Human
cucuuucucugcc

SEQ ID NO: 1320316 - RNA, 15 nt, Human
cucuuucucugccag

SEQ ID NO: 1320317 - RNA, 16 nt, Human
cucuuucucugccagu

SEQ ID NO: 1320318 - RNA, 17 nt, Human
cucuuucucugccagug

SEQ ID NO: 1320319 - RNA, 18 nt, Human
cucuuucucugccaguga

SEQ ID NO: 1320320 - RNA, 11 nt, Human
cucuuucugua

SEQ ID NO: 1320321 - RNA, 13 nt, Human
cucuuucuguaua

SEQ ID NO: 1320322 - RNA, 14 nt, Human
cucuuucuguauau

SEQ ID NO: 1320323 - RNA, 14 nt, Human
cucuuccaguuugc

SEQ ID NO: 1320324 - RNA, 15 nt, Human
cucuugagcaguggc

SEQ ID NO: 1320325 - RNA, 18 nt, Human
cucuugagcaguggcugg

SEQ ID NO: 1320326 - RNA, 22 nt, Human
cucuugagcaguggcuggucca

SEQ ID NO: 1320327 - RNA, 14 nt, Human
cucuugaccaggcu

SEQ ID NO: 1320328 - RNA, 15 nt, Human
cucuugaccaggcug

SEQ ID NO: 1320329 - RNA, 19 nt, Human
cucuugaccaggcugccuc

SEQ ID NO: 1320330 - RNA, 18 nt, Human
cucuugaacuccugaccu

SEQ ID NO: 1320331 - RNA, 18 nt, Human
cucuucuggguuccuucc

SEQ ID NO: 1320332 - RNA, 15 nt, Human
cucuuggagcuguga

SEQ ID NO: 1320333 - RNA, 16 nt, Human
cucuuggccugaucag

SEQ ID NO: 1320334 - RNA, 12 nt, Human
cucuuggcugga

SEQ ID NO: 1320335 - RNA, 14 nt, Human
cucuuggcuggacc

SEQ ID NO: 1320336 - RNA, 15 nt, Human
cucuuggcuggaccc

SEQ ID NO: 1320337 - RNA, 16 nt, Human
cucuuggcuggaccca

SEQ ID NO: 1320338 - RNA, 17 nt, Human
cucuuggcuggacccag

SEQ ID NO: 1320339 - RNA, 20 nt, Human
cucuuggcuggacccagcca

SEQ ID NO: 1320340 - RNA, 21 nt, Human
cucuugggaacugaacucacu

SEQ ID NO: 1320341 - RNA, 19 nt, Human
cucuuggcuggacccagcc

SEQ ID NO: 1320342 - RNA, 21 nt, Human
cucuuggggaguuuagggugg

SEQ ID NO: 1320343 - RNA, 15 nt, Human
cucucauacccuccc

SEQ ID NO: 1320344 - RNA, 16 nt, Human
cucucaucaacugaau

SEQ ID NO: 1320345 - RNA, 22 nt, Human
cucucaguugcagcccugcugc

SEQ ID NO: 1320346 - RNA, 19 nt, Human
cucucaguugcagcccugc

SEQ ID NO: 1320347 - RNA, 15 nt, Human
cucucaguugcagcc

SEQ ID NO: 1320348 - RNA, 18 nt, Human
cucucagucucugagcag

SEQ ID NO: 1320349 - RNA, 17 nt, Human
cucucaucaacugaaug

SEQ ID NO: 1320350 - RNA, 18 nt, Human
cucucaucaacugaauga

SEQ ID NO: 1320351 - RNA, 13 nt, Human
cucucaugaaccu

SEQ ID NO: 1320352 - RNA, 14 nt, Human
cucucaugaaccuc

SEQ ID NO: 1320353 - RNA, 17 nt, Human
cucuccacagcugccuc

SEQ ID NO: 1320354 - RNA, 22 nt, Human
cucuccacacagugcucaaggc

SEQ ID NO: 1320355 - RNA, 23 nt, Human
cucuccacacagugcucaaggcc

SEQ ID NO: 1320356 - RNA, 19 nt, Human
cucuccacucaugugacuc

SEQ ID NO: 1320357 - RNA, 16 nt, Human
cucuccacugccuucg

SEQ ID NO: 1320358 - RNA, 17 nt, Human
cucuaauucacagugcu

SEQ ID NO: 1320359 - RNA, 15 nt, Human
cucucagggccaggc

SEQ ID NO: 1320360 - RNA, 18 nt, Human
cucucagggccaggccuc

SEQ ID NO: 1320361 - RNA, 19 nt, Human
cucucagggccaggccucu

SEQ ID NO: 1320362 - RNA, 18 nt, Human
cucucaggugaaaggaaa

SEQ ID NO: 1320363 - RNA, 13 nt, Human
cucucagucucug

SEQ ID NO: 1320364 - RNA, 14 nt, Human
cucucagucucuga

SEQ ID NO: 1320365 - RNA, 15 nt, Human
cucucagucucugag

SEQ ID NO: 1320366 - RNA, 16 nt, Human
cucucagucucugagc

SEQ ID NO: 1320367 - RNA, 17 nt, Human
cucucagucucugagca

SEQ ID NO: 1320368 - RNA, 18 nt, Human
cucuaauguuugcauaua

SEQ ID NO: 1320369 - RNA, 17 nt, Human
cucuaauguuugcauau

SEQ ID NO: 1320370 - RNA, 15 nt, Human
cucuaauguuugcau

SEQ ID NO: 1320371 - RNA, 22 nt, Human
cucuaaucugugcuguuucaaa

SEQ ID NO: 1320372 - RNA, 15 nt, Human
cucuaauucacagug

SEQ ID NO: 1320373 - RNA, 16 nt, Human
cucuaauucacagugc

SEQ ID NO: 1320374 - RNA, 15 nt, Human
cucuaauacauucca

SEQ ID NO: 1320375 - RNA, 19 nt, Human
cucuaauauggcaaccauu

SEQ ID NO: 1320376 - RNA, 14 nt, Human
cucuaagguugggc

SEQ ID NO: 1320377 - RNA, 13 nt, Human
cucucccaaaaaa

SEQ ID NO: 1320378 - RNA, 13 nt, Human
cucucccaacucu

SEQ ID NO: 1320379 - RNA, 12 nt, Human
cucuccauucug

SEQ ID NO: 1320380 - RNA, 15 nt, Human
cucuccauucugcuc

SEQ ID NO: 1320381 - RNA, 16 nt, Human
cucuccauucugcucc

SEQ ID NO: 1320382 - RNA, 17 nt, Human
cucuccauucugcuccu

SEQ ID NO: 1320383 - RNA, 19 nt, Human
cucuccauucugcuccuuc

SEQ ID NO: 1320384 - RNA, 20 nt, Human
cucuccauucugcuccuucc

SEQ ID NO: 1320385 - RNA, 21 nt, Human
cucuccauucugcuccuuccc

SEQ ID NO: 1320386 - RNA, 23 nt, Human
cucuccaggcaggucugaagcuc

SEQ ID NO: 1320387 - RNA, 14 nt, Human
cucuccacuuucag

SEQ ID NO: 1320388 - RNA, 15 nt, Human
cucuccacuuucagc

SEQ ID NO: 1320389 - RNA, 16 nt, Human
cucuccacuuucagcu

SEQ ID NO: 1320390 - RNA, 17 nt, Human
cucuccacuuucagcug

SEQ ID NO: 1320391 - RNA, 18 nt, Human
cucuccacuuucagcugu

SEQ ID NO: 1320392 - RNA, 21 nt, Human
cucuccacuuucagcugucuu

SEQ ID NO: 1320393 - RNA, 19 nt, Human
cucuccacuuucagcuguc

SEQ ID NO: 1320394 - RNA, 18 nt, Human
cucuccagcugacuaaac

SEQ ID NO: 1320395 - RNA, 24 nt, Human
cucucccaggccccaugaccucca

SEQ ID NO: 1320396 - RNA, 19 nt, Human
cucucccaggccccaugac

SEQ ID NO: 1320397 - RNA, 21 nt, Human
cucucccaggccccaugaccu

SEQ ID NO: 1320398 - RNA, 14 nt, Human
cucucccaacucuu

SEQ ID NO: 1320399 - RNA, 13 nt, Human
cucucccacccuc

SEQ ID NO: 1320400 - RNA, 14 nt, Human
cucucccacccucu

SEQ ID NO: 1320401 - RNA, 16 nt, Human
cucucccacccucuuc

SEQ ID NO: 1320402 - RNA, 17 nt, Human
cucucccacccucuucc

SEQ ID NO: 1320403 - RNA, 19 nt, Human
cucucccacccucuuccua

SEQ ID NO: 1320404 - RNA, 21 nt, Human
cucucccacccucuuccuacu

SEQ ID NO: 1320405 - RNA, 13 nt, Human
cucucccaggcag

SEQ ID NO: 1320406 - RNA, 14 nt, Human
cucucccaggcagg

SEQ ID NO: 1320407 - RNA, 12 nt, Human
cucucccaggcc

SEQ ID NO: 1320408 - RNA, 13 nt, Human
cucucccaggccc

SEQ ID NO: 1320409 - RNA, 14 nt, Human
cucucccaggcccc

SEQ ID NO: 1320410 - RNA, 16 nt, Human
cucucccaggccccau

SEQ ID NO: 1320411 - RNA, 12 nt, Human
cucucccaguug

SEQ ID NO: 1320412 - RNA, 22 nt, Human
cucucugcaggucccuaauaaa

SEQ ID NO: 1320413 - RNA, 19 nt, Human
cucucugcaggucccuaau

SEQ ID NO: 1320414 - RNA, 17 nt, Human
cucucugcaggucccua

SEQ ID NO: 1320415 - RNA, 16 nt, Human
cucucugcaggucccu

SEQ ID NO: 1320416 - RNA, 14 nt, Human
cucucugcaggucc

SEQ ID NO: 1320417 - RNA, 13 nt, Human
cucucugcagguc

SEQ ID NO: 1320418 - RNA, 12 nt, Human
cucucugcaggu

SEQ ID NO: 1320419 - RNA, 14 nt, Human
cucucggcucccca

SEQ ID NO: 1320420 - RNA, 15 nt, Human
cucucggcuccccau

SEQ ID NO: 1320421 - RNA, 16 nt, Human
cucucggcuccccaug

SEQ ID NO: 1320422 - RNA, 17 nt, Human
cucucggcuccccaugu

SEQ ID NO: 1320423 - RNA, 18 nt, Human
cucucggcuccccaugug

SEQ ID NO: 1320424 - RNA, 19 nt, Human
cucucggguugugugucug

SEQ ID NO: 1320425 - RNA, 19 nt, Human
cucucuacaaacucccacu

SEQ ID NO: 1320426 - RNA, 14 nt, Human
cucucuacagucuc

SEQ ID NO: 1320427 - RNA, 18 nt, Human
cucucuacagucucgucu

SEQ ID NO: 1320428 - RNA, 16 nt, Human
cucucuacagucucgu

SEQ ID NO: 1320429 - RNA, 18 nt, Human
cucuccccacgagggcug

SEQ ID NO: 1320430 - RNA, 19 nt, Human
cucuccccacgagggcugg

SEQ ID NO: 1320431 - RNA, 21 nt, Human
cucuccccacgagggcuggcu

SEQ ID NO: 1320432 - RNA, 11 nt, Human
cucuccccagc

SEQ ID NO: 1320433 - RNA, 15 nt, Human
cucucgcacaccucu

SEQ ID NO: 1320434 - RNA, 13 nt, Human
cucucgcacaccu

SEQ ID NO: 1320435 - RNA, 12 nt, Human
cucuggagccca

SEQ ID NO: 1320436 - RNA, 14 nt, Human
cucuggagcauuuc

SEQ ID NO: 1320437 - RNA, 15 nt, Human
cucuggagcauuucu

SEQ ID NO: 1320438 - RNA, 21 nt, Human
cucuggagaaagggcccuggg

SEQ ID NO: 1320439 - RNA, 18 nt, Human
cucuggacagccccaccc

SEQ ID NO: 1320440 - RNA, 15 nt, Human
cucuggacagcccca

SEQ ID NO: 1320441 - RNA, 14 nt, Human
cucuggaauuugaa

SEQ ID NO: 1320442 - RNA, 15 nt, Human
cucugcuuuggaaau

SEQ ID NO: 1320443 - RNA, 15 nt, Human
cucugccuccucuuc

SEQ ID NO: 1320444 - RNA, 16 nt, Human
cucugccuccucuuca

SEQ ID NO: 1320445 - RNA, 12 nt, Human
cucugcccugcg

SEQ ID NO: 1320446 - RNA, 14 nt, Human
cucugccuccucuu

SEQ ID NO: 1320447 - RNA, 21 nt, Human
cucugcccuugaucagcccca

SEQ ID NO: 1320448 - RNA, 23 nt, Human
cucugcccuaaugcgcaggcugg

SEQ ID NO: 1320449 - RNA, 11 nt, Human
cucugcccugc

SEQ ID NO: 1320450 - RNA, 13 nt, Human
cucugccaguccu

SEQ ID NO: 1320451 - RNA, 19 nt, Human
cucugcccaggcacugcua

SEQ ID NO: 1320452 - RNA, 14 nt, Human
cucugcccaggcac

SEQ ID NO: 1320453 - RNA, 14 nt, Human
cucugcagucucua

SEQ ID NO: 1320454 - RNA, 15 nt, Human
cucugcagucccagc

SEQ ID NO: 1320455 - RNA, 22 nt, Human
cucugcaauuccccucugcugc

SEQ ID NO: 1320456 - RNA, 23 nt, Human
cucugcaauuccccucugcugcu

SEQ ID NO: 1320457 - RNA, 23 nt, Human
cucugcaggucccuaauaaagcu

SEQ ID NO: 1320458 - RNA, 22 nt, Human
cucugcagucucuauaccaaua

SEQ ID NO: 1320459 - RNA, 23 nt, Human
cucugcauacucauuaggauggc

SEQ ID NO: 1320460 - RNA, 18 nt, Human
cucugcaauuccccucug

SEQ ID NO: 1320461 - RNA, 19 nt, Human
cucugcaauuccccucugc

SEQ ID NO: 1320462 - RNA, 20 nt, Human
cucugcaauuccccucugcu

SEQ ID NO: 1320463 - RNA, 21 nt, Human
cucugcaauuccccucugcug

SEQ ID NO: 1320464 - RNA, 20 nt, Human
cucugcaaacugccuucuuc

SEQ ID NO: 1320465 - RNA, 16 nt, Human
cucugcaaacugccuu

SEQ ID NO: 1320466 - RNA, 15 nt, Human
cucugcaauuccccu

SEQ ID NO: 1320467 - RNA, 16 nt, Human
cucugcaauuccccuc

SEQ ID NO: 1320468 - RNA, 17 nt, Human
cucugcaauuccccucu

SEQ ID NO: 1320469 - RNA, 21 nt, Human
cucugaggggcuaccaggaaa

SEQ ID NO: 1320470 - RNA, 20 nt, Human
cucugaggggcuaccaggaa

SEQ ID NO: 1320471 - RNA, 17 nt, Human
cucugaugaagaggagu

SEQ ID NO: 1320472 - RNA, 14 nt, Human
cucugaugaaaaau

SEQ ID NO: 1320473 - RNA, 22 nt, Human
cucugaugaaaaauugcugacu

SEQ ID NO: 1320474 - RNA, 12 nt, Human
cucugaucccuc

SEQ ID NO: 1320475 - RNA, 21 nt, Human
cucugaucccucuacagagcu

SEQ ID NO: 1320476 - RNA, 22 nt, Human
cucugaucccucuacagagcuu

SEQ ID NO: 1320477 - RNA, 22 nt, Human
cucugauuuucaaagcuuuuuc

SEQ ID NO: 1320478 - RNA, 20 nt, Human
cucugauuuucaaagcuuuu

SEQ ID NO: 1320479 - RNA, 15 nt, Human
cucugcaaacugccu

SEQ ID NO: 1320480 - RNA, 23 nt, Human
cucugaugaaaaauugcugacug

SEQ ID NO: 1320481 - RNA, 13 nt, Human
cucugaugcagcu

SEQ ID NO: 1320482 - RNA, 14 nt, Human
cucugaugcagcuu

SEQ ID NO: 1320483 - RNA, 18 nt, Human
cucugaugcagcuuauac

SEQ ID NO: 1320484 - RNA, 15 nt, Human
cucugaugcaucaga

SEQ ID NO: 1320485 - RNA, 20 nt, Human
cucugaugcaucagaaaggg

SEQ ID NO: 1320486 - RNA, 15 nt, Human
cucugauuuucaaag

SEQ ID NO: 1320487 - RNA, 18 nt, Human
cucugauuuucaaagcuu

SEQ ID NO: 1320488 - RNA, 19 nt, Human
cucugauuuucaaagcuuu

SEQ ID NO: 1320489 - RNA, 20 nt, Human
cucugagaauuguugagaua

SEQ ID NO: 1320490 - RNA, 23 nt, Human
cucugagaauuguugagauacuu

SEQ ID NO: 1320491 - RNA, 14 nt, Human
cucugagacuccag

SEQ ID NO: 1320492 - RNA, 15 nt, Human
cucugagacuccaga

SEQ ID NO: 1320493 - RNA, 10 nt, Human
cucugagaac

SEQ ID NO: 1320494 - RNA, 16 nt, Human
cucugagaagcucuga

SEQ ID NO: 1320495 - RNA, 13 nt, Human
cucugacuucugc

SEQ ID NO: 1320496 - RNA, 14 nt, Human
cucugacuucugcc

SEQ ID NO: 1320497 - RNA, 15 nt, Human
cucugacuucugccu

SEQ ID NO: 1320498 - RNA, 16 nt, Human
cucugacuucugccug

SEQ ID NO: 1320499 - RNA, 17 nt, Human
cucugacuucugccugg

SEQ ID NO: 1320500 - RNA, 18 nt, Human
cucugacuucugccugga

SEQ ID NO: 1320501 - RNA, 19 nt, Human
cucugacuucugccuggag

SEQ ID NO: 1320502 - RNA, 21 nt, Human
cucugacuucugccuggagac

SEQ ID NO: 1320503 - RNA, 12 nt, Human
cucucugcccua

SEQ ID NO: 1320504 - RNA, 13 nt, Human
cucucugcccuaa

SEQ ID NO: 1320505 - RNA, 21 nt, Human
cucucugcccuaaugcgcagg

SEQ ID NO: 1320506 - RNA, 17 nt, Human
cucucugcccuugauca

SEQ ID NO: 1320507 - RNA, 12 nt, Human
cucucugcucug

SEQ ID NO: 1320508 - RNA, 14 nt, Human
cucucugcucugcg

SEQ ID NO: 1320509 - RNA, 22 nt, Human
cucucugcucugcgugucaccu

SEQ ID NO: 1320510 - RNA, 16 nt, Human
cucugagcaaaugugg

SEQ ID NO: 1320511 - RNA, 23 nt, Human
cucugagacuccagaccugaggc

SEQ ID NO: 1320512 - RNA, 19 nt, Human
cucugagagucuagauucu

SEQ ID NO: 1320513 - RNA, 22 nt, Human
cucugagagucuagauucucug

SEQ ID NO: 1320514 - RNA, 13 nt, Human
cucugagcaguga

SEQ ID NO: 1320515 - RNA, 15 nt, Human
cucugagccuuggga

SEQ ID NO: 1320516 - RNA, 13 nt, Human
cucugagcgccuc

SEQ ID NO: 1320517 - RNA, 11 nt, Human
cucugagcugu

SEQ ID NO: 1320518 - RNA, 13 nt, Human
cucugagcuguca

SEQ ID NO: 1320519 - RNA, 15 nt, Human
cucugagcugugcag

SEQ ID NO: 1320520 - RNA, 15 nt, Human
cucugagcugucaac

SEQ ID NO: 1320521 - RNA, 19 nt, Human
cucugagcugucaacgaga

SEQ ID NO: 1320522 - RNA, 13 nt, Human
cucugaggccagc

SEQ ID NO: 1320523 - RNA, 14 nt, Human
cucugaggccagcc

SEQ ID NO: 1320524 - RNA, 15 nt, Human
cucugaggccagccu

SEQ ID NO: 1320525 - RNA, 16 nt, Human
cucugaggccagccug

SEQ ID NO: 1320526 - RNA, 17 nt, Human
cucugaggccagccugg

SEQ ID NO: 1320527 - RNA, 18 nt, Human
cucugaggccagccuggc

SEQ ID NO: 1320528 - RNA, 19 nt, Human
cucugaggccagccuggcc

SEQ ID NO: 1320529 - RNA, 20 nt, Human
cucugaggccagccuggccu

SEQ ID NO: 1320530 - RNA, 21 nt, Human
cucugaggccagccuggccuc

SEQ ID NO: 1320531 - RNA, 10 nt, Human
cucugaggcg

SEQ ID NO: 1320532 - RNA, 12 nt, Human
cucugaggcgcc

SEQ ID NO: 1320533 - RNA, 19 nt, Human
cucugaggcgccccaaccc

SEQ ID NO: 1320534 - RNA, 21 nt, Human
cucugaggcgccccaacccgu

SEQ ID NO: 1320535 - RNA, 23 nt, Human
cucugaggcgccccaacccgugg

SEQ ID NO: 1320536 - RNA, 22 nt, Human
cucugaggcgccccaacccgug

SEQ ID NO: 1320537 - RNA, 14 nt, Human
cucauauuuucaug

SEQ ID NO: 1320538 - RNA, 13 nt, Human
cucaucaacugaa

SEQ ID NO: 1320539 - RNA, 23 nt, Human
cucaucauucucugucucaucca

SEQ ID NO: 1320540 - RNA, 18 nt, Human
cucauccacauacccuga

SEQ ID NO: 1320541 - RNA, 20 nt, Human
cucauccacauacccugacc

SEQ ID NO: 1320542 - RNA, 12 nt, Human
cucauauuuccc

SEQ ID NO: 1320543 - RNA, 19 nt, Human
cucauauugugauucugcc

SEQ ID NO: 1320544 - RNA, 21 nt, Human
cucauauugugauucugccuu

SEQ ID NO: 1320545 - RNA, 13 nt, Human
cucauauugugau

SEQ ID NO: 1320546 - RNA, 13 nt, Human
cucauccacccca

SEQ ID NO: 1320547 - RNA, 15 nt, Human
cucauccaccccauc

SEQ ID NO: 1320548 - RNA, 16 nt, Human
cucauccaccccaucc

SEQ ID NO: 1320549 - RNA, 19 nt, Human
cucauccaccccaucccuc

SEQ ID NO: 1320550 - RNA, 24 nt, Human
cucauccaccccaucccuccccag

SEQ ID NO: 1320551 - RNA, 22 nt, Human
cucauccacucuacuaaugccu

SEQ ID NO: 1320552 - RNA, 16 nt, Human
cucauccaucaucaug

SEQ ID NO: 1320553 - RNA, 19 nt, Human
cucauccaucaucaugugu

SEQ ID NO: 1320554 - RNA, 13 nt, Human
cucauccugcagg

SEQ ID NO: 1320555 - RNA, 21 nt, Human
cucaucuagguaaauuacagu

SEQ ID NO: 1320556 - RNA, 14 nt, Human
cucauccugcaggc

SEQ ID NO: 1320557 - RNA, 17 nt, Human
cucaucuccccaucauu

SEQ ID NO: 1320558 - RNA, 18 nt, Human
cucauuaggauggcuagu

SEQ ID NO: 1320559 - RNA, 17 nt, Human
cucauuaggauggcuag

SEQ ID NO: 1320560 - RNA, 11 nt, Human
cucaucucagu

SEQ ID NO: 1320561 - RNA, 18 nt, Human
cucaucucagugaagaau

SEQ ID NO: 1320562 - RNA, 14 nt, Human
cucauuagacugga

SEQ ID NO: 1320563 - RNA, 21 nt, Human
cucauuauuuauguccaggug

SEQ ID NO: 1320564 - RNA, 22 nt, Human
cucauuauuuauguccaggugu

SEQ ID NO: 1320565 - RNA, 19 nt, Human
cucauugcuuacaagccua

SEQ ID NO: 1320566 - RNA, 16 nt, Human
cucauuggaaauuuag

SEQ ID NO: 1320567 - RNA, 18 nt, Human
cucauuggaaauuuagca

SEQ ID NO: 1320568 - RNA, 19 nt, Human
cucauuggaaauuuagcau

SEQ ID NO: 1320569 - RNA, 20 nt, Human
cucauuggaaauuuagcauu

SEQ ID NO: 1320570 - RNA, 13 nt, Human
cucauuggacccu

SEQ ID NO: 1320571 - RNA, 17 nt, Human
cucauuggacccuucca

SEQ ID NO: 1320572 - RNA, 18 nt, Human
cucauuggacccuuccau

SEQ ID NO: 1320573 - RNA, 22 nt, Human
cucauuggaaauuuagcauugu

SEQ ID NO: 1320574 - RNA, 15 nt, Human
cucauuguaaacaaa

SEQ ID NO: 1320575 - RNA, 18 nt, Human
cucauucccuccccagaa

SEQ ID NO: 1320576 - RNA, 17 nt, Human
cucauuccauaaauguc

SEQ ID NO: 1320577 - RNA, 18 nt, Human
cucauuccauaaaugucg

SEQ ID NO: 1320578 - RNA, 21 nt, Human
cucauuccaccuucccaugcc

SEQ ID NO: 1320579 - RNA, 18 nt, Human
cucauuccaccuucccau

SEQ ID NO: 1320580 - RNA, 17 nt, Human
cguuuuuuaaauguaua

SEQ ID NO: 1320581 - RNA, 15 nt, Human
cguuuuuuucauucc

SEQ ID NO: 1320582 - RNA, 20 nt, Human
cguuuuuuuuuuguuuguug

SEQ ID NO: 1320583 - RNA, 17 nt, Human
cucaggggccugcccag

SEQ ID NO: 1320584 - RNA, 19 nt, Human
cuaaaagugggcuugauuc

SEQ ID NO: 1320585 - RNA, 14 nt, Human
cucagggggcgccu

SEQ ID NO: 1320586 - RNA, 19 nt, Human
cucagggggcgccuguggu

SEQ ID NO: 1320587 - RNA, 23 nt, Human
cucagggggcgccugugguucug

SEQ ID NO: 1320588 - RNA, 21 nt, Human
cucaggggucugagcuccagc

SEQ ID NO: 1320589 - RNA, 15 nt, Human
cucagguacuuguaa

SEQ ID NO: 1320590 - RNA, 19 nt, Human
cucaggucacauaaaacuu

SEQ ID NO: 1320591 - RNA, 17 nt, Human
cucaggucccugcaggg

SEQ ID NO: 1320592 - RNA, 18 nt, Human
cucaggucccugcagggc

SEQ ID NO: 1320593 - RNA, 20 nt, Human
cucaggucccuggggcuagg

SEQ ID NO: 1320594 - RNA, 14 nt, Human
cucauaacuugaga

SEQ ID NO: 1320595 - RNA, 17 nt, Human
cucauaacuugagaccu

SEQ ID NO: 1320596 - RNA, 20 nt, Human
cucauaacuugagaccuaau

SEQ ID NO: 1320597 - RNA, 17 nt, Human
cucauacacucguauga

SEQ ID NO: 1320598 - RNA, 18 nt, Human
cucaguucauccauucua

SEQ ID NO: 1320599 - RNA, 20 nt, Human
cucaguucauccauucuauu

SEQ ID NO: 1320600 - RNA, 15 nt, Human
cuccacagcugccuc

SEQ ID NO: 1320601 - RNA, 20 nt, Human
cuccacauauuucagugagg

SEQ ID NO: 1320602 - RNA, 13 nt, Human
cuccacauccucc

SEQ ID NO: 1320603 - RNA, 19 nt, Human
cucauugucuguguagagu

SEQ ID NO: 1320604 - RNA, 13 nt, Human
cucauuuaauccu

SEQ ID NO: 1320605 - RNA, 22 nt, Human
cucauuuaauccucccuuccuc

SEQ ID NO: 1320606 - RNA, 19 nt, Human
cucauuuaauccucccuuc

SEQ ID NO: 1320607 - RNA, 14 nt, Human
cucauuuagccugu

SEQ ID NO: 1320608 - RNA, 16 nt, Human
cucauuuagccugucc

SEQ ID NO: 1320609 - RNA, 13 nt, Human
cuccacaccugcg

SEQ ID NO: 1320610 - RNA, 15 nt, Human
cuccacaccugcggc

SEQ ID NO: 1320611 - RNA, 16 nt, Human
cuccacaccugcggcc

SEQ ID NO: 1320612 - RNA, 14 nt, Human
cuccacacugcaca

SEQ ID NO: 1320613 - RNA, 15 nt, Human
cuccacacugcacaa

SEQ ID NO: 1320614 - RNA, 16 nt, Human
cuccacagcaacccca

SEQ ID NO: 1320615 - RNA, 19 nt, Human
cuccacagcaaccccaggc

SEQ ID NO: 1320616 - RNA, 14 nt, Human
cuccacucuuucuu

SEQ ID NO: 1320617 - RNA, 11 nt, Human
cuccacugccu

SEQ ID NO: 1320618 - RNA, 16 nt, Human
cuccacucugcuucuc

SEQ ID NO: 1320619 - RNA, 17 nt, Human
cuccacucugcuucucu

SEQ ID NO: 1320620 - RNA, 20 nt, Human
cuccacucugcuucucugac

SEQ ID NO: 1320621 - RNA, 21 nt, Human
cuccacucugcuucucugacu

SEQ ID NO: 1320622 - RNA, 12 nt, Human
cuccacucugcu

SEQ ID NO: 1320623 - RNA, 13 nt, Human
cuccacucugcuu

SEQ ID NO: 1320624 - RNA, 14 nt, Human
cuccacucugcuuc

SEQ ID NO: 1320625 - RNA, 15 nt, Human
cuccacucugcuucu

SEQ ID NO: 1320626 - RNA, 15 nt, Human
cuccagaccccuggc

SEQ ID NO: 1320627 - RNA, 17 nt, Human
cuccagaccccuggcuu

SEQ ID NO: 1320628 - RNA, 18 nt, Human
cuccagaccccuggcuuu

SEQ ID NO: 1320629 - RNA, 19 nt, Human
cuccagaccccuggcuuuu

SEQ ID NO: 1320630 - RNA, 20 nt, Human
cuccagaccccuggcuuuuc

SEQ ID NO: 1320631 - RNA, 21 nt, Human
cuccagaccccuggcuuuuca

SEQ ID NO: 1320632 - RNA, 14 nt, Human
cuccagccucagcu

SEQ ID NO: 1320633 - RNA, 17 nt, Human
cuccagccucagccucc

SEQ ID NO: 1320634 - RNA, 15 nt, Human
cuccagccucagccu

SEQ ID NO: 1320635 - RNA, 12 nt, Human
cuccagccucag

SEQ ID NO: 1320636 - RNA, 12 nt, Human
cuccagccugac

SEQ ID NO: 1320637 - RNA, 13 nt, Human
cuccagccugaca

SEQ ID NO: 1320638 - RNA, 20 nt, Human
cuccagccugacaucaaaaa

SEQ ID NO: 1320639 - RNA, 20 nt, Human
cuccagccaucaagagacug

SEQ ID NO: 1320640 - RNA, 21 nt, Human
cuccagccaucaagagacuga

SEQ ID NO: 1320641 - RNA, 23 nt, Human
cuccagccaucaagagacugagu

SEQ ID NO: 1320642 - RNA, 21 nt, Human
cuccauccugaggcuccacuu

SEQ ID NO: 1320643 - RNA, 23 nt, Human
cuccauccugaggcuccacuugg

SEQ ID NO: 1320644 - RNA, 20 nt, Human
cuccaucgcugucaucucag

SEQ ID NO: 1320645 - RNA, 17 nt, Human
cuccaucuaaacugccc

SEQ ID NO: 1320646 - RNA, 18 nt, Human
cuccaucuaaacugcccc

SEQ ID NO: 1320647 - RNA, 13 nt, Human
cuccaucuccacu

SEQ ID NO: 1320648 - RNA, 17 nt, Human
cuccagcucccugugcc

SEQ ID NO: 1320649 - RNA, 21 nt, Human
cuccagcucccugugccccca

SEQ ID NO: 1320650 - RNA, 22 nt, Human
cuccagcucccugugcccccag

SEQ ID NO: 1320651 - RNA, 17 nt, Human
cuccagcuccuuugggc

SEQ ID NO: 1320652 - RNA, 13 nt, Human
cuccagcucccug

SEQ ID NO: 1320653 - RNA, 15 nt, Human
cuccagcucccugug

SEQ ID NO: 1320654 - RNA, 16 nt, Human
cuccagcuccuuuggg

SEQ ID NO: 1320655 - RNA, 11 nt, Human
cuccaggccca

SEQ ID NO: 1320656 - RNA, 12 nt, Human
cuccaggcccaa

SEQ ID NO: 1320657 - RNA, 19 nt, Human
cuccaggcccaaggcuccc

SEQ ID NO: 1320658 - RNA, 16 nt, Human
cuccaggcccaaggcu

SEQ ID NO: 1320659 - RNA, 17 nt, Human
cuccaggcccaaggcuc

SEQ ID NO: 1320660 - RNA, 12 nt, Human
cucccaggcccc

SEQ ID NO: 1320661 - RNA, 15 nt, Human
cucccaggccccaug

SEQ ID NO: 1320662 - RNA, 14 nt, Human
cucccaggcgcccc

SEQ ID NO: 1320663 - RNA, 16 nt, Human
cucccaggccccauga

SEQ ID NO: 1320664 - RNA, 19 nt, Human
cucccaggccccaugaccu

SEQ ID NO: 1320665 - RNA, 21 nt, Human
cucccaggccccaugaccucc

SEQ ID NO: 1320666 - RNA, 19 nt, Human
cucccaaggggccugagca

SEQ ID NO: 1320667 - RNA, 22 nt, Human
cucccaaguagcugggauuaca

SEQ ID NO: 1320668 - RNA, 18 nt, Human
cucccaaggggccugagc

SEQ ID NO: 1320669 - RNA, 14 nt, Human
cuccauucugcucc

SEQ ID NO: 1320670 - RNA, 15 nt, Human
cuccauucugcuccu

SEQ ID NO: 1320671 - RNA, 16 nt, Human
cuccauucugcuccuu

SEQ ID NO: 1320672 - RNA, 17 nt, Human
cuccauucugcuccuuc

SEQ ID NO: 1320673 - RNA, 14 nt, Human
cuccaucuccacuc

SEQ ID NO: 1320674 - RNA, 13 nt, Human
cuccuuagaaaaa

SEQ ID NO: 1320675 - RNA, 22 nt, Human
cuccuuaaggcucuuuuguaag

SEQ ID NO: 1320676 - RNA, 13 nt, Human
cuccuuaaggcuc

SEQ ID NO: 1320677 - RNA, 24 nt, Human
cuccuguugggagagggcgcaggc

SEQ ID NO: 1320678 - RNA, 22 nt, Human
cuccuguugggagagggcgcag

SEQ ID NO: 1320679 - RNA, 19 nt, Human
cuccuguuuugcacagcca

SEQ ID NO: 1320680 - RNA, 17 nt, Human
cuccugcccacggaguc

SEQ ID NO: 1320681 - RNA, 13 nt, Human
cuccuguugggag

SEQ ID NO: 1320682 - RNA, 14 nt, Human
cuccuguugggaga

SEQ ID NO: 1320683 - RNA, 16 nt, Human
cuccuguugggagagg

SEQ ID NO: 1320684 - RNA, 11 nt, Human
cuccugccacc

SEQ ID NO: 1320685 - RNA, 13 nt, Human
cuccugcccacgg

SEQ ID NO: 1320686 - RNA, 19 nt, Human
cuccugaggauguguccca

SEQ ID NO: 1320687 - RNA, 14 nt, Human
cuccuuagaaaaaa

SEQ ID NO: 1320688 - RNA, 19 nt, Human
cuccuucaugacagccucc

SEQ ID NO: 1320689 - RNA, 16 nt, Human
cuccuuccagcuagug

SEQ ID NO: 1320690 - RNA, 13 nt, Human
cuccuucugagcu

SEQ ID NO: 1320691 - RNA, 14 nt, Human
cuccuucugagcuc

SEQ ID NO: 1320692 - RNA, 16 nt, Human
cuccuucugagcuccu

SEQ ID NO: 1320693 - RNA, 18 nt, Human
cuccuucugagcuccugu

SEQ ID NO: 1320694 - RNA, 19 nt, Human
cuccuucugagcuccuguc

SEQ ID NO: 1320695 - RNA, 20 nt, Human
cuccuucugagcuccugucc

SEQ ID NO: 1320696 - RNA, 23 nt, Human
cuccuucugagcuccuguccccu

SEQ ID NO: 1320697 - RNA, 22 nt, Human
cuccuugagggcaagagccaca

SEQ ID NO: 1320698 - RNA, 21 nt, Human
cuccuugauuuuagccuucuc

SEQ ID NO: 1320699 - RNA, 19 nt, Human
cucuaacaguggacaaagu

SEQ ID NO: 1320700 - RNA, 15 nt, Human
cucuaacaguggaca

SEQ ID NO: 1320701 - RNA, 13 nt, Human
cucuaacagcacc

SEQ ID NO: 1320702 - RNA, 14 nt, Human
cucuaacagcacca

SEQ ID NO: 1320703 - RNA, 14 nt, Human
cucuaacagcccuc

SEQ ID NO: 1320704 - RNA, 13 nt, Human
cucuaaauucuuu

SEQ ID NO: 1320705 - RNA, 17 nt, Human
cucuaaauucuuucauu

SEQ ID NO: 1320706 - RNA, 14 nt, Human
cucggcucacugca

SEQ ID NO: 1320707 - RNA, 11 nt, Human
cucggccugcc

SEQ ID NO: 1320708 - RNA, 17 nt, Human
cucggccuucacaaucu

SEQ ID NO: 1320709 - RNA, 22 nt, Human
cucuaaagucuguugauuaaag

SEQ ID NO: 1320710 - RNA, 23 nt, Human
cucuaaauacugagaaaaccugu

SEQ ID NO: 1320711 - RNA, 22 nt, Human
cucggccucccaaagugcuggg

SEQ ID NO: 1320712 - RNA, 18 nt, Human
cucggccucccaaagugc

SEQ ID NO: 1320713 - RNA, 20 nt, Human
cucggccucccaaagugcug

SEQ ID NO: 1320714 - RNA, 23 nt, Human
cucggccucccaaagugcuggga

SEQ ID NO: 1320715 - RNA, 13 nt, Human
cucggccugcccc

SEQ ID NO: 1320716 - RNA, 14 nt, Human
cucggaucucuccu

SEQ ID NO: 1320717 - RNA, 23 nt, Human
cucggcagcccuuccaaacucuu

SEQ ID NO: 1320718 - RNA, 15 nt, Human
cucggccucccaaag

SEQ ID NO: 1320719 - RNA, 22 nt, Human
cucgcuauugucaccagggcug

SEQ ID NO: 1320720 - RNA, 21 nt, Human
cucgcuauugucaccagggcu

SEQ ID NO: 1320721 - RNA, 22 nt, Human
cucgcuagcaguggcaggcaga

SEQ ID NO: 1320722 - RNA, 14 nt, Human
cucggaaucuauuu

SEQ ID NO: 1320723 - RNA, 20 nt, Human
cucggaaucuauuuucucau

SEQ ID NO: 1320724 - RNA, 18 nt, Human
cucggacuuagcugggag

SEQ ID NO: 1320725 - RNA, 19 nt, Human
cucggacuuagcugggaga

SEQ ID NO: 1320726 - RNA, 19 nt, Human
cucgcuauugucaccaggg

SEQ ID NO: 1320727 - RNA, 15 nt, Human
cucgcggcccucagu

SEQ ID NO: 1320728 - RNA, 16 nt, Human
cucgcggcccucagua

SEQ ID NO: 1320729 - RNA, 16 nt, Human
cucgccccuggcagag

SEQ ID NO: 1320730 - RNA, 17 nt, Human
cucgccccuggcagaga

SEQ ID NO: 1320731 - RNA, 20 nt, Human
cucgccccuggcagagaugc

SEQ ID NO: 1320732 - RNA, 19 nt, Human
cucgauguggucacagcug

SEQ ID NO: 1320733 - RNA, 24 nt, Human
cucgauguggucacagcuguauag

SEQ ID NO: 1320734 - RNA, 22 nt, Human
cucgcauaggaccuuuccacca

SEQ ID NO: 1320735 - RNA, 20 nt, Human
cucgauguggucacagcugu

SEQ ID NO: 1320736 - RNA, 19 nt, Human
cucgcccauccccuugagg

SEQ ID NO: 1320737 - RNA, 14 nt, Human
cucgccccagcagg

SEQ ID NO: 1320738 - RNA, 14 nt, Human
cucgccccuggcag

SEQ ID NO: 1320739 - RNA, 15 nt, Human
cucgccccuggcaga

SEQ ID NO: 1320740 - RNA, 21 nt, Human
cucgaggucgggcagcacaag

SEQ ID NO: 1320741 - RNA, 13 nt, Human
cucgaaucucugu

SEQ ID NO: 1320742 - RNA, 14 nt, Human
cucgaaucucugug

SEQ ID NO: 1320743 - RNA, 15 nt, Human
cucgaaucucugugc

SEQ ID NO: 1320744 - RNA, 16 nt, Human
cucgaaucucugugcc

SEQ ID NO: 1320745 - RNA, 17 nt, Human
cucgaaucucugugccu

SEQ ID NO: 1320746 - RNA, 18 nt, Human
cucgaaucucugugccuu

SEQ ID NO: 1320747 - RNA, 14 nt, Human
cucgaaucugugug

SEQ ID NO: 1320748 - RNA, 19 nt, Human
cucgacaugaaaauucaga

SEQ ID NO: 1320749 - RNA, 22 nt, Human
cuccuaucagaaguuucucagc

SEQ ID NO: 1320750 - RNA, 14 nt, Human
cuccucacuguauc

SEQ ID NO: 1320751 - RNA, 16 nt, Human
cuccucacuguaucca

SEQ ID NO: 1320752 - RNA, 19 nt, Human
cuccucacuguauccaggu

SEQ ID NO: 1320753 - RNA, 19 nt, Human
cuccucuugccacugccuc

SEQ ID NO: 1320754 - RNA, 15 nt, Human
cuccucuccaccauc

SEQ ID NO: 1320755 - RNA, 13 nt, Human
cuccucuccacca

SEQ ID NO: 1320756 - RNA, 14 nt, Human
cuccucuccaccau

SEQ ID NO: 1320757 - RNA, 17 nt, Human
cuccucuagcugugggg

SEQ ID NO: 1320758 - RNA, 18 nt, Human
cuccucuagcuguggggg

SEQ ID NO: 1320759 - RNA, 19 nt, Human
cuccucuagcugugggggu

SEQ ID NO: 1320760 - RNA, 17 nt, Human
cuccugaguagcuggga

SEQ ID NO: 1320761 - RNA, 22 nt, Human
cuccugaguagcugggauuaca

SEQ ID NO: 1320762 - RNA, 17 nt, Human
cuccugaggcuuuggau

SEQ ID NO: 1320763 - RNA, 16 nt, Human
cuccugaggcuuugga

SEQ ID NO: 1320764 - RNA, 14 nt, Human
cuccugaccucagg

SEQ ID NO: 1320765 - RNA, 15 nt, Human
cuccugaccucaagu

SEQ ID NO: 1320766 - RNA, 14 nt, Human
cuccugaccuuagg

SEQ ID NO: 1320767 - RNA, 16 nt, Human
cuccugaccucaggca

SEQ ID NO: 1320768 - RNA, 15 nt, Human
cuccugaccucaggc

SEQ ID NO: 1320769 - RNA, 20 nt, Human
cuccugagaaaaaagguucc

SEQ ID NO: 1320770 - RNA, 21 nt, Human
cuccugaaaaaaaaccugaga

SEQ ID NO: 1320771 - RNA, 22 nt, Human
cuccugaaaagguuuaugaaaa

SEQ ID NO: 1320772 - RNA, 23 nt, Human
cuccugaaaaaaaaccugagauu

SEQ ID NO: 1320773 - RNA, 17 nt, Human
cuccugacacccuucuc

SEQ ID NO: 1320774 - RNA, 18 nt, Human
cuccugacacccuucucc

SEQ ID NO: 1320775 - RNA, 20 nt, Human
cuccugacacccuucuccca

SEQ ID NO: 1320776 - RNA, 22 nt, Human
cuccugacacccuucucccacu

SEQ ID NO: 1320777 - RNA, 14 nt, Human
cuccugacacugcu

SEQ ID NO: 1320778 - RNA, 17 nt, Human
cuccugacacugcugga

SEQ ID NO: 1320779 - RNA, 18 nt, Human
cuccugacacugcuggag

SEQ ID NO: 1320780 - RNA, 12 nt, Human
cuccugaccagu

SEQ ID NO: 1320781 - RNA, 16 nt, Human
cuccugaccaguugca

SEQ ID NO: 1320782 - RNA, 22 nt, Human
cuccugaccaguugcagucacu

SEQ ID NO: 1320783 - RNA, 23 nt, Human
cuccugaccaguugcagucacuc

SEQ ID NO: 1320784 - RNA, 21 nt, Human
cucccagguguuaacauucca

SEQ ID NO: 1320785 - RNA, 22 nt, Human
cucccagguguuaacauuccaa

SEQ ID NO: 1320786 - RNA, 13 nt, Human
cucccauccugug

SEQ ID NO: 1320787 - RNA, 15 nt, Human
cucccauccugugug

SEQ ID NO: 1320788 - RNA, 16 nt, Human
cucccauccugugugu

SEQ ID NO: 1320789 - RNA, 19 nt, Human
cucccauccuguguguuaa

SEQ ID NO: 1320790 - RNA, 12 nt, Human
cucccuucaacc

SEQ ID NO: 1320791 - RNA, 18 nt, Human
cucccuucaaccauuccc

SEQ ID NO: 1320792 - RNA, 19 nt, Human
cucccuucaaccauucccc

SEQ ID NO: 1320793 - RNA, 20 nt, Human
cucccuucaaccauucccca

SEQ ID NO: 1320794 - RNA, 11 nt, Human
cucccuggggg

SEQ ID NO: 1320795 - RNA, 10 nt, Human
cucccugggg

SEQ ID NO: 1320796 - RNA, 16 nt, Human
cucccuucuacagccu

SEQ ID NO: 1320797 - RNA, 16 nt, Human
cucccuucucuucaca

SEQ ID NO: 1320798 - RNA, 21 nt, Human
cucccuucucuacacucuugu

SEQ ID NO: 1320799 - RNA, 14 nt, Human
cucccuucuucccu

SEQ ID NO: 1320800 - RNA, 13 nt, Human
cucccuuucaaca

SEQ ID NO: 1320801 - RNA, 15 nt, Human
cucccuuucacuaaa

SEQ ID NO: 1320802 - RNA, 19 nt, Human
cucccuuucuaucguucuc

SEQ ID NO: 1320803 - RNA, 19 nt, Human
cuccuaggcauucuggacc

SEQ ID NO: 1320804 - RNA, 15 nt, Human
cuccuaggcauucug

SEQ ID NO: 1320805 - RNA, 22 nt, Human
cuccuaguacuaacuccuagga

SEQ ID NO: 1320806 - RNA, 14 nt, Human
cuccuaguucuaga

SEQ ID NO: 1320807 - RNA, 17 nt, Human
cuccuaguucuagaaaa

SEQ ID NO: 1320808 - RNA, 23 nt, Human
cuccuaguucuagaaaaacaggc

SEQ ID NO: 1320809 - RNA, 21 nt, Human
cuccuaguucuucaucccacu

SEQ ID NO: 1320810 - RNA, 16 nt, Human
cgucaacucauauuuu

SEQ ID NO: 1320811 - RNA, 22 nt, Human
cgucaaaacagauuguuugcaa

SEQ ID NO: 1320812 - RNA, 20 nt, Human
cgucaacucauauuuucaug

SEQ ID NO: 1320813 - RNA, 21 nt, Human
cgucaaaacagauuguuugca

SEQ ID NO: 1320814 - RNA, 22 nt, Human
cgucaagagugaauucccucac

SEQ ID NO: 1320815 - RNA, 23 nt, Human
cgucaagagugaauucccucacu

SEQ ID NO: 1320816 - RNA, 18 nt, Human
cgucaccacgacuggcca

SEQ ID NO: 1320817 - RNA, 12 nt, Human
cgucaccucaga

SEQ ID NO: 1320818 - RNA, 21 nt, Human
cgucaccccuguuucuggcac

SEQ ID NO: 1320819 - RNA, 22 nt, Human
cguauaugucucaggucccugc

SEQ ID NO: 1320820 - RNA, 15 nt, Human
cguaugucugguucu

SEQ ID NO: 1320821 - RNA, 18 nt, Human
cguaugucugguucucaa

SEQ ID NO: 1320822 - RNA, 19 nt, Human
cguaugucugguucucaau

SEQ ID NO: 1320823 - RNA, 15 nt, Human
cguauuuaauagcaa

SEQ ID NO: 1320824 - RNA, 21 nt, Human
cguauuuaauagcaaagaauu

SEQ ID NO: 1320825 - RNA, 23 nt, Human
cguauuuaauagcaaagaauuga

SEQ ID NO: 1320826 - RNA, 19 nt, Human
cgucagcugggacaccccg

SEQ ID NO: 1320827 - RNA, 14 nt, Human
cgucagugcugugc

SEQ ID NO: 1320828 - RNA, 21 nt, Human
cgucaugaggagauucugccu

SEQ ID NO: 1320829 - RNA, 14 nt, Human
cgucccccucuggc

SEQ ID NO: 1320830 - RNA, 21 nt, Human
cgucccccucuggcuccagcu

SEQ ID NO: 1320831 - RNA, 23 nt, Human
cguccaucacguuagcuguccca

SEQ ID NO: 1320832 - RNA, 20 nt, Human
cgucaugcacaguauuugua

SEQ ID NO: 1320833 - RNA, 22 nt, Human
cgucaugaggagauucugccuu

SEQ ID NO: 1320834 - RNA, 19 nt, Human
cguccaggagccugugccu

SEQ ID NO: 1320835 - RNA, 22 nt, Human
cguauaaaagccuguuuaagag

SEQ ID NO: 1320836 - RNA, 21 nt, Human
cguauaaaagccuguuuaaga

SEQ ID NO: 1320837 - RNA, 17 nt, Human
cguauaaaagccuguuu

SEQ ID NO: 1320838 - RNA, 16 nt, Human
cguauaaaagccuguu

SEQ ID NO: 1320839 - RNA, 14 nt, Human
cguagaugauuuca

SEQ ID NO: 1320840 - RNA, 19 nt, Human
cguagcuauccggacagag

SEQ ID NO: 1320841 - RNA, 14 nt, Human
cguaggcuacagag

SEQ ID NO: 1320842 - RNA, 15 nt, Human
cguaggcuacagaga

SEQ ID NO: 1320843 - RNA, 16 nt, Human
cguaggcuacagagaa

SEQ ID NO: 1320844 - RNA, 17 nt, Human
cguaggcuacagagaag

SEQ ID NO: 1320845 - RNA, 19 nt, Human
cguaggcuacagagaagcc

SEQ ID NO: 1320846 - RNA, 20 nt, Human
cguaggcuacagagaagccu

SEQ ID NO: 1320847 - RNA, 23 nt, Human
cguaggcuacagagaagccuuca

SEQ ID NO: 1320848 - RNA, 21 nt, Human
cguaggcuacagagaagccuu

SEQ ID NO: 1320849 - RNA, 15 nt, Human
cggggcaucuggccu

SEQ ID NO: 1320850 - RNA, 23 nt, Human
cggggauguguccugacacugca

SEQ ID NO: 1320851 - RNA, 14 nt, Human
cggggauguguccu

SEQ ID NO: 1320852 - RNA, 13 nt, Human
cggggcagccccc

SEQ ID NO: 1320853 - RNA, 19 nt, Human
cggggcagcccccucacag

SEQ ID NO: 1320854 - RNA, 17 nt, Human
cggggcaucuggccugg

SEQ ID NO: 1320855 - RNA, 13 nt, Human
cggugcucagggg

SEQ ID NO: 1320856 - RNA, 23 nt, Human
cguagauauuggacaaagaaccu

SEQ ID NO: 1320857 - RNA, 22 nt, Human
cguagauauuggacaaagaacc

SEQ ID NO: 1320858 - RNA, 22 nt, Human
cgucccccucuggcuccagcug

SEQ ID NO: 1320859 - RNA, 15 nt, Human
cgucggucugugccc

SEQ ID NO: 1320860 - RNA, 19 nt, Human
cgucucccccaacagcugg

SEQ ID NO: 1320861 - RNA, 20 nt, Human
cgucucccccaacagcugga

SEQ ID NO: 1320862 - RNA, 15 nt, Human
cgucuacccugggau

SEQ ID NO: 1320863 - RNA, 24 nt, Human
cgucucccccaacagcuggacccu

SEQ ID NO: 1320864 - RNA, 16 nt, Human
cgucucggccuucaca

SEQ ID NO: 1320865 - RNA, 21 nt, Human
cgucucuuuuacccuggcccc

SEQ ID NO: 1320866 - RNA, 20 nt, Human
cgucucuuuuacccuggccc

SEQ ID NO: 1320867 - RNA, 15 nt, Human
cgucuggaaguccaa

SEQ ID NO: 1320868 - RNA, 17 nt, Human
cgucuggcccaccaggg

SEQ ID NO: 1320869 - RNA, 12 nt, Human
cgucuggguggc

SEQ ID NO: 1320870 - RNA, 17 nt, Human
cgucuguuuauaaacau

SEQ ID NO: 1320871 - RNA, 18 nt, Human
cgugaaugggugcccaca

SEQ ID NO: 1320872 - RNA, 18 nt, Human
cguucuuguaauuuuaca

SEQ ID NO: 1320873 - RNA, 15 nt, Human
cguucuuguaauuuu

SEQ ID NO: 1320874 - RNA, 12 nt, Human
cguucuuguaau

SEQ ID NO: 1320875 - RNA, 13 nt, Human
cguucuuguaauu

SEQ ID NO: 1320876 - RNA, 14 nt, Human
cguucuuguaauuu

SEQ ID NO: 1320877 - RNA, 16 nt, Human
cguuuagcugacaaaa

SEQ ID NO: 1320878 - RNA, 15 nt, Human
cguuuauuuucaaga

SEQ ID NO: 1320879 - RNA, 18 nt, Human
cguuuagcugacaaaaua

SEQ ID NO: 1320880 - RNA, 14 nt, Human
cguuuauuuucaag

SEQ ID NO: 1320881 - RNA, 22 nt, Human
cguuucagcgacuccguuggcc

SEQ ID NO: 1320882 - RNA, 22 nt, Human
cguuucauuuagucaugugacc

SEQ ID NO: 1320883 - RNA, 22 nt, Human
cguuccuucaaagcaaaugucu

SEQ ID NO: 1320884 - RNA, 23 nt, Human
cguuccuagagaagacaggcugg

SEQ ID NO: 1320885 - RNA, 16 nt, Human
cguuccuuucuuuucc

SEQ ID NO: 1320886 - RNA, 19 nt, Human
cguucucucuuugcaugga

SEQ ID NO: 1320887 - RNA, 14 nt, Human
cguucugcucauca

SEQ ID NO: 1320888 - RNA, 13 nt, Human
cguucucucuuug

SEQ ID NO: 1320889 - RNA, 12 nt, Human
cguucugugcac

SEQ ID NO: 1320890 - RNA, 12 nt, Human
cguuuccuaccg

SEQ ID NO: 1320891 - RNA, 18 nt, Human
cguuucuccaccuagacu

SEQ ID NO: 1320892 - RNA, 22 nt, Human
cguuucuccaccuagacuguaa

SEQ ID NO: 1320893 - RNA, 14 nt, Human
cguuuccuuuguug

SEQ ID NO: 1320894 - RNA, 17 nt, Human
cguuugaccuuuuaugu

SEQ ID NO: 1320895 - RNA, 12 nt, Human
cguuuucuaauu

SEQ ID NO: 1320896 - RNA, 15 nt, Human
cguuuucuaauugcu

SEQ ID NO: 1320897 - RNA, 17 nt, Human
cguuuucuaauugcuua

SEQ ID NO: 1320898 - RNA, 20 nt, Human
cguuuucuaauugcuuauuu

SEQ ID NO: 1320899 - RNA, 13 nt, Human
cguuuugaagcua

SEQ ID NO: 1320900 - RNA, 20 nt, Human
cguuuugaagcuacugugug

SEQ ID NO: 1320901 - RNA, 14 nt, Human
cguuuucuuaaagu

SEQ ID NO: 1320902 - RNA, 11 nt, Human
cguuuugucac

SEQ ID NO: 1320903 - RNA, 21 nt, Human
cguucaugggggagggggcag

SEQ ID NO: 1320904 - RNA, 18 nt, Human
cguggcugcugugggaaa

SEQ ID NO: 1320905 - RNA, 13 nt, Human
cguggccuuguuc

SEQ ID NO: 1320906 - RNA, 12 nt, Human
cgugccuggcca

SEQ ID NO: 1320907 - RNA, 16 nt, Human
cgugccuggccacgcc

SEQ ID NO: 1320908 - RNA, 12 nt, Human
cgugccuguguc

SEQ ID NO: 1320909 - RNA, 14 nt, Human
cgugccugugucca

SEQ ID NO: 1320910 - RNA, 13 nt, Human
cgugccuucagcu

SEQ ID NO: 1320911 - RNA, 15 nt, Human
cgugccuucagcucu

SEQ ID NO: 1320912 - RNA, 16 nt, Human
cgugccuucagcucua

SEQ ID NO: 1320913 - RNA, 18 nt, Human
cgugccuucagcucuaca

SEQ ID NO: 1320914 - RNA, 15 nt, Human
cgugccuguguccau

SEQ ID NO: 1320915 - RNA, 14 nt, Human
cguggcccuuccug

SEQ ID NO: 1320916 - RNA, 15 nt, Human
cguggcccuuccugg

SEQ ID NO: 1320917 - RNA, 16 nt, Human
cguggcccuuccugga

SEQ ID NO: 1320918 - RNA, 17 nt, Human
cguggcccuuccuggac

SEQ ID NO: 1320919 - RNA, 18 nt, Human
cguggcccuuccuggaca

SEQ ID NO: 1320920 - RNA, 20 nt, Human
cguggcccuuccuggacagc

SEQ ID NO: 1320921 - RNA, 15 nt, Human
cguggccucuugagc

SEQ ID NO: 1320922 - RNA, 16 nt, Human
cguggccucuugagca

SEQ ID NO: 1320923 - RNA, 23 nt, Human
cguggccucuugagcaguggcug

SEQ ID NO: 1320924 - RNA, 22 nt, Human
cguggcccuuccuggacagcug

SEQ ID NO: 1320925 - RNA, 20 nt, Human
cguggccuuguucugucacc

SEQ ID NO: 1320926 - RNA, 14 nt, Human
cguggcucagccag

SEQ ID NO: 1320927 - RNA, 15 nt, Human
cguggcucagccagc

SEQ ID NO: 1320928 - RNA, 18 nt, Human
cguggcucagccagcacu

SEQ ID NO: 1320929 - RNA, 12 nt, Human
cguccuccucug

SEQ ID NO: 1320930 - RNA, 13 nt, Human
cgaucucagcuca

SEQ ID NO: 1320931 - RNA, 14 nt, Human
cgaucucccaccuu

SEQ ID NO: 1320932 - RNA, 20 nt, Human
cgaucuugguucacugcaac

SEQ ID NO: 1320933 - RNA, 18 nt, Human
cgaucuguaccugagagg

SEQ ID NO: 1320934 - RNA, 19 nt, Human
cgauucccucucccaggcc

SEQ ID NO: 1320935 - RNA, 23 nt, Human
cgauucccucucccaggccccau

SEQ ID NO: 1320936 - RNA, 16 nt, Human
cgauucucuugccuca

SEQ ID NO: 1320937 - RNA, 12 nt, Human
cgcagaaggaag

SEQ ID NO: 1320938 - RNA, 11 nt, Human
cgcaaugugac

SEQ ID NO: 1320939 - RNA, 14 nt, Human
cgcaagggccugau

SEQ ID NO: 1320940 - RNA, 14 nt, Human
cgcaaguucccagu

SEQ ID NO: 1320941 - RNA, 21 nt, Human
cgauucccucucccaggcccc

SEQ ID NO: 1320942 - RNA, 12 nt, Human
cgauuguaacuc

SEQ ID NO: 1320943 - RNA, 15 nt, Human
cgagcgcccugcaga

SEQ ID NO: 1320944 - RNA, 16 nt, Human
cgagcgcccugcagac

SEQ ID NO: 1320945 - RNA, 19 nt, Human
cgagcgcccugcagacccu

SEQ ID NO: 1320946 - RNA, 20 nt, Human
cgagcgcccugcagacccug

SEQ ID NO: 1320947 - RNA, 21 nt, Human
cgagcgcccugcagacccugc

SEQ ID NO: 1320948 - RNA, 10 nt, Human
cgagcuccuc

SEQ ID NO: 1320949 - RNA, 16 nt, Human
cgaggaaucugugggu

SEQ ID NO: 1320950 - RNA, 22 nt, Human
cgaggaaucugugggucuggga

SEQ ID NO: 1320951 - RNA, 12 nt, Human
cgaggcugagaa

SEQ ID NO: 1320952 - RNA, 20 nt, Human
cgaggcugagaaucagacug

SEQ ID NO: 1320953 - RNA, 13 nt, Human
cgaggcugagaau

SEQ ID NO: 1320954 - RNA, 20 nt, Human
ccuuuaacugacaagccauc

SEQ ID NO: 1320955 - RNA, 22 nt, Human
ccuuuaacaacauguuuccagc

SEQ ID NO: 1320956 - RNA, 19 nt, Human
ccuuuaacugacaagccau

SEQ ID NO: 1320957 - RNA, 22 nt, Human
ccuuucucucuuuauacagcug

SEQ ID NO: 1320958 - RNA, 23 nt, Human
ccuuucuggauuauucugggggc

SEQ ID NO: 1320959 - RNA, 16 nt, Human
ccuuguuuuggacagu

SEQ ID NO: 1320960 - RNA, 16 nt, Human
ccuuuaacaacauguu

SEQ ID NO: 1320961 - RNA, 17 nt, Human
ccuuuaacaacauguuu

SEQ ID NO: 1320962 - RNA, 21 nt, Human
ccuuuaacaacauguuuccag

SEQ ID NO: 1320963 - RNA, 15 nt, Human
ccuuguuacuucuga

SEQ ID NO: 1320964 - RNA, 16 nt, Human
ccuuguuuggggcagg

SEQ ID NO: 1320965 - RNA, 17 nt, Human
ccuuguuuggggcagga

SEQ ID NO: 1320966 - RNA, 19 nt, Human
ccuuguuuggggcaggagu

SEQ ID NO: 1320967 - RNA, 14 nt, Human
ccuuguuuuuuucu

SEQ ID NO: 1320968 - RNA, 17 nt, Human
ccuuggccaugcagaaa

SEQ ID NO: 1320969 - RNA, 15 nt, Human
ccuuggccaugcaga

SEQ ID NO: 1320970 - RNA, 20 nt, Human
ccuuggcugacaugaagcug

SEQ ID NO: 1320971 - RNA, 15 nt, Human
ccuuugaccugccuc

SEQ ID NO: 1320972 - RNA, 14 nt, Human
ccuuugacaaaggu

SEQ ID NO: 1320973 - RNA, 20 nt, Human
ccuuugaauccucucucugu

SEQ ID NO: 1320974 - RNA, 19 nt, Human
ccuuugagugcaguccuga

SEQ ID NO: 1320975 - RNA, 22 nt, Human
ccuuugagugcaguccugauca

SEQ ID NO: 1320976 - RNA, 21 nt, Human
ccuuugauuaaagacuccagu

SEQ ID NO: 1320977 - RNA, 11 nt, Human
ccuuucuuccg

SEQ ID NO: 1320978 - RNA, 19 nt, Human
ccuuucuuccggccccucc

SEQ ID NO: 1320979 - RNA, 12 nt, Human
ccuuucuuccgg

SEQ ID NO: 1320980 - RNA, 19 nt, Human
ccuuucuuuucccccuuug

SEQ ID NO: 1320981 - RNA, 12 nt, Human
ccuuucuuuucc

SEQ ID NO: 1320982 - RNA, 14 nt, Human
ccuuugaauccucu

SEQ ID NO: 1320983 - RNA, 16 nt, Human
ccuuugaauccucucu

SEQ ID NO: 1320984 - RNA, 20 nt, Human
ccuuuggcaggugcagcccc

SEQ ID NO: 1320985 - RNA, 19 nt, Human
ccuuuggcaggugcagccc

SEQ ID NO: 1320986 - RNA, 18 nt, Human
ccuuuggcaggugcagcc

SEQ ID NO: 1320987 - RNA, 13 nt, Human
ccuuugcugugag

SEQ ID NO: 1320988 - RNA, 17 nt, Human
ccuuugcugugaggcug

SEQ ID NO: 1320989 - RNA, 22 nt, Human
ccuuugcugugaggcuguccug

SEQ ID NO: 1320990 - RNA, 23 nt, Human
ccuuugcugugaggcuguccugu

SEQ ID NO: 1320991 - RNA, 13 nt, Human
ccuuugccaggug

SEQ ID NO: 1320992 - RNA, 16 nt, Human
ccuuugcccagaaaga

SEQ ID NO: 1320993 - RNA, 23 nt, Human
ccuuugcgcuccuggcccagccu

SEQ ID NO: 1320994 - RNA, 14 nt, Human
ccuuugcugacccu

SEQ ID NO: 1320995 - RNA, 17 nt, Human
ccuuugcugacccuccc

SEQ ID NO: 1320996 - RNA, 21 nt, Human
ccuuugcugacccuccccaaa

SEQ ID NO: 1320997 - RNA, 16 nt, Human
ccuuugcugcauggca

SEQ ID NO: 1320998 - RNA, 18 nt, Human
ccuuugcugacccucccc

SEQ ID NO: 1320999 - RNA, 20 nt, Human
cgcuacuaugauuuaauuug

SEQ ID NO: 1321000 - RNA, 18 nt, Human
cgcuagaggaagcagcca

SEQ ID NO: 1321001 - RNA, 14 nt, Human
cgcuagcaguggca

SEQ ID NO: 1321002 - RNA, 15 nt, Human
cgcuagcaguggcag

SEQ ID NO: 1321003 - RNA, 20 nt, Human
cgcuagcaguggcaggcaga

SEQ ID NO: 1321004 - RNA, 15 nt, Human
cgcgaucucagcuca

SEQ ID NO: 1321005 - RNA, 14 nt, Human
cgcgauguggaacu

SEQ ID NO: 1321006 - RNA, 14 nt, Human
cgcgaucucagcuc

SEQ ID NO: 1321007 - RNA, 15 nt, Human
cgcgacuaauuucaa

SEQ ID NO: 1321008 - RNA, 12 nt, Human
cgcccugccacu

SEQ ID NO: 1321009 - RNA, 21 nt, Human
cgcccugcagacccugcccuu

SEQ ID NO: 1321010 - RNA, 22 nt, Human
cgcgacuaauuucaaaaugcuu

SEQ ID NO: 1321011 - RNA, 18 nt, Human
cgcgauguggaacugcug

SEQ ID NO: 1321012 - RNA, 14 nt, Human
cgcgucuacccugg

SEQ ID NO: 1321013 - RNA, 15 nt, Human
cgcgucuacccuggg

SEQ ID NO: 1321014 - RNA, 17 nt, Human
cgcgucuacccugggau

SEQ ID NO: 1321015 - RNA, 16 nt, Human
cgcgucuacccuggga

SEQ ID NO: 1321016 - RNA, 12 nt, Human
cgcgucuuccug

SEQ ID NO: 1321017 - RNA, 13 nt, Human
cgcgucuuccuga

SEQ ID NO: 1321018 - RNA, 14 nt, Human
cgcgucuuccugag

SEQ ID NO: 1321019 - RNA, 16 nt, Human
cgcgucuuccugagug

SEQ ID NO: 1321020 - RNA, 13 nt, Human
cgcagaaggaagg

SEQ ID NO: 1321021 - RNA, 17 nt, Human
cgcagacaccuuggaca

SEQ ID NO: 1321022 - RNA, 15 nt, Human
cgcccagcuccugac

SEQ ID NO: 1321023 - RNA, 22 nt, Human
cgcccagcuccugacacugcug

SEQ ID NO: 1321024 - RNA, 14 nt, Human
cgcccaggacccca

SEQ ID NO: 1321025 - RNA, 12 nt, Human
cgcccaggcugg

SEQ ID NO: 1321026 - RNA, 16 nt, Human
cgcccagcuccugaca

SEQ ID NO: 1321027 - RNA, 19 nt, Human
cgcccaggcuggagugcaa

SEQ ID NO: 1321028 - RNA, 20 nt, Human
cgcccaggcuggagugcaau

SEQ ID NO: 1321029 - RNA, 11 nt, Human
cgcccugcaga

SEQ ID NO: 1321030 - RNA, 12 nt, Human
cgcccugcagac

SEQ ID NO: 1321031 - RNA, 15 nt, Human
cgcccugcagacccu

SEQ ID NO: 1321032 - RNA, 16 nt, Human
cgcccugcagacccug

SEQ ID NO: 1321033 - RNA, 20 nt, Human
cgcccugcagacccugcccu

SEQ ID NO: 1321034 - RNA, 11 nt, Human
cgcccugccac

SEQ ID NO: 1321035 - RNA, 14 nt, Human
cgcccugccacuca

SEQ ID NO: 1321036 - RNA, 17 nt, Human
cgcccccuccgcccugc

SEQ ID NO: 1321037 - RNA, 19 nt, Human
cgcccccuccgcccugcca

SEQ ID NO: 1321038 - RNA, 20 nt, Human
cgcccccuccgcccugccac

SEQ ID NO: 1321039 - RNA, 14 nt, Human
cgcccccuccucua

SEQ ID NO: 1321040 - RNA, 20 nt, Human
cgcccaggcuggagugcagu

SEQ ID NO: 1321041 - RNA, 22 nt, Human
cggaagaagagaucaggaagag

SEQ ID NO: 1321042 - RNA, 21 nt, Human
cggaagaagagaucaggaaga

SEQ ID NO: 1321043 - RNA, 21 nt, Human
cggaauccugucgauuagacu

SEQ ID NO: 1321044 - RNA, 22 nt, Human
cggaauccugucgauuagacug

SEQ ID NO: 1321045 - RNA, 22 nt, Human
cggacaaaaccccccagauauc

SEQ ID NO: 1321046 - RNA, 16 nt, Human
cggacaagacccccag

SEQ ID NO: 1321047 - RNA, 18 nt, Human
cggacaagacccccagca

SEQ ID NO: 1321048 - RNA, 20 nt, Human
cggacaagacccccagcacu

SEQ ID NO: 1321049 - RNA, 17 nt, Human
cgcuauugucaccaggg

SEQ ID NO: 1321050 - RNA, 21 nt, Human
cgcuaucucccugccuccugc

SEQ ID NO: 1321051 - RNA, 18 nt, Human
cgcuaucugggaagcuau

SEQ ID NO: 1321052 - RNA, 16 nt, Human
cgcuauuccagcuguc

SEQ ID NO: 1321053 - RNA, 12 nt, Human
cggaaagaagag

SEQ ID NO: 1321054 - RNA, 18 nt, Human
cggaaagaagagcgagag

SEQ ID NO: 1321055 - RNA, 14 nt, Human
cgcucucaguucuc

SEQ ID NO: 1321056 - RNA, 14 nt, Human
cgcucucuccaggc

SEQ ID NO: 1321057 - RNA, 16 nt, Human
cggaaagaagaaggug

SEQ ID NO: 1321058 - RNA, 20 nt, Human
cggauccuaagcaucuaagu

SEQ ID NO: 1321059 - RNA, 21 nt, Human
cggacuuagaaaaccagcuca

SEQ ID NO: 1321060 - RNA, 22 nt, Human
cggacuuagaaaaccagcucag

SEQ ID NO: 1321061 - RNA, 19 nt, Human
cggauccuaagcaucuaag

SEQ ID NO: 1321062 - RNA, 15 nt, Human
cggaccccagccauc

SEQ ID NO: 1321063 - RNA, 17 nt, Human
cggaccagccuggccca

SEQ ID NO: 1321064 - RNA, 14 nt, Human
cggaccagccuggc

SEQ ID NO: 1321065 - RNA, 13 nt, Human
cggaccagccugg

SEQ ID NO: 1321066 - RNA, 16 nt, Human
cggacgcccaggaccc

SEQ ID NO: 1321067 - RNA, 24 nt, Human
cggauuccaaagaguagaauugca

SEQ ID NO: 1321068 - RNA, 16 nt, Human
cggauuuauuuuucca

SEQ ID NO: 1321069 - RNA, 13 nt, Human
cggauuuuuucca

SEQ ID NO: 1321070 - RNA, 16 nt, Human
cggauuuuuuccaaaa

SEQ ID NO: 1321071 - RNA, 12 nt, Human
cggcaacaucaa

SEQ ID NO: 1321072 - RNA, 17 nt, Human
cggauuuuuuccaaaau

SEQ ID NO: 1321073 - RNA, 14 nt, Human
cggcacagggucug

SEQ ID NO: 1321074 - RNA, 18 nt, Human
cggcacagggucugcucu

SEQ ID NO: 1321075 - RNA, 19 nt, Human
cggcacagggucugcucuu

SEQ ID NO: 1321076 - RNA, 11 nt, Human
cggcaggacac

SEQ ID NO: 1321077 - RNA, 20 nt, Human
cggcagggcgggcagagggc

SEQ ID NO: 1321078 - RNA, 22 nt, Human
cggcagggcgggcagagggcug

SEQ ID NO: 1321079 - RNA, 23 nt, Human
cggcagggcgggcagagggcugg

SEQ ID NO: 1321080 - RNA, 14 nt, Human
cggcaggggccugg

SEQ ID NO: 1321081 - RNA, 14 nt, Human
cgcucucuggccuu

SEQ ID NO: 1321082 - RNA, 21 nt, Human
cggccuguccuccaacaccaa

SEQ ID NO: 1321083 - RNA, 12 nt, Human
cggccuguccuc

SEQ ID NO: 1321084 - RNA, 15 nt, Human
cggccuguccuccaa

SEQ ID NO: 1321085 - RNA, 15 nt, Human
cggccucccaaagug

SEQ ID NO: 1321086 - RNA, 13 nt, Human
cggccugccagga

SEQ ID NO: 1321087 - RNA, 14 nt, Human
cggccugccaggag

SEQ ID NO: 1321088 - RNA, 15 nt, Human
cggccugccaggagg

SEQ ID NO: 1321089 - RNA, 20 nt, Human
cggccugcccccaccccauu

SEQ ID NO: 1321090 - RNA, 22 nt, Human
cggccugccaggaggacccagg

SEQ ID NO: 1321091 - RNA, 17 nt, Human
cggccuccauccugagg

SEQ ID NO: 1321092 - RNA, 16 nt, Human
cggccuccauccugag

SEQ ID NO: 1321093 - RNA, 14 nt, Human
cggccccucccccu

SEQ ID NO: 1321094 - RNA, 17 nt, Human
cggccccuccccuccaa

SEQ ID NO: 1321095 - RNA, 15 nt, Human
cggcaggggccugga

SEQ ID NO: 1321096 - RNA, 17 nt, Human
cggcaggggccuggaga

SEQ ID NO: 1321097 - RNA, 18 nt, Human
cggcaggggccuggagau

SEQ ID NO: 1321098 - RNA, 19 nt, Human
cggcaggggccuggagauc

SEQ ID NO: 1321099 - RNA, 20 nt, Human
cggcccauccccaggcaccu

SEQ ID NO: 1321100 - RNA, 22 nt, Human
cgggagccugaucaccugcccu

SEQ ID NO: 1321101 - RNA, 16 nt, Human
cgggagcucaggaacc

SEQ ID NO: 1321102 - RNA, 22 nt, Human
cggcugggaggagggcaggcau

SEQ ID NO: 1321103 - RNA, 23 nt, Human
cggcugggaggagggcaggcauc

SEQ ID NO: 1321104 - RNA, 15 nt, Human
cggccuuucuagccu

SEQ ID NO: 1321105 - RNA, 16 nt, Human
cggcuggggucccagc

SEQ ID NO: 1321106 - RNA, 18 nt, Human
cggcuggggucccagcag

SEQ ID NO: 1321107 - RNA, 23 nt, Human
cggcuggggucccagcagcugcc

SEQ ID NO: 1321108 - RNA, 11 nt, Human
cggcugugugu

SEQ ID NO: 1321109 - RNA, 20 nt, Human
ccuggaaaccuuccacccag

SEQ ID NO: 1321110 - RNA, 18 nt, Human
ccuggaaaccuuccaccc

SEQ ID NO: 1321111 - RNA, 17 nt, Human
ccuggaaaccuuccacc

SEQ ID NO: 1321112 - RNA, 21 nt, Human
ccuggacagcugugccucgcu

SEQ ID NO: 1321113 - RNA, 22 nt, Human
ccuggacagcugugccucgcuc

SEQ ID NO: 1321114 - RNA, 21 nt, Human
ccuggacaugaagauucuuuc

SEQ ID NO: 1321115 - RNA, 23 nt, Human
ccuggacaugaagauucuuuccc

SEQ ID NO: 1321116 - RNA, 24 nt, Human
ccuggacaugaagauucuuuccca

SEQ ID NO: 1321117 - RNA, 14 nt, Human
ccuggaccagccuc

SEQ ID NO: 1321118 - RNA, 15 nt, Human
ccuggaccagccucu

SEQ ID NO: 1321119 - RNA, 16 nt, Human
ccuggaccagccucuc

SEQ ID NO: 1321120 - RNA, 18 nt, Human
ccuggaccccccuuucac

SEQ ID NO: 1321121 - RNA, 23 nt, Human
ccuggaccccccuuucacaggca

SEQ ID NO: 1321122 - RNA, 24 nt, Human
ccuggaccccccuuucacaggcag

SEQ ID NO: 1321123 - RNA, 13 nt, Human
ccuggaccccugc

SEQ ID NO: 1321124 - RNA, 14 nt, Human
ccuggaccccugca

SEQ ID NO: 1321125 - RNA, 15 nt, Human
ccuggaccccugcau

SEQ ID NO: 1321126 - RNA, 20 nt, Human
ccuggacugugugcucagga

SEQ ID NO: 1321127 - RNA, 17 nt, Human
ccuggacugugugcuca

SEQ ID NO: 1321128 - RNA, 14 nt, Human
ccuggacuccugca

SEQ ID NO: 1321129 - RNA, 22 nt, Human
ccuggacccguucaugggggag

SEQ ID NO: 1321130 - RNA, 23 nt, Human
ccuggacccguucaugggggagg

SEQ ID NO: 1321131 - RNA, 12 nt, Human
ccuggaccucug

SEQ ID NO: 1321132 - RNA, 15 nt, Human
ccuggaccucugaca

SEQ ID NO: 1321133 - RNA, 17 nt, Human
ccuggaccucugacagc

SEQ ID NO: 1321134 - RNA, 18 nt, Human
ccuggaccucugacagca

SEQ ID NO: 1321135 - RNA, 20 nt, Human
ccuggaccucugacagcagc

SEQ ID NO: 1321136 - RNA, 19 nt, Human
ccuggaccucugacagcag

SEQ ID NO: 1321137 - RNA, 19 nt, Human
ccuggacuuggccccugcc

SEQ ID NO: 1321138 - RNA, 13 nt, Human
ccuggacuugccu

SEQ ID NO: 1321139 - RNA, 20 nt, Human
ccuggacuuaagcaucuggc

SEQ ID NO: 1321140 - RNA, 24 nt, Human
ccuggacuuaagcaucuggcucua

SEQ ID NO: 1321141 - RNA, 14 nt, Human
ccuggacuguuuuc

SEQ ID NO: 1321142 - RNA, 21 nt, Human
ccuggagauccuccugcagac

SEQ ID NO: 1321143 - RNA, 21 nt, Human
ccuggagaugacuugaggccu

SEQ ID NO: 1321144 - RNA, 16 nt, Human
ccuggacuugccucug

SEQ ID NO: 1321145 - RNA, 16 nt, Human
ccuggagcacaaagac

SEQ ID NO: 1321146 - RNA, 13 nt, Human
ccuggagcagaag

SEQ ID NO: 1321147 - RNA, 15 nt, Human
ccuggagcagaagca

SEQ ID NO: 1321148 - RNA, 17 nt, Human
ccuggagcagaagcagc

SEQ ID NO: 1321149 - RNA, 21 nt, Human
ccuggagcagaagcagcaacu

SEQ ID NO: 1321150 - RNA, 18 nt, Human
ccuggagcagaccacccc

SEQ ID NO: 1321151 - RNA, 22 nt, Human
ccuggagcagaagcagcaacuu

SEQ ID NO: 1321152 - RNA, 12 nt, Human
ccuggcagccgu

SEQ ID NO: 1321153 - RNA, 18 nt, Human
ccuggcagccgugccuuc

SEQ ID NO: 1321154 - RNA, 19 nt, Human
ccuggcagccgugccuuca

SEQ ID NO: 1321155 - RNA, 12 nt, Human
ccuggcggggug

SEQ ID NO: 1321156 - RNA, 13 nt, Human
ccuggcccccucc

SEQ ID NO: 1321157 - RNA, 15 nt, Human
ccuggcgccuggcag

SEQ ID NO: 1321158 - RNA, 17 nt, Human
ccuggcucucaccucua

SEQ ID NO: 1321159 - RNA, 19 nt, Human
ccuggcucucaccucuagg

SEQ ID NO: 1321160 - RNA, 17 nt, Human
ccuggcucaccuugugc

SEQ ID NO: 1321161 - RNA, 16 nt, Human
ccuggcuauguccuaa

SEQ ID NO: 1321162 - RNA, 21 nt, Human
ccuggcucucaccucuagguc

SEQ ID NO: 1321163 - RNA, 16 nt, Human
ccuggccagugcccug

SEQ ID NO: 1321164 - RNA, 12 nt, Human
ccuggccagugc

SEQ ID NO: 1321165 - RNA, 12 nt, Human
ccuggcccccuc

SEQ ID NO: 1321166 - RNA, 20 nt, Human
ccuggcccccucccuggaug

SEQ ID NO: 1321167 - RNA, 13 nt, Human
ccugggauuacag

SEQ ID NO: 1321168 - RNA, 16 nt, Human
ccugggauucaggaaa

SEQ ID NO: 1321169 - RNA, 18 nt, Human
ccugggauucaggaaaag

SEQ ID NO: 1321170 - RNA, 13 nt, Human
ccugggcaaagcc

SEQ ID NO: 1321171 - RNA, 23 nt, Human
ccugggauucaggaaaaggccug

SEQ ID NO: 1321172 - RNA, 21 nt, Human
ccugggaggcucuggagccca

SEQ ID NO: 1321173 - RNA, 13 nt, Human
ccugggaggcucu

SEQ ID NO: 1321174 - RNA, 13 nt, Human
ccugggaggcagu

SEQ ID NO: 1321175 - RNA, 22 nt, Human
ccugggagggacaugcuuagca

SEQ ID NO: 1321176 - RNA, 21 nt, Human
ccugcuugaugggauucugga

SEQ ID NO: 1321177 - RNA, 22 nt, Human
ccugcuugaugggauucuggac

SEQ ID NO: 1321178 - RNA, 15 nt, Human
ccugcuugccaaggc

SEQ ID NO: 1321179 - RNA, 17 nt, Human
ccugcuugccaaggcag

SEQ ID NO: 1321180 - RNA, 18 nt, Human
ccugcuugccaaggcaga

SEQ ID NO: 1321181 - RNA, 21 nt, Human
ccugcuugccaaggcagaggc

SEQ ID NO: 1321182 - RNA, 23 nt, Human
ccugcuugccaaggcagaggccu

SEQ ID NO: 1321183 - RNA, 22 nt, Human
ccugcuugccaaggcagaggcc

SEQ ID NO: 1321184 - RNA, 23 nt, Human
ccugcuuggggggugaugagggc

SEQ ID NO: 1321185 - RNA, 14 nt, Human
ccuggaaaccuucc

SEQ ID NO: 1321186 - RNA, 16 nt, Human
ccugcuuuuuguguuu

SEQ ID NO: 1321187 - RNA, 17 nt, Human
ccugcuuugggcugccc

SEQ ID NO: 1321188 - RNA, 18 nt, Human
ccugcuuugggcugcccu

SEQ ID NO: 1321189 - RNA, 19 nt, Human
ccugcuuugggcugcccug

SEQ ID NO: 1321190 - RNA, 20 nt, Human
ccugcucccauccugugugu

SEQ ID NO: 1321191 - RNA, 15 nt, Human
ccugcucccauccug

SEQ ID NO: 1321192 - RNA, 14 nt, Human
ccugcuuccugcuu

SEQ ID NO: 1321193 - RNA, 18 nt, Human
ccugcuuccugcuugcca

SEQ ID NO: 1321194 - RNA, 15 nt, Human
ccugcuuccugcuug

SEQ ID NO: 1321195 - RNA, 16 nt, Human
ccugauuuuuuuuccu

SEQ ID NO: 1321196 - RNA, 18 nt, Human
ccugauuuaggagaagcc

SEQ ID NO: 1321197 - RNA, 19 nt, Human
ccugauuuaggagaagcca

SEQ ID NO: 1321198 - RNA, 20 nt, Human
ccugauuuaggagaagccag

SEQ ID NO: 1321199 - RNA, 21 nt, Human
ccugauuuaggagaagccagg

SEQ ID NO: 1321200 - RNA, 22 nt, Human
ccugauuuaggagaagccagga

SEQ ID NO: 1321201 - RNA, 16 nt, Human
ccugcuccagaccuga

SEQ ID NO: 1321202 - RNA, 22 nt, Human
ccugcuccagaccugauccugg

SEQ ID NO: 1321203 - RNA, 18 nt, Human
ccugcuaacggugcucag

SEQ ID NO: 1321204 - RNA, 19 nt, Human
ccugcuaacggugcucagg

SEQ ID NO: 1321205 - RNA, 17 nt, Human
ccugcuaaggucuugga

SEQ ID NO: 1321206 - RNA, 21 nt, Human
ccuggcagccgugccuucagc

SEQ ID NO: 1321207 - RNA, 22 nt, Human
ccugugagcuaggaauuguguu

SEQ ID NO: 1321208 - RNA, 16 nt, Human
ccuguccucuuucagc

SEQ ID NO: 1321209 - RNA, 17 nt, Human
ccuguccucuuucagcu

SEQ ID NO: 1321210 - RNA, 15 nt, Human
ccugugagcccagcu

SEQ ID NO: 1321211 - RNA, 17 nt, Human
ccugugagcccagcugg

SEQ ID NO: 1321212 - RNA, 20 nt, Human
ccugugagcccagcuggguc

SEQ ID NO: 1321213 - RNA, 18 nt, Human
ccuguccucuuucagcuc

SEQ ID NO: 1321214 - RNA, 14 nt, Human
ccuguccccugcua

SEQ ID NO: 1321215 - RNA, 13 nt, Human
ccuguccccugcu

SEQ ID NO: 1321216 - RNA, 13 nt, Human
ccuguccuccaac

SEQ ID NO: 1321217 - RNA, 21 nt, Human
ccuguccuccaacaccaagca

SEQ ID NO: 1321218 - RNA, 22 nt, Human
ccuguccuccaacaccaagcac

SEQ ID NO: 1321219 - RNA, 19 nt, Human
ccuguccucuuucagcucc

SEQ ID NO: 1321220 - RNA, 19 nt, Human
ccuguccagcuccaaccug

SEQ ID NO: 1321221 - RNA, 18 nt, Human
ccuguccacaggcuucug

SEQ ID NO: 1321222 - RNA, 16 nt, Human
ccuguccaaucuuuga

SEQ ID NO: 1321223 - RNA, 14 nt, Human
ccuguccacaggcu

SEQ ID NO: 1321224 - RNA, 21 nt, Human
ccuguccacaggcuucugagc

SEQ ID NO: 1321225 - RNA, 13 nt, Human
ccuguccagcucc

SEQ ID NO: 1321226 - RNA, 14 nt, Human
ccuguccagcucca

SEQ ID NO: 1321227 - RNA, 15 nt, Human
ccuguccagcuccaa

SEQ ID NO: 1321228 - RNA, 20 nt, Human
ccugugccuccucaccccca

SEQ ID NO: 1321229 - RNA, 21 nt, Human
ccugugccuccucacccccag

SEQ ID NO: 1321230 - RNA, 15 nt, Human
ccugugccuccuccc

SEQ ID NO: 1321231 - RNA, 16 nt, Human
ccugugccuccucccu

SEQ ID NO: 1321232 - RNA, 13 nt, Human
ccugugcacagcc

SEQ ID NO: 1321233 - RNA, 12 nt, Human
ccugugcacagc

SEQ ID NO: 1321234 - RNA, 18 nt, Human
ccugugcagccgcugagc

SEQ ID NO: 1321235 - RNA, 20 nt, Human
ccugugcagccgcugagcga

SEQ ID NO: 1321236 - RNA, 21 nt, Human
ccugugcagccgcugagcgag

SEQ ID NO: 1321237 - RNA, 13 nt, Human
ccugugcccccag

SEQ ID NO: 1321238 - RNA, 12 nt, Human
ccugugccuccu

SEQ ID NO: 1321239 - RNA, 15 nt, Human
ccugugccuccucac

SEQ ID NO: 1321240 - RNA, 17 nt, Human
ccugugcaaugcauuag

SEQ ID NO: 1321241 - RNA, 18 nt, Human
ccugugcacaccccacuc

SEQ ID NO: 1321242 - RNA, 22 nt, Human
ccugugcacaccccacucccac

SEQ ID NO: 1321243 - RNA, 23 nt, Human
ccugugcacaccccacucccaca

SEQ ID NO: 1321244 - RNA, 14 nt, Human
ccuggugcuucucc

SEQ ID NO: 1321245 - RNA, 16 nt, Human
ccuggugcuucuccuc

SEQ ID NO: 1321246 - RNA, 20 nt, Human
ccuggugcuucuccucuccu

SEQ ID NO: 1321247 - RNA, 15 nt, Human
ccuggugcugccaca

SEQ ID NO: 1321248 - RNA, 18 nt, Human
ccuggugcugccacacuu

SEQ ID NO: 1321249 - RNA, 21 nt, Human
ccuggugcugccacacuucag

SEQ ID NO: 1321250 - RNA, 15 nt, Human
ccuggugcugccucu

SEQ ID NO: 1321251 - RNA, 20 nt, Human
ccuggugcugccucuaccug

SEQ ID NO: 1321252 - RNA, 13 nt, Human
ccuggugcuggag

SEQ ID NO: 1321253 - RNA, 14 nt, Human
ccuggugcuggagg

SEQ ID NO: 1321254 - RNA, 15 nt, Human
ccuggugcuggaggu

SEQ ID NO: 1321255 - RNA, 20 nt, Human
ccuguacuguucugugucuu

SEQ ID NO: 1321256 - RNA, 18 nt, Human
ccuguacuguucuguguc

SEQ ID NO: 1321257 - RNA, 13 nt, Human
ccuguagaguugc

SEQ ID NO: 1321258 - RNA, 14 nt, Human
ccuguagaguugcu

SEQ ID NO: 1321259 - RNA, 16 nt, Human
ccuguagaguugcuga

SEQ ID NO: 1321260 - RNA, 17 nt, Human
ccuguagaguugcugag

SEQ ID NO: 1321261 - RNA, 15 nt, Human
ccuguagcacuuacu

SEQ ID NO: 1321262 - RNA, 17 nt, Human
ccuguacacaacucacu

SEQ ID NO: 1321263 - RNA, 22 nt, Human
ccuguaccuuuugaggagcccc

SEQ ID NO: 1321264 - RNA, 23 nt, Human
ccuguaccuuuugaggagcccca

SEQ ID NO: 1321265 - RNA, 13 nt, Human
ccuguacugccug

SEQ ID NO: 1321266 - RNA, 14 nt, Human
ccuguacugccugc

SEQ ID NO: 1321267 - RNA, 15 nt, Human
ccuguacugccugcu

SEQ ID NO: 1321268 - RNA, 16 nt, Human
ccuguacugccugcuu

SEQ ID NO: 1321269 - RNA, 17 nt, Human
ccuguacugccugcuug

SEQ ID NO: 1321270 - RNA, 17 nt, Human
ccuguacuguucugugu

SEQ ID NO: 1321271 - RNA, 17 nt, Human
ccuguagcacuuacugg

SEQ ID NO: 1321272 - RNA, 20 nt, Human
ccuguaggaagguacuguau

SEQ ID NO: 1321273 - RNA, 21 nt, Human
ccuguagauucagguaauaca

SEQ ID NO: 1321274 - RNA, 17 nt, Human
ccuguaugucuccagua

SEQ ID NO: 1321275 - RNA, 15 nt, Human
ccuguauucagacag

SEQ ID NO: 1321276 - RNA, 16 nt, Human
ccuguauucagacaga

SEQ ID NO: 1321277 - RNA, 23 nt, Human
ccuguauuccugaccuccgccau

SEQ ID NO: 1321278 - RNA, 19 nt, Human
ccuguauuccugaccuccg

SEQ ID NO: 1321279 - RNA, 16 nt, Human
ccuguauuuguuccca

SEQ ID NO: 1321280 - RNA, 19 nt, Human
ccuguauuuguucccaaga

SEQ ID NO: 1321281 - RNA, 21 nt, Human
ccuguauuuguucccaagagc

SEQ ID NO: 1321282 - RNA, 22 nt, Human
ccuguauuuguucccaagagca

SEQ ID NO: 1321283 - RNA, 14 nt, Human
ccuugaugaagaag

SEQ ID NO: 1321284 - RNA, 20 nt, Human
ccuugaucagccccacccug

SEQ ID NO: 1321285 - RNA, 18 nt, Human
ccuugaucagccccaccc

SEQ ID NO: 1321286 - RNA, 15 nt, Human
ccuuggcaccagaca

SEQ ID NO: 1321287 - RNA, 20 nt, Human
ccuuggcaccagacacccag

SEQ ID NO: 1321288 - RNA, 21 nt, Human
ccuuggcaccagacacccagg

SEQ ID NO: 1321289 - RNA, 22 nt, Human
ccuuggcaccagacacccagga

SEQ ID NO: 1321290 - RNA, 23 nt, Human
ccuuggcaccagacacccaggac

SEQ ID NO: 1321291 - RNA, 16 nt, Human
ccuugacaacuggcag

SEQ ID NO: 1321292 - RNA, 21 nt, Human
ccuugacaacuggcaggcagg

SEQ ID NO: 1321293 - RNA, 14 nt, Human
ccuugacaccugcu

SEQ ID NO: 1321294 - RNA, 12 nt, Human
ccuugaaugugg

SEQ ID NO: 1321295 - RNA, 17 nt, Human
ccuugaaaaaaaacagu

SEQ ID NO: 1321296 - RNA, 15 nt, Human
ccuugacaacuggca

SEQ ID NO: 1321297 - RNA, 14 nt, Human
ccuucuuuuucuuc

SEQ ID NO: 1321298 - RNA, 16 nt, Human
ccuucuuuuucuucuu

SEQ ID NO: 1321299 - RNA, 13 nt, Human
ccuuccuggacag

SEQ ID NO: 1321300 - RNA, 16 nt, Human
ccuuccuggacagcug

SEQ ID NO: 1321301 - RNA, 19 nt, Human
ccuucuuucuacccugcug

SEQ ID NO: 1321302 - RNA, 20 nt, Human
ccuugaaaacuuuaugcuaa

SEQ ID NO: 1321303 - RNA, 13 nt, Human
ccuuccacccagu

SEQ ID NO: 1321304 - RNA, 15 nt, Human
ccuuccacccagggg

SEQ ID NO: 1321305 - RNA, 18 nt, Human
ccuuccaaugucuggaga

SEQ ID NO: 1321306 - RNA, 19 nt, Human
ccuuccaaugucuggagac

SEQ ID NO: 1321307 - RNA, 21 nt, Human
ccuuccaaugucuggagacca

SEQ ID NO: 1321308 - RNA, 20 nt, Human
ccuuccaaugucuggagacc

SEQ ID NO: 1321309 - RNA, 13 nt, Human
ccuuccacccagg

SEQ ID NO: 1321310 - RNA, 14 nt, Human
ccuuccacccaggg

SEQ ID NO: 1321311 - RNA, 14 nt, Human
ccuucaucuggaac

SEQ ID NO: 1321312 - RNA, 17 nt, Human
ccuuccaaugucuggag

SEQ ID NO: 1321313 - RNA, 20 nt, Human
ccuucaucuggauuccagag

SEQ ID NO: 1321314 - RNA, 13 nt, Human
ccuucaucuggaa

SEQ ID NO: 1321315 - RNA, 18 nt, Human
ccuucauaucauccacac

SEQ ID NO: 1321316 - RNA, 19 nt, Human
ccuucauaucauccacaca

SEQ ID NO: 1321317 - RNA, 24 nt, Human
ccuucaguacccucucagcuccag

SEQ ID NO: 1321318 - RNA, 18 nt, Human
ccuucaguuaugauuuuu

SEQ ID NO: 1321319 - RNA, 15 nt, Human
ccuucauacuugaac

SEQ ID NO: 1321320 - RNA, 19 nt, Human
ccuucauacuugaacguuu

SEQ ID NO: 1321321 - RNA, 20 nt, Human
ccuucauacuugaacguuuu

SEQ ID NO: 1321322 - RNA, 17 nt, Human
ccuucaguacccucuca

SEQ ID NO: 1321323 - RNA, 19 nt, Human
ccuucaguacccucucagc

SEQ ID NO: 1321324 - RNA, 20 nt, Human
ccuucaguacccucucagcu

SEQ ID NO: 1321325 - RNA, 23 nt, Human
ccuucaguacccucucagcucca

SEQ ID NO: 1321326 - RNA, 18 nt, Human
ccuucaagcucugaggga

SEQ ID NO: 1321327 - RNA, 19 nt, Human
ccuuccaugucgccucugc

SEQ ID NO: 1321328 - RNA, 20 nt, Human
ccuuccaugucgccucugca

SEQ ID NO: 1321329 - RNA, 21 nt, Human
ccuuccaugucgccucugcau

SEQ ID NO: 1321330 - RNA, 23 nt, Human
ccuuccaugucgccucugcauuc

SEQ ID NO: 1321331 - RNA, 17 nt, Human
ccuuccacugagggcag

SEQ ID NO: 1321332 - RNA, 15 nt, Human
ccuuccacugagggc

SEQ ID NO: 1321333 - RNA, 14 nt, Human
ccuuccagaaaaca

SEQ ID NO: 1321334 - RNA, 20 nt, Human
ccuuccucuuuuccuuccca

SEQ ID NO: 1321335 - RNA, 10 nt, Human
ccuucccaaa

SEQ ID NO: 1321336 - RNA, 20 nt, Human
ccuucgauacaccgggccug

SEQ ID NO: 1321337 - RNA, 22 nt, Human
ccuucgauacaccgggccugga

SEQ ID NO: 1321338 - RNA, 23 nt, Human
ccuucgauacaccgggccuggag

SEQ ID NO: 1321339 - RNA, 13 nt, Human
ccuucgccaccug

SEQ ID NO: 1321340 - RNA, 16 nt, Human
ccuuccugccagcccc

SEQ ID NO: 1321341 - RNA, 17 nt, Human
ccuuccugccagccccu

SEQ ID NO: 1321342 - RNA, 23 nt, Human
ccuuccugccccaacuccuucca

SEQ ID NO: 1321343 - RNA, 17 nt, Human
ccuuccuggacagcugu

SEQ ID NO: 1321344 - RNA, 24 nt, Human
ccuguggaacauaaaaaggacauc

SEQ ID NO: 1321345 - RNA, 23 nt, Human
ccuguggaacauaaaaaggacau

SEQ ID NO: 1321346 - RNA, 19 nt, Human
ccuguggaacauaaaaagg

SEQ ID NO: 1321347 - RNA, 22 nt, Human
ccugugcuucgggcccuuccca

SEQ ID NO: 1321348 - RNA, 18 nt, Human
ccuguggccccacccugg

SEQ ID NO: 1321349 - RNA, 20 nt, Human
ccuguggccccacccugggc

SEQ ID NO: 1321350 - RNA, 22 nt, Human
ccuguggccccacccugggccc

SEQ ID NO: 1321351 - RNA, 17 nt, Human
ccuguggccaugacccu

SEQ ID NO: 1321352 - RNA, 22 nt, Human
ccuguggccaugacccugccuc

SEQ ID NO: 1321353 - RNA, 15 nt, Human
ccuguggccccaccc

SEQ ID NO: 1321354 - RNA, 16 nt, Human
ccuguggccccacccu

SEQ ID NO: 1321355 - RNA, 17 nt, Human
ccuguggccccacccug

SEQ ID NO: 1321356 - RNA, 17 nt, Human
ccuuacccuccuuggga

SEQ ID NO: 1321357 - RNA, 21 nt, Human
ccuuacccugccccagcuggg

SEQ ID NO: 1321358 - RNA, 23 nt, Human
ccuguggccaugacccugccucu

SEQ ID NO: 1321359 - RNA, 15 nt, Human
ccuuacuuuuuauau

SEQ ID NO: 1321360 - RNA, 18 nt, Human
ccuuacuuuuuauauaua

SEQ ID NO: 1321361 - RNA, 14 nt, Human
ccuuagaaccuuuc

SEQ ID NO: 1321362 - RNA, 15 nt, Human
ccuuagaaccuuucu

SEQ ID NO: 1321363 - RNA, 16 nt, Human
ccuuagaaccuuucuu

SEQ ID NO: 1321364 - RNA, 18 nt, Human
ccuuagaaccuuucuuac

SEQ ID NO: 1321365 - RNA, 17 nt, Human
ccuuacuuuuuauauau

SEQ ID NO: 1321366 - RNA, 15 nt, Human
ccuuagaccaccaag

SEQ ID NO: 1321367 - RNA, 16 nt, Human
ccuuagaccaccaagc

SEQ ID NO: 1321368 - RNA, 15 nt, Human
ccuucaaagcaaaug

SEQ ID NO: 1321369 - RNA, 14 nt, Human
ccuuauuuucaaga

SEQ ID NO: 1321370 - RNA, 18 nt, Human
ccuuauuuucaagaaacu

SEQ ID NO: 1321371 - RNA, 21 nt, Human
ccuuagaccaccaagccuuga

SEQ ID NO: 1321372 - RNA, 18 nt, Human
ccuuagaccaccaagccu

SEQ ID NO: 1321373 - RNA, 16 nt, Human
ccuuagacucuuuucc

SEQ ID NO: 1321374 - RNA, 20 nt, Human
ccuuagacucuuuuccuucc

SEQ ID NO: 1321375 - RNA, 17 nt, Human
ccuuagacucuuuuccu

SEQ ID NO: 1321376 - RNA, 14 nt, Human
ccuuagaucuggca

SEQ ID NO: 1321377 - RNA, 19 nt, Human
ccuucaaagcaaaugucuu

SEQ ID NO: 1321378 - RNA, 14 nt, Human
ccuucaaccauucc

SEQ ID NO: 1321379 - RNA, 22 nt, Human
ccuucaacaauucuaaaaugau

SEQ ID NO: 1321380 - RNA, 14 nt, Human
ccuucaacccgaga

SEQ ID NO: 1321381 - RNA, 18 nt, Human
ccuucaagaaaacaggca

SEQ ID NO: 1321382 - RNA, 13 nt, Human
ccuucaagcucug

SEQ ID NO: 1321383 - RNA, 14 nt, Human
ccuucaagcucuga

SEQ ID NO: 1321384 - RNA, 15 nt, Human
ccuucaagcucugag

SEQ ID NO: 1321385 - RNA, 16 nt, Human
ccuucaagcucugagg

SEQ ID NO: 1321386 - RNA, 21 nt, Human
ccuucaagcucugagggaaag

SEQ ID NO: 1321387 - RNA, 23 nt, Human
ccucugcagucucuauaccaaua

SEQ ID NO: 1321388 - RNA, 17 nt, Human
ccucugcagucucuaua

SEQ ID NO: 1321389 - RNA, 16 nt, Human
ccucugcagucucuau

SEQ ID NO: 1321390 - RNA, 16 nt, Human
ccucugcauccucugg

SEQ ID NO: 1321391 - RNA, 17 nt, Human
ccucugcauccucugga

SEQ ID NO: 1321392 - RNA, 18 nt, Human
ccucugcauccucuggag

SEQ ID NO: 1321393 - RNA, 19 nt, Human
ccucugccaaaggauguga

SEQ ID NO: 1321394 - RNA, 16 nt, Human
ccucugcacucccacc

SEQ ID NO: 1321395 - RNA, 20 nt, Human
ccucugcacacccuccagag

SEQ ID NO: 1321396 - RNA, 19 nt, Human
ccucugcacacccuccaga

SEQ ID NO: 1321397 - RNA, 19 nt, Human
ccucugcaccuuugcacgu

SEQ ID NO: 1321398 - RNA, 20 nt, Human
ccucugcacuacugacaugu

SEQ ID NO: 1321399 - RNA, 21 nt, Human
ccucugcacuacugacaugug

SEQ ID NO: 1321400 - RNA, 21 nt, Human
ccucuggcuuggccacagcca

SEQ ID NO: 1321401 - RNA, 23 nt, Human
ccucuggcuuggccacagccagg

SEQ ID NO: 1321402 - RNA, 12 nt, Human
ccucugggcucu

SEQ ID NO: 1321403 - RNA, 14 nt, Human
ccucugggcucuga

SEQ ID NO: 1321404 - RNA, 16 nt, Human
ccucugggcucugagu

SEQ ID NO: 1321405 - RNA, 15 nt, Human
ccucugggggguggc

SEQ ID NO: 1321406 - RNA, 19 nt, Human
ccucugggggguggccagg

SEQ ID NO: 1321407 - RNA, 20 nt, Human
ccucugggggguggccaggc

SEQ ID NO: 1321408 - RNA, 19 nt, Human
ccucugguaaccucuuacu

SEQ ID NO: 1321409 - RNA, 16 nt, Human
ccucuggucgcuccug

SEQ ID NO: 1321410 - RNA, 16 nt, Human
ccucuggcuccagcug

SEQ ID NO: 1321411 - RNA, 17 nt, Human
ccucuggcuccagcugg

SEQ ID NO: 1321412 - RNA, 18 nt, Human
ccucuggcuuggccacag

SEQ ID NO: 1321413 - RNA, 20 nt, Human
ccucuggcuuggccacagcc

SEQ ID NO: 1321414 - RNA, 20 nt, Human
ccucugccaaaggaugugau

SEQ ID NO: 1321415 - RNA, 22 nt, Human
ccucugccaaaggaugugauau

SEQ ID NO: 1321416 - RNA, 19 nt, Human
ccucugcauccucuggagc

SEQ ID NO: 1321417 - RNA, 22 nt, Human
ccucugcuuucuccuuuaauug

SEQ ID NO: 1321418 - RNA, 16 nt, Human
ccucuggagccagccg

SEQ ID NO: 1321419 - RNA, 17 nt, Human
ccucuggaggggugugg

SEQ ID NO: 1321420 - RNA, 20 nt, Human
ccucuggagggguguggcuc

SEQ ID NO: 1321421 - RNA, 22 nt, Human
ccucuggagggguguggcuccu

SEQ ID NO: 1321422 - RNA, 14 nt, Human
ccucuggagccagc

SEQ ID NO: 1321423 - RNA, 21 nt, Human
ccucuggcauuagaauuauuu

SEQ ID NO: 1321424 - RNA, 23 nt, Human
ccucuggcauuagaauuauuuaa

SEQ ID NO: 1321425 - RNA, 13 nt, Human
ccucucuggagaa

SEQ ID NO: 1321426 - RNA, 22 nt, Human
ccucucuggagaaagggcccug

SEQ ID NO: 1321427 - RNA, 23 nt, Human
ccucucuggagaaagggcccugg

SEQ ID NO: 1321428 - RNA, 11 nt, Human
ccucucuuccu

SEQ ID NO: 1321429 - RNA, 12 nt, Human
ccucucuuccuc

SEQ ID NO: 1321430 - RNA, 13 nt, Human
ccucucugcccua

SEQ ID NO: 1321431 - RNA, 12 nt, Human
ccucucugcucu

SEQ ID NO: 1321432 - RNA, 15 nt, Human
ccucucugcucugcg

SEQ ID NO: 1321433 - RNA, 16 nt, Human
ccucucugcucugcgu

SEQ ID NO: 1321434 - RNA, 12 nt, Human
ccucucuggaga

SEQ ID NO: 1321435 - RNA, 22 nt, Human
ccucuccccagggaagcagcag

SEQ ID NO: 1321436 - RNA, 21 nt, Human
ccucuccccagguccagcucu

SEQ ID NO: 1321437 - RNA, 23 nt, Human
ccucuccccagguccagcucugg

SEQ ID NO: 1321438 - RNA, 18 nt, Human
ccucuccccucagccucu

SEQ ID NO: 1321439 - RNA, 12 nt, Human
ccucuccccuca

SEQ ID NO: 1321440 - RNA, 15 nt, Human
ccucuccccucagcc

SEQ ID NO: 1321441 - RNA, 16 nt, Human
ccucuccccucagccu

SEQ ID NO: 1321442 - RNA, 12 nt, Human
ccucuccccugc

SEQ ID NO: 1321443 - RNA, 13 nt, Human
ccucuccccugcc

SEQ ID NO: 1321444 - RNA, 16 nt, Human
ccucuccccugccccc

SEQ ID NO: 1321445 - RNA, 20 nt, Human
ccucuccccugcccccugca

SEQ ID NO: 1321446 - RNA, 21 nt, Human
ccucuccccugcccccugcag

SEQ ID NO: 1321447 - RNA, 22 nt, Human
ccucuccccugcccccugcagg

SEQ ID NO: 1321448 - RNA, 15 nt, Human
ccucuccccugccug

SEQ ID NO: 1321449 - RNA, 23 nt, Human
ccucuccccugcccccugcagga

SEQ ID NO: 1321450 - RNA, 16 nt, Human
ccucucccaggcccca

SEQ ID NO: 1321451 - RNA, 17 nt, Human
ccucucccaggccccau

SEQ ID NO: 1321452 - RNA, 18 nt, Human
ccucucccaggccccaug

SEQ ID NO: 1321453 - RNA, 12 nt, Human
ccucucccaguu

SEQ ID NO: 1321454 - RNA, 13 nt, Human
ccucucccaguug

SEQ ID NO: 1321455 - RNA, 15 nt, Human
ccucucccaguuguc

SEQ ID NO: 1321456 - RNA, 18 nt, Human
ccucuccccagcccagag

SEQ ID NO: 1321457 - RNA, 19 nt, Human
ccucuccccagcccagaga

SEQ ID NO: 1321458 - RNA, 20 nt, Human
ccucuccccagcccagagac

SEQ ID NO: 1321459 - RNA, 21 nt, Human
ccucuccccagcccagagaca

SEQ ID NO: 1321460 - RNA, 12 nt, Human
ccucuccacugc

SEQ ID NO: 1321461 - RNA, 13 nt, Human
ccucuccacugcc

SEQ ID NO: 1321462 - RNA, 14 nt, Human
ccucuccacugccu

SEQ ID NO: 1321463 - RNA, 16 nt, Human
ccucuccacugccuuc

SEQ ID NO: 1321464 - RNA, 19 nt, Human
ccucuccacugccuucgau

SEQ ID NO: 1321465 - RNA, 14 nt, Human
ccucucccaggcag

SEQ ID NO: 1321466 - RNA, 19 nt, Human
ccucucccaggcaggggcc

SEQ ID NO: 1321467 - RNA, 22 nt, Human
ccucucccaggcaggggcccgc

SEQ ID NO: 1321468 - RNA, 13 nt, Human
ccucucccaggcc

SEQ ID NO: 1321469 - RNA, 14 nt, Human
ccucucccaggccc

SEQ ID NO: 1321470 - RNA, 15 nt, Human
ccucucccaggcccc

SEQ ID NO: 1321471 - RNA, 23 nt, Human
ccucucccaggccccaugaccuc

SEQ ID NO: 1321472 - RNA, 18 nt, Human
ccuccuuaucaaaggaca

SEQ ID NO: 1321473 - RNA, 20 nt, Human
ccuccuuaucaaaggacacc

SEQ ID NO: 1321474 - RNA, 23 nt, Human
ccuccuguugggagagggcgcag

SEQ ID NO: 1321475 - RNA, 23 nt, Human
ccucuccacucaugugacucuuu

SEQ ID NO: 1321476 - RNA, 23 nt, Human
ccucucaggauccaagcuaagca

SEQ ID NO: 1321477 - RNA, 13 nt, Human
ccucucagcucca

SEQ ID NO: 1321478 - RNA, 16 nt, Human
ccucucagcuccaggu

SEQ ID NO: 1321479 - RNA, 18 nt, Human
ccucucagcuccaggugg

SEQ ID NO: 1321480 - RNA, 15 nt, Human
ccucucaggauccaa

SEQ ID NO: 1321481 - RNA, 18 nt, Human
ccucucaggauccaagcu

SEQ ID NO: 1321482 - RNA, 11 nt, Human
ccucucagccc

SEQ ID NO: 1321483 - RNA, 13 nt, Human
ccucucagcccuc

SEQ ID NO: 1321484 - RNA, 14 nt, Human
ccucucagcccuca

SEQ ID NO: 1321485 - RNA, 17 nt, Human
ccuccugggaaugaagc

SEQ ID NO: 1321486 - RNA, 13 nt, Human
ccuccuggacucc

SEQ ID NO: 1321487 - RNA, 19 nt, Human
ccuccugccggcuccuugg

SEQ ID NO: 1321488 - RNA, 21 nt, Human
ccuccugggcccucucugcuc

SEQ ID NO: 1321489 - RNA, 19 nt, Human
ccuccugcagaccacgccc

SEQ ID NO: 1321490 - RNA, 14 nt, Human
ccuccucugcccgg

SEQ ID NO: 1321491 - RNA, 15 nt, Human
ccuccucugcccggg

SEQ ID NO: 1321492 - RNA, 21 nt, Human
ccuccucugcacucccaccug

SEQ ID NO: 1321493 - RNA, 14 nt, Human
ccuccuccuggacu

SEQ ID NO: 1321494 - RNA, 21 nt, Human
ccucccucaaccucauccucu

SEQ ID NO: 1321495 - RNA, 17 nt, Human
ccucccucaaccucauc

SEQ ID NO: 1321496 - RNA, 22 nt, Human
ccucccuacccuaaccaaguuc

SEQ ID NO: 1321497 - RNA, 16 nt, Human
ccucccggugcccaag

SEQ ID NO: 1321498 - RNA, 13 nt, Human
ccucccggugccc

SEQ ID NO: 1321499 - RNA, 17 nt, Human
ccuccccucuccuuccu

SEQ ID NO: 1321500 - RNA, 15 nt, Human
ccucccuccccuugc

SEQ ID NO: 1321501 - RNA, 14 nt, Human
ccucccucccucuc

SEQ ID NO: 1321502 - RNA, 15 nt, Human
ccucccucccucucc

SEQ ID NO: 1321503 - RNA, 19 nt, Human
ccucccugaagccuuugca

SEQ ID NO: 1321504 - RNA, 13 nt, Human
ccucccugccccu

SEQ ID NO: 1321505 - RNA, 22 nt, Human
ccucccugagcuagaacccucu

SEQ ID NO: 1321506 - RNA, 23 nt, Human
ccucccugagcuagaacccucug

SEQ ID NO: 1321507 - RNA, 21 nt, Human
ccuccuccccaacuguggggg

SEQ ID NO: 1321508 - RNA, 13 nt, Human
ccuccuccccacu

SEQ ID NO: 1321509 - RNA, 14 nt, Human
ccuccuccccacuu

SEQ ID NO: 1321510 - RNA, 13 nt, Human
ccuccucccuccc

SEQ ID NO: 1321511 - RNA, 14 nt, Human
ccuccucccucccu

SEQ ID NO: 1321512 - RNA, 20 nt, Human
ccucagaaaacaaggaugaa

SEQ ID NO: 1321513 - RNA, 21 nt, Human
ccucacuaggcuucugguuga

SEQ ID NO: 1321514 - RNA, 21 nt, Human
ccucacuaucccggcugcccu

SEQ ID NO: 1321515 - RNA, 22 nt, Human
ccucacuaucccggcugcccuu

SEQ ID NO: 1321516 - RNA, 18 nt, Human
ccucacuuuuaaugaaca

SEQ ID NO: 1321517 - RNA, 22 nt, Human
ccucacuuuuaaugaacaaaug

SEQ ID NO: 1321518 - RNA, 15 nt, Human
ccucagacucuaaga

SEQ ID NO: 1321519 - RNA, 19 nt, Human
ccucagacucuaagaaaga

SEQ ID NO: 1321520 - RNA, 20 nt, Human
ccucagacucuaagaaagaa

SEQ ID NO: 1321521 - RNA, 21 nt, Human
ccucagacucuaagaaagaac

SEQ ID NO: 1321522 - RNA, 18 nt, Human
ccucagccacuugccugu

SEQ ID NO: 1321523 - RNA, 14 nt, Human
ccucagggcaaagc

SEQ ID NO: 1321524 - RNA, 15 nt, Human
ccucagggcaaagcc

SEQ ID NO: 1321525 - RNA, 16 nt, Human
ccucagggcaaagcca

SEQ ID NO: 1321526 - RNA, 17 nt, Human
ccucagggcaaagccag

SEQ ID NO: 1321527 - RNA, 21 nt, Human
ccucagggcaaagccaggucc

SEQ ID NO: 1321528 - RNA, 22 nt, Human
ccucagggcaaagccagguccc

SEQ ID NO: 1321529 - RNA, 16 nt, Human
ccucagggcuccuugu

SEQ ID NO: 1321530 - RNA, 22 nt, Human
ccucagggcuccuugugggccu

SEQ ID NO: 1321531 - RNA, 23 nt, Human
ccucagggcuccuugugggccug

SEQ ID NO: 1321532 - RNA, 13 nt, Human
ccucaggggucug

SEQ ID NO: 1321533 - RNA, 16 nt, Human
ccucaggggucugagc

SEQ ID NO: 1321534 - RNA, 18 nt, Human
ccucaggggucugagcuc

SEQ ID NO: 1321535 - RNA, 22 nt, Human
ccucaggggucugagcuccagc

SEQ ID NO: 1321536 - RNA, 21 nt, Human
ccucagguaaucgaccugccu

SEQ ID NO: 1321537 - RNA, 22 nt, Human
ccucagguaaucgaccugccuc

SEQ ID NO: 1321538 - RNA, 23 nt, Human
ccucagguaaucgaccugccucg

SEQ ID NO: 1321539 - RNA, 23 nt, Human
ccucaggggucugagcuccagcu

SEQ ID NO: 1321540 - RNA, 14 nt, Human
ccucagucucccuc

SEQ ID NO: 1321541 - RNA, 15 nt, Human
ccucaguagucccug

SEQ ID NO: 1321542 - RNA, 18 nt, Human
ccucaguagucccugcac

SEQ ID NO: 1321543 - RNA, 19 nt, Human
ccucaguagucccugcaca

SEQ ID NO: 1321544 - RNA, 21 nt, Human
ccucaguagucccugcacagu

SEQ ID NO: 1321545 - RNA, 20 nt, Human
ccugaacaggauauucucac

SEQ ID NO: 1321546 - RNA, 21 nt, Human
ccugaacaagaauuggaagcu

SEQ ID NO: 1321547 - RNA, 16 nt, Human
ccugaaccccagggcu

SEQ ID NO: 1321548 - RNA, 18 nt, Human
ccugaaccccagggcugu

SEQ ID NO: 1321549 - RNA, 17 nt, Human
ccugaaccccagggcug

SEQ ID NO: 1321550 - RNA, 17 nt, Human
ccugaacugaacaccau

SEQ ID NO: 1321551 - RNA, 13 nt, Human
ccugaagaaccag

SEQ ID NO: 1321552 - RNA, 16 nt, Human
ccugaagaaccagucc

SEQ ID NO: 1321553 - RNA, 23 nt, Human
ccugaagcuaucguaaaauuaag

SEQ ID NO: 1321554 - RNA, 22 nt, Human
ccugaagcuaucguaaaauuaa

SEQ ID NO: 1321555 - RNA, 17 nt, Human
ccugaagaaccaguccc

SEQ ID NO: 1321556 - RNA, 12 nt, Human
ccugaaguauuu

SEQ ID NO: 1321557 - RNA, 17 nt, Human
ccugaauccaaacuaau

SEQ ID NO: 1321558 - RNA, 20 nt, Human
ccugaauccaaacuaaucca

SEQ ID NO: 1321559 - RNA, 21 nt, Human
ccugaauccaaacuaauccau

SEQ ID NO: 1321560 - RNA, 15 nt, Human
ccugaaugcucugua

SEQ ID NO: 1321561 - RNA, 16 nt, Human
ccugaaugcucuguag

SEQ ID NO: 1321562 - RNA, 15 nt, Human
ccugaauucuuuuuc

SEQ ID NO: 1321563 - RNA, 15 nt, Human
ccucuuccucccuca

SEQ ID NO: 1321564 - RNA, 16 nt, Human
ccucuuccucccucau

SEQ ID NO: 1321565 - RNA, 19 nt, Human
ccucuuccucccucauucc

SEQ ID NO: 1321566 - RNA, 21 nt, Human
ccucuuccuacuggucucucu

SEQ ID NO: 1321567 - RNA, 18 nt, Human
ccucuuccgugacgucac

SEQ ID NO: 1321568 - RNA, 15 nt, Human
ccucuuccuacuggu

SEQ ID NO: 1321569 - RNA, 19 nt, Human
ccucuuccuacuggucucu

SEQ ID NO: 1321570 - RNA, 23 nt, Human
ccugaaagaggaaugaaguacuc

SEQ ID NO: 1321571 - RNA, 15 nt, Human
ccugaaagaggcuga

SEQ ID NO: 1321572 - RNA, 19 nt, Human
ccugaaagaggcugaggcc

SEQ ID NO: 1321573 - RNA, 22 nt, Human
ccugaaagaggcugaggccugg

SEQ ID NO: 1321574 - RNA, 21 nt, Human
ccugaaaaaaaaccugagauu

SEQ ID NO: 1321575 - RNA, 14 nt, Human
ccugaaauuccaaa

SEQ ID NO: 1321576 - RNA, 15 nt, Human
ccugaaauuccaaag

SEQ ID NO: 1321577 - RNA, 16 nt, Human
ccugaaauuccaaagu

SEQ ID NO: 1321578 - RNA, 18 nt, Human
ccugaaauuccaaagucu

SEQ ID NO: 1321579 - RNA, 14 nt, Human
ccugaaauuucaga

SEQ ID NO: 1321580 - RNA, 15 nt, Human
ccugaaauuucagau

SEQ ID NO: 1321581 - RNA, 13 nt, Human
ccugaacaagaau

SEQ ID NO: 1321582 - RNA, 15 nt, Human
ccugaacaagaauug

SEQ ID NO: 1321583 - RNA, 16 nt, Human
ccugaacaagaauugg

SEQ ID NO: 1321584 - RNA, 17 nt, Human
ccugaacaagaauugga

SEQ ID NO: 1321585 - RNA, 18 nt, Human
ccugaaagaggaaugaag

SEQ ID NO: 1321586 - RNA, 17 nt, Human
ccugaaaacacugugca

SEQ ID NO: 1321587 - RNA, 17 nt, Human
ccucuuuuccuucccaa

SEQ ID NO: 1321588 - RNA, 21 nt, Human
ccucuuuuuaaaguucaaacu

SEQ ID NO: 1321589 - RNA, 23 nt, Human
ccucuuuuuccaacuuggcugca

SEQ ID NO: 1321590 - RNA, 13 nt, Human
ccucuuuuuucgu

SEQ ID NO: 1321591 - RNA, 19 nt, Human
ccucuuuuuucguuuguuu

SEQ ID NO: 1321592 - RNA, 23 nt, Human
ccucuuagaugcaguucugaaga

SEQ ID NO: 1321593 - RNA, 17 nt, Human
ccucuuaaauaaaccuu

SEQ ID NO: 1321594 - RNA, 18 nt, Human
ccucuuaaauaaaccuuu

SEQ ID NO: 1321595 - RNA, 20 nt, Human
ccucuuaccaguauuuaacu

SEQ ID NO: 1321596 - RNA, 23 nt, Human
ccucuuaccaguauuuaacuucu

SEQ ID NO: 1321597 - RNA, 21 nt, Human
ccucuguucugcacacagcac

SEQ ID NO: 1321598 - RNA, 18 nt, Human
ccucuguucaaagcugcc

SEQ ID NO: 1321599 - RNA, 16 nt, Human
ccucuguucaaagcug

SEQ ID NO: 1321600 - RNA, 16 nt, Human
ccucuguuccuucccu

SEQ ID NO: 1321601 - RNA, 15 nt, Human
ccucugugcugugug

SEQ ID NO: 1321602 - RNA, 18 nt, Human
ccucuguguauuugcuuu

SEQ ID NO: 1321603 - RNA, 22 nt, Human
ccucugucucgagcgcccugca

SEQ ID NO: 1321604 - RNA, 22 nt, Human
ccucugucuggcaaugccacag

SEQ ID NO: 1321605 - RNA, 14 nt, Human
ccucugucuggcaa

SEQ ID NO: 1321606 - RNA, 15 nt, Human
ccucugucuucugga

SEQ ID NO: 1321607 - RNA, 16 nt, Human
ccucugucuucuggac

SEQ ID NO: 1321608 - RNA, 22 nt, Human
ccucugucuugugaaggcaggg

SEQ ID NO: 1321609 - RNA, 18 nt, Human
ccucugugaccaaugucu

SEQ ID NO: 1321610 - RNA, 19 nt, Human
ccucugugaccaaugucuu

SEQ ID NO: 1321611 - RNA, 21 nt, Human
ccucugugaccaaugucuuga

SEQ ID NO: 1321612 - RNA, 13 nt, Human
ccucugugcugug

SEQ ID NO: 1321613 - RNA, 16 nt, Human
ccucugugcugugugu

SEQ ID NO: 1321614 - RNA, 17 nt, Human
ccucuggucgcuccugc

SEQ ID NO: 1321615 - RNA, 19 nt, Human
ccucuggucgcuccugccc

SEQ ID NO: 1321616 - RNA, 20 nt, Human
ccucuggucgcuccugccca

SEQ ID NO: 1321617 - RNA, 21 nt, Human
ccucuggucgcuccugcccac

SEQ ID NO: 1321618 - RNA, 17 nt, Human
ccucuguccaggcacug

SEQ ID NO: 1321619 - RNA, 15 nt, Human
ccucuguccaggcac

SEQ ID NO: 1321620 - RNA, 19 nt, Human
ccucuguccaggcacugag

SEQ ID NO: 1321621 - RNA, 20 nt, Human
ccucuguccaggcacugaga

SEQ ID NO: 1321622 - RNA, 21 nt, Human
ccucuguccaggcacugagau

SEQ ID NO: 1321623 - RNA, 23 nt, Human
ccucuguauuugaaucagccuac

SEQ ID NO: 1321624 - RNA, 15 nt, Human
ccucugucagucaca

SEQ ID NO: 1321625 - RNA, 16 nt, Human
ccucugucagucacag

SEQ ID NO: 1321626 - RNA, 18 nt, Human
ccucugucagucacagcc

SEQ ID NO: 1321627 - RNA, 19 nt, Human
ccucugucagucacagcca

SEQ ID NO: 1321628 - RNA, 21 nt, Human
ccucugucagucacagccacc

SEQ ID NO: 1321629 - RNA, 15 nt, Human
ccucugucucgagcg

SEQ ID NO: 1321630 - RNA, 18 nt, Human
ccucugucucgagcgccc

SEQ ID NO: 1321631 - RNA, 19 nt, Human
ccucugucucgagcgcccu

SEQ ID NO: 1321632 - RNA, 20 nt, Human
ccucugucucgagcgcccug

SEQ ID NO: 1321633 - RNA, 21 nt, Human
ccucugucucgagcgcccugc

SEQ ID NO: 1321634 - RNA, 23 nt, Human
ccucugucucgagcgcccugcag

SEQ ID NO: 1321635 - RNA, 23 nt, Human
ccugaugcugacauucaccugcc

SEQ ID NO: 1321636 - RNA, 13 nt, Human
ccugaugcugaca

SEQ ID NO: 1321637 - RNA, 21 nt, Human
ccugaugcugacauucaccug

SEQ ID NO: 1321638 - RNA, 21 nt, Human
ccugaugggguggaaggcaug

SEQ ID NO: 1321639 - RNA, 15 nt, Human
ccugaugaaaauaaa

SEQ ID NO: 1321640 - RNA, 17 nt, Human
ccugaugaaaauaaaga

SEQ ID NO: 1321641 - RNA, 18 nt, Human
ccugaugaaaauaaagaa

SEQ ID NO: 1321642 - RNA, 19 nt, Human
ccugaugaaaauaaagaau

SEQ ID NO: 1321643 - RNA, 21 nt, Human
ccugaugaaaauaaagaaugg

SEQ ID NO: 1321644 - RNA, 20 nt, Human
ccugaggcuccacuuggucu

SEQ ID NO: 1321645 - RNA, 18 nt, Human
ccugaggcuccacuuggu

SEQ ID NO: 1321646 - RNA, 13 nt, Human
ccugaggccuaga

SEQ ID NO: 1321647 - RNA, 13 nt, Human
ccugaugaaaaua

SEQ ID NO: 1321648 - RNA, 14 nt, Human
ccugaugaaaauaa

SEQ ID NO: 1321649 - RNA, 18 nt, Human
ccugaggccuagacucug

SEQ ID NO: 1321650 - RNA, 21 nt, Human
ccugaauuuuguugcuguuuu

SEQ ID NO: 1321651 - RNA, 16 nt, Human
cccuuuccugaguccc

SEQ ID NO: 1321652 - RNA, 14 nt, Human
cccuuuccuccuca

SEQ ID NO: 1321653 - RNA, 17 nt, Human
cccuuuccuccucaggc

SEQ ID NO: 1321654 - RNA, 23 nt, Human
cccuuggggguccuccuccaggg

SEQ ID NO: 1321655 - RNA, 15 nt, Human
cccuugggcccacac

SEQ ID NO: 1321656 - RNA, 14 nt, Human
cccuugggcccaca

SEQ ID NO: 1321657 - RNA, 15 nt, Human
cccuugggcucugau

SEQ ID NO: 1321658 - RNA, 16 nt, Human
cccuugggcucugaug

SEQ ID NO: 1321659 - RNA, 12 nt, Human
cccuuggggguc

SEQ ID NO: 1321660 - RNA, 21 nt, Human
cccuuggggguccuccuccag

SEQ ID NO: 1321661 - RNA, 22 nt, Human
cccuuggggguccuccuccagg

SEQ ID NO: 1321662 - RNA, 22 nt, Human
cccuuucugggcaccggggccu

SEQ ID NO: 1321663 - RNA, 18 nt, Human
cccuuucggauccaggga

SEQ ID NO: 1321664 - RNA, 16 nt, Human
cccuuucuagaccaau

SEQ ID NO: 1321665 - RNA, 17 nt, Human
cccuuucuagaccaaua

SEQ ID NO: 1321666 - RNA, 22 nt, Human
cccuuucuaucguucucucuuu

SEQ ID NO: 1321667 - RNA, 12 nt, Human
cccuuugagugc

SEQ ID NO: 1321668 - RNA, 14 nt, Human
cccuuugagugcag

SEQ ID NO: 1321669 - RNA, 17 nt, Human
cccuuugcccagaaaga

SEQ ID NO: 1321670 - RNA, 14 nt, Human
cccuuugccuucau

SEQ ID NO: 1321671 - RNA, 17 nt, Human
cccuuugcugcauggca

SEQ ID NO: 1321672 - RNA, 15 nt, Human
cccuuugcugacccu

SEQ ID NO: 1321673 - RNA, 23 nt, Human
cccuuugcugugaggcuguccug

SEQ ID NO: 1321674 - RNA, 23 nt, Human
cccuuugugugcucuccauucug

SEQ ID NO: 1321675 - RNA, 16 nt, Human
cccuugaugaagaagu

SEQ ID NO: 1321676 - RNA, 20 nt, Human
cccuuccucuccacugccuu

SEQ ID NO: 1321677 - RNA, 16 nt, Human
cccuuccucuccacug

SEQ ID NO: 1321678 - RNA, 17 nt, Human
cccuuccucuccacugc

SEQ ID NO: 1321679 - RNA, 21 nt, Human
cccuuccucuccacugccuuc

SEQ ID NO: 1321680 - RNA, 17 nt, Human
cccuuaccacugcucug

SEQ ID NO: 1321681 - RNA, 21 nt, Human
cccuuaccacugcucugauga

SEQ ID NO: 1321682 - RNA, 13 nt, Human
cccuuccucucca

SEQ ID NO: 1321683 - RNA, 21 nt, Human
cccuuccucccuauuaaccua

SEQ ID NO: 1321684 - RNA, 15 nt, Human
cccuugggccagaag

SEQ ID NO: 1321685 - RNA, 16 nt, Human
cccuugggccagaagu

SEQ ID NO: 1321686 - RNA, 21 nt, Human
cccuugggccagaaguaccag

SEQ ID NO: 1321687 - RNA, 14 nt, Human
ccgagcaaccgugg

SEQ ID NO: 1321688 - RNA, 16 nt, Human
ccgagcaaccguggcc

SEQ ID NO: 1321689 - RNA, 18 nt, Human
ccgagcaaccguggcccu

SEQ ID NO: 1321690 - RNA, 16 nt, Human
ccgagcaggaggccua

SEQ ID NO: 1321691 - RNA, 21 nt, Human
ccgagcagcugagcagggccg

SEQ ID NO: 1321692 - RNA, 23 nt, Human
ccgagcaaccguggcccuuccug

SEQ ID NO: 1321693 - RNA, 12 nt, Human
ccgagcagcuga

SEQ ID NO: 1321694 - RNA, 14 nt, Human
ccgagcagcugagc

SEQ ID NO: 1321695 - RNA, 15 nt, Human
ccgagcagcugagca

SEQ ID NO: 1321696 - RNA, 16 nt, Human
ccgagcagcugagcag

SEQ ID NO: 1321697 - RNA, 17 nt, Human
ccgagcagcugagcagg

SEQ ID NO: 1321698 - RNA, 18 nt, Human
ccgagcagcugagcaggg

SEQ ID NO: 1321699 - RNA, 20 nt, Human
ccgagcagcugagcagggcc

SEQ ID NO: 1321700 - RNA, 11 nt, Human
ccgagcuccuc

SEQ ID NO: 1321701 - RNA, 16 nt, Human
ccgagcuccucuucca

SEQ ID NO: 1321702 - RNA, 17 nt, Human
ccgagcuccucuuccau

SEQ ID NO: 1321703 - RNA, 18 nt, Human
ccgagcuccucuuccaug

SEQ ID NO: 1321704 - RNA, 12 nt, Human
ccgaggcugaga

SEQ ID NO: 1321705 - RNA, 22 nt, Human
ccgagucucuucuccacuggau

SEQ ID NO: 1321706 - RNA, 16 nt, Human
ccgaugcccagagaca

SEQ ID NO: 1321707 - RNA, 13 nt, Human
ccgaugcccagag

SEQ ID NO: 1321708 - RNA, 11 nt, Human
ccgcccugcca

SEQ ID NO: 1321709 - RNA, 12 nt, Human
ccgcccugccac

SEQ ID NO: 1321710 - RNA, 13 nt, Human
cccuuuucuguuc

SEQ ID NO: 1321711 - RNA, 16 nt, Human
cccuuuuggguuucug

SEQ ID NO: 1321712 - RNA, 13 nt, Human
cccuuuugucucu

SEQ ID NO: 1321713 - RNA, 20 nt, Human
cccuuuuggguuucugcccu

SEQ ID NO: 1321714 - RNA, 14 nt, Human
cccuuuuucaauga

SEQ ID NO: 1321715 - RNA, 15 nt, Human
cccuuuuucuccagc

SEQ ID NO: 1321716 - RNA, 16 nt, Human
cccuuuuucuccagcu

SEQ ID NO: 1321717 - RNA, 15 nt, Human
ccgacuggggcaggg

SEQ ID NO: 1321718 - RNA, 22 nt, Human
ccgacuuuuguuuaccagagaa

SEQ ID NO: 1321719 - RNA, 13 nt, Human
ccgagaagaacag

SEQ ID NO: 1321720 - RNA, 20 nt, Human
ccccuaaaagaaacccugca

SEQ ID NO: 1321721 - RNA, 19 nt, Human
ccccuaaagccucaaaaca

SEQ ID NO: 1321722 - RNA, 14 nt, Human
ccccguuucuggug

SEQ ID NO: 1321723 - RNA, 22 nt, Human
ccccuaacccuuugugugcucu

SEQ ID NO: 1321724 - RNA, 23 nt, Human
ccccuaacccuuugugugcucuc

SEQ ID NO: 1321725 - RNA, 17 nt, Human
ccccuaagagagcaccu

SEQ ID NO: 1321726 - RNA, 18 nt, Human
ccccuaagagagcaccug

SEQ ID NO: 1321727 - RNA, 23 nt, Human
ccccuaaugacaucaccacaguu

SEQ ID NO: 1321728 - RNA, 14 nt, Human
ccccuagaguccca

SEQ ID NO: 1321729 - RNA, 21 nt, Human
cccugguuuccugcccuggga

SEQ ID NO: 1321730 - RNA, 20 nt, Human
ccccucccccugagauucag

SEQ ID NO: 1321731 - RNA, 13 nt, Human
ccccuccccucca

SEQ ID NO: 1321732 - RNA, 20 nt, Human
cccuguacaguguuaccauc

SEQ ID NO: 1321733 - RNA, 19 nt, Human
cccuguaccuuuugaggag

SEQ ID NO: 1321734 - RNA, 18 nt, Human
cccuguacuguucugugu

SEQ ID NO: 1321735 - RNA, 15 nt, Human
cccuguacaguguua

SEQ ID NO: 1321736 - RNA, 22 nt, Human
cccugguuuccugcccugggag

SEQ ID NO: 1321737 - RNA, 23 nt, Human
cccugguuuccugcccugggagg

SEQ ID NO: 1321738 - RNA, 11 nt, Human
cccuguaacuu

SEQ ID NO: 1321739 - RNA, 18 nt, Human
cccuguacacaacucacu

SEQ ID NO: 1321740 - RNA, 13 nt, Human
cccuguacagugu

SEQ ID NO: 1321741 - RNA, 16 nt, Human
cccuguuucagaggcu

SEQ ID NO: 1321742 - RNA, 19 nt, Human
cccuguuucagaggcucag

SEQ ID NO: 1321743 - RNA, 14 nt, Human
cccuuacaguagga

SEQ ID NO: 1321744 - RNA, 18 nt, Human
cccccaguaucucuucag

SEQ ID NO: 1321745 - RNA, 16 nt, Human
cccccaucauccucug

SEQ ID NO: 1321746 - RNA, 18 nt, Human
cccccaggguccugggag

SEQ ID NO: 1321747 - RNA, 16 nt, Human
cccccaucucuucugg

SEQ ID NO: 1321748 - RNA, 18 nt, Human
cccccaugcacugugaag

SEQ ID NO: 1321749 - RNA, 14 nt, Human
cccccaugcacugu

SEQ ID NO: 1321750 - RNA, 19 nt, Human
ccccccaagggaggcugcu

SEQ ID NO: 1321751 - RNA, 21 nt, Human
ccccccaagggaggcugcugc

SEQ ID NO: 1321752 - RNA, 21 nt, Human
ccccccagauaucaucuaccu

SEQ ID NO: 1321753 - RNA, 12 nt, Human
ccccccagccuc

SEQ ID NO: 1321754 - RNA, 13 nt, Human
ccccccagccucu

SEQ ID NO: 1321755 - RNA, 14 nt, Human
ccccccagauauca

SEQ ID NO: 1321756 - RNA, 14 nt, Human
ccccccaugcacug

SEQ ID NO: 1321757 - RNA, 22 nt, Human
cccccagcccccuccuggugcc

SEQ ID NO: 1321758 - RNA, 14 nt, Human
cccccaggaccaga

SEQ ID NO: 1321759 - RNA, 23 nt, Human
cccccagcuuugcuaccaaagca

SEQ ID NO: 1321760 - RNA, 15 nt, Human
cccccaggaccagaa

SEQ ID NO: 1321761 - RNA, 18 nt, Human
cccccaagguucuccaac

SEQ ID NO: 1321762 - RNA, 13 nt, Human
cccccaauccaug

SEQ ID NO: 1321763 - RNA, 20 nt, Human
cccccaagggaggcugcugc

SEQ ID NO: 1321764 - RNA, 18 nt, Human
cccccaagggaggcugcu

SEQ ID NO: 1321765 - RNA, 12 nt, Human
cccccagcacuu

SEQ ID NO: 1321766 - RNA, 13 nt, Human
cccccagcccagg

SEQ ID NO: 1321767 - RNA, 14 nt, Human
cccccagcccaggg

SEQ ID NO: 1321768 - RNA, 21 nt, Human
cccccagcccagggcuccugc

SEQ ID NO: 1321769 - RNA, 14 nt, Human
cccccggcagcagc

SEQ ID NO: 1321770 - RNA, 14 nt, Human
cccccucucccagu

SEQ ID NO: 1321771 - RNA, 14 nt, Human
cccccucucccugc

SEQ ID NO: 1321772 - RNA, 15 nt, Human
cccccucucccugca

SEQ ID NO: 1321773 - RNA, 17 nt, Human
cccccucucccugcaug

SEQ ID NO: 1321774 - RNA, 12 nt, Human
ccccccucuguc

SEQ ID NO: 1321775 - RNA, 12 nt, Human
ccccccuggccu

SEQ ID NO: 1321776 - RNA, 13 nt, Human
ccccccuguacac

SEQ ID NO: 1321777 - RNA, 13 nt, Human
cccccucugcccu

SEQ ID NO: 1321778 - RNA, 14 nt, Human
cccccucugcccug

SEQ ID NO: 1321779 - RNA, 16 nt, Human
cccccucugcccugcg

SEQ ID NO: 1321780 - RNA, 18 nt, Human
cccccucucccugcaugg

SEQ ID NO: 1321781 - RNA, 19 nt, Human
cccccucucccugcauggc

SEQ ID NO: 1321782 - RNA, 22 nt, Human
cccccugccccccagccucugg

SEQ ID NO: 1321783 - RNA, 14 nt, Human
cccccugcugccau

SEQ ID NO: 1321784 - RNA, 16 nt, Human
ccccgucccccucugg

SEQ ID NO: 1321785 - RNA, 20 nt, Human
ccccgucccccucuggcucc

SEQ ID NO: 1321786 - RNA, 21 nt, Human
ccccgucucugguuccucccc

SEQ ID NO: 1321787 - RNA, 17 nt, Human
cccccuggccuccccca

SEQ ID NO: 1321788 - RNA, 15 nt, Human
ccccgucaagaguga

SEQ ID NO: 1321789 - RNA, 23 nt, Human
cccccaaccaaguggcucccaca

SEQ ID NO: 1321790 - RNA, 20 nt, Human
cccccaaccauuuccucaga

SEQ ID NO: 1321791 - RNA, 19 nt, Human
cccccaagcuguuuucuuc

SEQ ID NO: 1321792 - RNA, 16 nt, Human
ccccaggaccagcuca

SEQ ID NO: 1321793 - RNA, 11 nt, Human
ccccaggacca

SEQ ID NO: 1321794 - RNA, 13 nt, Human
ccccaggaccaga

SEQ ID NO: 1321795 - RNA, 14 nt, Human
ccccaggaccagaa

SEQ ID NO: 1321796 - RNA, 18 nt, Human
ccccaggaccagaagcuc

SEQ ID NO: 1321797 - RNA, 20 nt, Human
ccccaggaccagaagcuccc

SEQ ID NO: 1321798 - RNA, 13 nt, Human
ccccaggaccagc

SEQ ID NO: 1321799 - RNA, 15 nt, Human
ccccaggaccagcuc

SEQ ID NO: 1321800 - RNA, 11 nt, Human
ccccagcuacc

SEQ ID NO: 1321801 - RNA, 22 nt, Human
ccccagcuacccuuuuucucca

SEQ ID NO: 1321802 - RNA, 14 nt, Human
ccccagcucaaugg

SEQ ID NO: 1321803 - RNA, 13 nt, Human
ccccagcucccac

SEQ ID NO: 1321804 - RNA, 14 nt, Human
ccccagcucccacc

SEQ ID NO: 1321805 - RNA, 13 nt, Human
ccccagcucccag

SEQ ID NO: 1321806 - RNA, 11 nt, Human
ccccagcuccg

SEQ ID NO: 1321807 - RNA, 13 nt, Human
ccccagcuccggc

SEQ ID NO: 1321808 - RNA, 14 nt, Human
ccccagcucccagg

SEQ ID NO: 1321809 - RNA, 23 nt, Human
ccccagcugucaucaauuaaagg

SEQ ID NO: 1321810 - RNA, 21 nt, Human
ccccagccgcuuggcgaugcc

SEQ ID NO: 1321811 - RNA, 13 nt, Human
ccccagccucccu

SEQ ID NO: 1321812 - RNA, 15 nt, Human
ccccagccucccuga

SEQ ID NO: 1321813 - RNA, 14 nt, Human
ccccagccucuggc

SEQ ID NO: 1321814 - RNA, 15 nt, Human
ccccagccucuggca

SEQ ID NO: 1321815 - RNA, 16 nt, Human
ccccagccucuggcau

SEQ ID NO: 1321816 - RNA, 10 nt, Human
ccccagccug

SEQ ID NO: 1321817 - RNA, 20 nt, Human
ccccagccugggccuaugga

SEQ ID NO: 1321818 - RNA, 11 nt, Human
ccccagccugu

SEQ ID NO: 1321819 - RNA, 17 nt, Human
ccccagcuaagaaccug

SEQ ID NO: 1321820 - RNA, 19 nt, Human
ccccagcuaagaaccugga

SEQ ID NO: 1321821 - RNA, 21 nt, Human
ccccagcuaagaaccuggaac

SEQ ID NO: 1321822 - RNA, 12 nt, Human
ccccacucugcu

SEQ ID NO: 1321823 - RNA, 13 nt, Human
ccccacucugcuc

SEQ ID NO: 1321824 - RNA, 15 nt, Human
ccccacucugcucug

SEQ ID NO: 1321825 - RNA, 16 nt, Human
ccccacucugcucuga

SEQ ID NO: 1321826 - RNA, 19 nt, Human
ccccacucugcucugaugc

SEQ ID NO: 1321827 - RNA, 17 nt, Human
ccccacucugcucugau

SEQ ID NO: 1321828 - RNA, 14 nt, Human
ccccacugaccaga

SEQ ID NO: 1321829 - RNA, 15 nt, Human
ccccacugaccagaa

SEQ ID NO: 1321830 - RNA, 24 nt, Human
ccccacuggagcagaaggggagau

SEQ ID NO: 1321831 - RNA, 12 nt, Human
ccccacuggagc

SEQ ID NO: 1321832 - RNA, 13 nt, Human
ccccacuggagca

SEQ ID NO: 1321833 - RNA, 14 nt, Human
ccccacuggagcag

SEQ ID NO: 1321834 - RNA, 16 nt, Human
ccucacccaccccugc

SEQ ID NO: 1321835 - RNA, 17 nt, Human
ccucacaguauugcuca

SEQ ID NO: 1321836 - RNA, 22 nt, Human
ccucacaguauugcucacccag

SEQ ID NO: 1321837 - RNA, 19 nt, Human
ccucacccaccccugcaca

SEQ ID NO: 1321838 - RNA, 21 nt, Human
ccucacccaccccugcacagu

SEQ ID NO: 1321839 - RNA, 17 nt, Human
ccucacccccagcuuug

SEQ ID NO: 1321840 - RNA, 19 nt, Human
ccucacccccagcuuugcu

SEQ ID NO: 1321841 - RNA, 15 nt, Human
ccucaccuguagcag

SEQ ID NO: 1321842 - RNA, 15 nt, Human
ccucaccuucugagu

SEQ ID NO: 1321843 - RNA, 15 nt, Human
ccucaccuuggcacc

SEQ ID NO: 1321844 - RNA, 16 nt, Human
ccucaccuuggcacca

SEQ ID NO: 1321845 - RNA, 21 nt, Human
ccucaccuuggcaccagacac

SEQ ID NO: 1321846 - RNA, 14 nt, Human
ccucaccuccucua

SEQ ID NO: 1321847 - RNA, 23 nt, Human
ccucacacacaaugugucugaga

SEQ ID NO: 1321848 - RNA, 13 nt, Human
ccucacacacccu

SEQ ID NO: 1321849 - RNA, 15 nt, Human
ccucacaggccccag

SEQ ID NO: 1321850 - RNA, 17 nt, Human
ccucaauuuucacugug

SEQ ID NO: 1321851 - RNA, 21 nt, Human
ccucacaaguggguaccccca

SEQ ID NO: 1321852 - RNA, 22 nt, Human
ccucacaaguggguacccccag

SEQ ID NO: 1321853 - RNA, 16 nt, Human
ccucaauuuucacugu

SEQ ID NO: 1321854 - RNA, 16 nt, Human
ccucaauuucugaaca

SEQ ID NO: 1321855 - RNA, 18 nt, Human
ccuaugucauuucauuuc

SEQ ID NO: 1321856 - RNA, 13 nt, Human
ccucaauccagcu

SEQ ID NO: 1321857 - RNA, 18 nt, Human
ccucaauccagcuauguu

SEQ ID NO: 1321858 - RNA, 23 nt, Human
ccucaaugccaguaacgcgucuu

SEQ ID NO: 1321859 - RNA, 17 nt, Human
ccuaucagaaguuucuc

SEQ ID NO: 1321860 - RNA, 20 nt, Human
ccuaucagaguugcugcaaa

SEQ ID NO: 1321861 - RNA, 19 nt, Human
ccuauggagagcccuggga

SEQ ID NO: 1321862 - RNA, 21 nt, Human
ccuauggagagcccugggacc

SEQ ID NO: 1321863 - RNA, 22 nt, Human
ccuauggagagcccugggaccg

SEQ ID NO: 1321864 - RNA, 15 nt, Human
ccuauggccucaugu

SEQ ID NO: 1321865 - RNA, 12 nt, Human
ccuauggccuca

SEQ ID NO: 1321866 - RNA, 24 nt, Human
ccuagagaagacaggcuggaagau

SEQ ID NO: 1321867 - RNA, 12 nt, Human
ccuagaggccug

SEQ ID NO: 1321868 - RNA, 20 nt, Human
ccuaucacccaacgcuccaa

SEQ ID NO: 1321869 - RNA, 16 nt, Human
ccuaucaccuauuucc

SEQ ID NO: 1321870 - RNA, 17 nt, Human
ccuaucaccuauuucca

SEQ ID NO: 1321871 - RNA, 23 nt, Human
ccucaguagucccugcacaguga

SEQ ID NO: 1321872 - RNA, 18 nt, Human
ccuacccuaaccaaguuc

SEQ ID NO: 1321873 - RNA, 16 nt, Human
ccuacccuaaccaagu

SEQ ID NO: 1321874 - RNA, 15 nt, Human
ccuacccuaaccaag

SEQ ID NO: 1321875 - RNA, 13 nt, Human
ccuaccuccaaag

SEQ ID NO: 1321876 - RNA, 22 nt, Human
ccuaccccauggugcuaggaag

SEQ ID NO: 1321877 - RNA, 20 nt, Human
ccuaccccgcagacaccuug

SEQ ID NO: 1321878 - RNA, 21 nt, Human
ccuaccccgcagacaccuugg

SEQ ID NO: 1321879 - RNA, 12 nt, Human
ccuaccugguaa

SEQ ID NO: 1321880 - RNA, 13 nt, Human
ccuaccugcccca

SEQ ID NO: 1321881 - RNA, 14 nt, Human
ccuaccugugccug

SEQ ID NO: 1321882 - RNA, 15 nt, Human
ccuaccugugccuga

SEQ ID NO: 1321883 - RNA, 16 nt, Human
ccuaccugugccugac

SEQ ID NO: 1321884 - RNA, 17 nt, Human
ccuagagaagacaggcu

SEQ ID NO: 1321885 - RNA, 19 nt, Human
ccuagagaagacaggcugg

SEQ ID NO: 1321886 - RNA, 22 nt, Human
ccuagagaagacaggcuggaag

SEQ ID NO: 1321887 - RNA, 13 nt, Human
ccuaaagccucaa

SEQ ID NO: 1321888 - RNA, 19 nt, Human
ccuaaagccucaaaacaaa

SEQ ID NO: 1321889 - RNA, 12 nt, Human
ccuaaagagaua

SEQ ID NO: 1321890 - RNA, 14 nt, Human
ccuaaagaacaaag

SEQ ID NO: 1321891 - RNA, 15 nt, Human
ccuaaagaacaaagu

SEQ ID NO: 1321892 - RNA, 16 nt, Human
ccuaaagaaaaacaaa

SEQ ID NO: 1321893 - RNA, 14 nt, Human
ccuaauuccacagc

SEQ ID NO: 1321894 - RNA, 15 nt, Human
ccuaauuccacagcu

SEQ ID NO: 1321895 - RNA, 16 nt, Human
ccuaauuccacagcug

SEQ ID NO: 1321896 - RNA, 17 nt, Human
ccuaauuccacagcugc

SEQ ID NO: 1321897 - RNA, 17 nt, Human
ccuaauucuaugccugu

SEQ ID NO: 1321898 - RNA, 18 nt, Human
ccuaaaagaaacccugca

SEQ ID NO: 1321899 - RNA, 14 nt, Human
ccguuuugucacuu

SEQ ID NO: 1321900 - RNA, 19 nt, Human
ccguuuugucacuuuuucu

SEQ ID NO: 1321901 - RNA, 15 nt, Human
ccguggcuucccgcu

SEQ ID NO: 1321902 - RNA, 21 nt, Human
ccguggcuucccgcucagccc

SEQ ID NO: 1321903 - RNA, 23 nt, Human
ccguggcuucccgcucagcccuc

SEQ ID NO: 1321904 - RNA, 22 nt, Human
ccgugggcaauugucugaaaag

SEQ ID NO: 1321905 - RNA, 19 nt, Human
ccgugggccccacccucgg

SEQ ID NO: 1321906 - RNA, 15 nt, Human
ccguggcuuugguuu

SEQ ID NO: 1321907 - RNA, 14 nt, Human
ccgugggcucccug

SEQ ID NO: 1321908 - RNA, 17 nt, Human
ccguggggccgccgccu

SEQ ID NO: 1321909 - RNA, 23 nt, Human
ccguuucauuuagucaugugacc

SEQ ID NO: 1321910 - RNA, 16 nt, Human
ccgugccuucagcucu

SEQ ID NO: 1321911 - RNA, 17 nt, Human
ccgugccuucagcucua

SEQ ID NO: 1321912 - RNA, 14 nt, Human
ccgugccuucagcu

SEQ ID NO: 1321913 - RNA, 15 nt, Human
ccgugccuucagcuc

SEQ ID NO: 1321914 - RNA, 19 nt, Human
ccgggccacuccuuccugc

SEQ ID NO: 1321915 - RNA, 20 nt, Human
ccgggccacuccuuccugcc

SEQ ID NO: 1321916 - RNA, 21 nt, Human
ccgggccacuccuuccugccc

SEQ ID NO: 1321917 - RNA, 19 nt, Human
ccgggccuggagaacuaga

SEQ ID NO: 1321918 - RNA, 12 nt, Human
ccggcugcccuu

SEQ ID NO: 1321919 - RNA, 11 nt, Human
ccggaaagaag

SEQ ID NO: 1321920 - RNA, 13 nt, Human
ccggaccagccug

SEQ ID NO: 1321921 - RNA, 14 nt, Human
ccggaccagccugg

SEQ ID NO: 1321922 - RNA, 15 nt, Human
ccggaccagccuggc

SEQ ID NO: 1321923 - RNA, 16 nt, Human
ccggaccagccuggcc

SEQ ID NO: 1321924 - RNA, 18 nt, Human
ccggaccagccuggccca

SEQ ID NO: 1321925 - RNA, 15 nt, Human
ccggcugcagaggcc

SEQ ID NO: 1321926 - RNA, 13 nt, Human
ccgcccugccacu

SEQ ID NO: 1321927 - RNA, 14 nt, Human
ccgcccugccacuc

SEQ ID NO: 1321928 - RNA, 15 nt, Human
ccgcccugccacuca

SEQ ID NO: 1321929 - RNA, 15 nt, Human
ccgcuguaugucuua

SEQ ID NO: 1321930 - RNA, 15 nt, Human
ccgcuuggagcagag

SEQ ID NO: 1321931 - RNA, 20 nt, Human
ccgcuuggagcuauuuucca

SEQ ID NO: 1321932 - RNA, 17 nt, Human
ccgcuuggagcagaggg

SEQ ID NO: 1321933 - RNA, 18 nt, Human
ccgcuuggagcagagggg

SEQ ID NO: 1321934 - RNA, 20 nt, Human
ccguggggccgccgccucuu

SEQ ID NO: 1321935 - RNA, 15 nt, Human
cccaauugagaaaaa

SEQ ID NO: 1321936 - RNA, 14 nt, Human
cccaauugcuggag

SEQ ID NO: 1321937 - RNA, 15 nt, Human
cccaauuucagacuc

SEQ ID NO: 1321938 - RNA, 22 nt, Human
cccaauuucggauuuuuuccaa

SEQ ID NO: 1321939 - RNA, 19 nt, Human
cccaaguucaugcagcugu

SEQ ID NO: 1321940 - RNA, 14 nt, Human
cccaauccagugga

SEQ ID NO: 1321941 - RNA, 13 nt, Human
cccaacaccucuu

SEQ ID NO: 1321942 - RNA, 16 nt, Human
cccaaauuugauugau

SEQ ID NO: 1321943 - RNA, 13 nt, Human
cccaacacaaaga

SEQ ID NO: 1321944 - RNA, 14 nt, Human
cccaaauggcccug

SEQ ID NO: 1321945 - RNA, 19 nt, Human
cccaaauuugauugauuug

SEQ ID NO: 1321946 - RNA, 21 nt, Human
cccacacucagauccuccuca

SEQ ID NO: 1321947 - RNA, 12 nt, Human
cccacacucaga

SEQ ID NO: 1321948 - RNA, 13 nt, Human
cccagaggggccu

SEQ ID NO: 1321949 - RNA, 14 nt, Human
cccagaggggccug

SEQ ID NO: 1321950 - RNA, 15 nt, Human
cccagaggggccugc

SEQ ID NO: 1321951 - RNA, 17 nt, Human
cccagaggggccugcca

SEQ ID NO: 1321952 - RNA, 18 nt, Human
cccagaggggccugccac

SEQ ID NO: 1321953 - RNA, 19 nt, Human
cccagaggggccugccacc

SEQ ID NO: 1321954 - RNA, 20 nt, Human
cccagaggggccugccaccu

SEQ ID NO: 1321955 - RNA, 21 nt, Human
cccagaggggccugccaccug

SEQ ID NO: 1321956 - RNA, 23 nt, Human
cccagaggggccugccaccugga

SEQ ID NO: 1321957 - RNA, 15 nt, Human
cccagagggucuggg

SEQ ID NO: 1321958 - RNA, 22 nt, Human
cccagagggucugggggcacaa

SEQ ID NO: 1321959 - RNA, 22 nt, Human
cccagccgacccccucucccug

SEQ ID NO: 1321960 - RNA, 19 nt, Human
cccagccgacccccucucc

SEQ ID NO: 1321961 - RNA, 23 nt, Human
cccagccgcuuggcgaugccagc

SEQ ID NO: 1321962 - RNA, 10 nt, Human
cccagccugg

SEQ ID NO: 1321963 - RNA, 14 nt, Human
cccagcgauucccu

SEQ ID NO: 1321964 - RNA, 23 nt, Human
cccagcgauucccucucccaggc

SEQ ID NO: 1321965 - RNA, 21 nt, Human
cccagcgauucccucucccag

SEQ ID NO: 1321966 - RNA, 15 nt, Human
cccagcggacacacg

SEQ ID NO: 1321967 - RNA, 14 nt, Human
cccagcggacacac

SEQ ID NO: 1321968 - RNA, 16 nt, Human
cccagcggcaucaggc

SEQ ID NO: 1321969 - RNA, 16 nt, Human
cccagcuaagaaccug

SEQ ID NO: 1321970 - RNA, 17 nt, Human
cccagcuaagaaccugg

SEQ ID NO: 1321971 - RNA, 18 nt, Human
cccagcuaagaaccugga

SEQ ID NO: 1321972 - RNA, 19 nt, Human
cccagcuaagaaccuggaa

SEQ ID NO: 1321973 - RNA, 20 nt, Human
cccagcuaagaaccuggaac

SEQ ID NO: 1321974 - RNA, 22 nt, Human
cccagcuaagaaccuggaacuu

SEQ ID NO: 1321975 - RNA, 22 nt, Human
cccagcuacccuuuuucuccag

SEQ ID NO: 1321976 - RNA, 12 nt, Human
cccagcucccac

SEQ ID NO: 1321977 - RNA, 16 nt, Human
cccagcucccaccucc

SEQ ID NO: 1321978 - RNA, 14 nt, Human
cccagcucccagga

SEQ ID NO: 1321979 - RNA, 13 nt, Human
cccagcucccagg

SEQ ID NO: 1321980 - RNA, 17 nt, Human
cccagcuccggccuguc

SEQ ID NO: 1321981 - RNA, 11 nt, Human
cccagcuccug

SEQ ID NO: 1321982 - RNA, 12 nt, Human
cccagcuccuga

SEQ ID NO: 1321983 - RNA, 20 nt, Human
cccagcuccugacacugcug

SEQ ID NO: 1321984 - RNA, 22 nt, Human
cccagcuccugacacugcugga

SEQ ID NO: 1321985 - RNA, 16 nt, Human
cccaguaucucuucag

SEQ ID NO: 1321986 - RNA, 15 nt, Human
cccaguaucucuuca

SEQ ID NO: 1321987 - RNA, 17 nt, Human
cccagucauucugggaa

SEQ ID NO: 1321988 - RNA, 11 nt, Human
cccagucuguc

SEQ ID NO: 1321989 - RNA, 15 nt, Human
cccagugacagcuag

SEQ ID NO: 1321990 - RNA, 14 nt, Human
cccagugacagcua

SEQ ID NO: 1321991 - RNA, 19 nt, Human
cccagguuggagugcagug

SEQ ID NO: 1321992 - RNA, 14 nt, Human
cccagguuggcucu

SEQ ID NO: 1321993 - RNA, 15 nt, Human
cccagguuggcucug

SEQ ID NO: 1321994 - RNA, 16 nt, Human
cccagguuggcucugc

SEQ ID NO: 1321995 - RNA, 18 nt, Human
cccagguuggcucugcca

SEQ ID NO: 1321996 - RNA, 20 nt, Human
cccagguuggcucugccagu

SEQ ID NO: 1321997 - RNA, 21 nt, Human
cccagguuggcucugccaguc

SEQ ID NO: 1321998 - RNA, 18 nt, Human
cccagguuggagugcagu

SEQ ID NO: 1321999 - RNA, 21 nt, Human
cccagguguuaacauuccaag

SEQ ID NO: 1322000 - RNA, 22 nt, Human
cccagguguuaacauuccaaga

SEQ ID NO: 1322001 - RNA, 19 nt, Human
cccagguguuaacauucca

SEQ ID NO: 1322002 - RNA, 17 nt, Human
cccagguccagcucugg

SEQ ID NO: 1322003 - RNA, 18 nt, Human
cccagguccagcucugga

SEQ ID NO: 1322004 - RNA, 13 nt, Human
cccagguccucac

SEQ ID NO: 1322005 - RNA, 21 nt, Human
cccaggucucccuggaucaga

SEQ ID NO: 1322006 - RNA, 22 nt, Human
cccaggccccaugaccuccagc

SEQ ID NO: 1322007 - RNA, 21 nt, Human
cccaggccccaugaccuccag

SEQ ID NO: 1322008 - RNA, 15 nt, Human
cccaggccugccugu

SEQ ID NO: 1322009 - RNA, 16 nt, Human
cccaggccugccuguu

SEQ ID NO: 1322010 - RNA, 18 nt, Human
cccaggcgccccuucccc

SEQ ID NO: 1322011 - RNA, 14 nt, Human
cccaggcugagccu

SEQ ID NO: 1322012 - RNA, 15 nt, Human
cccaggcugagccuc

SEQ ID NO: 1322013 - RNA, 17 nt, Human
cccaggcucggccugcc

SEQ ID NO: 1322014 - RNA, 19 nt, Human
cccaggcucggccugcccc

SEQ ID NO: 1322015 - RNA, 17 nt, Human
cccaggcucguggacug

SEQ ID NO: 1322016 - RNA, 22 nt, Human
cccaggcucguggacugagugg

SEQ ID NO: 1322017 - RNA, 16 nt, Human
cccaggggcagcccca

SEQ ID NO: 1322018 - RNA, 14 nt, Human
cccaggggcucccu

SEQ ID NO: 1322019 - RNA, 16 nt, Human
cccaggggcucccucc

SEQ ID NO: 1322020 - RNA, 17 nt, Human
cccaggggcucccuccg

SEQ ID NO: 1322021 - RNA, 23 nt, Human
cccaggggcucccuccgccccca

SEQ ID NO: 1322022 - RNA, 15 nt, Human
cccaggguccuggga

SEQ ID NO: 1322023 - RNA, 16 nt, Human
cccaggguccugggag

SEQ ID NO: 1322024 - RNA, 18 nt, Human
cccaggguccugggagga

SEQ ID NO: 1322025 - RNA, 17 nt, Human
cccaggguccugggagg

SEQ ID NO: 1322026 - RNA, 12 nt, Human
cccaggagcucc

SEQ ID NO: 1322027 - RNA, 20 nt, Human
cccaggagcuccccucccca

SEQ ID NO: 1322028 - RNA, 13 nt, Human
cccaggagcuccc

SEQ ID NO: 1322029 - RNA, 19 nt, Human
cccaggauacuggcacaga

SEQ ID NO: 1322030 - RNA, 17 nt, Human
cccaggauacuggcaca

SEQ ID NO: 1322031 - RNA, 15 nt, Human
cccaggauccccaag

SEQ ID NO: 1322032 - RNA, 13 nt, Human
cccaggcaaggcu

SEQ ID NO: 1322033 - RNA, 18 nt, Human
cccaggcaaggcugugga

SEQ ID NO: 1322034 - RNA, 19 nt, Human
cccaggcaaggcuguggac

SEQ ID NO: 1322035 - RNA, 12 nt, Human
cccaggcacugc

SEQ ID NO: 1322036 - RNA, 17 nt, Human
cccaggcacugggcucc

SEQ ID NO: 1322037 - RNA, 14 nt, Human
cccaggcauugcca

SEQ ID NO: 1322038 - RNA, 21 nt, Human
cccaggcauugccaagggcuu

SEQ ID NO: 1322039 - RNA, 13 nt, Human
cccaggcacugca

SEQ ID NO: 1322040 - RNA, 13 nt, Human
cccaggccaggac

SEQ ID NO: 1322041 - RNA, 14 nt, Human
cccaggccaggacu

SEQ ID NO: 1322042 - RNA, 15 nt, Human
cccaggccaggacuc

SEQ ID NO: 1322043 - RNA, 17 nt, Human
cccaggccaggacucug

SEQ ID NO: 1322044 - RNA, 18 nt, Human
cccaggccaggacucugc

SEQ ID NO: 1322045 - RNA, 19 nt, Human
cccaggccaggacucugca

SEQ ID NO: 1322046 - RNA, 20 nt, Human
cccaggccaggacucugcag

SEQ ID NO: 1322047 - RNA, 21 nt, Human
cccaggccaggacucugcagc

SEQ ID NO: 1322048 - RNA, 22 nt, Human
cccaggccaggacucugcagcc

SEQ ID NO: 1322049 - RNA, 23 nt, Human
cccaggccaggacucugcagccu

SEQ ID NO: 1322050 - RNA, 22 nt, Human
cccaggcccacugugccucaga

SEQ ID NO: 1322051 - RNA, 14 nt, Human
cccaggccccauga

SEQ ID NO: 1322052 - RNA, 16 nt, Human
cccaggccccaugacc

SEQ ID NO: 1322053 - RNA, 17 nt, Human
cccaggccccaugaccu

SEQ ID NO: 1322054 - RNA, 20 nt, Human
cccaggccccaugaccucca

SEQ ID NO: 1322055 - RNA, 11 nt, Human
cccaggcccac

SEQ ID NO: 1322056 - RNA, 18 nt, Human
cccaggcccacugugccu

SEQ ID NO: 1322057 - RNA, 13 nt, Human
ccccaagccuggc

SEQ ID NO: 1322058 - RNA, 14 nt, Human
ccccaagccuggca

SEQ ID NO: 1322059 - RNA, 22 nt, Human
ccccaagauugagcucucugcc

SEQ ID NO: 1322060 - RNA, 14 nt, Human
ccccaagcuguuuu

SEQ ID NO: 1322061 - RNA, 16 nt, Human
ccccaagcuguuuucu

SEQ ID NO: 1322062 - RNA, 17 nt, Human
ccccaagcuguuuucuu

SEQ ID NO: 1322063 - RNA, 20 nt, Human
ccccaagggaggcugcugcu

SEQ ID NO: 1322064 - RNA, 14 nt, Human
ccccaacagcgccc

SEQ ID NO: 1322065 - RNA, 15 nt, Human
ccccaacagcgccca

SEQ ID NO: 1322066 - RNA, 17 nt, Human
ccccaacagcgcccaaa

SEQ ID NO: 1322067 - RNA, 13 nt, Human
ccccaacagcugg

SEQ ID NO: 1322068 - RNA, 14 nt, Human
ccccaacagcugga

SEQ ID NO: 1322069 - RNA, 21 nt, Human
ccccaacagcuggacccugac

SEQ ID NO: 1322070 - RNA, 22 nt, Human
ccccaacagcuggacccugacc

SEQ ID NO: 1322071 - RNA, 23 nt, Human
ccccaacagcuggacccugacca

SEQ ID NO: 1322072 - RNA, 16 nt, Human
ccccaacaugcacuga

SEQ ID NO: 1322073 - RNA, 23 nt, Human
ccccaaccauuuccucagacucu

SEQ ID NO: 1322074 - RNA, 16 nt, Human
ccccaacuccuuccag

SEQ ID NO: 1322075 - RNA, 17 nt, Human
ccccaacuccuuccagc

SEQ ID NO: 1322076 - RNA, 22 nt, Human
ccccaacuccuuccagcuagug

SEQ ID NO: 1322077 - RNA, 16 nt, Human
cccagugcacuugcug

SEQ ID NO: 1322078 - RNA, 20 nt, Human
cccauggagauugaccugga

SEQ ID NO: 1322079 - RNA, 21 nt, Human
cccauggagauugaccuggau

SEQ ID NO: 1322080 - RNA, 23 nt, Human
cccauggagauugaccuggaugg

SEQ ID NO: 1322081 - RNA, 22 nt, Human
cccauggcagugggaaaaaugu

SEQ ID NO: 1322082 - RNA, 15 nt, Human
cccauggcauuuuau

SEQ ID NO: 1322083 - RNA, 14 nt, Human
cccauggcccugag

SEQ ID NO: 1322084 - RNA, 14 nt, Human
cccauuccugggaa

SEQ ID NO: 1322085 - RNA, 18 nt, Human
cccauuccuucccagagg

SEQ ID NO: 1322086 - RNA, 23 nt, Human
ccaucagaaacacccucacacug

SEQ ID NO: 1322087 - RNA, 13 nt, Human
ccaucagccucca

SEQ ID NO: 1322088 - RNA, 12 nt, Human
ccaucagaugac

SEQ ID NO: 1322089 - RNA, 20 nt, Human
ccaucaggguaggcuggagu

SEQ ID NO: 1322090 - RNA, 12 nt, Human
ccaucagugcuc

SEQ ID NO: 1322091 - RNA, 17 nt, Human
ccaucagugcucccuca

SEQ ID NO: 1322092 - RNA, 16 nt, Human
ccaucaucaugugugu

SEQ ID NO: 1322093 - RNA, 15 nt, Human
ccauccaaggccagg

SEQ ID NO: 1322094 - RNA, 17 nt, Human
ccauccacaugggagcc

SEQ ID NO: 1322095 - RNA, 17 nt, Human
ccauccaccuuucccaa

SEQ ID NO: 1322096 - RNA, 12 nt, Human
ccaucucccugg

SEQ ID NO: 1322097 - RNA, 15 nt, Human
ccaucucccuggugc

SEQ ID NO: 1322098 - RNA, 16 nt, Human
ccaucucccuggugcu

SEQ ID NO: 1322099 - RNA, 17 nt, Human
ccaucucccuggugcuu

SEQ ID NO: 1322100 - RNA, 20 nt, Human
ccaucucccuggugcuuaug

SEQ ID NO: 1322101 - RNA, 19 nt, Human
ccaucucccuggugcuuau

SEQ ID NO: 1322102 - RNA, 23 nt, Human
ccaucugcgugacaauaaaacau

SEQ ID NO: 1322103 - RNA, 11 nt, Human
ccaucugcucc

SEQ ID NO: 1322104 - RNA, 12 nt, Human
ccaucugcuccu

SEQ ID NO: 1322105 - RNA, 13 nt, Human
ccaucugcuccug

SEQ ID NO: 1322106 - RNA, 14 nt, Human
ccaucugcuccugg

SEQ ID NO: 1322107 - RNA, 15 nt, Human
ccaucugcuccugga

SEQ ID NO: 1322108 - RNA, 16 nt, Human
ccaucaaguugugcca

SEQ ID NO: 1322109 - RNA, 21 nt, Human
ccauaguggaucacucaccau

SEQ ID NO: 1322110 - RNA, 14 nt, Human
ccauauacuuuaaa

SEQ ID NO: 1322111 - RNA, 21 nt, Human
ccauaucacacacauugcugu

SEQ ID NO: 1322112 - RNA, 18 nt, Human
ccauauccuuacccuccu

SEQ ID NO: 1322113 - RNA, 22 nt, Human
ccagugaagagccacugccauu

SEQ ID NO: 1322114 - RNA, 12 nt, Human
ccauacuaauua

SEQ ID NO: 1322115 - RNA, 13 nt, Human
ccauacuaauuau

SEQ ID NO: 1322116 - RNA, 23 nt, Human
ccauacuaauuauacccccugca

SEQ ID NO: 1322117 - RNA, 15 nt, Human
ccauagucuuaacug

SEQ ID NO: 1322118 - RNA, 18 nt, Human
ccauagucuuaacugguc

SEQ ID NO: 1322119 - RNA, 14 nt, Human
ccaugcagaaagca

SEQ ID NO: 1322120 - RNA, 15 nt, Human
ccaugcagaaagcau

SEQ ID NO: 1322121 - RNA, 11 nt, Human
ccaugcagaaa

SEQ ID NO: 1322122 - RNA, 21 nt, Human
ccaugcacugugaaggacccu

SEQ ID NO: 1322123 - RNA, 19 nt, Human
ccaugcacugugaaggacc

SEQ ID NO: 1322124 - RNA, 20 nt, Human
ccaugcacugugaaggaccc

SEQ ID NO: 1322125 - RNA, 21 nt, Human
ccaugcccggcuaauuuuugu

SEQ ID NO: 1322126 - RNA, 13 nt, Human
ccaugcgcucagg

SEQ ID NO: 1322127 - RNA, 15 nt, Human
ccaugcgcucagggc

SEQ ID NO: 1322128 - RNA, 16 nt, Human
ccaugcgcucagggcc

SEQ ID NO: 1322129 - RNA, 22 nt, Human
ccaugcgcucagggccaugcug

SEQ ID NO: 1322130 - RNA, 20 nt, Human
ccaugcguguuucugacucu

SEQ ID NO: 1322131 - RNA, 13 nt, Human
ccaugcucaucug

SEQ ID NO: 1322132 - RNA, 16 nt, Human
ccaugcucaucugcug

SEQ ID NO: 1322133 - RNA, 19 nt, Human
ccaugcuccucuuccccag

SEQ ID NO: 1322134 - RNA, 20 nt, Human
ccaugcuccucuuccccaga

SEQ ID NO: 1322135 - RNA, 13 nt, Human
ccaugcuccucuu

SEQ ID NO: 1322136 - RNA, 15 nt, Human
ccaugcuccucuucc

SEQ ID NO: 1322137 - RNA, 16 nt, Human
ccaugcuccucuuccc

SEQ ID NO: 1322138 - RNA, 18 nt, Human
ccaugcuccucuucccca

SEQ ID NO: 1322139 - RNA, 17 nt, Human
ccaugcucaucugcugg

SEQ ID NO: 1322140 - RNA, 18 nt, Human
ccaugcucaucugcuggu

SEQ ID NO: 1322141 - RNA, 20 nt, Human
ccaugcucaucugcuggucc

SEQ ID NO: 1322142 - RNA, 20 nt, Human
ccaugcugaggccugggccg

SEQ ID NO: 1322143 - RNA, 18 nt, Human
ccaugcugaggccugggc

SEQ ID NO: 1322144 - RNA, 19 nt, Human
ccaugcugaggccugggcc

SEQ ID NO: 1322145 - RNA, 24 nt, Human
ccaugcuccucuuccccagacgcc

SEQ ID NO: 1322146 - RNA, 22 nt, Human
ccaugcugcuggggaagacagu

SEQ ID NO: 1322147 - RNA, 23 nt, Human
ccaugcugcuggggaagacagug

SEQ ID NO: 1322148 - RNA, 16 nt, Human
ccaugauguuuagaaa

SEQ ID NO: 1322149 - RNA, 22 nt, Human
ccaugauuucauguacugcauu

SEQ ID NO: 1322150 - RNA, 21 nt, Human
ccaugauuucauguacugcau

SEQ ID NO: 1322151 - RNA, 18 nt, Human
ccaugauuucauguacug

SEQ ID NO: 1322152 - RNA, 15 nt, Human
ccaugauuucaugua

SEQ ID NO: 1322153 - RNA, 23 nt, Human
ccaugauucuauuuauauguaca

SEQ ID NO: 1322154 - RNA, 21 nt, Human
ccaugcacccucauacacaga

SEQ ID NO: 1322155 - RNA, 11 nt, Human
ccaugcacugu

SEQ ID NO: 1322156 - RNA, 13 nt, Human
ccaugcacuguga

SEQ ID NO: 1322157 - RNA, 15 nt, Human
ccaugcacugugaag

SEQ ID NO: 1322158 - RNA, 16 nt, Human
ccaugcacugugaagg

SEQ ID NO: 1322159 - RNA, 17 nt, Human
ccaugcacugugaagga

SEQ ID NO: 1322160 - RNA, 14 nt, Human
ccaugaagauguag

SEQ ID NO: 1322161 - RNA, 18 nt, Human
ccaugaagagauuuuuca

SEQ ID NO: 1322162 - RNA, 22 nt, Human
ccaugaagagauuuuucaugau

SEQ ID NO: 1322163 - RNA, 14 nt, Human
ccaugauggcaaca

SEQ ID NO: 1322164 - RNA, 15 nt, Human
ccaugauggcaacag

SEQ ID NO: 1322165 - RNA, 16 nt, Human
ccaugauggcaacaga

SEQ ID NO: 1322166 - RNA, 19 nt, Human
ccaugauggcaacagaucu

SEQ ID NO: 1322167 - RNA, 21 nt, Human
ccaugauggcaacagaucugg

SEQ ID NO: 1322168 - RNA, 12 nt, Human
ccaucugggcuc

SEQ ID NO: 1322169 - RNA, 16 nt, Human
ccaucugggcuccucc

SEQ ID NO: 1322170 - RNA, 15 nt, Human
ccauucuggaaguga

SEQ ID NO: 1322171 - RNA, 12 nt, Human
ccauucuggaag

SEQ ID NO: 1322172 - RNA, 16 nt, Human
ccauucugcuccuucc

SEQ ID NO: 1322173 - RNA, 19 nt, Human
ccauucugcuccuucccca

SEQ ID NO: 1322174 - RNA, 19 nt, Human
ccauucuggaagugacuuu

SEQ ID NO: 1322175 - RNA, 13 nt, Human
cccaaaaggcaga

SEQ ID NO: 1322176 - RNA, 18 nt, Human
cccaaaaggcagaagcaa

SEQ ID NO: 1322177 - RNA, 20 nt, Human
cccaaaauuagccaguaauc

SEQ ID NO: 1322178 - RNA, 22 nt, Human
cccaaacgcccuuuccuccuca

SEQ ID NO: 1322179 - RNA, 13 nt, Human
cccaaagcaagca

SEQ ID NO: 1322180 - RNA, 21 nt, Human
cccaaagcaagcaagaggccg

SEQ ID NO: 1322181 - RNA, 16 nt, Human
cccaaacgcccuuucc

SEQ ID NO: 1322182 - RNA, 23 nt, Human
cccaaacgcccuuuccuccucag

SEQ ID NO: 1322183 - RNA, 16 nt, Human
cccaaacaccuuccag

SEQ ID NO: 1322184 - RNA, 19 nt, Human
cccaaacaccuuccagcuc

SEQ ID NO: 1322185 - RNA, 21 nt, Human
cccaaacaccuuccagcuccu

SEQ ID NO: 1322186 - RNA, 22 nt, Human
cccaaacaccuuccagcuccug

SEQ ID NO: 1322187 - RNA, 19 nt, Human
ccaugcugugcgcccaggg

SEQ ID NO: 1322188 - RNA, 20 nt, Human
ccaugcugugcgcccagggc

SEQ ID NO: 1322189 - RNA, 22 nt, Human
ccaugcugugcgcccagggcug

SEQ ID NO: 1322190 - RNA, 16 nt, Human
ccauggacaggcuggc

SEQ ID NO: 1322191 - RNA, 18 nt, Human
ccauggacaggcuggcuc

SEQ ID NO: 1322192 - RNA, 19 nt, Human
ccauggacaggcuggcucc

SEQ ID NO: 1322193 - RNA, 15 nt, Human
ccauggacucugucc

SEQ ID NO: 1322194 - RNA, 16 nt, Human
ccauggacucuguccu

SEQ ID NO: 1322195 - RNA, 18 nt, Human
ccauggacucuguccuga

SEQ ID NO: 1322196 - RNA, 21 nt, Human
ccauggacucuguccugaagg

SEQ ID NO: 1322197 - RNA, 13 nt, Human
ccauggagaaagc

SEQ ID NO: 1322198 - RNA, 14 nt, Human
ccauggagaaagcu

SEQ ID NO: 1322199 - RNA, 13 nt, Human
ccauucugcuccu

SEQ ID NO: 1322200 - RNA, 14 nt, Human
ccauucugcuccuu

SEQ ID NO: 1322201 - RNA, 15 nt, Human
ccauggagaaagcug

SEQ ID NO: 1322202 - RNA, 13 nt, Human
ccaggacaggauc

SEQ ID NO: 1322203 - RNA, 17 nt, Human
ccaggacaagcaugguc

SEQ ID NO: 1322204 - RNA, 20 nt, Human
ccaggacaagcaugguccca

SEQ ID NO: 1322205 - RNA, 23 nt, Human
ccaggacaagcauggucccacau

SEQ ID NO: 1322206 - RNA, 19 nt, Human
ccaggacaggauccaggcc

SEQ ID NO: 1322207 - RNA, 17 nt, Human
ccaggacaggauccagg

SEQ ID NO: 1322208 - RNA, 15 nt, Human
ccaggacaggaucca

SEQ ID NO: 1322209 - RNA, 12 nt, Human
ccaggaccacag

SEQ ID NO: 1322210 - RNA, 13 nt, Human
ccaggaccacagg

SEQ ID NO: 1322211 - RNA, 20 nt, Human
ccaggacuauauuugggccu

SEQ ID NO: 1322212 - RNA, 21 nt, Human
ccaggacuauauuugggccug

SEQ ID NO: 1322213 - RNA, 23 nt, Human
ccagcuggggccaggcugggucg

SEQ ID NO: 1322214 - RNA, 22 nt, Human
ccagcuggggccaggcuggguc

SEQ ID NO: 1322215 - RNA, 21 nt, Human
ccagcuggggccaggcugggu

SEQ ID NO: 1322216 - RNA, 20 nt, Human
ccagcuggggccaggcuggg

SEQ ID NO: 1322217 - RNA, 19 nt, Human
ccagcuggggccaggcugg

SEQ ID NO: 1322218 - RNA, 18 nt, Human
ccagcuggggccaggcug

SEQ ID NO: 1322219 - RNA, 17 nt, Human
ccagcuggggccaggcu

SEQ ID NO: 1322220 - RNA, 19 nt, Human
ccagcugggcucugcaauu

SEQ ID NO: 1322221 - RNA, 14 nt, Human
ccaggaagucucau

SEQ ID NO: 1322222 - RNA, 15 nt, Human
ccaggaagucucauc

SEQ ID NO: 1322223 - RNA, 20 nt, Human
ccaggaagucucaucugggg

SEQ ID NO: 1322224 - RNA, 14 nt, Human
ccaggaauuuccca

SEQ ID NO: 1322225 - RNA, 16 nt, Human
ccaggaauuucccagg

SEQ ID NO: 1322226 - RNA, 17 nt, Human
ccaggaauuucccagga

SEQ ID NO: 1322227 - RNA, 18 nt, Human
ccaggaauuucccaggac

SEQ ID NO: 1322228 - RNA, 19 nt, Human
ccaggaauuucccaggacc

SEQ ID NO: 1322229 - RNA, 20 nt, Human
ccaggaauuucccaggaccc

SEQ ID NO: 1322230 - RNA, 21 nt, Human
ccaggaauuucccaggacccu

SEQ ID NO: 1322231 - RNA, 23 nt, Human
ccaggaauuucccaggacccuga

SEQ ID NO: 1322232 - RNA, 22 nt, Human
ccaggaauuucccaggacccug

SEQ ID NO: 1322233 - RNA, 15 nt, Human
ccaggacaagcaugg

SEQ ID NO: 1322234 - RNA, 11 nt, Human
ccaggaagccg

SEQ ID NO: 1322235 - RNA, 16 nt, Human
ccaggaagccguccug

SEQ ID NO: 1322236 - RNA, 22 nt, Human
ccaggaagccguccuggcgccu

SEQ ID NO: 1322237 - RNA, 15 nt, Human
ccaggaagcuuuggu

SEQ ID NO: 1322238 - RNA, 15 nt, Human
ccagagcccacucca

SEQ ID NO: 1322239 - RNA, 20 nt, Human
ccagagcccacuccaucugg

SEQ ID NO: 1322240 - RNA, 11 nt, Human
ccagagcccag

SEQ ID NO: 1322241 - RNA, 12 nt, Human
ccagagcccagc

SEQ ID NO: 1322242 - RNA, 13 nt, Human
ccagagcccagcu

SEQ ID NO: 1322243 - RNA, 14 nt, Human
ccagagcccagcuc

SEQ ID NO: 1322244 - RNA, 15 nt, Human
ccagagcccagcucc

SEQ ID NO: 1322245 - RNA, 16 nt, Human
ccagagcccagcucca

SEQ ID NO: 1322246 - RNA, 19 nt, Human
ccagcucuggaggggaggg

SEQ ID NO: 1322247 - RNA, 18 nt, Human
ccagcugcacugaugcug

SEQ ID NO: 1322248 - RNA, 19 nt, Human
ccagcugcacugaugcugc

SEQ ID NO: 1322249 - RNA, 17 nt, Human
ccagcugcccccagagc

SEQ ID NO: 1322250 - RNA, 19 nt, Human
ccagcugcccccagagcca

SEQ ID NO: 1322251 - RNA, 21 nt, Human
ccagcugcccccagagccaca

SEQ ID NO: 1322252 - RNA, 22 nt, Human
ccagcugcccccagagccacag

SEQ ID NO: 1322253 - RNA, 18 nt, Human
ccagcugccccggccccu

SEQ ID NO: 1322254 - RNA, 23 nt, Human
ccagcugcccccagagccacagu

SEQ ID NO: 1322255 - RNA, 22 nt, Human
ccagcugccuagauucagggaa

SEQ ID NO: 1322256 - RNA, 13 nt, Human
ccagcuggaggca

SEQ ID NO: 1322257 - RNA, 15 nt, Human
ccagcuggaggcagg

SEQ ID NO: 1322258 - RNA, 17 nt, Human
ccagcuggaggcagggg

SEQ ID NO: 1322259 - RNA, 18 nt, Human
ccagcuggaggcaggggc

SEQ ID NO: 1322260 - RNA, 22 nt, Human
ccagcuggaggcaggggcuucc

SEQ ID NO: 1322261 - RNA, 23 nt, Human
ccagcuggaggcaggggcuuccu

SEQ ID NO: 1322262 - RNA, 16 nt, Human
ccagcugggcucugca

SEQ ID NO: 1322263 - RNA, 18 nt, Human
ccagcugggcucugcaau

SEQ ID NO: 1322264 - RNA, 22 nt, Human
ccagcugcuccgaggacccagg

SEQ ID NO: 1322265 - RNA, 16 nt, Human
ccaguaucucuucagu

SEQ ID NO: 1322266 - RNA, 15 nt, Human
ccaguaucucuucag

SEQ ID NO: 1322267 - RNA, 13 nt, Human
ccaguaucgcuca

SEQ ID NO: 1322268 - RNA, 20 nt, Human
ccaguaggggcuuauaauaa

SEQ ID NO: 1322269 - RNA, 18 nt, Human
ccaguaccuagcuggcuc

SEQ ID NO: 1322270 - RNA, 22 nt, Human
ccaguagaccuuguuacuucug

SEQ ID NO: 1322271 - RNA, 20 nt, Human
ccaguaucucuucagucucu

SEQ ID NO: 1322272 - RNA, 18 nt, Human
ccaguaucucuucagucu

SEQ ID NO: 1322273 - RNA, 17 nt, Human
ccagucuuccugacacu

SEQ ID NO: 1322274 - RNA, 20 nt, Human
ccagugaaaucaguuacucu

SEQ ID NO: 1322275 - RNA, 22 nt, Human
ccagucuuccugacacuuuaau

SEQ ID NO: 1322276 - RNA, 14 nt, Human
ccaguaacaggcuc

SEQ ID NO: 1322277 - RNA, 15 nt, Human
ccaguaacaggcuca

SEQ ID NO: 1322278 - RNA, 19 nt, Human
ccaguaacgcgucuuccug

SEQ ID NO: 1322279 - RNA, 20 nt, Human
ccaguaacgcgucuuccuga

SEQ ID NO: 1322280 - RNA, 14 nt, Human
ccaguaauccugua

SEQ ID NO: 1322281 - RNA, 21 nt, Human
ccaguaacgcgucuuccugag

SEQ ID NO: 1322282 - RNA, 15 nt, Human
ccaguaacucaucug

SEQ ID NO: 1322283 - RNA, 16 nt, Human
ccaguaacucaucugu

SEQ ID NO: 1322284 - RNA, 16 nt, Human
ccaguaacaggcucaa

SEQ ID NO: 1322285 - RNA, 22 nt, Human
ccaggugcuacacccuuuucca

SEQ ID NO: 1322286 - RNA, 19 nt, Human
ccagguguuaacauuccaa

SEQ ID NO: 1322287 - RNA, 20 nt, Human
ccagguguuaacauuccaag

SEQ ID NO: 1322288 - RNA, 23 nt, Human
ccagguguuaacauuccaagacu

SEQ ID NO: 1322289 - RNA, 17 nt, Human
ccagguguuacuguaau

SEQ ID NO: 1322290 - RNA, 21 nt, Human
ccagguguuacuguaauuccu

SEQ ID NO: 1322291 - RNA, 15 nt, Human
ccaggugaggucagc

SEQ ID NO: 1322292 - RNA, 19 nt, Human
ccaggugaggucagcacau

SEQ ID NO: 1322293 - RNA, 20 nt, Human
ccaggugaggucagcacauc

SEQ ID NO: 1322294 - RNA, 12 nt, Human
ccagguccuggu

SEQ ID NO: 1322295 - RNA, 13 nt, Human
ccagguccuggug

SEQ ID NO: 1322296 - RNA, 14 nt, Human
ccagguccuggugg

SEQ ID NO: 1322297 - RNA, 15 nt, Human
ccagguccugguggg

SEQ ID NO: 1322298 - RNA, 19 nt, Human
ccagguccugguggggcag

SEQ ID NO: 1322299 - RNA, 21 nt, Human
ccagguccugguggggcagcu

SEQ ID NO: 1322300 - RNA, 20 nt, Human
ccaggucucccuggaucaga

SEQ ID NO: 1322301 - RNA, 13 nt, Human
ccaggucucccug

SEQ ID NO: 1322302 - RNA, 23 nt, Human
ccaggugaacaaaguuuaccaga

SEQ ID NO: 1322303 - RNA, 15 nt, Human
ccagggccugucuca

SEQ ID NO: 1322304 - RNA, 16 nt, Human
ccagggcuagugacuu

SEQ ID NO: 1322305 - RNA, 19 nt, Human
ccagggcuagugacuugug

SEQ ID NO: 1322306 - RNA, 17 nt, Human
ccagggcuccagccccu

SEQ ID NO: 1322307 - RNA, 12 nt, Human
ccagggcuccag

SEQ ID NO: 1322308 - RNA, 20 nt, Human
ccaggucacccuuugcugug

SEQ ID NO: 1322309 - RNA, 14 nt, Human
ccagggcuccagcc

SEQ ID NO: 1322310 - RNA, 17 nt, Human
ccagguccaaugagcuu

SEQ ID NO: 1322311 - RNA, 18 nt, Human
ccagguccaaugagcuuu

SEQ ID NO: 1322312 - RNA, 19 nt, Human
ccagguccaaugagcuuuc

SEQ ID NO: 1322313 - RNA, 20 nt, Human
ccagguccaaugagcuuucu

SEQ ID NO: 1322314 - RNA, 13 nt, Human
ccagguccagcuc

SEQ ID NO: 1322315 - RNA, 14 nt, Human
ccagguccagcucu

SEQ ID NO: 1322316 - RNA, 15 nt, Human
ccagguccagcucug

SEQ ID NO: 1322317 - RNA, 16 nt, Human
ccagguccagcucugg

SEQ ID NO: 1322318 - RNA, 17 nt, Human
ccagguccagcucugga

SEQ ID NO: 1322319 - RNA, 19 nt, Human
ccagguccagcucuggagg

SEQ ID NO: 1322320 - RNA, 18 nt, Human
ccagguccagcucuggag

SEQ ID NO: 1322321 - RNA, 12 nt, Human
ccaggucccucu

SEQ ID NO: 1322322 - RNA, 13 nt, Human
ccaggucccucuc

SEQ ID NO: 1322323 - RNA, 15 nt, Human
ccaggucccucucau

SEQ ID NO: 1322324 - RNA, 16 nt, Human
ccaggucccucucauu

SEQ ID NO: 1322325 - RNA, 23 nt, Human
ccaggucccucucauuuagccug

SEQ ID NO: 1322326 - RNA, 19 nt, Human
ccaggcuuuuuuaucaugu

SEQ ID NO: 1322327 - RNA, 18 nt, Human
ccaggcuugccugcaggc

SEQ ID NO: 1322328 - RNA, 21 nt, Human
ccaggcugguuucgaacuccu

SEQ ID NO: 1322329 - RNA, 14 nt, Human
ccagggaagcagca

SEQ ID NO: 1322330 - RNA, 16 nt, Human
ccagggaagcagcagc

SEQ ID NO: 1322331 - RNA, 18 nt, Human
ccagggaagcagcagccu

SEQ ID NO: 1322332 - RNA, 23 nt, Human
ccagggaagcagcagccucgccc

SEQ ID NO: 1322333 - RNA, 13 nt, Human
ccagggcagccag

SEQ ID NO: 1322334 - RNA, 14 nt, Human
ccagggcagccagg

SEQ ID NO: 1322335 - RNA, 15 nt, Human
ccagggcagccaggg

SEQ ID NO: 1322336 - RNA, 19 nt, Human
ccagggcagccagggagag

SEQ ID NO: 1322337 - RNA, 20 nt, Human
ccagggcagccagggagagc

SEQ ID NO: 1322338 - RNA, 13 nt, Human
ccagggcaucucu

SEQ ID NO: 1322339 - RNA, 14 nt, Human
ccagggcaucucug

SEQ ID NO: 1322340 - RNA, 15 nt, Human
ccagggcaucucugg

SEQ ID NO: 1322341 - RNA, 16 nt, Human
ccagggcaucucuggg

SEQ ID NO: 1322342 - RNA, 17 nt, Human
ccagggcaucucugggc

SEQ ID NO: 1322343 - RNA, 18 nt, Human
ccagggcaucucugggcu

SEQ ID NO: 1322344 - RNA, 20 nt, Human
ccagggcaucucugggcugg

SEQ ID NO: 1322345 - RNA, 19 nt, Human
ccagggcaucucugggcug

SEQ ID NO: 1322346 - RNA, 14 nt, Human
ccagggccacgcuc

SEQ ID NO: 1322347 - RNA, 16 nt, Human
ccagggccacgcucca

SEQ ID NO: 1322348 - RNA, 19 nt, Human
ccagggccacgcuccagcu

SEQ ID NO: 1322349 - RNA, 18 nt, Human
ccagggccacgcuccagc

SEQ ID NO: 1322350 - RNA, 21 nt, Human
ccaggcuggucucgaacuccu

SEQ ID NO: 1322351 - RNA, 17 nt, Human
ccaggcuugccugcagg

SEQ ID NO: 1322352 - RNA, 13 nt, Human
ccaggccccauga

SEQ ID NO: 1322353 - RNA, 15 nt, Human
ccaggccccaugacc

SEQ ID NO: 1322354 - RNA, 16 nt, Human
ccaggccccaugaccu

SEQ ID NO: 1322355 - RNA, 17 nt, Human
ccaggccccaugaccuc

SEQ ID NO: 1322356 - RNA, 18 nt, Human
ccaggccccaugaccucc

SEQ ID NO: 1322357 - RNA, 20 nt, Human
ccaggccccaugaccuccag

SEQ ID NO: 1322358 - RNA, 21 nt, Human
ccaggccccaugaccuccagc

SEQ ID NO: 1322359 - RNA, 22 nt, Human
ccaggccccaugaccuccagcu

SEQ ID NO: 1322360 - RNA, 23 nt, Human
ccaggccccaugaccuccagcuu

SEQ ID NO: 1322361 - RNA, 12 nt, Human
ccagggaagggg

SEQ ID NO: 1322362 - RNA, 12 nt, Human
ccaggacucugc

SEQ ID NO: 1322363 - RNA, 13 nt, Human
ccaggacucugca

SEQ ID NO: 1322364 - RNA, 14 nt, Human
ccaggacucugcag

SEQ ID NO: 1322365 - RNA, 14 nt, Human
ccaggaggacccag

SEQ ID NO: 1322366 - RNA, 15 nt, Human
ccaggaggacccagg

SEQ ID NO: 1322367 - RNA, 18 nt, Human
ccaggaggacccagggcu

SEQ ID NO: 1322368 - RNA, 19 nt, Human
ccaggaggacccagggcuc

SEQ ID NO: 1322369 - RNA, 21 nt, Human
ccaggaggacccagggcucug

SEQ ID NO: 1322370 - RNA, 20 nt, Human
ccaggaggacccagggcucu

SEQ ID NO: 1322371 - RNA, 20 nt, Human
ccaggcauccuccacaauag

SEQ ID NO: 1322372 - RNA, 18 nt, Human
ccaggcauguggcagggg

SEQ ID NO: 1322373 - RNA, 16 nt, Human
ccaggcauugccaagg

SEQ ID NO: 1322374 - RNA, 22 nt, Human
ccaggccaaaggggaccuggaa

SEQ ID NO: 1322375 - RNA, 23 nt, Human
ccaggccaaaggggaccuggaag

SEQ ID NO: 1322376 - RNA, 20 nt, Human
ccacaggaaccacaagacug

SEQ ID NO: 1322377 - RNA, 13 nt, Human
ccacagcuuuugc

SEQ ID NO: 1322378 - RNA, 15 nt, Human
ccacagcuuuugcaa

SEQ ID NO: 1322379 - RNA, 22 nt, Human
ccacagcuuuuuaccaaguuuc

SEQ ID NO: 1322380 - RNA, 19 nt, Human
ccacaggaagccugcaguc

SEQ ID NO: 1322381 - RNA, 22 nt, Human
ccacaggaagccugcaguccug

SEQ ID NO: 1322382 - RNA, 12 nt, Human
ccacacuccagc

SEQ ID NO: 1322383 - RNA, 14 nt, Human
ccacacucagcaca

SEQ ID NO: 1322384 - RNA, 21 nt, Human
ccacacucagauccuccucau

SEQ ID NO: 1322385 - RNA, 16 nt, Human
ccacacccuguacugu

SEQ ID NO: 1322386 - RNA, 19 nt, Human
ccacacccuguacuguucu

SEQ ID NO: 1322387 - RNA, 17 nt, Human
ccacacgagaaccugaa

SEQ ID NO: 1322388 - RNA, 11 nt, Human
ccacacucaga

SEQ ID NO: 1322389 - RNA, 18 nt, Human
ccacacucagauccuccu

SEQ ID NO: 1322390 - RNA, 19 nt, Human
ccacacucagauccuccuc

SEQ ID NO: 1322391 - RNA, 23 nt, Human
ccacaggaagccugcaguccugg

SEQ ID NO: 1322392 - RNA, 16 nt, Human
ccacaggacauuucuc

SEQ ID NO: 1322393 - RNA, 21 nt, Human
ccacaggacauuucucuaaga

SEQ ID NO: 1322394 - RNA, 15 nt, Human
ccacaggcccuuccu

SEQ ID NO: 1322395 - RNA, 16 nt, Human
ccacaggcccuuccuc

SEQ ID NO: 1322396 - RNA, 17 nt, Human
ccacaggcccuuccucu

SEQ ID NO: 1322397 - RNA, 18 nt, Human
ccacaggcccuuccucuc

SEQ ID NO: 1322398 - RNA, 19 nt, Human
ccacaggcccuuccucucc

SEQ ID NO: 1322399 - RNA, 22 nt, Human
ccacaggcccuuccucuccacu

SEQ ID NO: 1322400 - RNA, 23 nt, Human
ccacaggcccuuccucuccacug

SEQ ID NO: 1322401 - RNA, 16 nt, Human
ccacaggcccacagua

SEQ ID NO: 1322402 - RNA, 16 nt, Human
ccacaggccgcccugc

SEQ ID NO: 1322403 - RNA, 17 nt, Human
ccacaggccgcccugcg

SEQ ID NO: 1322404 - RNA, 19 nt, Human
ccacaccagggccagccuc

SEQ ID NO: 1322405 - RNA, 20 nt, Human
ccacaccagggccagccucu

SEQ ID NO: 1322406 - RNA, 18 nt, Human
ccaauauuaaaucugcug

SEQ ID NO: 1322407 - RNA, 22 nt, Human
ccaauagggcugagcucucugu

SEQ ID NO: 1322408 - RNA, 15 nt, Human
ccaauauuaaaucug

SEQ ID NO: 1322409 - RNA, 12 nt, Human
ccacacagcugc

SEQ ID NO: 1322410 - RNA, 16 nt, Human
ccacacagcugccggu

SEQ ID NO: 1322411 - RNA, 20 nt, Human
ccacacagugcucaaggcca

SEQ ID NO: 1322412 - RNA, 23 nt, Human
ccacacagugcucaaggccagcu

SEQ ID NO: 1322413 - RNA, 22 nt, Human
ccacacagugcucaaggccagc

SEQ ID NO: 1322414 - RNA, 20 nt, Human
ccacaugccauuuguacuga

SEQ ID NO: 1322415 - RNA, 22 nt, Human
ccacaugccauuuguacugacc

SEQ ID NO: 1322416 - RNA, 14 nt, Human
ccacaugccccauc

SEQ ID NO: 1322417 - RNA, 12 nt, Human
ccacaugcccca

SEQ ID NO: 1322418 - RNA, 15 nt, Human
ccacauggcacagag

SEQ ID NO: 1322419 - RNA, 17 nt, Human
ccacauggcacagagau

SEQ ID NO: 1322420 - RNA, 16 nt, Human
ccacaugggaggcuca

SEQ ID NO: 1322421 - RNA, 22 nt, Human
ccacauuuggaauacuuuuugu

SEQ ID NO: 1322422 - RNA, 19 nt, Human
ccacauuuggaauacuuuu

SEQ ID NO: 1322423 - RNA, 13 nt, Human
ccacauuaaagaa

SEQ ID NO: 1322424 - RNA, 14 nt, Human
ccacauuaaagaag

SEQ ID NO: 1322425 - RNA, 16 nt, Human
ccacauuaaagaagac

SEQ ID NO: 1322426 - RNA, 20 nt, Human
ccacauuaaagaagaccuga

SEQ ID NO: 1322427 - RNA, 14 nt, Human
ccacauuggaagag

SEQ ID NO: 1322428 - RNA, 19 nt, Human
ccacauuggaagagcagca

SEQ ID NO: 1322429 - RNA, 17 nt, Human
ccacauuggaagagcag

SEQ ID NO: 1322430 - RNA, 14 nt, Human
ccacauuucuaaaa

SEQ ID NO: 1322431 - RNA, 15 nt, Human
ccacauuucuaaaau

SEQ ID NO: 1322432 - RNA, 13 nt, Human
ccacauuuggaau

SEQ ID NO: 1322433 - RNA, 21 nt, Human
ccaccaagagggacgccuggg

SEQ ID NO: 1322434 - RNA, 17 nt, Human
ccaccaagagggacgcc

SEQ ID NO: 1322435 - RNA, 15 nt, Human
ccaccaacccucaga

SEQ ID NO: 1322436 - RNA, 15 nt, Human
ccaccaaaacugcuc

SEQ ID NO: 1322437 - RNA, 16 nt, Human
ccaccaaaacugcucc

SEQ ID NO: 1322438 - RNA, 13 nt, Human
ccaccaacccuca

SEQ ID NO: 1322439 - RNA, 14 nt, Human
ccaccaacccucag

SEQ ID NO: 1322440 - RNA, 15 nt, Human
ccaccaacccucagg

SEQ ID NO: 1322441 - RNA, 16 nt, Human
ccaccaacccucaggg

SEQ ID NO: 1322442 - RNA, 17 nt, Human
ccaccaacccucagggc

SEQ ID NO: 1322443 - RNA, 18 nt, Human
ccaccaacccucagggca

SEQ ID NO: 1322444 - RNA, 15 nt, Human
ccacaggcucaggca

SEQ ID NO: 1322445 - RNA, 16 nt, Human
ccacaggcucaggcag

SEQ ID NO: 1322446 - RNA, 21 nt, Human
ccacaggcucaggcaggggcc

SEQ ID NO: 1322447 - RNA, 17 nt, Human
ccacaggcucaggcagg

SEQ ID NO: 1322448 - RNA, 19 nt, Human
ccacaggcucaggcagggg

SEQ ID NO: 1322449 - RNA, 20 nt, Human
ccacaggcucaggcaggggc

SEQ ID NO: 1322450 - RNA, 14 nt, Human
ccacaggcuucuga

SEQ ID NO: 1322451 - RNA, 19 nt, Human
ccacaggcuucugagcagc

SEQ ID NO: 1322452 - RNA, 16 nt, Human
ccacagggucccacag

SEQ ID NO: 1322453 - RNA, 19 nt, Human
ccacagggucccacagcca

SEQ ID NO: 1322454 - RNA, 20 nt, Human
ccacagggucccacagccac

SEQ ID NO: 1322455 - RNA, 21 nt, Human
ccacagggucccacagccacg

SEQ ID NO: 1322456 - RNA, 14 nt, Human
ccacaggucuagac

SEQ ID NO: 1322457 - RNA, 15 nt, Human
ccacaggucuagacu

SEQ ID NO: 1322458 - RNA, 15 nt, Human
ccacaguagucuuga

SEQ ID NO: 1322459 - RNA, 17 nt, Human
ccacaguagucuugaug

SEQ ID NO: 1322460 - RNA, 19 nt, Human
ccacagucccaucugcuuc

SEQ ID NO: 1322461 - RNA, 20 nt, Human
ccacagugccuaauaauacu

SEQ ID NO: 1322462 - RNA, 13 nt, Human
ccacagugucagg

SEQ ID NO: 1322463 - RNA, 14 nt, Human
ccacagugucaggc

SEQ ID NO: 1322464 - RNA, 19 nt, Human
ccacagugucaggcacugg

SEQ ID NO: 1322465 - RNA, 22 nt, Human
ccacaucccacucacaacagcu

SEQ ID NO: 1322466 - RNA, 16 nt, Human
ccacaucccaucgucu

SEQ ID NO: 1322467 - RNA, 13 nt, Human
ccacaucccuggg

SEQ ID NO: 1322468 - RNA, 14 nt, Human
ccacaucccugggc

SEQ ID NO: 1322469 - RNA, 15 nt, Human
ccacaucccugggcc

SEQ ID NO: 1322470 - RNA, 16 nt, Human
ccacaucccugggccu

SEQ ID NO: 1322471 - RNA, 17 nt, Human
ccacaucccugggccug

SEQ ID NO: 1322472 - RNA, 18 nt, Human
ccacaucccugggccugc

SEQ ID NO: 1322473 - RNA, 19 nt, Human
ccacaucccugggccugcu

SEQ ID NO: 1322474 - RNA, 20 nt, Human
ccacaucccugggccugcug

SEQ ID NO: 1322475 - RNA, 21 nt, Human
ccacaucccugggccugcugc

SEQ ID NO: 1322476 - RNA, 23 nt, Human
ccacaucccugggccugcugcug

SEQ ID NO: 1322477 - RNA, 22 nt, Human
ccacaucccugggccugcugcu

SEQ ID NO: 1322478 - RNA, 13 nt, Human
ccacauccuccac

SEQ ID NO: 1322479 - RNA, 16 nt, Human
ccaauauucauagcag

SEQ ID NO: 1322480 - RNA, 16 nt, Human
ccaccauggccagcua

SEQ ID NO: 1322481 - RNA, 16 nt, Human
ccaccauuuggcaucc

SEQ ID NO: 1322482 - RNA, 17 nt, Human
ccaccauuuggcauccc

SEQ ID NO: 1322483 - RNA, 18 nt, Human
ccaccauuuggcaucccu

SEQ ID NO: 1322484 - RNA, 22 nt, Human
ccaccauuuggcaucccugggc

SEQ ID NO: 1322485 - RNA, 21 nt, Human
ccaccauuuggcaucccuggg

SEQ ID NO: 1322486 - RNA, 12 nt, Human
ccacccaggcca

SEQ ID NO: 1322487 - RNA, 14 nt, Human
ccacccaggccagg

SEQ ID NO: 1322488 - RNA, 23 nt, Human
ccacccaggggcagccccaggcc

SEQ ID NO: 1322489 - RNA, 17 nt, Human
ccacccaggggcagccc

SEQ ID NO: 1322490 - RNA, 16 nt, Human
ccaccccaaccugcuc

SEQ ID NO: 1322491 - RNA, 14 nt, Human
ccacgguguucugu

SEQ ID NO: 1322492 - RNA, 17 nt, Human
ccacggggacucagccc

SEQ ID NO: 1322493 - RNA, 16 nt, Human
ccaccugucugucugu

SEQ ID NO: 1322494 - RNA, 14 nt, Human
ccaccugucugucu

SEQ ID NO: 1322495 - RNA, 12 nt, Human
ccaccugucugu

SEQ ID NO: 1322496 - RNA, 11 nt, Human
ccaccugucug

SEQ ID NO: 1322497 - RNA, 22 nt, Human
ccaccugucugucugucugucc

SEQ ID NO: 1322498 - RNA, 18 nt, Human
ccaccccauccaguucau

SEQ ID NO: 1322499 - RNA, 16 nt, Human
ccaccccauucccgca

SEQ ID NO: 1322500 - RNA, 13 nt, Human
ccacccccaaggu

SEQ ID NO: 1322501 - RNA, 22 nt, Human
ccaccccaaccugcucuccucu

SEQ ID NO: 1322502 - RNA, 15 nt, Human
ccaccccacccacuu

SEQ ID NO: 1322503 - RNA, 17 nt, Human
ccaccccaauccuccca

SEQ ID NO: 1322504 - RNA, 14 nt, Human
ccaccccagggcag

SEQ ID NO: 1322505 - RNA, 18 nt, Human
ccaccccagggcagccag

SEQ ID NO: 1322506 - RNA, 20 nt, Human
ccaccccagggcagccaggg

SEQ ID NO: 1322507 - RNA, 19 nt, Human
ccaccccagggcagccagg

SEQ ID NO: 1322508 - RNA, 21 nt, Human
ccacgucagcugggacacccc

SEQ ID NO: 1322509 - RNA, 13 nt, Human
ccacguacugcag

SEQ ID NO: 1322510 - RNA, 16 nt, Human
ccacguacugcagccu

SEQ ID NO: 1322511 - RNA, 17 nt, Human
ccacguacugcagccuc

SEQ ID NO: 1322512 - RNA, 15 nt, Human
ccacuagacccacug

SEQ ID NO: 1322513 - RNA, 17 nt, Human
ccacuagacccacugga

SEQ ID NO: 1322514 - RNA, 14 nt, Human
ccacuagccucagg

SEQ ID NO: 1322515 - RNA, 15 nt, Human
ccacuagccucaggg

SEQ ID NO: 1322516 - RNA, 16 nt, Human
ccacuagccucagggg

SEQ ID NO: 1322517 - RNA, 21 nt, Human
ccacuccagaccccuggcuuu

SEQ ID NO: 1322518 - RNA, 22 nt, Human
ccacuccagaccccuggcuuuu

SEQ ID NO: 1322519 - RNA, 12 nt, Human
ccacucagagac

SEQ ID NO: 1322520 - RNA, 13 nt, Human
ccacucagagaca

SEQ ID NO: 1322521 - RNA, 15 nt, Human
ccacucagagacaug

SEQ ID NO: 1322522 - RNA, 17 nt, Human
ccacucagagacaugca

SEQ ID NO: 1322523 - RNA, 14 nt, Human
ccacuucagccucc

SEQ ID NO: 1322524 - RNA, 21 nt, Human
ccagaaagcaguugagacaag

SEQ ID NO: 1322525 - RNA, 22 nt, Human
ccagaaagccccacccaggcca

SEQ ID NO: 1322526 - RNA, 23 nt, Human
ccagaaagccccacccaggccag

SEQ ID NO: 1322527 - RNA, 15 nt, Human
ccagaaaguaaaggu

SEQ ID NO: 1322528 - RNA, 21 nt, Human
ccacuuagaaauugcauuucc

SEQ ID NO: 1322529 - RNA, 16 nt, Human
ccacuuauagccucug

SEQ ID NO: 1322530 - RNA, 22 nt, Human
ccacuuauuccccauucuuccu

SEQ ID NO: 1322531 - RNA, 15 nt, Human
ccacuuauagccucu

SEQ ID NO: 1322532 - RNA, 18 nt, Human
ccacugcagaagacagua

SEQ ID NO: 1322533 - RNA, 13 nt, Human
ccacugcagaaga

SEQ ID NO: 1322534 - RNA, 13 nt, Human
ccacuccaucugg

SEQ ID NO: 1322535 - RNA, 16 nt, Human
ccacuccaucugguag

SEQ ID NO: 1322536 - RNA, 17 nt, Human
ccacuccaucugguaga

SEQ ID NO: 1322537 - RNA, 18 nt, Human
ccacuccaucugguagaa

SEQ ID NO: 1322538 - RNA, 19 nt, Human
ccacuuagaaauugcauuu

SEQ ID NO: 1322539 - RNA, 15 nt, Human
ccacuuaauguaugu

SEQ ID NO: 1322540 - RNA, 17 nt, Human
ccacuuaauguauguua

SEQ ID NO: 1322541 - RNA, 20 nt, Human
ccacuuaauguauguuacca

SEQ ID NO: 1322542 - RNA, 21 nt, Human
ccacuuacauuuacaaacuga

SEQ ID NO: 1322543 - RNA, 16 nt, Human
ccacuuaaaaauuaaa

SEQ ID NO: 1322544 - RNA, 13 nt, Human
ccacuuaaaaugu

SEQ ID NO: 1322545 - RNA, 16 nt, Human
ccagaagugugacugg

SEQ ID NO: 1322546 - RNA, 18 nt, Human
ccagaagugugacuggcu

SEQ ID NO: 1322547 - RNA, 13 nt, Human
ccagaagaugacu

SEQ ID NO: 1322548 - RNA, 21 nt, Human
ccagaagaugacugaggguga

SEQ ID NO: 1322549 - RNA, 16 nt, Human
ccagaagaugacugag

SEQ ID NO: 1322550 - RNA, 16 nt, Human
ccagaaugcuuuagga

SEQ ID NO: 1322551 - RNA, 23 nt, Human
ccagaauggucuuucuaaugugu

SEQ ID NO: 1322552 - RNA, 13 nt, Human
ccagaauuucaaa

SEQ ID NO: 1322553 - RNA, 16 nt, Human
ccagaauuuaaaccua

SEQ ID NO: 1322554 - RNA, 15 nt, Human
ccagacacaggcccu

SEQ ID NO: 1322555 - RNA, 14 nt, Human
ccagaccccuggcu

SEQ ID NO: 1322556 - RNA, 12 nt, Human
ccagacacuggu

SEQ ID NO: 1322557 - RNA, 14 nt, Human
ccagacacaggccc

SEQ ID NO: 1322558 - RNA, 11 nt, Human
ccagacacugg

SEQ ID NO: 1322559 - RNA, 13 nt, Human
ccagacacugguu

SEQ ID NO: 1322560 - RNA, 15 nt, Human
ccagaccccuggcuu

SEQ ID NO: 1322561 - RNA, 16 nt, Human
ccagaccccuggcuuu

SEQ ID NO: 1322562 - RNA, 17 nt, Human
ccagaccccuggcuuuu

SEQ ID NO: 1322563 - RNA, 18 nt, Human
ccagaccccuggcuuuuc

SEQ ID NO: 1322564 - RNA, 20 nt, Human
ccaagcaccugggauuacaa

SEQ ID NO: 1322565 - RNA, 18 nt, Human
ccaagcacuucuuuuucu

SEQ ID NO: 1322566 - RNA, 13 nt, Human
ccaagcacagcag

SEQ ID NO: 1322567 - RNA, 14 nt, Human
ccaagcacagcagc

SEQ ID NO: 1322568 - RNA, 15 nt, Human
ccaagcacagcagcc

SEQ ID NO: 1322569 - RNA, 17 nt, Human
ccaagcacagcagccug

SEQ ID NO: 1322570 - RNA, 18 nt, Human
ccaagcacagcagccugg

SEQ ID NO: 1322571 - RNA, 14 nt, Human
ccaagcaaguauua

SEQ ID NO: 1322572 - RNA, 12 nt, Human
ccaagcacagca

SEQ ID NO: 1322573 - RNA, 22 nt, Human
ccaagaugggcaucuuuuguau

SEQ ID NO: 1322574 - RNA, 13 nt, Human
ccaagauuccgga

SEQ ID NO: 1322575 - RNA, 20 nt, Human
ccaagauuccggauccuaag

SEQ ID NO: 1322576 - RNA, 13 nt, Human
ccaagauucuaga

SEQ ID NO: 1322577 - RNA, 14 nt, Human
ccaagauucuagau

SEQ ID NO: 1322578 - RNA, 15 nt, Human
ccaagauucuagaug

SEQ ID NO: 1322579 - RNA, 16 nt, Human
ccaagauucuagauga

SEQ ID NO: 1322580 - RNA, 21 nt, Human
ccaagauuggccugaggcugc

SEQ ID NO: 1322581 - RNA, 18 nt, Human
ccaagauugagcucucug

SEQ ID NO: 1322582 - RNA, 17 nt, Human
ccaagauucuagaugau

SEQ ID NO: 1322583 - RNA, 17 nt, Human
ccaagcauuuagaugua

SEQ ID NO: 1322584 - RNA, 13 nt, Human
ccaagcaucuugg

SEQ ID NO: 1322585 - RNA, 22 nt, Human
ccaagcaucuuggggggguggc

SEQ ID NO: 1322586 - RNA, 23 nt, Human
ccaagcaucuuggggggguggcc

SEQ ID NO: 1322587 - RNA, 22 nt, Human
ccaagcaguugggacuacaggc

SEQ ID NO: 1322588 - RNA, 20 nt, Human
ccaagcaguugggacuacag

SEQ ID NO: 1322589 - RNA, 21 nt, Human
ccaagcaguugggacuacagg

SEQ ID NO: 1322590 - RNA, 16 nt, Human
ccaagcauauaaaauu

SEQ ID NO: 1322591 - RNA, 18 nt, Human
ccaagcauauaaaauuuu

SEQ ID NO: 1322592 - RNA, 17 nt, Human
ccaagcuauucaauucu

SEQ ID NO: 1322593 - RNA, 17 nt, Human
ccaagcuaagcacugcc

SEQ ID NO: 1322594 - RNA, 20 nt, Human
ccaagcuaagcacugccacu

SEQ ID NO: 1322595 - RNA, 15 nt, Human
ccaagcggugucucu

SEQ ID NO: 1322596 - RNA, 17 nt, Human
ccaagcggugucucucc

SEQ ID NO: 1322597 - RNA, 22 nt, Human
ccaagccuuggggauucuucca

SEQ ID NO: 1322598 - RNA, 22 nt, Human
ccaagccuugauugguguugcc

SEQ ID NO: 1322599 - RNA, 14 nt, Human
ccaagccguggcuu

SEQ ID NO: 1322600 - RNA, 15 nt, Human
ccaagccuggcaagg

SEQ ID NO: 1322601 - RNA, 13 nt, Human
ccaagccguggcu

SEQ ID NO: 1322602 - RNA, 22 nt, Human
ccaagccuacuuuugccauuga

SEQ ID NO: 1322603 - RNA, 20 nt, Human
ccaagccauggguagccugg

SEQ ID NO: 1322604 - RNA, 15 nt, Human
ccaagcccagcccau

SEQ ID NO: 1322605 - RNA, 21 nt, Human
ccaagccauggguagccuggg

SEQ ID NO: 1322606 - RNA, 18 nt, Human
ccaagccaagggaaccug

SEQ ID NO: 1322607 - RNA, 20 nt, Human
ccaagccaagggaaccugug

SEQ ID NO: 1322608 - RNA, 22 nt, Human
ccaagccaagggaaccuguguc

SEQ ID NO: 1322609 - RNA, 23 nt, Human
ccaagccaagggaaccugugucc

SEQ ID NO: 1322610 - RNA, 16 nt, Human
ccaagccagaggcugg

SEQ ID NO: 1322611 - RNA, 17 nt, Human
ccaagccagaggcuggg

SEQ ID NO: 1322612 - RNA, 19 nt, Human
ccaagccagaggcuggguu

SEQ ID NO: 1322613 - RNA, 20 nt, Human
ccaaguagcugagacuacag

SEQ ID NO: 1322614 - RNA, 20 nt, Human
ccaaguagcugggauuacag

SEQ ID NO: 1322615 - RNA, 20 nt, Human
ccaaguaacugggauuacag

SEQ ID NO: 1322616 - RNA, 19 nt, Human
ccaaguaaagguuaaaaau

SEQ ID NO: 1322617 - RNA, 22 nt, Human
ccaaguagaaucucaguugauu

SEQ ID NO: 1322618 - RNA, 16 nt, Human
ccaaggucuucuuaau

SEQ ID NO: 1322619 - RNA, 19 nt, Human
ccaagguuuuauaaggcug

SEQ ID NO: 1322620 - RNA, 20 nt, Human
ccaagguuuuauaaggcuga

SEQ ID NO: 1322621 - RNA, 21 nt, Human
ccaagguuuuauaaggcugau

SEQ ID NO: 1322622 - RNA, 22 nt, Human
ccaauaguuguugauuggcagg

SEQ ID NO: 1322623 - RNA, 18 nt, Human
ccaauagggcugagcucu

SEQ ID NO: 1322624 - RNA, 15 nt, Human
ccaaguccagguccu

SEQ ID NO: 1322625 - RNA, 16 nt, Human
ccaaguccagguccug

SEQ ID NO: 1322626 - RNA, 17 nt, Human
ccaaguccagguccugg

SEQ ID NO: 1322627 - RNA, 18 nt, Human
ccaaguccagguccuggu

SEQ ID NO: 1322628 - RNA, 19 nt, Human
ccaaguccagguccuggug

SEQ ID NO: 1322629 - RNA, 13 nt, Human
ccaaguuccucua

SEQ ID NO: 1322630 - RNA, 11 nt, Human
ccaaguuccuc

SEQ ID NO: 1322631 - RNA, 17 nt, Human
ccaaguugugcuugagc

SEQ ID NO: 1322632 - RNA, 20 nt, Human
ccaaguugugcuugagccag

SEQ ID NO: 1322633 - RNA, 22 nt, Human
ccaaguugugcuugagccagga

SEQ ID NO: 1322634 - RNA, 16 nt, Human
ccaaggcuuucucuac

SEQ ID NO: 1322635 - RNA, 18 nt, Human
ccaagggauggacaucuu

SEQ ID NO: 1322636 - RNA, 19 nt, Human
ccaagggcauaaauuauug

SEQ ID NO: 1322637 - RNA, 18 nt, Human
ccaagggccgacuaagag

SEQ ID NO: 1322638 - RNA, 16 nt, Human
ccaagggaaccugugu

SEQ ID NO: 1322639 - RNA, 17 nt, Human
ccaagggaaccuguguc

SEQ ID NO: 1322640 - RNA, 18 nt, Human
ccaagggaaccugugucc

SEQ ID NO: 1322641 - RNA, 19 nt, Human
ccaagggaaccuguguccg

SEQ ID NO: 1322642 - RNA, 13 nt, Human
ccaagggaggcug

SEQ ID NO: 1322643 - RNA, 15 nt, Human
ccaagggaggcugcu

SEQ ID NO: 1322644 - RNA, 22 nt, Human
ccaagggaggcugcugcugcuc

SEQ ID NO: 1322645 - RNA, 18 nt, Human
ccaagggaggcugcugcu

SEQ ID NO: 1322646 - RNA, 13 nt, Human
ccaagggcugccg

SEQ ID NO: 1322647 - RNA, 21 nt, Human
ccaagggcuuuguuuugcaca

SEQ ID NO: 1322648 - RNA, 19 nt, Human
ccaaggggaaucagaacuc

SEQ ID NO: 1322649 - RNA, 22 nt, Human
ccaaggggauuuuuaugucugg

SEQ ID NO: 1322650 - RNA, 14 nt, Human
ccaaggggccugag

SEQ ID NO: 1322651 - RNA, 15 nt, Human
ccaaggggccugagc

SEQ ID NO: 1322652 - RNA, 16 nt, Human
ccaaggggccugagca

SEQ ID NO: 1322653 - RNA, 17 nt, Human
ccaaggggccugagcag

SEQ ID NO: 1322654 - RNA, 22 nt, Human
ccaaggggccugagcaguccuu

SEQ ID NO: 1322655 - RNA, 16 nt, Human
ccaaggggcuucaggu

SEQ ID NO: 1322656 - RNA, 16 nt, Human
ccaagguaccauccua

SEQ ID NO: 1322657 - RNA, 21 nt, Human
ccaacaagauugcuuaauaaa

SEQ ID NO: 1322658 - RNA, 21 nt, Human
ccaacaagaagggacugagag

SEQ ID NO: 1322659 - RNA, 13 nt, Human
ccaacaccaagca

SEQ ID NO: 1322660 - RNA, 16 nt, Human
ccaacaccaagcacag

SEQ ID NO: 1322661 - RNA, 17 nt, Human
ccaacaccaagcacagc

SEQ ID NO: 1322662 - RNA, 19 nt, Human
ccaacaccaagcacagcag

SEQ ID NO: 1322663 - RNA, 22 nt, Human
ccaacaccaagcacagcagccu

SEQ ID NO: 1322664 - RNA, 23 nt, Human
ccaacaccaagcacagcagccug

SEQ ID NO: 1322665 - RNA, 13 nt, Human
ccaacacugccag

SEQ ID NO: 1322666 - RNA, 20 nt, Human
ccaacacgcaccugccucag

SEQ ID NO: 1322667 - RNA, 21 nt, Human
ccaacacgcaccugccucagg

SEQ ID NO: 1322668 - RNA, 14 nt, Human
ccaacacugccagc

SEQ ID NO: 1322669 - RNA, 15 nt, Human
ccaacacugccagca

SEQ ID NO: 1322670 - RNA, 16 nt, Human
ccaacacugccagcau

SEQ ID NO: 1322671 - RNA, 13 nt, Human
ccaaagggagucu

SEQ ID NO: 1322672 - RNA, 18 nt, Human
ccaaagggagucugccag

SEQ ID NO: 1322673 - RNA, 19 nt, Human
ccaaagggagucugccagg

SEQ ID NO: 1322674 - RNA, 21 nt, Human
ccaaagggagucugccagggc

SEQ ID NO: 1322675 - RNA, 19 nt, Human
ccaaaggggaccuggaagg

SEQ ID NO: 1322676 - RNA, 18 nt, Human
ccaaaggggaccuggaag

SEQ ID NO: 1322677 - RNA, 15 nt, Human
ccaaauuugauugau

SEQ ID NO: 1322678 - RNA, 20 nt, Human
ccaaauuugauugauuugaa

SEQ ID NO: 1322679 - RNA, 19 nt, Human
ccaacaaagaacacuaacu

SEQ ID NO: 1322680 - RNA, 20 nt, Human
ccaaccaaguggcucccaca

SEQ ID NO: 1322681 - RNA, 13 nt, Human
ccaaccauuuccu

SEQ ID NO: 1322682 - RNA, 14 nt, Human
ccaaccauuuccuc

SEQ ID NO: 1322683 - RNA, 17 nt, Human
ccaaccauuuccucaga

SEQ ID NO: 1322684 - RNA, 23 nt, Human
ccaacagcgcccaaaggacgcac

SEQ ID NO: 1322685 - RNA, 16 nt, Human
ccaacagcgcccaaag

SEQ ID NO: 1322686 - RNA, 12 nt, Human
ccaacagcugga

SEQ ID NO: 1322687 - RNA, 22 nt, Human
ccaacagcuggacccugaccag

SEQ ID NO: 1322688 - RNA, 18 nt, Human
ccaacagcuggacccuga

SEQ ID NO: 1322689 - RNA, 22 nt, Human
ccaaacugacucuuaagaagac

SEQ ID NO: 1322690 - RNA, 18 nt, Human
ccaaacucuucccucucu

SEQ ID NO: 1322691 - RNA, 17 nt, Human
ccaaacugauccaguau

SEQ ID NO: 1322692 - RNA, 20 nt, Human
ccaaacauccucuuccauau

SEQ ID NO: 1322693 - RNA, 16 nt, Human
ccaaagcuuuccugcc

SEQ ID NO: 1322694 - RNA, 17 nt, Human
ccaaagcuuuccugccc

SEQ ID NO: 1322695 - RNA, 19 nt, Human
ccaaagcuuuccugcccca

SEQ ID NO: 1322696 - RNA, 20 nt, Human
ccaaagcuuuccugccccag

SEQ ID NO: 1322697 - RNA, 17 nt, Human
ccaaaggacagccgccu

SEQ ID NO: 1322698 - RNA, 18 nt, Human
ccaaaggacgcacugagc

SEQ ID NO: 1322699 - RNA, 19 nt, Human
ccaaaggacgcacugagca

SEQ ID NO: 1322700 - RNA, 21 nt, Human
ccaaaggacgcacugagcaac

SEQ ID NO: 1322701 - RNA, 14 nt, Human
ccaaaggaggaugg

SEQ ID NO: 1322702 - RNA, 16 nt, Human
ccaaaggaugugauau

SEQ ID NO: 1322703 - RNA, 19 nt, Human
ccaaaggaugugauauaua

SEQ ID NO: 1322704 - RNA, 14 nt, Human
ccaaaggcucccug

SEQ ID NO: 1322705 - RNA, 17 nt, Human
ccaaagcuucccacggc

SEQ ID NO: 1322706 - RNA, 16 nt, Human
ccaaagcuuucaugua

SEQ ID NO: 1322707 - RNA, 13 nt, Human
ccaaagcuuuccu

SEQ ID NO: 1322708 - RNA, 14 nt, Human
ccaaagcuuuccug

SEQ ID NO: 1322709 - RNA, 15 nt, Human
ccaaagcuuuccugc

SEQ ID NO: 1322710 - RNA, 12 nt, Human
ccaacccuagca

SEQ ID NO: 1322711 - RNA, 20 nt, Human
ccaacccguggaggcugcuc

SEQ ID NO: 1322712 - RNA, 21 nt, Human
ccaacccguggaggcugcucg

SEQ ID NO: 1322713 - RNA, 14 nt, Human
ccaacccguggagg

SEQ ID NO: 1322714 - RNA, 15 nt, Human
ccaacccguggaggc

SEQ ID NO: 1322715 - RNA, 17 nt, Human
ccaacccguggaggcug

SEQ ID NO: 1322716 - RNA, 18 nt, Human
ccaacccguggaggcugc

SEQ ID NO: 1322717 - RNA, 14 nt, Human
ccaacccucagagc

SEQ ID NO: 1322718 - RNA, 15 nt, Human
ccaacccucagagcc

SEQ ID NO: 1322719 - RNA, 19 nt, Human
ccaacccccgacuucaucc

SEQ ID NO: 1322720 - RNA, 22 nt, Human
ccaacccgucuggcccaccagg

SEQ ID NO: 1322721 - RNA, 19 nt, Human
ccaagaauagaugcugacu

SEQ ID NO: 1322722 - RNA, 15 nt, Human
ccaacccucagggca

SEQ ID NO: 1322723 - RNA, 12 nt, Human
ccaacccucagg

SEQ ID NO: 1322724 - RNA, 13 nt, Human
ccaacccucaggg

SEQ ID NO: 1322725 - RNA, 14 nt, Human
ccaacccucagggc

SEQ ID NO: 1322726 - RNA, 20 nt, Human
ccaagaauagaugcugacug

SEQ ID NO: 1322727 - RNA, 18 nt, Human
ccaagaauccacauuucu

SEQ ID NO: 1322728 - RNA, 19 nt, Human
ccaagaauccacauuucua

SEQ ID NO: 1322729 - RNA, 21 nt, Human
ccaagaauccacauuucuaaa

SEQ ID NO: 1322730 - RNA, 11 nt, Human
ccaagaaucuu

SEQ ID NO: 1322731 - RNA, 14 nt, Human
ccaagacucuagag

SEQ ID NO: 1322732 - RNA, 15 nt, Human
ccaagacucuagagu

SEQ ID NO: 1322733 - RNA, 21 nt, Human
ccaagacucuagaguccaagg

SEQ ID NO: 1322734 - RNA, 11 nt, Human
ccaagagucua

SEQ ID NO: 1322735 - RNA, 15 nt, Human
ccaagagucuaaaga

SEQ ID NO: 1322736 - RNA, 16 nt, Human
ccaagagucuaaagau

SEQ ID NO: 1322737 - RNA, 18 nt, Human
ccaagauacuuaagugcu

SEQ ID NO: 1322738 - RNA, 15 nt, Human
ccaagauggcccauc

SEQ ID NO: 1322739 - RNA, 18 nt, Human
ccaagauggcccauccug

SEQ ID NO: 1322740 - RNA, 18 nt, Human
ccaagaugggcaucuuuu

SEQ ID NO: 1322741 - RNA, 22 nt, Human
ccaagacucuagaguccaaggu

SEQ ID NO: 1322742 - RNA, 17 nt, Human
ccaagacugcuguggcc

SEQ ID NO: 1322743 - RNA, 18 nt, Human
ccaagacugcuguggcca

SEQ ID NO: 1322744 - RNA, 21 nt, Human
ccaagacugcuguggccagga

SEQ ID NO: 1322745 - RNA, 23 nt, Human
ccaagacugcuguggccaggagg

SEQ ID NO: 1322746 - RNA, 22 nt, Human
ccaagacugcuguggccaggag

SEQ ID NO: 1322747 - RNA, 15 nt, Human
ccaagagaaacuucc

SEQ ID NO: 1322748 - RNA, 17 nt, Human
ccaagagaaacuuccua

SEQ ID NO: 1322749 - RNA, 23 nt, Human
cauuguauucagaguugaugguu

SEQ ID NO: 1322750 - RNA, 15 nt, Human
cauuguaugugguca

SEQ ID NO: 1322751 - RNA, 19 nt, Human
cauuguccaauccuauguu

SEQ ID NO: 1322752 - RNA, 21 nt, Human
cauuguccaauccuauguuuu

SEQ ID NO: 1322753 - RNA, 14 nt, Human
cauuguauauguga

SEQ ID NO: 1322754 - RNA, 13 nt, Human
cauuguccucuuu

SEQ ID NO: 1322755 - RNA, 14 nt, Human
cauugucucagagc

SEQ ID NO: 1322756 - RNA, 20 nt, Human
cauugucuuuuuagaugccc

SEQ ID NO: 1322757 - RNA, 14 nt, Human
cauugucuuuuuag

SEQ ID NO: 1322758 - RNA, 16 nt, Human
cauugugauuggccug

SEQ ID NO: 1322759 - RNA, 16 nt, Human
cauugugcauucuaga

SEQ ID NO: 1322760 - RNA, 18 nt, Human
cauugugauuggccugua

SEQ ID NO: 1322761 - RNA, 22 nt, Human
cauugugccaugucaaacaaau

SEQ ID NO: 1322762 - RNA, 13 nt, Human
cauuguugagcua

SEQ ID NO: 1322763 - RNA, 20 nt, Human
cauuguugagcuauugcugu

SEQ ID NO: 1322764 - RNA, 12 nt, Human
cauuguuuaaaa

SEQ ID NO: 1322765 - RNA, 14 nt, Human
cauuguuuaaaaau

SEQ ID NO: 1322766 - RNA, 18 nt, Human
cauuguuuagaaagaaua

SEQ ID NO: 1322767 - RNA, 17 nt, Human
cauuguuucguaacaca

SEQ ID NO: 1322768 - RNA, 15 nt, Human
cauugccaagggcuu

SEQ ID NO: 1322769 - RNA, 15 nt, Human
cauuguagagcuucu

SEQ ID NO: 1322770 - RNA, 14 nt, Human
cauuguagaaaagc

SEQ ID NO: 1322771 - RNA, 16 nt, Human
cauuguagagcuucug

SEQ ID NO: 1322772 - RNA, 17 nt, Human
cauuguagagcuucugg

SEQ ID NO: 1322773 - RNA, 19 nt, Human
cauuguagagcuucuggca

SEQ ID NO: 1322774 - RNA, 21 nt, Human
cauuguagagcuucuggcacu

SEQ ID NO: 1322775 - RNA, 18 nt, Human
cauuguagcgucuuucuu

SEQ ID NO: 1322776 - RNA, 19 nt, Human
cauuguagcgucuuucuuu

SEQ ID NO: 1322777 - RNA, 15 nt, Human
cauuguagugcuuug

SEQ ID NO: 1322778 - RNA, 18 nt, Human
cauuguagugcuuugaga

SEQ ID NO: 1322779 - RNA, 20 nt, Human
cauuguagugcuuugagaga

SEQ ID NO: 1322780 - RNA, 24 nt, Human
cauuguagugcuuugagagagaaa

SEQ ID NO: 1322781 - RNA, 22 nt, Human
cauuguauaguuggaaucauau

SEQ ID NO: 1322782 - RNA, 22 nt, Human
cauuuaauggggaggacaaaau

SEQ ID NO: 1322783 - RNA, 13 nt, Human
cauuuaauagacu

SEQ ID NO: 1322784 - RNA, 16 nt, Human
cauuuagcauguuguu

SEQ ID NO: 1322785 - RNA, 16 nt, Human
cauuuagccuguccug

SEQ ID NO: 1322786 - RNA, 17 nt, Human
cauuuaggccaugggac

SEQ ID NO: 1322787 - RNA, 17 nt, Human
cauuuagccuguccugu

SEQ ID NO: 1322788 - RNA, 18 nt, Human
cauuuagccuguccuguc

SEQ ID NO: 1322789 - RNA, 22 nt, Human
cauuuagcuaaacggauuccaa

SEQ ID NO: 1322790 - RNA, 13 nt, Human
cauuuccugacag

SEQ ID NO: 1322791 - RNA, 20 nt, Human
cauuuccugacagaaggacu

SEQ ID NO: 1322792 - RNA, 23 nt, Human
cauuuccuaucaccuauuuccau

SEQ ID NO: 1322793 - RNA, 14 nt, Human
cauuuccucagacu

SEQ ID NO: 1322794 - RNA, 22 nt, Human
cauuuccucagacucuaagaaa

SEQ ID NO: 1322795 - RNA, 21 nt, Human
cauuuaaaacauuaaaauaua

SEQ ID NO: 1322796 - RNA, 12 nt, Human
cauuuccugggu

SEQ ID NO: 1322797 - RNA, 14 nt, Human
cauuuccugggugg

SEQ ID NO: 1322798 - RNA, 20 nt, Human
cauuuccuggguggcuacuc

SEQ ID NO: 1322799 - RNA, 21 nt, Human
cauuuccuggguggcuacucu

SEQ ID NO: 1322800 - RNA, 22 nt, Human
cauuuccuggguggcuacucug

SEQ ID NO: 1322801 - RNA, 12 nt, Human
cauuucuaaaau

SEQ ID NO: 1322802 - RNA, 11 nt, Human
cauuucuaauu

SEQ ID NO: 1322803 - RNA, 19 nt, Human
cauuucuaauuauguagcu

SEQ ID NO: 1322804 - RNA, 20 nt, Human
cauuucuaauuauguagcuc

SEQ ID NO: 1322805 - RNA, 23 nt, Human
cauuucuaauuauguagcucuuu

SEQ ID NO: 1322806 - RNA, 21 nt, Human
cauuucuaauuauguagcucu

SEQ ID NO: 1322807 - RNA, 20 nt, Human
cauuucuagcgcauggccug

SEQ ID NO: 1322808 - RNA, 12 nt, Human
cauuucuauuaa

SEQ ID NO: 1322809 - RNA, 19 nt, Human
cauuuuagggguagcauuu

SEQ ID NO: 1322810 - RNA, 11 nt, Human
cauuugcugaa

SEQ ID NO: 1322811 - RNA, 17 nt, Human
cauuuguuuuguuuaca

SEQ ID NO: 1322812 - RNA, 19 nt, Human
cauuuguuuuguuuacaga

SEQ ID NO: 1322813 - RNA, 12 nt, Human
cauuuuguacca

SEQ ID NO: 1322814 - RNA, 22 nt, Human
cauuuuguaccaaccauccaau

SEQ ID NO: 1322815 - RNA, 13 nt, Human
cauuuuguaauaa

SEQ ID NO: 1322816 - RNA, 16 nt, Human
cauuuuguaauaauaa

SEQ ID NO: 1322817 - RNA, 12 nt, Human
cauuuuguaaua

SEQ ID NO: 1322818 - RNA, 16 nt, Human
cauuuuucaugauaau

SEQ ID NO: 1322819 - RNA, 16 nt, Human
cauuuuuccguaaaaa

SEQ ID NO: 1322820 - RNA, 17 nt, Human
cauuuuucaauagcaca

SEQ ID NO: 1322821 - RNA, 16 nt, Human
ccaaacaggcucagag

SEQ ID NO: 1322822 - RNA, 22 nt, Human
ccaaacaccuuccagcuccugu

SEQ ID NO: 1322823 - RNA, 19 nt, Human
ccaaacauccuacaagaca

SEQ ID NO: 1322824 - RNA, 20 nt, Human
ccaaacauccuacaagacac

SEQ ID NO: 1322825 - RNA, 13 nt, Human
cauuugcucaugg

SEQ ID NO: 1322826 - RNA, 14 nt, Human
cauuugcucaugga

SEQ ID NO: 1322827 - RNA, 19 nt, Human
cauuugaaaccccuguagg

SEQ ID NO: 1322828 - RNA, 21 nt, Human
cauuugaaaccccuguaggcc

SEQ ID NO: 1322829 - RNA, 23 nt, Human
cauuucuauagccaaaaauagcu

SEQ ID NO: 1322830 - RNA, 15 nt, Human
ggaguuuugcaaagu

SEQ ID NO: 1322831 - RNA, 17 nt, Human
ggaguuuuguuuccucu

SEQ ID NO: 1322832 - RNA, 16 nt, Human
ggaguuuuuuguacca

SEQ ID NO: 1322833 - RNA, 18 nt, Human
ggaguuuuuaugagaaac

SEQ ID NO: 1322834 - RNA, 21 nt, Human
ggaguuggaagugugugaucu

SEQ ID NO: 1322835 - RNA, 13 nt, Human
ggaguugugggua

SEQ ID NO: 1322836 - RNA, 20 nt, Human
ggaguuuagggaacaauuug

SEQ ID NO: 1322837 - RNA, 21 nt, Human
ggaguuuauguuccauuaaac

SEQ ID NO: 1322838 - RNA, 12 nt, Human
ggaguuucuaag

SEQ ID NO: 1322839 - RNA, 14 nt, Human
ggaguuucuaaggu

SEQ ID NO: 1322840 - RNA, 12 nt, Human
ggagugcagugg

SEQ ID NO: 1322841 - RNA, 22 nt, Human
ggagugcggaccacccucacug

SEQ ID NO: 1322842 - RNA, 21 nt, Human
ggagugcuguuuuguuauaua

SEQ ID NO: 1322843 - RNA, 18 nt, Human
ggagugcggaccacccuc

SEQ ID NO: 1322844 - RNA, 16 nt, Human
ggaguggcagcccagc

SEQ ID NO: 1322845 - RNA, 17 nt, Human
ggaguggcagcccagcc

SEQ ID NO: 1322846 - RNA, 19 nt, Human
ggaguggcagcccagccag

SEQ ID NO: 1322847 - RNA, 20 nt, Human
ggaguggcagcccagccagc

SEQ ID NO: 1322848 - RNA, 20 nt, Human
ggaguugaucgccuuuccca

SEQ ID NO: 1322849 - RNA, 23 nt, Human
ggaguugaucgccuuucccaggu

SEQ ID NO: 1322850 - RNA, 14 nt, Human
ggaguugaucugga

SEQ ID NO: 1322851 - RNA, 17 nt, Human
ggaguugaucuggaacc

SEQ ID NO: 1322852 - RNA, 21 nt, Human
ggaguugaucuggaacccaga

SEQ ID NO: 1322853 - RNA, 22 nt, Human
ggaguugaucuggaacccagac

SEQ ID NO: 1322854 - RNA, 21 nt, Human
ggauguacaaggacagccccu

SEQ ID NO: 1322855 - RNA, 16 nt, Human
ggauggccccagcaca

SEQ ID NO: 1322856 - RNA, 13 nt, Human
ggauggccccagc

SEQ ID NO: 1322857 - RNA, 14 nt, Human
ggauggccccagca

SEQ ID NO: 1322858 - RNA, 22 nt, Human
ggauguugaaaaaguucugcag

SEQ ID NO: 1322859 - RNA, 16 nt, Human
ggauguccccagcaga

SEQ ID NO: 1322860 - RNA, 14 nt, Human
ggauguccccagca

SEQ ID NO: 1322861 - RNA, 15 nt, Human
ggauguccccagcag

SEQ ID NO: 1322862 - RNA, 12 nt, Human
ggaugucccugg

SEQ ID NO: 1322863 - RNA, 13 nt, Human
ggauggggcuccc

SEQ ID NO: 1322864 - RNA, 13 nt, Human
ggauguccccagc

SEQ ID NO: 1322865 - RNA, 19 nt, Human
ggcaauuaauuccuucagc

SEQ ID NO: 1322866 - RNA, 11 nt, Human
ggcaauuuugu

SEQ ID NO: 1322867 - RNA, 20 nt, Human
ggcaauuaauuccuucagca

SEQ ID NO: 1322868 - RNA, 17 nt, Human
ggcaauuaauuccuuca

SEQ ID NO: 1322869 - RNA, 22 nt, Human
ggcaauguuaauuuaguggaaa

SEQ ID NO: 1322870 - RNA, 14 nt, Human
ggcacacaccacca

SEQ ID NO: 1322871 - RNA, 22 nt, Human
ggcacaaucucggcucacugca

SEQ ID NO: 1322872 - RNA, 13 nt, Human
ggcacaagacuga

SEQ ID NO: 1322873 - RNA, 15 nt, Human
ggcaauuuugugguu

SEQ ID NO: 1322874 - RNA, 14 nt, Human
ggcaauuuuguaac

SEQ ID NO: 1322875 - RNA, 14 nt, Human
ggcacaagacugac

SEQ ID NO: 1322876 - RNA, 12 nt, Human
ggcacagccugg

SEQ ID NO: 1322877 - RNA, 13 nt, Human
ggcacagccuggc

SEQ ID NO: 1322878 - RNA, 13 nt, Human
ggcacaggagcua

SEQ ID NO: 1322879 - RNA, 16 nt, Human
ggcacaggagcuaccu

SEQ ID NO: 1322880 - RNA, 17 nt, Human
ggcacaggagcuaccug

SEQ ID NO: 1322881 - RNA, 20 nt, Human
ggcacaggagcuaccugugu

SEQ ID NO: 1322882 - RNA, 16 nt, Human
ggcacagggcaguggg

SEQ ID NO: 1322883 - RNA, 16 nt, Human
ggcaccagacacccag

SEQ ID NO: 1322884 - RNA, 19 nt, Human
ggcacaggagcuaccugug

SEQ ID NO: 1322885 - RNA, 19 nt, Human
ggcacaggaguguccucuu

SEQ ID NO: 1322886 - RNA, 20 nt, Human
ggcacaggaguguccucuuc

SEQ ID NO: 1322887 - RNA, 14 nt, Human
ggcacaggcccccu

SEQ ID NO: 1322888 - RNA, 15 nt, Human
ggcacaggcccccuu

SEQ ID NO: 1322889 - RNA, 16 nt, Human
ggagcaucagugcccu

SEQ ID NO: 1322890 - RNA, 17 nt, Human
ggaggugagaccaccuc

SEQ ID NO: 1322891 - RNA, 16 nt, Human
ggaggugccacuggag

SEQ ID NO: 1322892 - RNA, 20 nt, Human
ggagguccuuaggccucuga

SEQ ID NO: 1322893 - RNA, 23 nt, Human
ggaggccuuucccuaagccagcu

SEQ ID NO: 1322894 - RNA, 15 nt, Human
ggaggcccugugccc

SEQ ID NO: 1322895 - RNA, 12 nt, Human
ggaggccgaagc

SEQ ID NO: 1322896 - RNA, 23 nt, Human
ggaggcccugugccccuugacaa

SEQ ID NO: 1322897 - RNA, 20 nt, Human
ggaggccuaggaggguccuc

SEQ ID NO: 1322898 - RNA, 15 nt, Human
ggaggguaggcagga

SEQ ID NO: 1322899 - RNA, 13 nt, Human
ggaggguaggcag

SEQ ID NO: 1322900 - RNA, 22 nt, Human
ggagggggucguggagagcuag

SEQ ID NO: 1322901 - RNA, 15 nt, Human
ggagggguaggggcu

SEQ ID NO: 1322902 - RNA, 18 nt, Human
ggagggguaggggcuggg

SEQ ID NO: 1322903 - RNA, 16 nt, Human
ggagggguaggggcug

SEQ ID NO: 1322904 - RNA, 15 nt, Human
ggagggguguggcuc

SEQ ID NO: 1322905 - RNA, 13 nt, Human
ggaggacccagga

SEQ ID NO: 1322906 - RNA, 14 nt, Human
ggaggacccaggac

SEQ ID NO: 1322907 - RNA, 12 nt, Human
ggaggacccagg

SEQ ID NO: 1322908 - RNA, 23 nt, Human
ggaggaauaagcucccagggccu

SEQ ID NO: 1322909 - RNA, 12 nt, Human
ggaggaauacug

SEQ ID NO: 1322910 - RNA, 18 nt, Human
ggaggaaggaggacccag

SEQ ID NO: 1322911 - RNA, 20 nt, Human
ggagcuucauggcagaaggc

SEQ ID NO: 1322912 - RNA, 21 nt, Human
ggaggaaggcuuacacccaca

SEQ ID NO: 1322913 - RNA, 17 nt, Human
ggagcugccuggacccg

SEQ ID NO: 1322914 - RNA, 13 nt, Human
ggagcugggccug

SEQ ID NO: 1322915 - RNA, 14 nt, Human
ggagcugggccugg

SEQ ID NO: 1322916 - RNA, 17 nt, Human
ggagcuggggaucccuc

SEQ ID NO: 1322917 - RNA, 18 nt, Human
ggagcugguuagaaaugc

SEQ ID NO: 1322918 - RNA, 23 nt, Human
ggagcugguuagaaaugcagaau

SEQ ID NO: 1322919 - RNA, 20 nt, Human
ggagcugugaguucucccug

SEQ ID NO: 1322920 - RNA, 22 nt, Human
ggagcccccacccuguuccugc

SEQ ID NO: 1322921 - RNA, 13 nt, Human
ggagcccccagcc

SEQ ID NO: 1322922 - RNA, 14 nt, Human
ggagcccccagccu

SEQ ID NO: 1322923 - RNA, 15 nt, Human
ggagcccccagccug

SEQ ID NO: 1322924 - RNA, 16 nt, Human
ggagcccccagccugu

SEQ ID NO: 1322925 - RNA, 17 nt, Human
ggagcccccagccuguc

SEQ ID NO: 1322926 - RNA, 18 nt, Human
ggagcccccagccuguca

SEQ ID NO: 1322927 - RNA, 11 nt, Human
ggagcugccug

SEQ ID NO: 1322928 - RNA, 13 nt, Human
ggagcugccugga

SEQ ID NO: 1322929 - RNA, 14 nt, Human
ggagcugccuggac

SEQ ID NO: 1322930 - RNA, 15 nt, Human
ggagcugccuggacc

SEQ ID NO: 1322931 - RNA, 16 nt, Human
ggagcugccuggaccc

SEQ ID NO: 1322932 - RNA, 16 nt, Human
ggagccaauggagacu

SEQ ID NO: 1322933 - RNA, 18 nt, Human
ggagccaagggauggaca

SEQ ID NO: 1322934 - RNA, 16 nt, Human
ggagccaagggaugga

SEQ ID NO: 1322935 - RNA, 14 nt, Human
ggagccaccaguuc

SEQ ID NO: 1322936 - RNA, 15 nt, Human
ggagccaccaguucu

SEQ ID NO: 1322937 - RNA, 16 nt, Human
ggagccacuccucuga

SEQ ID NO: 1322938 - RNA, 19 nt, Human
ggagccacuccucugacuc

SEQ ID NO: 1322939 - RNA, 21 nt, Human
ggagccacuccucugacucag

SEQ ID NO: 1322940 - RNA, 14 nt, Human
ggagccagccgagc

SEQ ID NO: 1322941 - RNA, 14 nt, Human
ggagcccacugucc

SEQ ID NO: 1322942 - RNA, 17 nt, Human
ggagcccacuguccugg

SEQ ID NO: 1322943 - RNA, 18 nt, Human
ggagcccacuguccuggg

SEQ ID NO: 1322944 - RNA, 20 nt, Human
ggagcccacuguccugggcc

SEQ ID NO: 1322945 - RNA, 22 nt, Human
ggagcccacuguccugggccug

SEQ ID NO: 1322946 - RNA, 23 nt, Human
ggagcccacuguccugggccugc

SEQ ID NO: 1322947 - RNA, 16 nt, Human
ggagcccagcucugaa

SEQ ID NO: 1322948 - RNA, 14 nt, Human
ggagcccaggccag

SEQ ID NO: 1322949 - RNA, 15 nt, Human
ggagcccaggccagg

SEQ ID NO: 1322950 - RNA, 16 nt, Human
ggagcccaggccagga

SEQ ID NO: 1322951 - RNA, 24 nt, Human
ggagcccaggccaggacucugcag

SEQ ID NO: 1322952 - RNA, 22 nt, Human
ggagcccaggccaggacucugc

SEQ ID NO: 1322953 - RNA, 16 nt, Human
ggcucacugcauccuc

SEQ ID NO: 1322954 - RNA, 19 nt, Human
ggcucacugcauccuccgc

SEQ ID NO: 1322955 - RNA, 15 nt, Human
ggcucagccagcacu

SEQ ID NO: 1322956 - RNA, 23 nt, Human
ggcucagccccaccccagggcag

SEQ ID NO: 1322957 - RNA, 22 nt, Human
ggcucagccccaccccagggca

SEQ ID NO: 1322958 - RNA, 13 nt, Human
ggccuccauccug

SEQ ID NO: 1322959 - RNA, 15 nt, Human
ggccggccagccccu

SEQ ID NO: 1322960 - RNA, 15 nt, Human
ggccucauguggcug

SEQ ID NO: 1322961 - RNA, 16 nt, Human
ggccucauguggcugg

SEQ ID NO: 1322962 - RNA, 17 nt, Human
ggccucauguggcugga

SEQ ID NO: 1322963 - RNA, 19 nt, Human
ggccucauguggcuggaag

SEQ ID NO: 1322964 - RNA, 20 nt, Human
ggccucauguggcuggaaga

SEQ ID NO: 1322965 - RNA, 11 nt, Human
ggccuggagau

SEQ ID NO: 1322966 - RNA, 14 nt, Human
ggccuggagauccu

SEQ ID NO: 1322967 - RNA, 15 nt, Human
ggccuggagauccuc

SEQ ID NO: 1322968 - RNA, 17 nt, Human
ggccuggagauccuccu

SEQ ID NO: 1322969 - RNA, 19 nt, Human
ggccuggagauccuccugc

SEQ ID NO: 1322970 - RNA, 18 nt, Human
ggccuggagauccuccug

SEQ ID NO: 1322971 - RNA, 15 nt, Human
ggccugaucagacca

SEQ ID NO: 1322972 - RNA, 18 nt, Human
ggccugaucagaccacgg

SEQ ID NO: 1322973 - RNA, 20 nt, Human
ggccugaucagaccacggcu

SEQ ID NO: 1322974 - RNA, 18 nt, Human
ggccuggacuuuccugca

SEQ ID NO: 1322975 - RNA, 21 nt, Human
ggccuggacuuuccugcaacu

SEQ ID NO: 1322976 - RNA, 17 nt, Human
ggccuguguagcuguga

SEQ ID NO: 1322977 - RNA, 19 nt, Human
ggccuguguagcugugacc

SEQ ID NO: 1322978 - RNA, 20 nt, Human
ggccuguguagcugugaccu

SEQ ID NO: 1322979 - RNA, 14 nt, Human
ggccuggccagugc

SEQ ID NO: 1322980 - RNA, 16 nt, Human
ggccuggccagugccc

SEQ ID NO: 1322981 - RNA, 19 nt, Human
ggccuggccagugcccuga

SEQ ID NO: 1322982 - RNA, 20 nt, Human
ggccuggccagugcccugau

SEQ ID NO: 1322983 - RNA, 23 nt, Human
ggccuucggccuccauccugagg

SEQ ID NO: 1322984 - RNA, 21 nt, Human
ggccuguguagcugugaccug

SEQ ID NO: 1322985 - RNA, 22 nt, Human
ggccuguguagcugugaccugc

SEQ ID NO: 1322986 - RNA, 23 nt, Human
ggccuguguagcugugaccugcu

SEQ ID NO: 1322987 - RNA, 16 nt, Human
ggccuguguucuuccu

SEQ ID NO: 1322988 - RNA, 19 nt, Human
ggccuguguucuuccuggc

SEQ ID NO: 1322989 - RNA, 21 nt, Human
ggccuguguucuuccuggccg

SEQ ID NO: 1322990 - RNA, 22 nt, Human
ggccuguguucuuccuggccgc

SEQ ID NO: 1322991 - RNA, 15 nt, Human
ggccuuucccuaagc

SEQ ID NO: 1322992 - RNA, 17 nt, Human
ggccuuucccuaagcca

SEQ ID NO: 1322993 - RNA, 13 nt, Human
ggccuuugagcuc

SEQ ID NO: 1322994 - RNA, 15 nt, Human
ggccuuggccuggag

SEQ ID NO: 1322995 - RNA, 16 nt, Human
ggccuuggccuggagc

SEQ ID NO: 1322996 - RNA, 17 nt, Human
ggccuuggccuggagca

SEQ ID NO: 1322997 - RNA, 18 nt, Human
ggccuuggccuggagcac

SEQ ID NO: 1322998 - RNA, 13 nt, Human
ggccuugggcucc

SEQ ID NO: 1322999 - RNA, 12 nt, Human
ggccuugggcuc

SEQ ID NO: 1323000 - RNA, 13 nt, Human
ggccuuguucugu

SEQ ID NO: 1323001 - RNA, 16 nt, Human
ggccuuguucugucac

SEQ ID NO: 1323002 - RNA, 18 nt, Human
ggccuuguucugucacca

SEQ ID NO: 1323003 - RNA, 17 nt, Human
ggccuugcggcuccuca

SEQ ID NO: 1323004 - RNA, 18 nt, Human
ggccuugcggcuccucag

SEQ ID NO: 1323005 - RNA, 19 nt, Human
ggccuugcggcuccucagg

SEQ ID NO: 1323006 - RNA, 14 nt, Human
ggccuuggccugga

SEQ ID NO: 1323007 - RNA, 16 nt, Human
ggccuuugagcucaga

SEQ ID NO: 1323008 - RNA, 14 nt, Human
ggccuuugcgcucc

SEQ ID NO: 1323009 - RNA, 23 nt, Human
ggccuuugcgcuccuggcccagc

SEQ ID NO: 1323010 - RNA, 15 nt, Human
ggccuuuuucauuua

SEQ ID NO: 1323011 - RNA, 22 nt, Human
ggcgaagcguuguccucagccc

SEQ ID NO: 1323012 - RNA, 18 nt, Human
ggcgagaagggcugcuuc

SEQ ID NO: 1323013 - RNA, 11 nt, Human
ggcgaccuccu

SEQ ID NO: 1323014 - RNA, 14 nt, Human
ggcguaaguacaga

SEQ ID NO: 1323015 - RNA, 15 nt, Human
ggcguaaguacagag

SEQ ID NO: 1323016 - RNA, 16 nt, Human
ggcguaaguacagaga

SEQ ID NO: 1323017 - RNA, 18 nt, Human
ggcguaaguacagagaag

SEQ ID NO: 1323018 - RNA, 19 nt, Human
ggcguaaguacagagaagc

SEQ ID NO: 1323019 - RNA, 20 nt, Human
ggcguaaguacagagaagcc

SEQ ID NO: 1323020 - RNA, 22 nt, Human
ggcguaaguacagagaagccau

SEQ ID NO: 1323021 - RNA, 21 nt, Human
ggcguaaguacagagaagcca

SEQ ID NO: 1323022 - RNA, 15 nt, Human
ggcguaggcuacaga

SEQ ID NO: 1323023 - RNA, 17 nt, Human
ggcguaggcuacagaga

SEQ ID NO: 1323024 - RNA, 19 nt, Human
ggcguaggcuacagagaag

SEQ ID NO: 1323025 - RNA, 20 nt, Human
ggcguaggcuacagagaagc

SEQ ID NO: 1323026 - RNA, 21 nt, Human
ggcguaggcuacagagaagcc

SEQ ID NO: 1323027 - RNA, 22 nt, Human
ggcguaggcuacagagaagccu

SEQ ID NO: 1323028 - RNA, 16 nt, Human
ggcacuggcgaggaga

SEQ ID NO: 1323029 - RNA, 15 nt, Human
ggcacuggggcaggg

SEQ ID NO: 1323030 - RNA, 15 nt, Human
ggcacugggcaugag

SEQ ID NO: 1323031 - RNA, 16 nt, Human
ggcacugggcaugagg

SEQ ID NO: 1323032 - RNA, 17 nt, Human
ggcaccagacacccagg

SEQ ID NO: 1323033 - RNA, 18 nt, Human
ggcaccagacacccagga

SEQ ID NO: 1323034 - RNA, 19 nt, Human
ggcaccagacacccaggac

SEQ ID NO: 1323035 - RNA, 20 nt, Human
ggcaccagacacccaggacu

SEQ ID NO: 1323036 - RNA, 13 nt, Human
ggcauagcucugg

SEQ ID NO: 1323037 - RNA, 15 nt, Human
ggcauagcucugggg

SEQ ID NO: 1323038 - RNA, 22 nt, Human
ggcauccagagucccugccugg

SEQ ID NO: 1323039 - RNA, 12 nt, Human
ggcaucccuggg

SEQ ID NO: 1323040 - RNA, 14 nt, Human
ggcaucccugggcc

SEQ ID NO: 1323041 - RNA, 13 nt, Human
ggcaucccugggc

SEQ ID NO: 1323042 - RNA, 14 nt, Human
ggcauccuccagcc

SEQ ID NO: 1323043 - RNA, 16 nt, Human
ggcauccuccagcccc

SEQ ID NO: 1323044 - RNA, 17 nt, Human
ggcauccucuuuuucca

SEQ ID NO: 1323045 - RNA, 20 nt, Human
ggcauccuuccucacaccag

SEQ ID NO: 1323046 - RNA, 12 nt, Human
ggcaucucuggg

SEQ ID NO: 1323047 - RNA, 13 nt, Human
ggcaucucugggc

SEQ ID NO: 1323048 - RNA, 14 nt, Human
ggcaucucugggcu

SEQ ID NO: 1323049 - RNA, 17 nt, Human
ggcaucucugggcugga

SEQ ID NO: 1323050 - RNA, 16 nt, Human
ggcaucucugggcugg

SEQ ID NO: 1323051 - RNA, 16 nt, Human
ggcaucuggccuggcc

SEQ ID NO: 1323052 - RNA, 18 nt, Human
ggcaucuggccuggccag

SEQ ID NO: 1323053 - RNA, 21 nt, Human
ggcaucuggccuggccagugc

SEQ ID NO: 1323054 - RNA, 15 nt, Human
ggcauuuuuauuuua

SEQ ID NO: 1323055 - RNA, 18 nt, Human
ggccaggcuugucucgaa

SEQ ID NO: 1323056 - RNA, 19 nt, Human
ggccaggcuggucuaaaac

SEQ ID NO: 1323057 - RNA, 15 nt, Human
ggccagggagaagcu

SEQ ID NO: 1323058 - RNA, 16 nt, Human
ggccagggagaagcuc

SEQ ID NO: 1323059 - RNA, 17 nt, Human
ggccagggagaagcucc

SEQ ID NO: 1323060 - RNA, 18 nt, Human
ggccagggagaagcuccu

SEQ ID NO: 1323061 - RNA, 21 nt, Human
ggcauuuuuaccaucacugag

SEQ ID NO: 1323062 - RNA, 11 nt, Human
ggccagagcca

SEQ ID NO: 1323063 - RNA, 14 nt, Human
ggccagagccaagg

SEQ ID NO: 1323064 - RNA, 12 nt, Human
ggccagagccag

SEQ ID NO: 1323065 - RNA, 13 nt, Human
ggccagagccagg

SEQ ID NO: 1323066 - RNA, 14 nt, Human
ggccagagccaggg

SEQ ID NO: 1323067 - RNA, 12 nt, Human
ggccagagccca

SEQ ID NO: 1323068 - RNA, 13 nt, Human
ggccagagcccac

SEQ ID NO: 1323069 - RNA, 17 nt, Human
ggccagagcccacucca

SEQ ID NO: 1323070 - RNA, 15 nt, Human
ggccagagcccacuc

SEQ ID NO: 1323071 - RNA, 16 nt, Human
ggccagaggcccccag

SEQ ID NO: 1323072 - RNA, 18 nt, Human
ggccagaggcccccagcc

SEQ ID NO: 1323073 - RNA, 19 nt, Human
ggccagaggcccccagccc

SEQ ID NO: 1323074 - RNA, 12 nt, Human
ggccagcagcac

SEQ ID NO: 1323075 - RNA, 18 nt, Human
ggccagcagcaccugccc

SEQ ID NO: 1323076 - RNA, 19 nt, Human
ggccagcagcaccugcccu

SEQ ID NO: 1323077 - RNA, 21 nt, Human
ggccagugcccugaucccaga

SEQ ID NO: 1323078 - RNA, 18 nt, Human
ggccauauuuaccucagc

SEQ ID NO: 1323079 - RNA, 19 nt, Human
ggccauauuuaccucagcc

SEQ ID NO: 1323080 - RNA, 20 nt, Human
ggccauauuuaccucagccu

SEQ ID NO: 1323081 - RNA, 21 nt, Human
ggccauauuuaccucagccug

SEQ ID NO: 1323082 - RNA, 22 nt, Human
ggccauauuuaccucagccugg

SEQ ID NO: 1323083 - RNA, 19 nt, Human
ggccagugcccugauccca

SEQ ID NO: 1323084 - RNA, 20 nt, Human
ggccagugcccugaucccag

SEQ ID NO: 1323085 - RNA, 13 nt, Human
ggccagggcagag

SEQ ID NO: 1323086 - RNA, 20 nt, Human
ggccagggccacgcuccagc

SEQ ID NO: 1323087 - RNA, 21 nt, Human
ggccagggccacgcuccagcu

SEQ ID NO: 1323088 - RNA, 23 nt, Human
ggccagggccccucacccugccu

SEQ ID NO: 1323089 - RNA, 15 nt, Human
ggccaugauggcaac

SEQ ID NO: 1323090 - RNA, 18 nt, Human
ggccaugauggcaacaga

SEQ ID NO: 1323091 - RNA, 22 nt, Human
ggccaugauggcaacagaucug

SEQ ID NO: 1323092 - RNA, 13 nt, Human
ggccaucugcucc

SEQ ID NO: 1323093 - RNA, 14 nt, Human
ggccaucugcuccu

SEQ ID NO: 1323094 - RNA, 16 nt, Human
ggccaucugcuccugg

SEQ ID NO: 1323095 - RNA, 17 nt, Human
ggccaucugcuccugga

SEQ ID NO: 1323096 - RNA, 22 nt, Human
ggccaucugggcuccuccaggg

SEQ ID NO: 1323097 - RNA, 16 nt, Human
ggccaugacccugccu

SEQ ID NO: 1323098 - RNA, 17 nt, Human
ggccaugacccugccuc

SEQ ID NO: 1323099 - RNA, 18 nt, Human
ggccaugacccugccucu

SEQ ID NO: 1323100 - RNA, 20 nt, Human
ggccaugacccugccucucc

SEQ ID NO: 1323101 - RNA, 22 nt, Human
ggccaugacccugccucuccca

SEQ ID NO: 1323102 - RNA, 23 nt, Human
ggccccacccucguggacaccug

SEQ ID NO: 1323103 - RNA, 13 nt, Human
ggccccacccugg

SEQ ID NO: 1323104 - RNA, 12 nt, Human
ggccccacccuc

SEQ ID NO: 1323105 - RNA, 19 nt, Human
ggcccagggcccagagccc

SEQ ID NO: 1323106 - RNA, 21 nt, Human
ggcccagggcccagagcccag

SEQ ID NO: 1323107 - RNA, 22 nt, Human
ggcccagggcccagagcccagc

SEQ ID NO: 1323108 - RNA, 18 nt, Human
ggcccaggucagccacug

SEQ ID NO: 1323109 - RNA, 20 nt, Human
ggcccaggucagccacuguu

SEQ ID NO: 1323110 - RNA, 22 nt, Human
ggcccaguaccuagcuggcucu

SEQ ID NO: 1323111 - RNA, 15 nt, Human
ggccccacccugggc

SEQ ID NO: 1323112 - RNA, 17 nt, Human
ggccccacccugggccc

SEQ ID NO: 1323113 - RNA, 21 nt, Human
ggccccacccugggcccuggg

SEQ ID NO: 1323114 - RNA, 23 nt, Human
ggccccacccugggcccugggcu

SEQ ID NO: 1323115 - RNA, 17 nt, Human
ggccccacccucgggga

SEQ ID NO: 1323116 - RNA, 15 nt, Human
ggccccagcacagcu

SEQ ID NO: 1323117 - RNA, 16 nt, Human
ggcccagggcccagag

SEQ ID NO: 1323118 - RNA, 17 nt, Human
ggcccagggcccagagc

SEQ ID NO: 1323119 - RNA, 18 nt, Human
ggcccagggcccagagcc

SEQ ID NO: 1323120 - RNA, 17 nt, Human
ggcccuuccucuccacu

SEQ ID NO: 1323121 - RNA, 13 nt, Human
ggccgaguccaag

SEQ ID NO: 1323122 - RNA, 16 nt, Human
ggccgaguccaagcug

SEQ ID NO: 1323123 - RNA, 15 nt, Human
ggccgaugcccagag

SEQ ID NO: 1323124 - RNA, 12 nt, Human
ggccgcccccug

SEQ ID NO: 1323125 - RNA, 23 nt, Human
ggccgcccccagcccccuccugg

SEQ ID NO: 1323126 - RNA, 17 nt, Human
ggccgcugaguggcagg

SEQ ID NO: 1323127 - RNA, 12 nt, Human
ggccgcugccac

SEQ ID NO: 1323128 - RNA, 13 nt, Human
ggcccuuccucuc

SEQ ID NO: 1323129 - RNA, 15 nt, Human
ggcccuuccucucca

SEQ ID NO: 1323130 - RNA, 18 nt, Human
ggcccuuccucuccacug

SEQ ID NO: 1323131 - RNA, 15 nt, Human
ggcccgacagccugg

SEQ ID NO: 1323132 - RNA, 20 nt, Human
ggcccuuaugacugccaaga

SEQ ID NO: 1323133 - RNA, 19 nt, Human
ggcccuucccacaggacau

SEQ ID NO: 1323134 - RNA, 18 nt, Human
ggccccuuugcugacccu

SEQ ID NO: 1323135 - RNA, 21 nt, Human
aaauaauuuuuauauuugaaa

SEQ ID NO: 1323136 - RNA, 16 nt, Human
aaauaaugcuuugaaa

SEQ ID NO: 1323137 - RNA, 12 nt, Human
guaaaauacuuu

SEQ ID NO: 1323138 - RNA, 22 nt, Human
guaaaauacuuuuacucugccu

SEQ ID NO: 1323139 - RNA, 13 nt, Human
guaaaauacuuuu

SEQ ID NO: 1323140 - RNA, 15 nt, Human
guaaaauauuuugaa

SEQ ID NO: 1323141 - RNA, 18 nt, Human
guaaaauauuuugaauca

SEQ ID NO: 1323142 - RNA, 19 nt, Human
guaaaauauuuugaaucaa

SEQ ID NO: 1323143 - RNA, 21 nt, Human
guaaaauauuuugaaucaaua

SEQ ID NO: 1323144 - RNA, 12 nt, Human
guaaaaucuugu

SEQ ID NO: 1323145 - RNA, 15 nt, Human
guaaaaucuugucau

SEQ ID NO: 1323146 - RNA, 16 nt, Human
guaaaaucuugucaug

SEQ ID NO: 1323147 - RNA, 18 nt, Human
guaaaaucuugucaugug

SEQ ID NO: 1323148 - RNA, 19 nt, Human
guaaaaucuugucaugugu

SEQ ID NO: 1323149 - RNA, 20 nt, Human
guaaaaucuugucaugugua

SEQ ID NO: 1323150 - RNA, 21 nt, Human
guaaaaucuugucauguguau

SEQ ID NO: 1323151 - RNA, 22 nt, Human
guaaaaucuugucauguguaua

SEQ ID NO: 1323152 - RNA, 23 nt, Human
guaaaaucuugucauguguauaa

SEQ ID NO: 1323153 - RNA, 16 nt, Human
guaaaaugacaaucau

SEQ ID NO: 1323154 - RNA, 22 nt, Human
guaaaaugacaaucaugugugu

SEQ ID NO: 1323155 - RNA, 21 nt, Human
guaaaaugacaaucaugugug

SEQ ID NO: 1323156 - RNA, 19 nt, Human
guaacaauacaaauggauu

SEQ ID NO: 1323157 - RNA, 12 nt, Human
guaaagccaugc

SEQ ID NO: 1323158 - RNA, 22 nt, Human
guaaauuauuaauuuaugcaga

SEQ ID NO: 1323159 - RNA, 19 nt, Human
guaaauuggcauggaaauu

SEQ ID NO: 1323160 - RNA, 18 nt, Human
guaaaaugugggauuaug

SEQ ID NO: 1323161 - RNA, 13 nt, Human
guaaagaauuauu

SEQ ID NO: 1323162 - RNA, 14 nt, Human
guaaagaauuauuu

SEQ ID NO: 1323163 - RNA, 14 nt, Human
guaaagacuggcuu

SEQ ID NO: 1323164 - RNA, 19 nt, Human
guaaagacuggcuuuuauu

SEQ ID NO: 1323165 - RNA, 15 nt, Human
guaaagacuggcuuu

SEQ ID NO: 1323166 - RNA, 15 nt, Human
guaaagaauuauuuu

SEQ ID NO: 1323167 - RNA, 19 nt, Human
guaaagauauuuuuaucuu

SEQ ID NO: 1323168 - RNA, 22 nt, Human
guaaagauauuuuuaucuuuau

SEQ ID NO: 1323169 - RNA, 16 nt, Human
guaaagaucaauaaaa

SEQ ID NO: 1323170 - RNA, 21 nt, Human
guaaagauguuuauuucaggc

SEQ ID NO: 1323171 - RNA, 18 nt, Human
aaauaauuuuuauauuug

SEQ ID NO: 1323172 - RNA, 20 nt, Human
aaauaauuuuuauauuugaa

SEQ ID NO: 1323173 - RNA, 19 nt, Human
aaauaaugaauacauuucc

SEQ ID NO: 1323174 - RNA, 19 nt, Human
aaauaagugcccucuccca

SEQ ID NO: 1323175 - RNA, 14 nt, Human
aaauaagucaacag

SEQ ID NO: 1323176 - RNA, 15 nt, Human
aaauaagucaacagu

SEQ ID NO: 1323177 - RNA, 21 nt, Human
aaauaagucaacaguaaacca

SEQ ID NO: 1323178 - RNA, 18 nt, Human
aaauaagucaacaguaaa

SEQ ID NO: 1323179 - RNA, 12 nt, Human
aaauaaugcuuu

SEQ ID NO: 1323180 - RNA, 13 nt, Human
aaauaaugcuuug

SEQ ID NO: 1323181 - RNA, 19 nt, Human
aaauaaaaaaaaaaaagag

SEQ ID NO: 1323182 - RNA, 11 nt, Human
aaaguuuuuua

SEQ ID NO: 1323183 - RNA, 20 nt, Human
aaaguuuuauauauuauaug

SEQ ID NO: 1323184 - RNA, 21 nt, Human
aaaguuuuauauauuauaugg

SEQ ID NO: 1323185 - RNA, 23 nt, Human
aaaguuuuauauauuauauggaa

SEQ ID NO: 1323186 - RNA, 22 nt, Human
aaaguuuuauauauuauaugga

SEQ ID NO: 1323187 - RNA, 22 nt, Human
aaaguuuuuuauuaugcauuau

SEQ ID NO: 1323188 - RNA, 16 nt, Human
aaauaaaaaagauccc

SEQ ID NO: 1323189 - RNA, 15 nt, Human
aaauaaaaaagaucc

SEQ ID NO: 1323190 - RNA, 14 nt, Human
aaauaagauucuaa

SEQ ID NO: 1323191 - RNA, 15 nt, Human
aaauaagauucuaac

SEQ ID NO: 1323192 - RNA, 16 nt, Human
aaauaagauucuaacg

SEQ ID NO: 1323193 - RNA, 13 nt, Human
aaauaagcaggug

SEQ ID NO: 1323194 - RNA, 15 nt, Human
aaauaagcaggugga

SEQ ID NO: 1323195 - RNA, 22 nt, Human
aaauaagcagguggaucuauuu

SEQ ID NO: 1323196 - RNA, 12 nt, Human
aaauaagcuauu

SEQ ID NO: 1323197 - RNA, 17 nt, Human
aaauaagcuauuugaug

SEQ ID NO: 1323198 - RNA, 18 nt, Human
aaauaagcuauuugaugu

SEQ ID NO: 1323199 - RNA, 16 nt, Human
aaauaaggaaaagcuu

SEQ ID NO: 1323200 - RNA, 22 nt, Human
aaauaagcuauuugauguaaua

SEQ ID NO: 1323201 - RNA, 22 nt, Human
aaauaaggcacccaucugucug

SEQ ID NO: 1323202 - RNA, 19 nt, Human
aaauaaggcacccaucugu

SEQ ID NO: 1323203 - RNA, 13 nt, Human
aaauaagucaaca

SEQ ID NO: 1323204 - RNA, 20 nt, Human
gguuuggacaaaauggaaua

SEQ ID NO: 1323205 - RNA, 15 nt, Human
gguuucugcccugcc

SEQ ID NO: 1323206 - RNA, 17 nt, Human
gguuucugcccugccca

SEQ ID NO: 1323207 - RNA, 18 nt, Human
gguuucugcccugcccac

SEQ ID NO: 1323208 - RNA, 21 nt, Human
aaaguucccuacuuccuguga

SEQ ID NO: 1323209 - RNA, 16 nt, Human
aaaguuccaagagucu

SEQ ID NO: 1323210 - RNA, 18 nt, Human
aaaguuccaagagucuaa

SEQ ID NO: 1323211 - RNA, 20 nt, Human
aaaguuccaagagucuaaag

SEQ ID NO: 1323212 - RNA, 21 nt, Human
aaaguuccaagagucuaaaga

SEQ ID NO: 1323213 - RNA, 18 nt, Human
aaaguucaacauguuauu

SEQ ID NO: 1323214 - RNA, 10 nt, Human
aaaguguauu

SEQ ID NO: 1323215 - RNA, 14 nt, Human
aaaguguauuugga

SEQ ID NO: 1323216 - RNA, 15 nt, Human
aaaguguauuuggaa

SEQ ID NO: 1323217 - RNA, 22 nt, Human
aaaguguauuuggaaauaaagu

SEQ ID NO: 1323218 - RNA, 23 nt, Human
aaaguguauuuggaaauaaaguc

SEQ ID NO: 1323219 - RNA, 21 nt, Human
aaagugugaaauaaauuuuuu

SEQ ID NO: 1323220 - RNA, 15 nt, Human
aaaguuuaaucagag

SEQ ID NO: 1323221 - RNA, 19 nt, Human
aaaguugcagcuguuuugu

SEQ ID NO: 1323222 - RNA, 20 nt, Human
aaaguugauaaagauuuuuu

SEQ ID NO: 1323223 - RNA, 17 nt, Human
aaaguugcagcuguuuu

SEQ ID NO: 1323224 - RNA, 18 nt, Human
aaaguugcagcuguuuug

SEQ ID NO: 1323225 - RNA, 20 nt, Human
aaaguugcagcuguuuuguu

SEQ ID NO: 1323226 - RNA, 23 nt, Human
aaaguucccuacuuccugugacu

SEQ ID NO: 1323227 - RNA, 22 nt, Human
aaaguuccaagagucuaaagau

SEQ ID NO: 1323228 - RNA, 11 nt, Human
aaaguucuaag

SEQ ID NO: 1323229 - RNA, 12 nt, Human
aaaguucuaaga

SEQ ID NO: 1323230 - RNA, 16 nt, Human
aaaguugaauuuuaca

SEQ ID NO: 1323231 - RNA, 17 nt, Human
aaaguugauaaagauuu

SEQ ID NO: 1323232 - RNA, 18 nt, Human
aaaguugauaaagauuuu

SEQ ID NO: 1323233 - RNA, 23 nt, Human
aaaguugauaaagauuuuuuaau

SEQ ID NO: 1323234 - RNA, 16 nt, Human
aaaguuuguugaaaca

SEQ ID NO: 1323235 - RNA, 14 nt, Human
aaaguuuguuugcu

SEQ ID NO: 1323236 - RNA, 13 nt, Human
aaaguuuuauaua

SEQ ID NO: 1323237 - RNA, 14 nt, Human
aaaguuuuauauau

SEQ ID NO: 1323238 - RNA, 15 nt, Human
aaaguuuuauauauu

SEQ ID NO: 1323239 - RNA, 16 nt, Human
aaaguuuuauauauua

SEQ ID NO: 1323240 - RNA, 17 nt, Human
aaaguuuuauauauuau

SEQ ID NO: 1323241 - RNA, 18 nt, Human
aaaguuuuauauauuaua

SEQ ID NO: 1323242 - RNA, 19 nt, Human
aaaguuuagccccugaaag

SEQ ID NO: 1323243 - RNA, 19 nt, Human
aaaguuucaauuuguuucc

SEQ ID NO: 1323244 - RNA, 19 nt, Human
gguuucaccauguuggcca

SEQ ID NO: 1323245 - RNA, 16 nt, Human
gguuucaaagaugcug

SEQ ID NO: 1323246 - RNA, 18 nt, Human
gguuucaaagaugcugug

SEQ ID NO: 1323247 - RNA, 20 nt, Human
gguuucaaagaugcugugag

SEQ ID NO: 1323248 - RNA, 19 nt, Human
gguuucaccauguugccca

SEQ ID NO: 1323249 - RNA, 21 nt, Human
gguuucucgcauaggaccuuu

SEQ ID NO: 1323250 - RNA, 20 nt, Human
gguuucaccauguuggccag

SEQ ID NO: 1323251 - RNA, 17 nt, Human
gguuucugaguuccugc

SEQ ID NO: 1323252 - RNA, 14 nt, Human
gguuucugcccugc

SEQ ID NO: 1323253 - RNA, 19 nt, Human
gguuccuuccucugagccu

SEQ ID NO: 1323254 - RNA, 20 nt, Human
gguuccuuccucugagccuu

SEQ ID NO: 1323255 - RNA, 18 nt, Human
gguuccuccccuccagcu

SEQ ID NO: 1323256 - RNA, 18 nt, Human
gguucucagguguugcca

SEQ ID NO: 1323257 - RNA, 19 nt, Human
gguucuccguuagcuccug

SEQ ID NO: 1323258 - RNA, 20 nt, Human
gguucuccguuagcuccugu

SEQ ID NO: 1323259 - RNA, 21 nt, Human
gguucuccguuagcuccugug

SEQ ID NO: 1323260 - RNA, 21 nt, Human
gguuuaugacaguaauugugu

SEQ ID NO: 1323261 - RNA, 16 nt, Human
gguuuagaaagcuugc

SEQ ID NO: 1323262 - RNA, 17 nt, Human
gguucugagauggcucc

SEQ ID NO: 1323263 - RNA, 18 nt, Human
gguucugagauggcuccc

SEQ ID NO: 1323264 - RNA, 20 nt, Human
gguucugccugccagcugca

SEQ ID NO: 1323265 - RNA, 19 nt, Human
gguucugccugccagcugc

SEQ ID NO: 1323266 - RNA, 13 nt, Human
gguucuggcuguu

SEQ ID NO: 1323267 - RNA, 12 nt, Human
ggugugcuggga

SEQ ID NO: 1323268 - RNA, 19 nt, Human
ggugugcugggagcuccac

SEQ ID NO: 1323269 - RNA, 22 nt, Human
ggugugcugggagcuccacucu

SEQ ID NO: 1323270 - RNA, 12 nt, Human
gguucaggcccg

SEQ ID NO: 1323271 - RNA, 13 nt, Human
gguucaggcccgg

SEQ ID NO: 1323272 - RNA, 17 nt, Human
gguuccguguccacccc

SEQ ID NO: 1323273 - RNA, 19 nt, Human
gguuccguguccaccccca

SEQ ID NO: 1323274 - RNA, 16 nt, Human
gguuccuccccuccuc

SEQ ID NO: 1323275 - RNA, 12 nt, Human
gguuccacagac

SEQ ID NO: 1323276 - RNA, 24 nt, Human
gguuccagcaauucuccugccuca

SEQ ID NO: 1323277 - RNA, 15 nt, Human
gguuccccuguucac

SEQ ID NO: 1323278 - RNA, 17 nt, Human
gguucccguuucuccac

SEQ ID NO: 1323279 - RNA, 23 nt, Human
gguuccagcaauucuccugccuc

SEQ ID NO: 1323280 - RNA, 18 nt, Human
aaagccuguuuaagagac

SEQ ID NO: 1323281 - RNA, 16 nt, Human
aaagccuguuuaagag

SEQ ID NO: 1323282 - RNA, 15 nt, Human
aaagcaucuugcauu

SEQ ID NO: 1323283 - RNA, 18 nt, Human
aaagccuucuuuuggggg

SEQ ID NO: 1323284 - RNA, 11 nt, Human
aaagccuucuu

SEQ ID NO: 1323285 - RNA, 16 nt, Human
aaagccuuuauuuguu

SEQ ID NO: 1323286 - RNA, 12 nt, Human
aaagcgaaaaaa

SEQ ID NO: 1323287 - RNA, 16 nt, Human
aaagcgaaaaaaucag

SEQ ID NO: 1323288 - RNA, 17 nt, Human
ggugggaggaugugaau

SEQ ID NO: 1323289 - RNA, 17 nt, Human
gguggggggggugcugg

SEQ ID NO: 1323290 - RNA, 12 nt, Human
gguggggcagcu

SEQ ID NO: 1323291 - RNA, 13 nt, Human
gguggggcagcuc

SEQ ID NO: 1323292 - RNA, 15 nt, Human
gguggggcagcuccu

SEQ ID NO: 1323293 - RNA, 10 nt, Human
ggugggggua

SEQ ID NO: 1323294 - RNA, 23 nt, Human
gguggggguaggguuucccuacu

SEQ ID NO: 1323295 - RNA, 20 nt, Human
gguggggguagggggcugga

SEQ ID NO: 1323296 - RNA, 15 nt, Human
ggugucucaggcugc

SEQ ID NO: 1323297 - RNA, 16 nt, Human
ggugucucaggcugcc

SEQ ID NO: 1323298 - RNA, 17 nt, Human
ggugucucaggcugccu

SEQ ID NO: 1323299 - RNA, 18 nt, Human
ggugucucaggcugccug

SEQ ID NO: 1323300 - RNA, 20 nt, Human
ggugucucaggcugccugag

SEQ ID NO: 1323301 - RNA, 16 nt, Human
ggugugaccacugcag

SEQ ID NO: 1323302 - RNA, 21 nt, Human
ggugucucaggcugccugagu

SEQ ID NO: 1323303 - RNA, 20 nt, Human
ggugucuugggcagagcugg

SEQ ID NO: 1323304 - RNA, 15 nt, Human
ggugugaucgucuga

SEQ ID NO: 1323305 - RNA, 18 nt, Human
ggugugaucgucugacug

SEQ ID NO: 1323306 - RNA, 16 nt, Human
ggugugcaccaggguu

SEQ ID NO: 1323307 - RNA, 17 nt, Human
ggugugcaccaggguug

SEQ ID NO: 1323308 - RNA, 14 nt, Human
ggucggaccagcuu

SEQ ID NO: 1323309 - RNA, 22 nt, Human
ggucgggcagcacaaguguaau

SEQ ID NO: 1323310 - RNA, 14 nt, Human
ggucggggcaucug

SEQ ID NO: 1323311 - RNA, 20 nt, Human
ggucggggcaucuggccugg

SEQ ID NO: 1323312 - RNA, 20 nt, Human
ggucgguagguucagccaag

SEQ ID NO: 1323313 - RNA, 14 nt, Human
ggucggugccuuca

SEQ ID NO: 1323314 - RNA, 15 nt, Human
ggucggugccuucaa

SEQ ID NO: 1323315 - RNA, 14 nt, Human
ggucguggagagcu

SEQ ID NO: 1323316 - RNA, 15 nt, Human
ggucguggagagcua

SEQ ID NO: 1323317 - RNA, 20 nt, Human
ggucguggagagcuaggagc

SEQ ID NO: 1323318 - RNA, 13 nt, Human
ggucggaccagcu

SEQ ID NO: 1323319 - RNA, 19 nt, Human
ggucgcccuuugcugcaug

SEQ ID NO: 1323320 - RNA, 18 nt, Human
ggucgcuugggaauuuua

SEQ ID NO: 1323321 - RNA, 14 nt, Human
ggucguuuuuuuca

SEQ ID NO: 1323322 - RNA, 19 nt, Human
ggucguggagagcuaggag

SEQ ID NO: 1323323 - RNA, 14 nt, Human
ggucuaggacacag

SEQ ID NO: 1323324 - RNA, 17 nt, Human
gguccugguggggcagc

SEQ ID NO: 1323325 - RNA, 18 nt, Human
gguccugguggggcagcu

SEQ ID NO: 1323326 - RNA, 12 nt, Human
ggucgcuccugc

SEQ ID NO: 1323327 - RNA, 13 nt, Human
ggucgcuccugcc

SEQ ID NO: 1323328 - RNA, 14 nt, Human
ggucgcuccugccc

SEQ ID NO: 1323329 - RNA, 19 nt, Human
gguccugguggggcagcuc

SEQ ID NO: 1323330 - RNA, 20 nt, Human
gguccugagcacugccagga

SEQ ID NO: 1323331 - RNA, 17 nt, Human
gguccuggagcagacca

SEQ ID NO: 1323332 - RNA, 21 nt, Human
gguccuggagcagaccacccc

SEQ ID NO: 1323333 - RNA, 15 nt, Human
gguccugggaggaga

SEQ ID NO: 1323334 - RNA, 18 nt, Human
gguccuccuccagggaca

SEQ ID NO: 1323335 - RNA, 13 nt, Human
gguccucugucag

SEQ ID NO: 1323336 - RNA, 21 nt, Human
gguccucugucagucacagcc

SEQ ID NO: 1323337 - RNA, 23 nt, Human
gguccucugucagucacagccac

SEQ ID NO: 1323338 - RNA, 22 nt, Human
gguccucuucugggccugacca

SEQ ID NO: 1323339 - RNA, 19 nt, Human
gguccucuucugggccuga

SEQ ID NO: 1323340 - RNA, 15 nt, Human
gguccugagcacugc

SEQ ID NO: 1323341 - RNA, 16 nt, Human
gguccugagcacugcc

SEQ ID NO: 1323342 - RNA, 18 nt, Human
gguccugagcacugccag

SEQ ID NO: 1323343 - RNA, 19 nt, Human
gguccugagcacugccagg

SEQ ID NO: 1323344 - RNA, 13 nt, Human
aaagcaaaugucu

SEQ ID NO: 1323345 - RNA, 14 nt, Human
aaagcaacacuuuu

SEQ ID NO: 1323346 - RNA, 18 nt, Human
aaagcaagaaucagagaa

SEQ ID NO: 1323347 - RNA, 22 nt, Human
aaagcaagcauucagaagaaaa

SEQ ID NO: 1323348 - RNA, 14 nt, Human
aaagcaagaaucag

SEQ ID NO: 1323349 - RNA, 20 nt, Human
aaagcaagcauucagaagaa

SEQ ID NO: 1323350 - RNA, 21 nt, Human
gguccucagagaauuucuacc

SEQ ID NO: 1323351 - RNA, 14 nt, Human
gguccucagagaau

SEQ ID NO: 1323352 - RNA, 16 nt, Human
gguccuauggccucau

SEQ ID NO: 1323353 - RNA, 14 nt, Human
gguccuccuccagg

SEQ ID NO: 1323354 - RNA, 17 nt, Human
gguccuccuccagggac

SEQ ID NO: 1323355 - RNA, 19 nt, Human
gguccuccuccagggacag

SEQ ID NO: 1323356 - RNA, 15 nt, Human
aaagcaaaccuguaa

SEQ ID NO: 1323357 - RNA, 11 nt, Human
aaagcaaagca

SEQ ID NO: 1323358 - RNA, 17 nt, Human
aaagcaaagcacagaga

SEQ ID NO: 1323359 - RNA, 14 nt, Human
aaagcaaaucauuu

SEQ ID NO: 1323360 - RNA, 22 nt, Human
aaagcaaaagaucccuuuuucu

SEQ ID NO: 1323361 - RNA, 20 nt, Human
aaagacguuuuauaagcauc

SEQ ID NO: 1323362 - RNA, 21 nt, Human
aaagauucuauaguucuagac

SEQ ID NO: 1323363 - RNA, 22 nt, Human
aaagauucugaccuuaaaugca

SEQ ID NO: 1323364 - RNA, 23 nt, Human
aaagauugaaguauuuugcugga

SEQ ID NO: 1323365 - RNA, 15 nt, Human
aaagauugagagaau

SEQ ID NO: 1323366 - RNA, 19 nt, Human
aaagauugcugaaauuuua

SEQ ID NO: 1323367 - RNA, 21 nt, Human
aaagauugcugaaauuuuaua

SEQ ID NO: 1323368 - RNA, 20 nt, Human
ggugcugggccccugccucu

SEQ ID NO: 1323369 - RNA, 16 nt, Human
ggugcuggggccuggu

SEQ ID NO: 1323370 - RNA, 13 nt, Human
ggugcuggucccg

SEQ ID NO: 1323371 - RNA, 21 nt, Human
ggugcaauguguguauaugga

SEQ ID NO: 1323372 - RNA, 22 nt, Human
ggugcaauguguguauauggac

SEQ ID NO: 1323373 - RNA, 13 nt, Human
ggugcaauuucaa

SEQ ID NO: 1323374 - RNA, 23 nt, Human
ggugccaaacaaaaagguucuca

SEQ ID NO: 1323375 - RNA, 23 nt, Human
ggugccaauuucaaguuccaagu

SEQ ID NO: 1323376 - RNA, 10 nt, Human
ggugccaccu

SEQ ID NO: 1323377 - RNA, 12 nt, Human
ggugccagaagc

SEQ ID NO: 1323378 - RNA, 19 nt, Human
ggucuguuggcaggcuggc

SEQ ID NO: 1323379 - RNA, 20 nt, Human
ggucuguuggcaggcuggcc

SEQ ID NO: 1323380 - RNA, 12 nt, Human
ggucuguuugca

SEQ ID NO: 1323381 - RNA, 15 nt, Human
ggucuuacagcaggc

SEQ ID NO: 1323382 - RNA, 24 nt, Human
aaagcaucccucacccauccuaga

SEQ ID NO: 1323383 - RNA, 17 nt, Human
aaagcaucccucaccca

SEQ ID NO: 1323384 - RNA, 22 nt, Human
aaagcaucuugcauuaugcaau

SEQ ID NO: 1323385 - RNA, 15 nt, Human
aaagcaucccucacc

SEQ ID NO: 1323386 - RNA, 12 nt, Human
aaagcaucccuc

SEQ ID NO: 1323387 - RNA, 20 nt, Human
aaagcaucauggcuaucugu

SEQ ID NO: 1323388 - RNA, 17 nt, Human
aaagcaggcagaacuca

SEQ ID NO: 1323389 - RNA, 19 nt, Human
aaagcaggcagaacucauc

SEQ ID NO: 1323390 - RNA, 17 nt, Human
aaagcagggacuugaac

SEQ ID NO: 1323391 - RNA, 17 nt, Human
gguggcacaggcccccu

SEQ ID NO: 1323392 - RNA, 23 nt, Human
gguggcacaggaguguccucuuc

SEQ ID NO: 1323393 - RNA, 18 nt, Human
gguggcacaggcccccuu

SEQ ID NO: 1323394 - RNA, 14 nt, Human
gguggauggcccca

SEQ ID NO: 1323395 - RNA, 22 nt, Human
gguggauggccccagcacagcu

SEQ ID NO: 1323396 - RNA, 21 nt, Human
ggugcuucuaguucugccagg

SEQ ID NO: 1323397 - RNA, 22 nt, Human
gguaugaacuugaggacacaug

SEQ ID NO: 1323398 - RNA, 21 nt, Human
gguaugaacuugaggacacau

SEQ ID NO: 1323399 - RNA, 17 nt, Human
gguaugaagaguguuau

SEQ ID NO: 1323400 - RNA, 12 nt, Human
gguaggaaaugu

SEQ ID NO: 1323401 - RNA, 14 nt, Human
gguagcuuuucccu

SEQ ID NO: 1323402 - RNA, 23 nt, Human
gguaugaacuugaggacacaugu

SEQ ID NO: 1323403 - RNA, 13 nt, Human
gguaugaagagug

SEQ ID NO: 1323404 - RNA, 16 nt, Human
gguccacaacacacag

SEQ ID NO: 1323405 - RNA, 17 nt, Human
gguccaauuaguuuccu

SEQ ID NO: 1323406 - RNA, 18 nt, Human
gguccaauuaguuuccuu

SEQ ID NO: 1323407 - RNA, 18 nt, Human
gguccacaggucuagacu

SEQ ID NO: 1323408 - RNA, 12 nt, Human
gguccagggcua

SEQ ID NO: 1323409 - RNA, 16 nt, Human
aaagaaugauuaugaa

SEQ ID NO: 1323410 - RNA, 16 nt, Human
aaagaauagaagcuaa

SEQ ID NO: 1323411 - RNA, 13 nt, Human
aaagacaccuacu

SEQ ID NO: 1323412 - RNA, 19 nt, Human
aaagacaccuacugagugg

SEQ ID NO: 1323413 - RNA, 22 nt, Human
aaagacacauuuuuuaggaaau

SEQ ID NO: 1323414 - RNA, 14 nt, Human
gguccaugggcaga

SEQ ID NO: 1323415 - RNA, 16 nt, Human
gguccaugggcagagc

SEQ ID NO: 1323416 - RNA, 18 nt, Human
aaagaaguggggacagag

SEQ ID NO: 1323417 - RNA, 24 nt, Human
aaagaaguguggggauuuucacug

SEQ ID NO: 1323418 - RNA, 13 nt, Human
gguccaugggcag

SEQ ID NO: 1323419 - RNA, 18 nt, Human
ggguggggggggugcugg

SEQ ID NO: 1323420 - RNA, 13 nt, Human
ggguggggagaga

SEQ ID NO: 1323421 - RNA, 16 nt, Human
gggugggguggcugca

SEQ ID NO: 1323422 - RNA, 23 nt, Human
gggugucuugggcagagcuggcu

SEQ ID NO: 1323423 - RNA, 13 nt, Human
gggugugcuggga

SEQ ID NO: 1323424 - RNA, 23 nt, Human
ggguguccugcaccggggccugg

SEQ ID NO: 1323425 - RNA, 15 nt, Human
gggugucuugggcag

SEQ ID NO: 1323426 - RNA, 21 nt, Human
gggugucuugggcagagcugg

SEQ ID NO: 1323427 - RNA, 11 nt, Human
ggggccuggca

SEQ ID NO: 1323428 - RNA, 12 nt, Human
ggggccuggcag

SEQ ID NO: 1323429 - RNA, 22 nt, Human
ggggccugccaccuggaccccu

SEQ ID NO: 1323430 - RNA, 15 nt, Human
gggugggcaguuuuu

SEQ ID NO: 1323431 - RNA, 19 nt, Human
ggguuucugcccugcccac

SEQ ID NO: 1323432 - RNA, 15 nt, Human
ggguuucugcccugc

SEQ ID NO: 1323433 - RNA, 17 nt, Human
ggguuugugacagggcg

SEQ ID NO: 1323434 - RNA, 16 nt, Human
ggguuuuaacuuuguu

SEQ ID NO: 1323435 - RNA, 15 nt, Human
ggguuuuaacuuugu

SEQ ID NO: 1323436 - RNA, 14 nt, Human
gguaaucgaccugc

SEQ ID NO: 1323437 - RNA, 17 nt, Human
gguaaucgaccugccuc

SEQ ID NO: 1323438 - RNA, 18 nt, Human
gguaaucgaccugccucg

SEQ ID NO: 1323439 - RNA, 23 nt, Human
gguacaaccuguucugcuuuccu

SEQ ID NO: 1323440 - RNA, 22 nt, Human
gguaauuguugcuaaucuucuu

SEQ ID NO: 1323441 - RNA, 24 nt, Human
gguacaaccuguucugcuuuccuc

SEQ ID NO: 1323442 - RNA, 10 nt, Human
gguacagaga

SEQ ID NO: 1323443 - RNA, 12 nt, Human
gguacagagaag

SEQ ID NO: 1323444 - RNA, 13 nt, Human
gguacagagaagc

SEQ ID NO: 1323445 - RNA, 14 nt, Human
gguacagagaagcc

SEQ ID NO: 1323446 - RNA, 15 nt, Human
gguacagagaagcca

SEQ ID NO: 1323447 - RNA, 16 nt, Human
gguacagagaagccag

SEQ ID NO: 1323448 - RNA, 21 nt, Human
gguacagagaagccagcuugu

SEQ ID NO: 1323449 - RNA, 17 nt, Human
gguacaguauggggguu

SEQ ID NO: 1323450 - RNA, 16 nt, Human
gguacauggugcuggg

SEQ ID NO: 1323451 - RNA, 18 nt, Human
gguacaugguguuugugg

SEQ ID NO: 1323452 - RNA, 14 nt, Human
gguaccagaugcag

SEQ ID NO: 1323453 - RNA, 17 nt, Human
gguaccagauaacuuuu

SEQ ID NO: 1323454 - RNA, 22 nt, Human
gguagcgggggaggguaggcag

SEQ ID NO: 1323455 - RNA, 15 nt, Human
aaacacccucacacu

SEQ ID NO: 1323456 - RNA, 18 nt, Human
aaacaccuccucauguac

SEQ ID NO: 1323457 - RNA, 15 nt, Human
aaacaccaacauaaa

SEQ ID NO: 1323458 - RNA, 19 nt, Human
aaacaccaacauaaaaaug

SEQ ID NO: 1323459 - RNA, 19 nt, Human
aaacaccaacauguuggga

SEQ ID NO: 1323460 - RNA, 22 nt, Human
aaacaccuuccagcuccuguaa

SEQ ID NO: 1323461 - RNA, 14 nt, Human
aaacagugagccug

SEQ ID NO: 1323462 - RNA, 21 nt, Human
aaacaguugcacagcaucuca

SEQ ID NO: 1323463 - RNA, 19 nt, Human
aaacaguugcacagcaucu

SEQ ID NO: 1323464 - RNA, 18 nt, Human
aaacaguugcauguagua

SEQ ID NO: 1323465 - RNA, 19 nt, Human
aaacaguugcauguaguaa

SEQ ID NO: 1323466 - RNA, 18 nt, Human
aaacaguugcacagcauc

SEQ ID NO: 1323467 - RNA, 17 nt, Human
aaacaguugcacagcau

SEQ ID NO: 1323468 - RNA, 16 nt, Human
aaacaguugcacagca

SEQ ID NO: 1323469 - RNA, 15 nt, Human
aaacaguugcacagc

SEQ ID NO: 1323470 - RNA, 23 nt, Human
aaacaguggaucacaaaguggaa

SEQ ID NO: 1323471 - RNA, 20 nt, Human
aaacaguugcauguaguaac

SEQ ID NO: 1323472 - RNA, 24 nt, Human
aaacaguugcauguaguaacacua

SEQ ID NO: 1323473 - RNA, 20 nt, Human
aaacaagcacuaaacaaaga

SEQ ID NO: 1323474 - RNA, 13 nt, Human
aaacaaaaacacu

SEQ ID NO: 1323475 - RNA, 19 nt, Human
aaacaaaaauuaaaauccu

SEQ ID NO: 1323476 - RNA, 13 nt, Human
ggggccaggcugg

SEQ ID NO: 1323477 - RNA, 19 nt, Human
ggggccagauccagccugg

SEQ ID NO: 1323478 - RNA, 21 nt, Human
ggggccuccaugggccccagg

SEQ ID NO: 1323479 - RNA, 13 nt, Human
ggggccagaggcu

SEQ ID NO: 1323480 - RNA, 13 nt, Human
ggggccagaucca

SEQ ID NO: 1323481 - RNA, 14 nt, Human
ggggccagauccag

SEQ ID NO: 1323482 - RNA, 17 nt, Human
ggggccagauccagccu

SEQ ID NO: 1323483 - RNA, 12 nt, Human
ggggccugagca

SEQ ID NO: 1323484 - RNA, 17 nt, Human
ggggccugagcaguccu

SEQ ID NO: 1323485 - RNA, 23 nt, Human
ggggccugagcaguccuuggccu

SEQ ID NO: 1323486 - RNA, 12 nt, Human
ggggccugccac

SEQ ID NO: 1323487 - RNA, 18 nt, Human
ggggccugccaccuggac

SEQ ID NO: 1323488 - RNA, 19 nt, Human
ggggccugccaccuggacc

SEQ ID NO: 1323489 - RNA, 20 nt, Human
ggggccugccaccuggaccc

SEQ ID NO: 1323490 - RNA, 23 nt, Human
ggggccugcccagugcacuugcu

SEQ ID NO: 1323491 - RNA, 19 nt, Human
ggggccuggagauccuccu

SEQ ID NO: 1323492 - RNA, 20 nt, Human
aaacaugcagaacaaaugaa

SEQ ID NO: 1323493 - RNA, 16 nt, Human
aaacaugcagaacaaa

SEQ ID NO: 1323494 - RNA, 16 nt, Human
ggggcaucuggccugg

SEQ ID NO: 1323495 - RNA, 15 nt, Human
ggggcaucuggccug

SEQ ID NO: 1323496 - RNA, 12 nt, Human
ggggccagaggc

SEQ ID NO: 1323497 - RNA, 22 nt, Human
aaacaucuuugaaauuauguaa

SEQ ID NO: 1323498 - RNA, 19 nt, Human
aaacaugacccuaaaucuu

SEQ ID NO: 1323499 - RNA, 21 nt, Human
aaacaugacccuaaaucuuga

SEQ ID NO: 1323500 - RNA, 18 nt, Human
aaacauccuacaagacac

SEQ ID NO: 1323501 - RNA, 19 nt, Human
aaacaucauucauuuuugu

SEQ ID NO: 1323502 - RNA, 22 nt, Human
aaacauccuacaagacacagug

SEQ ID NO: 1323503 - RNA, 17 nt, Human
aaacauccucuuccaua

SEQ ID NO: 1323504 - RNA, 16 nt, Human
aaacaucuuugaaauu

SEQ ID NO: 1323505 - RNA, 17 nt, Human
aaacaucuuugaaauua

SEQ ID NO: 1323506 - RNA, 19 nt, Human
gggcuggugggugccuagg

SEQ ID NO: 1323507 - RNA, 14 nt, Human
gggcugguucugua

SEQ ID NO: 1323508 - RNA, 18 nt, Human
aaaaugucuuguguuacc

SEQ ID NO: 1323509 - RNA, 15 nt, Human
aaaaugugauaugua

SEQ ID NO: 1323510 - RNA, 15 nt, Human
aaaaugugauguucu

SEQ ID NO: 1323511 - RNA, 17 nt, Human
aaaaugugauguucuaa

SEQ ID NO: 1323512 - RNA, 19 nt, Human
aaaaugugauguucuaagg

SEQ ID NO: 1323513 - RNA, 20 nt, Human
aaaaugugauguucuaaggc

SEQ ID NO: 1323514 - RNA, 21 nt, Human
aaaaugugauguucuaaggcu

SEQ ID NO: 1323515 - RNA, 19 nt, Human
aaaaugugcuauacugcau

SEQ ID NO: 1323516 - RNA, 12 nt, Human
aaaaugugugug

SEQ ID NO: 1323517 - RNA, 20 nt, Human
aaaaugugcuauacugcaua

SEQ ID NO: 1323518 - RNA, 22 nt, Human
aaaaugugggauuaugggucac

SEQ ID NO: 1323519 - RNA, 21 nt, Human
aaaaugugggauuauggguca

SEQ ID NO: 1323520 - RNA, 18 nt, Human
aaaauguuaucuucucaa

SEQ ID NO: 1323521 - RNA, 18 nt, Human
aaaauuuguuauuuugca

SEQ ID NO: 1323522 - RNA, 16 nt, Human
aaaauuuguucuugua

SEQ ID NO: 1323523 - RNA, 19 nt, Human
aaaauuuguucuuguauuu

SEQ ID NO: 1323524 - RNA, 20 nt, Human
aaaauuuguucuuguauuua

SEQ ID NO: 1323525 - RNA, 13 nt, Human
aaaauuuguugca

SEQ ID NO: 1323526 - RNA, 14 nt, Human
aaaauuuguugcau

SEQ ID NO: 1323527 - RNA, 13 nt, Human
gggcugggaaguc

SEQ ID NO: 1323528 - RNA, 16 nt, Human
gggcugggagcucugc

SEQ ID NO: 1323529 - RNA, 18 nt, Human
gggcugggagcucugcag

SEQ ID NO: 1323530 - RNA, 11 nt, Human
gggcuggcugg

SEQ ID NO: 1323531 - RNA, 13 nt, Human
gggcugcccuggu

SEQ ID NO: 1323532 - RNA, 14 nt, Human
gggcugcccuggug

SEQ ID NO: 1323533 - RNA, 15 nt, Human
gggcugcccuggugc

SEQ ID NO: 1323534 - RNA, 21 nt, Human
gggcugcccuggugcugccac

SEQ ID NO: 1323535 - RNA, 20 nt, Human
gggcuacccugagcugaggc

SEQ ID NO: 1323536 - RNA, 21 nt, Human
gggcuauuuuguuugcuucau

SEQ ID NO: 1323537 - RNA, 18 nt, Human
gggcucaaucucuggggg

SEQ ID NO: 1323538 - RNA, 19 nt, Human
gggcugcaguucgacucug

SEQ ID NO: 1323539 - RNA, 14 nt, Human
gggcucacacaccu

SEQ ID NO: 1323540 - RNA, 15 nt, Human
gggcuaccaggaaag

SEQ ID NO: 1323541 - RNA, 13 nt, Human
gggcuacccugag

SEQ ID NO: 1323542 - RNA, 12 nt, Human
gggcuaccagga

SEQ ID NO: 1323543 - RNA, 16 nt, Human
gggcuacccugagcug

SEQ ID NO: 1323544 - RNA, 19 nt, Human
gggcuacccugagcugagg

SEQ ID NO: 1323545 - RNA, 21 nt, Human
gggcuacccugagcugaggca

SEQ ID NO: 1323546 - RNA, 23 nt, Human
gggcuacaccuuagccugcccuc

SEQ ID NO: 1323547 - RNA, 13 nt, Human
gggcuaauuuaac

SEQ ID NO: 1323548 - RNA, 17 nt, Human
gggcgggcagagggcug

SEQ ID NO: 1323549 - RNA, 14 nt, Human
gggcggggguggcg

SEQ ID NO: 1323550 - RNA, 17 nt, Human
gggcggcaggggccugg

SEQ ID NO: 1323551 - RNA, 21 nt, Human
gggcggcaggggccuggagau

SEQ ID NO: 1323552 - RNA, 22 nt, Human
gggcggccuaugacuugggcac

SEQ ID NO: 1323553 - RNA, 22 nt, Human
gggccucggacuuagcugggag

SEQ ID NO: 1323554 - RNA, 22 nt, Human
gggccuauggagagcccuggga

SEQ ID NO: 1323555 - RNA, 19 nt, Human
gggccucaaaggcccgcuc

SEQ ID NO: 1323556 - RNA, 20 nt, Human
gggccucaaaggcccgcucu

SEQ ID NO: 1323557 - RNA, 20 nt, Human
gggccuccaugggccccagg

SEQ ID NO: 1323558 - RNA, 12 nt, Human
gggccugagcag

SEQ ID NO: 1323559 - RNA, 20 nt, Human
gggccugagcaguccuuggc

SEQ ID NO: 1323560 - RNA, 21 nt, Human
gggccugagcaguccuuggcc

SEQ ID NO: 1323561 - RNA, 22 nt, Human
gggccaugauggcaacagaucu

SEQ ID NO: 1323562 - RNA, 23 nt, Human
gggccaugauggcaacagaucug

SEQ ID NO: 1323563 - RNA, 14 nt, Human
gggccaugcugagg

SEQ ID NO: 1323564 - RNA, 15 nt, Human
gggccaugcugaggc

SEQ ID NO: 1323565 - RNA, 22 nt, Human
gggcccuggugguggcucggga

SEQ ID NO: 1323566 - RNA, 18 nt, Human
gggcccuggggccuguac

SEQ ID NO: 1323567 - RNA, 17 nt, Human
gggccaugcugaggccu

SEQ ID NO: 1323568 - RNA, 12 nt, Human
gggcccuggggc

SEQ ID NO: 1323569 - RNA, 14 nt, Human
gggcccuggggccu

SEQ ID NO: 1323570 - RNA, 15 nt, Human
gggcccuggggccug

SEQ ID NO: 1323571 - RNA, 17 nt, Human
gggcccuggggccugua

SEQ ID NO: 1323572 - RNA, 20 nt, Human
gggcccuggggccuguacug

SEQ ID NO: 1323573 - RNA, 17 nt, Human
gggcccuuugagugcag

SEQ ID NO: 1323574 - RNA, 14 nt, Human
gggccgacuaagag

SEQ ID NO: 1323575 - RNA, 15 nt, Human
gggccgaugcccaga

SEQ ID NO: 1323576 - RNA, 17 nt, Human
gggccgaugcccagaga

SEQ ID NO: 1323577 - RNA, 16 nt, Human
gggccgaugcccagag

SEQ ID NO: 1323578 - RNA, 17 nt, Human
gggccuacuagagucug

SEQ ID NO: 1323579 - RNA, 15 nt, Human
gggccuaggcugcau

SEQ ID NO: 1323580 - RNA, 14 nt, Human
gggccuauggagag

SEQ ID NO: 1323581 - RNA, 16 nt, Human
gggccuauggagagcc

SEQ ID NO: 1323582 - RNA, 18 nt, Human
gggccuauggagagcccu

SEQ ID NO: 1323583 - RNA, 19 nt, Human
gggccuauggagagcccug

SEQ ID NO: 1323584 - RNA, 20 nt, Human
gggccuauggagagcccugg

SEQ ID NO: 1323585 - RNA, 21 nt, Human
gggccuauggagagcccuggg

SEQ ID NO: 1323586 - RNA, 15 nt, Human
gggccaggcuggguc

SEQ ID NO: 1323587 - RNA, 14 nt, Human
gggccaggcugggu

SEQ ID NO: 1323588 - RNA, 21 nt, Human
gggccaggcugggucgcccug

SEQ ID NO: 1323589 - RNA, 22 nt, Human
gggccagucuguggaucagaga

SEQ ID NO: 1323590 - RNA, 11 nt, Human
gggccagccuc

SEQ ID NO: 1323591 - RNA, 12 nt, Human
gggccagccucu

SEQ ID NO: 1323592 - RNA, 21 nt, Human
aaaaugcuguauuagucacag

SEQ ID NO: 1323593 - RNA, 18 nt, Human
aaaaugcucuuauuucau

SEQ ID NO: 1323594 - RNA, 19 nt, Human
aaaaugcuggcuauagaug

SEQ ID NO: 1323595 - RNA, 20 nt, Human
aaaaugcucuuauuucauca

SEQ ID NO: 1323596 - RNA, 17 nt, Human
aaaaugcucuuauuuca

SEQ ID NO: 1323597 - RNA, 16 nt, Human
aaaaugcuagguucua

SEQ ID NO: 1323598 - RNA, 18 nt, Human
aaaaugcgguuauaaaaa

SEQ ID NO: 1323599 - RNA, 22 nt, Human
aaaaugcgguuauaaaaaaugg

SEQ ID NO: 1323600 - RNA, 13 nt, Human
aaaaugcuagguu

SEQ ID NO: 1323601 - RNA, 15 nt, Human
aaaaugcuagguucu

SEQ ID NO: 1323602 - RNA, 19 nt, Human
aaaaguauguuagugcaaa

SEQ ID NO: 1323603 - RNA, 13 nt, Human
aaaaguagcaauu

SEQ ID NO: 1323604 - RNA, 23 nt, Human
aaaaguauguucuaaccuuuaca

SEQ ID NO: 1323605 - RNA, 14 nt, Human
aaaaucuuaaugua

SEQ ID NO: 1323606 - RNA, 18 nt, Human
aaaaucuuauaguucuag

SEQ ID NO: 1323607 - RNA, 19 nt, Human
aaaaucuuauaguucuagg

SEQ ID NO: 1323608 - RNA, 20 nt, Human
aaaaucuuauaguucuaggc

SEQ ID NO: 1323609 - RNA, 18 nt, Human
aaaaucuugaucaguuaa

SEQ ID NO: 1323610 - RNA, 15 nt, Human
aaaaucuugaucagu

SEQ ID NO: 1323611 - RNA, 11 nt, Human
aaaaucuuguc

SEQ ID NO: 1323612 - RNA, 12 nt, Human
aaaaucuuguca

SEQ ID NO: 1323613 - RNA, 13 nt, Human
aaaaucuugucau

SEQ ID NO: 1323614 - RNA, 19 nt, Human
aaaaucuugucauguguau

SEQ ID NO: 1323615 - RNA, 14 nt, Human
aaaaugacaaucau

SEQ ID NO: 1323616 - RNA, 14 nt, Human
aaaaugauacagca

SEQ ID NO: 1323617 - RNA, 19 nt, Human
aaaaugauauuguuauaua

SEQ ID NO: 1323618 - RNA, 14 nt, Human
aaaaugaaagcuac

SEQ ID NO: 1323619 - RNA, 19 nt, Human
aaaaugaaagcuacucaua

SEQ ID NO: 1323620 - RNA, 13 nt, Human
aaaagcagacauu

SEQ ID NO: 1323621 - RNA, 14 nt, Human
aaaagcaaaucauu

SEQ ID NO: 1323622 - RNA, 13 nt, Human
aaaagcaacacuu

SEQ ID NO: 1323623 - RNA, 14 nt, Human
aaaagcaacauuca

SEQ ID NO: 1323624 - RNA, 18 nt, Human
aaaagaugaaagagcagu

SEQ ID NO: 1323625 - RNA, 18 nt, Human
aaaagaugcacuuugcuu

SEQ ID NO: 1323626 - RNA, 22 nt, Human
aaaagaugcacuuugcuuuaau

SEQ ID NO: 1323627 - RNA, 13 nt, Human
aaaagaugcuuuu

SEQ ID NO: 1323628 - RNA, 19 nt, Human
aaaagaugcuuuuaacaga

SEQ ID NO: 1323629 - RNA, 14 nt, Human
aaaagcagacauuu

SEQ ID NO: 1323630 - RNA, 22 nt, Human
aaaagcagguugauaaaucauu

SEQ ID NO: 1323631 - RNA, 18 nt, Human
aaaagcagguugauaaau

SEQ ID NO: 1323632 - RNA, 12 nt, Human
gggagaagcucc

SEQ ID NO: 1323633 - RNA, 14 nt, Human
gggagacacuggcc

SEQ ID NO: 1323634 - RNA, 19 nt, Human
gggagacacuggccccuca

SEQ ID NO: 1323635 - RNA, 12 nt, Human
gggagacagcau

SEQ ID NO: 1323636 - RNA, 15 nt, Human
gggagacaugugaca

SEQ ID NO: 1323637 - RNA, 17 nt, Human
gggagaccggccugcca

SEQ ID NO: 1323638 - RNA, 20 nt, Human
gggagaccggccugccagga

SEQ ID NO: 1323639 - RNA, 21 nt, Human
gggagaccggccugccaggag

SEQ ID NO: 1323640 - RNA, 22 nt, Human
gggagaccggccugccaggagg

SEQ ID NO: 1323641 - RNA, 19 nt, Human
gggagaccucagaaguaaa

SEQ ID NO: 1323642 - RNA, 17 nt, Human
gggagaggggccucaaa

SEQ ID NO: 1323643 - RNA, 20 nt, Human
gggagagggcgcaggccgug

SEQ ID NO: 1323644 - RNA, 17 nt, Human
gggagauucaagggacc

SEQ ID NO: 1323645 - RNA, 19 nt, Human
gggagcaaacugcaugccc

SEQ ID NO: 1323646 - RNA, 12 nt, Human
gggagcaggcag

SEQ ID NO: 1323647 - RNA, 14 nt, Human
gggagcaggcagcc

SEQ ID NO: 1323648 - RNA, 13 nt, Human
gggagcaggcagc

SEQ ID NO: 1323649 - RNA, 13 nt, Human
gggaggcucaggu

SEQ ID NO: 1323650 - RNA, 22 nt, Human
gggaggcucuggagcccacugu

SEQ ID NO: 1323651 - RNA, 18 nt, Human
gggaugguggagggccac

SEQ ID NO: 1323652 - RNA, 17 nt, Human
gggaugguggagggcca

SEQ ID NO: 1323653 - RNA, 12 nt, Human
gggauguguccu

SEQ ID NO: 1323654 - RNA, 13 nt, Human
gggauguguccug

SEQ ID NO: 1323655 - RNA, 18 nt, Human
gggauguguccugacacu

SEQ ID NO: 1323656 - RNA, 22 nt, Human
gggauguucagcacugucccuu

SEQ ID NO: 1323657 - RNA, 16 nt, Human
gggauuaaccucugca

SEQ ID NO: 1323658 - RNA, 15 nt, Human
gggaggcucaggucc

SEQ ID NO: 1323659 - RNA, 16 nt, Human
gggauggacaucuugu

SEQ ID NO: 1323660 - RNA, 19 nt, Human
gggauggacgaucucccac

SEQ ID NO: 1323661 - RNA, 14 nt, Human
gggaugguaguuuu

SEQ ID NO: 1323662 - RNA, 16 nt, Human
gggcaaauuggagaaa

SEQ ID NO: 1323663 - RNA, 12 nt, Human
gggauuacaggu

SEQ ID NO: 1323664 - RNA, 20 nt, Human
gggauuacaggcgugagcca

SEQ ID NO: 1323665 - RNA, 14 nt, Human
gggauuacaggcgu

SEQ ID NO: 1323666 - RNA, 13 nt, Human
gggauuacaggcu

SEQ ID NO: 1323667 - RNA, 16 nt, Human
gggauuacaggcuccu

SEQ ID NO: 1323668 - RNA, 21 nt, Human
gggauuacaggcuccugccac

SEQ ID NO: 1323669 - RNA, 17 nt, Human
gggauuaugggucacag

SEQ ID NO: 1323670 - RNA, 16 nt, Human
gggauuguaaaauggu

SEQ ID NO: 1323671 - RNA, 17 nt, Human
gggauuguaaaauggug

SEQ ID NO: 1323672 - RNA, 13 nt, Human
gggcaaagccagg

SEQ ID NO: 1323673 - RNA, 16 nt, Human
gggcaaagccaggucc

SEQ ID NO: 1323674 - RNA, 20 nt, Human
gggcaaagccaggucccucu

SEQ ID NO: 1323675 - RNA, 14 nt, Human
gggcaaagccuagu

SEQ ID NO: 1323676 - RNA, 22 nt, Human
aaaagggccaaagaaccaaaga

SEQ ID NO: 1323677 - RNA, 14 nt, Human
aaaagggaggggga

SEQ ID NO: 1323678 - RNA, 12 nt, Human
gggcagggagcg

SEQ ID NO: 1323679 - RNA, 21 nt, Human
gggcaggccaccuggcucuca

SEQ ID NO: 1323680 - RNA, 23 nt, Human
gggcaggccaccuggcucucacc

SEQ ID NO: 1323681 - RNA, 12 nt, Human
gggcaggcuggg

SEQ ID NO: 1323682 - RNA, 13 nt, Human
gggcaggcugggc

SEQ ID NO: 1323683 - RNA, 14 nt, Human
gggcaggcugggcc

SEQ ID NO: 1323684 - RNA, 15 nt, Human
gggcaggcugggcca

SEQ ID NO: 1323685 - RNA, 16 nt, Human
gggcaggcugggccau

SEQ ID NO: 1323686 - RNA, 21 nt, Human
gggcagaggcaguaccugggc

SEQ ID NO: 1323687 - RNA, 13 nt, Human
gggcagagggcug

SEQ ID NO: 1323688 - RNA, 14 nt, Human
gggcagagggcugg

SEQ ID NO: 1323689 - RNA, 15 nt, Human
gggcagagggcugga

SEQ ID NO: 1323690 - RNA, 16 nt, Human
gggcagagggcuggag

SEQ ID NO: 1323691 - RNA, 22 nt, Human
gggcagagggcuggaggcccag

SEQ ID NO: 1323692 - RNA, 17 nt, Human
gggcagagugagaccca

SEQ ID NO: 1323693 - RNA, 16 nt, Human
gggcagauuuucagca

SEQ ID NO: 1323694 - RNA, 13 nt, Human
gggcagccccagg

SEQ ID NO: 1323695 - RNA, 22 nt, Human
gggcagccagggagagcccagg

SEQ ID NO: 1323696 - RNA, 13 nt, Human
gggcagcgccagg

SEQ ID NO: 1323697 - RNA, 15 nt, Human
gggcagcgccaggcu

SEQ ID NO: 1323698 - RNA, 16 nt, Human
gggcagcgccaggcug

SEQ ID NO: 1323699 - RNA, 12 nt, Human
gggcagcuccuc

SEQ ID NO: 1323700 - RNA, 14 nt, Human
gggcagcuccucug

SEQ ID NO: 1323701 - RNA, 17 nt, Human
gggcagcuccucugucu

SEQ ID NO: 1323702 - RNA, 21 nt, Human
gggcagcuccucugucucgag

SEQ ID NO: 1323703 - RNA, 22 nt, Human
gggcagcuccucugucucgagc

SEQ ID NO: 1323704 - RNA, 15 nt, Human
aaaaauauauacuaa

SEQ ID NO: 1323705 - RNA, 17 nt, Human
aaaaauauauguauaua

SEQ ID NO: 1323706 - RNA, 21 nt, Human
aaaaauaugaccacacuccag

SEQ ID NO: 1323707 - RNA, 23 nt, Human
aaaaauaugaccacacuccagcu

SEQ ID NO: 1323708 - RNA, 20 nt, Human
gggacauuugcucauggaau

SEQ ID NO: 1323709 - RNA, 21 nt, Human
gggacauuugcucauggaauu

SEQ ID NO: 1323710 - RNA, 21 nt, Human
aaaaauagcuaaauaccucaa

SEQ ID NO: 1323711 - RNA, 23 nt, Human
aaaaauaguuuggauauguaaaa

SEQ ID NO: 1323712 - RNA, 14 nt, Human
aaaaauaguuugga

SEQ ID NO: 1323713 - RNA, 19 nt, Human
gggaagcccauccugacca

SEQ ID NO: 1323714 - RNA, 15 nt, Human
gggaagcuagucuuu

SEQ ID NO: 1323715 - RNA, 15 nt, Human
gggaaggaggagccu

SEQ ID NO: 1323716 - RNA, 22 nt, Human
gggaagagagccugcaggaucu

SEQ ID NO: 1323717 - RNA, 12 nt, Human
gggaagaggccu

SEQ ID NO: 1323718 - RNA, 19 nt, Human
gggaagaggguuaggaggg

SEQ ID NO: 1323719 - RNA, 23 nt, Human
gggaagaggguuaggaggguuuc

SEQ ID NO: 1323720 - RNA, 13 nt, Human
gggaagcagcagc

SEQ ID NO: 1323721 - RNA, 17 nt, Human
gggaagcagcagccucg

SEQ ID NO: 1323722 - RNA, 18 nt, Human
gggaagcccauccugacc

SEQ ID NO: 1323723 - RNA, 15 nt, Human
aaaacccagauaaag

SEQ ID NO: 1323724 - RNA, 13 nt, Human
aaaacauuuauuu

SEQ ID NO: 1323725 - RNA, 16 nt, Human
aaaacauuuauuuuga

SEQ ID NO: 1323726 - RNA, 13 nt, Human
aaaacccccaaac

SEQ ID NO: 1323727 - RNA, 17 nt, Human
aaaaccccccagauauc

SEQ ID NO: 1323728 - RNA, 18 nt, Human
aaaaccccccagauauca

SEQ ID NO: 1323729 - RNA, 20 nt, Human
aaaaccccccagauaucauc

SEQ ID NO: 1323730 - RNA, 16 nt, Human
aaaacccuugggccag

SEQ ID NO: 1323731 - RNA, 19 nt, Human
aaaacccuugggccagaag

SEQ ID NO: 1323732 - RNA, 20 nt, Human
aaaacccuugggccagaagu

SEQ ID NO: 1323733 - RNA, 15 nt, Human
aaaaccugagauuua

SEQ ID NO: 1323734 - RNA, 22 nt, Human
aaaacuagaggugagaaauuua

SEQ ID NO: 1323735 - RNA, 19 nt, Human
aaaacuauauguaugguuu

SEQ ID NO: 1323736 - RNA, 18 nt, Human
aaaaccugagauuuauua

SEQ ID NO: 1323737 - RNA, 18 nt, Human
aaaacucuacuuaaucca

SEQ ID NO: 1323738 - RNA, 19 nt, Human
aaaacucuacuuaauccaa

SEQ ID NO: 1323739 - RNA, 17 nt, Human
aaaacuccaccuuccca

SEQ ID NO: 1323740 - RNA, 16 nt, Human
aaaacuccaccuuccc

SEQ ID NO: 1323741 - RNA, 12 nt, Human
aaaacucuacuu

SEQ ID NO: 1323742 - RNA, 15 nt, Human
aaaacucuacuuaau

SEQ ID NO: 1323743 - RNA, 16 nt, Human
aaaacauuccauccuu

SEQ ID NO: 1323744 - RNA, 15 nt, Human
aaaacauguuuauuu

SEQ ID NO: 1323745 - RNA, 12 nt, Human
aaaacauuuauu

SEQ ID NO: 1323746 - RNA, 22 nt, Human
aaaacauuuauuuugacauaaa

SEQ ID NO: 1323747 - RNA, 19 nt, Human
aaaacaguggaucacaaag

SEQ ID NO: 1323748 - RNA, 17 nt, Human
aaaacauaaucuucugc

SEQ ID NO: 1323749 - RNA, 18 nt, Human
aaaacauaaucuucugcc

SEQ ID NO: 1323750 - RNA, 20 nt, Human
aaaacauaaucuucugccuu

SEQ ID NO: 1323751 - RNA, 24 nt, Human
aaaacauaaucuucugccuucuca

SEQ ID NO: 1323752 - RNA, 19 nt, Human
aaaacauguuuauuuuucu

SEQ ID NO: 1323753 - RNA, 19 nt, Human
aaaacagguauauacuuug

SEQ ID NO: 1323754 - RNA, 21 nt, Human
aaaacaggucuucaucgaauc

SEQ ID NO: 1323755 - RNA, 18 nt, Human
aaaacagguauauacuuu

SEQ ID NO: 1323756 - RNA, 17 nt, Human
gcugaguauuaaaaugu

SEQ ID NO: 1323757 - RNA, 16 nt, Human
gcugaguauuaaaaug

SEQ ID NO: 1323758 - RNA, 17 nt, Human
gcugaggccugggccgc

SEQ ID NO: 1323759 - RNA, 20 nt, Human
gcugaggccugggccgcugc

SEQ ID NO: 1323760 - RNA, 23 nt, Human
gcugaggccugggccgcugccac

SEQ ID NO: 1323761 - RNA, 13 nt, Human
gcugaggcuggca

SEQ ID NO: 1323762 - RNA, 18 nt, Human
gcugccaguguccugagc

SEQ ID NO: 1323763 - RNA, 19 nt, Human
gcugccaguguccugagcc

SEQ ID NO: 1323764 - RNA, 15 nt, Human
gcugcagaggccaga

SEQ ID NO: 1323765 - RNA, 18 nt, Human
gcugcagaggccagaggc

SEQ ID NO: 1323766 - RNA, 22 nt, Human
gcugcagaggccagaggccccc

SEQ ID NO: 1323767 - RNA, 21 nt, Human
gcugcagccugcgccaccgcc

SEQ ID NO: 1323768 - RNA, 22 nt, Human
gcugcaggaaucuuuaaaagau

SEQ ID NO: 1323769 - RNA, 17 nt, Human
gcugcaggaaucuuuaa

SEQ ID NO: 1323770 - RNA, 20 nt, Human
gcugcacugaugcugccccu

SEQ ID NO: 1323771 - RNA, 21 nt, Human
gcuggagaugaggccagacca

SEQ ID NO: 1323772 - RNA, 20 nt, Human
gcuggagaugaggccagacc

SEQ ID NO: 1323773 - RNA, 18 nt, Human
gcuggagaugaggccaga

SEQ ID NO: 1323774 - RNA, 13 nt, Human
gcugcugagaacc

SEQ ID NO: 1323775 - RNA, 14 nt, Human
gcugcugagaaccu

SEQ ID NO: 1323776 - RNA, 15 nt, Human
gcugcugagaaccug

SEQ ID NO: 1323777 - RNA, 16 nt, Human
gcugcugagaaccugg

SEQ ID NO: 1323778 - RNA, 17 nt, Human
gcugcugagaaccuggc

SEQ ID NO: 1323779 - RNA, 18 nt, Human
gcugcugagaaccuggcc

SEQ ID NO: 1323780 - RNA, 19 nt, Human
gcugcugagaaccuggccu

SEQ ID NO: 1323781 - RNA, 20 nt, Human
gcugcugagaaccuggccuu

SEQ ID NO: 1323782 - RNA, 22 nt, Human
gcugcugagaaccuggccuuca

SEQ ID NO: 1323783 - RNA, 21 nt, Human
gcugcugagaaccuggccuuc

SEQ ID NO: 1323784 - RNA, 16 nt, Human
gcugcuguacugaagu

SEQ ID NO: 1323785 - RNA, 15 nt, Human
gcugcugucccuccc

SEQ ID NO: 1323786 - RNA, 16 nt, Human
gcugcugucccucccc

SEQ ID NO: 1323787 - RNA, 18 nt, Human
gcugcugucccucccccu

SEQ ID NO: 1323788 - RNA, 22 nt, Human
gcugcugucccucccccuuguc

SEQ ID NO: 1323789 - RNA, 23 nt, Human
gcugcugucccucccccuugucc

SEQ ID NO: 1323790 - RNA, 13 nt, Human
gcugcugucuggg

SEQ ID NO: 1323791 - RNA, 16 nt, Human
gcugcugucugggugc

SEQ ID NO: 1323792 - RNA, 20 nt, Human
gcugcugucugggugcuacu

SEQ ID NO: 1323793 - RNA, 13 nt, Human
gcugcugggcuca

SEQ ID NO: 1323794 - RNA, 16 nt, Human
gcugcugggcucagug

SEQ ID NO: 1323795 - RNA, 19 nt, Human
gcugcugggcucagugaag

SEQ ID NO: 1323796 - RNA, 20 nt, Human
gcugcugggcucagugaagu

SEQ ID NO: 1323797 - RNA, 18 nt, Human
gcugcuggggaagacagu

SEQ ID NO: 1323798 - RNA, 19 nt, Human
gcugcuggggaagacagug

SEQ ID NO: 1323799 - RNA, 20 nt, Human
gcugcuggggaagacagugg

SEQ ID NO: 1323800 - RNA, 21 nt, Human
gcugcuggggaagacaguggc

SEQ ID NO: 1323801 - RNA, 13 nt, Human
gcugcuccccacg

SEQ ID NO: 1323802 - RNA, 22 nt, Human
gcugcuccccacgucagcuggg

SEQ ID NO: 1323803 - RNA, 12 nt, Human
gcugcucccuca

SEQ ID NO: 1323804 - RNA, 13 nt, Human
gcugcucccucag

SEQ ID NO: 1323805 - RNA, 14 nt, Human
gcugcucccucaga

SEQ ID NO: 1323806 - RNA, 15 nt, Human
gcugcucccucagac

SEQ ID NO: 1323807 - RNA, 16 nt, Human
gcugcucccucagacu

SEQ ID NO: 1323808 - RNA, 19 nt, Human
gcugcucccucagacuggg

SEQ ID NO: 1323809 - RNA, 21 nt, Human
gcugcucccucagacuggggc

SEQ ID NO: 1323810 - RNA, 20 nt, Human
gcugcuccgaggacccagga

SEQ ID NO: 1323811 - RNA, 21 nt, Human
gcugcugucugggugcuacug

SEQ ID NO: 1323812 - RNA, 22 nt, Human
gcugcugucugggugcuacugg

SEQ ID NO: 1323813 - RNA, 24 nt, Human
gcugcugucugggugcuacugggg

SEQ ID NO: 1323814 - RNA, 16 nt, Human
gcuccucuccccagcc

SEQ ID NO: 1323815 - RNA, 18 nt, Human
gcuccucuccccagccca

SEQ ID NO: 1323816 - RNA, 19 nt, Human
gcuccucuccccagcccag

SEQ ID NO: 1323817 - RNA, 20 nt, Human
gcuccucuccccagcccaga

SEQ ID NO: 1323818 - RNA, 21 nt, Human
gcuccucuccccagcccagag

SEQ ID NO: 1323819 - RNA, 22 nt, Human
gcuccucuccccagcccagaga

SEQ ID NO: 1323820 - RNA, 23 nt, Human
gcuccucuccccagcccagagac

SEQ ID NO: 1323821 - RNA, 18 nt, Human
gcucuacaucuucugccu

SEQ ID NO: 1323822 - RNA, 19 nt, Human
gcucuacaucuucugccuu

SEQ ID NO: 1323823 - RNA, 20 nt, Human
gcucuacaucuucugccuua

SEQ ID NO: 1323824 - RNA, 21 nt, Human
gcucuacuggucuuguggaau

SEQ ID NO: 1323825 - RNA, 15 nt, Human
gcucuacuuccccau

SEQ ID NO: 1323826 - RNA, 16 nt, Human
gcucuacuuccccaug

SEQ ID NO: 1323827 - RNA, 22 nt, Human
gcucuacuuccccauggcccug

SEQ ID NO: 1323828 - RNA, 23 nt, Human
gcucuacuuccccauggcccuga

SEQ ID NO: 1323829 - RNA, 13 nt, Human
gcucuagaaucug

SEQ ID NO: 1323830 - RNA, 18 nt, Human
gcucuauuaugaauguga

SEQ ID NO: 1323831 - RNA, 21 nt, Human
gcucuauuaugaaugugaagc

SEQ ID NO: 1323832 - RNA, 23 nt, Human
gcucuauuaugaaugugaagccu

SEQ ID NO: 1323833 - RNA, 22 nt, Human
gcucuauuaugaaugugaagcc

SEQ ID NO: 1323834 - RNA, 17 nt, Human
gcucucaccuggcccug

SEQ ID NO: 1323835 - RNA, 12 nt, Human
gcucucaccucu

SEQ ID NO: 1323836 - RNA, 23 nt, Human
gcucucacggccacacagcugcc

SEQ ID NO: 1323837 - RNA, 21 nt, Human
gcucucacggccacacagcug

SEQ ID NO: 1323838 - RNA, 22 nt, Human
gcucuagaucauaaggcuucaa

SEQ ID NO: 1323839 - RNA, 23 nt, Human
gcucuagauugagagaagagaca

SEQ ID NO: 1323840 - RNA, 20 nt, Human
gcucuagaucauaaggcuuc

SEQ ID NO: 1323841 - RNA, 19 nt, Human
gcucuagguacgaugacag

SEQ ID NO: 1323842 - RNA, 13 nt, Human
gcucuaugagucu

SEQ ID NO: 1323843 - RNA, 14 nt, Human
gcucuaugagucua

SEQ ID NO: 1323844 - RNA, 18 nt, Human
gcucuaugagucuagaug

SEQ ID NO: 1323845 - RNA, 21 nt, Human
gcucuaugagucuagauguuu

SEQ ID NO: 1323846 - RNA, 16 nt, Human
gcucuauuaugaaugu

SEQ ID NO: 1323847 - RNA, 20 nt, Human
gcuccacuuggucugugaga

SEQ ID NO: 1323848 - RNA, 14 nt, Human
gcuccagacaggga

SEQ ID NO: 1323849 - RNA, 12 nt, Human
gcuccagaccug

SEQ ID NO: 1323850 - RNA, 13 nt, Human
gcuccagaccuga

SEQ ID NO: 1323851 - RNA, 20 nt, Human
gcuccagaccugauccugga

SEQ ID NO: 1323852 - RNA, 21 nt, Human
gcuccagaccugauccuggag

SEQ ID NO: 1323853 - RNA, 22 nt, Human
gcuccagaccugauccuggagg

SEQ ID NO: 1323854 - RNA, 23 nt, Human
gcuccagaccugauccuggaggc

SEQ ID NO: 1323855 - RNA, 12 nt, Human
gcuccagagggc

SEQ ID NO: 1323856 - RNA, 20 nt, Human
gcuccagagggcacucugcu

SEQ ID NO: 1323857 - RNA, 21 nt, Human
gcuccagagggcacucugcuu

SEQ ID NO: 1323858 - RNA, 17 nt, Human
gcuccagaugcagggca

SEQ ID NO: 1323859 - RNA, 18 nt, Human
gcuccagaugcagggcag

SEQ ID NO: 1323860 - RNA, 19 nt, Human
gcuccagaugcagggcagu

SEQ ID NO: 1323861 - RNA, 21 nt, Human
gcuccagaugcagggcaguca

SEQ ID NO: 1323862 - RNA, 22 nt, Human
gcuccagaugcagggcagucau

SEQ ID NO: 1323863 - RNA, 16 nt, Human
gcuccagccccucuug

SEQ ID NO: 1323864 - RNA, 12 nt, Human
gcuccagccuga

SEQ ID NO: 1323865 - RNA, 13 nt, Human
gcuccagccugac

SEQ ID NO: 1323866 - RNA, 17 nt, Human
gcuccagccugacauca

SEQ ID NO: 1323867 - RNA, 11 nt, Human
gcucccagggc

SEQ ID NO: 1323868 - RNA, 22 nt, Human
gcucccagggacaccugggaga

SEQ ID NO: 1323869 - RNA, 19 nt, Human
gcucccaggggcucccucc

SEQ ID NO: 1323870 - RNA, 21 nt, Human
gcucccaggggcucccuccgc

SEQ ID NO: 1323871 - RNA, 20 nt, Human
gcucccaggggcucccuccg

SEQ ID NO: 1323872 - RNA, 15 nt, Human
gcuccucuccccagc

SEQ ID NO: 1323873 - RNA, 18 nt, Human
gcuccucgagaucccaac

SEQ ID NO: 1323874 - RNA, 17 nt, Human
gcuccuccuucugcugc

SEQ ID NO: 1323875 - RNA, 19 nt, Human
gcuccucccggugcccaag

SEQ ID NO: 1323876 - RNA, 22 nt, Human
gcuccucccucucaacacccag

SEQ ID NO: 1323877 - RNA, 17 nt, Human
gcucccauccugugugu

SEQ ID NO: 1323878 - RNA, 14 nt, Human
gcuccucccucuca

SEQ ID NO: 1323879 - RNA, 16 nt, Human
gcucuggagcccacug

SEQ ID NO: 1323880 - RNA, 15 nt, Human
gcucuggagcccacu

SEQ ID NO: 1323881 - RNA, 21 nt, Human
gcucugcccauccugccccug

SEQ ID NO: 1323882 - RNA, 18 nt, Human
gcucugccaguccugucc

SEQ ID NO: 1323883 - RNA, 16 nt, Human
gcucugccaguccugu

SEQ ID NO: 1323884 - RNA, 17 nt, Human
gcucugccaguccuguc

SEQ ID NO: 1323885 - RNA, 13 nt, Human
gcucugccagucc

SEQ ID NO: 1323886 - RNA, 15 nt, Human
gcucugcccauccug

SEQ ID NO: 1323887 - RNA, 19 nt, Human
gcucucugugggcuggcag

SEQ ID NO: 1323888 - RNA, 14 nt, Human
gcucucuuucuguc

SEQ ID NO: 1323889 - RNA, 15 nt, Human
gcucucuuucugucu

SEQ ID NO: 1323890 - RNA, 16 nt, Human
gcucugaaaccagugu

SEQ ID NO: 1323891 - RNA, 17 nt, Human
gcucugaaagagaaaca

SEQ ID NO: 1323892 - RNA, 20 nt, Human
gcucucugugggcuggcagu

SEQ ID NO: 1323893 - RNA, 24 nt, Human
gcugaauuucccucucucauaccc

SEQ ID NO: 1323894 - RNA, 17 nt, Human
gcugaauuucccucucu

SEQ ID NO: 1323895 - RNA, 20 nt, Human
gcugaacuuguuuucuggga

SEQ ID NO: 1323896 - RNA, 18 nt, Human
gcugaagaauuauuuuuu

SEQ ID NO: 1323897 - RNA, 20 nt, Human
gcugaagguuguggccuuug

SEQ ID NO: 1323898 - RNA, 17 nt, Human
gcugaagguuguggccu

SEQ ID NO: 1323899 - RNA, 16 nt, Human
gcugacaccuaacucu

SEQ ID NO: 1323900 - RNA, 17 nt, Human
gcugacaccuaacucuu

SEQ ID NO: 1323901 - RNA, 12 nt, Human
gcugagccucag

SEQ ID NO: 1323902 - RNA, 16 nt, Human
gcugagccucagucuc

SEQ ID NO: 1323903 - RNA, 23 nt, Human
gcugagcgaggagaugcuccuug

SEQ ID NO: 1323904 - RNA, 12 nt, Human
gcugaggccugg

SEQ ID NO: 1323905 - RNA, 13 nt, Human
gcugaggccugga

SEQ ID NO: 1323906 - RNA, 14 nt, Human
gcugaggccuggac

SEQ ID NO: 1323907 - RNA, 21 nt, Human
gcugaggccuggacuuuccug

SEQ ID NO: 1323908 - RNA, 13 nt, Human
gcugaggccuggg

SEQ ID NO: 1323909 - RNA, 14 nt, Human
gcugaggccugggc

SEQ ID NO: 1323910 - RNA, 15 nt, Human
gcugaggccugggcc

SEQ ID NO: 1323911 - RNA, 16 nt, Human
gcugaggccugggccg

SEQ ID NO: 1323912 - RNA, 17 nt, Human
gcucuggagcccacugu

SEQ ID NO: 1323913 - RNA, 19 nt, Human
gcucugguuguuucuguuc

SEQ ID NO: 1323914 - RNA, 20 nt, Human
gcucugguuguuucuguucc

SEQ ID NO: 1323915 - RNA, 21 nt, Human
gcucugguuguuucuguucca

SEQ ID NO: 1323916 - RNA, 23 nt, Human
gcucuguaaguagaugcauuugg

SEQ ID NO: 1323917 - RNA, 22 nt, Human
gcucugguuguuucuguuccaa

SEQ ID NO: 1323918 - RNA, 17 nt, Human
gcucuguagugcuacag

SEQ ID NO: 1323919 - RNA, 23 nt, Human
gcucuguagugcuacagggucca

SEQ ID NO: 1323920 - RNA, 13 nt, Human
gcucuguccccag

SEQ ID NO: 1323921 - RNA, 14 nt, Human
gcucuguccccagc

SEQ ID NO: 1323922 - RNA, 18 nt, Human
gcucuguaucaggaccca

SEQ ID NO: 1323923 - RNA, 19 nt, Human
gcucuguaucaggacccag

SEQ ID NO: 1323924 - RNA, 22 nt, Human
gcucuguaucaggacccagagg

SEQ ID NO: 1323925 - RNA, 23 nt, Human
gcucuguaucaggacccagagga

SEQ ID NO: 1323926 - RNA, 21 nt, Human
gcucugucuacuugcucaggu

SEQ ID NO: 1323927 - RNA, 22 nt, Human
gcucugugagggugcugacugg

SEQ ID NO: 1323928 - RNA, 15 nt, Human
gcucuguccccagcc

SEQ ID NO: 1323929 - RNA, 17 nt, Human
gcucuguccccagccug

SEQ ID NO: 1323930 - RNA, 13 nt, Human
gcucugucuacuu

SEQ ID NO: 1323931 - RNA, 19 nt, Human
gcucugucuacuugcucag

SEQ ID NO: 1323932 - RNA, 18 nt, Human
gcugaaacgcaucuaguu

SEQ ID NO: 1323933 - RNA, 18 nt, Human
gcugaaaauguccuugug

SEQ ID NO: 1323934 - RNA, 13 nt, Human
gcugaacagugga

SEQ ID NO: 1323935 - RNA, 22 nt, Human
gcugaacaguggaggaagaggg

SEQ ID NO: 1323936 - RNA, 11 nt, Human
gcugaaaauau

SEQ ID NO: 1323937 - RNA, 15 nt, Human
gcuuugauguuccuu

SEQ ID NO: 1323938 - RNA, 19 nt, Human
gcuuugauguuccuuccag

SEQ ID NO: 1323939 - RNA, 20 nt, Human
gcuuugauguuccuuccagu

SEQ ID NO: 1323940 - RNA, 22 nt, Human
gcuuuuuucucugauacagaaa

SEQ ID NO: 1323941 - RNA, 23 nt, Human
gcuuuuugugauaugcacaaugu

SEQ ID NO: 1323942 - RNA, 16 nt, Human
gcuuuuuguguuuuuu

SEQ ID NO: 1323943 - RNA, 17 nt, Human
gcuuuuuuguuuuggcu

SEQ ID NO: 1323944 - RNA, 18 nt, Human
ggaaaauucuaacccagg

SEQ ID NO: 1323945 - RNA, 17 nt, Human
ggaaaccuuccacccag

SEQ ID NO: 1323946 - RNA, 20 nt, Human
gcuuuuuuaucaugugaaau

SEQ ID NO: 1323947 - RNA, 18 nt, Human
gcuuuuuuaucaugugaa

SEQ ID NO: 1323948 - RNA, 15 nt, Human
gcuuuuuuaucaugu

SEQ ID NO: 1323949 - RNA, 22 nt, Human
gcuuuuggcggggaggaggaaa

SEQ ID NO: 1323950 - RNA, 21 nt, Human
gcuuuuggcggggaggaggaa

SEQ ID NO: 1323951 - RNA, 20 nt, Human
gcuuuugucuacacacccug

SEQ ID NO: 1323952 - RNA, 19 nt, Human
gcuuuugugauggagugcu

SEQ ID NO: 1323953 - RNA, 19 nt, Human
gcuuuuuauuccuccugcu

SEQ ID NO: 1323954 - RNA, 15 nt, Human
gcuuuuuauuucugc

SEQ ID NO: 1323955 - RNA, 21 nt, Human
gcuuuuuauuucugcauaugu

SEQ ID NO: 1323956 - RNA, 17 nt, Human
gcuuuuuauuucugcau

SEQ ID NO: 1323957 - RNA, 13 nt, Human
gcuuuuuccagag

SEQ ID NO: 1323958 - RNA, 18 nt, Human
ggaagacgcaagggccug

SEQ ID NO: 1323959 - RNA, 17 nt, Human
ggaagacccauuccuuc

SEQ ID NO: 1323960 - RNA, 20 nt, Human
ggaagacccauuccuuccca

SEQ ID NO: 1323961 - RNA, 22 nt, Human
ggaagaagagaucaggaagaga

SEQ ID NO: 1323962 - RNA, 21 nt, Human
ggaagaagagaucaggaagag

SEQ ID NO: 1323963 - RNA, 20 nt, Human
ggaagaagagaucaggaaga

SEQ ID NO: 1323964 - RNA, 23 nt, Human
ggaacuuggggaguuaagaccug

SEQ ID NO: 1323965 - RNA, 15 nt, Human
ggaacugcugccacu

SEQ ID NO: 1323966 - RNA, 16 nt, Human
ggaacugcugccacug

SEQ ID NO: 1323967 - RNA, 17 nt, Human
ggaacugcugccacuga

SEQ ID NO: 1323968 - RNA, 21 nt, Human
ggaacugcugccacugagggg

SEQ ID NO: 1323969 - RNA, 15 nt, Human
ggaagaaagaagaca

SEQ ID NO: 1323970 - RNA, 17 nt, Human
ggaacaccauaggucac

SEQ ID NO: 1323971 - RNA, 14 nt, Human
ggaacacggccaca

SEQ ID NO: 1323972 - RNA, 20 nt, Human
ggaacacuagacaagccaga

SEQ ID NO: 1323973 - RNA, 21 nt, Human
ggaacacuagacaagccagaa

SEQ ID NO: 1323974 - RNA, 15 nt, Human
ggaacaauugaagua

SEQ ID NO: 1323975 - RNA, 19 nt, Human
ggaacaauugaaguaaacu

SEQ ID NO: 1323976 - RNA, 21 nt, Human
ggaacaauugaaguaaacuuu

SEQ ID NO: 1323977 - RNA, 12 nt, Human
ggaacugaaggg

SEQ ID NO: 1323978 - RNA, 21 nt, Human
ggaacugaagggggcggccua

SEQ ID NO: 1323979 - RNA, 20 nt, Human
ggaacugaagggggcggccu

SEQ ID NO: 1323980 - RNA, 12 nt, Human
ggaacugcugcc

SEQ ID NO: 1323981 - RNA, 13 nt, Human
ggaacugcugcca

SEQ ID NO: 1323982 - RNA, 14 nt, Human
ggaacugcugccac

SEQ ID NO: 1323983 - RNA, 21 nt, Human
ggaaacuaggugcauauuuau

SEQ ID NO: 1323984 - RNA, 15 nt, Human
ggaaacgagacuuuc

SEQ ID NO: 1323985 - RNA, 18 nt, Human
ggaaaccuuccacccagu

SEQ ID NO: 1323986 - RNA, 20 nt, Human
ggaaauucccuucaucugga

SEQ ID NO: 1323987 - RNA, 16 nt, Human
ggaaauucugcucaga

SEQ ID NO: 1323988 - RNA, 22 nt, Human
ggaaauucccuucaucuggaac

SEQ ID NO: 1323989 - RNA, 16 nt, Human
ggaaauugauuuugaa

SEQ ID NO: 1323990 - RNA, 17 nt, Human
ggaaauuggaagagcac

SEQ ID NO: 1323991 - RNA, 21 nt, Human
ggaaauuuaaagcagguucuu

SEQ ID NO: 1323992 - RNA, 14 nt, Human
ggaaauuuagcauu

SEQ ID NO: 1323993 - RNA, 17 nt, Human
ggaaauuuagcauugua

SEQ ID NO: 1323994 - RNA, 19 nt, Human
ggaaauucccuucaucugg

SEQ ID NO: 1323995 - RNA, 17 nt, Human
ggaaaugucaacaagua

SEQ ID NO: 1323996 - RNA, 15 nt, Human
ggaacaaacagggcu

SEQ ID NO: 1323997 - RNA, 14 nt, Human
ggaacaaacagggc

SEQ ID NO: 1323998 - RNA, 18 nt, Human
ggaacaaggagucagaca

SEQ ID NO: 1323999 - RNA, 19 nt, Human
gcuuccuggcaauagucaa

SEQ ID NO: 1324000 - RNA, 13 nt, Human
gcuuccugcuugc

SEQ ID NO: 1324001 - RNA, 14 nt, Human
gcuuccugcuugcc

SEQ ID NO: 1324002 - RNA, 21 nt, Human
gcuuccugcuugccaaggcag

SEQ ID NO: 1324003 - RNA, 12 nt, Human
gcuuccuggagc

SEQ ID NO: 1324004 - RNA, 13 nt, Human
gcuuccuggagca

SEQ ID NO: 1324005 - RNA, 15 nt, Human
gcuuccuggagcaga

SEQ ID NO: 1324006 - RNA, 18 nt, Human
gcuuccuggagcagaagc

SEQ ID NO: 1324007 - RNA, 22 nt, Human
gcuuccuggagcagaagcagca

SEQ ID NO: 1324008 - RNA, 11 nt, Human
gcuuccuggug

SEQ ID NO: 1324009 - RNA, 14 nt, Human
gcuuccuggugcug

SEQ ID NO: 1324010 - RNA, 16 nt, Human
gcuuccuggugcugga

SEQ ID NO: 1324011 - RNA, 13 nt, Human
gcuuccuucagag

SEQ ID NO: 1324012 - RNA, 14 nt, Human
gcuuccuucagaga

SEQ ID NO: 1324013 - RNA, 16 nt, Human
gcuuccuucagagagc

SEQ ID NO: 1324014 - RNA, 17 nt, Human
gcuuccuucagagagca

SEQ ID NO: 1324015 - RNA, 19 nt, Human
gcuuccuucagagagcagu

SEQ ID NO: 1324016 - RNA, 20 nt, Human
gcuuccuucagagagcagug

SEQ ID NO: 1324017 - RNA, 13 nt, Human
gcuuccuucauuu

SEQ ID NO: 1324018 - RNA, 14 nt, Human
gcuuccaugauucu

SEQ ID NO: 1324019 - RNA, 15 nt, Human
gcuuccaugauucua

SEQ ID NO: 1324020 - RNA, 18 nt, Human
gcuuccaugauucuauuu

SEQ ID NO: 1324021 - RNA, 19 nt, Human
gcuuccaugauucuauuua

SEQ ID NO: 1324022 - RNA, 22 nt, Human
gcuuccuucagagagcagugcu

SEQ ID NO: 1324023 - RNA, 20 nt, Human
gcuugaacuaggcugagcaa

SEQ ID NO: 1324024 - RNA, 19 nt, Human
gcuugaacuaggcugagca

SEQ ID NO: 1324025 - RNA, 21 nt, Human
gcuuuccccaugucucgacuc

SEQ ID NO: 1324026 - RNA, 14 nt, Human
gcuugaccugaggc

SEQ ID NO: 1324027 - RNA, 16 nt, Human
gcuugguuccuuccca

SEQ ID NO: 1324028 - RNA, 22 nt, Human
gcuuuccccaugucucgacuca

SEQ ID NO: 1324029 - RNA, 15 nt, Human
gcuugguuccuuccc

SEQ ID NO: 1324030 - RNA, 19 nt, Human
gcuuucuccuuuaauugua

SEQ ID NO: 1324031 - RNA, 16 nt, Human
gcuuucugaacagcug

SEQ ID NO: 1324032 - RNA, 16 nt, Human
gcuuuccucuuccuga

SEQ ID NO: 1324033 - RNA, 15 nt, Human
gcuuucccugccucu

SEQ ID NO: 1324034 - RNA, 16 nt, Human
gcuuucuguuccaaau

SEQ ID NO: 1324035 - RNA, 22 nt, Human
gcuuugagagagaaaggacucc

SEQ ID NO: 1324036 - RNA, 12 nt, Human
gcuuucuguucc

SEQ ID NO: 1324037 - RNA, 13 nt, Human
gcuuucuguucca

SEQ ID NO: 1324038 - RNA, 14 nt, Human
gcuuucuguuccaa

SEQ ID NO: 1324039 - RNA, 15 nt, Human
gcuuucuguuccaaa

SEQ ID NO: 1324040 - RNA, 18 nt, Human
gcuuucugaacagcuggu

SEQ ID NO: 1324041 - RNA, 19 nt, Human
gcuuucugaacagcuggug

SEQ ID NO: 1324042 - RNA, 21 nt, Human
gcuuucugaacagcuggugua

SEQ ID NO: 1324043 - RNA, 17 nt, Human
gcuuucugaucaaggcc

SEQ ID NO: 1324044 - RNA, 20 nt, Human
gcuuucugaacagcuggugu

SEQ ID NO: 1324045 - RNA, 16 nt, Human
gcuucaaauuguaagc

SEQ ID NO: 1324046 - RNA, 23 nt, Human
gcuucaggcccccgccuuggccu

SEQ ID NO: 1324047 - RNA, 21 nt, Human
gcuucagguccaggcuguguu

SEQ ID NO: 1324048 - RNA, 15 nt, Human
gcuucagguccaggc

SEQ ID NO: 1324049 - RNA, 15 nt, Human
gcuuaauucaaauaa

SEQ ID NO: 1324050 - RNA, 14 nt, Human
gcuuaauucaaaua

SEQ ID NO: 1324051 - RNA, 20 nt, Human
gcuuaauggcugauaauuuu

SEQ ID NO: 1324052 - RNA, 13 nt, Human
gcuguuuuuuugu

SEQ ID NO: 1324053 - RNA, 23 nt, Human
gcuguuuuguugacauucugaau

SEQ ID NO: 1324054 - RNA, 23 nt, Human
gcuguuuuguuauauaauuuaga

SEQ ID NO: 1324055 - RNA, 19 nt, Human
gcuguuuuguuauauaauu

SEQ ID NO: 1324056 - RNA, 14 nt, Human
gcuguuuuguugac

SEQ ID NO: 1324057 - RNA, 19 nt, Human
gcuguuuuguugacauucu

SEQ ID NO: 1324058 - RNA, 12 nt, Human
gcuuaaaacuuu

SEQ ID NO: 1324059 - RNA, 16 nt, Human
gcuguuuuaaacauua

SEQ ID NO: 1324060 - RNA, 13 nt, Human
gcuguuuuguuau

SEQ ID NO: 1324061 - RNA, 14 nt, Human
gcuguuuuguuaua

SEQ ID NO: 1324062 - RNA, 16 nt, Human
gcuguuuuguuauaua

SEQ ID NO: 1324063 - RNA, 12 nt, Human
gcugugccucug

SEQ ID NO: 1324064 - RNA, 15 nt, Human
gcugugccucgcucc

SEQ ID NO: 1324065 - RNA, 18 nt, Human
gcugugccucgcucccca

SEQ ID NO: 1324066 - RNA, 23 nt, Human
gcugugccucgcuccccacucug

SEQ ID NO: 1324067 - RNA, 20 nt, Human
gcuggagugcaguggcgcga

SEQ ID NO: 1324068 - RNA, 19 nt, Human
gcuggagugcaguggugca

SEQ ID NO: 1324069 - RNA, 14 nt, Human
gcuggagcucugcc

SEQ ID NO: 1324070 - RNA, 20 nt, Human
gcuggagugcagugguguga

SEQ ID NO: 1324071 - RNA, 17 nt, Human
gcuggaguuagggacug

SEQ ID NO: 1324072 - RNA, 21 nt, Human
gcuggaguuagggacugacca

SEQ ID NO: 1324073 - RNA, 16 nt, Human
gcuggaguuucaugua

SEQ ID NO: 1324074 - RNA, 12 nt, Human
gcuguauuuuaa

SEQ ID NO: 1324075 - RNA, 19 nt, Human
gcuguauuagucacagaga

SEQ ID NO: 1324076 - RNA, 13 nt, Human
gcuguauuuuaaa

SEQ ID NO: 1324077 - RNA, 18 nt, Human
gcuguauuuuaaaagaau

SEQ ID NO: 1324078 - RNA, 12 nt, Human
gcuguauugucu

SEQ ID NO: 1324079 - RNA, 14 nt, Human
gcuguauugucuga

SEQ ID NO: 1324080 - RNA, 15 nt, Human
gcuguauugucugaa

SEQ ID NO: 1324081 - RNA, 19 nt, Human
gcuguacugaaguaaaaca

SEQ ID NO: 1324082 - RNA, 13 nt, Human
gcuguagaaaaaa

SEQ ID NO: 1324083 - RNA, 20 nt, Human
gcuguacugaaguaaaacaa

SEQ ID NO: 1324084 - RNA, 23 nt, Human
gcuguacaucuauuuuggauugu

SEQ ID NO: 1324085 - RNA, 13 nt, Human
gcuguacccaguu

SEQ ID NO: 1324086 - RNA, 16 nt, Human
gcuguacccaguuucu

SEQ ID NO: 1324087 - RNA, 12 nt, Human
gcuguacaucua

SEQ ID NO: 1324088 - RNA, 16 nt, Human
gcuguacaucuauuuu

SEQ ID NO: 1324089 - RNA, 20 nt, Human
gcuguacaucuauuuuggau

SEQ ID NO: 1324090 - RNA, 22 nt, Human
gcuguacaucuauuuuggauug

SEQ ID NO: 1324091 - RNA, 12 nt, Human
gcugguucugua

SEQ ID NO: 1324092 - RNA, 15 nt, Human
gcugguuuaauguuu

SEQ ID NO: 1324093 - RNA, 17 nt, Human
gccauguguuuauccua

SEQ ID NO: 1324094 - RNA, 11 nt, Human
gcccaggagcu

SEQ ID NO: 1324095 - RNA, 14 nt, Human
gcccaggagcuccc

SEQ ID NO: 1324096 - RNA, 15 nt, Human
gcccaggagcucccc

SEQ ID NO: 1324097 - RNA, 17 nt, Human
gcccaggagcuccccuc

SEQ ID NO: 1324098 - RNA, 20 nt, Human
gcccaggagcuccccucccc

SEQ ID NO: 1324099 - RNA, 21 nt, Human
gcccaggagcuccccucccca

SEQ ID NO: 1324100 - RNA, 22 nt, Human
gccaugugcuaguaauuggaaa

SEQ ID NO: 1324101 - RNA, 14 nt, Human
gccaucaaaaugcu

SEQ ID NO: 1324102 - RNA, 15 nt, Human
gccaucaaaaugcuu

SEQ ID NO: 1324103 - RNA, 16 nt, Human
gccaucaaaaugcuuu

SEQ ID NO: 1324104 - RNA, 18 nt, Human
gccaucaaaaugcuuuuu

SEQ ID NO: 1324105 - RNA, 19 nt, Human
gccaucaaaaugcuuuuua

SEQ ID NO: 1324106 - RNA, 20 nt, Human
gccauauuuguaaaaugaca

SEQ ID NO: 1324107 - RNA, 15 nt, Human
gccaucaagagacug

SEQ ID NO: 1324108 - RNA, 16 nt, Human
gccaucaagagacuga

SEQ ID NO: 1324109 - RNA, 24 nt, Human
gcccaggagcuccccuccccaacu

SEQ ID NO: 1324110 - RNA, 16 nt, Human
gcccucacccuggggc

SEQ ID NO: 1324111 - RNA, 21 nt, Human
gcccuauuuagaugauaaaga

SEQ ID NO: 1324112 - RNA, 17 nt, Human
gcccucacccuggggcu

SEQ ID NO: 1324113 - RNA, 19 nt, Human
gcccucaguagucccugca

SEQ ID NO: 1324114 - RNA, 23 nt, Human
gcccucaguagucccugcacagu

SEQ ID NO: 1324115 - RNA, 12 nt, Human
gcccucaucccg

SEQ ID NO: 1324116 - RNA, 16 nt, Human
gcccucauggccccuc

SEQ ID NO: 1324117 - RNA, 18 nt, Human
gcccucauggccccucug

SEQ ID NO: 1324118 - RNA, 23 nt, Human
gcccauucauuccauucuggaag

SEQ ID NO: 1324119 - RNA, 19 nt, Human
gcccauucauuccauucug

SEQ ID NO: 1324120 - RNA, 16 nt, Human
gcccauucauuccauu

SEQ ID NO: 1324121 - RNA, 14 nt, Human
gccccaacuccuuc

SEQ ID NO: 1324122 - RNA, 17 nt, Human
gccccaacuccuuccag

SEQ ID NO: 1324123 - RNA, 18 nt, Human
gccccaacuccuuccagc

SEQ ID NO: 1324124 - RNA, 19 nt, Human
gccccaacuccuuccagcu

SEQ ID NO: 1324125 - RNA, 21 nt, Human
gccccaacuccuuccagcuag

SEQ ID NO: 1324126 - RNA, 21 nt, Human
gccccaacucuccccugaccu

SEQ ID NO: 1324127 - RNA, 20 nt, Human
gccccaacuccuuccagcua

SEQ ID NO: 1324128 - RNA, 23 nt, Human
gccccacccucguggacaccugc

SEQ ID NO: 1324129 - RNA, 22 nt, Human
gccccacccucguggacaccug

SEQ ID NO: 1324130 - RNA, 12 nt, Human
gccccacccugg

SEQ ID NO: 1324131 - RNA, 14 nt, Human
gccccacccugggc

SEQ ID NO: 1324132 - RNA, 21 nt, Human
gccccacccucguggacaccu

SEQ ID NO: 1324133 - RNA, 20 nt, Human
gccccacccucguggacacc

SEQ ID NO: 1324134 - RNA, 12 nt, Human
gccccacccucg

SEQ ID NO: 1324135 - RNA, 13 nt, Human
gccccacccucgg

SEQ ID NO: 1324136 - RNA, 16 nt, Human
gccccacccucgggga

SEQ ID NO: 1324137 - RNA, 22 nt, Human
gccccacccucggggauguguc

SEQ ID NO: 1324138 - RNA, 12 nt, Human
gccccccuggcc

SEQ ID NO: 1324139 - RNA, 13 nt, Human
gccccccuggccu

SEQ ID NO: 1324140 - RNA, 19 nt, Human
gccccccuggccuccccca

SEQ ID NO: 1324141 - RNA, 18 nt, Human
gccccccugguccccucc

SEQ ID NO: 1324142 - RNA, 20 nt, Human
gccccccugguccccuccuu

SEQ ID NO: 1324143 - RNA, 21 nt, Human
gccccacaccagggccagccu

SEQ ID NO: 1324144 - RNA, 22 nt, Human
gccccacaccagggccagccuc

SEQ ID NO: 1324145 - RNA, 16 nt, Human
gccccacccaggccag

SEQ ID NO: 1324146 - RNA, 15 nt, Human
gccccaccccagggc

SEQ ID NO: 1324147 - RNA, 17 nt, Human
gccccaccccagggcag

SEQ ID NO: 1324148 - RNA, 18 nt, Human
gccccaccccagggcagc

SEQ ID NO: 1324149 - RNA, 19 nt, Human
gccccaccccagggcagcc

SEQ ID NO: 1324150 - RNA, 20 nt, Human
gccccaccccagggcagcca

SEQ ID NO: 1324151 - RNA, 21 nt, Human
gccccaccccagggcagccag

SEQ ID NO: 1324152 - RNA, 22 nt, Human
gccccaccccagggcagccagg

SEQ ID NO: 1324153 - RNA, 16 nt, Human
gccccugccucucugc

SEQ ID NO: 1324154 - RNA, 15 nt, Human
gccccugccucucug

SEQ ID NO: 1324155 - RNA, 17 nt, Human
gcccccgccuuggccug

SEQ ID NO: 1324156 - RNA, 23 nt, Human
gcccccucacaguauugcucacc

SEQ ID NO: 1324157 - RNA, 14 nt, Human
gcccccucccugga

SEQ ID NO: 1324158 - RNA, 16 nt, Human
gcccccuccgcccugc

SEQ ID NO: 1324159 - RNA, 18 nt, Human
gccccugccucucugcag

SEQ ID NO: 1324160 - RNA, 17 nt, Human
gccccugccucucugca

SEQ ID NO: 1324161 - RNA, 15 nt, Human
gcccccucccuggau

SEQ ID NO: 1324162 - RNA, 16 nt, Human
gcccccucccuggaug

SEQ ID NO: 1324163 - RNA, 14 nt, Human
gccaggcauguggc

SEQ ID NO: 1324164 - RNA, 14 nt, Human
gccaggcccagccg

SEQ ID NO: 1324165 - RNA, 16 nt, Human
gccaggauggcgcagg

SEQ ID NO: 1324166 - RNA, 14 nt, Human
gccaggauggcgca

SEQ ID NO: 1324167 - RNA, 16 nt, Human
gccauaugaaaaggcu

SEQ ID NO: 1324168 - RNA, 16 nt, Human
gccauauuuaccucag

SEQ ID NO: 1324169 - RNA, 17 nt, Human
gccauauuuaccucagc

SEQ ID NO: 1324170 - RNA, 18 nt, Human
gccauauuuaccucagcc

SEQ ID NO: 1324171 - RNA, 19 nt, Human
gccauauuuaccucagccu

SEQ ID NO: 1324172 - RNA, 20 nt, Human
gccauauuuaccucagccug

SEQ ID NO: 1324173 - RNA, 22 nt, Human
gccauauuuaccucagccuggg

SEQ ID NO: 1324174 - RNA, 21 nt, Human
gccauauuuaccucagccugg

SEQ ID NO: 1324175 - RNA, 13 nt, Human
gccauauuuguaa

SEQ ID NO: 1324176 - RNA, 14 nt, Human
gccauauuuguaaa

SEQ ID NO: 1324177 - RNA, 18 nt, Human
gccauauuuguaaaauga

SEQ ID NO: 1324178 - RNA, 17 nt, Human
gccauauuuucaccauu

SEQ ID NO: 1324179 - RNA, 14 nt, Human
gccauacugugucc

SEQ ID NO: 1324180 - RNA, 13 nt, Human
gccaguuguccuc

SEQ ID NO: 1324181 - RNA, 14 nt, Human
gccaguuguccucc

SEQ ID NO: 1324182 - RNA, 16 nt, Human
gccaguuguccuccuu

SEQ ID NO: 1324183 - RNA, 22 nt, Human
gccauaaaacagguaauauaaa

SEQ ID NO: 1324184 - RNA, 17 nt, Human
gccaguguuuaaaacuu

SEQ ID NO: 1324185 - RNA, 16 nt, Human
gccaguguccugagcc

SEQ ID NO: 1324186 - RNA, 14 nt, Human
gcuagaacaugguu

SEQ ID NO: 1324187 - RNA, 15 nt, Human
gcuagaacccucugu

SEQ ID NO: 1324188 - RNA, 14 nt, Human
gcuagaacccucug

SEQ ID NO: 1324189 - RNA, 17 nt, Human
gcuacuugggaggcuga

SEQ ID NO: 1324190 - RNA, 18 nt, Human
gcuacuuccuccucccca

SEQ ID NO: 1324191 - RNA, 19 nt, Human
gcuacuuccuccuccccac

SEQ ID NO: 1324192 - RNA, 18 nt, Human
gcuacuucggggcuggga

SEQ ID NO: 1324193 - RNA, 23 nt, Human
gcuacuuugcugcuaugguuuuc

SEQ ID NO: 1324194 - RNA, 16 nt, Human
gcuacuuugcugcuau

SEQ ID NO: 1324195 - RNA, 19 nt, Human
gcuacuguaaggcaaucau

SEQ ID NO: 1324196 - RNA, 18 nt, Human
gcuacuguaaggcaauca

SEQ ID NO: 1324197 - RNA, 16 nt, Human
gcuacuggggaaacug

SEQ ID NO: 1324198 - RNA, 17 nt, Human
gcuacuggggaaacugg

SEQ ID NO: 1324199 - RNA, 18 nt, Human
gcuacuggggaaacuggc

SEQ ID NO: 1324200 - RNA, 20 nt, Human
gcuacuggggaaacuggcca

SEQ ID NO: 1324201 - RNA, 21 nt, Human
gcuacuggggaaacuggccau

SEQ ID NO: 1324202 - RNA, 23 nt, Human
gcuacuggggaaacuggccaugg

SEQ ID NO: 1324203 - RNA, 15 nt, Human
gcuacugugugugug

SEQ ID NO: 1324204 - RNA, 18 nt, Human
gcuacugugugugugaau

SEQ ID NO: 1324205 - RNA, 19 nt, Human
gcuacugugugugugaaug

SEQ ID NO: 1324206 - RNA, 21 nt, Human
gcuacugugugugugaaugaa

SEQ ID NO: 1324207 - RNA, 18 nt, Human
gcuaauuuugaaaaacug

SEQ ID NO: 1324208 - RNA, 20 nt, Human
gcuaauuuauccugaaauuu

SEQ ID NO: 1324209 - RNA, 12 nt, Human
gcuaauuugcau

SEQ ID NO: 1324210 - RNA, 13 nt, Human
gcuaauuugcauu

SEQ ID NO: 1324211 - RNA, 15 nt, Human
gcuaauuugcauuaa

SEQ ID NO: 1324212 - RNA, 20 nt, Human
gcuaauuuguuuuggauaua

SEQ ID NO: 1324213 - RNA, 13 nt, Human
gcguggugcgagu

SEQ ID NO: 1324214 - RNA, 12 nt, Human
gcuaauuuuuau

SEQ ID NO: 1324215 - RNA, 15 nt, Human
gcuaauuuuuguaau

SEQ ID NO: 1324216 - RNA, 16 nt, Human
gcuaauuuuuguaauu

SEQ ID NO: 1324217 - RNA, 17 nt, Human
gcuaauuuuuguaauuu

SEQ ID NO: 1324218 - RNA, 21 nt, Human
gcuaauuuuuuuguauuuuag

SEQ ID NO: 1324219 - RNA, 18 nt, Human
gcuaauuuuuauuaauuu

SEQ ID NO: 1324220 - RNA, 20 nt, Human
gcuaauuuuuguauuuuuag

SEQ ID NO: 1324221 - RNA, 20 nt, Human
gcuaauuuuuuguuguuucu

SEQ ID NO: 1324222 - RNA, 19 nt, Human
gcuaauuuuuuuguauuuu

SEQ ID NO: 1324223 - RNA, 18 nt, Human
gcuacugccgucagugcu

SEQ ID NO: 1324224 - RNA, 22 nt, Human
gcuacugccgucagugcugugc

SEQ ID NO: 1324225 - RNA, 12 nt, Human
gcuacugcuuca

SEQ ID NO: 1324226 - RNA, 23 nt, Human
gcggaggaaggaggacccaggac

SEQ ID NO: 1324227 - RNA, 21 nt, Human
gcggagguguggagccgaggc

SEQ ID NO: 1324228 - RNA, 16 nt, Human
gcgugaucucagcuca

SEQ ID NO: 1324229 - RNA, 15 nt, Human
gcggccuccuucuga

SEQ ID NO: 1324230 - RNA, 15 nt, Human
gcgugaucucagcuc

SEQ ID NO: 1324231 - RNA, 12 nt, Human
gcgugaucucag

SEQ ID NO: 1324232 - RNA, 16 nt, Human
gcggcuggggucccag

SEQ ID NO: 1324233 - RNA, 16 nt, Human
gcgugguggucccugg

SEQ ID NO: 1324234 - RNA, 22 nt, Human
gcguggagggguaggggcuggg

SEQ ID NO: 1324235 - RNA, 21 nt, Human
gcguggccuuguucugucacc

SEQ ID NO: 1324236 - RNA, 12 nt, Human
gcguggcugacu

SEQ ID NO: 1324237 - RNA, 19 nt, Human
gcggccuccuucugagcuc

SEQ ID NO: 1324238 - RNA, 23 nt, Human
gcggccuaugacuugggcacccc

SEQ ID NO: 1324239 - RNA, 19 nt, Human
gcggccuaugacuugggca

SEQ ID NO: 1324240 - RNA, 14 nt, Human
gcggccuccuucug

SEQ ID NO: 1324241 - RNA, 14 nt, Human
gcggcugggaggag

SEQ ID NO: 1324242 - RNA, 17 nt, Human
gcggcugggaggagggc

SEQ ID NO: 1324243 - RNA, 18 nt, Human
gcggcugggaggagggca

SEQ ID NO: 1324244 - RNA, 19 nt, Human
gcggcugggaggagggcag

SEQ ID NO: 1324245 - RNA, 22 nt, Human
gcggcugggaggagggcaggca

SEQ ID NO: 1324246 - RNA, 13 nt, Human
gcggcccucagua

SEQ ID NO: 1324247 - RNA, 14 nt, Human
gcggcccugucauc

SEQ ID NO: 1324248 - RNA, 13 nt, Human
gcggcccugucau

SEQ ID NO: 1324249 - RNA, 13 nt, Human
gcggccggccagc

SEQ ID NO: 1324250 - RNA, 18 nt, Human
gcggccuaugacuugggc

SEQ ID NO: 1324251 - RNA, 17 nt, Human
gcggaggggacagagcg

SEQ ID NO: 1324252 - RNA, 16 nt, Human
gcggcccaauccaagg

SEQ ID NO: 1324253 - RNA, 22 nt, Human
gcggcccaauccaagguggggu

SEQ ID NO: 1324254 - RNA, 18 nt, Human
gcgauucucuugccucaa

SEQ ID NO: 1324255 - RNA, 23 nt, Human
gcgauucuccugccucagccucc

SEQ ID NO: 1324256 - RNA, 17 nt, Human
gcgauucuccugccuca

SEQ ID NO: 1324257 - RNA, 13 nt, Human
gcgauagagucuc

SEQ ID NO: 1324258 - RNA, 19 nt, Human
gcgagauaccccaccuccc

SEQ ID NO: 1324259 - RNA, 18 nt, Human
gcgagcaugucguggaca

SEQ ID NO: 1324260 - RNA, 15 nt, Human
gcgagagaugugugu

SEQ ID NO: 1324261 - RNA, 16 nt, Human
gcgagagauguguguu

SEQ ID NO: 1324262 - RNA, 22 nt, Human
gcgagagauguguguugauacu

SEQ ID NO: 1324263 - RNA, 16 nt, Human
gcgacuuucugccugg

SEQ ID NO: 1324264 - RNA, 17 nt, Human
gcgacuuucugccugga

SEQ ID NO: 1324265 - RNA, 19 nt, Human
gcgagagaucaaagaugaa

SEQ ID NO: 1324266 - RNA, 12 nt, Human
gcgagagaugug

SEQ ID NO: 1324267 - RNA, 13 nt, Human
gcgagagaugugu

SEQ ID NO: 1324268 - RNA, 14 nt, Human
gcgagagaugugug

SEQ ID NO: 1324269 - RNA, 20 nt, Human
gccugcuaaggucuuggaac

SEQ ID NO: 1324270 - RNA, 20 nt, Human
gccugcuauuugaaguguaa

SEQ ID NO: 1324271 - RNA, 12 nt, Human
gccugcuccaga

SEQ ID NO: 1324272 - RNA, 13 nt, Human
gccugcuccagac

SEQ ID NO: 1324273 - RNA, 14 nt, Human
gccugcuccagacc

SEQ ID NO: 1324274 - RNA, 15 nt, Human
gccugcuccagaccu

SEQ ID NO: 1324275 - RNA, 16 nt, Human
gccugcuccagaccug

SEQ ID NO: 1324276 - RNA, 12 nt, Human
gccugcccuggu

SEQ ID NO: 1324277 - RNA, 14 nt, Human
gccugcccugguga

SEQ ID NO: 1324278 - RNA, 13 nt, Human
gccucggacuuag

SEQ ID NO: 1324279 - RNA, 18 nt, Human
gccucgcuccccacucug

SEQ ID NO: 1324280 - RNA, 19 nt, Human
gccucgcuccccacucugc

SEQ ID NO: 1324281 - RNA, 20 nt, Human
gccucgcuccccacucugcu

SEQ ID NO: 1324282 - RNA, 23 nt, Human
gccucgcuccccacucugcucug

SEQ ID NO: 1324283 - RNA, 24 nt, Human
gccucgcuccccacucugcucuga

SEQ ID NO: 1324284 - RNA, 20 nt, Human
gccugcccucauggccccuc

SEQ ID NO: 1324285 - RNA, 21 nt, Human
gccugcccucauggccccucu

SEQ ID NO: 1324286 - RNA, 22 nt, Human
gccugcccucauggccccucug

SEQ ID NO: 1324287 - RNA, 20 nt, Human
gccuccuucugagcuccugu

SEQ ID NO: 1324288 - RNA, 21 nt, Human
gccuccuucugagcuccuguc

SEQ ID NO: 1324289 - RNA, 22 nt, Human
gccuccuucugagcuccugucc

SEQ ID NO: 1324290 - RNA, 12 nt, Human
gccucgcaaccc

SEQ ID NO: 1324291 - RNA, 18 nt, Human
gccucgcaacccgugcca

SEQ ID NO: 1324292 - RNA, 23 nt, Human
gccucgcaacccgugccaagucc

SEQ ID NO: 1324293 - RNA, 20 nt, Human
gccucgcaacccgugccaag

SEQ ID NO: 1324294 - RNA, 16 nt, Human
gccucgcccauccccu

SEQ ID NO: 1324295 - RNA, 13 nt, Human
gccucgccccugg

SEQ ID NO: 1324296 - RNA, 14 nt, Human
gccucgccccuggc

SEQ ID NO: 1324297 - RNA, 16 nt, Human
gccucgccccuggcag

SEQ ID NO: 1324298 - RNA, 17 nt, Human
gccucgccccuggcaga

SEQ ID NO: 1324299 - RNA, 18 nt, Human
gccucgccccuggcagag

SEQ ID NO: 1324300 - RNA, 14 nt, Human
gccucgcuccccac

SEQ ID NO: 1324301 - RNA, 16 nt, Human
gccucgcuccccacuc

SEQ ID NO: 1324302 - RNA, 17 nt, Human
gccugcuccagaccuga

SEQ ID NO: 1324303 - RNA, 21 nt, Human
gccugcuccagaccugauccu

SEQ ID NO: 1324304 - RNA, 20 nt, Human
gccuccaacccuagcaaaag

SEQ ID NO: 1324305 - RNA, 22 nt, Human
gccuccaaggaggggcuguaaa

SEQ ID NO: 1324306 - RNA, 23 nt, Human
gccuccaaggaggggcuguaaaa

SEQ ID NO: 1324307 - RNA, 22 nt, Human
gccuccaauuuuuuaagugaaa

SEQ ID NO: 1324308 - RNA, 22 nt, Human
gccuccagaggggcucagguca

SEQ ID NO: 1324309 - RNA, 16 nt, Human
gccuccaacccuagca

SEQ ID NO: 1324310 - RNA, 17 nt, Human
gccuccaagcuccaucu

SEQ ID NO: 1324311 - RNA, 15 nt, Human
gccucauuuuuuucc

SEQ ID NO: 1324312 - RNA, 21 nt, Human
gccucauuuuuuuccuugcaa

SEQ ID NO: 1324313 - RNA, 19 nt, Human
gccucauuuuuuuccuugc

SEQ ID NO: 1324314 - RNA, 18 nt, Human
gccucauguggcuggaag

SEQ ID NO: 1324315 - RNA, 19 nt, Human
gccucauguggcuggaaga

SEQ ID NO: 1324316 - RNA, 11 nt, Human
gccuccaugcu

SEQ ID NO: 1324317 - RNA, 12 nt, Human
gccuccuucuga

SEQ ID NO: 1324318 - RNA, 18 nt, Human
gccuccuucugagcuccu

SEQ ID NO: 1324319 - RNA, 20 nt, Human
gccuccauccugaggcucca

SEQ ID NO: 1324320 - RNA, 16 nt, Human
gccuccauccugaggc

SEQ ID NO: 1324321 - RNA, 19 nt, Human
gagcuggggaccugguacc

SEQ ID NO: 1324322 - RNA, 22 nt, Human
gagcuggcucugagcgccucca

SEQ ID NO: 1324323 - RNA, 12 nt, Human
gagcugggccug

SEQ ID NO: 1324324 - RNA, 13 nt, Human
gagcugggccugg

SEQ ID NO: 1324325 - RNA, 14 nt, Human
gagcugggccuggu

SEQ ID NO: 1324326 - RNA, 16 nt, Human
gagcugggccuggucu

SEQ ID NO: 1324327 - RNA, 21 nt, Human
gagcugggccuggucucaccc

SEQ ID NO: 1324328 - RNA, 17 nt, Human
gagcugggccuggucuc

SEQ ID NO: 1324329 - RNA, 13 nt, Human
gagcuggggaccu

SEQ ID NO: 1324330 - RNA, 15 nt, Human
gagcuggggaccugg

SEQ ID NO: 1324331 - RNA, 23 nt, Human
gagccuuuucccucuuuggcucc

SEQ ID NO: 1324332 - RNA, 13 nt, Human
gagcgacagugag

SEQ ID NO: 1324333 - RNA, 17 nt, Human
gagcgggucugcuccca

SEQ ID NO: 1324334 - RNA, 15 nt, Human
gagcgggucugcucc

SEQ ID NO: 1324335 - RNA, 13 nt, Human
gagcuggcucuga

SEQ ID NO: 1324336 - RNA, 17 nt, Human
gagcuggcucugagcgc

SEQ ID NO: 1324337 - RNA, 20 nt, Human
gagcagggauuaaccucugc

SEQ ID NO: 1324338 - RNA, 21 nt, Human
gagcagggauuaaccucugca

SEQ ID NO: 1324339 - RNA, 22 nt, Human
gagcagggauuaaccucugcac

SEQ ID NO: 1324340 - RNA, 15 nt, Human
gagcagggccgggga

SEQ ID NO: 1324341 - RNA, 16 nt, Human
gagcagggccggggaa

SEQ ID NO: 1324342 - RNA, 21 nt, Human
gagcagggccggggaacuggc

SEQ ID NO: 1324343 - RNA, 22 nt, Human
gagcagggccggggaacuggcc

SEQ ID NO: 1324344 - RNA, 21 nt, Human
gagcauaggugauccauguaa

SEQ ID NO: 1324345 - RNA, 22 nt, Human
gagcauaggugauccauguaac

SEQ ID NO: 1324346 - RNA, 12 nt, Human
gagcaucacaga

SEQ ID NO: 1324347 - RNA, 13 nt, Human
gagcaucacagaa

SEQ ID NO: 1324348 - RNA, 14 nt, Human
gagcaucacagaau

SEQ ID NO: 1324349 - RNA, 19 nt, Human
gagcauggaacacuucgag

SEQ ID NO: 1324350 - RNA, 18 nt, Human
gagcauggaacacuucga

SEQ ID NO: 1324351 - RNA, 22 nt, Human
gagcauguacugagccuuguaa

SEQ ID NO: 1324352 - RNA, 15 nt, Human
gagcaugucguggac

SEQ ID NO: 1324353 - RNA, 16 nt, Human
gagccccagcuacccu

SEQ ID NO: 1324354 - RNA, 14 nt, Human
gagccccagggaga

SEQ ID NO: 1324355 - RNA, 23 nt, Human
gagccccagggagagggggcugg

SEQ ID NO: 1324356 - RNA, 16 nt, Human
gagccccauuccuggg

SEQ ID NO: 1324357 - RNA, 17 nt, Human
gagccccauuccuggga

SEQ ID NO: 1324358 - RNA, 18 nt, Human
gagccccauuccugggaa

SEQ ID NO: 1324359 - RNA, 14 nt, Human
gagcccccacccug

SEQ ID NO: 1324360 - RNA, 15 nt, Human
gagcccccacccugu

SEQ ID NO: 1324361 - RNA, 22 nt, Human
gagcccccacccuguuccugcu

SEQ ID NO: 1324362 - RNA, 23 nt, Human
gagcccccacccuguuccugcug

SEQ ID NO: 1324363 - RNA, 13 nt, Human
gagcccccagccu

SEQ ID NO: 1324364 - RNA, 14 nt, Human
gagcccccagccug

SEQ ID NO: 1324365 - RNA, 15 nt, Human
gagcccccagccugu

SEQ ID NO: 1324366 - RNA, 16 nt, Human
gagcccccagccuguc

SEQ ID NO: 1324367 - RNA, 17 nt, Human
gagcccccagccuguca

SEQ ID NO: 1324368 - RNA, 18 nt, Human
gagcccccagccugucag

SEQ ID NO: 1324369 - RNA, 14 nt, Human
gagauguagccccu

SEQ ID NO: 1324370 - RNA, 16 nt, Human
gagaugggcuucccaa

SEQ ID NO: 1324371 - RNA, 16 nt, Human
gagauguaaaagguau

SEQ ID NO: 1324372 - RNA, 17 nt, Human
gagauguaaaagguauu

SEQ ID NO: 1324373 - RNA, 14 nt, Human
gagauggcucccag

SEQ ID NO: 1324374 - RNA, 15 nt, Human
gagauggcucccagg

SEQ ID NO: 1324375 - RNA, 14 nt, Human
gagaugggcuuccc

SEQ ID NO: 1324376 - RNA, 17 nt, Human
gagaugggcuucccaag

SEQ ID NO: 1324377 - RNA, 21 nt, Human
gagauugcaccacugcacucc

SEQ ID NO: 1324378 - RNA, 20 nt, Human
gagauucucauaacuugaga

SEQ ID NO: 1324379 - RNA, 23 nt, Human
gagauucucauaacuugagaccu

SEQ ID NO: 1324380 - RNA, 14 nt, Human
gagauucugccuuu

SEQ ID NO: 1324381 - RNA, 15 nt, Human
gagauucugccuuug

SEQ ID NO: 1324382 - RNA, 21 nt, Human
gagauucugccuuugccaggu

SEQ ID NO: 1324383 - RNA, 14 nt, Human
gagauugaauuuca

SEQ ID NO: 1324384 - RNA, 22 nt, Human
gagauugaauuucacugucuuu

SEQ ID NO: 1324385 - RNA, 14 nt, Human
gagauugaccugga

SEQ ID NO: 1324386 - RNA, 16 nt, Human
gagauuuauuaaagaa

SEQ ID NO: 1324387 - RNA, 17 nt, Human
gagauuuauuaaagaaa

SEQ ID NO: 1324388 - RNA, 21 nt, Human
gagauuuucaacauuucaaaa

SEQ ID NO: 1324389 - RNA, 12 nt, Human
gagauuuuucau

SEQ ID NO: 1324390 - RNA, 21 nt, Human
gagaggcagcccaggaagucu

SEQ ID NO: 1324391 - RNA, 18 nt, Human
gagaugcaccaccaagcc

SEQ ID NO: 1324392 - RNA, 21 nt, Human
gagaugcaccaccaagccaag

SEQ ID NO: 1324393 - RNA, 16 nt, Human
gagaugcagugccagg

SEQ ID NO: 1324394 - RNA, 19 nt, Human
gagaugcuggcuugggcag

SEQ ID NO: 1324395 - RNA, 12 nt, Human
gagaugcuggcu

SEQ ID NO: 1324396 - RNA, 18 nt, Human
gagauggagucuugcucu

SEQ ID NO: 1324397 - RNA, 13 nt, Human
gagaagccuucaa

SEQ ID NO: 1324398 - RNA, 16 nt, Human
gagaagccuucaagcu

SEQ ID NO: 1324399 - RNA, 18 nt, Human
gagaagccuucaagcucu

SEQ ID NO: 1324400 - RNA, 20 nt, Human
gagaaggacccggaggggcc

SEQ ID NO: 1324401 - RNA, 18 nt, Human
gagaaggaaaauuuuagc

SEQ ID NO: 1324402 - RNA, 22 nt, Human
gagaaggacccggaggggccug

SEQ ID NO: 1324403 - RNA, 23 nt, Human
gagaaggacccggaggggccugg

SEQ ID NO: 1324404 - RNA, 16 nt, Human
gagaagucacagggca

SEQ ID NO: 1324405 - RNA, 17 nt, Human
gagaagucacagggcag

SEQ ID NO: 1324406 - RNA, 18 nt, Human
gagaagucacagggcagu

SEQ ID NO: 1324407 - RNA, 22 nt, Human
gagaagucacagggcaguaccu

SEQ ID NO: 1324408 - RNA, 13 nt, Human
gagaagucucagc

SEQ ID NO: 1324409 - RNA, 19 nt, Human
gagaagccuucaagcucug

SEQ ID NO: 1324410 - RNA, 20 nt, Human
gagaagccuucaagcucuga

SEQ ID NO: 1324411 - RNA, 22 nt, Human
gagaagccuucaagcucugagg

SEQ ID NO: 1324412 - RNA, 21 nt, Human
gagaagccuucaagcucugag

SEQ ID NO: 1324413 - RNA, 13 nt, Human
gagaccucagaag

SEQ ID NO: 1324414 - RNA, 18 nt, Human
gagaccucagaaguaaag

SEQ ID NO: 1324415 - RNA, 11 nt, Human
gagaccugccc

SEQ ID NO: 1324416 - RNA, 12 nt, Human
gagaccugcccc

SEQ ID NO: 1324417 - RNA, 13 nt, Human
gagaccugccccu

SEQ ID NO: 1324418 - RNA, 15 nt, Human
gagaaucacuugaac

SEQ ID NO: 1324419 - RNA, 14 nt, Human
gagaaucagacuga

SEQ ID NO: 1324420 - RNA, 18 nt, Human
gagacccagcccucaucc

SEQ ID NO: 1324421 - RNA, 11 nt, Human
gagacccagcg

SEQ ID NO: 1324422 - RNA, 18 nt, Human
gagacccagcggacacac

SEQ ID NO: 1324423 - RNA, 14 nt, Human
gagaaucacuugaa

SEQ ID NO: 1324424 - RNA, 14 nt, Human
gagaagucucagcu

SEQ ID NO: 1324425 - RNA, 21 nt, Human
gagaagucucagcuaagcuca

SEQ ID NO: 1324426 - RNA, 22 nt, Human
gagaagucucagcuaagcucac

SEQ ID NO: 1324427 - RNA, 17 nt, Human
gagaagugaaugcuggg

SEQ ID NO: 1324428 - RNA, 19 nt, Human
gagaagugaaugcugggac

SEQ ID NO: 1324429 - RNA, 20 nt, Human
gagaagugaaugcugggacu

SEQ ID NO: 1324430 - RNA, 18 nt, Human
gacuggugcuaaugucaa

SEQ ID NO: 1324431 - RNA, 21 nt, Human
gacuggguaggaaagaggaag

SEQ ID NO: 1324432 - RNA, 15 nt, Human
gacugaaaauauugu

SEQ ID NO: 1324433 - RNA, 11 nt, Human
gacuuuccucu

SEQ ID NO: 1324434 - RNA, 14 nt, Human
gacuuuccauuaca

SEQ ID NO: 1324435 - RNA, 11 nt, Human
gacuuucccca

SEQ ID NO: 1324436 - RNA, 12 nt, Human
gacuuuccccac

SEQ ID NO: 1324437 - RNA, 18 nt, Human
gacuuuccccaccagaug

SEQ ID NO: 1324438 - RNA, 21 nt, Human
gacuuuccccaccagaugcug

SEQ ID NO: 1324439 - RNA, 11 nt, Human
gacuuuccugc

SEQ ID NO: 1324440 - RNA, 12 nt, Human
gacuuuccugca

SEQ ID NO: 1324441 - RNA, 20 nt, Human
gacuuuccccaccagaugcu

SEQ ID NO: 1324442 - RNA, 12 nt, Human
gacuuucugccu

SEQ ID NO: 1324443 - RNA, 14 nt, Human
gacuuucugccugg

SEQ ID NO: 1324444 - RNA, 15 nt, Human
gacuuucugccugga

SEQ ID NO: 1324445 - RNA, 12 nt, Human
gacuuuugugaa

SEQ ID NO: 1324446 - RNA, 17 nt, Human
gacucuuaagaagacug

SEQ ID NO: 1324447 - RNA, 18 nt, Human
gacucuuaagaagacugc

SEQ ID NO: 1324448 - RNA, 16 nt, Human
gacucuuaagaagacu

SEQ ID NO: 1324449 - RNA, 18 nt, Human
gacucuggugccuccaga

SEQ ID NO: 1324450 - RNA, 13 nt, Human
gacucuguccuga

SEQ ID NO: 1324451 - RNA, 24 nt, Human
gacucuguccugaaggccugaggu

SEQ ID NO: 1324452 - RNA, 19 nt, Human
gacucugucuaccuggucu

SEQ ID NO: 1324453 - RNA, 16 nt, Human
gacucuuuaugcuugc

SEQ ID NO: 1324454 - RNA, 17 nt, Human
gacucuuuuccuucccu

SEQ ID NO: 1324455 - RNA, 17 nt, Human
gacucuuuugccauuaa

SEQ ID NO: 1324456 - RNA, 14 nt, Human
gacucaaaccaaau

SEQ ID NO: 1324457 - RNA, 18 nt, Human
gacuaucugucugguggc

SEQ ID NO: 1324458 - RNA, 15 nt, Human
gacuaggguccuggg

SEQ ID NO: 1324459 - RNA, 16 nt, Human
gacuaggguccugggg

SEQ ID NO: 1324460 - RNA, 18 nt, Human
gacuaggguccuggggaa

SEQ ID NO: 1324461 - RNA, 22 nt, Human
gacuauauuugggccugcucca

SEQ ID NO: 1324462 - RNA, 17 nt, Human
gacuaucuuacuauuuc

SEQ ID NO: 1324463 - RNA, 19 nt, Human
gacuaucuuacuauuucac

SEQ ID NO: 1324464 - RNA, 15 nt, Human
gacuaugaaaagcua

SEQ ID NO: 1324465 - RNA, 19 nt, Human
gacuaugaaaaugcuggcu

SEQ ID NO: 1324466 - RNA, 21 nt, Human
gacuauucuugauguaaaauc

SEQ ID NO: 1324467 - RNA, 22 nt, Human
gacuauucuugauguaaaaucu

SEQ ID NO: 1324468 - RNA, 17 nt, Human
gacuagccuggcuuggg

SEQ ID NO: 1324469 - RNA, 23 nt, Human
gacuaggccuugcggcuccucag

SEQ ID NO: 1324470 - RNA, 16 nt, Human
gacuagggagccaugu

SEQ ID NO: 1324471 - RNA, 20 nt, Human
gaaugagagacacacugaag

SEQ ID NO: 1324472 - RNA, 14 nt, Human
gaaugaauuaaaua

SEQ ID NO: 1324473 - RNA, 16 nt, Human
gaaugaauuaaauaaa

SEQ ID NO: 1324474 - RNA, 12 nt, Human
gaaugacacugu

SEQ ID NO: 1324475 - RNA, 15 nt, Human
gaaugagacauccag

SEQ ID NO: 1324476 - RNA, 13 nt, Human
gaaugagacaucc

SEQ ID NO: 1324477 - RNA, 11 nt, Human
gaaugagccuc

SEQ ID NO: 1324478 - RNA, 13 nt, Human
gaaugagccucgg

SEQ ID NO: 1324479 - RNA, 22 nt, Human
gaaugagagacacacugaagaa

SEQ ID NO: 1324480 - RNA, 23 nt, Human
gaaugagagacacacugaagaag

SEQ ID NO: 1324481 - RNA, 15 nt, Human
gaagugugacuggcu

SEQ ID NO: 1324482 - RNA, 20 nt, Human
gaagugugccuucucucucc

SEQ ID NO: 1324483 - RNA, 13 nt, Human
gaaauccagggug

SEQ ID NO: 1324484 - RNA, 18 nt, Human
gaaauccagggugguggu

SEQ ID NO: 1324485 - RNA, 14 nt, Human
gaaauccauucaca

SEQ ID NO: 1324486 - RNA, 15 nt, Human
gaagcuacugugugu

SEQ ID NO: 1324487 - RNA, 20 nt, Human
gaagcuacugugugugugaa

SEQ ID NO: 1324488 - RNA, 22 nt, Human
gaagcuacugugugugugaaug

SEQ ID NO: 1324489 - RNA, 23 nt, Human
gaagcuacugugugugugaauga

SEQ ID NO: 1324490 - RNA, 18 nt, Human
gaagcuagacacaugaag

SEQ ID NO: 1324491 - RNA, 12 nt, Human
gaagcucagcug

SEQ ID NO: 1324492 - RNA, 14 nt, Human
gaagcuaauuugca

SEQ ID NO: 1324493 - RNA, 15 nt, Human
gaagcuaauuugcau

SEQ ID NO: 1324494 - RNA, 16 nt, Human
gaagcuaauuugcauu

SEQ ID NO: 1324495 - RNA, 17 nt, Human
gaagcuaauuugcauua

SEQ ID NO: 1324496 - RNA, 21 nt, Human
gaagcucagcugcauuccgca

SEQ ID NO: 1324497 - RNA, 21 nt, Human
gaagugacuuuggcugcaugc

SEQ ID NO: 1324498 - RNA, 12 nt, Human
gaagugagaccu

SEQ ID NO: 1324499 - RNA, 16 nt, Human
gaagugagcacagccu

SEQ ID NO: 1324500 - RNA, 20 nt, Human
gaagugacuuuggcugcaug

SEQ ID NO: 1324501 - RNA, 15 nt, Human
gaagugacuuuggcu

SEQ ID NO: 1324502 - RNA, 13 nt, Human
gaagugacuuugg

SEQ ID NO: 1324503 - RNA, 22 nt, Human
gaagugagggcucacucagcca

SEQ ID NO: 1324504 - RNA, 23 nt, Human
gaagugcaucuggagagaacagg

SEQ ID NO: 1324505 - RNA, 15 nt, Human
gaaguggggacagag

SEQ ID NO: 1324506 - RNA, 21 nt, Human
gaagugcugccgcgcagugug

SEQ ID NO: 1324507 - RNA, 18 nt, Human
gaagugcuguuuauuaau

SEQ ID NO: 1324508 - RNA, 20 nt, Human
gaagugcuguuuauuaaucu

SEQ ID NO: 1324509 - RNA, 21 nt, Human
gaagugcuuaguguacuugga

SEQ ID NO: 1324510 - RNA, 13 nt, Human
gaagggccagagc

SEQ ID NO: 1324511 - RNA, 14 nt, Human
gaagucuuuuguuc

SEQ ID NO: 1324512 - RNA, 15 nt, Human
gaagugaagaaugca

SEQ ID NO: 1324513 - RNA, 15 nt, Human
gaagugaaugcuggg

SEQ ID NO: 1324514 - RNA, 16 nt, Human
gaagugaaugcuggga

SEQ ID NO: 1324515 - RNA, 17 nt, Human
gaagugaaugcugggac

SEQ ID NO: 1324516 - RNA, 13 nt, Human
gaagggcaaguuu

SEQ ID NO: 1324517 - RNA, 23 nt, Human
gaagggagggcagagcuggugcg

SEQ ID NO: 1324518 - RNA, 14 nt, Human
gaagggagggcaga

SEQ ID NO: 1324519 - RNA, 15 nt, Human
gaagggagggcagag

SEQ ID NO: 1324520 - RNA, 16 nt, Human
gaagggagggcagagc

SEQ ID NO: 1324521 - RNA, 17 nt, Human
gaagggagggcagagcu

SEQ ID NO: 1324522 - RNA, 20 nt, Human
gaagggagggcagagcuggu

SEQ ID NO: 1324523 - RNA, 21 nt, Human
gaagggagggcagagcuggug

SEQ ID NO: 1324524 - RNA, 16 nt, Human
gaagggaggggcugug

SEQ ID NO: 1324525 - RNA, 12 nt, Human
gaagggagccaa

SEQ ID NO: 1324526 - RNA, 13 nt, Human
gaagggagccaag

SEQ ID NO: 1324527 - RNA, 14 nt, Human
gaagggagccaagg

SEQ ID NO: 1324528 - RNA, 15 nt, Human
gaagggagccaaggg

SEQ ID NO: 1324529 - RNA, 16 nt, Human
gaagggagccaaggga

SEQ ID NO: 1324530 - RNA, 20 nt, Human
gaagggagccaagggaugga

SEQ ID NO: 1324531 - RNA, 22 nt, Human
gaagggagccaagggauggaca

SEQ ID NO: 1324532 - RNA, 23 nt, Human
gaagggagccaagggauggacau

SEQ ID NO: 1324533 - RNA, 16 nt, Human
gaaggcuugggauuug

SEQ ID NO: 1324534 - RNA, 17 nt, Human
gaaggcuugggauuugc

SEQ ID NO: 1324535 - RNA, 20 nt, Human
gaaggcuugggauuugcugu

SEQ ID NO: 1324536 - RNA, 21 nt, Human
gaaggcuugggauuugcugug

SEQ ID NO: 1324537 - RNA, 20 nt, Human
gaaggcuuguugugcuuuua

SEQ ID NO: 1324538 - RNA, 17 nt, Human
gaaggcuuguugugcuu

SEQ ID NO: 1324539 - RNA, 19 nt, Human
gaaggcuuguugugcuuuu

SEQ ID NO: 1324540 - RNA, 15 nt, Human
gaagggaagagacag

SEQ ID NO: 1324541 - RNA, 22 nt, Human
gaagggaauaagguacaagaag

SEQ ID NO: 1324542 - RNA, 17 nt, Human
gaagggaauaagguaca

SEQ ID NO: 1324543 - RNA, 14 nt, Human
gaagggacugagag

SEQ ID NO: 1324544 - RNA, 15 nt, Human
gaagcucccccagca

SEQ ID NO: 1324545 - RNA, 20 nt, Human
gaagcucccccagcaaagcc

SEQ ID NO: 1324546 - RNA, 12 nt, Human
gaagcuccccca

SEQ ID NO: 1324547 - RNA, 14 nt, Human
gaagcugcucaacu

SEQ ID NO: 1324548 - RNA, 21 nt, Human
gaagcucccccagcaaagccc

SEQ ID NO: 1324549 - RNA, 16 nt, Human
gaagcugcccugccca

SEQ ID NO: 1324550 - RNA, 20 nt, Human
gaagcugcucaacuugcaaa

SEQ ID NO: 1324551 - RNA, 19 nt, Human
gaagcugugcgugugugug

SEQ ID NO: 1324552 - RNA, 19 nt, Human
gaaggcuacuucggggcug

SEQ ID NO: 1324553 - RNA, 21 nt, Human
gaaggcuacuucggggcuggg

SEQ ID NO: 1324554 - RNA, 22 nt, Human
gaaggcuacuucggggcuggga

SEQ ID NO: 1324555 - RNA, 14 nt, Human
gacauuaacucauu

SEQ ID NO: 1324556 - RNA, 21 nt, Human
gacauuaacucauuagacugg

SEQ ID NO: 1324557 - RNA, 22 nt, Human
gacauuaacucauuagacugga

SEQ ID NO: 1324558 - RNA, 23 nt, Human
gacauuaugugguuuuagauuuu

SEQ ID NO: 1324559 - RNA, 14 nt, Human
gacauucaccugcc

SEQ ID NO: 1324560 - RNA, 15 nt, Human
gacauucaccugccc

SEQ ID NO: 1324561 - RNA, 16 nt, Human
gacauucaccugcccc

SEQ ID NO: 1324562 - RNA, 17 nt, Human
gacauucaccugcccca

SEQ ID NO: 1324563 - RNA, 17 nt, Human
gacauuaugugguuuua

SEQ ID NO: 1324564 - RNA, 18 nt, Human
gacauucaccugccccaa

SEQ ID NO: 1324565 - RNA, 14 nt, Human
gacagugaaagaaa

SEQ ID NO: 1324566 - RNA, 17 nt, Human
gacagucguucccagug

SEQ ID NO: 1324567 - RNA, 13 nt, Human
gacagucucacuu

SEQ ID NO: 1324568 - RNA, 17 nt, Human
gacagucaccucaugga

SEQ ID NO: 1324569 - RNA, 15 nt, Human
gacagucaaaaccaa

SEQ ID NO: 1324570 - RNA, 12 nt, Human
gacagcuccacc

SEQ ID NO: 1324571 - RNA, 13 nt, Human
gacagcccuccau

SEQ ID NO: 1324572 - RNA, 19 nt, Human
gacagccuggcacagggca

SEQ ID NO: 1324573 - RNA, 16 nt, Human
gacagguuagcugcuc

SEQ ID NO: 1324574 - RNA, 16 nt, Human
gacaggucccuccccu

SEQ ID NO: 1324575 - RNA, 18 nt, Human
gacagcuccacccuggcc

SEQ ID NO: 1324576 - RNA, 16 nt, Human
gacacugccacacagg

SEQ ID NO: 1324577 - RNA, 16 nt, Human
gacacuuaaaaauggu

SEQ ID NO: 1324578 - RNA, 12 nt, Human
gacacuguucuu

SEQ ID NO: 1324579 - RNA, 18 nt, Human
gacacuguucuuagcuca

SEQ ID NO: 1324580 - RNA, 22 nt, Human
gacacuguucuuagcucaauga

SEQ ID NO: 1324581 - RNA, 23 nt, Human
gacacuguucuuagcucaaugag

SEQ ID NO: 1324582 - RNA, 20 nt, Human
gacacuuaauacuaccuuga

SEQ ID NO: 1324583 - RNA, 15 nt, Human
gacagaaguuugcac

SEQ ID NO: 1324584 - RNA, 20 nt, Human
gacagaaguuugcacuaucu

SEQ ID NO: 1324585 - RNA, 22 nt, Human
gacagaaguuugcacuaucuuu

SEQ ID NO: 1324586 - RNA, 14 nt, Human
gacacacugaagaa

SEQ ID NO: 1324587 - RNA, 15 nt, Human
gacacacuaaccaag

SEQ ID NO: 1324588 - RNA, 18 nt, Human
gacacacuaaccaagcug

SEQ ID NO: 1324589 - RNA, 19 nt, Human
gacacacuaaccaagcuga

SEQ ID NO: 1324590 - RNA, 13 nt, Human
gacacacugaaga

SEQ ID NO: 1324591 - RNA, 13 nt, Human
gacaaaauguuau

SEQ ID NO: 1324592 - RNA, 18 nt, Human
gacacaccaggcgcuaau

SEQ ID NO: 1324593 - RNA, 16 nt, Human
gacaaacaccucccag

SEQ ID NO: 1324594 - RNA, 15 nt, Human
gacacaccaggcgcu

SEQ ID NO: 1324595 - RNA, 12 nt, Human
gacacacaugaa

SEQ ID NO: 1324596 - RNA, 11 nt, Human
gaauuaguuuu

SEQ ID NO: 1324597 - RNA, 12 nt, Human
gaauuaugaaac

SEQ ID NO: 1324598 - RNA, 14 nt, Human
gaauuaucuaauuu

SEQ ID NO: 1324599 - RNA, 20 nt, Human
gaauuaucuugguugaaaau

SEQ ID NO: 1324600 - RNA, 14 nt, Human
gaauuaugaaacuu

SEQ ID NO: 1324601 - RNA, 17 nt, Human
gaauuaguuuuaaaaug

SEQ ID NO: 1324602 - RNA, 19 nt, Human
gaauuauaacuggaaagaa

SEQ ID NO: 1324603 - RNA, 21 nt, Human
gaauuauaacuguaaagaugu

SEQ ID NO: 1324604 - RNA, 20 nt, Human
gaauuauaacuggaaagaag

SEQ ID NO: 1324605 - RNA, 13 nt, Human
gaauuauaacugu

SEQ ID NO: 1324606 - RNA, 14 nt, Human
gaauuauaacugua

SEQ ID NO: 1324607 - RNA, 21 nt, Human
gaauuuucuuuguguagcuuu

SEQ ID NO: 1324608 - RNA, 23 nt, Human
gaauuuucuuuguguagcuuugc

SEQ ID NO: 1324609 - RNA, 21 nt, Human
gaauuuuauuuuuugggaaaa

SEQ ID NO: 1324610 - RNA, 18 nt, Human
gaauuuuauugacacagu

SEQ ID NO: 1324611 - RNA, 15 nt, Human
gaauuuuagcuuuug

SEQ ID NO: 1324612 - RNA, 16 nt, Human
gaauuuuagcuuuugu

SEQ ID NO: 1324613 - RNA, 18 nt, Human
gaauuuuauacuuucccu

SEQ ID NO: 1324614 - RNA, 19 nt, Human
gaauuuuauacuuucccua

SEQ ID NO: 1324615 - RNA, 20 nt, Human
gaauuuuauacuuucccuac

SEQ ID NO: 1324616 - RNA, 21 nt, Human
gaauuuuauacuuucccuacc

SEQ ID NO: 1324617 - RNA, 22 nt, Human
gaauuuuauacuuucccuaccc

SEQ ID NO: 1324618 - RNA, 23 nt, Human
gaauuuuauacuuucccuacccu

SEQ ID NO: 1324619 - RNA, 15 nt, Human
gacaaaauggaauac

SEQ ID NO: 1324620 - RNA, 22 nt, Human
gacaaaauacuugucuguuuua

SEQ ID NO: 1324621 - RNA, 20 nt, Human
gacaaaaccccccagauauc

SEQ ID NO: 1324622 - RNA, 23 nt, Human
gacaaaaccccccagauaucauc

SEQ ID NO: 1324623 - RNA, 15 nt, Human
gacaaaacuagagac

SEQ ID NO: 1324624 - RNA, 16 nt, Human
gacaaaauguuauuuc

SEQ ID NO: 1324625 - RNA, 12 nt, Human
gacaaaauguua

SEQ ID NO: 1324626 - RNA, 17 nt, Human
gacaaacaccucccagg

SEQ ID NO: 1324627 - RNA, 15 nt, Human
gaauuuuguugcugu

SEQ ID NO: 1324628 - RNA, 17 nt, Human
gaauuuuuaaacaagua

SEQ ID NO: 1324629 - RNA, 18 nt, Human
gaauuuuuaaacaaguau

SEQ ID NO: 1324630 - RNA, 21 nt, Human
gaauuuugcaaagauuuaauc

SEQ ID NO: 1324631 - RNA, 22 nt, Human
gaauuuugcaaagauuuaaucu

SEQ ID NO: 1324632 - RNA, 21 nt, Human
gaucucuucuuaauguacaua

SEQ ID NO: 1324633 - RNA, 19 nt, Human
gaucucuucuuaauguaca

SEQ ID NO: 1324634 - RNA, 17 nt, Human
gauccaguauaagacua

SEQ ID NO: 1324635 - RNA, 12 nt, Human
gauccaguuuug

SEQ ID NO: 1324636 - RNA, 12 nt, Human
gaucccaacacu

SEQ ID NO: 1324637 - RNA, 16 nt, Human
gaucccaacacugcca

SEQ ID NO: 1324638 - RNA, 14 nt, Human
gauccauguaacug

SEQ ID NO: 1324639 - RNA, 17 nt, Human
gauccauguaacugccu

SEQ ID NO: 1324640 - RNA, 14 nt, Human
gauccauuucuaau

SEQ ID NO: 1324641 - RNA, 16 nt, Human
gaucucccugagaugg

SEQ ID NO: 1324642 - RNA, 15 nt, Human
gaucucccugagaug

SEQ ID NO: 1324643 - RNA, 15 nt, Human
gauccauuucuaauu

SEQ ID NO: 1324644 - RNA, 21 nt, Human
gaucucauuggacccuuccau

SEQ ID NO: 1324645 - RNA, 23 nt, Human
gauccaggccggcuugccacacc

SEQ ID NO: 1324646 - RNA, 23 nt, Human
gauccaggagcuccaguguccug

SEQ ID NO: 1324647 - RNA, 13 nt, Human
gauccaggagcuc

SEQ ID NO: 1324648 - RNA, 15 nt, Human
gauccaggagcucca

SEQ ID NO: 1324649 - RNA, 16 nt, Human
gauccaggagcuccag

SEQ ID NO: 1324650 - RNA, 19 nt, Human
gauccaggagcuccagugu

SEQ ID NO: 1324651 - RNA, 13 nt, Human
gauccagccuggg

SEQ ID NO: 1324652 - RNA, 21 nt, Human
gauccagccuggggucuggag

SEQ ID NO: 1324653 - RNA, 12 nt, Human
gauccaggacua

SEQ ID NO: 1324654 - RNA, 12 nt, Human
gauccagggaca

SEQ ID NO: 1324655 - RNA, 13 nt, Human
gauccagggacag

SEQ ID NO: 1324656 - RNA, 14 nt, Human
gauccagggacaga

SEQ ID NO: 1324657 - RNA, 15 nt, Human
gauccagggacagag

SEQ ID NO: 1324658 - RNA, 18 nt, Human
gauccagggacagaggcc

SEQ ID NO: 1324659 - RNA, 22 nt, Human
gauccagggacagaggccccag

SEQ ID NO: 1324660 - RNA, 19 nt, Human
gauccagggaggcuggucc

SEQ ID NO: 1324661 - RNA, 20 nt, Human
gauccagggaggcugguccu

SEQ ID NO: 1324662 - RNA, 16 nt, Human
gauccaguauaagacu

SEQ ID NO: 1324663 - RNA, 17 nt, Human
gauauuuuuaucuuuau

SEQ ID NO: 1324664 - RNA, 18 nt, Human
gauauuuuuccauuuuuu

SEQ ID NO: 1324665 - RNA, 12 nt, Human
gaugcuggccca

SEQ ID NO: 1324666 - RNA, 13 nt, Human
gaugcuggcccag

SEQ ID NO: 1324667 - RNA, 14 nt, Human
gaugcuggcccagg

SEQ ID NO: 1324668 - RNA, 15 nt, Human
gaugcuggcccaggg

SEQ ID NO: 1324669 - RNA, 12 nt, Human
gaugagcuccca

SEQ ID NO: 1324670 - RNA, 13 nt, Human
gaugagcucccac

SEQ ID NO: 1324671 - RNA, 17 nt, Human
gauuagagccuguaaac

SEQ ID NO: 1324672 - RNA, 19 nt, Human
gauuagcuuugucacuguu

SEQ ID NO: 1324673 - RNA, 16 nt, Human
gauuaugggucacagg

SEQ ID NO: 1324674 - RNA, 17 nt, Human
gauuaugggucacagga

SEQ ID NO: 1324675 - RNA, 18 nt, Human
gauuaugggucacaggaa

SEQ ID NO: 1324676 - RNA, 19 nt, Human
gauuauguagcaaaauaca

SEQ ID NO: 1324677 - RNA, 19 nt, Human
gauuauuaacgauguccaa

SEQ ID NO: 1324678 - RNA, 22 nt, Human
gauuacaggugugagccaccac

SEQ ID NO: 1324679 - RNA, 20 nt, Human
gauuacaggugugagccacc

SEQ ID NO: 1324680 - RNA, 12 nt, Human
gaugugaagcca

SEQ ID NO: 1324681 - RNA, 13 nt, Human
gaugugaagccaa

SEQ ID NO: 1324682 - RNA, 14 nt, Human
gaugugaagccaau

SEQ ID NO: 1324683 - RNA, 23 nt, Human
gaugugaagccaauucagacagg

SEQ ID NO: 1324684 - RNA, 16 nt, Human
gaugcuggcccagggc

SEQ ID NO: 1324685 - RNA, 17 nt, Human
gaugcuggcccagggcc

SEQ ID NO: 1324686 - RNA, 19 nt, Human
gaugcuggcccagggccca

SEQ ID NO: 1324687 - RNA, 21 nt, Human
gaugcuggcccagggcccaga

SEQ ID NO: 1324688 - RNA, 22 nt, Human
gaugcuggcccagggcccagag

SEQ ID NO: 1324689 - RNA, 23 nt, Human
gaugcuggcccagggcccagagc

SEQ ID NO: 1324690 - RNA, 14 nt, Human
gauuagacagaaca

SEQ ID NO: 1324691 - RNA, 16 nt, Human
gauuagacagaacacc

SEQ ID NO: 1324692 - RNA, 19 nt, Human
gauuagacagaacaccuau

SEQ ID NO: 1324693 - RNA, 18 nt, Human
gauuagacuggacagcuu

SEQ ID NO: 1324694 - RNA, 19 nt, Human
gauuagacuggacagcuug

SEQ ID NO: 1324695 - RNA, 20 nt, Human
gauuagacuggacagcuugu

SEQ ID NO: 1324696 - RNA, 20 nt, Human
gauuagaaauuaccugugga

SEQ ID NO: 1324697 - RNA, 22 nt, Human
gauuagaaauuaccuguggaua

SEQ ID NO: 1324698 - RNA, 22 nt, Human
gauuacuggccuuuuucauuua

SEQ ID NO: 1324699 - RNA, 15 nt, Human
gauuagaaauuaccu

SEQ ID NO: 1324700 - RNA, 18 nt, Human
gauuacugccuauuuuaa

SEQ ID NO: 1324701 - RNA, 13 nt, Human
gauuaccuccuga

SEQ ID NO: 1324702 - RNA, 14 nt, Human
gauuaccuccugag

SEQ ID NO: 1324703 - RNA, 17 nt, Human
gauuaccuccugagaaa

SEQ ID NO: 1324704 - RNA, 14 nt, Human
gauuaccagggacu

SEQ ID NO: 1324705 - RNA, 14 nt, Human
gauuacauuuuaaa

SEQ ID NO: 1324706 - RNA, 22 nt, Human
gauucucuggcuguaaggcucu

SEQ ID NO: 1324707 - RNA, 23 nt, Human
gauucucuggcuguaaggcucua

SEQ ID NO: 1324708 - RNA, 15 nt, Human
gauucucugugucua

SEQ ID NO: 1324709 - RNA, 18 nt, Human
gauucucugugucuaaga

SEQ ID NO: 1324710 - RNA, 22 nt, Human
gauucucugugucuaagauucu

SEQ ID NO: 1324711 - RNA, 23 nt, Human
gauucucugugucuaagauucua

SEQ ID NO: 1324712 - RNA, 14 nt, Human
gauucucuugccuc

SEQ ID NO: 1324713 - RNA, 16 nt, Human
gauucucuugccucaa

SEQ ID NO: 1324714 - RNA, 15 nt, Human
gauucucuugccuca

SEQ ID NO: 1324715 - RNA, 17 nt, Human
gauacuugaaaauuaac

SEQ ID NO: 1324716 - RNA, 20 nt, Human
gauacuucgacacuguucuu

SEQ ID NO: 1324717 - RNA, 22 nt, Human
gauacuucgacacuguucuuag

SEQ ID NO: 1324718 - RNA, 23 nt, Human
gauacuucgacacuguucuuagc

SEQ ID NO: 1324719 - RNA, 17 nt, Human
gauaugcauauuuguuu

SEQ ID NO: 1324720 - RNA, 14 nt, Human
gauaugcguauuau

SEQ ID NO: 1324721 - RNA, 12 nt, Human
gauaugcuugua

SEQ ID NO: 1324722 - RNA, 22 nt, Human
gauaugcuuguaacuaaaauaa

SEQ ID NO: 1324723 - RNA, 16 nt, Human
gauacuugaaaauuaa

SEQ ID NO: 1324724 - RNA, 19 nt, Human
gauacuguugcacgugugu

SEQ ID NO: 1324725 - RNA, 21 nt, Human
gauacuguugcacguguguuu

SEQ ID NO: 1324726 - RNA, 19 nt, Human
gauacuucgacacuguucu

SEQ ID NO: 1324727 - RNA, 13 nt, Human
gauacuguugcac

SEQ ID NO: 1324728 - RNA, 14 nt, Human
gauacuguugcacg

SEQ ID NO: 1324729 - RNA, 15 nt, Human
gauacuguugcacgu

SEQ ID NO: 1324730 - RNA, 16 nt, Human
gauacuguugcacgug

SEQ ID NO: 1324731 - RNA, 17 nt, Human
gauacuguugcacgugu

SEQ ID NO: 1324732 - RNA, 18 nt, Human
gauacuguugcacgugug

SEQ ID NO: 1324733 - RNA, 20 nt, Human
gauacuuaagugcugcaauu

SEQ ID NO: 1324734 - RNA, 13 nt, Human
gauaugugaacag

SEQ ID NO: 1324735 - RNA, 14 nt, Human
gauaugugaacagu

SEQ ID NO: 1324736 - RNA, 16 nt, Human
gauauguaaaacauuu

SEQ ID NO: 1324737 - RNA, 17 nt, Human
gauauguaaaacauuua

SEQ ID NO: 1324738 - RNA, 19 nt, Human
gauauguaaaacauuuauu

SEQ ID NO: 1324739 - RNA, 18 nt, Human
gauauguaaaacauuuau

SEQ ID NO: 1324740 - RNA, 17 nt, Human
gauauguauggguaggg

SEQ ID NO: 1324741 - RNA, 18 nt, Human
gauauguauggguagggu

SEQ ID NO: 1324742 - RNA, 20 nt, Human
gauauguaccuaacgaagua

SEQ ID NO: 1324743 - RNA, 17 nt, Human
gauaugggacauuuuug

SEQ ID NO: 1324744 - RNA, 16 nt, Human
gauaugggacauuuuu

SEQ ID NO: 1324745 - RNA, 19 nt, Human
gauauuaaauuuuuuaaaa

SEQ ID NO: 1324746 - RNA, 17 nt, Human
gauauuaaugcccagac

SEQ ID NO: 1324747 - RNA, 12 nt, Human
gauauucuaaga

SEQ ID NO: 1324748 - RNA, 22 nt, Human
gauauuccuauugugcaaugua

SEQ ID NO: 1324749 - RNA, 13 nt, Human
gauauucuaagac

SEQ ID NO: 1324750 - RNA, 15 nt, Human
gauauuggaacuugc

SEQ ID NO: 1324751 - RNA, 19 nt, Human
gauaccaugcuguaaggau

SEQ ID NO: 1324752 - RNA, 13 nt, Human
gauaccccccucu

SEQ ID NO: 1324753 - RNA, 21 nt, Human
gauaccccccucugucuugug

SEQ ID NO: 1324754 - RNA, 16 nt, Human
gauacgacaguacacu

SEQ ID NO: 1324755 - RNA, 17 nt, Human
gauacgacaguacacug

SEQ ID NO: 1324756 - RNA, 13 nt, Human
gauacuaaggacg

SEQ ID NO: 1324757 - RNA, 22 nt, Human
gauacuaauaaacuaauaauug

SEQ ID NO: 1324758 - RNA, 16 nt, Human
gaguuuagcuggaaaa

SEQ ID NO: 1324759 - RNA, 14 nt, Human
gaguuuaggguggg

SEQ ID NO: 1324760 - RNA, 15 nt, Human
gaguuuagggugggg

SEQ ID NO: 1324761 - RNA, 15 nt, Human
gaguuguggguagug

SEQ ID NO: 1324762 - RNA, 20 nt, Human
gaguuuagggaacaauuugg

SEQ ID NO: 1324763 - RNA, 22 nt, Human
gaguuuagggaacaauuuggca

SEQ ID NO: 1324764 - RNA, 22 nt, Human
gaguuuauguuccauuaaacga

SEQ ID NO: 1324765 - RNA, 15 nt, Human
gaguuucauguacaa

SEQ ID NO: 1324766 - RNA, 18 nt, Human
gaguuucauguacaagau

SEQ ID NO: 1324767 - RNA, 18 nt, Human
gaguuuauguuccauuaa

SEQ ID NO: 1324768 - RNA, 17 nt, Human
gaguuuccuaugggaac

SEQ ID NO: 1324769 - RNA, 12 nt, Human
gaguuucuaagg

SEQ ID NO: 1324770 - RNA, 13 nt, Human
gaguuucuaaggu

SEQ ID NO: 1324771 - RNA, 16 nt, Human
gaguuucuaagguccg

SEQ ID NO: 1324772 - RNA, 17 nt, Human
gaguuugaugaggcccu

SEQ ID NO: 1324773 - RNA, 19 nt, Human
gagugcugaaggaauggaa

SEQ ID NO: 1324774 - RNA, 12 nt, Human
gagugcuguuuu

SEQ ID NO: 1324775 - RNA, 15 nt, Human
gagugcuguuuuguu

SEQ ID NO: 1324776 - RNA, 19 nt, Human
gagugcuugcuuuucaugc

SEQ ID NO: 1324777 - RNA, 18 nt, Human
gagugcggaccacccuca

SEQ ID NO: 1324778 - RNA, 15 nt, Human
gagugcguggugcga

SEQ ID NO: 1324779 - RNA, 17 nt, Human
gagugcaguccugauca

SEQ ID NO: 1324780 - RNA, 18 nt, Human
gagugcaguccugaucag

SEQ ID NO: 1324781 - RNA, 22 nt, Human
gagugcaguccugaucagagcc

SEQ ID NO: 1324782 - RNA, 18 nt, Human
gagugcuugcuuuucaug

SEQ ID NO: 1324783 - RNA, 22 nt, Human
gaguuuggagagagcagacugg

SEQ ID NO: 1324784 - RNA, 19 nt, Human
gaguuuggagagagcagac

SEQ ID NO: 1324785 - RNA, 17 nt, Human
gaguuugucgcucaugu

SEQ ID NO: 1324786 - RNA, 18 nt, Human
gaguuugucgcucaugug

SEQ ID NO: 1324787 - RNA, 22 nt, Human
gaguuugucgcucaugugugca

SEQ ID NO: 1324788 - RNA, 14 nt, Human
gaggucuguuccuu

SEQ ID NO: 1324789 - RNA, 16 nt, Human
gaggucuguuccuuuu

SEQ ID NO: 1324790 - RNA, 18 nt, Human
gaggugcacugggaggcu

SEQ ID NO: 1324791 - RNA, 16 nt, Human
gaggugcacugggagg

SEQ ID NO: 1324792 - RNA, 13 nt, Human
gaggugccugucc

SEQ ID NO: 1324793 - RNA, 15 nt, Human
gaggugccuguccca

SEQ ID NO: 1324794 - RNA, 21 nt, Human
gaggugccugucccaccccca

SEQ ID NO: 1324795 - RNA, 14 nt, Human
gaggugccacugga

SEQ ID NO: 1324796 - RNA, 13 nt, Human
gaggugccacugg

SEQ ID NO: 1324797 - RNA, 13 nt, Human
gaggugcccagga

SEQ ID NO: 1324798 - RNA, 14 nt, Human
gaggugcccaggag

SEQ ID NO: 1324799 - RNA, 15 nt, Human
gaggugcccaggaga

SEQ ID NO: 1324800 - RNA, 16 nt, Human
gaggugcccaggagaa

SEQ ID NO: 1324801 - RNA, 13 nt, Human
gagucaauacaua

SEQ ID NO: 1324802 - RNA, 14 nt, Human
gagucaaguuguuc

SEQ ID NO: 1324803 - RNA, 12 nt, Human
gagucacacagu

SEQ ID NO: 1324804 - RNA, 13 nt, Human
gaguccacuuugu

SEQ ID NO: 1324805 - RNA, 22 nt, Human
gaguccacuuuguuucgugggg

SEQ ID NO: 1324806 - RNA, 13 nt, Human
gaguccaucagcc

SEQ ID NO: 1324807 - RNA, 14 nt, Human
gaguccaucagccu

SEQ ID NO: 1324808 - RNA, 15 nt, Human
gaguccaucagccuc

SEQ ID NO: 1324809 - RNA, 16 nt, Human
gaguccaucagccucc

SEQ ID NO: 1324810 - RNA, 14 nt, Human
gagugcaguccuga

SEQ ID NO: 1324811 - RNA, 21 nt, Human
gcaaguccuaagccuguuagc

SEQ ID NO: 1324812 - RNA, 13 nt, Human
gcaagugaauuug

SEQ ID NO: 1324813 - RNA, 16 nt, Human
gcaauaaaucugaccc

SEQ ID NO: 1324814 - RNA, 18 nt, Human
gcaauaaaucugacccag

SEQ ID NO: 1324815 - RNA, 19 nt, Human
gcaauaaaucugacccagu

SEQ ID NO: 1324816 - RNA, 21 nt, Human
gcaauaaaucugacccagugc

SEQ ID NO: 1324817 - RNA, 21 nt, Human
gcaauaacguuuaagccaaaa

SEQ ID NO: 1324818 - RNA, 23 nt, Human
gauucugaccuuaaaugcaacca

SEQ ID NO: 1324819 - RNA, 20 nt, Human
gauucugaccuuaaaugcaa

SEQ ID NO: 1324820 - RNA, 21 nt, Human
gauucugaccuuaaaugcaac

SEQ ID NO: 1324821 - RNA, 21 nt, Human
gcacaaucucggcucacugca

SEQ ID NO: 1324822 - RNA, 22 nt, Human
gcacaaucucggcucacugcau

SEQ ID NO: 1324823 - RNA, 19 nt, Human
gcacaauguagauaagugu

SEQ ID NO: 1324824 - RNA, 21 nt, Human
gcacaguugaagggaggggcu

SEQ ID NO: 1324825 - RNA, 13 nt, Human
gcacaugacucgg

SEQ ID NO: 1324826 - RNA, 21 nt, Human
gcacaucuguaaaucuacaca

SEQ ID NO: 1324827 - RNA, 17 nt, Human
gcacaucugugucuugu

SEQ ID NO: 1324828 - RNA, 18 nt, Human
gcacaucugugucuuguu

SEQ ID NO: 1324829 - RNA, 16 nt, Human
gcacaugaacuuagau

SEQ ID NO: 1324830 - RNA, 22 nt, Human
gcacaucuguaaaucuacacac

SEQ ID NO: 1324831 - RNA, 14 nt, Human
gcaccgaagcccag

SEQ ID NO: 1324832 - RNA, 15 nt, Human
gcaccgaagcccaga

SEQ ID NO: 1324833 - RNA, 16 nt, Human
gcaccgaagcccagag

SEQ ID NO: 1324834 - RNA, 23 nt, Human
gcaccgaagcccagagggucugg

SEQ ID NO: 1324835 - RNA, 20 nt, Human
gcaccggggccugggcagga

SEQ ID NO: 1324836 - RNA, 14 nt, Human
gcaccguucugugc

SEQ ID NO: 1324837 - RNA, 15 nt, Human
gcaccguucugugca

SEQ ID NO: 1324838 - RNA, 14 nt, Human
gcaccuaaaacuua

SEQ ID NO: 1324839 - RNA, 17 nt, Human
gcaccuaaagaaaaaca

SEQ ID NO: 1324840 - RNA, 14 nt, Human
gcaccuaaagaaaa

SEQ ID NO: 1324841 - RNA, 15 nt, Human
gcaccuaauccaggc

SEQ ID NO: 1324842 - RNA, 16 nt, Human
gcaccuaauccaggca

SEQ ID NO: 1324843 - RNA, 21 nt, Human
gcacugaauaaauuguacagc

SEQ ID NO: 1324844 - RNA, 22 nt, Human
gcacugaauaaauuguacagcc

SEQ ID NO: 1324845 - RNA, 20 nt, Human
gcagaaagcaucccucaccc

SEQ ID NO: 1324846 - RNA, 13 nt, Human
gcagaaagugccu

SEQ ID NO: 1324847 - RNA, 14 nt, Human
gcagaaagugccuu

SEQ ID NO: 1324848 - RNA, 19 nt, Human
gcagaaagugccuuucagg

SEQ ID NO: 1324849 - RNA, 23 nt, Human
gcagaaagugccuuucaggaucu

SEQ ID NO: 1324850 - RNA, 20 nt, Human
gcagaaagugccuuucagga

SEQ ID NO: 1324851 - RNA, 16 nt, Human
gcagaaauccaagcac

SEQ ID NO: 1324852 - RNA, 20 nt, Human
gcacuuuagaauaugccuug

SEQ ID NO: 1324853 - RNA, 19 nt, Human
gcacuuuagaauaugccuu

SEQ ID NO: 1324854 - RNA, 18 nt, Human
gcacuuuagaauaugccu

SEQ ID NO: 1324855 - RNA, 12 nt, Human
gcacuuuauccu

SEQ ID NO: 1324856 - RNA, 19 nt, Human
gcacugacggacucaugau

SEQ ID NO: 1324857 - RNA, 20 nt, Human
gcacugacugggaccaggca

SEQ ID NO: 1324858 - RNA, 22 nt, Human
gcacuuggggguucaggcccgg

SEQ ID NO: 1324859 - RNA, 16 nt, Human
gcacuuguccagcuga

SEQ ID NO: 1324860 - RNA, 15 nt, Human
gcagagccaggaaga

SEQ ID NO: 1324861 - RNA, 14 nt, Human
gcagagccaggaag

SEQ ID NO: 1324862 - RNA, 19 nt, Human
gcagagauuuucaacauuu

SEQ ID NO: 1324863 - RNA, 21 nt, Human
gcagagagguuugcaguccca

SEQ ID NO: 1324864 - RNA, 22 nt, Human
gcagagagguuugcagucccaa

SEQ ID NO: 1324865 - RNA, 15 nt, Human
gcagagaugccuccc

SEQ ID NO: 1324866 - RNA, 17 nt, Human
gcagagaugccucccug

SEQ ID NO: 1324867 - RNA, 16 nt, Human
gcagagaugccucccu

SEQ ID NO: 1324868 - RNA, 15 nt, Human
gcagaacaaaugaag

SEQ ID NO: 1324869 - RNA, 18 nt, Human
gcagaacacauuucaaau

SEQ ID NO: 1324870 - RNA, 14 nt, Human
gcagaacaaaugaa

SEQ ID NO: 1324871 - RNA, 16 nt, Human
gcagagccaggaagau

SEQ ID NO: 1324872 - RNA, 16 nt, Human
gcagagcccaagggaa

SEQ ID NO: 1324873 - RNA, 19 nt, Human
gcagagcugauggagaagg

SEQ ID NO: 1324874 - RNA, 18 nt, Human
gcagagcugauggagaag

SEQ ID NO: 1324875 - RNA, 12 nt, Human
gcagccacccug

SEQ ID NO: 1324876 - RNA, 14 nt, Human
gcagccacccugag

SEQ ID NO: 1324877 - RNA, 15 nt, Human
gcagccacccugagg

SEQ ID NO: 1324878 - RNA, 16 nt, Human
gcagccacccugagga

SEQ ID NO: 1324879 - RNA, 17 nt, Human
gcagccacccugaggag

SEQ ID NO: 1324880 - RNA, 20 nt, Human
gcagccacccugaggagucu

SEQ ID NO: 1324881 - RNA, 21 nt, Human
gcagccacccugaggagucug

SEQ ID NO: 1324882 - RNA, 19 nt, Human
gcagccagaccagcaggcu

SEQ ID NO: 1324883 - RNA, 13 nt, Human
gcagccagcaucu

SEQ ID NO: 1324884 - RNA, 14 nt, Human
gcagccagcaucug

SEQ ID NO: 1324885 - RNA, 15 nt, Human
gcagccagcaucugg

SEQ ID NO: 1324886 - RNA, 12 nt, Human
gcagcccagcca

SEQ ID NO: 1324887 - RNA, 12 nt, Human
gcagccccaggc

SEQ ID NO: 1324888 - RNA, 14 nt, Human
gcagcccaggaagu

SEQ ID NO: 1324889 - RNA, 14 nt, Human
gcagccccacccag

SEQ ID NO: 1324890 - RNA, 22 nt, Human
gcagccccacaccagggccagc

SEQ ID NO: 1324891 - RNA, 13 nt, Human
gcagcccagccag

SEQ ID NO: 1324892 - RNA, 14 nt, Human
gcagcccagccagc

SEQ ID NO: 1324893 - RNA, 16 nt, Human
gcagcccaggaagucu

SEQ ID NO: 1324894 - RNA, 22 nt, Human
gcauaacguauaaaagccuguu

SEQ ID NO: 1324895 - RNA, 13 nt, Human
gcaguuugcaaaa

SEQ ID NO: 1324896 - RNA, 12 nt, Human
gcaguuuuuuga

SEQ ID NO: 1324897 - RNA, 18 nt, Human
gcaguuuuuugaaaaugg

SEQ ID NO: 1324898 - RNA, 20 nt, Human
gcaguuuuuuuuuucuuguc

SEQ ID NO: 1324899 - RNA, 11 nt, Human
gcaguuuuuuu

SEQ ID NO: 1324900 - RNA, 14 nt, Human
gcauaaccugucuc

SEQ ID NO: 1324901 - RNA, 19 nt, Human
gcauaaccugucucaccug

SEQ ID NO: 1324902 - RNA, 17 nt, Human
gcaguuuuuuuuuucuu

SEQ ID NO: 1324903 - RNA, 19 nt, Human
gcagucauuauccagguaa

SEQ ID NO: 1324904 - RNA, 18 nt, Human
gcaguccacuucugacag

SEQ ID NO: 1324905 - RNA, 19 nt, Human
gcaguccacuucugacagc

SEQ ID NO: 1324906 - RNA, 20 nt, Human
gcaguccacuucugacagcc

SEQ ID NO: 1324907 - RNA, 21 nt, Human
gcaguccacuucugacagccu

SEQ ID NO: 1324908 - RNA, 23 nt, Human
gcaguccacuucugacagccuca

SEQ ID NO: 1324909 - RNA, 22 nt, Human
gcaguccacuucugacagccuc

SEQ ID NO: 1324910 - RNA, 16 nt, Human
gcagucccaagcggug

SEQ ID NO: 1324911 - RNA, 14 nt, Human
gcaguccccuuccc

SEQ ID NO: 1324912 - RNA, 21 nt, Human
gcaguccccuucccuccaaga

SEQ ID NO: 1324913 - RNA, 23 nt, Human
gcaguccccuucccuccaagaag

SEQ ID NO: 1324914 - RNA, 19 nt, Human
gcaguccugaucagagccg

SEQ ID NO: 1324915 - RNA, 18 nt, Human
gcaguccuggaagccagc

SEQ ID NO: 1324916 - RNA, 20 nt, Human
gcaguccuggaagccagcuu

SEQ ID NO: 1324917 - RNA, 14 nt, Human
gcaguccuuggccu

SEQ ID NO: 1324918 - RNA, 15 nt, Human
gcaguccuuggccug

SEQ ID NO: 1324919 - RNA, 18 nt, Human
gcaguccuuggccugcua

SEQ ID NO: 1324920 - RNA, 13 nt, Human
gcagucgugccug

SEQ ID NO: 1324921 - RNA, 15 nt, Human
gcagucgugccugug

SEQ ID NO: 1324922 - RNA, 16 nt, Human
gcagucgugccugugu

SEQ ID NO: 1324923 - RNA, 16 nt, Human
gcaguuuaucauucaa

SEQ ID NO: 1324924 - RNA, 20 nt, Human
gcaguuuaucauucaagugu

SEQ ID NO: 1324925 - RNA, 12 nt, Human
gcaguuugcaaa

SEQ ID NO: 1324926 - RNA, 16 nt, Human
gcaguuugcaaaaaau

SEQ ID NO: 1324927 - RNA, 23 nt, Human
gcauaccagguuuuacacuugca

SEQ ID NO: 1324928 - RNA, 20 nt, Human
gcauacccacacaaauaaca

SEQ ID NO: 1324929 - RNA, 18 nt, Human
gcauaccuccuauggguu

SEQ ID NO: 1324930 - RNA, 20 nt, Human
gcauacgagagcagaggucu

SEQ ID NO: 1324931 - RNA, 15 nt, Human
gcaggcuggcccugc

SEQ ID NO: 1324932 - RNA, 16 nt, Human
gcaggcuggcccugcc

SEQ ID NO: 1324933 - RNA, 17 nt, Human
gcaggcuggcccugccc

SEQ ID NO: 1324934 - RNA, 18 nt, Human
gcaggcuggcccugcccu

SEQ ID NO: 1324935 - RNA, 19 nt, Human
gcaggcuggcccugcccug

SEQ ID NO: 1324936 - RNA, 20 nt, Human
gcaggcuggcccugcccugg

SEQ ID NO: 1324937 - RNA, 21 nt, Human
gcaggcuggcccugcccuggu

SEQ ID NO: 1324938 - RNA, 17 nt, Human
gcaggcuggccuaugug

SEQ ID NO: 1324939 - RNA, 10 nt, Human
gcaggcuggg

SEQ ID NO: 1324940 - RNA, 11 nt, Human
gcaggcugggc

SEQ ID NO: 1324941 - RNA, 12 nt, Human
gcaggcugggcc

SEQ ID NO: 1324942 - RNA, 13 nt, Human
gcaggcugggcca

SEQ ID NO: 1324943 - RNA, 14 nt, Human
gcaggcugggccau

SEQ ID NO: 1324944 - RNA, 15 nt, Human
gcaggcugggccaug

SEQ ID NO: 1324945 - RNA, 23 nt, Human
gcaggcugggccauguccaaaga

SEQ ID NO: 1324946 - RNA, 21 nt, Human
gcagggaaaauuauuugcaua

SEQ ID NO: 1324947 - RNA, 19 nt, Human
gcagggagcggccggccag

SEQ ID NO: 1324948 - RNA, 16 nt, Human
gcagggagcugggcuu

SEQ ID NO: 1324949 - RNA, 17 nt, Human
gcagggagcugggcuuc

SEQ ID NO: 1324950 - RNA, 10 nt, Human
gcagggaggg

SEQ ID NO: 1324951 - RNA, 13 nt, Human
gcagggagggccu

SEQ ID NO: 1324952 - RNA, 13 nt, Human
gcagguucuuguu

SEQ ID NO: 1324953 - RNA, 17 nt, Human
gcagguucuuguuggug

SEQ ID NO: 1324954 - RNA, 22 nt, Human
gcagguucuuguuggugcacag

SEQ ID NO: 1324955 - RNA, 23 nt, Human
gcagguucuuguuggugcacagc

SEQ ID NO: 1324956 - RNA, 19 nt, Human
gcagguugauaaaucauuu

SEQ ID NO: 1324957 - RNA, 17 nt, Human
gcagguugauaaaucau

SEQ ID NO: 1324958 - RNA, 16 nt, Human
gcagguugauaaauca

SEQ ID NO: 1324959 - RNA, 22 nt, Human
gcaguaucggcacuguacaaaa

SEQ ID NO: 1324960 - RNA, 20 nt, Human
gcaguaucggcacuguacaa

SEQ ID NO: 1324961 - RNA, 21 nt, Human
gcaguaucaugcccugugcaa

SEQ ID NO: 1324962 - RNA, 15 nt, Human
gcaguaugaaaauaa

SEQ ID NO: 1324963 - RNA, 22 nt, Human
gcagucacucuagucaaugaca

SEQ ID NO: 1324964 - RNA, 21 nt, Human
gcaguagaggcuauggacagg

SEQ ID NO: 1324965 - RNA, 13 nt, Human
gcaguaauaaaaa

SEQ ID NO: 1324966 - RNA, 19 nt, Human
gcaguaccugggcaagcug

SEQ ID NO: 1324967 - RNA, 14 nt, Human
gcaguaccugaggg

SEQ ID NO: 1324968 - RNA, 15 nt, Human
gcaguaccugagggu

SEQ ID NO: 1324969 - RNA, 15 nt, Human
cugcuacaauguccu

SEQ ID NO: 1324970 - RNA, 20 nt, Human
cugcuacaccuauuauccca

SEQ ID NO: 1324971 - RNA, 23 nt, Human
cugcuacaccuauuaucccagcu

SEQ ID NO: 1324972 - RNA, 12 nt, Human
cugcuacagcaa

SEQ ID NO: 1324973 - RNA, 20 nt, Human
cugcuacagcaauuucuaau

SEQ ID NO: 1324974 - RNA, 13 nt, Human
cugcucagacaga

SEQ ID NO: 1324975 - RNA, 14 nt, Human
cugcucagcccugc

SEQ ID NO: 1324976 - RNA, 15 nt, Human
cugcucagcccugca

SEQ ID NO: 1324977 - RNA, 18 nt, Human
cugcucagcccugcacca

SEQ ID NO: 1324978 - RNA, 21 nt, Human
cugcucagcccugcaccaugc

SEQ ID NO: 1324979 - RNA, 13 nt, Human
cugcucagcucug

SEQ ID NO: 1324980 - RNA, 14 nt, Human
cugcucagcucugg

SEQ ID NO: 1324981 - RNA, 16 nt, Human
cugcucagcucugggc

SEQ ID NO: 1324982 - RNA, 22 nt, Human
cugcucagcucugggccauucu

SEQ ID NO: 1324983 - RNA, 15 nt, Human
cugcuaauauuuucc

SEQ ID NO: 1324984 - RNA, 16 nt, Human
cugcuaauauuuuccu

SEQ ID NO: 1324985 - RNA, 24 nt, Human
cugcuaauauuuuccuccugagug

SEQ ID NO: 1324986 - RNA, 23 nt, Human
cugcuaauauuuuccuccugagu

SEQ ID NO: 1324987 - RNA, 20 nt, Human
cugccugguauauccaaaag

SEQ ID NO: 1324988 - RNA, 14 nt, Human
cugccuguggccau

SEQ ID NO: 1324989 - RNA, 21 nt, Human
cugccuguggccaugacccug

SEQ ID NO: 1324990 - RNA, 12 nt, Human
cugccuguggcg

SEQ ID NO: 1324991 - RNA, 22 nt, Human
cugccuguggcgccgucuccag

SEQ ID NO: 1324992 - RNA, 23 nt, Human
cugccuguggcgccgucuccagg

SEQ ID NO: 1324993 - RNA, 23 nt, Human
cugccuguggccaugacccugcc

SEQ ID NO: 1324994 - RNA, 13 nt, Human
cuggacugugugc

SEQ ID NO: 1324995 - RNA, 18 nt, Human
cuggacugucauagaaau

SEQ ID NO: 1324996 - RNA, 16 nt, Human
cuggaacugucucuca

SEQ ID NO: 1324997 - RNA, 18 nt, Human
cuggaacugucucucaug

SEQ ID NO: 1324998 - RNA, 19 nt, Human
cuggaacugucucucauga

SEQ ID NO: 1324999 - RNA, 16 nt, Human
cuggaacuugaacuga

SEQ ID NO: 1325000 - RNA, 19 nt, Human
cuggaacuugaacugauuc

SEQ ID NO: 1325001 - RNA, 20 nt, Human
cuggaacuugaacugauuca

SEQ ID NO: 1325002 - RNA, 14 nt, Human
cuggaacccagacu

SEQ ID NO: 1325003 - RNA, 16 nt, Human
cuggaacccagacuca

SEQ ID NO: 1325004 - RNA, 18 nt, Human
cuggaacccagacucaga

SEQ ID NO: 1325005 - RNA, 19 nt, Human
cuggaacccagacucagac

SEQ ID NO: 1325006 - RNA, 22 nt, Human
cuggaacccagacucagacauu

SEQ ID NO: 1325007 - RNA, 12 nt, Human
cuggaaccucag

SEQ ID NO: 1325008 - RNA, 15 nt, Human
cuggaaccucagccu

SEQ ID NO: 1325009 - RNA, 16 nt, Human
cuggaaccucagccug

SEQ ID NO: 1325010 - RNA, 17 nt, Human
cuggaaccucagccugg

SEQ ID NO: 1325011 - RNA, 18 nt, Human
cuggaaccucagccuggc

SEQ ID NO: 1325012 - RNA, 20 nt, Human
cuggaaccucagccuggcca

SEQ ID NO: 1325013 - RNA, 22 nt, Human
cuggaaccucagccuggccaga

SEQ ID NO: 1325014 - RNA, 23 nt, Human
cuggaaccucagccuggccagac

SEQ ID NO: 1325015 - RNA, 16 nt, Human
cuggaaccaucagaaa

SEQ ID NO: 1325016 - RNA, 13 nt, Human
cuggaacccagac

SEQ ID NO: 1325017 - RNA, 15 nt, Human
cuggaaccaucagaa

SEQ ID NO: 1325018 - RNA, 21 nt, Human
cuggaacacuagacaagccag

SEQ ID NO: 1325019 - RNA, 22 nt, Human
cuggaacacuagacaagccaga

SEQ ID NO: 1325020 - RNA, 23 nt, Human
cuggaacacuagacaagccagaa

SEQ ID NO: 1325021 - RNA, 21 nt, Human
cugcuguuccagugguaagcu

SEQ ID NO: 1325022 - RNA, 20 nt, Human
cuggaacacuagacaagcca

SEQ ID NO: 1325023 - RNA, 21 nt, Human
cuggaaaucaggguuaguauu

SEQ ID NO: 1325024 - RNA, 18 nt, Human
cugcuuuuuauggccugu

SEQ ID NO: 1325025 - RNA, 22 nt, Human
cugcuuuuuccaacucagaaau

SEQ ID NO: 1325026 - RNA, 17 nt, Human
cugcuuuuuauggccug

SEQ ID NO: 1325027 - RNA, 21 nt, Human
cugcuguuugacaccucuuuu

SEQ ID NO: 1325028 - RNA, 22 nt, Human
cugcugugugcuuuuuuugugu

SEQ ID NO: 1325029 - RNA, 23 nt, Human
cugcugugugcuuuuuuugugug

SEQ ID NO: 1325030 - RNA, 20 nt, Human
cugcuguuauauuucaucau

SEQ ID NO: 1325031 - RNA, 15 nt, Human
cugcuguuccagugg

SEQ ID NO: 1325032 - RNA, 16 nt, Human
cugcccccucugcccu

SEQ ID NO: 1325033 - RNA, 17 nt, Human
cugcccccucugcccug

SEQ ID NO: 1325034 - RNA, 18 nt, Human
cugcccccucugcccugc

SEQ ID NO: 1325035 - RNA, 19 nt, Human
cugcccccucugcccugcg

SEQ ID NO: 1325036 - RNA, 17 nt, Human
cugcccuggugcugcca

SEQ ID NO: 1325037 - RNA, 18 nt, Human
cugcccuggugcugccac

SEQ ID NO: 1325038 - RNA, 19 nt, Human
cugcccuggugcugccaca

SEQ ID NO: 1325039 - RNA, 13 nt, Human
cugcccuguaccc

SEQ ID NO: 1325040 - RNA, 21 nt, Human
cugcccuguaccccagcacuu

SEQ ID NO: 1325041 - RNA, 20 nt, Human
cugcccuggugcugccacac

SEQ ID NO: 1325042 - RNA, 21 nt, Human
cugcccuggugcugccacacu

SEQ ID NO: 1325043 - RNA, 22 nt, Human
cugcccugguuuccugcccugg

SEQ ID NO: 1325044 - RNA, 23 nt, Human
cugcccugguuuccugcccuggg

SEQ ID NO: 1325045 - RNA, 12 nt, Human
cugccccaggcc

SEQ ID NO: 1325046 - RNA, 19 nt, Human
cugccccagggcucccggc

SEQ ID NO: 1325047 - RNA, 13 nt, Human
cugccccaggccu

SEQ ID NO: 1325048 - RNA, 14 nt, Human
cugccccaggccug

SEQ ID NO: 1325049 - RNA, 15 nt, Human
cugccccaggccuga

SEQ ID NO: 1325050 - RNA, 14 nt, Human
cugcccccucugcc

SEQ ID NO: 1325051 - RNA, 15 nt, Human
cugcccccucugccc

SEQ ID NO: 1325052 - RNA, 17 nt, Human
cugccaagacugcugug

SEQ ID NO: 1325053 - RNA, 21 nt, Human
cugccaagacugcuguggcca

SEQ ID NO: 1325054 - RNA, 13 nt, Human
cugccaagccaug

SEQ ID NO: 1325055 - RNA, 20 nt, Human
cugccaagacugcuguggcc

SEQ ID NO: 1325056 - RNA, 12 nt, Human
cugccaagccau

SEQ ID NO: 1325057 - RNA, 14 nt, Human
cugcauuugugaaa

SEQ ID NO: 1325058 - RNA, 15 nt, Human
cugcauuugugaaau

SEQ ID NO: 1325059 - RNA, 17 nt, Human
cugcauuugugaaauga

SEQ ID NO: 1325060 - RNA, 22 nt, Human
cugcauuugugaaaugauggug

SEQ ID NO: 1325061 - RNA, 12 nt, Human
cugcauuuuuca

SEQ ID NO: 1325062 - RNA, 14 nt, Human
cugccaaaggaugu

SEQ ID NO: 1325063 - RNA, 16 nt, Human
cugccaaaggauguga

SEQ ID NO: 1325064 - RNA, 18 nt, Human
cugccaaaggaugugaua

SEQ ID NO: 1325065 - RNA, 19 nt, Human
cugccaaaggaugugauau

SEQ ID NO: 1325066 - RNA, 22 nt, Human
cugccaaaggaugugauauaua

SEQ ID NO: 1325067 - RNA, 22 nt, Human
cugccaaccuaaaacucuuucg

SEQ ID NO: 1325068 - RNA, 16 nt, Human
cugccaaccuaaaacu

SEQ ID NO: 1325069 - RNA, 23 nt, Human
cugcauugagcuugcaugcuugc

SEQ ID NO: 1325070 - RNA, 15 nt, Human
cugcauuggaacugg

SEQ ID NO: 1325071 - RNA, 16 nt, Human
cugcauuggaacugga

SEQ ID NO: 1325072 - RNA, 19 nt, Human
cugcauuggaacuggaggc

SEQ ID NO: 1325073 - RNA, 17 nt, Human
cugcauugaaaagagcu

SEQ ID NO: 1325074 - RNA, 18 nt, Human
cugcauugaaaagagcug

SEQ ID NO: 1325075 - RNA, 22 nt, Human
cugcauugaaaagagcugaagg

SEQ ID NO: 1325076 - RNA, 19 nt, Human
cugcauugaaaagagcuga

SEQ ID NO: 1325077 - RNA, 17 nt, Human
cugcauugagcuugcau

SEQ ID NO: 1325078 - RNA, 20 nt, Human
cugcauucaggaucaaaccc

SEQ ID NO: 1325079 - RNA, 12 nt, Human
cugcauuccgca

SEQ ID NO: 1325080 - RNA, 13 nt, Human
cugcauuccgcag

SEQ ID NO: 1325081 - RNA, 21 nt, Human
cugcauucugccucucuagga

SEQ ID NO: 1325082 - RNA, 18 nt, Human
cugcauucuucugagcac

SEQ ID NO: 1325083 - RNA, 22 nt, Human
cugcauucuucugagcacuguu

SEQ ID NO: 1325084 - RNA, 13 nt, Human
cugcauuugugaa

SEQ ID NO: 1325085 - RNA, 21 nt, Human
cugcauuggaacuggaggcag

SEQ ID NO: 1325086 - RNA, 22 nt, Human
cugcauuggaacuggaggcagg

SEQ ID NO: 1325087 - RNA, 23 nt, Human
cugcauuggaacuggaggcaggg

SEQ ID NO: 1325088 - RNA, 24 nt, Human
cugcauuauuugagaagcugcuca

SEQ ID NO: 1325089 - RNA, 17 nt, Human
cugcauuauuugagaag

SEQ ID NO: 1325090 - RNA, 23 nt, Human
cugcauuauuggaauauaauugu

SEQ ID NO: 1325091 - RNA, 15 nt, Human
cugagacuccagacc

SEQ ID NO: 1325092 - RNA, 16 nt, Human
cugagacuccagaccu

SEQ ID NO: 1325093 - RNA, 18 nt, Human
cugagacuccagaccuga

SEQ ID NO: 1325094 - RNA, 14 nt, Human
cugugaaggacccu

SEQ ID NO: 1325095 - RNA, 17 nt, Human
cugugaagugagaccuu

SEQ ID NO: 1325096 - RNA, 22 nt, Human
cugugaagugagaccuuccuuu

SEQ ID NO: 1325097 - RNA, 21 nt, Human
cugugagaugcuagaacuccc

SEQ ID NO: 1325098 - RNA, 16 nt, Human
cugugagaugcuagaa

SEQ ID NO: 1325099 - RNA, 16 nt, Human
cugucgcccaggcugg

SEQ ID NO: 1325100 - RNA, 15 nt, Human
cugucgauuagacug

SEQ ID NO: 1325101 - RNA, 17 nt, Human
cugucgauuagacugga

SEQ ID NO: 1325102 - RNA, 19 nt, Human
cuguccuuuuuccucucca

SEQ ID NO: 1325103 - RNA, 20 nt, Human
cuguccuuuuuccucuccac

SEQ ID NO: 1325104 - RNA, 18 nt, Human
cuguccuuuuuccucucc

SEQ ID NO: 1325105 - RNA, 19 nt, Human
cugucgauuagacuggaca

SEQ ID NO: 1325106 - RNA, 20 nt, Human
cugucgauuagacuggacag

SEQ ID NO: 1325107 - RNA, 23 nt, Human
cugucgauuagacuggacagcuu

SEQ ID NO: 1325108 - RNA, 23 nt, Human
cuguacuugcucuugaugccugg

SEQ ID NO: 1325109 - RNA, 22 nt, Human
cuguacuugcucuugaugccug

SEQ ID NO: 1325110 - RNA, 21 nt, Human
cuguaaaaugugggauuaugg

SEQ ID NO: 1325111 - RNA, 20 nt, Human
cuguaaaccucucgagggca

SEQ ID NO: 1325112 - RNA, 17 nt, Human
cuguaaaauaaaagguc

SEQ ID NO: 1325113 - RNA, 13 nt, Human
cuguaaaacuaag

SEQ ID NO: 1325114 - RNA, 15 nt, Human
cuguaaaacagguua

SEQ ID NO: 1325115 - RNA, 15 nt, Human
cuguaaaauguggga

SEQ ID NO: 1325116 - RNA, 15 nt, Human
cuguaaacacagaca

SEQ ID NO: 1325117 - RNA, 22 nt, Human
cugucacccagguuggagugca

SEQ ID NO: 1325118 - RNA, 23 nt, Human
cugucaccacccugcucauccac

SEQ ID NO: 1325119 - RNA, 21 nt, Human
cuguagggagggcggcagggg

SEQ ID NO: 1325120 - RNA, 16 nt, Human
cugucaccacccugcu

SEQ ID NO: 1325121 - RNA, 18 nt, Human
cugucaccacccugcuca

SEQ ID NO: 1325122 - RNA, 12 nt, Human
cuguaggccuca

SEQ ID NO: 1325123 - RNA, 13 nt, Human
cuguaggccucag

SEQ ID NO: 1325124 - RNA, 22 nt, Human
cuguaggccucaggugaaacuc

SEQ ID NO: 1325125 - RNA, 20 nt, Human
cuguagggagggcggcaggg

SEQ ID NO: 1325126 - RNA, 15 nt, Human
cuguccugaaggccu

SEQ ID NO: 1325127 - RNA, 16 nt, Human
cuguccugaaggccug

SEQ ID NO: 1325128 - RNA, 19 nt, Human
cuguccugaaggccugagg

SEQ ID NO: 1325129 - RNA, 20 nt, Human
cuguccugaaggccugaggu

SEQ ID NO: 1325130 - RNA, 12 nt, Human
cuguccugccua

SEQ ID NO: 1325131 - RNA, 13 nt, Human
cuguccugccugu

SEQ ID NO: 1325132 - RNA, 17 nt, Human
cuguccugccuguggcc

SEQ ID NO: 1325133 - RNA, 18 nt, Human
cuguccugccuguggcca

SEQ ID NO: 1325134 - RNA, 17 nt, Human
cuguccugccacccagc

SEQ ID NO: 1325135 - RNA, 22 nt, Human
cuguccugccacccagccccag

SEQ ID NO: 1325136 - RNA, 23 nt, Human
cuguccugccacccagccccagc

SEQ ID NO: 1325137 - RNA, 11 nt, Human
cuguccugccu

SEQ ID NO: 1325138 - RNA, 12 nt, Human
cugucagcugca

SEQ ID NO: 1325139 - RNA, 21 nt, Human
cugucagauccaggagcucca

SEQ ID NO: 1325140 - RNA, 22 nt, Human
cugucagauccaggagcuccag

SEQ ID NO: 1325141 - RNA, 23 nt, Human
cugucagauccaggagcuccagu

SEQ ID NO: 1325142 - RNA, 12 nt, Human
cugucagcauga

SEQ ID NO: 1325143 - RNA, 14 nt, Human
cugucagcaugaau

SEQ ID NO: 1325144 - RNA, 15 nt, Human
cugucagcaugaauu

SEQ ID NO: 1325145 - RNA, 16 nt, Human
cugucagcaugaauuu

SEQ ID NO: 1325146 - RNA, 22 nt, Human
cugucagcaugaauuuguaaug

SEQ ID NO: 1325147 - RNA, 13 nt, Human
cugucagauccag

SEQ ID NO: 1325148 - RNA, 18 nt, Human
cugucagauccaggagcu

SEQ ID NO: 1325149 - RNA, 19 nt, Human
cugucagauccaggagcuc

SEQ ID NO: 1325150 - RNA, 24 nt, Human
cugucagauccaggagcuccagug

SEQ ID NO: 1325151 - RNA, 18 nt, Human
cugguuuccugcccuggg

SEQ ID NO: 1325152 - RNA, 21 nt, Human
cugguuuccugcccugggagg

SEQ ID NO: 1325153 - RNA, 22 nt, Human
cugguuuccugcccugggaggc

SEQ ID NO: 1325154 - RNA, 17 nt, Human
cugguuugaagaauguu

SEQ ID NO: 1325155 - RNA, 16 nt, Human
cugggaccgcuacacc

SEQ ID NO: 1325156 - RNA, 17 nt, Human
cugggaccgcuacacca

SEQ ID NO: 1325157 - RNA, 20 nt, Human
cugggaccgcuacaccacuc

SEQ ID NO: 1325158 - RNA, 22 nt, Human
cugggaccgcuacaccacucug

SEQ ID NO: 1325159 - RNA, 23 nt, Human
cugggaccgcuacaccacucugg

SEQ ID NO: 1325160 - RNA, 24 nt, Human
cugggaccgcuacaccacucuggc

SEQ ID NO: 1325161 - RNA, 15 nt, Human
cugggacguggcuca

SEQ ID NO: 1325162 - RNA, 16 nt, Human
cugggacguggcucag

SEQ ID NO: 1325163 - RNA, 17 nt, Human
cugggacguggcucagc

SEQ ID NO: 1325164 - RNA, 18 nt, Human
cugggacguggcucagcc

SEQ ID NO: 1325165 - RNA, 10 nt, Human
cugggacagg

SEQ ID NO: 1325166 - RNA, 18 nt, Human
cuggcucccacaggcccu

SEQ ID NO: 1325167 - RNA, 18 nt, Human
cugggaccaggcaccagg

SEQ ID NO: 1325168 - RNA, 15 nt, Human
cuggcucccacaggc

SEQ ID NO: 1325169 - RNA, 13 nt, Human
cuggcuccagcug

SEQ ID NO: 1325170 - RNA, 14 nt, Human
cuggcuccagcugg

SEQ ID NO: 1325171 - RNA, 18 nt, Human
cuggcuccagcuggccgg

SEQ ID NO: 1325172 - RNA, 20 nt, Human
cuggcuccagcuggccggga

SEQ ID NO: 1325173 - RNA, 14 nt, Human
cuggcuccagaugc

SEQ ID NO: 1325174 - RNA, 20 nt, Human
cuggcuccagaugcagggca

SEQ ID NO: 1325175 - RNA, 21 nt, Human
cuggcuccagaugcagggcag

SEQ ID NO: 1325176 - RNA, 19 nt, Human
cuggacugucauagaaauu

SEQ ID NO: 1325177 - RNA, 20 nt, Human
cuggacugucauagaaauua

SEQ ID NO: 1325178 - RNA, 16 nt, Human
cuggacugugugcuca

SEQ ID NO: 1325179 - RNA, 15 nt, Human
cuggagaccaccagg

SEQ ID NO: 1325180 - RNA, 19 nt, Human
cuggagaccaccagggcau

SEQ ID NO: 1325181 - RNA, 22 nt, Human
cuggagaccaccagggcaucuc

SEQ ID NO: 1325182 - RNA, 20 nt, Human
cuggagacugugugugcccu

SEQ ID NO: 1325183 - RNA, 22 nt, Human
cuggagacugugugugcccucu

SEQ ID NO: 1325184 - RNA, 23 nt, Human
cuggagacugugugugcccucug

SEQ ID NO: 1325185 - RNA, 15 nt, Human
cuggagacuuagggc

SEQ ID NO: 1325186 - RNA, 12 nt, Human
cuggcagcucug

SEQ ID NO: 1325187 - RNA, 17 nt, Human
cuggcagcucuggacag

SEQ ID NO: 1325188 - RNA, 18 nt, Human
cuggcagcucuggacagc

SEQ ID NO: 1325189 - RNA, 20 nt, Human
cuggcagcucuggacagccc

SEQ ID NO: 1325190 - RNA, 21 nt, Human
cuggcagcucuggacagcccc

SEQ ID NO: 1325191 - RNA, 24 nt, Human
cuggcaggcaggcucccagggaca

SEQ ID NO: 1325192 - RNA, 18 nt, Human
cuggcaggcaggcuccca

SEQ ID NO: 1325193 - RNA, 14 nt, Human
cuggggaagacagu

SEQ ID NO: 1325194 - RNA, 15 nt, Human
cuggggaagacagug

SEQ ID NO: 1325195 - RNA, 16 nt, Human
cuggggaagacagugg

SEQ ID NO: 1325196 - RNA, 17 nt, Human
cuggggaagacaguggc

SEQ ID NO: 1325197 - RNA, 18 nt, Human
cuggggaagacaguggcc

SEQ ID NO: 1325198 - RNA, 13 nt, Human
cugggcagaccuu

SEQ ID NO: 1325199 - RNA, 15 nt, Human
cuggggaaccugacc

SEQ ID NO: 1325200 - RNA, 16 nt, Human
cuggggaaccugaccc

SEQ ID NO: 1325201 - RNA, 17 nt, Human
cuggggaaccugacccc

SEQ ID NO: 1325202 - RNA, 19 nt, Human
cuggugcacuggccccacc

SEQ ID NO: 1325203 - RNA, 16 nt, Human
cuggugcacuggcccc

SEQ ID NO: 1325204 - RNA, 23 nt, Human
cuggugcaaguugaggacuucuu

SEQ ID NO: 1325205 - RNA, 14 nt, Human
cuggugagccaagc

SEQ ID NO: 1325206 - RNA, 24 nt, Human
cuggugagucaccacuucagggcu

SEQ ID NO: 1325207 - RNA, 21 nt, Human
cuggugaucacguggucacgg

SEQ ID NO: 1325208 - RNA, 22 nt, Human
cuggguuccagcaauucuccug

SEQ ID NO: 1325209 - RNA, 18 nt, Human
cuggguuccuuccucuga

SEQ ID NO: 1325210 - RNA, 22 nt, Human
cuggguuccuuccucugagccu

SEQ ID NO: 1325211 - RNA, 23 nt, Human
cuggguuccuuccucugagccuu

SEQ ID NO: 1325212 - RNA, 23 nt, Human
cuuauuguagcauccuggaauau

SEQ ID NO: 1325213 - RNA, 15 nt, Human
cuuauuggaacucug

SEQ ID NO: 1325214 - RNA, 17 nt, Human
cuuauuggaacucugcu

SEQ ID NO: 1325215 - RNA, 18 nt, Human
cuuauuggaacucugcuu

SEQ ID NO: 1325216 - RNA, 20 nt, Human
cuuauuguagcauccuggaa

SEQ ID NO: 1325217 - RNA, 16 nt, Human
cuuauuauuuuugaga

SEQ ID NO: 1325218 - RNA, 19 nt, Human
cuuauucagcaccaagcau

SEQ ID NO: 1325219 - RNA, 14 nt, Human
cuuauucauuuucu

SEQ ID NO: 1325220 - RNA, 16 nt, Human
cuuauucauuuucucu

SEQ ID NO: 1325221 - RNA, 17 nt, Human
cuuauucauuuucucua

SEQ ID NO: 1325222 - RNA, 18 nt, Human
cuuauucauuuucucuaa

SEQ ID NO: 1325223 - RNA, 14 nt, Human
cuuauuauuuuuga

SEQ ID NO: 1325224 - RNA, 20 nt, Human
cuuauuagagugucuuucca

SEQ ID NO: 1325225 - RNA, 21 nt, Human
cuuauuagagugucuuuccac

SEQ ID NO: 1325226 - RNA, 15 nt, Human
cuuauucccuuccug

SEQ ID NO: 1325227 - RNA, 19 nt, Human
cuuauucauuuucucuaau

SEQ ID NO: 1325228 - RNA, 14 nt, Human
cuuauuccaugacu

SEQ ID NO: 1325229 - RNA, 17 nt, Human
cuuauuccaugacugcu

SEQ ID NO: 1325230 - RNA, 18 nt, Human
cuuauuccaugacugcuu

SEQ ID NO: 1325231 - RNA, 19 nt, Human
cuuauuccaugacugcuug

SEQ ID NO: 1325232 - RNA, 14 nt, Human
cuuauucccuuccu

SEQ ID NO: 1325233 - RNA, 14 nt, Human
cuuaugcuuaaauu

SEQ ID NO: 1325234 - RNA, 18 nt, Human
cuuaugcuguacccaguu

SEQ ID NO: 1325235 - RNA, 15 nt, Human
cuuaugcucuuaauu

SEQ ID NO: 1325236 - RNA, 19 nt, Human
cuuaugcucuuaauugcca

SEQ ID NO: 1325237 - RNA, 22 nt, Human
cuuaugcucuuaauugccaccu

SEQ ID NO: 1325238 - RNA, 15 nt, Human
cuuaugcugauuuau

SEQ ID NO: 1325239 - RNA, 16 nt, Human
cuuaugcgguuaauuu

SEQ ID NO: 1325240 - RNA, 17 nt, Human
cuuaugcgguuaauuuu

SEQ ID NO: 1325241 - RNA, 18 nt, Human
cuuaugcgguuaauuuug

SEQ ID NO: 1325242 - RNA, 12 nt, Human
cuuaugcucuua

SEQ ID NO: 1325243 - RNA, 11 nt, Human
cuuccauaauc

SEQ ID NO: 1325244 - RNA, 21 nt, Human
cuuccauaaucuggacuccuc

SEQ ID NO: 1325245 - RNA, 14 nt, Human
cuuccaguuugcuu

SEQ ID NO: 1325246 - RNA, 17 nt, Human
cuuccaguuugcuuugc

SEQ ID NO: 1325247 - RNA, 21 nt, Human
cuuccaguuugcuuugcccuu

SEQ ID NO: 1325248 - RNA, 15 nt, Human
cuucacuguaaaaua

SEQ ID NO: 1325249 - RNA, 19 nt, Human
cuucacucuucaaaugccu

SEQ ID NO: 1325250 - RNA, 12 nt, Human
cuucacugucac

SEQ ID NO: 1325251 - RNA, 15 nt, Human
cuucauaacaauuuu

SEQ ID NO: 1325252 - RNA, 19 nt, Human
cuucauaacaauuuuagga

SEQ ID NO: 1325253 - RNA, 13 nt, Human
cuucaguugucuc

SEQ ID NO: 1325254 - RNA, 14 nt, Human
cuucaguugucucu

SEQ ID NO: 1325255 - RNA, 15 nt, Human
cuucaguugucucug

SEQ ID NO: 1325256 - RNA, 17 nt, Human
cuucaguugucucugau

SEQ ID NO: 1325257 - RNA, 23 nt, Human
cuucaguugucucugaugcagcu

SEQ ID NO: 1325258 - RNA, 20 nt, Human
cuucaguugucucugaugca

SEQ ID NO: 1325259 - RNA, 15 nt, Human
cuucaguuucacaga

SEQ ID NO: 1325260 - RNA, 17 nt, Human
cuucaguuucacagaaa

SEQ ID NO: 1325261 - RNA, 20 nt, Human
cuucaguuucacagaaaaua

SEQ ID NO: 1325262 - RNA, 19 nt, Human
cuucaucuggauuccagag

SEQ ID NO: 1325263 - RNA, 13 nt, Human
cuucaucuggcaa

SEQ ID NO: 1325264 - RNA, 14 nt, Human
cuucaucuggcaac

SEQ ID NO: 1325265 - RNA, 19 nt, Human
cuucaucuggcaacaucuu

SEQ ID NO: 1325266 - RNA, 23 nt, Human
cuucaucuggcaacaucuuuauc

SEQ ID NO: 1325267 - RNA, 15 nt, Human
cuucaucuggaacca

SEQ ID NO: 1325268 - RNA, 13 nt, Human
cuucaucuggaac

SEQ ID NO: 1325269 - RNA, 12 nt, Human
cuucaucuggaa

SEQ ID NO: 1325270 - RNA, 11 nt, Human
cuucaucugga

SEQ ID NO: 1325271 - RNA, 12 nt, Human
cuucauaaucca

SEQ ID NO: 1325272 - RNA, 13 nt, Human
cuucauacuugaa

SEQ ID NO: 1325273 - RNA, 16 nt, Human
cuucauacuugaacgu

SEQ ID NO: 1325274 - RNA, 23 nt, Human
cuucauacuugaacguuuucuaa

SEQ ID NO: 1325275 - RNA, 19 nt, Human
cuucauagagacuugggaa

SEQ ID NO: 1325276 - RNA, 16 nt, Human
cuucauaucauccaca

SEQ ID NO: 1325277 - RNA, 17 nt, Human
cuucauaucauccacac

SEQ ID NO: 1325278 - RNA, 18 nt, Human
cuucauaucauccacaca

SEQ ID NO: 1325279 - RNA, 20 nt, Human
cuucauaucauccacacaug

SEQ ID NO: 1325280 - RNA, 21 nt, Human
cuucauaucauccacacauga

SEQ ID NO: 1325281 - RNA, 17 nt, Human
cuuccagugucauuucu

SEQ ID NO: 1325282 - RNA, 15 nt, Human
cuucaugcauggaaa

SEQ ID NO: 1325283 - RNA, 13 nt, Human
cuucaugcaugga

SEQ ID NO: 1325284 - RNA, 16 nt, Human
cuucaugacagccucc

SEQ ID NO: 1325285 - RNA, 21 nt, Human
cuugccuuauuagagugucuu

SEQ ID NO: 1325286 - RNA, 15 nt, Human
cuugccuucuggugu

SEQ ID NO: 1325287 - RNA, 15 nt, Human
cuugcggcuccucag

SEQ ID NO: 1325288 - RNA, 16 nt, Human
cuuggcaccagacacc

SEQ ID NO: 1325289 - RNA, 19 nt, Human
cuuggcaccagacacccag

SEQ ID NO: 1325290 - RNA, 20 nt, Human
cuuggcaccagacacccagg

SEQ ID NO: 1325291 - RNA, 21 nt, Human
cuuggcaccagacacccagga

SEQ ID NO: 1325292 - RNA, 13 nt, Human
cuuggcagccuug

SEQ ID NO: 1325293 - RNA, 13 nt, Human
cuugaugccuggc

SEQ ID NO: 1325294 - RNA, 13 nt, Human
cuugccugcaggc

SEQ ID NO: 1325295 - RNA, 13 nt, Human
cuugccugccuuu

SEQ ID NO: 1325296 - RNA, 15 nt, Human
cuugccugccuuucc

SEQ ID NO: 1325297 - RNA, 16 nt, Human
cuugccugccuuucca

SEQ ID NO: 1325298 - RNA, 15 nt, Human
cuugccugguacagu

SEQ ID NO: 1325299 - RNA, 16 nt, Human
cuugccugguacagua

SEQ ID NO: 1325300 - RNA, 11 nt, Human
cuugccugugc

SEQ ID NO: 1325301 - RNA, 14 nt, Human
cuugccugugccag

SEQ ID NO: 1325302 - RNA, 15 nt, Human
cuugccugugccagg

SEQ ID NO: 1325303 - RNA, 16 nt, Human
cuugccugugccaggu

SEQ ID NO: 1325304 - RNA, 18 nt, Human
cuugccugugccagguga

SEQ ID NO: 1325305 - RNA, 20 nt, Human
cuugccuguuucccaggccc

SEQ ID NO: 1325306 - RNA, 22 nt, Human
cuugccuguuucccaggcccac

SEQ ID NO: 1325307 - RNA, 18 nt, Human
cuugccuuauuagagugu

SEQ ID NO: 1325308 - RNA, 20 nt, Human
cuugccuuauuagagugucu

SEQ ID NO: 1325309 - RNA, 12 nt, Human
cuugaugccugg

SEQ ID NO: 1325310 - RNA, 21 nt, Human
cuugaugcaugcacuguuccc

SEQ ID NO: 1325311 - RNA, 13 nt, Human
cuugaugaagaag

SEQ ID NO: 1325312 - RNA, 18 nt, Human
cuugaugaccaaaguccu

SEQ ID NO: 1325313 - RNA, 21 nt, Human
cuugaugaccaaaguccuuuu

SEQ ID NO: 1325314 - RNA, 16 nt, Human
cuuggcagccuuguga

SEQ ID NO: 1325315 - RNA, 14 nt, Human
cuuggcagccuugu

SEQ ID NO: 1325316 - RNA, 20 nt, Human
cuuggcgaugccagccaagc

SEQ ID NO: 1325317 - RNA, 12 nt, Human
cuugaugaagaa

SEQ ID NO: 1325318 - RNA, 17 nt, Human
cuugauagaaaugccaa

SEQ ID NO: 1325319 - RNA, 22 nt, Human
cuugauagaaaugccaagcacu

SEQ ID NO: 1325320 - RNA, 12 nt, Human
cuugauagaaau

SEQ ID NO: 1325321 - RNA, 14 nt, Human
cuugauagaaaugc

SEQ ID NO: 1325322 - RNA, 20 nt, Human
cuugauccauuucuaauuau

SEQ ID NO: 1325323 - RNA, 19 nt, Human
cuugauccauuucuaauua

SEQ ID NO: 1325324 - RNA, 21 nt, Human
cuugaguuugucgcucaugug

SEQ ID NO: 1325325 - RNA, 16 nt, Human
cuugauaccccccucu

SEQ ID NO: 1325326 - RNA, 17 nt, Human
cuugauaccccccucug

SEQ ID NO: 1325327 - RNA, 18 nt, Human
cuugauaccccccucugu

SEQ ID NO: 1325328 - RNA, 19 nt, Human
cuugauaccccccucuguc

SEQ ID NO: 1325329 - RNA, 20 nt, Human
cuugauaccccccucugucu

SEQ ID NO: 1325330 - RNA, 21 nt, Human
cuugauaccccccucugucuu

SEQ ID NO: 1325331 - RNA, 15 nt, Human
cuuccuccugggccc

SEQ ID NO: 1325332 - RNA, 22 nt, Human
cuuccuccugggcccucucugc

SEQ ID NO: 1325333 - RNA, 12 nt, Human
cuuccuccugga

SEQ ID NO: 1325334 - RNA, 13 nt, Human
cuuccuccuggaa

SEQ ID NO: 1325335 - RNA, 14 nt, Human
cuuccuccuggaaa

SEQ ID NO: 1325336 - RNA, 12 nt, Human
cuuccuccuggg

SEQ ID NO: 1325337 - RNA, 14 nt, Human
cuuccuccugggcc

SEQ ID NO: 1325338 - RNA, 20 nt, Human
cuuccugcaggcaggaacaa

SEQ ID NO: 1325339 - RNA, 21 nt, Human
cuuccugcaggcaggaacaaa

SEQ ID NO: 1325340 - RNA, 22 nt, Human
cuuccugccagccccugccauu

SEQ ID NO: 1325341 - RNA, 13 nt, Human
cuucuagaaccag

SEQ ID NO: 1325342 - RNA, 13 nt, Human
cuucuacuuuuaa

SEQ ID NO: 1325343 - RNA, 21 nt, Human
cuucuacuuuuaaguugcuga

SEQ ID NO: 1325344 - RNA, 14 nt, Human
cuuccugccagccc

SEQ ID NO: 1325345 - RNA, 15 nt, Human
cuuccugccagcccc

SEQ ID NO: 1325346 - RNA, 17 nt, Human
cuuccugccagccccug

SEQ ID NO: 1325347 - RNA, 18 nt, Human
cuuccugccagccccugc

SEQ ID NO: 1325348 - RNA, 20 nt, Human
cuuccugccagccccugcca

SEQ ID NO: 1325349 - RNA, 14 nt, Human
cuucuaaguaaaua

SEQ ID NO: 1325350 - RNA, 17 nt, Human
cuucuaaguaaauacaa

SEQ ID NO: 1325351 - RNA, 21 nt, Human
cuucuaaguaaauacaauuuu

SEQ ID NO: 1325352 - RNA, 18 nt, Human
cuucuaaguaaauacaau

SEQ ID NO: 1325353 - RNA, 17 nt, Human
cuucuagaaccaggcaa

SEQ ID NO: 1325354 - RNA, 9 nt, Human
cuucuagag

SEQ ID NO: 1325355 - RNA, 13 nt, Human
cuucuagaguuca

SEQ ID NO: 1325356 - RNA, 14 nt, Human
cuucuagaguucag

SEQ ID NO: 1325357 - RNA, 23 nt, Human
cuucuauuuggggcuugaugacu

SEQ ID NO: 1325358 - RNA, 14 nt, Human
cuucuauuuuguaa

SEQ ID NO: 1325359 - RNA, 15 nt, Human
cuucuauuuuguaaa

SEQ ID NO: 1325360 - RNA, 16 nt, Human
cuucuauuuuguaaac

SEQ ID NO: 1325361 - RNA, 17 nt, Human
cuucuauuuuguaaacu

SEQ ID NO: 1325362 - RNA, 16 nt, Human
cuuccuccuccccacu

SEQ ID NO: 1325363 - RNA, 17 nt, Human
cuuccuccuccccacuu

SEQ ID NO: 1325364 - RNA, 21 nt, Human
cuucuguugcugccucaugcu

SEQ ID NO: 1325365 - RNA, 14 nt, Human
cuucuucagggacu

SEQ ID NO: 1325366 - RNA, 17 nt, Human
cuucuguugcugccuca

SEQ ID NO: 1325367 - RNA, 18 nt, Human
cuucuguugcugccucau

SEQ ID NO: 1325368 - RNA, 19 nt, Human
cuucuguugcugccucaug

SEQ ID NO: 1325369 - RNA, 20 nt, Human
cuucuguugcugccucaugc

SEQ ID NO: 1325370 - RNA, 14 nt, Human
cuucucaaguucua

SEQ ID NO: 1325371 - RNA, 15 nt, Human
cuucucaaguucuaa

SEQ ID NO: 1325372 - RNA, 16 nt, Human
cuucucaaguucuaag

SEQ ID NO: 1325373 - RNA, 17 nt, Human
cuucucaaguucuaaga

SEQ ID NO: 1325374 - RNA, 18 nt, Human
cuucucaaguucuaagau

SEQ ID NO: 1325375 - RNA, 23 nt, Human
cuucucaaguucuaagauucuaa

SEQ ID NO: 1325376 - RNA, 21 nt, Human
cuucucaaguucuaagauucu

SEQ ID NO: 1325377 - RNA, 13 nt, Human
cuucugagcuccu

SEQ ID NO: 1325378 - RNA, 14 nt, Human
cuucugagcuccug

SEQ ID NO: 1325379 - RNA, 15 nt, Human
cuucugagcuccugu

SEQ ID NO: 1325380 - RNA, 16 nt, Human
cuucugagcuccuguc

SEQ ID NO: 1325381 - RNA, 19 nt, Human
cuucugagcuccugucccc

SEQ ID NO: 1325382 - RNA, 23 nt, Human
cuucugagcuccuguccccugcu

SEQ ID NO: 1325383 - RNA, 22 nt, Human
cuucugagcuccuguccccugc

SEQ ID NO: 1325384 - RNA, 18 nt, Human
cuuuuaugugaaacaugu

SEQ ID NO: 1325385 - RNA, 14 nt, Human
cuuuuaugugaaac

SEQ ID NO: 1325386 - RNA, 15 nt, Human
cuuuuauguaguaau

SEQ ID NO: 1325387 - RNA, 18 nt, Human
cuuuuauguaguaauuga

SEQ ID NO: 1325388 - RNA, 22 nt, Human
cuuuuauguaguaauugacaug

SEQ ID NO: 1325389 - RNA, 23 nt, Human
cuuuuauguaguaauugacaugu

SEQ ID NO: 1325390 - RNA, 17 nt, Human
cuuuuauacucuuucug

SEQ ID NO: 1325391 - RNA, 19 nt, Human
cuuuuauacucuuucugua

SEQ ID NO: 1325392 - RNA, 20 nt, Human
cuuuuauacucuuucuguau

SEQ ID NO: 1325393 - RNA, 15 nt, Human
cuuuuauacugacac

SEQ ID NO: 1325394 - RNA, 21 nt, Human
cuuuuauaggauuuauuuaaa

SEQ ID NO: 1325395 - RNA, 14 nt, Human
cuuuuauaucccau

SEQ ID NO: 1325396 - RNA, 22 nt, Human
cuuuuaucccaaaguuguugua

SEQ ID NO: 1325397 - RNA, 17 nt, Human
cuuuguaagugaaaaac

SEQ ID NO: 1325398 - RNA, 21 nt, Human
cuuuguaagugaaaaacauga

SEQ ID NO: 1325399 - RNA, 21 nt, Human
cuuuuaguuccugugcacagc

SEQ ID NO: 1325400 - RNA, 22 nt, Human
cuuuuaguuccugugcacagcc

SEQ ID NO: 1325401 - RNA, 15 nt, Human
cuuuuaguuccugug

SEQ ID NO: 1325402 - RNA, 13 nt, Human
cuuuguaaugaaa

SEQ ID NO: 1325403 - RNA, 15 nt, Human
cuuuguaaauuguca

SEQ ID NO: 1325404 - RNA, 16 nt, Human
cuuugggcuucagcug

SEQ ID NO: 1325405 - RNA, 14 nt, Human
cuuugggcugcccu

SEQ ID NO: 1325406 - RNA, 15 nt, Human
cuuugggcugcccug

SEQ ID NO: 1325407 - RNA, 19 nt, Human
cuuugggcugcccuggugc

SEQ ID NO: 1325408 - RNA, 20 nt, Human
cuuugggcugcccuggugcu

SEQ ID NO: 1325409 - RNA, 21 nt, Human
cuuugggcugcccuggugcug

SEQ ID NO: 1325410 - RNA, 22 nt, Human
cuuucuagaaagagaaacaguu

SEQ ID NO: 1325411 - RNA, 17 nt, Human
cuuucuagaccaauaaa

SEQ ID NO: 1325412 - RNA, 16 nt, Human
cuuucuagccuggcua

SEQ ID NO: 1325413 - RNA, 22 nt, Human
cuuugauauuuucaacgcagcc

SEQ ID NO: 1325414 - RNA, 15 nt, Human
cuuugauauuucaau

SEQ ID NO: 1325415 - RNA, 17 nt, Human
cuuuccuugaguaguuu

SEQ ID NO: 1325416 - RNA, 14 nt, Human
cuuucacaaccuuc

SEQ ID NO: 1325417 - RNA, 16 nt, Human
cuuucacaaccuucug

SEQ ID NO: 1325418 - RNA, 12 nt, Human
cuuucagcuccu

SEQ ID NO: 1325419 - RNA, 13 nt, Human
cuuucagcuccug

SEQ ID NO: 1325420 - RNA, 14 nt, Human
cuuucagcuccuga

SEQ ID NO: 1325421 - RNA, 15 nt, Human
cuuucagcuccugac

SEQ ID NO: 1325422 - RNA, 17 nt, Human
cuuucagcuccugacca

SEQ ID NO: 1325423 - RNA, 19 nt, Human
cuuucagcuccugaccagu

SEQ ID NO: 1325424 - RNA, 21 nt, Human
cuuucagcuccugaccaguug

SEQ ID NO: 1325425 - RNA, 12 nt, Human
cuuucagcuguc

SEQ ID NO: 1325426 - RNA, 13 nt, Human
cuuucagcugucu

SEQ ID NO: 1325427 - RNA, 17 nt, Human
cuuucagcugucuuuug

SEQ ID NO: 1325428 - RNA, 22 nt, Human
cuuucagcugucuuuuggagga

SEQ ID NO: 1325429 - RNA, 15 nt, Human
cuuucaggaucuauu

SEQ ID NO: 1325430 - RNA, 16 nt, Human
cuuucaggaucuauuu

SEQ ID NO: 1325431 - RNA, 21 nt, Human
cuuucaggaucuauuuuugga

SEQ ID NO: 1325432 - RNA, 17 nt, Human
cuuucaggaucuauuuu

SEQ ID NO: 1325433 - RNA, 22 nt, Human
cuuuccugagucccaucccugc

SEQ ID NO: 1325434 - RNA, 20 nt, Human
cuuuccugagucccaucccu

SEQ ID NO: 1325435 - RNA, 18 nt, Human
cuuuccugagucccaucc

SEQ ID NO: 1325436 - RNA, 21 nt, Human
cuuuccugcaacucaaggacu

SEQ ID NO: 1325437 - RNA, 10 nt, Human
cuuuccugcc

SEQ ID NO: 1325438 - RNA, 12 nt, Human
cuuuccugcccc

SEQ ID NO: 1325439 - RNA, 13 nt, Human
cuuuccugcccca

SEQ ID NO: 1325440 - RNA, 14 nt, Human
cuuuccugccccag

SEQ ID NO: 1325441 - RNA, 18 nt, Human
cuuuccugccccaggccu

SEQ ID NO: 1325442 - RNA, 19 nt, Human
cuuuccugccccaggccug

SEQ ID NO: 1325443 - RNA, 20 nt, Human
cuuuccuggacacucagacc

SEQ ID NO: 1325444 - RNA, 23 nt, Human
cuuuccuggacacucagaccuga

SEQ ID NO: 1325445 - RNA, 23 nt, Human
cuuuccuguauuuguucccaaga

SEQ ID NO: 1325446 - RNA, 13 nt, Human
gaaacuuuuggaa

SEQ ID NO: 1325447 - RNA, 15 nt, Human
gaaacuuuuggaagg

SEQ ID NO: 1325448 - RNA, 11 nt, Human
gaaacuuuucu

SEQ ID NO: 1325449 - RNA, 21 nt, Human
gaaacuuuucuuaaaaaguua

SEQ ID NO: 1325450 - RNA, 16 nt, Human
gaaacuuucuuucuca

SEQ ID NO: 1325451 - RNA, 17 nt, Human
gaaacuuuuuuauuuaa

SEQ ID NO: 1325452 - RNA, 18 nt, Human
gaaacuuuuuuauuuaaa

SEQ ID NO: 1325453 - RNA, 18 nt, Human
gaaaggcugcuguacuga

SEQ ID NO: 1325454 - RNA, 18 nt, Human
gaaauauuuauuuuaaua

SEQ ID NO: 1325455 - RNA, 22 nt, Human
gaaauauuuauuuuaauaaugu

SEQ ID NO: 1325456 - RNA, 17 nt, Human
gaaaggugguguuucug

SEQ ID NO: 1325457 - RNA, 22 nt, Human
gaaaggugguguuucuguaaga

SEQ ID NO: 1325458 - RNA, 20 nt, Human
gaaaggugugagacugggaa

SEQ ID NO: 1325459 - RNA, 20 nt, Human
gaaagguuagagaauaaauu

SEQ ID NO: 1325460 - RNA, 17 nt, Human
gaaauauuuauuuuaau

SEQ ID NO: 1325461 - RNA, 14 nt, Human
gaaaggugguguuu

SEQ ID NO: 1325462 - RNA, 16 nt, Human
gaaaggugguguuucu

SEQ ID NO: 1325463 - RNA, 17 nt, Human
gaaaggggucggcugac

SEQ ID NO: 1325464 - RNA, 23 nt, Human
gaaaggcugcuguacugaaguaa

SEQ ID NO: 1325465 - RNA, 20 nt, Human
gaaaggcugcuguacugaag

SEQ ID NO: 1325466 - RNA, 19 nt, Human
gaaaggcugcuguacugaa

SEQ ID NO: 1325467 - RNA, 22 nt, Human
gaaaggcuguuaaauacaggaa

SEQ ID NO: 1325468 - RNA, 15 nt, Human
cuuuuggcauuuuac

SEQ ID NO: 1325469 - RNA, 23 nt, Human
cuuuuggauuggacaaaaugacu

SEQ ID NO: 1325470 - RNA, 21 nt, Human
cuuuuggauuggacaaaauga

SEQ ID NO: 1325471 - RNA, 19 nt, Human
cuuuuggauuggacaaaau

SEQ ID NO: 1325472 - RNA, 17 nt, Human
cuuuuggcggggaggag

SEQ ID NO: 1325473 - RNA, 21 nt, Human
cuuuugguuaugaauacuuug

SEQ ID NO: 1325474 - RNA, 19 nt, Human
cuuuuguagaagucacauu

SEQ ID NO: 1325475 - RNA, 10 nt, Human
cuuuuguaag

SEQ ID NO: 1325476 - RNA, 13 nt, Human
cuuuuguaagaca

SEQ ID NO: 1325477 - RNA, 20 nt, Human
cuuuuguaagacaaagguuu

SEQ ID NO: 1325478 - RNA, 15 nt, Human
cuuuugucucugcaa

SEQ ID NO: 1325479 - RNA, 13 nt, Human
cuuuugugaauua

SEQ ID NO: 1325480 - RNA, 20 nt, Human
cuuuugugauggagugcugu

SEQ ID NO: 1325481 - RNA, 21 nt, Human
cuuuugugauggagugcuguu

SEQ ID NO: 1325482 - RNA, 22 nt, Human
cuuuugugauggagugcuguuu

SEQ ID NO: 1325483 - RNA, 13 nt, Human
cuuuuggagucag

SEQ ID NO: 1325484 - RNA, 18 nt, Human
cuuuuggauuggacaaaa

SEQ ID NO: 1325485 - RNA, 12 nt, Human
cuuuuggaggac

SEQ ID NO: 1325486 - RNA, 17 nt, Human
cuuuugccauuaaacuu

SEQ ID NO: 1325487 - RNA, 17 nt, Human
cuuuugcccauuuugaa

SEQ ID NO: 1325488 - RNA, 16 nt, Human
cuuuugcccauuuuga

SEQ ID NO: 1325489 - RNA, 15 nt, Human
cuuuugcccuuugau

SEQ ID NO: 1325490 - RNA, 13 nt, Human
cuuuugccauuga

SEQ ID NO: 1325491 - RNA, 13 nt, Human
gaaaaaaaauuau

SEQ ID NO: 1325492 - RNA, 23 nt, Human
cuuuuuuuuuucuuuauaagaaa

SEQ ID NO: 1325493 - RNA, 18 nt, Human
gaaaaaaaaauucacaug

SEQ ID NO: 1325494 - RNA, 16 nt, Human
gaaaaaaaacagugga

SEQ ID NO: 1325495 - RNA, 18 nt, Human
gaaaaaaaaccugagauu

SEQ ID NO: 1325496 - RNA, 21 nt, Human
gaaaaaaaaccugagauuuau

SEQ ID NO: 1325497 - RNA, 21 nt, Human
cuuuuuuuuuuuugagacaga

SEQ ID NO: 1325498 - RNA, 21 nt, Human
gaaaaacaaacucguuuuuua

SEQ ID NO: 1325499 - RNA, 23 nt, Human
gaaaaacaaacucguuuuuuaca

SEQ ID NO: 1325500 - RNA, 13 nt, Human
gaaaaacaggcac

SEQ ID NO: 1325501 - RNA, 11 nt, Human
gaaaaacaggu

SEQ ID NO: 1325502 - RNA, 18 nt, Human
gaaaaacaggcacuuggc

SEQ ID NO: 1325503 - RNA, 13 nt, Human
cuuuuuuguuuug

SEQ ID NO: 1325504 - RNA, 20 nt, Human
cuuuuuuuuuuuugagacag

SEQ ID NO: 1325505 - RNA, 14 nt, Human
cuuuuuuuuuucuu

SEQ ID NO: 1325506 - RNA, 16 nt, Human
cuuuuuuuuuucuuua

SEQ ID NO: 1325507 - RNA, 18 nt, Human
cuuuuuuuuuucuuuaua

SEQ ID NO: 1325508 - RNA, 20 nt, Human
cuuuuuuucuguaccaguua

SEQ ID NO: 1325509 - RNA, 16 nt, Human
cuuuuuuuagagaagu

SEQ ID NO: 1325510 - RNA, 19 nt, Human
cuuuuuuuccaucuuuaca

SEQ ID NO: 1325511 - RNA, 14 nt, Human
cuuuuuuucuguac

SEQ ID NO: 1325512 - RNA, 16 nt, Human
cuuuuuuucuguacca

SEQ ID NO: 1325513 - RNA, 19 nt, Human
cuuuuuuucuguaccaguu

SEQ ID NO: 1325514 - RNA, 23 nt, Human
gaaaaugcuguauuagucacaga

SEQ ID NO: 1325515 - RNA, 15 nt, Human
gaaaaugcgguuaua

SEQ ID NO: 1325516 - RNA, 12 nt, Human
gaaaagaaaaag

SEQ ID NO: 1325517 - RNA, 11 nt, Human
gaaaaugcuga

SEQ ID NO: 1325518 - RNA, 22 nt, Human
gaaaaugguccaauuaguuucc

SEQ ID NO: 1325519 - RNA, 18 nt, Human
gaaaaugguccaggagaa

SEQ ID NO: 1325520 - RNA, 22 nt, Human
gaaaauggucgagaaagaggca

SEQ ID NO: 1325521 - RNA, 23 nt, Human
gaaaaugguccaauuaguuuccu

SEQ ID NO: 1325522 - RNA, 13 nt, Human
gaaaauucauuuu

SEQ ID NO: 1325523 - RNA, 14 nt, Human
gaaaauucauuuuu

SEQ ID NO: 1325524 - RNA, 22 nt, Human
gaaaauucuaacccagguaucc

SEQ ID NO: 1325525 - RNA, 13 nt, Human
gaaaauucugugc

SEQ ID NO: 1325526 - RNA, 22 nt, Human
gaaaauucugugccuuguuuuu

SEQ ID NO: 1325527 - RNA, 20 nt, Human
gaaaauucugugccuuguuu

SEQ ID NO: 1325528 - RNA, 17 nt, Human
gaaaauuuguuauuuug

SEQ ID NO: 1325529 - RNA, 21 nt, Human
gaaaauuuguuauuuugcaac

SEQ ID NO: 1325530 - RNA, 20 nt, Human
cucuuagaugcaguucugaa

SEQ ID NO: 1325531 - RNA, 21 nt, Human
cucuuagaugcaguucugaag

SEQ ID NO: 1325532 - RNA, 22 nt, Human
cugaaaauugaugggauuuggu

SEQ ID NO: 1325533 - RNA, 17 nt, Human
cugaaaauuauuuaaac

SEQ ID NO: 1325534 - RNA, 22 nt, Human
cugaaggaauaaauugcuccuu

SEQ ID NO: 1325535 - RNA, 14 nt, Human
cugaaaauguccuu

SEQ ID NO: 1325536 - RNA, 16 nt, Human
cugaaaauguccuugu

SEQ ID NO: 1325537 - RNA, 17 nt, Human
cugaaaauguccuugug

SEQ ID NO: 1325538 - RNA, 18 nt, Human
cugaaaauguccuuguga

SEQ ID NO: 1325539 - RNA, 19 nt, Human
cugaaaauguccuugugau

SEQ ID NO: 1325540 - RNA, 12 nt, Human
cugaaaaugugc

SEQ ID NO: 1325541 - RNA, 13 nt, Human
cugaaaaugugcu

SEQ ID NO: 1325542 - RNA, 18 nt, Human
cucuuggagaagucucag

SEQ ID NO: 1325543 - RNA, 19 nt, Human
cucuuggagaagucucagc

SEQ ID NO: 1325544 - RNA, 21 nt, Human
cucuuggagaagucucagcua

SEQ ID NO: 1325545 - RNA, 17 nt, Human
cugaaaacacugugcac

SEQ ID NO: 1325546 - RNA, 17 nt, Human
cugaaaacuucauucuu

SEQ ID NO: 1325547 - RNA, 13 nt, Human
cucuuggagaagu

SEQ ID NO: 1325548 - RNA, 15 nt, Human
cucuuggagaagucu

SEQ ID NO: 1325549 - RNA, 22 nt, Human
cucuugcuugugggacuagccu

SEQ ID NO: 1325550 - RNA, 22 nt, Human
cucuugccacugccucuuccuc

SEQ ID NO: 1325551 - RNA, 16 nt, Human
cucuugccacugccuc

SEQ ID NO: 1325552 - RNA, 17 nt, Human
cucuugccacugccucu

SEQ ID NO: 1325553 - RNA, 18 nt, Human
cucuugccacugccucuu

SEQ ID NO: 1325554 - RNA, 19 nt, Human
cucuugccacugccucuuc

SEQ ID NO: 1325555 - RNA, 20 nt, Human
cucuugccacugccucuucc

SEQ ID NO: 1325556 - RNA, 14 nt, Human
cugacagaaggacu

SEQ ID NO: 1325557 - RNA, 21 nt, Human
cugaaggguugacuuuaccca

SEQ ID NO: 1325558 - RNA, 15 nt, Human
cugaagggggcggcc

SEQ ID NO: 1325559 - RNA, 16 nt, Human
cugaagggggcggccu

SEQ ID NO: 1325560 - RNA, 20 nt, Human
cugaagggggcggccuauga

SEQ ID NO: 1325561 - RNA, 22 nt, Human
cugaaggggaaggaaauagcuu

SEQ ID NO: 1325562 - RNA, 23 nt, Human
cugaaggggccaugauggcaaca

SEQ ID NO: 1325563 - RNA, 15 nt, Human
cugaaggggccauga

SEQ ID NO: 1325564 - RNA, 19 nt, Human
cugaaggggccaugauggc

SEQ ID NO: 1325565 - RNA, 17 nt, Human
cugaccucaagugaucu

SEQ ID NO: 1325566 - RNA, 14 nt, Human
cugaccuccgccau

SEQ ID NO: 1325567 - RNA, 16 nt, Human
cugaccuccgccaucc

SEQ ID NO: 1325568 - RNA, 19 nt, Human
cugaccuccgccauccacc

SEQ ID NO: 1325569 - RNA, 17 nt, Human
cugaccuccgccaucca

SEQ ID NO: 1325570 - RNA, 17 nt, Human
cugaccugugagcccag

SEQ ID NO: 1325571 - RNA, 18 nt, Human
cugaccugugagcccagc

SEQ ID NO: 1325572 - RNA, 20 nt, Human
cugaccugugagcccagcug

SEQ ID NO: 1325573 - RNA, 21 nt, Human
cugaccugugagcccagcugg

SEQ ID NO: 1325574 - RNA, 15 nt, Human
cugaccuuaaaugca

SEQ ID NO: 1325575 - RNA, 19 nt, Human
cugaccuuaaaugcaacca

SEQ ID NO: 1325576 - RNA, 21 nt, Human
cucucacuuguuuuauuuaac

SEQ ID NO: 1325577 - RNA, 15 nt, Human
cucucacucccuccc

SEQ ID NO: 1325578 - RNA, 19 nt, Human
cucucaauauucaauaaag

SEQ ID NO: 1325579 - RNA, 21 nt, Human
cucucaauauucaauaaagcu

SEQ ID NO: 1325580 - RNA, 10 nt, Human
cucucaauau

SEQ ID NO: 1325581 - RNA, 18 nt, Human
cucucaauauucaauaaa

SEQ ID NO: 1325582 - RNA, 17 nt, Human
cucucaauaaaauuaua

SEQ ID NO: 1325583 - RNA, 14 nt, Human
cucuauuaugaaug

SEQ ID NO: 1325584 - RNA, 15 nt, Human
cucuauuaugaaugu

SEQ ID NO: 1325585 - RNA, 21 nt, Human
cucuauuaugaaugugaagcc

SEQ ID NO: 1325586 - RNA, 23 nt, Human
cucuauuaugaaugugaagccuu

SEQ ID NO: 1325587 - RNA, 22 nt, Human
cucuauuaugaaugugaagccu

SEQ ID NO: 1325588 - RNA, 20 nt, Human
cucuauucgccacacaguau

SEQ ID NO: 1325589 - RNA, 13 nt, Human
cucuauucuuuaa

SEQ ID NO: 1325590 - RNA, 23 nt, Human
cucuauucgccacacaguauuuu

SEQ ID NO: 1325591 - RNA, 17 nt, Human
cucucaaagcaaauaau

SEQ ID NO: 1325592 - RNA, 14 nt, Human
cucucaacaccaug

SEQ ID NO: 1325593 - RNA, 15 nt, Human
cucucaacaccauga

SEQ ID NO: 1325594 - RNA, 18 nt, Human
cucucaacaccaugauuc

SEQ ID NO: 1325595 - RNA, 22 nt, Human
cucucaacaccaugauuccuuu

SEQ ID NO: 1325596 - RNA, 17 nt, Human
cucucaacacccaguuu

SEQ ID NO: 1325597 - RNA, 15 nt, Human
cucuccccaugaugu

SEQ ID NO: 1325598 - RNA, 18 nt, Human
cucuccccagguccagcu

SEQ ID NO: 1325599 - RNA, 20 nt, Human
cucuccccagguccagcucu

SEQ ID NO: 1325600 - RNA, 23 nt, Human
cucuccccagguccagcucugga

SEQ ID NO: 1325601 - RNA, 24 nt, Human
cucuccgacucacaccacuagccu

SEQ ID NO: 1325602 - RNA, 24 nt, Human
cucuccccagggaagcagcagccu

SEQ ID NO: 1325603 - RNA, 15 nt, Human
cucuccggucucucu

SEQ ID NO: 1325604 - RNA, 15 nt, Human
cucuccuagccccug

SEQ ID NO: 1325605 - RNA, 21 nt, Human
cucuccuaggcauucuggacc

SEQ ID NO: 1325606 - RNA, 22 nt, Human
cucuccuaggcauucuggaccu

SEQ ID NO: 1325607 - RNA, 13 nt, Human
cucucagcccuca

SEQ ID NO: 1325608 - RNA, 21 nt, Human
cucucagcccucacacacccu

SEQ ID NO: 1325609 - RNA, 13 nt, Human
cucuccccagccc

SEQ ID NO: 1325610 - RNA, 15 nt, Human
cucuccccagcccag

SEQ ID NO: 1325611 - RNA, 16 nt, Human
cucuccccagcccaga

SEQ ID NO: 1325612 - RNA, 17 nt, Human
cucuccccagcccagag

SEQ ID NO: 1325613 - RNA, 18 nt, Human
cucuccccagcccagaga

SEQ ID NO: 1325614 - RNA, 19 nt, Human
cucuccccagcccagagac

SEQ ID NO: 1325615 - RNA, 20 nt, Human
cucuccccagcccagagaca

SEQ ID NO: 1325616 - RNA, 20 nt, Human
cucuccccagggaagcagca

SEQ ID NO: 1325617 - RNA, 22 nt, Human
cucuccccagggaagcagcagc

SEQ ID NO: 1325618 - RNA, 15 nt, Human
cucuccccaggucca

SEQ ID NO: 1325619 - RNA, 16 nt, Human
cucuccccagguccag

SEQ ID NO: 1325620 - RNA, 11 nt, Human
cucucuggccu

SEQ ID NO: 1325621 - RNA, 12 nt, Human
cucucuggccuu

SEQ ID NO: 1325622 - RNA, 20 nt, Human
cucucuggaagccccugggc

SEQ ID NO: 1325623 - RNA, 12 nt, Human
cucucuggagaa

SEQ ID NO: 1325624 - RNA, 17 nt, Human
cucugaagccacaaaua

SEQ ID NO: 1325625 - RNA, 19 nt, Human
cucugaagccacaaauagg

SEQ ID NO: 1325626 - RNA, 13 nt, Human
cucucuggccuuc

SEQ ID NO: 1325627 - RNA, 19 nt, Human
cucugaagaacucucugga

SEQ ID NO: 1325628 - RNA, 18 nt, Human
cuccguccaggagccugg

SEQ ID NO: 1325629 - RNA, 19 nt, Human
cuccguccaggagccuggc

SEQ ID NO: 1325630 - RNA, 20 nt, Human
cuccguccaggagccugugc

SEQ ID NO: 1325631 - RNA, 22 nt, Human
cuccguccaggagccugugccu

SEQ ID NO: 1325632 - RNA, 12 nt, Human
cuccguguggga

SEQ ID NO: 1325633 - RNA, 14 nt, Human
cuccgugugggaga

SEQ ID NO: 1325634 - RNA, 15 nt, Human
cuccguuagcuccug

SEQ ID NO: 1325635 - RNA, 16 nt, Human
cuccguuagcuccugu

SEQ ID NO: 1325636 - RNA, 18 nt, Human
cuccgugugggagaccgg

SEQ ID NO: 1325637 - RNA, 20 nt, Human
cucgggauuaguacacacuu

SEQ ID NO: 1325638 - RNA, 15 nt, Human
cucuuagaugcaguu

SEQ ID NO: 1325639 - RNA, 22 nt, Human
cucuguauuugaaucagccuac

SEQ ID NO: 1325640 - RNA, 20 nt, Human
cucugucacuccucaugccu

SEQ ID NO: 1325641 - RNA, 13 nt, Human
cucuguagccuaa

SEQ ID NO: 1325642 - RNA, 22 nt, Human
cucuguaucaggacccagagga

SEQ ID NO: 1325643 - RNA, 18 nt, Human
cucuguaauugaauauua

SEQ ID NO: 1325644 - RNA, 19 nt, Human
cucuguaauugaauauuau

SEQ ID NO: 1325645 - RNA, 14 nt, Human
cucuguaauugcaa

SEQ ID NO: 1325646 - RNA, 15 nt, Human
cucuguaauugcaaa

SEQ ID NO: 1325647 - RNA, 16 nt, Human
cucuguaauugcaaaa

SEQ ID NO: 1325648 - RNA, 17 nt, Human
cucugguuguuucuguu

SEQ ID NO: 1325649 - RNA, 18 nt, Human
cucugguuguuucuguuc

SEQ ID NO: 1325650 - RNA, 20 nt, Human
cucugguuguuucuguucca

SEQ ID NO: 1325651 - RNA, 23 nt, Human
cucugguuguuucuguuccaaau

SEQ ID NO: 1325652 - RNA, 22 nt, Human
cucugguuguuucuguuccaaa

SEQ ID NO: 1325653 - RNA, 15 nt, Human
cucuguaaagcuaaa

SEQ ID NO: 1325654 - RNA, 21 nt, Human
cucuguaaagcuaaaauaaag

SEQ ID NO: 1325655 - RNA, 23 nt, Human
cucuguaaguagaugcauuuggg

SEQ ID NO: 1325656 - RNA, 14 nt, Human
cucugguuccuccc

SEQ ID NO: 1325657 - RNA, 20 nt, Human
cucugcacuacugacaugug

SEQ ID NO: 1325658 - RNA, 22 nt, Human
cucugcacuacugacauguggg

SEQ ID NO: 1325659 - RNA, 19 nt, Human
cucugcacucccaccugac

SEQ ID NO: 1325660 - RNA, 20 nt, Human
cucugcacucccaccugaca

SEQ ID NO: 1325661 - RNA, 16 nt, Human
cucugcacuacugaca

SEQ ID NO: 1325662 - RNA, 18 nt, Human
cucugcacuacugacaug

SEQ ID NO: 1325663 - RNA, 23 nt, Human
cucugcacucccaccugacacac

SEQ ID NO: 1325664 - RNA, 22 nt, Human
cucugcgugucaccugugcuuc

SEQ ID NO: 1325665 - RNA, 18 nt, Human
cucugcuauuaggccagc

SEQ ID NO: 1325666 - RNA, 18 nt, Human
cuccaacccuagcaaaag

SEQ ID NO: 1325667 - RNA, 23 nt, Human
cuccaacaccaagcacagcagcc

SEQ ID NO: 1325668 - RNA, 21 nt, Human
cuccaacaccaccucuccaga

SEQ ID NO: 1325669 - RNA, 19 nt, Human
cuccaacaucacagcccag

SEQ ID NO: 1325670 - RNA, 20 nt, Human
cuccaacccaaccucauccu

SEQ ID NO: 1325671 - RNA, 16 nt, Human
cuccaaagucucugga

SEQ ID NO: 1325672 - RNA, 12 nt, Human
cuccaaagucau

SEQ ID NO: 1325673 - RNA, 17 nt, Human
cuccaaagucauaauug

SEQ ID NO: 1325674 - RNA, 19 nt, Human
cuccaaagucauaauugca

SEQ ID NO: 1325675 - RNA, 20 nt, Human
cuccaaagucauaauugcau

SEQ ID NO: 1325676 - RNA, 21 nt, Human
cuccaaagucauaauugcauu

SEQ ID NO: 1325677 - RNA, 23 nt, Human
cuccaaagucauaauugcauuga

SEQ ID NO: 1325678 - RNA, 12 nt, Human
cuccaacaauaa

SEQ ID NO: 1325679 - RNA, 15 nt, Human
cuccaacaccaagca

SEQ ID NO: 1325680 - RNA, 16 nt, Human
cuccaacaccaagcac

SEQ ID NO: 1325681 - RNA, 18 nt, Human
cuccaacaccaagcacag

SEQ ID NO: 1325682 - RNA, 22 nt, Human
cuccaacaccaagcacagcagc

SEQ ID NO: 1325683 - RNA, 14 nt, Human
cucauggccccucu

SEQ ID NO: 1325684 - RNA, 18 nt, Human
cucaugccucagccuccu

SEQ ID NO: 1325685 - RNA, 20 nt, Human
cucaugccucagccuccuga

SEQ ID NO: 1325686 - RNA, 13 nt, Human
cucaugaauguaa

SEQ ID NO: 1325687 - RNA, 14 nt, Human
cucaugaauguaaa

SEQ ID NO: 1325688 - RNA, 12 nt, Human
cucagucucucu

SEQ ID NO: 1325689 - RNA, 17 nt, Human
cucagucucucuucucu

SEQ ID NO: 1325690 - RNA, 19 nt, Human
cucagucucucuucucucc

SEQ ID NO: 1325691 - RNA, 13 nt, Human
cucagucucugag

SEQ ID NO: 1325692 - RNA, 14 nt, Human
cucagucucugagc

SEQ ID NO: 1325693 - RNA, 20 nt, Human
cucagucucugagcagugaa

SEQ ID NO: 1325694 - RNA, 22 nt, Human
cucaguggcccauggcauuuua

SEQ ID NO: 1325695 - RNA, 16 nt, Human
cucaguggggcagagg

SEQ ID NO: 1325696 - RNA, 16 nt, Human
cucaucuuucuuccaa

SEQ ID NO: 1325697 - RNA, 14 nt, Human
cucaucuuuuuacu

SEQ ID NO: 1325698 - RNA, 12 nt, Human
cucaugaaccuc

SEQ ID NO: 1325699 - RNA, 21 nt, Human
cucaugaaccucaagcugcau

SEQ ID NO: 1325700 - RNA, 12 nt, Human
cucaugaaugua

SEQ ID NO: 1325701 - RNA, 20 nt, Human
cucaguguccucaggggccu

SEQ ID NO: 1325702 - RNA, 17 nt, Human
cucaucuucuucaccau

SEQ ID NO: 1325703 - RNA, 14 nt, Human
cucaucuuucccuc

SEQ ID NO: 1325704 - RNA, 15 nt, Human
cucaucuuucccucc

SEQ ID NO: 1325705 - RNA, 16 nt, Human
cucaucuuucccuccu

SEQ ID NO: 1325706 - RNA, 17 nt, Human
cucaucuuucccuccuu

SEQ ID NO: 1325707 - RNA, 18 nt, Human
cucaucuuucccuccuug

SEQ ID NO: 1325708 - RNA, 19 nt, Human
cucaucuuucccuccuugg

SEQ ID NO: 1325709 - RNA, 20 nt, Human
cucaucuuucccuccuuggu

SEQ ID NO: 1325710 - RNA, 18 nt, Human
cucagccucccaaguaac

SEQ ID NO: 1325711 - RNA, 17 nt, Human
cuaucccggcugcccuu

SEQ ID NO: 1325712 - RNA, 15 nt, Human
cucagccucccaaag

SEQ ID NO: 1325713 - RNA, 17 nt, Human
cucagccucccaaagug

SEQ ID NO: 1325714 - RNA, 15 nt, Human
cuaucccggcugccc

SEQ ID NO: 1325715 - RNA, 16 nt, Human
cuaucccggcugcccu

SEQ ID NO: 1325716 - RNA, 14 nt, Human
cucagcgaaugaau

SEQ ID NO: 1325717 - RNA, 22 nt, Human
cucagccuugccagagauccaa

SEQ ID NO: 1325718 - RNA, 13 nt, Human
cucaggccagagc

SEQ ID NO: 1325719 - RNA, 16 nt, Human
cucaggccagagccaa

SEQ ID NO: 1325720 - RNA, 17 nt, Human
cucaggccagagccaag

SEQ ID NO: 1325721 - RNA, 18 nt, Human
cucaggccagagccaagg

SEQ ID NO: 1325722 - RNA, 12 nt, Human
cucagccuccug

SEQ ID NO: 1325723 - RNA, 13 nt, Human
cucagccuccuga

SEQ ID NO: 1325724 - RNA, 15 nt, Human
cucagccuucagaca

SEQ ID NO: 1325725 - RNA, 16 nt, Human
cucagccuucagacag

SEQ ID NO: 1325726 - RNA, 17 nt, Human
cucagccuucagacaga

SEQ ID NO: 1325727 - RNA, 19 nt, Human
cucagccuucagacagaga

SEQ ID NO: 1325728 - RNA, 15 nt, Human
cucagccuugccaga

SEQ ID NO: 1325729 - RNA, 16 nt, Human
cucagccuugccagag

SEQ ID NO: 1325730 - RNA, 17 nt, Human
cucagccuugccagaga

SEQ ID NO: 1325731 - RNA, 18 nt, Human
cucagccuugccagagau

SEQ ID NO: 1325732 - RNA, 19 nt, Human
cucagccuugccagagauc

SEQ ID NO: 1325733 - RNA, 20 nt, Human
cucagccuugccagagaucc

SEQ ID NO: 1325734 - RNA, 21 nt, Human
cucagccuugccagagaucca

SEQ ID NO: 1325735 - RNA, 20 nt, Human
cucaggcccccaccuggcuc

SEQ ID NO: 1325736 - RNA, 21 nt, Human
cucaggcccccaccuggcuca

SEQ ID NO: 1325737 - RNA, 23 nt, Human
cuccagguauucguuaucuaaua

SEQ ID NO: 1325738 - RNA, 19 nt, Human
cuccaggguggcagcaaca

SEQ ID NO: 1325739 - RNA, 16 nt, Human
cuccagggugugugcu

SEQ ID NO: 1325740 - RNA, 22 nt, Human
cuccaggggcugcuuccuccug

SEQ ID NO: 1325741 - RNA, 23 nt, Human
cuccaggggcugcuuccuccugg

SEQ ID NO: 1325742 - RNA, 13 nt, Human
cuccaaccugcaa

SEQ ID NO: 1325743 - RNA, 14 nt, Human
cuccagaccccugg

SEQ ID NO: 1325744 - RNA, 15 nt, Human
cuccgcucuguagug

SEQ ID NO: 1325745 - RNA, 16 nt, Human
cuccgccuggccuggc

SEQ ID NO: 1325746 - RNA, 12 nt, Human
cucccacccucu

SEQ ID NO: 1325747 - RNA, 14 nt, Human
cucccacccucuuc

SEQ ID NO: 1325748 - RNA, 15 nt, Human
cucccacccucuucc

SEQ ID NO: 1325749 - RNA, 16 nt, Human
cucccacccucuuccu

SEQ ID NO: 1325750 - RNA, 21 nt, Human
cucccacccucuuccuacugg

SEQ ID NO: 1325751 - RNA, 18 nt, Human
cucccaccuagcagcacc

SEQ ID NO: 1325752 - RNA, 20 nt, Human
cucccacccucuuccuacug

SEQ ID NO: 1325753 - RNA, 21 nt, Human
cuccagugagacagcucugca

SEQ ID NO: 1325754 - RNA, 17 nt, Human
cucccacccggcugcag

SEQ ID NO: 1325755 - RNA, 19 nt, Human
cucccacccggcugcagag

SEQ ID NO: 1325756 - RNA, 17 nt, Human
cuccccgauaaagaaug

SEQ ID NO: 1325757 - RNA, 12 nt, Human
cuccccucagcc

SEQ ID NO: 1325758 - RNA, 13 nt, Human
cuccccucagccu

SEQ ID NO: 1325759 - RNA, 15 nt, Human
cuccccucagccucu

SEQ ID NO: 1325760 - RNA, 16 nt, Human
cuccccucagccucuc

SEQ ID NO: 1325761 - RNA, 21 nt, Human
cuccccucagccucuccccug

SEQ ID NO: 1325762 - RNA, 20 nt, Human
cuccccuccaaaaugugccu

SEQ ID NO: 1325763 - RNA, 12 nt, Human
cuccccuccagc

SEQ ID NO: 1325764 - RNA, 13 nt, Human
cuccccuccagcu

SEQ ID NO: 1325765 - RNA, 14 nt, Human
cuccccuccauccc

SEQ ID NO: 1325766 - RNA, 15 nt, Human
cuccccuccaucccu

SEQ ID NO: 1325767 - RNA, 16 nt, Human
cuccccuccaucccug

SEQ ID NO: 1325768 - RNA, 19 nt, Human
cuccccuccaucccuggcc

SEQ ID NO: 1325769 - RNA, 23 nt, Human
cuccccuccaucccuggcccccu

SEQ ID NO: 1325770 - RNA, 16 nt, Human
cuccccuccccaacug

SEQ ID NO: 1325771 - RNA, 15 nt, Human
cuccccuccccaacu

SEQ ID NO: 1325772 - RNA, 15 nt, Human
cucccuccgccccca

SEQ ID NO: 1325773 - RNA, 16 nt, Human
cucccuccgcccccag

SEQ ID NO: 1325774 - RNA, 18 nt, Human
cucccuccgcccccaggu

SEQ ID NO: 1325775 - RNA, 20 nt, Human
cucccuccgcccccagguag

SEQ ID NO: 1325776 - RNA, 19 nt, Human
cucccuccuaaccuagaga

SEQ ID NO: 1325777 - RNA, 13 nt, Human
cucccuccucugc

SEQ ID NO: 1325778 - RNA, 12 nt, Human
cucccuccucca

SEQ ID NO: 1325779 - RNA, 14 nt, Human
cucccuccucugcc

SEQ ID NO: 1325780 - RNA, 20 nt, Human
cucccugcagaggggcugag

SEQ ID NO: 1325781 - RNA, 12 nt, Human
cucccugagaug

SEQ ID NO: 1325782 - RNA, 19 nt, Human
cuaaacuggagacugugug

SEQ ID NO: 1325783 - RNA, 23 nt, Human
cuaaacugcccccucugcccugc

SEQ ID NO: 1325784 - RNA, 13 nt, Human
cgugugcaggagc

SEQ ID NO: 1325785 - RNA, 12 nt, Human
cuaaacuggaga

SEQ ID NO: 1325786 - RNA, 13 nt, Human
cuaaacuggagac

SEQ ID NO: 1325787 - RNA, 14 nt, Human
cuaaacuggagacu

SEQ ID NO: 1325788 - RNA, 15 nt, Human
cuaaacuggagacug

SEQ ID NO: 1325789 - RNA, 17 nt, Human
cuaaacuggagacugug

SEQ ID NO: 1325790 - RNA, 16 nt, Human
cuaaacuuccccaucu

SEQ ID NO: 1325791 - RNA, 20 nt, Human
cuaaacuuccccaucuucua

SEQ ID NO: 1325792 - RNA, 14 nt, Human
cgugucuggcacag

SEQ ID NO: 1325793 - RNA, 21 nt, Human
cgugucuggcacagccuggcu

SEQ ID NO: 1325794 - RNA, 22 nt, Human
cuaaacugcccccucugcccug

SEQ ID NO: 1325795 - RNA, 22 nt, Human
cgugugagaagugaaugcuggg

SEQ ID NO: 1325796 - RNA, 21 nt, Human
cgugugagaagugaaugcugg

SEQ ID NO: 1325797 - RNA, 23 nt, Human
cgugugagaagugaaugcuggga

SEQ ID NO: 1325798 - RNA, 13 nt, Human
cgugagaccugcc

SEQ ID NO: 1325799 - RNA, 14 nt, Human
cgugagaccugccc

SEQ ID NO: 1325800 - RNA, 16 nt, Human
cgugagaccugccccu

SEQ ID NO: 1325801 - RNA, 23 nt, Human
cgugagccaccgugccuggccac

SEQ ID NO: 1325802 - RNA, 20 nt, Human
cgugagcauguuuggaaggg

SEQ ID NO: 1325803 - RNA, 15 nt, Human
cguggggugugcugg

SEQ ID NO: 1325804 - RNA, 17 nt, Human
cguggggugugcuggga

SEQ ID NO: 1325805 - RNA, 18 nt, Human
cguggggugugcugggag

SEQ ID NO: 1325806 - RNA, 13 nt, Human
cgugggugugugc

SEQ ID NO: 1325807 - RNA, 20 nt, Human
cgugaccggacuuuucugca

SEQ ID NO: 1325808 - RNA, 22 nt, Human
cgugaccugcuaggccagagcc

SEQ ID NO: 1325809 - RNA, 15 nt, Human
cgugacgucugggug

SEQ ID NO: 1325810 - RNA, 20 nt, Human
cgugacgucuggguggcccu

SEQ ID NO: 1325811 - RNA, 13 nt, Human
cggcucucaccug

SEQ ID NO: 1325812 - RNA, 16 nt, Human
cggcucucaccuggcc

SEQ ID NO: 1325813 - RNA, 18 nt, Human
cggcucucaccuggcccu

SEQ ID NO: 1325814 - RNA, 14 nt, Human
cggcucugucccca

SEQ ID NO: 1325815 - RNA, 15 nt, Human
cggcucuguccccag

SEQ ID NO: 1325816 - RNA, 16 nt, Human
cggcucuguccccagc

SEQ ID NO: 1325817 - RNA, 19 nt, Human
cggcucuguccccagccug

SEQ ID NO: 1325818 - RNA, 17 nt, Human
cggcucuguccccagcc

SEQ ID NO: 1325819 - RNA, 11 nt, Human
cggcugaccau

SEQ ID NO: 1325820 - RNA, 14 nt, Human
cggcugaccaugcu

SEQ ID NO: 1325821 - RNA, 15 nt, Human
cggcugaccaugcuc

SEQ ID NO: 1325822 - RNA, 16 nt, Human
cggcugaccaugcuca

SEQ ID NO: 1325823 - RNA, 22 nt, Human
cggcugaccaugcucaucugcu

SEQ ID NO: 1325824 - RNA, 23 nt, Human
cggcugaccaugcucaucugcug

SEQ ID NO: 1325825 - RNA, 16 nt, Human
cuaagaaacuuaaauu

SEQ ID NO: 1325826 - RNA, 22 nt, Human
cuaagaaacauuuauauugaua

SEQ ID NO: 1325827 - RNA, 19 nt, Human
cuaagaaacauuuauauug

SEQ ID NO: 1325828 - RNA, 20 nt, Human
cuaagaaacauuuauauuga

SEQ ID NO: 1325829 - RNA, 21 nt, Human
cuaagaaacauuuauauugau

SEQ ID NO: 1325830 - RNA, 12 nt, Human
cuaagaaagaac

SEQ ID NO: 1325831 - RNA, 15 nt, Human
cuaagaaagaacacg

SEQ ID NO: 1325832 - RNA, 21 nt, Human
cuaaccuugccugguacagua

SEQ ID NO: 1325833 - RNA, 13 nt, Human
cuaaccuuuacau

SEQ ID NO: 1325834 - RNA, 21 nt, Human
cuaaccuuuacaugaggacuc

SEQ ID NO: 1325835 - RNA, 21 nt, Human
cuaacuuacaaagauucucua

SEQ ID NO: 1325836 - RNA, 20 nt, Human
cuaacgaaguauccuucagc

SEQ ID NO: 1325837 - RNA, 18 nt, Human
cuaaagauucuauaguuc

SEQ ID NO: 1325838 - RNA, 20 nt, Human
cuaaagauucuauaguucua

SEQ ID NO: 1325839 - RNA, 13 nt, Human
cuaaccuugccug

SEQ ID NO: 1325840 - RNA, 16 nt, Human
cuaaccuugccuggua

SEQ ID NO: 1325841 - RNA, 17 nt, Human
cuaaccuugccugguac

SEQ ID NO: 1325842 - RNA, 20 nt, Human
cuaaccuugccugguacagu

SEQ ID NO: 1325843 - RNA, 12 nt, Human
cuaaccugccga

SEQ ID NO: 1325844 - RNA, 23 nt, Human
cuaaagauggaguuucuaagguc

SEQ ID NO: 1325845 - RNA, 12 nt, Human
cuaaagauucua

SEQ ID NO: 1325846 - RNA, 14 nt, Human
cuaaagauucuaua

SEQ ID NO: 1325847 - RNA, 17 nt, Human
cuaaagauucuauaguu

SEQ ID NO: 1325848 - RNA, 19 nt, Human
cuaaccugccgagagucca

SEQ ID NO: 1325849 - RNA, 21 nt, Human
cuaaccugccgagaguccauc

SEQ ID NO: 1325850 - RNA, 17 nt, Human
cuaaagauggaguuucu

SEQ ID NO: 1325851 - RNA, 18 nt, Human
cuaaagauggaguuucua

SEQ ID NO: 1325852 - RNA, 19 nt, Human
cuaaagauggaguuucuaa

SEQ ID NO: 1325853 - RNA, 20 nt, Human
cuaaagauggaguuucuaag

SEQ ID NO: 1325854 - RNA, 21 nt, Human
cuaaagauggaguuucuaagg

SEQ ID NO: 1325855 - RNA, 18 nt, Human
cuaccucuccagccucag

SEQ ID NO: 1325856 - RNA, 18 nt, Human
cuacaugagguacugaga

SEQ ID NO: 1325857 - RNA, 14 nt, Human
cuacaugagaacaa

SEQ ID NO: 1325858 - RNA, 17 nt, Human
cuacaugagaacaaaca

SEQ ID NO: 1325859 - RNA, 15 nt, Human
cuacaugagguacug

SEQ ID NO: 1325860 - RNA, 15 nt, Human
cuacaugaaacagaa

SEQ ID NO: 1325861 - RNA, 16 nt, Human
cuacaugaaacagaaa

SEQ ID NO: 1325862 - RNA, 18 nt, Human
cuacaugaaacagaaaca

SEQ ID NO: 1325863 - RNA, 13 nt, Human
cuacaugagaaca

SEQ ID NO: 1325864 - RNA, 19 nt, Human
cuacauaacuaauacagcu

SEQ ID NO: 1325865 - RNA, 15 nt, Human
cuacauaauuuaguu

SEQ ID NO: 1325866 - RNA, 17 nt, Human
cuacaguuuuaacugug

SEQ ID NO: 1325867 - RNA, 18 nt, Human
cuacaguuuuaacugugg

SEQ ID NO: 1325868 - RNA, 20 nt, Human
cuacaguuuuaacuguggau

SEQ ID NO: 1325869 - RNA, 19 nt, Human
cuacaguuuuaacugugga

SEQ ID NO: 1325870 - RNA, 13 nt, Human
cuaauuuuuuugu

SEQ ID NO: 1325871 - RNA, 16 nt, Human
cuaauuuuuuuguauu

SEQ ID NO: 1325872 - RNA, 20 nt, Human
cuaauuuuuuuguauuuuag

SEQ ID NO: 1325873 - RNA, 21 nt, Human
cuaauuuuuuuguauuuuagc

SEQ ID NO: 1325874 - RNA, 20 nt, Human
cuaauuuuuguauuuuuagu

SEQ ID NO: 1325875 - RNA, 13 nt, Human
cuaauuuuuguau

SEQ ID NO: 1325876 - RNA, 23 nt, Human
cuaauuuuuguauuuuuaguaga

SEQ ID NO: 1325877 - RNA, 14 nt, Human
cuaauuuuuuguug

SEQ ID NO: 1325878 - RNA, 16 nt, Human
cuaauuuuuuguuguu

SEQ ID NO: 1325879 - RNA, 11 nt, Human
cuaauuuuugu

SEQ ID NO: 1325880 - RNA, 21 nt, Human
cuaauuuuuauuuuugcugag

SEQ ID NO: 1325881 - RNA, 14 nt, Human
cuaauuuuuguaau

SEQ ID NO: 1325882 - RNA, 20 nt, Human
cuaauuuuuguaauuuuagu

SEQ ID NO: 1325883 - RNA, 12 nt, Human
cuaauuuauaaa

SEQ ID NO: 1325884 - RNA, 22 nt, Human
cuaauuuuuaagaauugaguaa

SEQ ID NO: 1325885 - RNA, 22 nt, Human
cuaauuuuuauuaauuuuaguu

SEQ ID NO: 1325886 - RNA, 17 nt, Human
cuaauuuuuauuaauuu

SEQ ID NO: 1325887 - RNA, 18 nt, Human
cuaauuuuuauuuuugcu

SEQ ID NO: 1325888 - RNA, 16 nt, Human
cuacaaccuccgccuc

SEQ ID NO: 1325889 - RNA, 15 nt, Human
cuacaagacacagug

SEQ ID NO: 1325890 - RNA, 21 nt, Human
cuacaaagguuuaaaugaaca

SEQ ID NO: 1325891 - RNA, 22 nt, Human
cuacaaagguuuaaaugaacaa

SEQ ID NO: 1325892 - RNA, 15 nt, Human
cuacaaccaauggaa

SEQ ID NO: 1325893 - RNA, 15 nt, Human
cuacaaagguuuaaa

SEQ ID NO: 1325894 - RNA, 17 nt, Human
cuacaaagguuuaaaug

SEQ ID NO: 1325895 - RNA, 18 nt, Human
cuacaaagguuuaaauga

SEQ ID NO: 1325896 - RNA, 19 nt, Human
cuacaaagguuuaaaugaa

SEQ ID NO: 1325897 - RNA, 20 nt, Human
cuacaaagguuuaaaugaac

SEQ ID NO: 1325898 - RNA, 10 nt, Human
cuacaaauca

SEQ ID NO: 1325899 - RNA, 16 nt, Human
cuaagucuuuccauug

SEQ ID NO: 1325900 - RNA, 13 nt, Human
cuaagugauauaa

SEQ ID NO: 1325901 - RNA, 11 nt, Human
cuaauugcuua

SEQ ID NO: 1325902 - RNA, 12 nt, Human
cuaauugcuuau

SEQ ID NO: 1325903 - RNA, 14 nt, Human
cuaagugauauaaa

SEQ ID NO: 1325904 - RNA, 16 nt, Human
cuaagugauauaaauc

SEQ ID NO: 1325905 - RNA, 13 nt, Human
cuaauugcuuauu

SEQ ID NO: 1325906 - RNA, 14 nt, Human
cuaauugcuuauuu

SEQ ID NO: 1325907 - RNA, 18 nt, Human
cuaauugcuuauuuauug

SEQ ID NO: 1325908 - RNA, 22 nt, Human
cuaauuggcaugaaggugucau

SEQ ID NO: 1325909 - RNA, 11 nt, Human
cuaauuuaaca

SEQ ID NO: 1325910 - RNA, 23 nt, Human
cuaagugaaauaagccagacauc

SEQ ID NO: 1325911 - RNA, 20 nt, Human
cuaagugaaauaagccagac

SEQ ID NO: 1325912 - RNA, 14 nt, Human
cuaagucuuuccau

SEQ ID NO: 1325913 - RNA, 23 nt, Human
cuaguugaucagcuuauugucua

SEQ ID NO: 1325914 - RNA, 22 nt, Human
cuaguucuuuguucauagccca

SEQ ID NO: 1325915 - RNA, 21 nt, Human
cuaguucuucaucccacucca

SEQ ID NO: 1325916 - RNA, 18 nt, Human
cuaguuccccuguuuauu

SEQ ID NO: 1325917 - RNA, 16 nt, Human
cuaguuccccuguuua

SEQ ID NO: 1325918 - RNA, 17 nt, Human
cuauaaccaaaugaaau

SEQ ID NO: 1325919 - RNA, 19 nt, Human
cuauaaccaaaugaaauau

SEQ ID NO: 1325920 - RNA, 16 nt, Human
cuauaaccagacacau

SEQ ID NO: 1325921 - RNA, 17 nt, Human
cuauaagaacuuugagc

SEQ ID NO: 1325922 - RNA, 20 nt, Human
cuagccucaggggucugagc

SEQ ID NO: 1325923 - RNA, 13 nt, Human
cuagccucagggg

SEQ ID NO: 1325924 - RNA, 19 nt, Human
cuagccugcauugagcuug

SEQ ID NO: 1325925 - RNA, 17 nt, Human
cuagcccuccuuuuucc

SEQ ID NO: 1325926 - RNA, 18 nt, Human
cuagcccuccuuuuucca

SEQ ID NO: 1325927 - RNA, 19 nt, Human
cuagcccuccuuuuuccaa

SEQ ID NO: 1325928 - RNA, 13 nt, Human
cuagcccucucac

SEQ ID NO: 1325929 - RNA, 18 nt, Human
cuagcccucucacauuua

SEQ ID NO: 1325930 - RNA, 19 nt, Human
cuagcccucucacauuuau

SEQ ID NO: 1325931 - RNA, 13 nt, Human
cuagggaucccuc

SEQ ID NO: 1325932 - RNA, 17 nt, Human
cuagggaucccucaucu

SEQ ID NO: 1325933 - RNA, 23 nt, Human
cuagggaucccucaucugucccu

SEQ ID NO: 1325934 - RNA, 16 nt, Human
cuagggccaagcccag

SEQ ID NO: 1325935 - RNA, 17 nt, Human
cuagggccaagcccagc

SEQ ID NO: 1325936 - RNA, 18 nt, Human
cuagggccaagcccagca

SEQ ID NO: 1325937 - RNA, 19 nt, Human
cuaccugacacucccuugg

SEQ ID NO: 1325938 - RNA, 20 nt, Human
cuaccugacacucccuuggg

SEQ ID NO: 1325939 - RNA, 14 nt, Human
cuaccugagcuaaa

SEQ ID NO: 1325940 - RNA, 14 nt, Human
cuagaacacaggca

SEQ ID NO: 1325941 - RNA, 19 nt, Human
cuagaacacaggcaaaauc

SEQ ID NO: 1325942 - RNA, 21 nt, Human
cuagaacacaggcaaaauccu

SEQ ID NO: 1325943 - RNA, 22 nt, Human
cuagaacacaggcaaaauccuu

SEQ ID NO: 1325944 - RNA, 19 nt, Human
cuagaacucccuuucaaca

SEQ ID NO: 1325945 - RNA, 18 nt, Human
cuagaacucccuuucaac

SEQ ID NO: 1325946 - RNA, 17 nt, Human
cuagaacucccuuucaa

SEQ ID NO: 1325947 - RNA, 16 nt, Human
cuagaacucccuuuca

SEQ ID NO: 1325948 - RNA, 13 nt, Human
cuagcaguggcag

SEQ ID NO: 1325949 - RNA, 15 nt, Human
cuagcaguggcaggc

SEQ ID NO: 1325950 - RNA, 18 nt, Human
cuagcaguggcaggcaga

SEQ ID NO: 1325951 - RNA, 20 nt, Human
cuagcaguggcaggcagagg

SEQ ID NO: 1325952 - RNA, 21 nt, Human
cuagcaguggcaggcagaggc

SEQ ID NO: 1325953 - RNA, 15 nt, Human
cuagccccuggggug

SEQ ID NO: 1325954 - RNA, 18 nt, Human
cuagccaaaccucaccaa

SEQ ID NO: 1325955 - RNA, 20 nt, Human
cuagccaaaccucaccaacu

SEQ ID NO: 1325956 - RNA, 21 nt, Human
cuagccaaaccucaccaacuc

SEQ ID NO: 1325957 - RNA, 22 nt, Human
cuagcauuguaaaauuauuuca

SEQ ID NO: 1325958 - RNA, 23 nt, Human
cuagcauuguaaaauuauuucau

SEQ ID NO: 1325959 - RNA, 19 nt, Human
cuagcauuucccaacacaa

SEQ ID NO: 1325960 - RNA, 16 nt, Human
cuagccaaaccaggac

SEQ ID NO: 1325961 - RNA, 20 nt, Human
cuagccaaaccaggacccug

SEQ ID NO: 1325962 - RNA, 13 nt, Human
cuagccaaaccuc

SEQ ID NO: 1325963 - RNA, 17 nt, Human
cuagccaaaccucacca

SEQ ID NO: 1325964 - RNA, 17 nt, Human
cggagucaaaaauuaaa

SEQ ID NO: 1325965 - RNA, 22 nt, Human
cggagguugggugggccggcuu

SEQ ID NO: 1325966 - RNA, 16 nt, Human
cggagguguggagccg

SEQ ID NO: 1325967 - RNA, 18 nt, Human
cggaggggccuggcagcc

SEQ ID NO: 1325968 - RNA, 17 nt, Human
cggcucacugcauccuc

SEQ ID NO: 1325969 - RNA, 17 nt, Human
cggcggccccuagcgcu

SEQ ID NO: 1325970 - RNA, 23 nt, Human
cggcuccucgagaucccaacacu

SEQ ID NO: 1325971 - RNA, 21 nt, Human
cggcucacugcauccuccgcc

SEQ ID NO: 1325972 - RNA, 13 nt, Human
cggcuccucaggg

SEQ ID NO: 1325973 - RNA, 14 nt, Human
cggcuccucaggga

SEQ ID NO: 1325974 - RNA, 20 nt, Human
cggcuccucagggacucagg

SEQ ID NO: 1325975 - RNA, 11 nt, Human
cggcuccuggu

SEQ ID NO: 1325976 - RNA, 19 nt, Human
cggcuccuggucaccuagg

SEQ ID NO: 1325977 - RNA, 13 nt, Human
cggcuccugguca

SEQ ID NO: 1325978 - RNA, 16 nt, Human
cggcucggaggaagcc

SEQ ID NO: 1325979 - RNA, 20 nt, Human
cggcucggaggaagccccca

SEQ ID NO: 1325980 - RNA, 11 nt, Human
cggagccacuc

SEQ ID NO: 1325981 - RNA, 13 nt, Human
cggagccacuccu

SEQ ID NO: 1325982 - RNA, 17 nt, Human
cggagccacuccucuga

SEQ ID NO: 1325983 - RNA, 18 nt, Human
cggagccacuccucugac

SEQ ID NO: 1325984 - RNA, 21 nt, Human
cggagccacuccucugacuca

SEQ ID NO: 1325985 - RNA, 15 nt, Human
cgccggaucugaggg

SEQ ID NO: 1325986 - RNA, 12 nt, Human
cgccgccucuuu

SEQ ID NO: 1325987 - RNA, 15 nt, Human
cgccgucuccagggg

SEQ ID NO: 1325988 - RNA, 19 nt, Human
cgcaggcuggcccugcccu

SEQ ID NO: 1325989 - RNA, 20 nt, Human
cgcaggcuggcccugcccug

SEQ ID NO: 1325990 - RNA, 14 nt, Human
cgcaggcuggcccu

SEQ ID NO: 1325991 - RNA, 15 nt, Human
cgcaggcuggcccug

SEQ ID NO: 1325992 - RNA, 17 nt, Human
cgcaggcuggcccugcc

SEQ ID NO: 1325993 - RNA, 18 nt, Human
cgcaggcuggcccugccc

SEQ ID NO: 1325994 - RNA, 21 nt, Human
cgcaggcuggcccugcccugg

SEQ ID NO: 1325995 - RNA, 14 nt, Human
cgaguggagucugc

SEQ ID NO: 1325996 - RNA, 19 nt, Human
cgaguggagucugccaccc

SEQ ID NO: 1325997 - RNA, 18 nt, Human
cgaguggagucugccacc

SEQ ID NO: 1325998 - RNA, 16 nt, Human
cgaccugccucggccu

SEQ ID NO: 1325999 - RNA, 13 nt, Human
cgaccaucugauu

SEQ ID NO: 1326000 - RNA, 13 nt, Human
cgaccgccccagu

SEQ ID NO: 1326001 - RNA, 13 nt, Human
cgaccgcccccuc

SEQ ID NO: 1326002 - RNA, 13 nt, Human
ccuuuuucauuua

SEQ ID NO: 1326003 - RNA, 21 nt, Human
ccuuuuggguuucugcccugc

SEQ ID NO: 1326004 - RNA, 12 nt, Human
ccuuuugucucu

SEQ ID NO: 1326005 - RNA, 15 nt, Human
ccuuuuggguuucug

SEQ ID NO: 1326006 - RNA, 18 nt, Human
ccuuuuucugcacuauau

SEQ ID NO: 1326007 - RNA, 21 nt, Human
ccuuuuucugcacuauaugca

SEQ ID NO: 1326008 - RNA, 17 nt, Human
ccuuuuucugcacuaua

SEQ ID NO: 1326009 - RNA, 15 nt, Human
ccuuuuucugcacua

SEQ ID NO: 1326010 - RNA, 14 nt, Human
ccuuuuucugcacu

SEQ ID NO: 1326011 - RNA, 13 nt, Human
ccuuuuuccucuc

SEQ ID NO: 1326012 - RNA, 15 nt, Human
ccuuuuuccucucca

SEQ ID NO: 1326013 - RNA, 16 nt, Human
ccuuuuuccucuccac

SEQ ID NO: 1326014 - RNA, 17 nt, Human
ccuuuuuccucuccaca

SEQ ID NO: 1326015 - RNA, 14 nt, Human
ccuuuuucuccagc

SEQ ID NO: 1326016 - RNA, 16 nt, Human
ccuuuuucuccagcug

SEQ ID NO: 1326017 - RNA, 12 nt, Human
cgaccaccugcc

SEQ ID NO: 1326018 - RNA, 14 nt, Human
cgaccaccugccca

SEQ ID NO: 1326019 - RNA, 21 nt, Human
cgacaguggaugcugggucca

SEQ ID NO: 1326020 - RNA, 22 nt, Human
ccuuuuuuaggaagcaagcuua

SEQ ID NO: 1326021 - RNA, 16 nt, Human
cgacagugagacucug

SEQ ID NO: 1326022 - RNA, 15 nt, Human
cgacagugagacucu

SEQ ID NO: 1326023 - RNA, 16 nt, Human
ccuuggacacgcucag

SEQ ID NO: 1326024 - RNA, 16 nt, Human
ccuuuagaucucugaa

SEQ ID NO: 1326025 - RNA, 23 nt, Human
ccuuuccaccacagccagcaccu

SEQ ID NO: 1326026 - RNA, 13 nt, Human
ccuuuagguucuu

SEQ ID NO: 1326027 - RNA, 12 nt, Human
ccuugcuuguua

SEQ ID NO: 1326028 - RNA, 18 nt, Human
ccuuggacaacuuuucuc

SEQ ID NO: 1326029 - RNA, 16 nt, Human
ccuuggacauccuccu

SEQ ID NO: 1326030 - RNA, 17 nt, Human
ccuuggacauccuccuc

SEQ ID NO: 1326031 - RNA, 17 nt, Human
ccuuuagaucucugaag

SEQ ID NO: 1326032 - RNA, 20 nt, Human
ccuuuccauaaauccuugau

SEQ ID NO: 1326033 - RNA, 22 nt, Human
ccuuuccauaaauccuugauga

SEQ ID NO: 1326034 - RNA, 18 nt, Human
ccuuuccauccauggcca

SEQ ID NO: 1326035 - RNA, 11 nt, Human
ccuuucccacc

SEQ ID NO: 1326036 - RNA, 12 nt, Human
ccuuucccaccc

SEQ ID NO: 1326037 - RNA, 18 nt, Human
ccuuucccaccccaaccu

SEQ ID NO: 1326038 - RNA, 22 nt, Human
ccuuucccaccccaaccugcuc

SEQ ID NO: 1326039 - RNA, 19 nt, Human
ccuuucccaggugcuacac

SEQ ID NO: 1326040 - RNA, 12 nt, Human
ccuuucccuaag

SEQ ID NO: 1326041 - RNA, 12 nt, Human
ccuuuucugacc

SEQ ID NO: 1326042 - RNA, 18 nt, Human
ccuuuucugaccaaagag

SEQ ID NO: 1326043 - RNA, 13 nt, Human
ccuuuucugacca

SEQ ID NO: 1326044 - RNA, 14 nt, Human
ccuuuucuguucua

SEQ ID NO: 1326045 - RNA, 21 nt, Human
ccuuuugaaauuaaccucuca

SEQ ID NO: 1326046 - RNA, 15 nt, Human
ccuugccucaaugcc

SEQ ID NO: 1326047 - RNA, 16 nt, Human
ccuugccucaaugcca

SEQ ID NO: 1326048 - RNA, 19 nt, Human
ccuugccucaaugccagua

SEQ ID NO: 1326049 - RNA, 20 nt, Human
ccuugccucaaugccaguaa

SEQ ID NO: 1326050 - RNA, 17 nt, Human
ccuggccuccugccucu

SEQ ID NO: 1326051 - RNA, 18 nt, Human
ccuggccuccugccucua

SEQ ID NO: 1326052 - RNA, 21 nt, Human
ccuggccuccugccucuacug

SEQ ID NO: 1326053 - RNA, 14 nt, Human
ccuucugagcuccu

SEQ ID NO: 1326054 - RNA, 15 nt, Human
ccuucugagcuccug

SEQ ID NO: 1326055 - RNA, 17 nt, Human
ccuucugagcuccuguc

SEQ ID NO: 1326056 - RNA, 21 nt, Human
ccuucugagcuccuguccccu

SEQ ID NO: 1326057 - RNA, 10 nt, Human
ccuucuggcc

SEQ ID NO: 1326058 - RNA, 22 nt, Human
ccuucugagcuccuguccccug

SEQ ID NO: 1326059 - RNA, 12 nt, Human
ccuucugcucag

SEQ ID NO: 1326060 - RNA, 17 nt, Human
ccuucugcucagcucug

SEQ ID NO: 1326061 - RNA, 11 nt, Human
ccuucugcugc

SEQ ID NO: 1326062 - RNA, 16 nt, Human
ccuucuggccuuguaa

SEQ ID NO: 1326063 - RNA, 20 nt, Human
ccuucugggcagaccuugac

SEQ ID NO: 1326064 - RNA, 18 nt, Human
ccagagugcugaaggaau

SEQ ID NO: 1326065 - RNA, 15 nt, Human
ccagauccuggaaau

SEQ ID NO: 1326066 - RNA, 13 nt, Human
ccagauccagccu

SEQ ID NO: 1326067 - RNA, 14 nt, Human
ccagauccagccug

SEQ ID NO: 1326068 - RNA, 15 nt, Human
ccagauccagccugg

SEQ ID NO: 1326069 - RNA, 16 nt, Human
ccagauccagccuggg

SEQ ID NO: 1326070 - RNA, 16 nt, Human
ccagagucccugccug

SEQ ID NO: 1326071 - RNA, 17 nt, Human
ccagagucccugccugg

SEQ ID NO: 1326072 - RNA, 18 nt, Human
ccagagucccugccugga

SEQ ID NO: 1326073 - RNA, 19 nt, Human
ccagagucccugccuggac

SEQ ID NO: 1326074 - RNA, 22 nt, Human
ccagagucccugccuggaccag

SEQ ID NO: 1326075 - RNA, 20 nt, Human
ccaggaaagcgccuccaacc

SEQ ID NO: 1326076 - RNA, 20 nt, Human
ccagcuuauagucauauaua

SEQ ID NO: 1326077 - RNA, 19 nt, Human
ccaggaacagcaaaugcaa

SEQ ID NO: 1326078 - RNA, 19 nt, Human
ccaggaagaucccccagaa

SEQ ID NO: 1326079 - RNA, 18 nt, Human
ccaggaagaucccccaga

SEQ ID NO: 1326080 - RNA, 17 nt, Human
ccaggaagaucccccag

SEQ ID NO: 1326081 - RNA, 14 nt, Human
ccaggaacugggcc

SEQ ID NO: 1326082 - RNA, 10 nt, Human
ccaggaagcc

SEQ ID NO: 1326083 - RNA, 15 nt, Human
ccagccccucugguc

SEQ ID NO: 1326084 - RNA, 17 nt, Human
ccagccccucuggucgc

SEQ ID NO: 1326085 - RNA, 22 nt, Human
ccagccccucuggucgcuccug

SEQ ID NO: 1326086 - RNA, 23 nt, Human
ccagccccucuggucgcuccugc

SEQ ID NO: 1326087 - RNA, 13 nt, Human
ccagccccucuug

SEQ ID NO: 1326088 - RNA, 18 nt, Human
ccagccccucuuggagaa

SEQ ID NO: 1326089 - RNA, 21 nt, Human
ccagccccucuuggagaaguc

SEQ ID NO: 1326090 - RNA, 20 nt, Human
ccagccccucuuggagaagu

SEQ ID NO: 1326091 - RNA, 16 nt, Human
ccagcuacccuuuuuc

SEQ ID NO: 1326092 - RNA, 21 nt, Human
ccagcuacccuuuuucuccag

SEQ ID NO: 1326093 - RNA, 22 nt, Human
ccagcuacccuuuuucuccagc

SEQ ID NO: 1326094 - RNA, 22 nt, Human
ccagcucaauggacuggaaggg

SEQ ID NO: 1326095 - RNA, 23 nt, Human
ccaggaaacucugcauucuagua

SEQ ID NO: 1326096 - RNA, 18 nt, Human
ccagcagauuuccagccu

SEQ ID NO: 1326097 - RNA, 20 nt, Human
ccagcagcaccugcccuacc

SEQ ID NO: 1326098 - RNA, 14 nt, Human
ccagcagcaccugc

SEQ ID NO: 1326099 - RNA, 10 nt, Human
ccagcagcug

SEQ ID NO: 1326100 - RNA, 20 nt, Human
ccagcagcugccaggagcac

SEQ ID NO: 1326101 - RNA, 22 nt, Human
ccagcagcuuuagaaucccagc

SEQ ID NO: 1326102 - RNA, 23 nt, Human
ccagcagcugccaggagcacggc

SEQ ID NO: 1326103 - RNA, 16 nt, Human
ccaggcucggccugcc

SEQ ID NO: 1326104 - RNA, 17 nt, Human
ccaggcucggccugccc

SEQ ID NO: 1326105 - RNA, 18 nt, Human
ccaggcucguggacugag

SEQ ID NO: 1326106 - RNA, 20 nt, Human
ccaggcucguggacugagug

SEQ ID NO: 1326107 - RNA, 21 nt, Human
ccaggcucguggacugagugg

SEQ ID NO: 1326108 - RNA, 23 nt, Human
ccaggcucucgcacaccucugca

SEQ ID NO: 1326109 - RNA, 23 nt, Human
ccaggcucguggacugaguggga

SEQ ID NO: 1326110 - RNA, 15 nt, Human
ccagggcugggagga

SEQ ID NO: 1326111 - RNA, 18 nt, Human
ccagggcugggaggaagg

SEQ ID NO: 1326112 - RNA, 19 nt, Human
ccagggcugggaggaagga

SEQ ID NO: 1326113 - RNA, 21 nt, Human
ccagggcugggaggaaggacu

SEQ ID NO: 1326114 - RNA, 19 nt, Human
ccagggcuguaacugccag

SEQ ID NO: 1326115 - RNA, 20 nt, Human
ccagggcuguaacugccagg

SEQ ID NO: 1326116 - RNA, 22 nt, Human
ccagggcuguaacugccaggcu

SEQ ID NO: 1326117 - RNA, 13 nt, Human
ccagggguuucuc

SEQ ID NO: 1326118 - RNA, 16 nt, Human
ccaggcacugcugccc

SEQ ID NO: 1326119 - RNA, 18 nt, Human
ccaggcacugcugcccag

SEQ ID NO: 1326120 - RNA, 12 nt, Human
ccaggcacugca

SEQ ID NO: 1326121 - RNA, 13 nt, Human
ccaggcacugcaa

SEQ ID NO: 1326122 - RNA, 16 nt, Human
ccaggcacugcuaggc

SEQ ID NO: 1326123 - RNA, 15 nt, Human
ccaggcacugucuua

SEQ ID NO: 1326124 - RNA, 13 nt, Human
ccaggcagaucca

SEQ ID NO: 1326125 - RNA, 15 nt, Human
ccaggcagauccagg

SEQ ID NO: 1326126 - RNA, 16 nt, Human
ccaggcagauccagga

SEQ ID NO: 1326127 - RNA, 17 nt, Human
ccaggcagauccaggac

SEQ ID NO: 1326128 - RNA, 18 nt, Human
ccaggcagauccaggacu

SEQ ID NO: 1326129 - RNA, 19 nt, Human
ccaggcagauccaggacua

SEQ ID NO: 1326130 - RNA, 17 nt, Human
ccaggcaccaaaagaag

SEQ ID NO: 1326131 - RNA, 17 nt, Human
ccaggcaccaggacuag

SEQ ID NO: 1326132 - RNA, 15 nt, Human
ccaggcaccaggcag

SEQ ID NO: 1326133 - RNA, 16 nt, Human
ccagggucccucugug

SEQ ID NO: 1326134 - RNA, 17 nt, Human
ccagggucccucugugu

SEQ ID NO: 1326135 - RNA, 18 nt, Human
ccagggucccucugugua

SEQ ID NO: 1326136 - RNA, 17 nt, Human
ccaggguaugaagagug

SEQ ID NO: 1326137 - RNA, 17 nt, Human
ccaguucauugcacuuu

SEQ ID NO: 1326138 - RNA, 18 nt, Human
ccaguucauugcacuuug

SEQ ID NO: 1326139 - RNA, 13 nt, Human
ccaguucacccug

SEQ ID NO: 1326140 - RNA, 21 nt, Human
ccaguugucccgauuguaacu

SEQ ID NO: 1326141 - RNA, 22 nt, Human
ccaguugucccgauuguaacuc

SEQ ID NO: 1326142 - RNA, 12 nt, Human
ccaguuguccuc

SEQ ID NO: 1326143 - RNA, 13 nt, Human
ccaguuguccucc

SEQ ID NO: 1326144 - RNA, 14 nt, Human
ccaguuguccuccu

SEQ ID NO: 1326145 - RNA, 15 nt, Human
ccaguuguccuccuu

SEQ ID NO: 1326146 - RNA, 21 nt, Human
ccaguuguuagauuaagaaau

SEQ ID NO: 1326147 - RNA, 16 nt, Human
ccaguuguccuccuuc

SEQ ID NO: 1326148 - RNA, 16 nt, Human
ccaguuuccuugggag

SEQ ID NO: 1326149 - RNA, 17 nt, Human
ccaguuucuaaacugga

SEQ ID NO: 1326150 - RNA, 19 nt, Human
ccaguuucuaaacuggaga

SEQ ID NO: 1326151 - RNA, 20 nt, Human
ccaguuucuaaacuggagac

SEQ ID NO: 1326152 - RNA, 21 nt, Human
ccaguuucuaaacuggagacu

SEQ ID NO: 1326153 - RNA, 22 nt, Human
ccaugacaacuucuaauugcca

SEQ ID NO: 1326154 - RNA, 14 nt, Human
ccaugacaucaaga

SEQ ID NO: 1326155 - RNA, 15 nt, Human
ccaugacccugccuc

SEQ ID NO: 1326156 - RNA, 21 nt, Human
ccaugacccugccucucccag

SEQ ID NO: 1326157 - RNA, 22 nt, Human
ccauggugcuaggaagaggagu

SEQ ID NO: 1326158 - RNA, 18 nt, Human
ccauggugugaucgucug

SEQ ID NO: 1326159 - RNA, 19 nt, Human
ccauggugugaucgucuga

SEQ ID NO: 1326160 - RNA, 17 nt, Human
ccauggugcuaggaaga

SEQ ID NO: 1326161 - RNA, 20 nt, Human
ccaugguuaagaguccaaga

SEQ ID NO: 1326162 - RNA, 11 nt, Human
ccauguaacug

SEQ ID NO: 1326163 - RNA, 14 nt, Human
ccauguaacugccu

SEQ ID NO: 1326164 - RNA, 17 nt, Human
ccauguaacugccuaga

SEQ ID NO: 1326165 - RNA, 18 nt, Human
ccauguaacugccuagaa

SEQ ID NO: 1326166 - RNA, 19 nt, Human
ccauguaacugccuagaaa

SEQ ID NO: 1326167 - RNA, 12 nt, Human
ccaugagcuccu

SEQ ID NO: 1326168 - RNA, 16 nt, Human
ccaugacccugccucu

SEQ ID NO: 1326169 - RNA, 17 nt, Human
ccaugacccugccucuc

SEQ ID NO: 1326170 - RNA, 18 nt, Human
ccaugacccugccucucc

SEQ ID NO: 1326171 - RNA, 19 nt, Human
ccaugacccugccucuccc

SEQ ID NO: 1326172 - RNA, 20 nt, Human
ccaugacccugccucuccca

SEQ ID NO: 1326173 - RNA, 17 nt, Human
ccaugucaagauucagc

SEQ ID NO: 1326174 - RNA, 19 nt, Human
ccaugucaagauucagcua

SEQ ID NO: 1326175 - RNA, 13 nt, Human
ccauguccaaaga

SEQ ID NO: 1326176 - RNA, 14 nt, Human
ccauguccaaagag

SEQ ID NO: 1326177 - RNA, 17 nt, Human
ccauguccaaagaggcu

SEQ ID NO: 1326178 - RNA, 15 nt, Human
ccaugucaagauuca

SEQ ID NO: 1326179 - RNA, 16 nt, Human
ccaugucaaacaaaua

SEQ ID NO: 1326180 - RNA, 20 nt, Human
ccauguaacugccuagaaac

SEQ ID NO: 1326181 - RNA, 20 nt, Human
ccauguccaaagaggcugcc

SEQ ID NO: 1326182 - RNA, 18 nt, Human
ccauguccaaagaggcug

SEQ ID NO: 1326183 - RNA, 19 nt, Human
ccauguccaaagaggcugc

SEQ ID NO: 1326184 - RNA, 14 nt, Human
cccauccuagaggc

SEQ ID NO: 1326185 - RNA, 19 nt, Human
cccaggaaaggcaggauug

SEQ ID NO: 1326186 - RNA, 16 nt, Human
cccaggaaaggcccag

SEQ ID NO: 1326187 - RNA, 15 nt, Human
cccagcuugaaaccu

SEQ ID NO: 1326188 - RNA, 19 nt, Human
cccaggcuggagugcagug

SEQ ID NO: 1326189 - RNA, 20 nt, Human
cccauauuuguacaccaaua

SEQ ID NO: 1326190 - RNA, 15 nt, Human
cccauauuguaaaac

SEQ ID NO: 1326191 - RNA, 18 nt, Human
cccauauuguaaaacagg

SEQ ID NO: 1326192 - RNA, 19 nt, Human
cccauauuguaaaacaggu

SEQ ID NO: 1326193 - RNA, 20 nt, Human
cccauaugcuaccaccagcu

SEQ ID NO: 1326194 - RNA, 21 nt, Human
cccauaugcuaccaccagcug

SEQ ID NO: 1326195 - RNA, 13 nt, Human
cccagggcccaga

SEQ ID NO: 1326196 - RNA, 14 nt, Human
cccagggcccagag

SEQ ID NO: 1326197 - RNA, 15 nt, Human
cccagggcccagagc

SEQ ID NO: 1326198 - RNA, 16 nt, Human
cccagggcccagagcc

SEQ ID NO: 1326199 - RNA, 17 nt, Human
cccagggcccagagccc

SEQ ID NO: 1326200 - RNA, 19 nt, Human
cccagggcccagagcccag

SEQ ID NO: 1326201 - RNA, 20 nt, Human
cccagggcccagagcccagc

SEQ ID NO: 1326202 - RNA, 22 nt, Human
cccagggcccagagcccagcuc

SEQ ID NO: 1326203 - RNA, 20 nt, Human
cccacccucguggacaccug

SEQ ID NO: 1326204 - RNA, 21 nt, Human
cccacccucggggaugugucc

SEQ ID NO: 1326205 - RNA, 14 nt, Human
cccacccccggcag

SEQ ID NO: 1326206 - RNA, 23 nt, Human
cccacccucguggacaccugccc

SEQ ID NO: 1326207 - RNA, 22 nt, Human
cccacccucguggacaccugcc

SEQ ID NO: 1326208 - RNA, 13 nt, Human
cccacccucuucc

SEQ ID NO: 1326209 - RNA, 15 nt, Human
cccacccucuuccua

SEQ ID NO: 1326210 - RNA, 13 nt, Human
cccacccccagcu

SEQ ID NO: 1326211 - RNA, 15 nt, Human
cccacuucagccucc

SEQ ID NO: 1326212 - RNA, 13 nt, Human
cccacuucagccu

SEQ ID NO: 1326213 - RNA, 16 nt, Human
cccacugugccucaga

SEQ ID NO: 1326214 - RNA, 15 nt, Human
cccacugugccucag

SEQ ID NO: 1326215 - RNA, 22 nt, Human
cccacugugccucagagaccag

SEQ ID NO: 1326216 - RNA, 14 nt, Human
cccacuuacauuua

SEQ ID NO: 1326217 - RNA, 14 nt, Human
cccacugccuuuga

SEQ ID NO: 1326218 - RNA, 16 nt, Human
cccacucccaggacca

SEQ ID NO: 1326219 - RNA, 13 nt, Human
cccacucccucac

SEQ ID NO: 1326220 - RNA, 14 nt, Human
cccacucccucaca

SEQ ID NO: 1326221 - RNA, 18 nt, Human
cccacuagacccacugga

SEQ ID NO: 1326222 - RNA, 13 nt, Human
cccacccuggccu

SEQ ID NO: 1326223 - RNA, 20 nt, Human
cccacccuggccuagaccag

SEQ ID NO: 1326224 - RNA, 15 nt, Human
cccacuagcucuugu

SEQ ID NO: 1326225 - RNA, 22 nt, Human
cccacuagcucuuguugagccg

SEQ ID NO: 1326226 - RNA, 14 nt, Human
cccacuccaucugg

SEQ ID NO: 1326227 - RNA, 18 nt, Human
cccacuccaucugguaga

SEQ ID NO: 1326228 - RNA, 19 nt, Human
cccacuccaucugguagaa

SEQ ID NO: 1326229 - RNA, 12 nt, Human
cccacucccaca

SEQ ID NO: 1326230 - RNA, 12 nt, Human
cccacuucugca

SEQ ID NO: 1326231 - RNA, 14 nt, Human
cccacuucugcacu

SEQ ID NO: 1326232 - RNA, 16 nt, Human
cccacuucugcacuug

SEQ ID NO: 1326233 - RNA, 18 nt, Human
ccccuuugcugacccucc

SEQ ID NO: 1326234 - RNA, 22 nt, Human
ccccuuuucggccccauguauc

SEQ ID NO: 1326235 - RNA, 12 nt, Human
ccccucugucuu

SEQ ID NO: 1326236 - RNA, 14 nt, Human
ccccucuguccagg

SEQ ID NO: 1326237 - RNA, 22 nt, Human
ccccucuguccaggcacugaga

SEQ ID NO: 1326238 - RNA, 11 nt, Human
ccccuugccug

SEQ ID NO: 1326239 - RNA, 16 nt, Human
ccccuugccugugcca

SEQ ID NO: 1326240 - RNA, 16 nt, Human
ccccuugggcccacac

SEQ ID NO: 1326241 - RNA, 18 nt, Human
ccccuugggcccacaccu

SEQ ID NO: 1326242 - RNA, 19 nt, Human
ccccuugggcccacaccuc

SEQ ID NO: 1326243 - RNA, 15 nt, Human
ccccuuguccuuucc

SEQ ID NO: 1326244 - RNA, 18 nt, Human
ccccuuguccuuucccuu

SEQ ID NO: 1326245 - RNA, 20 nt, Human
ccccuuuagaucucugaagc

SEQ ID NO: 1326246 - RNA, 15 nt, Human
ccccuuucacaggca

SEQ ID NO: 1326247 - RNA, 16 nt, Human
ccccuuucacaggcag

SEQ ID NO: 1326248 - RNA, 21 nt, Human
ccccuuucacaggcagccagu

SEQ ID NO: 1326249 - RNA, 19 nt, Human
ccccuuucacaggcagcca

SEQ ID NO: 1326250 - RNA, 13 nt, Human
ccccuuucccacc

SEQ ID NO: 1326251 - RNA, 14 nt, Human
ccccuuucccaccc

SEQ ID NO: 1326252 - RNA, 10 nt, Human
ccccuuuccu

SEQ ID NO: 1326253 - RNA, 22 nt, Human
ccccuuuccuggacacucagac

SEQ ID NO: 1326254 - RNA, 23 nt, Human
ccccuuuccuggacacucagacc

SEQ ID NO: 1326255 - RNA, 17 nt, Human
cccuauugguaaagaau

SEQ ID NO: 1326256 - RNA, 13 nt, Human
cccuauuaaccua

SEQ ID NO: 1326257 - RNA, 23 nt, Human
cccgggaggcagagguugcagug

SEQ ID NO: 1326258 - RNA, 13 nt, Human
cccggcuccuggu

SEQ ID NO: 1326259 - RNA, 15 nt, Human
cccggcuccugguca

SEQ ID NO: 1326260 - RNA, 18 nt, Human
cccggcuccuggucaccu

SEQ ID NO: 1326261 - RNA, 22 nt, Human
cccggcuccuggucaccuagga

SEQ ID NO: 1326262 - RNA, 16 nt, Human
cccggcugcagaggcc

SEQ ID NO: 1326263 - RNA, 21 nt, Human
cccggcugcagaggccagagg

SEQ ID NO: 1326264 - RNA, 14 nt, Human
cccgggagcucagg

SEQ ID NO: 1326265 - RNA, 19 nt, Human
ccccucuggcuccagcugg

SEQ ID NO: 1326266 - RNA, 12 nt, Human
ccccucuggucg

SEQ ID NO: 1326267 - RNA, 19 nt, Human
ccccucuggucgcuccugc

SEQ ID NO: 1326268 - RNA, 20 nt, Human
ccccucuggucgcuccugcc

SEQ ID NO: 1326269 - RNA, 23 nt, Human
ccccucuggucgcuccugcccac

SEQ ID NO: 1326270 - RNA, 12 nt, Human
ccccucugucca

SEQ ID NO: 1326271 - RNA, 16 nt, Human
ccccagagcccaggcu

SEQ ID NO: 1326272 - RNA, 13 nt, Human
ccccagaggcugg

SEQ ID NO: 1326273 - RNA, 23 nt, Human
ccccagacuuguuggcguaggcu

SEQ ID NO: 1326274 - RNA, 13 nt, Human
ccccagagccaca

SEQ ID NO: 1326275 - RNA, 14 nt, Human
ccccagagccacag

SEQ ID NO: 1326276 - RNA, 15 nt, Human
ccccagagccacagu

SEQ ID NO: 1326277 - RNA, 16 nt, Human
ccccagagccacaguu

SEQ ID NO: 1326278 - RNA, 13 nt, Human
ccccagagcccag

SEQ ID NO: 1326279 - RNA, 14 nt, Human
ccccagagcccagg

SEQ ID NO: 1326280 - RNA, 16 nt, Human
ccccagagcccccggg

SEQ ID NO: 1326281 - RNA, 14 nt, Human
ccccauuucugagg

SEQ ID NO: 1326282 - RNA, 19 nt, Human
ccccaucguugcccccauu

SEQ ID NO: 1326283 - RNA, 22 nt, Human
ccccaucguugcccccauuucu

SEQ ID NO: 1326284 - RNA, 13 nt, Human
ccccaucucaggc

SEQ ID NO: 1326285 - RNA, 14 nt, Human
ccccaucucaggcc

SEQ ID NO: 1326286 - RNA, 17 nt, Human
ccccaucucaggccaga

SEQ ID NO: 1326287 - RNA, 21 nt, Human
ccccaucucaugccccuggcu

SEQ ID NO: 1326288 - RNA, 23 nt, Human
ccccaucucaugccccuggcugg

SEQ ID NO: 1326289 - RNA, 23 nt, Human
cccauuguggucacaggaaguag

SEQ ID NO: 1326290 - RNA, 22 nt, Human
cccauuguggucacaggaagua

SEQ ID NO: 1326291 - RNA, 20 nt, Human
cccauuuaaauuuuuuuccu

SEQ ID NO: 1326292 - RNA, 19 nt, Human
ccccaaaagcgugagcuua

SEQ ID NO: 1326293 - RNA, 13 nt, Human
ccccaaaauuagc

SEQ ID NO: 1326294 - RNA, 18 nt, Human
ccccaaacaccuuccagc

SEQ ID NO: 1326295 - RNA, 22 nt, Human
ccccaaacaccuuccagcuccu

SEQ ID NO: 1326296 - RNA, 18 nt, Human
ccccggcagcagccccca

SEQ ID NO: 1326297 - RNA, 13 nt, Human
ccccggcagcagc

SEQ ID NO: 1326298 - RNA, 14 nt, Human
ccccgacuuuuguu

SEQ ID NO: 1326299 - RNA, 13 nt, Human
ccccgacuggggc

SEQ ID NO: 1326300 - RNA, 16 nt, Human
ccccgacuucauccca

SEQ ID NO: 1326301 - RNA, 23 nt, Human
ccugacccuccaccgcagaagga

SEQ ID NO: 1326302 - RNA, 13 nt, Human
ccugaccucaggc

SEQ ID NO: 1326303 - RNA, 14 nt, Human
ccucuugccacugc

SEQ ID NO: 1326304 - RNA, 19 nt, Human
ccucuugagcaguggcugg

SEQ ID NO: 1326305 - RNA, 24 nt, Human
ccucuugagcaguggcugguccag

SEQ ID NO: 1326306 - RNA, 14 nt, Human
ccugaccuggcccc

SEQ ID NO: 1326307 - RNA, 15 nt, Human
ccugaccuggccccc

SEQ ID NO: 1326308 - RNA, 13 nt, Human
ccugacugccaag

SEQ ID NO: 1326309 - RNA, 14 nt, Human
ccugacugccaagc

SEQ ID NO: 1326310 - RNA, 15 nt, Human
ccugacugccaagcc

SEQ ID NO: 1326311 - RNA, 16 nt, Human
ccugacugccaagcca

SEQ ID NO: 1326312 - RNA, 18 nt, Human
ccugacugccaagccaug

SEQ ID NO: 1326313 - RNA, 20 nt, Human
ccucuugaccaggcugccuc

SEQ ID NO: 1326314 - RNA, 14 nt, Human
ccucuugagcagug

SEQ ID NO: 1326315 - RNA, 15 nt, Human
ccucuugagcagugg

SEQ ID NO: 1326316 - RNA, 16 nt, Human
ccucuugagcaguggc

SEQ ID NO: 1326317 - RNA, 17 nt, Human
ccucuugagcaguggcu

SEQ ID NO: 1326318 - RNA, 21 nt, Human
ccugcagaaccggagagccag

SEQ ID NO: 1326319 - RNA, 22 nt, Human
ccugcagaaccggagagccagc

SEQ ID NO: 1326320 - RNA, 23 nt, Human
ccugcagaaccggagagccagcu

SEQ ID NO: 1326321 - RNA, 16 nt, Human
ccugcagaauuugggu

SEQ ID NO: 1326322 - RNA, 13 nt, Human
ccugcagacccug

SEQ ID NO: 1326323 - RNA, 14 nt, Human
ccugcagacccugc

SEQ ID NO: 1326324 - RNA, 15 nt, Human
ccugcagacccugcc

SEQ ID NO: 1326325 - RNA, 16 nt, Human
ccugcagacccugccc

SEQ ID NO: 1326326 - RNA, 17 nt, Human
ccugcagacccugcccu

SEQ ID NO: 1326327 - RNA, 18 nt, Human
ccugcagacccugcccuu

SEQ ID NO: 1326328 - RNA, 15 nt, Human
ccugcagacucacug

SEQ ID NO: 1326329 - RNA, 16 nt, Human
ccugcagacucacugu

SEQ ID NO: 1326330 - RNA, 12 nt, Human
ccugcagcuugu

SEQ ID NO: 1326331 - RNA, 16 nt, Human
ccugcagcuuguagcc

SEQ ID NO: 1326332 - RNA, 17 nt, Human
ccugcagcuuguagcca

SEQ ID NO: 1326333 - RNA, 18 nt, Human
ccugcagcuuguagccag

SEQ ID NO: 1326334 - RNA, 19 nt, Human
ccugcagcuuguagccagc

SEQ ID NO: 1326335 - RNA, 20 nt, Human
ccugcagcuuguagccagcc

SEQ ID NO: 1326336 - RNA, 21 nt, Human
ccugcagcuuguagccagccg

SEQ ID NO: 1326337 - RNA, 13 nt, Human
ccugcaggaagga

SEQ ID NO: 1326338 - RNA, 17 nt, Human
ccugaguacuccacacu

SEQ ID NO: 1326339 - RNA, 18 nt, Human
ccugaguacuccacacug

SEQ ID NO: 1326340 - RNA, 23 nt, Human
ccugaguacuccacacugcacaa

SEQ ID NO: 1326341 - RNA, 21 nt, Human
ccugaguacuccacacugcac

SEQ ID NO: 1326342 - RNA, 14 nt, Human
ccugagguuacugg

SEQ ID NO: 1326343 - RNA, 14 nt, Human
ccugagaaagcuca

SEQ ID NO: 1326344 - RNA, 17 nt, Human
ccugagaaagcucaaag

SEQ ID NO: 1326345 - RNA, 18 nt, Human
ccugagagauuuaacauu

SEQ ID NO: 1326346 - RNA, 14 nt, Human
ccugcaggaaggag

SEQ ID NO: 1326347 - RNA, 17 nt, Human
ccugcaggaaggagcug

SEQ ID NO: 1326348 - RNA, 19 nt, Human
ccugcaggaaggagcugcc

SEQ ID NO: 1326349 - RNA, 20 nt, Human
ccugcaggaaggagcugccu

SEQ ID NO: 1326350 - RNA, 23 nt, Human
ccugcaggaaggagcugccugga

SEQ ID NO: 1326351 - RNA, 21 nt, Human
ccugcaggaaggagcugccug

SEQ ID NO: 1326352 - RNA, 22 nt, Human
ccugcaggaaggagcugccugg

SEQ ID NO: 1326353 - RNA, 15 nt, Human
ccucucugcaggucc

SEQ ID NO: 1326354 - RNA, 17 nt, Human
ccucucugcagacuucc

SEQ ID NO: 1326355 - RNA, 21 nt, Human
ccucucugcagacuucccagc

SEQ ID NO: 1326356 - RNA, 13 nt, Human
ccucucugcaggu

SEQ ID NO: 1326357 - RNA, 22 nt, Human
ccucucugcaggucccuaauaa

SEQ ID NO: 1326358 - RNA, 21 nt, Human
ccucucugcaggucccuaaua

SEQ ID NO: 1326359 - RNA, 23 nt, Human
ccucucugcaggucccuaauaaa

SEQ ID NO: 1326360 - RNA, 12 nt, Human
ccucucugcccu

SEQ ID NO: 1326361 - RNA, 22 nt, Human
ccucucugcagacuucccagcu

SEQ ID NO: 1326362 - RNA, 23 nt, Human
ccucucugcagacuucccagcua

SEQ ID NO: 1326363 - RNA, 12 nt, Human
ccucugccuguc

SEQ ID NO: 1326364 - RNA, 15 nt, Human
ccucugcugauccuc

SEQ ID NO: 1326365 - RNA, 18 nt, Human
ccucugcugauccuccca

SEQ ID NO: 1326366 - RNA, 17 nt, Human
ccucugcugaccugcug

SEQ ID NO: 1326367 - RNA, 15 nt, Human
ccucugcuucucacg

SEQ ID NO: 1326368 - RNA, 14 nt, Human
ccucugcugcuguc

SEQ ID NO: 1326369 - RNA, 19 nt, Human
ccucugcugcugucccucc

SEQ ID NO: 1326370 - RNA, 20 nt, Human
ccucugcugcugucccuccc

SEQ ID NO: 1326371 - RNA, 18 nt, Human
ccucugcugaccugcuga

SEQ ID NO: 1326372 - RNA, 16 nt, Human
ccuggcacagggcagu

SEQ ID NO: 1326373 - RNA, 17 nt, Human
ccuggcacagggcagug

SEQ ID NO: 1326374 - RNA, 18 nt, Human
ccuggcacagggcagugg

SEQ ID NO: 1326375 - RNA, 18 nt, Human
ccuggaucagcguggccu

SEQ ID NO: 1326376 - RNA, 19 nt, Human
ccuggaucagcguggccuu

SEQ ID NO: 1326377 - RNA, 20 nt, Human
ccuggaucagcguggccuug

SEQ ID NO: 1326378 - RNA, 21 nt, Human
ccuggauccaucaggccacuu

SEQ ID NO: 1326379 - RNA, 17 nt, Human
ccuggaucagaacagga

SEQ ID NO: 1326380 - RNA, 14 nt, Human
ccuggaucagcgug

SEQ ID NO: 1326381 - RNA, 16 nt, Human
ccuggaucagcguggc

SEQ ID NO: 1326382 - RNA, 17 nt, Human
ccuggaucagcguggcc

SEQ ID NO: 1326383 - RNA, 14 nt, Human
ccuggaucucccug

SEQ ID NO: 1326384 - RNA, 16 nt, Human
ccuggaugacauuaaa

SEQ ID NO: 1326385 - RNA, 14 nt, Human
ccuggaugauacua

SEQ ID NO: 1326386 - RNA, 22 nt, Human
ccuggaguguaugacugcacau

SEQ ID NO: 1326387 - RNA, 19 nt, Human
ccuggaggggcuggggacu

SEQ ID NO: 1326388 - RNA, 22 nt, Human
ccuggagggggaauggcagcag

SEQ ID NO: 1326389 - RNA, 21 nt, Human
ccuggagggggaauggcagca

SEQ ID NO: 1326390 - RNA, 22 nt, Human
ccugccccaacuccuuccagcu

SEQ ID NO: 1326391 - RNA, 18 nt, Human
ccugcccagugcacuugc

SEQ ID NO: 1326392 - RNA, 22 nt, Human
ccugcccagugcacuugcugga

SEQ ID NO: 1326393 - RNA, 16 nt, Human
ccugcccaguugcacu

SEQ ID NO: 1326394 - RNA, 22 nt, Human
ccugcccaguugcacucaggug

SEQ ID NO: 1326395 - RNA, 16 nt, Human
ccugcccaugggagcu

SEQ ID NO: 1326396 - RNA, 14 nt, Human
ccugccccaacucc

SEQ ID NO: 1326397 - RNA, 15 nt, Human
ccugccccaacuccu

SEQ ID NO: 1326398 - RNA, 17 nt, Human
ccugccccaacuccuuc

SEQ ID NO: 1326399 - RNA, 21 nt, Human
ccugccccaacucuccccuga

SEQ ID NO: 1326400 - RNA, 12 nt, Human
ccuggaggaccu

SEQ ID NO: 1326401 - RNA, 13 nt, Human
ccuggaggaccug

SEQ ID NO: 1326402 - RNA, 14 nt, Human
ccuggaggaccuga

SEQ ID NO: 1326403 - RNA, 15 nt, Human
ccuggaggaccugag

SEQ ID NO: 1326404 - RNA, 16 nt, Human
ccuggaggaccugagc

SEQ ID NO: 1326405 - RNA, 17 nt, Human
ccuggaggaccugagcc

SEQ ID NO: 1326406 - RNA, 18 nt, Human
ccuggaggaccugagccu

SEQ ID NO: 1326407 - RNA, 19 nt, Human
ccuggaggaccugagccug

SEQ ID NO: 1326408 - RNA, 20 nt, Human
ccuggaggaccugagccugc

SEQ ID NO: 1326409 - RNA, 22 nt, Human
ccuggaggaccugagccugccg

SEQ ID NO: 1326410 - RNA, 21 nt, Human
ccuggaggaccugagccugcc

SEQ ID NO: 1326411 - RNA, 14 nt, Human
ccuggaggcacuga

SEQ ID NO: 1326412 - RNA, 22 nt, Human
ccuggaggcacugaagugcuua

SEQ ID NO: 1326413 - RNA, 12 nt, Human
ccuggaggccca

SEQ ID NO: 1326414 - RNA, 13 nt, Human
ccuggaggcccag

SEQ ID NO: 1326415 - RNA, 14 nt, Human
ccuggaggcccagu

SEQ ID NO: 1326416 - RNA, 16 nt, Human
ccuggaggcccaguuc

SEQ ID NO: 1326417 - RNA, 23 nt, Human
ccuggaggccccaacccuguccu

SEQ ID NO: 1326418 - RNA, 18 nt, Human
ccuggccgaguccaagcu

SEQ ID NO: 1326419 - RNA, 19 nt, Human
ccuggccgaguccaagcug

SEQ ID NO: 1326420 - RNA, 12 nt, Human
ccuggccgcccc

SEQ ID NO: 1326421 - RNA, 14 nt, Human
ccuggccgcccccu

SEQ ID NO: 1326422 - RNA, 13 nt, Human
ccuggcccugcuu

SEQ ID NO: 1326423 - RNA, 14 nt, Human
ccuggcccugcuuc

SEQ ID NO: 1326424 - RNA, 16 nt, Human
ccuggcccugcuuccu

SEQ ID NO: 1326425 - RNA, 17 nt, Human
ccuggcccugcuuccug

SEQ ID NO: 1326426 - RNA, 21 nt, Human
ccuggcccugcuuccugcuug

SEQ ID NO: 1326427 - RNA, 23 nt, Human
ccuggcccugcuuccugcuugcc

SEQ ID NO: 1326428 - RNA, 15 nt, Human
ccuggccgcccccug

SEQ ID NO: 1326429 - RNA, 20 nt, Human
ccuggccgcccccugccccc

SEQ ID NO: 1326430 - RNA, 14 nt, Human
ccuggccccucucc

SEQ ID NO: 1326431 - RNA, 15 nt, Human
ccuggccccucuccc

SEQ ID NO: 1326432 - RNA, 16 nt, Human
ccuggccccucucccu

SEQ ID NO: 1326433 - RNA, 20 nt, Human
ccuggccccucucccuuggg

SEQ ID NO: 1326434 - RNA, 17 nt, Human
ccuggccccucucccuu

SEQ ID NO: 1326435 - RNA, 17 nt, Human
cccuucuuuccacagaa

SEQ ID NO: 1326436 - RNA, 14 nt, Human
cccuucugcucagc

SEQ ID NO: 1326437 - RNA, 23 nt, Human
cccuucugcucagcucugggcca

SEQ ID NO: 1326438 - RNA, 12 nt, Human
cccuucuucccu

SEQ ID NO: 1326439 - RNA, 23 nt, Human
ccgaaucucuuuuugcuuucgaa

SEQ ID NO: 1326440 - RNA, 15 nt, Human
ccgaaugugucuuua

SEQ ID NO: 1326441 - RNA, 13 nt, Human
ccgaaugugucuu

SEQ ID NO: 1326442 - RNA, 14 nt, Human
ccgaaugugucuuu

SEQ ID NO: 1326443 - RNA, 16 nt, Human
ccgaccccaagaguuu

SEQ ID NO: 1326444 - RNA, 13 nt, Human
ccgccacuggggc

SEQ ID NO: 1326445 - RNA, 14 nt, Human
ccgccacuggggcu

SEQ ID NO: 1326446 - RNA, 20 nt, Human
ccgccacuggggcucagagc

SEQ ID NO: 1326447 - RNA, 16 nt, Human
ccgccacuggggcuca

SEQ ID NO: 1326448 - RNA, 13 nt, Human
ccgccagcucugu

SEQ ID NO: 1326449 - RNA, 14 nt, Human
ccgccagcucuguu

SEQ ID NO: 1326450 - RNA, 15 nt, Human
ccgccagcucuguuc

SEQ ID NO: 1326451 - RNA, 20 nt, Human
ccgcccccagcccccuccug

SEQ ID NO: 1326452 - RNA, 14 nt, Human
ccgcccccagguag

SEQ ID NO: 1326453 - RNA, 12 nt, Human
ccgcccccuccu

SEQ ID NO: 1326454 - RNA, 19 nt, Human
cccugugccuccucccucc

SEQ ID NO: 1326455 - RNA, 15 nt, Human
cccugugccuuguca

SEQ ID NO: 1326456 - RNA, 20 nt, Human
cccugugccuugucacgcca

SEQ ID NO: 1326457 - RNA, 22 nt, Human
cccugugccuugucacgccaga

SEQ ID NO: 1326458 - RNA, 12 nt, Human
cccugugccccc

SEQ ID NO: 1326459 - RNA, 19 nt, Human
cccugugcccccagggucc

SEQ ID NO: 1326460 - RNA, 13 nt, Human
cccugugccccca

SEQ ID NO: 1326461 - RNA, 17 nt, Human
cccugugccuccucccu

SEQ ID NO: 1326462 - RNA, 17 nt, Human
cccucacccauccuaga

SEQ ID NO: 1326463 - RNA, 13 nt, Human
cccucacccaucc

SEQ ID NO: 1326464 - RNA, 11 nt, Human
cccucacccau

SEQ ID NO: 1326465 - RNA, 18 nt, Human
cccucacaguauugcuca

SEQ ID NO: 1326466 - RNA, 20 nt, Human
cccuauuuagaugauaaaga

SEQ ID NO: 1326467 - RNA, 15 nt, Human
cccucacccuggggc

SEQ ID NO: 1326468 - RNA, 13 nt, Human
cccucacccugcc

SEQ ID NO: 1326469 - RNA, 16 nt, Human
cccucacccugccuua

SEQ ID NO: 1326470 - RNA, 12 nt, Human
cccuggcagaga

SEQ ID NO: 1326471 - RNA, 21 nt, Human
cccuggcagagaugccucccu

SEQ ID NO: 1326472 - RNA, 22 nt, Human
cccuggcagagaugccucccug

SEQ ID NO: 1326473 - RNA, 20 nt, Human
cccuggcaugucaacagcgu

SEQ ID NO: 1326474 - RNA, 9 nt, Human
cccuggccc

SEQ ID NO: 1326475 - RNA, 13 nt, Human
cccuggccccagg

SEQ ID NO: 1326476 - RNA, 14 nt, Human
cccuggccccagga

SEQ ID NO: 1326477 - RNA, 13 nt, Human
cccuggcccccuc

SEQ ID NO: 1326478 - RNA, 21 nt, Human
cccuggcccccucccuggaug

SEQ ID NO: 1326479 - RNA, 20 nt, Human
cccuggcccccucccuggau

SEQ ID NO: 1326480 - RNA, 11 nt, Human
cccuggccccu

SEQ ID NO: 1326481 - RNA, 18 nt, Human
cccuggccccucucccuu

SEQ ID NO: 1326482 - RNA, 17 nt, Human
cccuggccccucucccu

SEQ ID NO: 1326483 - RNA, 17 nt, Human
cccuggcucccacaggc

SEQ ID NO: 1326484 - RNA, 19 nt, Human
cccuggcucccacaggccc

SEQ ID NO: 1326485 - RNA, 23 nt, Human
cccuggcugggacguggcucagc

SEQ ID NO: 1326486 - RNA, 17 nt, Human
cccuggcuuuucacugc

SEQ ID NO: 1326487 - RNA, 23 nt, Human
cccuggcuuucauuuucucucag

SEQ ID NO: 1326488 - RNA, 24 nt, Human
cccuggcuuucauuuucucucagg

SEQ ID NO: 1326489 - RNA, 13 nt, Human
cccuggcuuuuca

SEQ ID NO: 1326490 - RNA, 10 nt, Human
cccuggcuuu

SEQ ID NO: 1326491 - RNA, 23 nt, Human
ccuaauaaagcuguguggcaguc

SEQ ID NO: 1326492 - RNA, 16 nt, Human
ccuaauaaaguucugu

SEQ ID NO: 1326493 - RNA, 21 nt, Human
ccuaauaaaguucuguacuca

SEQ ID NO: 1326494 - RNA, 20 nt, Human
ccuaauaauaucccacuggg

SEQ ID NO: 1326495 - RNA, 19 nt, Human
ccuaauaauaucccacugg

SEQ ID NO: 1326496 - RNA, 13 nt, Human
ccuaauccaggca

SEQ ID NO: 1326497 - RNA, 14 nt, Human
ccuaauccaggcag

SEQ ID NO: 1326498 - RNA, 15 nt, Human
ccuaauccaggcaga

SEQ ID NO: 1326499 - RNA, 21 nt, Human
ccuagagucccagguuggcuc

SEQ ID NO: 1326500 - RNA, 14 nt, Human
ccuaauaaagcugu

SEQ ID NO: 1326501 - RNA, 23 nt, Human
ccuaagggucgaaagcucuagaa

SEQ ID NO: 1326502 - RNA, 22 nt, Human
ccuaagggucgaaagcucuaga

SEQ ID NO: 1326503 - RNA, 19 nt, Human
ccuaagcuggagugcagug

SEQ ID NO: 1326504 - RNA, 17 nt, Human
ccuaagccagcugcccc

SEQ ID NO: 1326505 - RNA, 18 nt, Human
ccuaagggauccugccug

SEQ ID NO: 1326506 - RNA, 19 nt, Human
ccuaagggucgaaagcucu

SEQ ID NO: 1326507 - RNA, 21 nt, Human
ccuaagggucgaaagcucuag

SEQ ID NO: 1326508 - RNA, 18 nt, Human
ccuaagcuggagugcagu

SEQ ID NO: 1326509 - RNA, 18 nt, Human
ccuaagccagcugccccc

SEQ ID NO: 1326510 - RNA, 13 nt, Human
ccuaagcaucuaa

SEQ ID NO: 1326511 - RNA, 14 nt, Human
ccuaagccagcugc

SEQ ID NO: 1326512 - RNA, 16 nt, Human
ccuaagccagcugccc

SEQ ID NO: 1326513 - RNA, 23 nt, Human
ccuaagcagaaagugccuuucag

SEQ ID NO: 1326514 - RNA, 12 nt, Human
ccuaagcaucua

SEQ ID NO: 1326515 - RNA, 16 nt, Human
ccuaagcaucuaaguu

SEQ ID NO: 1326516 - RNA, 18 nt, Human
ccgucucugguuccuccc

SEQ ID NO: 1326517 - RNA, 16 nt, Human
ccgucuggcccaccag

SEQ ID NO: 1326518 - RNA, 17 nt, Human
ccgucuggcccaccagg

SEQ ID NO: 1326519 - RNA, 18 nt, Human
ccgucuggcccaccaggg

SEQ ID NO: 1326520 - RNA, 19 nt, Human
ccuaagaggcugcccuccu

SEQ ID NO: 1326521 - RNA, 14 nt, Human
ccuaagcagaaagu

SEQ ID NO: 1326522 - RNA, 15 nt, Human
ccuaagcagaaagug

SEQ ID NO: 1326523 - RNA, 17 nt, Human
ccuaagcagaaagugcc

SEQ ID NO: 1326524 - RNA, 19 nt, Human
ccuaagcagaaagugccuu

SEQ ID NO: 1326525 - RNA, 20 nt, Human
ccuaagcagaaagugccuuu

SEQ ID NO: 1326526 - RNA, 16 nt, Human
ccguagguuauuuuca

SEQ ID NO: 1326527 - RNA, 19 nt, Human
ccggcuaauuuuuguauuu

SEQ ID NO: 1326528 - RNA, 17 nt, Human
ccggcuaugggggcacu

SEQ ID NO: 1326529 - RNA, 22 nt, Human
ccggcuaugggggcacugagga

SEQ ID NO: 1326530 - RNA, 23 nt, Human
ccggcuaugggggcacugaggac

SEQ ID NO: 1326531 - RNA, 15 nt, Human
ccggcuaauuuuugu

SEQ ID NO: 1326532 - RNA, 18 nt, Human
ccggcuaauuuuuguaau

SEQ ID NO: 1326533 - RNA, 22 nt, Human
ccgucaaaacagauuguuugca

SEQ ID NO: 1326534 - RNA, 23 nt, Human
ccgucaagagugaauucccucac

SEQ ID NO: 1326535 - RNA, 22 nt, Human
ccgucaagagugaauucccuca

SEQ ID NO: 1326536 - RNA, 19 nt, Human
ccgucaccacgacuggcca

SEQ ID NO: 1326537 - RNA, 20 nt, Human
ccgucaccacgacuggccag

SEQ ID NO: 1326538 - RNA, 21 nt, Human
ccgucaccacgacuggccagg

SEQ ID NO: 1326539 - RNA, 17 nt, Human
ccgucaccccuguuucu

SEQ ID NO: 1326540 - RNA, 12 nt, Human
ccgucagugcug

SEQ ID NO: 1326541 - RNA, 16 nt, Human
ccguccaggagccugg

SEQ ID NO: 1326542 - RNA, 18 nt, Human
ccguccaggagccugugc

SEQ ID NO: 1326543 - RNA, 21 nt, Human
ccgucucaguguugagccuuu

SEQ ID NO: 1326544 - RNA, 20 nt, Human
ccgucuccaggggcugcuuc

SEQ ID NO: 1326545 - RNA, 21 nt, Human
ccgucuccaggggcugcuucc

SEQ ID NO: 1326546 - RNA, 16 nt, Human
ccuaggcauucuggac

SEQ ID NO: 1326547 - RNA, 15 nt, Human
ccuaggaggguccuc

SEQ ID NO: 1326548 - RNA, 11 nt, Human
ccuaggauucu

SEQ ID NO: 1326549 - RNA, 14 nt, Human
ccuaggauucuaaa

SEQ ID NO: 1326550 - RNA, 15 nt, Human
ccuagcacagauggc

SEQ ID NO: 1326551 - RNA, 12 nt, Human
ccuagaguccca

SEQ ID NO: 1326552 - RNA, 14 nt, Human
ccuagauccuaagg

SEQ ID NO: 1326553 - RNA, 16 nt, Human
ccuagauccuaagggu

SEQ ID NO: 1326554 - RNA, 20 nt, Human
ccuagauguauaacuaggag

SEQ ID NO: 1326555 - RNA, 22 nt, Human
ccuagauguauaacuaggagcu

SEQ ID NO: 1326556 - RNA, 21 nt, Human
ccuagauguauaacuaggagc

SEQ ID NO: 1326557 - RNA, 16 nt, Human
ccuagauucagggaaa

SEQ ID NO: 1326558 - RNA, 16 nt, Human
ccuagauuuaauauaa

SEQ ID NO: 1326559 - RNA, 15 nt, Human
ccuauuuuaauaaac

SEQ ID NO: 1326560 - RNA, 16 nt, Human
ccuauuuccagaaaua

SEQ ID NO: 1326561 - RNA, 18 nt, Human
ccuauuuccauucaacaa

SEQ ID NO: 1326562 - RNA, 19 nt, Human
ccuauugugcaauguaaau

SEQ ID NO: 1326563 - RNA, 18 nt, Human
ccucaacguauuguuucg

SEQ ID NO: 1326564 - RNA, 17 nt, Human
ccucaagaugaaggcaa

SEQ ID NO: 1326565 - RNA, 15 nt, Human
ccucaagcugcaucu

SEQ ID NO: 1326566 - RNA, 13 nt, Human
ccucagccuccug

SEQ ID NO: 1326567 - RNA, 19 nt, Human
ccucagccucccaaagugc

SEQ ID NO: 1326568 - RNA, 22 nt, Human
ccucagccucccaaguagcugg

SEQ ID NO: 1326569 - RNA, 13 nt, Human
ccucauguggcug

SEQ ID NO: 1326570 - RNA, 15 nt, Human
ccucauguggcugga

SEQ ID NO: 1326571 - RNA, 16 nt, Human
ccucauguggcuggaa

SEQ ID NO: 1326572 - RNA, 17 nt, Human
ccucauguggcuggaag

SEQ ID NO: 1326573 - RNA, 20 nt, Human
ccucauguccacugguucuu

SEQ ID NO: 1326574 - RNA, 21 nt, Human
ccucagccucccaaagugcug

SEQ ID NO: 1326575 - RNA, 21 nt, Human
ccuccaagcuccaucuccacu

SEQ ID NO: 1326576 - RNA, 22 nt, Human
ccuccaagcuccaucuccacuc

SEQ ID NO: 1326577 - RNA, 18 nt, Human
ccucauguggcuggaaga

SEQ ID NO: 1326578 - RNA, 23 nt, Human
ccucauguggcuggaagauccug

SEQ ID NO: 1326579 - RNA, 22 nt, Human
ccuccaaucccaccaacccuca

SEQ ID NO: 1326580 - RNA, 20 nt, Human
ccuccaaggaggggcuguaa

SEQ ID NO: 1326581 - RNA, 21 nt, Human
ccuccaaggaggggcuguaaa

SEQ ID NO: 1326582 - RNA, 14 nt, Human
ccucccaggcgccc

SEQ ID NO: 1326583 - RNA, 20 nt, Human
ccucccaggcgccccuuccc

SEQ ID NO: 1326584 - RNA, 14 nt, Human
ccucccaagcaguu

SEQ ID NO: 1326585 - RNA, 19 nt, Human
ccucccaauuucagacucc

SEQ ID NO: 1326586 - RNA, 20 nt, Human
ccucccaauuucagacuccc

SEQ ID NO: 1326587 - RNA, 16 nt, Human
auuguugucugcaacu

SEQ ID NO: 1326588 - RNA, 16 nt, Human
auuguuguccuuuuca

SEQ ID NO: 1326589 - RNA, 17 nt, Human
auuguuguccuuuucau

SEQ ID NO: 1326590 - RNA, 18 nt, Human
auuguuguccuuuucaua

SEQ ID NO: 1326591 - RNA, 16 nt, Human
auuguugagcuauugc

SEQ ID NO: 1326592 - RNA, 19 nt, Human
auuguugagcuauugcugu

SEQ ID NO: 1326593 - RNA, 12 nt, Human
auuguugcauua

SEQ ID NO: 1326594 - RNA, 16 nt, Human
auuguugcauugcuuu

SEQ ID NO: 1326595 - RNA, 14 nt, Human
auuguugcauugcu

SEQ ID NO: 1326596 - RNA, 21 nt, Human
auuguuguacacagaaauaca

SEQ ID NO: 1326597 - RNA, 13 nt, Human
auuguuguccuuu

SEQ ID NO: 1326598 - RNA, 15 nt, Human
auuguuguccuuuuc

SEQ ID NO: 1326599 - RNA, 19 nt, Human
auuguguggauucuuuaaa

SEQ ID NO: 1326600 - RNA, 21 nt, Human
auuguuacauuauguggaaaa

SEQ ID NO: 1326601 - RNA, 19 nt, Human
auuguuacguagccuaagg

SEQ ID NO: 1326602 - RNA, 15 nt, Human
auuguuaguuucuga

SEQ ID NO: 1326603 - RNA, 22 nt, Human
auuguuauauacauacuaugaa

SEQ ID NO: 1326604 - RNA, 13 nt, Human
auuguaaucacug

SEQ ID NO: 1326605 - RNA, 16 nt, Human
auuguaaucugaauaa

SEQ ID NO: 1326606 - RNA, 12 nt, Human
auuguaaucacu

SEQ ID NO: 1326607 - RNA, 14 nt, Human
auuguaaaauggug

SEQ ID NO: 1326608 - RNA, 20 nt, Human
auuguaaaauuauuucauga

SEQ ID NO: 1326609 - RNA, 23 nt, Human
auuguaaacaaacuguguaacug

SEQ ID NO: 1326610 - RNA, 12 nt, Human
auuguaaaguaa

SEQ ID NO: 1326611 - RNA, 12 nt, Human
auugcuccuuga

SEQ ID NO: 1326612 - RNA, 19 nt, Human
auugcucugaauaugucau

SEQ ID NO: 1326613 - RNA, 12 nt, Human
auugcugaaauu

SEQ ID NO: 1326614 - RNA, 16 nt, Human
auugcucacccagugc

SEQ ID NO: 1326615 - RNA, 23 nt, Human
auugcucacccagugcccucucc

SEQ ID NO: 1326616 - RNA, 13 nt, Human
auugcugaaauuu

SEQ ID NO: 1326617 - RNA, 16 nt, Human
auugcugaaauuuuau

SEQ ID NO: 1326618 - RNA, 16 nt, Human
auugcugacuguagcu

SEQ ID NO: 1326619 - RNA, 20 nt, Human
auugcugccccaucagugcu

SEQ ID NO: 1326620 - RNA, 21 nt, Human
auugcugccccaucagugcuc

SEQ ID NO: 1326621 - RNA, 17 nt, Human
auugcuuauuuauugua

SEQ ID NO: 1326622 - RNA, 20 nt, Human
auugcuuauuuauuguauuc

SEQ ID NO: 1326623 - RNA, 23 nt, Human
auugcuuauuuauuguauucugg

SEQ ID NO: 1326624 - RNA, 16 nt, Human
auugcuuccuccuccc

SEQ ID NO: 1326625 - RNA, 19 nt, Human
auugcuuccuccuccccaa

SEQ ID NO: 1326626 - RNA, 19 nt, Human
auugaguaaugguguagaa

SEQ ID NO: 1326627 - RNA, 20 nt, Human
auugaguaaugguguagaac

SEQ ID NO: 1326628 - RNA, 15 nt, Human
auugagucaaauggu

SEQ ID NO: 1326629 - RNA, 13 nt, Human
auugaguuggaau

SEQ ID NO: 1326630 - RNA, 15 nt, Human
auugaguuuucagug

SEQ ID NO: 1326631 - RNA, 16 nt, Human
auugaguuuucagugg

SEQ ID NO: 1326632 - RNA, 19 nt, Human
auugauaaccuugaaaaaa

SEQ ID NO: 1326633 - RNA, 22 nt, Human
auugaguaaugguguagaacac

SEQ ID NO: 1326634 - RNA, 18 nt, Human
auugauagaguguuauca

SEQ ID NO: 1326635 - RNA, 14 nt, Human
auugcuagagcucc

SEQ ID NO: 1326636 - RNA, 15 nt, Human
auugcuagagcuccu

SEQ ID NO: 1326637 - RNA, 23 nt, Human
auugcuagagcuccucccucuca

SEQ ID NO: 1326638 - RNA, 16 nt, Human
auugcuagagcuccuc

SEQ ID NO: 1326639 - RNA, 18 nt, Human
auugcuagagcuccuccc

SEQ ID NO: 1326640 - RNA, 19 nt, Human
auugcuagagcuccucccu

SEQ ID NO: 1326641 - RNA, 22 nt, Human
auugcuauguuuugacauuuuu

SEQ ID NO: 1326642 - RNA, 16 nt, Human
auucuugauguaaaau

SEQ ID NO: 1326643 - RNA, 17 nt, Human
auucuugauguaaaauc

SEQ ID NO: 1326644 - RNA, 21 nt, Human
auucuuucccaauucacaucu

SEQ ID NO: 1326645 - RNA, 19 nt, Human
auucuuucccagucugucg

SEQ ID NO: 1326646 - RNA, 20 nt, Human
auucuuucccagucugucga

SEQ ID NO: 1326647 - RNA, 15 nt, Human
auucugaaugcuucu

SEQ ID NO: 1326648 - RNA, 16 nt, Human
auucugaaugcuucua

SEQ ID NO: 1326649 - RNA, 17 nt, Human
auucugaaugcuucuaa

SEQ ID NO: 1326650 - RNA, 19 nt, Human
auucugaaugcuucuaagu

SEQ ID NO: 1326651 - RNA, 22 nt, Human
auucugaaugcuucuaaguaaa

SEQ ID NO: 1326652 - RNA, 14 nt, Human
auucugaccuuaaa

SEQ ID NO: 1326653 - RNA, 13 nt, Human
auucuucugaacu

SEQ ID NO: 1326654 - RNA, 16 nt, Human
auucauaguaacuucu

SEQ ID NO: 1326655 - RNA, 17 nt, Human
auucauaguaacuucuu

SEQ ID NO: 1326656 - RNA, 20 nt, Human
auucucuuguauaagauccu

SEQ ID NO: 1326657 - RNA, 18 nt, Human
auucauaguaacuucuua

SEQ ID NO: 1326658 - RNA, 22 nt, Human
auucucuuguauaagauccuag

SEQ ID NO: 1326659 - RNA, 22 nt, Human
auucugaacuaaagugcugcac

SEQ ID NO: 1326660 - RNA, 19 nt, Human
auucugaacuaaagugcug

SEQ ID NO: 1326661 - RNA, 15 nt, Human
auucugaaggagccc

SEQ ID NO: 1326662 - RNA, 16 nt, Human
auucugaaggagcccc

SEQ ID NO: 1326663 - RNA, 21 nt, Human
auucuucugaacucaaacuga

SEQ ID NO: 1326664 - RNA, 17 nt, Human
auucuucugagcacugu

SEQ ID NO: 1326665 - RNA, 16 nt, Human
auucuuucccaacacc

SEQ ID NO: 1326666 - RNA, 19 nt, Human
auucuuucccaacaccucu

SEQ ID NO: 1326667 - RNA, 12 nt, Human
auucuugaugua

SEQ ID NO: 1326668 - RNA, 14 nt, Human
auucuugauguaaa

SEQ ID NO: 1326669 - RNA, 18 nt, Human
auucuugauguaaaaucu

SEQ ID NO: 1326670 - RNA, 18 nt, Human
auuagcagucccuccaca

SEQ ID NO: 1326671 - RNA, 17 nt, Human
auuagcaguuugcuuug

SEQ ID NO: 1326672 - RNA, 22 nt, Human
auuagcaauugacugucacugu

SEQ ID NO: 1326673 - RNA, 23 nt, Human
auuagauuucucauuugccaaua

SEQ ID NO: 1326674 - RNA, 23 nt, Human
auuagccaguaauccuguaggaa

SEQ ID NO: 1326675 - RNA, 17 nt, Human
auuagccagugaaaaac

SEQ ID NO: 1326676 - RNA, 19 nt, Human
auuagccaguaauccugua

SEQ ID NO: 1326677 - RNA, 18 nt, Human
auuagccaguaauccugu

SEQ ID NO: 1326678 - RNA, 17 nt, Human
auuagccaguaauccug

SEQ ID NO: 1326679 - RNA, 16 nt, Human
auuagccaguaauccu

SEQ ID NO: 1326680 - RNA, 14 nt, Human
auuagccaguaauc

SEQ ID NO: 1326681 - RNA, 12 nt, Human
auuagccaguaa

SEQ ID NO: 1326682 - RNA, 19 nt, Human
auuacaguggggaaugaag

SEQ ID NO: 1326683 - RNA, 17 nt, Human
auuacaggcgugagcca

SEQ ID NO: 1326684 - RNA, 15 nt, Human
auuacagauaaaaug

SEQ ID NO: 1326685 - RNA, 22 nt, Human
auuacagauaaaauguaaacug

SEQ ID NO: 1326686 - RNA, 19 nt, Human
auuacagaugggcaaauua

SEQ ID NO: 1326687 - RNA, 21 nt, Human
auuacagaugggcaaauuaag

SEQ ID NO: 1326688 - RNA, 15 nt, Human
auuacagcuggagaa

SEQ ID NO: 1326689 - RNA, 20 nt, Human
auuacaggcaccugccacca

SEQ ID NO: 1326690 - RNA, 22 nt, Human
auuacaggcaccugccaccaug

SEQ ID NO: 1326691 - RNA, 22 nt, Human
auuacaggcgugagccaccucg

SEQ ID NO: 1326692 - RNA, 22 nt, Human
auuaauuccuucagcacuuuag

SEQ ID NO: 1326693 - RNA, 13 nt, Human
auuaauucuauaa

SEQ ID NO: 1326694 - RNA, 18 nt, Human
auuaauuccuguuugucu

SEQ ID NO: 1326695 - RNA, 14 nt, Human
auuaauucuauaag

SEQ ID NO: 1326696 - RNA, 20 nt, Human
auuaauuccuguuugucuac

SEQ ID NO: 1326697 - RNA, 17 nt, Human
auuacaacggagucaaa

SEQ ID NO: 1326698 - RNA, 15 nt, Human
auuacaacggaguca

SEQ ID NO: 1326699 - RNA, 14 nt, Human
auuacaaaucagaa

SEQ ID NO: 1326700 - RNA, 16 nt, Human
auuacaaaucagaagu

SEQ ID NO: 1326701 - RNA, 18 nt, Human
auuacaaaucagaaguca

SEQ ID NO: 1326702 - RNA, 19 nt, Human
auuacaaaucagaagucau

SEQ ID NO: 1326703 - RNA, 21 nt, Human
auuacaaaucagaagucaucu

SEQ ID NO: 1326704 - RNA, 22 nt, Human
auuacaaaucagaagucaucuu

SEQ ID NO: 1326705 - RNA, 23 nt, Human
auuacaaaucagaagucaucuug

SEQ ID NO: 1326706 - RNA, 23 nt, Human
auguuugggagacugcugaguca

SEQ ID NO: 1326707 - RNA, 22 nt, Human
auguuucuucuagguucuaaaa

SEQ ID NO: 1326708 - RNA, 23 nt, Human
auguuuggcugcuagaacauggu

SEQ ID NO: 1326709 - RNA, 13 nt, Human
auguuugguaaga

SEQ ID NO: 1326710 - RNA, 16 nt, Human
auucaaauguauuaca

SEQ ID NO: 1326711 - RNA, 18 nt, Human
auucaaauguauuacagu

SEQ ID NO: 1326712 - RNA, 18 nt, Human
auucaaugccccugaauu

SEQ ID NO: 1326713 - RNA, 20 nt, Human
auucaaugccccugaauuua

SEQ ID NO: 1326714 - RNA, 16 nt, Human
auucaauucaaagcug

SEQ ID NO: 1326715 - RNA, 19 nt, Human
auucacaagacccaaaagg

SEQ ID NO: 1326716 - RNA, 18 nt, Human
auuaugaauuacauuugu

SEQ ID NO: 1326717 - RNA, 19 nt, Human
auuaugaagaaggugaaua

SEQ ID NO: 1326718 - RNA, 20 nt, Human
auuaugaaugugaagccuuc

SEQ ID NO: 1326719 - RNA, 15 nt, Human
auuaugauuagcuuu

SEQ ID NO: 1326720 - RNA, 18 nt, Human
auuaugcaauuuuuauau

SEQ ID NO: 1326721 - RNA, 14 nt, Human
auucaaaguguuau

SEQ ID NO: 1326722 - RNA, 14 nt, Human
auuaugaauuacau

SEQ ID NO: 1326723 - RNA, 17 nt, Human
auuaugaauuacauuug

SEQ ID NO: 1326724 - RNA, 18 nt, Human
auuaugaaacuuuuggaa

SEQ ID NO: 1326725 - RNA, 22 nt, Human
auuaucuuuucauacauuuucu

SEQ ID NO: 1326726 - RNA, 23 nt, Human
auuaucuuuucauacauuuucua

SEQ ID NO: 1326727 - RNA, 15 nt, Human
auuagggaugccucc

SEQ ID NO: 1326728 - RNA, 18 nt, Human
auuagggcccugugucug

SEQ ID NO: 1326729 - RNA, 15 nt, Human
auuagggcccugugu

SEQ ID NO: 1326730 - RNA, 22 nt, Human
auuagcuuauguuaacugacaa

SEQ ID NO: 1326731 - RNA, 21 nt, Human
auuagcuuauguuaacugaca

SEQ ID NO: 1326732 - RNA, 13 nt, Human
auuagcuuauguu

SEQ ID NO: 1326733 - RNA, 21 nt, Human
auucauaauuauuauuuggcc

SEQ ID NO: 1326734 - RNA, 22 nt, Human
auucauagcagcuuauucacaa

SEQ ID NO: 1326735 - RNA, 19 nt, Human
auucauagcagcuuauuca

SEQ ID NO: 1326736 - RNA, 22 nt, Human
auucacaguucuuugggccaga

SEQ ID NO: 1326737 - RNA, 21 nt, Human
auucacagugcucuuuucucc

SEQ ID NO: 1326738 - RNA, 19 nt, Human
auucacagugcucuuuucu

SEQ ID NO: 1326739 - RNA, 20 nt, Human
auucacagugcucuuuucuc

SEQ ID NO: 1326740 - RNA, 17 nt, Human
auuuuauaggaaaaaau

SEQ ID NO: 1326741 - RNA, 19 nt, Human
auuuuauaggaaaaaauaa

SEQ ID NO: 1326742 - RNA, 22 nt, Human
auuuuauaggcauaccuccuau

SEQ ID NO: 1326743 - RNA, 19 nt, Human
auuuuauagcuacuaauuu

SEQ ID NO: 1326744 - RNA, 18 nt, Human
auuuguuucuuucucuga

SEQ ID NO: 1326745 - RNA, 19 nt, Human
auuuguuuauguaauuuca

SEQ ID NO: 1326746 - RNA, 13 nt, Human
auuuguuucuacu

SEQ ID NO: 1326747 - RNA, 15 nt, Human
auuuguuggaaugaa

SEQ ID NO: 1326748 - RNA, 17 nt, Human
auuuguuuaaaaaguaa

SEQ ID NO: 1326749 - RNA, 16 nt, Human
auuuguuuaaaaagua

SEQ ID NO: 1326750 - RNA, 20 nt, Human
auuuguuuaugguaaaaaau

SEQ ID NO: 1326751 - RNA, 22 nt, Human
auuuguuuaugguaaaaaauuu

SEQ ID NO: 1326752 - RNA, 13 nt, Human
auuuguuuaugua

SEQ ID NO: 1326753 - RNA, 17 nt, Human
auuuguuuauguaauuu

SEQ ID NO: 1326754 - RNA, 18 nt, Human
auuuguuuauguaauuuc

SEQ ID NO: 1326755 - RNA, 22 nt, Human
auuuguggguuuuuauuuccua

SEQ ID NO: 1326756 - RNA, 21 nt, Human
auuuguggguuuuuauuuccu

SEQ ID NO: 1326757 - RNA, 13 nt, Human
auuuguugagagu

SEQ ID NO: 1326758 - RNA, 22 nt, Human
auuuguugagagugugaccaaa

SEQ ID NO: 1326759 - RNA, 11 nt, Human
auuuguugcau

SEQ ID NO: 1326760 - RNA, 13 nt, Human
auuuguuggaaug

SEQ ID NO: 1326761 - RNA, 14 nt, Human
auuuguuggaauga

SEQ ID NO: 1326762 - RNA, 15 nt, Human
auuuggaaauaaagu

SEQ ID NO: 1326763 - RNA, 17 nt, Human
auuuggaaauaaaguca

SEQ ID NO: 1326764 - RNA, 22 nt, Human
auuuggaaauaaagucagaugg

SEQ ID NO: 1326765 - RNA, 18 nt, Human
auuugcuuuuugugauau

SEQ ID NO: 1326766 - RNA, 14 nt, Human
auuugugccagaau

SEQ ID NO: 1326767 - RNA, 19 nt, Human
auuugugcccccaaccauu

SEQ ID NO: 1326768 - RNA, 14 nt, Human
auuugcucauggaa

SEQ ID NO: 1326769 - RNA, 17 nt, Human
auuugcucauggaauug

SEQ ID NO: 1326770 - RNA, 13 nt, Human
auuuggaaaauaa

SEQ ID NO: 1326771 - RNA, 12 nt, Human
auuuggaaaaua

SEQ ID NO: 1326772 - RNA, 17 nt, Human
auuugcuuuuugugaua

SEQ ID NO: 1326773 - RNA, 13 nt, Human
auuugcuuuggaa

SEQ ID NO: 1326774 - RNA, 14 nt, Human
auuugcuuuggaag

SEQ ID NO: 1326775 - RNA, 15 nt, Human
auuugcuuuggaagu

SEQ ID NO: 1326776 - RNA, 11 nt, Human
auuugcuuuuu

SEQ ID NO: 1326777 - RNA, 18 nt, Human
auuugcuuuuucaccaga

SEQ ID NO: 1326778 - RNA, 16 nt, Human
auuugccuguaacaag

SEQ ID NO: 1326779 - RNA, 13 nt, Human
auuugcuaauuuu

SEQ ID NO: 1326780 - RNA, 14 nt, Human
auuugcuaauuuuu

SEQ ID NO: 1326781 - RNA, 16 nt, Human
auuugcuaauuuuuau

SEQ ID NO: 1326782 - RNA, 19 nt, Human
auuugcuaauuuuuauuaa

SEQ ID NO: 1326783 - RNA, 11 nt, Human
auuugccugua

SEQ ID NO: 1326784 - RNA, 13 nt, Human
auuugccuguaac

SEQ ID NO: 1326785 - RNA, 15 nt, Human
auuugccuguaacaa

SEQ ID NO: 1326786 - RNA, 22 nt, Human
auuugccuguaacaagccagau

SEQ ID NO: 1326787 - RNA, 15 nt, Human
auuugccaauaauaa

SEQ ID NO: 1326788 - RNA, 16 nt, Human
auuugcauuuguuuau

SEQ ID NO: 1326789 - RNA, 21 nt, Human
auuugcauuuguuuauguaau

SEQ ID NO: 1326790 - RNA, 23 nt, Human
auuugcauuuguuuauguaauuu

SEQ ID NO: 1326791 - RNA, 16 nt, Human
auuugcauugaacaca

SEQ ID NO: 1326792 - RNA, 21 nt, Human
auuugcauugaacacaaacug

SEQ ID NO: 1326793 - RNA, 22 nt, Human
auuugcauugaacacaaacugu

SEQ ID NO: 1326794 - RNA, 12 nt, Human
auuugcauuugu

SEQ ID NO: 1326795 - RNA, 13 nt, Human
auuugcauuuguu

SEQ ID NO: 1326796 - RNA, 16 nt, Human
auuugccaauaauaau

SEQ ID NO: 1326797 - RNA, 22 nt, Human
auuugcauuuguuuauguaauu

SEQ ID NO: 1326798 - RNA, 17 nt, Human
auuugcauacauucuuc

SEQ ID NO: 1326799 - RNA, 18 nt, Human
auuugcauuaaauucaca

SEQ ID NO: 1326800 - RNA, 19 nt, Human
auuugcauuaaauucacaa

SEQ ID NO: 1326801 - RNA, 23 nt, Human
auuugcauuaaauucacaaacuu

SEQ ID NO: 1326802 - RNA, 15 nt, Human
auuugcaagggaaaa

SEQ ID NO: 1326803 - RNA, 20 nt, Human
auuugcaagggaaaagucuc

SEQ ID NO: 1326804 - RNA, 22 nt, Human
auuugcagcugagagaaaauaa

SEQ ID NO: 1326805 - RNA, 14 nt, Human
auuugcaggguccu

SEQ ID NO: 1326806 - RNA, 21 nt, Human
auuugcauaacaauuccucua

SEQ ID NO: 1326807 - RNA, 22 nt, Human
auuugcauaacaauuccucuac

SEQ ID NO: 1326808 - RNA, 13 nt, Human
auuugauugauuu

SEQ ID NO: 1326809 - RNA, 16 nt, Human
auuugauugauuugaa

SEQ ID NO: 1326810 - RNA, 20 nt, Human
caaacaggaucaguuaacua

SEQ ID NO: 1326811 - RNA, 15 nt, Human
caaacaggcucagag

SEQ ID NO: 1326812 - RNA, 14 nt, Human
caaacaggcucaga

SEQ ID NO: 1326813 - RNA, 20 nt, Human
caaacagccaacuagccccu

SEQ ID NO: 1326814 - RNA, 19 nt, Human
caaaagggccaaagaacca

SEQ ID NO: 1326815 - RNA, 24 nt, Human
caaaagggggauucccugauggaa

SEQ ID NO: 1326816 - RNA, 20 nt, Human
caaaagggccaaagaaccaa

SEQ ID NO: 1326817 - RNA, 21 nt, Human
caaacccaccugcuaguguga

SEQ ID NO: 1326818 - RNA, 20 nt, Human
caaaaaaaaaaaaaaauuag

SEQ ID NO: 1326819 - RNA, 20 nt, Human
auuuuuuuuuuuuuccuguc

SEQ ID NO: 1326820 - RNA, 19 nt, Human
auuuuuuuuuuuuuuuccu

SEQ ID NO: 1326821 - RNA, 23 nt, Human
auuuuuuuuuuuuuuuuuuuaag

SEQ ID NO: 1326822 - RNA, 19 nt, Human
auuuuuuuuuuuucucuca

SEQ ID NO: 1326823 - RNA, 16 nt, Human
caaaagauugcugaaa

SEQ ID NO: 1326824 - RNA, 19 nt, Human
caaaagauugcugaaauuu

SEQ ID NO: 1326825 - RNA, 20 nt, Human
caaaagauugcugaaauuuu

SEQ ID NO: 1326826 - RNA, 15 nt, Human
caaaaggcagaagca

SEQ ID NO: 1326827 - RNA, 12 nt, Human
caacaauaaaua

SEQ ID NO: 1326828 - RNA, 13 nt, Human
caacaauucuaaa

SEQ ID NO: 1326829 - RNA, 22 nt, Human
caacaccaagcacagcagccug

SEQ ID NO: 1326830 - RNA, 17 nt, Human
caacaccaugauuccuu

SEQ ID NO: 1326831 - RNA, 19 nt, Human
caacaccaugauuccuuua

SEQ ID NO: 1326832 - RNA, 22 nt, Human
caacaccaugauuccuuuaaca

SEQ ID NO: 1326833 - RNA, 15 nt, Human
caacacgcaccugcc

SEQ ID NO: 1326834 - RNA, 17 nt, Human
caacacgcaccugccuc

SEQ ID NO: 1326835 - RNA, 15 nt, Human
caaauccuugaagau

SEQ ID NO: 1326836 - RNA, 17 nt, Human
caaauccuuagaucugg

SEQ ID NO: 1326837 - RNA, 21 nt, Human
caaauccuuagaucuggcaug

SEQ ID NO: 1326838 - RNA, 14 nt, Human
caacacuaacauga

SEQ ID NO: 1326839 - RNA, 19 nt, Human
caacacgcaccugccucag

SEQ ID NO: 1326840 - RNA, 16 nt, Human
caacacccauuuuucc

SEQ ID NO: 1326841 - RNA, 13 nt, Human
caacacguuacua

SEQ ID NO: 1326842 - RNA, 21 nt, Human
caaagucucuggaauuugaaa

SEQ ID NO: 1326843 - RNA, 12 nt, Human
caaagucucuaa

SEQ ID NO: 1326844 - RNA, 13 nt, Human
caaagucucuaau

SEQ ID NO: 1326845 - RNA, 14 nt, Human
caaagucucuaauu

SEQ ID NO: 1326846 - RNA, 15 nt, Human
caaagucucuaauuc

SEQ ID NO: 1326847 - RNA, 16 nt, Human
caaagugcaaggaccu

SEQ ID NO: 1326848 - RNA, 12 nt, Human
caaagugcaagg

SEQ ID NO: 1326849 - RNA, 15 nt, Human
caaagugcugagauu

SEQ ID NO: 1326850 - RNA, 16 nt, Human
caaagugcugagauua

SEQ ID NO: 1326851 - RNA, 12 nt, Human
caaagguucuag

SEQ ID NO: 1326852 - RNA, 14 nt, Human
caaagguucuaggu

SEQ ID NO: 1326853 - RNA, 19 nt, Human
caaagguucuagguuucaa

SEQ ID NO: 1326854 - RNA, 21 nt, Human
caaagguucuagguuucaaag

SEQ ID NO: 1326855 - RNA, 22 nt, Human
caaagguucuagguuucaaaga

SEQ ID NO: 1326856 - RNA, 15 nt, Human
caaagguugagaugu

SEQ ID NO: 1326857 - RNA, 13 nt, Human
caaagguuuaaau

SEQ ID NO: 1326858 - RNA, 16 nt, Human
caaagguuuaaaugaa

SEQ ID NO: 1326859 - RNA, 20 nt, Human
caaagguuuaaaugaacaag

SEQ ID NO: 1326860 - RNA, 23 nt, Human
caaagguuuaaaugaacaagaga

SEQ ID NO: 1326861 - RNA, 16 nt, Human
caaagguuuggaagga

SEQ ID NO: 1326862 - RNA, 17 nt, Human
caaagguuuggaaggag

SEQ ID NO: 1326863 - RNA, 18 nt, Human
caaagguuuggaaggagc

SEQ ID NO: 1326864 - RNA, 19 nt, Human
caaagguuuggaaggagca

SEQ ID NO: 1326865 - RNA, 11 nt, Human
caaagguuuuc

SEQ ID NO: 1326866 - RNA, 19 nt, Human
caaagguuuuccucuucua

SEQ ID NO: 1326867 - RNA, 21 nt, Human
caaagguuuggaaggagcaga

SEQ ID NO: 1326868 - RNA, 11 nt, Human
caaagaugcug

SEQ ID NO: 1326869 - RNA, 16 nt, Human
caaagaugcugugagu

SEQ ID NO: 1326870 - RNA, 17 nt, Human
caaagauucucuaugua

SEQ ID NO: 1326871 - RNA, 13 nt, Human
caaagauuuaauc

SEQ ID NO: 1326872 - RNA, 16 nt, Human
caaagauuuaaucugc

SEQ ID NO: 1326873 - RNA, 14 nt, Human
caaagcaagacccu

SEQ ID NO: 1326874 - RNA, 22 nt, Human
caaagcaagcauucagaagaaa

SEQ ID NO: 1326875 - RNA, 13 nt, Human
caaagcaaggaaa

SEQ ID NO: 1326876 - RNA, 15 nt, Human
caaagcaaggaaacu

SEQ ID NO: 1326877 - RNA, 14 nt, Human
caaagcaauaauag

SEQ ID NO: 1326878 - RNA, 16 nt, Human
caaagcaauaauagua

SEQ ID NO: 1326879 - RNA, 23 nt, Human
caaagcaagcauucagaagaaaa

SEQ ID NO: 1326880 - RNA, 18 nt, Human
caaagcaauucuuucaag

SEQ ID NO: 1326881 - RNA, 11 nt, Human
caaagcacaga

SEQ ID NO: 1326882 - RNA, 13 nt, Human
caaagcacagaga

SEQ ID NO: 1326883 - RNA, 19 nt, Human
caaagcacagagagucugg

SEQ ID NO: 1326884 - RNA, 14 nt, Human
caaagcacagagag

SEQ ID NO: 1326885 - RNA, 20 nt, Human
caaagcacgaaauguuauuu

SEQ ID NO: 1326886 - RNA, 22 nt, Human
caaagcacgaaauguuauuuuu

SEQ ID NO: 1326887 - RNA, 12 nt, Human
caaagcagacag

SEQ ID NO: 1326888 - RNA, 13 nt, Human
caaagcagacagc

SEQ ID NO: 1326889 - RNA, 15 nt, Human
caaagcagacagcuc

SEQ ID NO: 1326890 - RNA, 16 nt, Human
caaagcagacagcucc

SEQ ID NO: 1326891 - RNA, 17 nt, Human
caaagcagacagcucca

SEQ ID NO: 1326892 - RNA, 19 nt, Human
caaagcagacagcuccacc

SEQ ID NO: 1326893 - RNA, 19 nt, Human
caaagcagauucagaaaug

SEQ ID NO: 1326894 - RNA, 12 nt, Human
caaagcagccac

SEQ ID NO: 1326895 - RNA, 13 nt, Human
caaagcagccacg

SEQ ID NO: 1326896 - RNA, 17 nt, Human
cacugggacuugcaaaa

SEQ ID NO: 1326897 - RNA, 12 nt, Human
cacuggggcuca

SEQ ID NO: 1326898 - RNA, 15 nt, Human
cacuggggcucagag

SEQ ID NO: 1326899 - RNA, 16 nt, Human
cacuggggcucagagc

SEQ ID NO: 1326900 - RNA, 17 nt, Human
cacuggggcucagagcc

SEQ ID NO: 1326901 - RNA, 18 nt, Human
cacuggggcucagagccg

SEQ ID NO: 1326902 - RNA, 19 nt, Human
cacuggggcucagagccgg

SEQ ID NO: 1326903 - RNA, 20 nt, Human
cacuggggcucagagccggg

SEQ ID NO: 1326904 - RNA, 22 nt, Human
cacuggggcucagagccggggu

SEQ ID NO: 1326905 - RNA, 18 nt, Human
cacugggagaaaugaaaa

SEQ ID NO: 1326906 - RNA, 14 nt, Human
cacugccaggaggg

SEQ ID NO: 1326907 - RNA, 15 nt, Human
cacugccaggaggga

SEQ ID NO: 1326908 - RNA, 16 nt, Human
cacugccaggagggac

SEQ ID NO: 1326909 - RNA, 17 nt, Human
cacugccaggagggaca

SEQ ID NO: 1326910 - RNA, 22 nt, Human
cacugccaggagggacaaagga

SEQ ID NO: 1326911 - RNA, 14 nt, Human
cacugcauccuccg

SEQ ID NO: 1326912 - RNA, 16 nt, Human
cacugcauccuccgcc

SEQ ID NO: 1326913 - RNA, 18 nt, Human
cacugcagccccacccag

SEQ ID NO: 1326914 - RNA, 18 nt, Human
cacugccagcauuucccu

SEQ ID NO: 1326915 - RNA, 22 nt, Human
cacugccagcauuucccuuccu

SEQ ID NO: 1326916 - RNA, 12 nt, Human
cacugccaggag

SEQ ID NO: 1326917 - RNA, 13 nt, Human
cacugccaggagg

SEQ ID NO: 1326918 - RNA, 18 nt, Human
cacugcauccuccgccuc

SEQ ID NO: 1326919 - RNA, 12 nt, Human
cacugccacugg

SEQ ID NO: 1326920 - RNA, 21 nt, Human
cacugcacucaaccuuaagac

SEQ ID NO: 1326921 - RNA, 21 nt, Human
cacugcagaagacaguauggc

SEQ ID NO: 1326922 - RNA, 17 nt, Human
cacugcacucaaccuua

SEQ ID NO: 1326923 - RNA, 22 nt, Human
cacuuguguuuugcaagccaga

SEQ ID NO: 1326924 - RNA, 23 nt, Human
cacuuguccagcugagcgccagg

SEQ ID NO: 1326925 - RNA, 18 nt, Human
cacuugucauuguuauau

SEQ ID NO: 1326926 - RNA, 16 nt, Human
cacuugucaauaaaau

SEQ ID NO: 1326927 - RNA, 19 nt, Human
cacuuguguuuugcaagcc

SEQ ID NO: 1326928 - RNA, 16 nt, Human
cacuugucaggagugu

SEQ ID NO: 1326929 - RNA, 20 nt, Human
cacuugucaggagugugugu

SEQ ID NO: 1326930 - RNA, 22 nt, Human
cacuugucaggaguguguguga

SEQ ID NO: 1326931 - RNA, 14 nt, Human
cacuuguccagcug

SEQ ID NO: 1326932 - RNA, 15 nt, Human
cacuuguccagcuga

SEQ ID NO: 1326933 - RNA, 23 nt, Human
cacuuaggaacguaaucgugucc

SEQ ID NO: 1326934 - RNA, 24 nt, Human
cacuuagaaauugcauuuccugac

SEQ ID NO: 1326935 - RNA, 16 nt, Human
cacuuauagccucugu

SEQ ID NO: 1326936 - RNA, 14 nt, Human
cacuuauagccucu

SEQ ID NO: 1326937 - RNA, 16 nt, Human
cacuuaucugaucaga

SEQ ID NO: 1326938 - RNA, 17 nt, Human
cacuuaucugaucagaa

SEQ ID NO: 1326939 - RNA, 20 nt, Human
cacuuauuccccauucuucc

SEQ ID NO: 1326940 - RNA, 19 nt, Human
cacuuauguuauacaauac

SEQ ID NO: 1326941 - RNA, 21 nt, Human
cacuuauuggaacucugcuug

SEQ ID NO: 1326942 - RNA, 14 nt, Human
cacuuacauuuaca

SEQ ID NO: 1326943 - RNA, 22 nt, Human
cacugguucuucuuggucucag

SEQ ID NO: 1326944 - RNA, 22 nt, Human
cacugguggggauaggccagcc

SEQ ID NO: 1326945 - RNA, 14 nt, Human
cacugguuugaaga

SEQ ID NO: 1326946 - RNA, 23 nt, Human
cacugguggcccgacagccuggc

SEQ ID NO: 1326947 - RNA, 21 nt, Human
cacugguggggauaggccagc

SEQ ID NO: 1326948 - RNA, 23 nt, Human
cacugguggggauaggccagccg

SEQ ID NO: 1326949 - RNA, 15 nt, Human
cacucuuucuuucaa

SEQ ID NO: 1326950 - RNA, 14 nt, Human
cacucuuucuuuca

SEQ ID NO: 1326951 - RNA, 15 nt, Human
cacucuuuguaagag

SEQ ID NO: 1326952 - RNA, 12 nt, Human
cacucuuuguaa

SEQ ID NO: 1326953 - RNA, 15 nt, Human
cacucuuuugcuuua

SEQ ID NO: 1326954 - RNA, 23 nt, Human
cacucuuuugcuuuauuccagaa

SEQ ID NO: 1326955 - RNA, 12 nt, Human
cacugaaaaaau

SEQ ID NO: 1326956 - RNA, 13 nt, Human
cacugaaaaaaua

SEQ ID NO: 1326957 - RNA, 14 nt, Human
cacugaaaaaauau

SEQ ID NO: 1326958 - RNA, 14 nt, Human
cacuaguauuucua

SEQ ID NO: 1326959 - RNA, 15 nt, Human
cacuccaagcccagc

SEQ ID NO: 1326960 - RNA, 21 nt, Human
cacuccaagcccagcccaugg

SEQ ID NO: 1326961 - RNA, 16 nt, Human
cacuccaagcccagcc

SEQ ID NO: 1326962 - RNA, 16 nt, Human
cacuccagugagacag

SEQ ID NO: 1326963 - RNA, 15 nt, Human
cacuccagcugggau

SEQ ID NO: 1326964 - RNA, 11 nt, Human
cacuccagcug

SEQ ID NO: 1326965 - RNA, 12 nt, Human
cacuccagcugg

SEQ ID NO: 1326966 - RNA, 14 nt, Human
cacuaggcuucugg

SEQ ID NO: 1326967 - RNA, 23 nt, Human
caccugcccugcccugccaccug

SEQ ID NO: 1326968 - RNA, 22 nt, Human
caccugcccugcccugccaccu

SEQ ID NO: 1326969 - RNA, 21 nt, Human
caccugcccugcccugccacc

SEQ ID NO: 1326970 - RNA, 20 nt, Human
caccugcccugcccugccac

SEQ ID NO: 1326971 - RNA, 19 nt, Human
caccugcccugcccugcca

SEQ ID NO: 1326972 - RNA, 18 nt, Human
caccugcccugcccugcc

SEQ ID NO: 1326973 - RNA, 17 nt, Human
caccugcccugcccugc

SEQ ID NO: 1326974 - RNA, 20 nt, Human
caccuaauccaggcagaucc

SEQ ID NO: 1326975 - RNA, 21 nt, Human
caccuaauccaggcagaucca

SEQ ID NO: 1326976 - RNA, 22 nt, Human
caccuaauccaggcagauccag

SEQ ID NO: 1326977 - RNA, 16 nt, Human
caccucagccucccaa

SEQ ID NO: 1326978 - RNA, 23 nt, Human
cacccucguggacaccugcccug

SEQ ID NO: 1326979 - RNA, 21 nt, Human
cacccucguggacaccugccc

SEQ ID NO: 1326980 - RNA, 11 nt, Human
cacccucuucc

SEQ ID NO: 1326981 - RNA, 12 nt, Human
cacccucuuccu

SEQ ID NO: 1326982 - RNA, 14 nt, Human
cacccucuuccuac

SEQ ID NO: 1326983 - RNA, 15 nt, Human
cacccucuuccuacu

SEQ ID NO: 1326984 - RNA, 16 nt, Human
cacccucuuccuacug

SEQ ID NO: 1326985 - RNA, 17 nt, Human
cacccucuuccuacugg

SEQ ID NO: 1326986 - RNA, 21 nt, Human
cacccucuuccuacuggucuc

SEQ ID NO: 1326987 - RNA, 23 nt, Human
cacccugggcccugggcuggaau

SEQ ID NO: 1326988 - RNA, 21 nt, Human
cacccucaugcugugugacuc

SEQ ID NO: 1326989 - RNA, 16 nt, Human
cacccucaugcugugu

SEQ ID NO: 1326990 - RNA, 14 nt, Human
cacccucaugcugu

SEQ ID NO: 1326991 - RNA, 13 nt, Human
cacccucaugcug

SEQ ID NO: 1326992 - RNA, 17 nt, Human
cacccucauucuacuga

SEQ ID NO: 1326993 - RNA, 16 nt, Human
cacccuccagagacaa

SEQ ID NO: 1326994 - RNA, 13 nt, Human
caccugccucagg

SEQ ID NO: 1326995 - RNA, 14 nt, Human
caccugccucagga

SEQ ID NO: 1326996 - RNA, 20 nt, Human
caccugccucaggacugcga

SEQ ID NO: 1326997 - RNA, 15 nt, Human
caccccacucccaca

SEQ ID NO: 1326998 - RNA, 18 nt, Human
caccccacgccuuauccc

SEQ ID NO: 1326999 - RNA, 18 nt, Human
cacacaugcuucccuuuc

SEQ ID NO: 1327000 - RNA, 17 nt, Human
cacacaugaaguccaag

SEQ ID NO: 1327001 - RNA, 22 nt, Human
cacacaugaaguccaagcauuu

SEQ ID NO: 1327002 - RNA, 18 nt, Human
cacacagugcucaaggcc

SEQ ID NO: 1327003 - RNA, 23 nt, Human
cacacagggucugcaaggucuuu

SEQ ID NO: 1327004 - RNA, 13 nt, Human
cacacaguauuuu

SEQ ID NO: 1327005 - RNA, 14 nt, Human
cacacaguauuuuu

SEQ ID NO: 1327006 - RNA, 12 nt, Human
cacacagcugcc

SEQ ID NO: 1327007 - RNA, 14 nt, Human
cacacagcugccgg

SEQ ID NO: 1327008 - RNA, 13 nt, Human
cacacagcugccg

SEQ ID NO: 1327009 - RNA, 10 nt, Human
cacacaggca

SEQ ID NO: 1327010 - RNA, 16 nt, Human
cacacaggcauuuccu

SEQ ID NO: 1327011 - RNA, 17 nt, Human
cacacaggcauuuccug

SEQ ID NO: 1327012 - RNA, 18 nt, Human
cacacaggcauuuccugg

SEQ ID NO: 1327013 - RNA, 19 nt, Human
cacacaggcauuuccuggg

SEQ ID NO: 1327014 - RNA, 20 nt, Human
cacacaggcauuuccugggu

SEQ ID NO: 1327015 - RNA, 12 nt, Human
cacacagggcag

SEQ ID NO: 1327016 - RNA, 21 nt, Human
cacacaggcauuuccugggug

SEQ ID NO: 1327017 - RNA, 21 nt, Human
cacaguaaaaauggaaacuau

SEQ ID NO: 1327018 - RNA, 19 nt, Human
cacaguacgaaccuacagu

SEQ ID NO: 1327019 - RNA, 13 nt, Human
cacaguagucuug

SEQ ID NO: 1327020 - RNA, 15 nt, Human
cacaguauuuguaau

SEQ ID NO: 1327021 - RNA, 15 nt, Human
cacaguauugcucac

SEQ ID NO: 1327022 - RNA, 19 nt, Human
cacaguauugcucacccag

SEQ ID NO: 1327023 - RNA, 15 nt, Human
cacagucacugcucu

SEQ ID NO: 1327024 - RNA, 14 nt, Human
cacaguauuuguaa

SEQ ID NO: 1327025 - RNA, 17 nt, Human
cacagccucuuagaugc

SEQ ID NO: 1327026 - RNA, 21 nt, Human
cacagccucuuagaugcaguu

SEQ ID NO: 1327027 - RNA, 23 nt, Human
cacaggcccuuccucuccacugc

SEQ ID NO: 1327028 - RNA, 20 nt, Human
cacagcggagguguggagcc

SEQ ID NO: 1327029 - RNA, 13 nt, Human
cacaggccugugu

SEQ ID NO: 1327030 - RNA, 14 nt, Human
cacaggccugugua

SEQ ID NO: 1327031 - RNA, 15 nt, Human
cacagggucccacag

SEQ ID NO: 1327032 - RNA, 17 nt, Human
cacagggucccacagcc

SEQ ID NO: 1327033 - RNA, 18 nt, Human
cacagggucccacagcca

SEQ ID NO: 1327034 - RNA, 15 nt, Human
cacagggucugcucu

SEQ ID NO: 1327035 - RNA, 19 nt, Human
cacaggugcaacagacuug

SEQ ID NO: 1327036 - RNA, 23 nt, Human
caaugcuguauuuuaaaagaaug

SEQ ID NO: 1327037 - RNA, 20 nt, Human
caauggagacugucucaaga

SEQ ID NO: 1327038 - RNA, 22 nt, Human
caauggaccggagagugggggu

SEQ ID NO: 1327039 - RNA, 16 nt, Human
caaugcuguauuuuaa

SEQ ID NO: 1327040 - RNA, 17 nt, Human
caaugcuguauuuuaaa

SEQ ID NO: 1327041 - RNA, 14 nt, Human
caauuuaaauguua

SEQ ID NO: 1327042 - RNA, 13 nt, Human
caauuuaaauguu

SEQ ID NO: 1327043 - RNA, 11 nt, Human
caauuuaaaug

SEQ ID NO: 1327044 - RNA, 13 nt, Human
caauucuuucaag

SEQ ID NO: 1327045 - RNA, 19 nt, Human
caauucuuuuaacuguugu

SEQ ID NO: 1327046 - RNA, 22 nt, Human
caauugaaagugggcaaaagcu

SEQ ID NO: 1327047 - RNA, 22 nt, Human
caauucuucccuaucuuugcca

SEQ ID NO: 1327048 - RNA, 21 nt, Human
caauucuucccuaucuuugcc

SEQ ID NO: 1327049 - RNA, 15 nt, Human
caauucuugccaaau

SEQ ID NO: 1327050 - RNA, 22 nt, Human
caauuuauaccucaauuuucac

SEQ ID NO: 1327051 - RNA, 14 nt, Human
caauuuaugaauug

SEQ ID NO: 1327052 - RNA, 14 nt, Human
caauuuauaccuca

SEQ ID NO: 1327053 - RNA, 13 nt, Human
caauuuauaccuc

SEQ ID NO: 1327054 - RNA, 20 nt, Human
caauuuaguuguuguagaga

SEQ ID NO: 1327055 - RNA, 17 nt, Human
caauuuaguuguuguag

SEQ ID NO: 1327056 - RNA, 22 nt, Human
caauaaagcugcugagaaucua

SEQ ID NO: 1327057 - RNA, 23 nt, Human
caauaaagcugcugagaaucuag

SEQ ID NO: 1327058 - RNA, 17 nt, Human
caauaaagcugcugaga

SEQ ID NO: 1327059 - RNA, 15 nt, Human
caauaaagcugcuga

SEQ ID NO: 1327060 - RNA, 24 nt, Human
caaguccagguccugguggggcag

SEQ ID NO: 1327061 - RNA, 16 nt, Human
caaguccagguccugg

SEQ ID NO: 1327062 - RNA, 17 nt, Human
caaguccagguccuggu

SEQ ID NO: 1327063 - RNA, 15 nt, Human
caagcuauucaauuc

SEQ ID NO: 1327064 - RNA, 21 nt, Human
caagcuaggugcuauuuguca

SEQ ID NO: 1327065 - RNA, 21 nt, Human
caagcucacuccccaaccccc

SEQ ID NO: 1327066 - RNA, 21 nt, Human
caagcucagaggcgcacugug

SEQ ID NO: 1327067 - RNA, 19 nt, Human
caagcucuaucaccaagga

SEQ ID NO: 1327068 - RNA, 19 nt, Human
caagcuccaagccccaucu

SEQ ID NO: 1327069 - RNA, 13 nt, Human
caagcuccaagcc

SEQ ID NO: 1327070 - RNA, 14 nt, Human
caagcuccaagccc

SEQ ID NO: 1327071 - RNA, 14 nt, Human
caagcucugaggga

SEQ ID NO: 1327072 - RNA, 17 nt, Human
caagcucugagggaaag

SEQ ID NO: 1327073 - RNA, 23 nt, Human
caagcucugagggaaagggcccu

SEQ ID NO: 1327074 - RNA, 15 nt, Human
caaggcacugucacu

SEQ ID NO: 1327075 - RNA, 18 nt, Human
caaggcacuugaggggga

SEQ ID NO: 1327076 - RNA, 20 nt, Human
caaggcacuugagggggaag

SEQ ID NO: 1327077 - RNA, 13 nt, Human
caaggcagaggcc

SEQ ID NO: 1327078 - RNA, 14 nt, Human
caaggcagaggccu

SEQ ID NO: 1327079 - RNA, 15 nt, Human
caaggcagaggccug

SEQ ID NO: 1327080 - RNA, 16 nt, Human
caaggcagaggccugg

SEQ ID NO: 1327081 - RNA, 19 nt, Human
caaggcagaggccugggcu

SEQ ID NO: 1327082 - RNA, 20 nt, Human
caaggcagaggccugggcug

SEQ ID NO: 1327083 - RNA, 14 nt, Human
caaggcagcaaggc

SEQ ID NO: 1327084 - RNA, 16 nt, Human
caaguaugaauaaaga

SEQ ID NO: 1327085 - RNA, 18 nt, Human
caaguauacuagggagcc

SEQ ID NO: 1327086 - RNA, 15 nt, Human
caaggcagcaaggcc

SEQ ID NO: 1327087 - RNA, 16 nt, Human
caaggcagcaaggccc

SEQ ID NO: 1327088 - RNA, 17 nt, Human
caaggcagcaaggcccg

SEQ ID NO: 1327089 - RNA, 19 nt, Human
caaggcagcaaggcccgag

SEQ ID NO: 1327090 - RNA, 13 nt, Human
caaggcagccgug

SEQ ID NO: 1327091 - RNA, 12 nt, Human
caaggcagccgu

SEQ ID NO: 1327092 - RNA, 19 nt, Human
caaguaugaauaaagacac

SEQ ID NO: 1327093 - RNA, 21 nt, Human
caaguaugaauaaagacaccu

SEQ ID NO: 1327094 - RNA, 22 nt, Human
caaguaugugggcagauuuuca

SEQ ID NO: 1327095 - RNA, 22 nt, Human
caaguauuuguuaauuuagaaa

SEQ ID NO: 1327096 - RNA, 11 nt, Human
caaguauuuuu

SEQ ID NO: 1327097 - RNA, 15 nt, Human
caaguauuuuuaauu

SEQ ID NO: 1327098 - RNA, 16 nt, Human
caaguauuuuuaauua

SEQ ID NO: 1327099 - RNA, 13 nt, Human
caaguccaggucc

SEQ ID NO: 1327100 - RNA, 15 nt, Human
caaguccagguccug

SEQ ID NO: 1327101 - RNA, 14 nt, Human
caagcuaagcacug

SEQ ID NO: 1327102 - RNA, 16 nt, Human
caagcuaagcacugcc

SEQ ID NO: 1327103 - RNA, 22 nt, Human
caagcuaagcacugccacuggg

SEQ ID NO: 1327104 - RNA, 12 nt, Human
caggguggcagc

SEQ ID NO: 1327105 - RNA, 20 nt, Human
cagggugcaguaucaugccc

SEQ ID NO: 1327106 - RNA, 18 nt, Human
cagggucuccagaaagcc

SEQ ID NO: 1327107 - RNA, 19 nt, Human
cagggucuccagaaagccc

SEQ ID NO: 1327108 - RNA, 11 nt, Human
cagguuuuucc

SEQ ID NO: 1327109 - RNA, 15 nt, Human
cagguugauaaauca

SEQ ID NO: 1327110 - RNA, 18 nt, Human
cagguugauaaaucauuu

SEQ ID NO: 1327111 - RNA, 13 nt, Human
cagguugauaaau

SEQ ID NO: 1327112 - RNA, 20 nt, Human
caggugcugacuucaucucc

SEQ ID NO: 1327113 - RNA, 21 nt, Human
caggugcugacuucaucuccc

SEQ ID NO: 1327114 - RNA, 23 nt, Human
caggugcugacuucaucucccac

SEQ ID NO: 1327115 - RNA, 15 nt, Human
caggguuuuaacuuu

SEQ ID NO: 1327116 - RNA, 21 nt, Human
cagguucuccguuagcuccug

SEQ ID NO: 1327117 - RNA, 22 nt, Human
cagguucuccguuagcuccugu

SEQ ID NO: 1327118 - RNA, 23 nt, Human
cagguucuccguuagcuccugug

SEQ ID NO: 1327119 - RNA, 24 nt, Human
cagguucuccguuagcuccugugg

SEQ ID NO: 1327120 - RNA, 12 nt, Human
cagguucuuguu

SEQ ID NO: 1327121 - RNA, 18 nt, Human
cagguucuuguuggugca

SEQ ID NO: 1327122 - RNA, 21 nt, Human
cagguucuuguuggugcacag

SEQ ID NO: 1327123 - RNA, 19 nt, Human
caggguuucaccauguugc

SEQ ID NO: 1327124 - RNA, 16 nt, Human
caggguuuuaacuuug

SEQ ID NO: 1327125 - RNA, 19 nt, Human
caggugcucaauaaaugau

SEQ ID NO: 1327126 - RNA, 16 nt, Human
caguaaauaacuggaa

SEQ ID NO: 1327127 - RNA, 17 nt, Human
caguaaauaacuggaaa

SEQ ID NO: 1327128 - RNA, 18 nt, Human
caguaaauaacuggaaaa

SEQ ID NO: 1327129 - RNA, 22 nt, Human
caguaaauaacuggaaaacaga

SEQ ID NO: 1327130 - RNA, 12 nt, Human
caguaaaucuuu

SEQ ID NO: 1327131 - RNA, 20 nt, Human
caguaaaucuuuuacaacug

SEQ ID NO: 1327132 - RNA, 12 nt, Human
cagguuuuuccc

SEQ ID NO: 1327133 - RNA, 13 nt, Human
cagguuuuuccuu

SEQ ID NO: 1327134 - RNA, 15 nt, Human
cagguuuuuccuuuu

SEQ ID NO: 1327135 - RNA, 23 nt, Human
caguaaauaacuggaaaacagaa

SEQ ID NO: 1327136 - RNA, 13 nt, Human
caguauuauaugu

SEQ ID NO: 1327137 - RNA, 15 nt, Human
caguauuauauguac

SEQ ID NO: 1327138 - RNA, 14 nt, Human
caguauuauaugua

SEQ ID NO: 1327139 - RNA, 18 nt, Human
caguauuuguaauuaaaa

SEQ ID NO: 1327140 - RNA, 23 nt, Human
caguauuuguaauuaaaagcaaa

SEQ ID NO: 1327141 - RNA, 12 nt, Human
caguauuuguaa

SEQ ID NO: 1327142 - RNA, 13 nt, Human
caguauuuguaau

SEQ ID NO: 1327143 - RNA, 14 nt, Human
caguauuuguaauu

SEQ ID NO: 1327144 - RNA, 15 nt, Human
caguauuuguaauua

SEQ ID NO: 1327145 - RNA, 16 nt, Human
caguauuuaacuucug

SEQ ID NO: 1327146 - RNA, 16 nt, Human
caguauuuagaagcca

SEQ ID NO: 1327147 - RNA, 17 nt, Human
caguauuuagaagccaa

SEQ ID NO: 1327148 - RNA, 13 nt, Human
caguauuuaacua

SEQ ID NO: 1327149 - RNA, 14 nt, Human
caguauuuaacuaa

SEQ ID NO: 1327150 - RNA, 17 nt, Human
caguauuuaacuaauua

SEQ ID NO: 1327151 - RNA, 15 nt, Human
cagggaggaggcaga

SEQ ID NO: 1327152 - RNA, 21 nt, Human
cagggaggaggcagagaagaa

SEQ ID NO: 1327153 - RNA, 22 nt, Human
cagggaggacgcucucuggccu

SEQ ID NO: 1327154 - RNA, 23 nt, Human
caggcugggccauguccaaagag

SEQ ID NO: 1327155 - RNA, 11 nt, Human
caggcugggcc

SEQ ID NO: 1327156 - RNA, 12 nt, Human
caggcugggcca

SEQ ID NO: 1327157 - RNA, 13 nt, Human
caggcugggccau

SEQ ID NO: 1327158 - RNA, 17 nt, Human
caggcugggccaugucc

SEQ ID NO: 1327159 - RNA, 18 nt, Human
caggcugggccaugucca

SEQ ID NO: 1327160 - RNA, 20 nt, Human
caggcugggccauguccaaa

SEQ ID NO: 1327161 - RNA, 22 nt, Human
caggcugggccauguccaaaga

SEQ ID NO: 1327162 - RNA, 18 nt, Human
cagggagggccugggccc

SEQ ID NO: 1327163 - RNA, 16 nt, Human
cagggaggucauuuug

SEQ ID NO: 1327164 - RNA, 19 nt, Human
cagggcuguaacugccagg

SEQ ID NO: 1327165 - RNA, 18 nt, Human
cagggcuguaacugccag

SEQ ID NO: 1327166 - RNA, 21 nt, Human
cagggcuguaacugccaggcu

SEQ ID NO: 1327167 - RNA, 13 nt, Human
cagggcugggagg

SEQ ID NO: 1327168 - RNA, 14 nt, Human
cagggcugggagga

SEQ ID NO: 1327169 - RNA, 19 nt, Human
cagggcugggaggaaggac

SEQ ID NO: 1327170 - RNA, 16 nt, Human
cagggcugggaggaag

SEQ ID NO: 1327171 - RNA, 23 nt, Human
caggacagcccuucuuuccacag

SEQ ID NO: 1327172 - RNA, 24 nt, Human
caggacagcccuucuuuccacaga

SEQ ID NO: 1327173 - RNA, 18 nt, Human
caggacaugcgguagcca

SEQ ID NO: 1327174 - RNA, 20 nt, Human
caggacaugcgguagccagc

SEQ ID NO: 1327175 - RNA, 21 nt, Human
caggacaugcgguagccagca

SEQ ID NO: 1327176 - RNA, 22 nt, Human
caggacaugcgguagccagcac

SEQ ID NO: 1327177 - RNA, 23 nt, Human
caggacaugcgguagccagcaca

SEQ ID NO: 1327178 - RNA, 15 nt, Human
caggaccagcucagg

SEQ ID NO: 1327179 - RNA, 16 nt, Human
caggaccagcucagga

SEQ ID NO: 1327180 - RNA, 17 nt, Human
caggaccagcucaggac

SEQ ID NO: 1327181 - RNA, 19 nt, Human
caggaccagcucaggacag

SEQ ID NO: 1327182 - RNA, 20 nt, Human
caggaccagcucaggacaga

SEQ ID NO: 1327183 - RNA, 17 nt, Human
caggacccugaaggggc

SEQ ID NO: 1327184 - RNA, 18 nt, Human
caggacccugaaggggcc

SEQ ID NO: 1327185 - RNA, 13 nt, Human
caggacccuggac

SEQ ID NO: 1327186 - RNA, 14 nt, Human
caggacccuggacc

SEQ ID NO: 1327187 - RNA, 17 nt, Human
caggacccuggacccag

SEQ ID NO: 1327188 - RNA, 22 nt, Human
caggacccuggacccagccaga

SEQ ID NO: 1327189 - RNA, 18 nt, Human
caggacccuggacccagc

SEQ ID NO: 1327190 - RNA, 15 nt, Human
caggaggcaggaccu

SEQ ID NO: 1327191 - RNA, 18 nt, Human
caggaggcaggaccuucg

SEQ ID NO: 1327192 - RNA, 13 nt, Human
caggacagaugcc

SEQ ID NO: 1327193 - RNA, 14 nt, Human
caggacagaugcca

SEQ ID NO: 1327194 - RNA, 17 nt, Human
caggacagaugccacac

SEQ ID NO: 1327195 - RNA, 16 nt, Human
caggcacugcugccca

SEQ ID NO: 1327196 - RNA, 17 nt, Human
caggcacugcugcccag

SEQ ID NO: 1327197 - RNA, 23 nt, Human
caggcacugagauaccagcgagg

SEQ ID NO: 1327198 - RNA, 14 nt, Human
caggcacugcaaac

SEQ ID NO: 1327199 - RNA, 21 nt, Human
caggcacugcaaaccgccacc

SEQ ID NO: 1327200 - RNA, 13 nt, Human
caggcacugcccu

SEQ ID NO: 1327201 - RNA, 15 nt, Human
caggcacugcccugg

SEQ ID NO: 1327202 - RNA, 16 nt, Human
caggcacugcccuggu

SEQ ID NO: 1327203 - RNA, 22 nt, Human
caggcacugcccugguggcccu

SEQ ID NO: 1327204 - RNA, 17 nt, Human
caggccaccuggcucuc

SEQ ID NO: 1327205 - RNA, 21 nt, Human
caggccaccuggcucucaccu

SEQ ID NO: 1327206 - RNA, 22 nt, Human
caggccaccuggcucucaccuc

SEQ ID NO: 1327207 - RNA, 23 nt, Human
caggcacugcugcccagccucca

SEQ ID NO: 1327208 - RNA, 15 nt, Human
caggcacugcuaggc

SEQ ID NO: 1327209 - RNA, 16 nt, Human
caggcacugggcauga

SEQ ID NO: 1327210 - RNA, 17 nt, Human
caggcacugggcaugag

SEQ ID NO: 1327211 - RNA, 18 nt, Human
caggcacugggcaugagg

SEQ ID NO: 1327212 - RNA, 12 nt, Human
caggcacuuggc

SEQ ID NO: 1327213 - RNA, 16 nt, Human
caggcacuuggcagcc

SEQ ID NO: 1327214 - RNA, 21 nt, Human
caggcacuuggcagccuugug

SEQ ID NO: 1327215 - RNA, 20 nt, Human
caggcacuuggcagccuugu

SEQ ID NO: 1327216 - RNA, 11 nt, Human
caggccaccuc

SEQ ID NO: 1327217 - RNA, 12 nt, Human
caggccaccucc

SEQ ID NO: 1327218 - RNA, 15 nt, Human
caggccaccucccca

SEQ ID NO: 1327219 - RNA, 16 nt, Human
caggccaccuccccag

SEQ ID NO: 1327220 - RNA, 19 nt, Human
caggccaccuccccagcau

SEQ ID NO: 1327221 - RNA, 20 nt, Human
caggccaccuccccagcauu

SEQ ID NO: 1327222 - RNA, 19 nt, Human
cagcuguggcagaguuaca

SEQ ID NO: 1327223 - RNA, 23 nt, Human
cagcuguggcagaguuacaguuc

SEQ ID NO: 1327224 - RNA, 17 nt, Human
cagcuuauucacaagac

SEQ ID NO: 1327225 - RNA, 16 nt, Human
cagcuuauucacaaga

SEQ ID NO: 1327226 - RNA, 22 nt, Human
cagcuguguccaaaaccgccag

SEQ ID NO: 1327227 - RNA, 14 nt, Human
cagcuuagauuuca

SEQ ID NO: 1327228 - RNA, 19 nt, Human
cagcuuagauuucauaguu

SEQ ID NO: 1327229 - RNA, 15 nt, Human
cagcuuagauuucau

SEQ ID NO: 1327230 - RNA, 16 nt, Human
cagcuuagauuucaua

SEQ ID NO: 1327231 - RNA, 17 nt, Human
cagcuuagauuucauag

SEQ ID NO: 1327232 - RNA, 13 nt, Human
cagcuuauacgaa

SEQ ID NO: 1327233 - RNA, 16 nt, Human
cagcuuauacgaaaua

SEQ ID NO: 1327234 - RNA, 19 nt, Human
cagcuuauacgaaauaauu

SEQ ID NO: 1327235 - RNA, 21 nt, Human
cagcuuauacgaaauaauugu

SEQ ID NO: 1327236 - RNA, 13 nt, Human
caggaaaaggccu

SEQ ID NO: 1327237 - RNA, 14 nt, Human
caggaaaaggccug

SEQ ID NO: 1327238 - RNA, 15 nt, Human
caggaaaaggccugg

SEQ ID NO: 1327239 - RNA, 16 nt, Human
caggaaaaggccuggg

SEQ ID NO: 1327240 - RNA, 17 nt, Human
caggaaaaggccugggg

SEQ ID NO: 1327241 - RNA, 18 nt, Human
caggaaaaggccuggggu

SEQ ID NO: 1327242 - RNA, 19 nt, Human
caggaaaaggccuggggug

SEQ ID NO: 1327243 - RNA, 21 nt, Human
caggaaaaggccuggggugac

SEQ ID NO: 1327244 - RNA, 17 nt, Human
caggaaaauugaaugca

SEQ ID NO: 1327245 - RNA, 13 nt, Human
caggaaaauugaa

SEQ ID NO: 1327246 - RNA, 16 nt, Human
caggaaaguggccaag

SEQ ID NO: 1327247 - RNA, 21 nt, Human
cagcccccacugccuuugacc

SEQ ID NO: 1327248 - RNA, 18 nt, Human
cagcccccacccccaagg

SEQ ID NO: 1327249 - RNA, 24 nt, Human
cagccccgcguggaacucgugucu

SEQ ID NO: 1327250 - RNA, 19 nt, Human
cagccccgugggguuccuc

SEQ ID NO: 1327251 - RNA, 18 nt, Human
cagcccccagcucccacc

SEQ ID NO: 1327252 - RNA, 19 nt, Human
cagcccccagcucccaccu

SEQ ID NO: 1327253 - RNA, 21 nt, Human
cagcccccagcucccaccucc

SEQ ID NO: 1327254 - RNA, 17 nt, Human
cagcccccuaagagagc

SEQ ID NO: 1327255 - RNA, 19 nt, Human
cagcccccuaagagagcac

SEQ ID NO: 1327256 - RNA, 12 nt, Human
cagcccccucac

SEQ ID NO: 1327257 - RNA, 14 nt, Human
cagcccccucacag

SEQ ID NO: 1327258 - RNA, 14 nt, Human
cagcccccuccugg

SEQ ID NO: 1327259 - RNA, 22 nt, Human
cagcccccuccuggugccaccu

SEQ ID NO: 1327260 - RNA, 12 nt, Human
cagcccccugac

SEQ ID NO: 1327261 - RNA, 13 nt, Human
cagcccccugacc

SEQ ID NO: 1327262 - RNA, 14 nt, Human
cagcccccugacca

SEQ ID NO: 1327263 - RNA, 16 nt, Human
cagcccccugaccacu

SEQ ID NO: 1327264 - RNA, 18 nt, Human
cagcccccugaccacuca

SEQ ID NO: 1327265 - RNA, 20 nt, Human
cagcccccugaccacucaga

SEQ ID NO: 1327266 - RNA, 21 nt, Human
cagcccccugaccacucagag

SEQ ID NO: 1327267 - RNA, 22 nt, Human
cagcccccugaccacucagaga

SEQ ID NO: 1327268 - RNA, 13 nt, Human
cagccccugcaca

SEQ ID NO: 1327269 - RNA, 24 nt, Human
cagccccucuuggagaagucucag

SEQ ID NO: 1327270 - RNA, 23 nt, Human
cagccccucuuggagaagucuca

SEQ ID NO: 1327271 - RNA, 18 nt, Human
cagccccucuuggagaag

SEQ ID NO: 1327272 - RNA, 20 nt, Human
cagccccucuuggagaaguc

SEQ ID NO: 1327273 - RNA, 21 nt, Human
cagccccucuuggagaagucu

SEQ ID NO: 1327274 - RNA, 13 nt, Human
cagcccugucagc

SEQ ID NO: 1327275 - RNA, 13 nt, Human
cagccccucuggu

SEQ ID NO: 1327276 - RNA, 14 nt, Human
cagccccucugguc

SEQ ID NO: 1327277 - RNA, 16 nt, Human
cagccccucuggucgc

SEQ ID NO: 1327278 - RNA, 18 nt, Human
cagccccucuggucgcuc

SEQ ID NO: 1327279 - RNA, 21 nt, Human
cagccccucuggucgcuccug

SEQ ID NO: 1327280 - RNA, 22 nt, Human
cagccccucuggucgcuccugc

SEQ ID NO: 1327281 - RNA, 22 nt, Human
cagcguggagggguaggggcug

SEQ ID NO: 1327282 - RNA, 23 nt, Human
cagcguggagggguaggggcugg

SEQ ID NO: 1327283 - RNA, 12 nt, Human
cagcguggccuu

SEQ ID NO: 1327284 - RNA, 13 nt, Human
cagcguggccuug

SEQ ID NO: 1327285 - RNA, 14 nt, Human
cagcguggccuugu

SEQ ID NO: 1327286 - RNA, 15 nt, Human
cagcguggccuuguu

SEQ ID NO: 1327287 - RNA, 18 nt, Human
cagcguggccuuguucug

SEQ ID NO: 1327288 - RNA, 21 nt, Human
cagcguuccuagagaagacag

SEQ ID NO: 1327289 - RNA, 19 nt, Human
cagcgugcuuuaaaaaaua

SEQ ID NO: 1327290 - RNA, 14 nt, Human
cagcggcccuguca

SEQ ID NO: 1327291 - RNA, 21 nt, Human
cagcggcuugccugccugcuc

SEQ ID NO: 1327292 - RNA, 23 nt, Human
cagccugagcgacagugagacuc

SEQ ID NO: 1327293 - RNA, 18 nt, Human
cagccucuccccugccug

SEQ ID NO: 1327294 - RNA, 16 nt, Human
cagccucuccccaggu

SEQ ID NO: 1327295 - RNA, 19 nt, Human
cagccucuccccaggucca

SEQ ID NO: 1327296 - RNA, 20 nt, Human
cagccucuccccagguccag

SEQ ID NO: 1327297 - RNA, 23 nt, Human
cagccucuccccagguccagcuc

SEQ ID NO: 1327298 - RNA, 18 nt, Human
cagccugcagacucacug

SEQ ID NO: 1327299 - RNA, 16 nt, Human
cagcccugucagcaug

SEQ ID NO: 1327300 - RNA, 17 nt, Human
cagcccugucagcauga

SEQ ID NO: 1327301 - RNA, 21 nt, Human
cagcccugucagcaugaauuu

SEQ ID NO: 1327302 - RNA, 18 nt, Human
cagcccugucagcaugaa

SEQ ID NO: 1327303 - RNA, 16 nt, Human
cagcccugucuuccua

SEQ ID NO: 1327304 - RNA, 24 nt, Human
cagccucuccacucaugugacucu

SEQ ID NO: 1327305 - RNA, 14 nt, Human
cagccucuccccag

SEQ ID NO: 1327306 - RNA, 17 nt, Human
cagccgcgcaucagacu

SEQ ID NO: 1327307 - RNA, 13 nt, Human
cagauuugagcuc

SEQ ID NO: 1327308 - RNA, 14 nt, Human
cagauuugagcuca

SEQ ID NO: 1327309 - RNA, 16 nt, Human
cagauuugagcucagc

SEQ ID NO: 1327310 - RNA, 20 nt, Human
cagauuugcuaauuuauccu

SEQ ID NO: 1327311 - RNA, 13 nt, Human
cagauuuggaaag

SEQ ID NO: 1327312 - RNA, 18 nt, Human
cagauuuggcuugacaaa

SEQ ID NO: 1327313 - RNA, 16 nt, Human
cagcacaucucaacag

SEQ ID NO: 1327314 - RNA, 22 nt, Human
cagcacagcuuagauuucauag

SEQ ID NO: 1327315 - RNA, 22 nt, Human
cagcacagcuugaccugaggcu

SEQ ID NO: 1327316 - RNA, 16 nt, Human
cagcacaggagggcgg

SEQ ID NO: 1327317 - RNA, 19 nt, Human
cagcacaucucaacaggcc

SEQ ID NO: 1327318 - RNA, 23 nt, Human
cagcaccaaaucaaaaucucucc

SEQ ID NO: 1327319 - RNA, 17 nt, Human
cagcacagcuuagauuu

SEQ ID NO: 1327320 - RNA, 13 nt, Human
cagcacagcuuga

SEQ ID NO: 1327321 - RNA, 15 nt, Human
cagcacagcuugacc

SEQ ID NO: 1327322 - RNA, 16 nt, Human
cagcacagcuugaccu

SEQ ID NO: 1327323 - RNA, 17 nt, Human
cagcacagcuugaccug

SEQ ID NO: 1327324 - RNA, 20 nt, Human
cagcacagcuugaccugagg

SEQ ID NO: 1327325 - RNA, 21 nt, Human
cagcacagcuugaccugaggc

SEQ ID NO: 1327326 - RNA, 11 nt, Human
cagcaccaaau

SEQ ID NO: 1327327 - RNA, 15 nt, Human
cagcaccaaaucaaa

SEQ ID NO: 1327328 - RNA, 19 nt, Human
cagcaccaaaucaaaaucu

SEQ ID NO: 1327329 - RNA, 22 nt, Human
cagcacucgcuagcaguggcag

SEQ ID NO: 1327330 - RNA, 14 nt, Human
cagcacugccugcu

SEQ ID NO: 1327331 - RNA, 15 nt, Human
cagcacugccugcuc

SEQ ID NO: 1327332 - RNA, 17 nt, Human
cagcacugccugcuccc

SEQ ID NO: 1327333 - RNA, 18 nt, Human
cagcacugccugcuccca

SEQ ID NO: 1327334 - RNA, 16 nt, Human
cagcacugcuugagga

SEQ ID NO: 1327335 - RNA, 18 nt, Human
cagcacugcuugaggaaa

SEQ ID NO: 1327336 - RNA, 19 nt, Human
cagcacugcuugaggaaaa

SEQ ID NO: 1327337 - RNA, 23 nt, Human
cagcacugccugcucccauccug

SEQ ID NO: 1327338 - RNA, 14 nt, Human
cagccagcaccugg

SEQ ID NO: 1327339 - RNA, 16 nt, Human
cagccagcaccuggca

SEQ ID NO: 1327340 - RNA, 12 nt, Human
cagccagcaccu

SEQ ID NO: 1327341 - RNA, 13 nt, Human
cagccagcaccug

SEQ ID NO: 1327342 - RNA, 16 nt, Human
cagaucauugugaaau

SEQ ID NO: 1327343 - RNA, 21 nt, Human
cagauacggacagagaccaag

SEQ ID NO: 1327344 - RNA, 22 nt, Human
cagauacggacagagaccaaga

SEQ ID NO: 1327345 - RNA, 22 nt, Human
cagaucauugugaaauuauuca

SEQ ID NO: 1327346 - RNA, 12 nt, Human
cagauccagccu

SEQ ID NO: 1327347 - RNA, 18 nt, Human
cagauccagccugggguc

SEQ ID NO: 1327348 - RNA, 13 nt, Human
cagauccagccug

SEQ ID NO: 1327349 - RNA, 14 nt, Human
cagauccagccugg

SEQ ID NO: 1327350 - RNA, 15 nt, Human
cagauccagccuggg

SEQ ID NO: 1327351 - RNA, 17 nt, Human
cagauccagccuggggu

SEQ ID NO: 1327352 - RNA, 23 nt, Human
cagagcuggagaugaggccagac

SEQ ID NO: 1327353 - RNA, 22 nt, Human
cagagcuggagaugaggccaga

SEQ ID NO: 1327354 - RNA, 21 nt, Human
cagagcuggagaugaggccag

SEQ ID NO: 1327355 - RNA, 17 nt, Human
cagagcuggagaugagg

SEQ ID NO: 1327356 - RNA, 13 nt, Human
cagagcuggcucu

SEQ ID NO: 1327357 - RNA, 17 nt, Human
cagagcuggcucugagc

SEQ ID NO: 1327358 - RNA, 18 nt, Human
cagagcuggcucugagcg

SEQ ID NO: 1327359 - RNA, 13 nt, Human
cagaggucuccca

SEQ ID NO: 1327360 - RNA, 16 nt, Human
cagagguugcagugag

SEQ ID NO: 1327361 - RNA, 11 nt, Human
cagagagcagu

SEQ ID NO: 1327362 - RNA, 14 nt, Human
cagagagcagugcu

SEQ ID NO: 1327363 - RNA, 17 nt, Human
cagagagcagugcuuuu

SEQ ID NO: 1327364 - RNA, 20 nt, Human
cagagaggccuuuuggaaug

SEQ ID NO: 1327365 - RNA, 18 nt, Human
cagagaggacuguaggga

SEQ ID NO: 1327366 - RNA, 20 nt, Human
cagagaggacuguagggagg

SEQ ID NO: 1327367 - RNA, 11 nt, Human
cagagccuggg

SEQ ID NO: 1327368 - RNA, 15 nt, Human
cagagcgugagcuga

SEQ ID NO: 1327369 - RNA, 19 nt, Human
cagagcgugagcugagcag

SEQ ID NO: 1327370 - RNA, 22 nt, Human
cagagcgugagcugagcaggcc

SEQ ID NO: 1327371 - RNA, 16 nt, Human
cagagccuggggcucu

SEQ ID NO: 1327372 - RNA, 12 nt, Human
cagagccugggg

SEQ ID NO: 1327373 - RNA, 13 nt, Human
cagagccuggggc

SEQ ID NO: 1327374 - RNA, 14 nt, Human
cagagccuggggcu

SEQ ID NO: 1327375 - RNA, 15 nt, Human
cagagcgcacaggga

SEQ ID NO: 1327376 - RNA, 13 nt, Human
cagagcgcacagg

SEQ ID NO: 1327377 - RNA, 11 nt, Human
caucagcaaac

SEQ ID NO: 1327378 - RNA, 19 nt, Human
caucagacugugaacccca

SEQ ID NO: 1327379 - RNA, 19 nt, Human
caucaggccuagaggccug

SEQ ID NO: 1327380 - RNA, 12 nt, Human
caucccaugcug

SEQ ID NO: 1327381 - RNA, 14 nt, Human
cauccuugagucaa

SEQ ID NO: 1327382 - RNA, 23 nt, Human
cauccuguguguuaagcucugcu

SEQ ID NO: 1327383 - RNA, 22 nt, Human
cauccuugucuuauucccuucc

SEQ ID NO: 1327384 - RNA, 13 nt, Human
cauccuugucuua

SEQ ID NO: 1327385 - RNA, 12 nt, Human
caucgcaaugua

SEQ ID NO: 1327386 - RNA, 21 nt, Human
caucgaaucuacuaauuccac

SEQ ID NO: 1327387 - RNA, 17 nt, Human
caucugucccuccggga

SEQ ID NO: 1327388 - RNA, 18 nt, Human
caucugucccuccgggac

SEQ ID NO: 1327389 - RNA, 20 nt, Human
caucugucccuccgggaccu

SEQ ID NO: 1327390 - RNA, 23 nt, Human
caucugucugccaaccuaaaacu

SEQ ID NO: 1327391 - RNA, 14 nt, Human
caugaccaguaaag

SEQ ID NO: 1327392 - RNA, 14 nt, Human
caugacccugccuc

SEQ ID NO: 1327393 - RNA, 18 nt, Human
caugaccuaguuuuccau

SEQ ID NO: 1327394 - RNA, 19 nt, Human
caugaccuaguuuuccaug

SEQ ID NO: 1327395 - RNA, 16 nt, Human
caugauucaugccaau

SEQ ID NO: 1327396 - RNA, 21 nt, Human
caugauucaugccaauuagca

SEQ ID NO: 1327397 - RNA, 13 nt, Human
caugauucauuuu

SEQ ID NO: 1327398 - RNA, 14 nt, Human
caugauucauuuua

SEQ ID NO: 1327399 - RNA, 16 nt, Human
caugaauuaguuuuau

SEQ ID NO: 1327400 - RNA, 14 nt, Human
caugaauuugugaa

SEQ ID NO: 1327401 - RNA, 17 nt, Human
caugaauuauuacagug

SEQ ID NO: 1327402 - RNA, 18 nt, Human
caugaauuauuacagugu

SEQ ID NO: 1327403 - RNA, 20 nt, Human
caugaauuauuacaguguuu

SEQ ID NO: 1327404 - RNA, 16 nt, Human
caugaauuugugaagg

SEQ ID NO: 1327405 - RNA, 19 nt, Human
caugaauuuguaaugucuu

SEQ ID NO: 1327406 - RNA, 22 nt, Human
caugaauuuguaaugucuugag

SEQ ID NO: 1327407 - RNA, 12 nt, Human
caugaauuugua

SEQ ID NO: 1327408 - RNA, 18 nt, Human
caugaauuuguaaugucu

SEQ ID NO: 1327409 - RNA, 21 nt, Human
caugauugguuucuaggcagu

SEQ ID NO: 1327410 - RNA, 17 nt, Human
caugauuccuuuaacaa

SEQ ID NO: 1327411 - RNA, 16 nt, Human
caugcaauacauacca

SEQ ID NO: 1327412 - RNA, 16 nt, Human
caugcugaggccuggg

SEQ ID NO: 1327413 - RNA, 17 nt, Human
caugcugaggccugggc

SEQ ID NO: 1327414 - RNA, 18 nt, Human
caugcugaggccugggcc

SEQ ID NO: 1327415 - RNA, 19 nt, Human
caugcugaggccugggccg

SEQ ID NO: 1327416 - RNA, 18 nt, Human
caugauucauuuuaacau

SEQ ID NO: 1327417 - RNA, 15 nt, Human
caugacccugccucu

SEQ ID NO: 1327418 - RNA, 14 nt, Human
caugauuccagcca

SEQ ID NO: 1327419 - RNA, 15 nt, Human
caugauuccagccau

SEQ ID NO: 1327420 - RNA, 16 nt, Human
caugauuccagccauc

SEQ ID NO: 1327421 - RNA, 17 nt, Human
caugauuccagccauca

SEQ ID NO: 1327422 - RNA, 13 nt, Human
caugauuccuuua

SEQ ID NO: 1327423 - RNA, 16 nt, Human
caugauuccuuuaaca

SEQ ID NO: 1327424 - RNA, 22 nt, Human
caugauuccuuuaacaacaugu

SEQ ID NO: 1327425 - RNA, 14 nt, Human
caugauucuauuua

SEQ ID NO: 1327426 - RNA, 12 nt, Human
caugcugccucc

SEQ ID NO: 1327427 - RNA, 14 nt, Human
caugcugccuccag

SEQ ID NO: 1327428 - RNA, 22 nt, Human
caugcugccuuauucagggaag

SEQ ID NO: 1327429 - RNA, 14 nt, Human
caugcugcugggga

SEQ ID NO: 1327430 - RNA, 12 nt, Human
cauagcccucac

SEQ ID NO: 1327431 - RNA, 15 nt, Human
cauagcccaguagac

SEQ ID NO: 1327432 - RNA, 15 nt, Human
cauagccaggaaacu

SEQ ID NO: 1327433 - RNA, 11 nt, Human
cauagcccagu

SEQ ID NO: 1327434 - RNA, 15 nt, Human
cauagcccucacccu

SEQ ID NO: 1327435 - RNA, 19 nt, Human
cauagcccucacccugggg

SEQ ID NO: 1327436 - RNA, 18 nt, Human
cauagcgggggccuaaaa

SEQ ID NO: 1327437 - RNA, 16 nt, Human
cauaggaccuuuccac

SEQ ID NO: 1327438 - RNA, 18 nt, Human
cauaggaccuuuccacca

SEQ ID NO: 1327439 - RNA, 16 nt, Human
cauaggaguuuggagg

SEQ ID NO: 1327440 - RNA, 17 nt, Human
cauaggaguuuggagga

SEQ ID NO: 1327441 - RNA, 20 nt, Human
cauaggaguuuggaggaagu

SEQ ID NO: 1327442 - RNA, 19 nt, Human
cauaggaguuuggaggaag

SEQ ID NO: 1327443 - RNA, 15 nt, Human
caguuugugugucuu

SEQ ID NO: 1327444 - RNA, 16 nt, Human
caguuugugugucuua

SEQ ID NO: 1327445 - RNA, 20 nt, Human
cauaaucuggacuccucugu

SEQ ID NO: 1327446 - RNA, 21 nt, Human
caguuugugugucuuaauuau

SEQ ID NO: 1327447 - RNA, 23 nt, Human
caguuugugugucuuaauuauua

SEQ ID NO: 1327448 - RNA, 21 nt, Human
cauaaucuggacuccucuguc

SEQ ID NO: 1327449 - RNA, 22 nt, Human
cauaaucuggacuccucugucc

SEQ ID NO: 1327450 - RNA, 23 nt, Human
cauaaucuggacuccucugucca

SEQ ID NO: 1327451 - RNA, 13 nt, Human
cauaaucuucugc

SEQ ID NO: 1327452 - RNA, 15 nt, Human
cauaaucuucugccu

SEQ ID NO: 1327453 - RNA, 21 nt, Human
cauaaucuucugccuucucau

SEQ ID NO: 1327454 - RNA, 22 nt, Human
cauaaucuucugccuucucaug

SEQ ID NO: 1327455 - RNA, 20 nt, Human
cauaaugcauucuucucugu

SEQ ID NO: 1327456 - RNA, 21 nt, Human
cauaaugcauucuucucuguu

SEQ ID NO: 1327457 - RNA, 22 nt, Human
cauaaugcauucuucucuguug

SEQ ID NO: 1327458 - RNA, 22 nt, Human
caguuuggguaaaauacuuuua

SEQ ID NO: 1327459 - RNA, 20 nt, Human
caguuuggguaaaauacuuu

SEQ ID NO: 1327460 - RNA, 18 nt, Human
caguuuguagugccacug

SEQ ID NO: 1327461 - RNA, 12 nt, Human
caguuugcuuug

SEQ ID NO: 1327462 - RNA, 14 nt, Human
caguuugcuuugcc

SEQ ID NO: 1327463 - RNA, 16 nt, Human
caguuugcuuugcccu

SEQ ID NO: 1327464 - RNA, 14 nt, Human
caguuugcuuugua

SEQ ID NO: 1327465 - RNA, 21 nt, Human
caguuugcuuuguaugcacuu

SEQ ID NO: 1327466 - RNA, 14 nt, Human
caguuuaaaagcac

SEQ ID NO: 1327467 - RNA, 13 nt, Human
caguuuaaugaag

SEQ ID NO: 1327468 - RNA, 18 nt, Human
caguuuaaugaagaucua

SEQ ID NO: 1327469 - RNA, 19 nt, Human
caguuuaaugaagaucuaa

SEQ ID NO: 1327470 - RNA, 21 nt, Human
caguuuaaugaagaucuaaau

SEQ ID NO: 1327471 - RNA, 23 nt, Human
caguuuacagacgcugcugucac

SEQ ID NO: 1327472 - RNA, 23 nt, Human
caguuuaccaguugccuuuuauc

SEQ ID NO: 1327473 - RNA, 18 nt, Human
caguuuaccaguugccuu

SEQ ID NO: 1327474 - RNA, 19 nt, Human
caguuuauauuuaacucuc

SEQ ID NO: 1327475 - RNA, 14 nt, Human
caguuuauauuuaa

SEQ ID NO: 1327476 - RNA, 13 nt, Human
caguuuaucauuc

SEQ ID NO: 1327477 - RNA, 17 nt, Human
caguuuauauuuaacuc

SEQ ID NO: 1327478 - RNA, 11 nt, Human
caguuugcaaa

SEQ ID NO: 1327479 - RNA, 15 nt, Human
caguuugcaaaaaau

SEQ ID NO: 1327480 - RNA, 17 nt, Human
caguuugcaaaaaaugu

SEQ ID NO: 1327481 - RNA, 15 nt, Human
caguuguucuuuuua

SEQ ID NO: 1327482 - RNA, 19 nt, Human
caguuguucuuuuuagaaa

SEQ ID NO: 1327483 - RNA, 15 nt, Human
caguuuaaaagcacg

SEQ ID NO: 1327484 - RNA, 20 nt, Human
cauuuuuguacuaacuagca

SEQ ID NO: 1327485 - RNA, 13 nt, Human
cauuuuuguauuu

SEQ ID NO: 1327486 - RNA, 20 nt, Human
cauuuuuguauuuuguuuaa

SEQ ID NO: 1327487 - RNA, 19 nt, Human
ccaaaaauguguaagaaca

SEQ ID NO: 1327488 - RNA, 14 nt, Human
ccaaaacaauguuu

SEQ ID NO: 1327489 - RNA, 22 nt, Human
ccaaaaauuacuuaguauugca

SEQ ID NO: 1327490 - RNA, 16 nt, Human
ccaaaaagugaaauaa

SEQ ID NO: 1327491 - RNA, 12 nt, Human
ccaaaaauagcu

SEQ ID NO: 1327492 - RNA, 13 nt, Human
ccaaaaauagcua

SEQ ID NO: 1327493 - RNA, 16 nt, Human
ccaaaaauaaauauau

SEQ ID NO: 1327494 - RNA, 12 nt, Human
cauuuccaagca

SEQ ID NO: 1327495 - RNA, 18 nt, Human
cauuuuugaauacaggca

SEQ ID NO: 1327496 - RNA, 20 nt, Human
cauuuuugaauacaggcaua

SEQ ID NO: 1327497 - RNA, 16 nt, Human
cauuugguucauuaau

SEQ ID NO: 1327498 - RNA, 20 nt, Human
cauuugguucauuaauucua

SEQ ID NO: 1327499 - RNA, 21 nt, Human
cauuugguucauuaauucuau

SEQ ID NO: 1327500 - RNA, 14 nt, Human
cauuggcuauuuaa

SEQ ID NO: 1327501 - RNA, 18 nt, Human
cauuggcuauuuaaaacu

SEQ ID NO: 1327502 - RNA, 19 nt, Human
cauuggcuauuuaaaacuu

SEQ ID NO: 1327503 - RNA, 14 nt, Human
cauugcugugaaca

SEQ ID NO: 1327504 - RNA, 20 nt, Human
cauuggcaccuaauccaggc

SEQ ID NO: 1327505 - RNA, 21 nt, Human
cauuggcaccuaauccaggca

SEQ ID NO: 1327506 - RNA, 18 nt, Human
cauuucauuugugccaga

SEQ ID NO: 1327507 - RNA, 14 nt, Human
cauuucauuuccua

SEQ ID NO: 1327508 - RNA, 15 nt, Human
cauuucacuuauuua

SEQ ID NO: 1327509 - RNA, 19 nt, Human
cauuucacuugucaggagu

SEQ ID NO: 1327510 - RNA, 13 nt, Human
cauuucagaaguu

SEQ ID NO: 1327511 - RNA, 21 nt, Human
cauuucagaaguuaguuugua

SEQ ID NO: 1327512 - RNA, 14 nt, Human
cauuuauuuugaca

SEQ ID NO: 1327513 - RNA, 14 nt, Human
cauuucaaaaugau

SEQ ID NO: 1327514 - RNA, 15 nt, Human
cauuucaacuguuug

SEQ ID NO: 1327515 - RNA, 23 nt, Human
cauugcguuugaccuuuuaugua

SEQ ID NO: 1327516 - RNA, 22 nt, Human
cauggcuggagcuagaauuuga

SEQ ID NO: 1327517 - RNA, 16 nt, Human
caugcugcuggggaag

SEQ ID NO: 1327518 - RNA, 16 nt, Human
cauggccugcaaacug

SEQ ID NO: 1327519 - RNA, 19 nt, Human
cauggccugcaaacuggga

SEQ ID NO: 1327520 - RNA, 20 nt, Human
cauggccugcaaacugggaa

SEQ ID NO: 1327521 - RNA, 14 nt, Human
cauggcuaacuggc

SEQ ID NO: 1327522 - RNA, 16 nt, Human
cauggcuaacuggcga

SEQ ID NO: 1327523 - RNA, 23 nt, Human
cauguuauuuguaauagauguuu

SEQ ID NO: 1327524 - RNA, 19 nt, Human
cauuaggaaaaguugcuau

SEQ ID NO: 1327525 - RNA, 15 nt, Human
cauuaggauggcuag

SEQ ID NO: 1327526 - RNA, 20 nt, Human
cauuagggaugccuccuuuc

SEQ ID NO: 1327527 - RNA, 15 nt, Human
cauucucauuggaaa

SEQ ID NO: 1327528 - RNA, 17 nt, Human
cauucucauuggaaauu

SEQ ID NO: 1327529 - RNA, 22 nt, Human
cauucucauuggaaauuuagca

SEQ ID NO: 1327530 - RNA, 14 nt, Human
cauucuccacagca

SEQ ID NO: 1327531 - RNA, 17 nt, Human
cauuagggaugccuccu

SEQ ID NO: 1327532 - RNA, 13 nt, Human
cauuaugaugugu

SEQ ID NO: 1327533 - RNA, 19 nt, Human
cauuaugcaauuuuuauau

SEQ ID NO: 1327534 - RNA, 16 nt, Human
cauucucacuccuacc

SEQ ID NO: 1327535 - RNA, 21 nt, Human
cauuaugugguuuuagauuuu

SEQ ID NO: 1327536 - RNA, 17 nt, Human
cauucucacuccuaccu

SEQ ID NO: 1327537 - RNA, 17 nt, Human
cauuaugugguuuuaga

SEQ ID NO: 1327538 - RNA, 18 nt, Human
ccaaagugcugggauuaa

SEQ ID NO: 1327539 - RNA, 15 nt, Human
ccaaauccccuaagc

SEQ ID NO: 1327540 - RNA, 22 nt, Human
ccaaagugcugggauuacaggu

SEQ ID NO: 1327541 - RNA, 20 nt, Human
ccaaauccuuagaucuggca

SEQ ID NO: 1327542 - RNA, 21 nt, Human
ccaaauccuuagaucuggcau

SEQ ID NO: 1327543 - RNA, 14 nt, Human
ccaaaucuggaagc

SEQ ID NO: 1327544 - RNA, 12 nt, Human
ccaaauuaagag

SEQ ID NO: 1327545 - RNA, 18 nt, Human
ccaaauuaaaaaagauaa

SEQ ID NO: 1327546 - RNA, 13 nt, Human
ccaaauuaaaaaa

SEQ ID NO: 1327547 - RNA, 15 nt, Human
ccaaauuaaaaaaga

SEQ ID NO: 1327548 - RNA, 17 nt, Human
ccaaauuaaaaaagaua

SEQ ID NO: 1327549 - RNA, 18 nt, Human
ccaaaugaaauauauuua

SEQ ID NO: 1327550 - RNA, 21 nt, Human
ccaaaugaaauauauuuaaaa

SEQ ID NO: 1327551 - RNA, 12 nt, Human
ccaaaugcagcu

SEQ ID NO: 1327552 - RNA, 11 nt, Human
ccaacuuguaa

SEQ ID NO: 1327553 - RNA, 17 nt, Human
ccaacuuggcugcagga

SEQ ID NO: 1327554 - RNA, 22 nt, Human
ccaacuacuguguuaugcaaaa

SEQ ID NO: 1327555 - RNA, 15 nt, Human
ccaacuagccccugg

SEQ ID NO: 1327556 - RNA, 17 nt, Human
ccaacuagccccugggg

SEQ ID NO: 1327557 - RNA, 14 nt, Human
ccaacuaugauuau

SEQ ID NO: 1327558 - RNA, 13 nt, Human
ccaaauucaguuu

SEQ ID NO: 1327559 - RNA, 15 nt, Human
ccaaauucaguuuca

SEQ ID NO: 1327560 - RNA, 18 nt, Human
ccaaauucaguuucauaa

SEQ ID NO: 1327561 - RNA, 19 nt, Human
ccaaauucaguuucauaaa

SEQ ID NO: 1327562 - RNA, 19 nt, Human
ccaacuaaugccuuacucu

SEQ ID NO: 1327563 - RNA, 20 nt, Human
ccaacuaaugccuuacucuu

SEQ ID NO: 1327564 - RNA, 14 nt, Human
ccaacuacuaauag

SEQ ID NO: 1327565 - RNA, 22 nt, Human
ccaacuacuaauagaauaaagg

SEQ ID NO: 1327566 - RNA, 21 nt, Human
ccaaaaccgccagcucuguuc

SEQ ID NO: 1327567 - RNA, 15 nt, Human
ccaaaaccgccagcu

SEQ ID NO: 1327568 - RNA, 16 nt, Human
ccaaaaccgccagcuc

SEQ ID NO: 1327569 - RNA, 17 nt, Human
ccaaaaccgccagcucu

SEQ ID NO: 1327570 - RNA, 18 nt, Human
ccaaaaccgccagcucug

SEQ ID NO: 1327571 - RNA, 19 nt, Human
ccaaaaccgccagcucugu

SEQ ID NO: 1327572 - RNA, 19 nt, Human
ccaaagugcugggauuaca

SEQ ID NO: 1327573 - RNA, 22 nt, Human
ccaaagugcugggauuacaggc

SEQ ID NO: 1327574 - RNA, 23 nt, Human
ccaauguuucaagaggagccccc

SEQ ID NO: 1327575 - RNA, 14 nt, Human
ccaauuaguuuccu

SEQ ID NO: 1327576 - RNA, 15 nt, Human
ccaauuaguuuccuu

SEQ ID NO: 1327577 - RNA, 16 nt, Human
ccaauuaguuuccuuu

SEQ ID NO: 1327578 - RNA, 20 nt, Human
ccaauuaguuuccuuuuuaa

SEQ ID NO: 1327579 - RNA, 14 nt, Human
ccaagcuguuuucu

SEQ ID NO: 1327580 - RNA, 17 nt, Human
ccaagcuguuuucuucu

SEQ ID NO: 1327581 - RNA, 18 nt, Human
ccaagcuguuuucuucua

SEQ ID NO: 1327582 - RNA, 13 nt, Human
ccacccugggccc

SEQ ID NO: 1327583 - RNA, 23 nt, Human
ccaccgggcugggagcucugcag

SEQ ID NO: 1327584 - RNA, 15 nt, Human
ccaccguugucucau

SEQ ID NO: 1327585 - RNA, 19 nt, Human
ccaccguugucucaugcca

SEQ ID NO: 1327586 - RNA, 21 nt, Human
ccaccaggccaccuccccagc

SEQ ID NO: 1327587 - RNA, 20 nt, Human
ccacccuggccgaguccaag

SEQ ID NO: 1327588 - RNA, 21 nt, Human
ccacccuggccgaguccaagc

SEQ ID NO: 1327589 - RNA, 22 nt, Human
ccacccuggccgaguccaagcu

SEQ ID NO: 1327590 - RNA, 12 nt, Human
ccacccugggcc

SEQ ID NO: 1327591 - RNA, 16 nt, Human
ccaccagcugugucca

SEQ ID NO: 1327592 - RNA, 15 nt, Human
ccaccagcugugucc

SEQ ID NO: 1327593 - RNA, 13 nt, Human
ccaccaggccacc

SEQ ID NO: 1327594 - RNA, 19 nt, Human
ccaccaggccaccucccca

SEQ ID NO: 1327595 - RNA, 13 nt, Human
ccaccagaugcug

SEQ ID NO: 1327596 - RNA, 12 nt, Human
ccaccagaugcu

SEQ ID NO: 1327597 - RNA, 14 nt, Human
ccaccagcuguguc

SEQ ID NO: 1327598 - RNA, 17 nt, Human
ccacacuucucaggaca

SEQ ID NO: 1327599 - RNA, 18 nt, Human
ccacacuucucaggacac

SEQ ID NO: 1327600 - RNA, 21 nt, Human
ccacacuucucaggacacagg

SEQ ID NO: 1327601 - RNA, 22 nt, Human
ccacacuucucaggacacaggc

SEQ ID NO: 1327602 - RNA, 24 nt, Human
ccacacuucucaggacacaggccu

SEQ ID NO: 1327603 - RNA, 23 nt, Human
ccacacuucucaggacacaggcc

SEQ ID NO: 1327604 - RNA, 22 nt, Human
ccacacuucaggcucuucuccu

SEQ ID NO: 1327605 - RNA, 14 nt, Human
ccacacuucucagg

SEQ ID NO: 1327606 - RNA, 15 nt, Human
ccacacuucucagga

SEQ ID NO: 1327607 - RNA, 22 nt, Human
augucuauaaaccgaacugaug

SEQ ID NO: 1327608 - RNA, 14 nt, Human
augucuauucagcu

SEQ ID NO: 1327609 - RNA, 15 nt, Human
augucuauucagcuu

SEQ ID NO: 1327610 - RNA, 16 nt, Human
augucuauucagcuuc

SEQ ID NO: 1327611 - RNA, 16 nt, Human
auguccacugguucuu

SEQ ID NO: 1327612 - RNA, 20 nt, Human
augucccaacuuguaaaaau

SEQ ID NO: 1327613 - RNA, 18 nt, Human
auguccaucagaugacaa

SEQ ID NO: 1327614 - RNA, 14 nt, Human
auguccauuuacac

SEQ ID NO: 1327615 - RNA, 24 nt, Human
augucccuaccgagucucuucucc

SEQ ID NO: 1327616 - RNA, 17 nt, Human
augucaguaccuucaaa

SEQ ID NO: 1327617 - RNA, 20 nt, Human
augucaggguaccuggggcc

SEQ ID NO: 1327618 - RNA, 20 nt, Human
auguaguaugcuaugauuaa

SEQ ID NO: 1327619 - RNA, 15 nt, Human
uuuggggcuugauga

SEQ ID NO: 1327620 - RNA, 12 nt, Human
auguaguauuuu

SEQ ID NO: 1327621 - RNA, 21 nt, Human
auguaguauuuuuuguauaau

SEQ ID NO: 1327622 - RNA, 22 nt, Human
auguaguauuuuuuguauaauu

SEQ ID NO: 1327623 - RNA, 23 nt, Human
auguaguauuuuuuguauaauug

SEQ ID NO: 1327624 - RNA, 17 nt, Human
auguaguucugcuccag

SEQ ID NO: 1327625 - RNA, 18 nt, Human
auguaguucugcuccaga

SEQ ID NO: 1327626 - RNA, 21 nt, Human
auguaguuuuuauauguugua

SEQ ID NO: 1327627 - RNA, 20 nt, Human
auguaguuuuuauauguugu

SEQ ID NO: 1327628 - RNA, 20 nt, Human
auguauaacuuuaacuucug

SEQ ID NO: 1327629 - RNA, 11 nt, Human
auguaucacua

SEQ ID NO: 1327630 - RNA, 23 nt, Human
auguauaacuaggagcuuugacu

SEQ ID NO: 1327631 - RNA, 16 nt, Human
auguaucauagaaaug

SEQ ID NO: 1327632 - RNA, 17 nt, Human
auguaucauagaaaugu

SEQ ID NO: 1327633 - RNA, 19 nt, Human
auguauggguaggguaaau

SEQ ID NO: 1327634 - RNA, 21 nt, Human
auguauggguaggguaaauca

SEQ ID NO: 1327635 - RNA, 22 nt, Human
auguauggugcaauguguguau

SEQ ID NO: 1327636 - RNA, 12 nt, Human
auguauggugca

SEQ ID NO: 1327637 - RNA, 11 nt, Human
uuugcucaugg

SEQ ID NO: 1327638 - RNA, 12 nt, Human
uuugcucaugga

SEQ ID NO: 1327639 - RNA, 13 nt, Human
uuugcccauuuug

SEQ ID NO: 1327640 - RNA, 14 nt, Human
uuugccccuuuaua

SEQ ID NO: 1327641 - RNA, 17 nt, Human
uuugcccugcugcccuc

SEQ ID NO: 1327642 - RNA, 21 nt, Human
uuugcccugcugcccuccccc

SEQ ID NO: 1327643 - RNA, 23 nt, Human
uuugcccugcugcccucccccuc

SEQ ID NO: 1327644 - RNA, 12 nt, Human
uuugcccuuuga

SEQ ID NO: 1327645 - RNA, 14 nt, Human
uuugcuaauuuuua

SEQ ID NO: 1327646 - RNA, 21 nt, Human
uuugcuaauuuuuauuaauuu

SEQ ID NO: 1327647 - RNA, 13 nt, Human
uuugcuaguuuuu

SEQ ID NO: 1327648 - RNA, 16 nt, Human
uuugcuaucugggcug

SEQ ID NO: 1327649 - RNA, 24 nt, Human
uuugcaaggugcauuuuuacuauu

SEQ ID NO: 1327650 - RNA, 12 nt, Human
uuugcacagcuc

SEQ ID NO: 1327651 - RNA, 16 nt, Human
uuugcacagcucuccg

SEQ ID NO: 1327652 - RNA, 19 nt, Human
uuugcacauguuuccucua

SEQ ID NO: 1327653 - RNA, 18 nt, Human
uuugcccagaaagaagau

SEQ ID NO: 1327654 - RNA, 13 nt, Human
uuugcucauggaa

SEQ ID NO: 1327655 - RNA, 16 nt, Human
uuugcucauauuuccc

SEQ ID NO: 1327656 - RNA, 13 nt, Human
uuugcucauauuu

SEQ ID NO: 1327657 - RNA, 18 nt, Human
uuugcucagcuucuccaa

SEQ ID NO: 1327658 - RNA, 17 nt, Human
uuugcucauauuuccca

SEQ ID NO: 1327659 - RNA, 17 nt, Human
uuugcugugaggcuguc

SEQ ID NO: 1327660 - RNA, 19 nt, Human
uuugcugugaggcuguccu

SEQ ID NO: 1327661 - RNA, 21 nt, Human
uuugcugugaggcuguccugu

SEQ ID NO: 1327662 - RNA, 21 nt, Human
uuugcuguuuuaaacauuaau

SEQ ID NO: 1327663 - RNA, 23 nt, Human
uuuggccaaugcaccuaaagaaa

SEQ ID NO: 1327664 - RNA, 17 nt, Human
uuuggccaucugcuccu

SEQ ID NO: 1327665 - RNA, 20 nt, Human
uuuggggcaggaguagcuga

SEQ ID NO: 1327666 - RNA, 18 nt, Human
uuuggggcagaaaggacu

SEQ ID NO: 1327667 - RNA, 16 nt, Human
uuuggcuaguccuugu

SEQ ID NO: 1327668 - RNA, 20 nt, Human
uuugggaagugaagacugga

SEQ ID NO: 1327669 - RNA, 22 nt, Human
uuugggaagugaagacuggaag

SEQ ID NO: 1327670 - RNA, 16 nt, Human
uuugggagacauguga

SEQ ID NO: 1327671 - RNA, 18 nt, Human
uuugggagacaugugaca

SEQ ID NO: 1327672 - RNA, 21 nt, Human
uuugggagacaugugacauuu

SEQ ID NO: 1327673 - RNA, 14 nt, Human
uuugggagagacuu

SEQ ID NO: 1327674 - RNA, 23 nt, Human
uuugggagagacuuguuuuggau

SEQ ID NO: 1327675 - RNA, 16 nt, Human
uuugugagcaggcugu

SEQ ID NO: 1327676 - RNA, 23 nt, Human
uuugucucugcaaacugccuucu

SEQ ID NO: 1327677 - RNA, 17 nt, Human
uuuguagaagucacauu

SEQ ID NO: 1327678 - RNA, 20 nt, Human
uuuguagcuggggcuuugau

SEQ ID NO: 1327679 - RNA, 19 nt, Human
uuugucgcucaugugugca

SEQ ID NO: 1327680 - RNA, 17 nt, Human
uuuguuucuuucucuga

SEQ ID NO: 1327681 - RNA, 18 nt, Human
uuugugagucaauacaua

SEQ ID NO: 1327682 - RNA, 18 nt, Human
uuuguacauuugggaguu

SEQ ID NO: 1327683 - RNA, 19 nt, Human
uuuguaccauuuuaaaguu

SEQ ID NO: 1327684 - RNA, 14 nt, Human
uuuguacugaaaaa

SEQ ID NO: 1327685 - RNA, 15 nt, Human
uuuguacugaaaaau

SEQ ID NO: 1327686 - RNA, 19 nt, Human
uuuguaacccacugagagg

SEQ ID NO: 1327687 - RNA, 13 nt, Human
uuuguaaauuguc

SEQ ID NO: 1327688 - RNA, 12 nt, Human
augucuggagac

SEQ ID NO: 1327689 - RNA, 13 nt, Human
augucuggagacc

SEQ ID NO: 1327690 - RNA, 14 nt, Human
augucuggagacca

SEQ ID NO: 1327691 - RNA, 18 nt, Human
augucuggagaccaccag

SEQ ID NO: 1327692 - RNA, 23 nt, Human
augucuggagaccaccagggcau

SEQ ID NO: 1327693 - RNA, 12 nt, Human
augucuggggca

SEQ ID NO: 1327694 - RNA, 13 nt, Human
augucugguucuc

SEQ ID NO: 1327695 - RNA, 14 nt, Human
augucugguucuca

SEQ ID NO: 1327696 - RNA, 16 nt, Human
augucugguucucaau

SEQ ID NO: 1327697 - RNA, 17 nt, Human
augucugguucucaauu

SEQ ID NO: 1327698 - RNA, 19 nt, Human
augucugguucucaauucc

SEQ ID NO: 1327699 - RNA, 23 nt, Human
augucugguucucaauuccaaca

SEQ ID NO: 1327700 - RNA, 21 nt, Human
augucugguucucaauuccaa

SEQ ID NO: 1327701 - RNA, 14 nt, Human
augucuguggauuu

SEQ ID NO: 1327702 - RNA, 14 nt, Human
augucuguucuaca

SEQ ID NO: 1327703 - RNA, 16 nt, Human
augucuguucuacaua

SEQ ID NO: 1327704 - RNA, 23 nt, Human
augucuuaaaaccugcuuuucaa

SEQ ID NO: 1327705 - RNA, 16 nt, Human
uuuuaaguaaggaauu

SEQ ID NO: 1327706 - RNA, 23 nt, Human
uuuuaaggguuuguggaaaauga

SEQ ID NO: 1327707 - RNA, 15 nt, Human
uuuuaaguauuuagg

SEQ ID NO: 1327708 - RNA, 20 nt, Human
uuuuaaggguuuguggaaaa

SEQ ID NO: 1327709 - RNA, 15 nt, Human
uuuuaagcucugagc

SEQ ID NO: 1327710 - RNA, 16 nt, Human
uuuuaagaauaucugu

SEQ ID NO: 1327711 - RNA, 15 nt, Human
uuuuaacuuuguuuu

SEQ ID NO: 1327712 - RNA, 19 nt, Human
uuuuaagaauugaguaaug

SEQ ID NO: 1327713 - RNA, 13 nt, Human
uuuuaagaauauc

SEQ ID NO: 1327714 - RNA, 14 nt, Human
uuuuaacuguggau

SEQ ID NO: 1327715 - RNA, 11 nt, Human
uuuuaacuuug

SEQ ID NO: 1327716 - RNA, 12 nt, Human
uuuuaacuuugu

SEQ ID NO: 1327717 - RNA, 13 nt, Human
uuuuaacuuuguu

SEQ ID NO: 1327718 - RNA, 14 nt, Human
uuuuaacuuuguuu

SEQ ID NO: 1327719 - RNA, 18 nt, Human
uuuuaacuuuguuuuauu

SEQ ID NO: 1327720 - RNA, 14 nt, Human
uuuuaaaagaauga

SEQ ID NO: 1327721 - RNA, 15 nt, Human
uuuuaaaagaaugau

SEQ ID NO: 1327722 - RNA, 14 nt, Human
uuuuaacauuccuc

SEQ ID NO: 1327723 - RNA, 13 nt, Human
uuuuaacauuccu

SEQ ID NO: 1327724 - RNA, 16 nt, Human
uuuuaaaacacuucca

SEQ ID NO: 1327725 - RNA, 22 nt, Human
uuuuaaaacacuuccauaaucu

SEQ ID NO: 1327726 - RNA, 13 nt, Human
uuuuaaaacccag

SEQ ID NO: 1327727 - RNA, 17 nt, Human
uuuuaaaaauagacacu

SEQ ID NO: 1327728 - RNA, 22 nt, Human
uuuuaaaaauuaaaucaaccuu

SEQ ID NO: 1327729 - RNA, 20 nt, Human
uuuuaaaaauuguuaauuuu

SEQ ID NO: 1327730 - RNA, 17 nt, Human
uuuuaaaaaauggucac

SEQ ID NO: 1327731 - RNA, 16 nt, Human
uuuuaaaaaaugguca

SEQ ID NO: 1327732 - RNA, 14 nt, Human
uuuuaaaaagcaaa

SEQ ID NO: 1327733 - RNA, 14 nt, Human
uuuuaaaaaagcuu

SEQ ID NO: 1327734 - RNA, 15 nt, Human
uuuuaaaaaagcuua

SEQ ID NO: 1327735 - RNA, 17 nt, Human
uuuuaaaaaagcuuaaa

SEQ ID NO: 1327736 - RNA, 20 nt, Human
uuuuaaaaaagcuuaaaacu

SEQ ID NO: 1327737 - RNA, 21 nt, Human
uuuuaaaaaagcuuaaaacuu

SEQ ID NO: 1327738 - RNA, 22 nt, Human
uuuuaaaaaagcuuaaaacuuu

SEQ ID NO: 1327739 - RNA, 23 nt, Human
uuuuaaaaaagcuuaaaacuuug

SEQ ID NO: 1327740 - RNA, 13 nt, Human
uuuuaaaaaagaa

SEQ ID NO: 1327741 - RNA, 16 nt, Human
auguuuauucuucuag

SEQ ID NO: 1327742 - RNA, 17 nt, Human
auguuuauucuucuaga

SEQ ID NO: 1327743 - RNA, 18 nt, Human
auguuuauucuucuagag

SEQ ID NO: 1327744 - RNA, 19 nt, Human
auguuuagacuuuaacaua

SEQ ID NO: 1327745 - RNA, 21 nt, Human
auguuuagacuuuaacauaag

SEQ ID NO: 1327746 - RNA, 14 nt, Human
auguuuaguaaacu

SEQ ID NO: 1327747 - RNA, 17 nt, Human
auguuuagacuuuaaca

SEQ ID NO: 1327748 - RNA, 18 nt, Human
auguuuagacuuuaacau

SEQ ID NO: 1327749 - RNA, 18 nt, Human
auguuucaaacauauaua

SEQ ID NO: 1327750 - RNA, 21 nt, Human
auguuuauucuucuagaguuc

SEQ ID NO: 1327751 - RNA, 19 nt, Human
auguuuauucuucuagagu

SEQ ID NO: 1327752 - RNA, 14 nt, Human
auguuuauuucagg

SEQ ID NO: 1327753 - RNA, 21 nt, Human
auguuucaaacauauauaaca

SEQ ID NO: 1327754 - RNA, 11 nt, Human
uuuucuauuaa

SEQ ID NO: 1327755 - RNA, 12 nt, Human
uuuucuauuaaa

SEQ ID NO: 1327756 - RNA, 13 nt, Human
uuuucuauuaaaa

SEQ ID NO: 1327757 - RNA, 14 nt, Human
uuuucuauuaaaag

SEQ ID NO: 1327758 - RNA, 15 nt, Human
uuuucuauuaaaaga

SEQ ID NO: 1327759 - RNA, 16 nt, Human
uuuucuauuaaaagac

SEQ ID NO: 1327760 - RNA, 17 nt, Human
uuuucuauuaaaagacu

SEQ ID NO: 1327761 - RNA, 18 nt, Human
uuuucuauuaaaagacuc

SEQ ID NO: 1327762 - RNA, 19 nt, Human
uuuucuauuaaaagacuca

SEQ ID NO: 1327763 - RNA, 20 nt, Human
uuuucuauuaaaagacucau

SEQ ID NO: 1327764 - RNA, 21 nt, Human
uuuucuauuaaaagacucauc

SEQ ID NO: 1327765 - RNA, 18 nt, Human
uuuucuauuucacuggag

SEQ ID NO: 1327766 - RNA, 16 nt, Human
uuuucuauuuuaauaa

SEQ ID NO: 1327767 - RNA, 23 nt, Human
uuuucuauuucacuggagcacaa

SEQ ID NO: 1327768 - RNA, 14 nt, Human
auguuguaagcaac

SEQ ID NO: 1327769 - RNA, 14 nt, Human
auguuguaauauuu

SEQ ID NO: 1327770 - RNA, 17 nt, Human
auguuguaauauuucuu

SEQ ID NO: 1327771 - RNA, 19 nt, Human
auguuguaauauuucuuca

SEQ ID NO: 1327772 - RNA, 13 nt, Human
auguugucuaaga

SEQ ID NO: 1327773 - RNA, 14 nt, Human
auguugucuaagaa

SEQ ID NO: 1327774 - RNA, 16 nt, Human
auguugucuaagaaau

SEQ ID NO: 1327775 - RNA, 17 nt, Human
auguugucuaagaaauu

SEQ ID NO: 1327776 - RNA, 22 nt, Human
auguugucuaagaaauugaaua

SEQ ID NO: 1327777 - RNA, 22 nt, Human
auguuuuugaucaaaaacuauu

SEQ ID NO: 1327778 - RNA, 19 nt, Human
auguuuuuguucaaagcca

SEQ ID NO: 1327779 - RNA, 17 nt, Human
auguuuuccuugccaaa

SEQ ID NO: 1327780 - RNA, 18 nt, Human
auguuuucgaaaaucaaa

SEQ ID NO: 1327781 - RNA, 20 nt, Human
auguuuucgaaaaucaaaug

SEQ ID NO: 1327782 - RNA, 22 nt, Human
auguuuucgaaaaucaaauggu

SEQ ID NO: 1327783 - RNA, 18 nt, Human
auguuuucugaaaauaua

SEQ ID NO: 1327784 - RNA, 20 nt, Human
auguuuucugaaaauauaac

SEQ ID NO: 1327785 - RNA, 21 nt, Human
auguuuucugaaaauauaacc

SEQ ID NO: 1327786 - RNA, 23 nt, Human
auguuuucgaaaaucaaauggua

SEQ ID NO: 1327787 - RNA, 14 nt, Human
auguuuugacauuu

SEQ ID NO: 1327788 - RNA, 16 nt, Human
auguuuugacauuuuu

SEQ ID NO: 1327789 - RNA, 18 nt, Human
auuaaaaaagauaaacac

SEQ ID NO: 1327790 - RNA, 13 nt, Human
auuaaaaacugag

SEQ ID NO: 1327791 - RNA, 14 nt, Human
auuaaaaacugagu

SEQ ID NO: 1327792 - RNA, 20 nt, Human
auuaaaaacugagugacucu

SEQ ID NO: 1327793 - RNA, 19 nt, Human
auuaaaaagguuuacagaa

SEQ ID NO: 1327794 - RNA, 18 nt, Human
auuaaaaagguuuacaga

SEQ ID NO: 1327795 - RNA, 11 nt, Human
auuaaaagacu

SEQ ID NO: 1327796 - RNA, 12 nt, Human
auuaaaagacuc

SEQ ID NO: 1327797 - RNA, 13 nt, Human
auuaaaagacuca

SEQ ID NO: 1327798 - RNA, 14 nt, Human
auuaaaagacucau

SEQ ID NO: 1327799 - RNA, 15 nt, Human
auuaaaagacucauc

SEQ ID NO: 1327800 - RNA, 15 nt, Human
auuaaaagcaaauca

SEQ ID NO: 1327801 - RNA, 22 nt, Human
auuaaaagcaaaucauuuguuu

SEQ ID NO: 1327802 - RNA, 16 nt, Human
auuaaaagcaaaucau

SEQ ID NO: 1327803 - RNA, 13 nt, Human
auuaaaauauaau

SEQ ID NO: 1327804 - RNA, 18 nt, Human
auuaaaauauaaucucua

SEQ ID NO: 1327805 - RNA, 21 nt, Human
auuaacccacuagcucuuguu

SEQ ID NO: 1327806 - RNA, 11 nt, Human
auuaaccuaga

SEQ ID NO: 1327807 - RNA, 13 nt, Human
auuaaccuagaga

SEQ ID NO: 1327808 - RNA, 13 nt, Human
auuaaccucucac

SEQ ID NO: 1327809 - RNA, 13 nt, Human
auuaaccucugca

SEQ ID NO: 1327810 - RNA, 22 nt, Human
auuaacuggguaaugaaacaaa

SEQ ID NO: 1327811 - RNA, 19 nt, Human
auuaacuggguaaugaaac

SEQ ID NO: 1327812 - RNA, 14 nt, Human
auuaaccucugcac

SEQ ID NO: 1327813 - RNA, 15 nt, Human
auuaacgauguccaa

SEQ ID NO: 1327814 - RNA, 12 nt, Human
auuaacucauua

SEQ ID NO: 1327815 - RNA, 17 nt, Human
auuaacucauuagacug

SEQ ID NO: 1327816 - RNA, 18 nt, Human
auuaacuggguaaugaaa

SEQ ID NO: 1327817 - RNA, 13 nt, Human
auuaacuuuaaug

SEQ ID NO: 1327818 - RNA, 15 nt, Human
auuaagaaaaucuau

SEQ ID NO: 1327819 - RNA, 12 nt, Human
auuaagaaagga

SEQ ID NO: 1327820 - RNA, 13 nt, Human
auuaagaaaggaa

SEQ ID NO: 1327821 - RNA, 17 nt, Human
auuaagaaaggaagcau

SEQ ID NO: 1327822 - RNA, 11 nt, Human
auuaagaaaua

SEQ ID NO: 1327823 - RNA, 12 nt, Human
auuaagaaauag

SEQ ID NO: 1327824 - RNA, 23 nt, Human
auuaagaaaggaagcauuguaaa

SEQ ID NO: 1327825 - RNA, 15 nt, Human
auuaagaaggcaaaa

SEQ ID NO: 1327826 - RNA, 19 nt, Human
auuaagaaggcaaaaaugu

SEQ ID NO: 1327827 - RNA, 22 nt, Human
auuaagaaggcaaaaauguaaa

SEQ ID NO: 1327828 - RNA, 21 nt, Human
uuuuauucagcucauggacuu

SEQ ID NO: 1327829 - RNA, 11 nt, Human
uuuucagaugu

SEQ ID NO: 1327830 - RNA, 18 nt, Human
uuuucagaugugaaccau

SEQ ID NO: 1327831 - RNA, 17 nt, Human
uuuucagaugugaacca

SEQ ID NO: 1327832 - RNA, 18 nt, Human
uuuucagcaaacucuuuu

SEQ ID NO: 1327833 - RNA, 19 nt, Human
uuuucagcaaacucuuuuc

SEQ ID NO: 1327834 - RNA, 21 nt, Human
uuuucauuccaugugcccagu

SEQ ID NO: 1327835 - RNA, 20 nt, Human
uuuucauuccaugugcccag

SEQ ID NO: 1327836 - RNA, 22 nt, Human
uuuucauuaaauaaauuugacu

SEQ ID NO: 1327837 - RNA, 20 nt, Human
uuuucauuaaauaaauuuga

SEQ ID NO: 1327838 - RNA, 14 nt, Human
uuuucauuaaauaa

SEQ ID NO: 1327839 - RNA, 18 nt, Human
uuuucauuaaauaaauuu

SEQ ID NO: 1327840 - RNA, 17 nt, Human
uuuuccaggcuucugcu

SEQ ID NO: 1327841 - RNA, 19 nt, Human
uuuuccaggcuucugcugg

SEQ ID NO: 1327842 - RNA, 20 nt, Human
uuuuccaggcuucugcuggg

SEQ ID NO: 1327843 - RNA, 22 nt, Human
uuuuauguugcauagaauaaaa

SEQ ID NO: 1327844 - RNA, 19 nt, Human
uuuuaugugaaacauguuu

SEQ ID NO: 1327845 - RNA, 23 nt, Human
uuuuauggugccuaguauugaca

SEQ ID NO: 1327846 - RNA, 19 nt, Human
uuuuauguaguaauugaca

SEQ ID NO: 1327847 - RNA, 18 nt, Human
uuuuaugugaaacauguu

SEQ ID NO: 1327848 - RNA, 18 nt, Human
uuuuauggugccuaguau

SEQ ID NO: 1327849 - RNA, 19 nt, Human
uuuuauaauucucauuaaa

SEQ ID NO: 1327850 - RNA, 22 nt, Human
uuuuauggcacuaguauuucua

SEQ ID NO: 1327851 - RNA, 19 nt, Human
uuuuauggcacuaguauuu

SEQ ID NO: 1327852 - RNA, 14 nt, Human
uuuuauaauuuugu

SEQ ID NO: 1327853 - RNA, 13 nt, Human
uuuuauaaauacu

SEQ ID NO: 1327854 - RNA, 22 nt, Human
uuuuauaaauacugcaaaucag

SEQ ID NO: 1327855 - RNA, 18 nt, Human
uuuuaguuuuucauuaaa

SEQ ID NO: 1327856 - RNA, 15 nt, Human
auguugcauagaaua

SEQ ID NO: 1327857 - RNA, 16 nt, Human
auguuggccaggcugg

SEQ ID NO: 1327858 - RNA, 16 nt, Human
auguuggccaggcugc

SEQ ID NO: 1327859 - RNA, 16 nt, Human
auguugagaaucccaa

SEQ ID NO: 1327860 - RNA, 22 nt, Human
auguugagaaucccaaauuuga

SEQ ID NO: 1327861 - RNA, 18 nt, Human
auguugauuacagugcag

SEQ ID NO: 1327862 - RNA, 20 nt, Human
uuuuaguuuaaaaaccuugu

SEQ ID NO: 1327863 - RNA, 16 nt, Human
uuuuaguuuuucauua

SEQ ID NO: 1327864 - RNA, 22 nt, Human
uuuuaguuuuucauuaaauaaa

SEQ ID NO: 1327865 - RNA, 22 nt, Human
uuuuagauuuucugguucuaac

SEQ ID NO: 1327866 - RNA, 23 nt, Human
uuuuagcaaagauaucucaucuc

SEQ ID NO: 1327867 - RNA, 16 nt, Human
uuuuagccuucucugu

SEQ ID NO: 1327868 - RNA, 23 nt, Human
uuuuagccuucucuguucauuuc

SEQ ID NO: 1327869 - RNA, 15 nt, Human
auguugacaugggac

SEQ ID NO: 1327870 - RNA, 14 nt, Human
auguugaauacuuu

SEQ ID NO: 1327871 - RNA, 15 nt, Human
auguugaauacuuuu

SEQ ID NO: 1327872 - RNA, 19 nt, Human
auguugaauacuuuuuaca

SEQ ID NO: 1327873 - RNA, 16 nt, Human
auguugaagccuuugu

SEQ ID NO: 1327874 - RNA, 21 nt, Human
auguuauauguuguucuuaca

SEQ ID NO: 1327875 - RNA, 15 nt, Human
auguuaucuucucaa

SEQ ID NO: 1327876 - RNA, 16 nt, Human
auguuaucuucucaag

SEQ ID NO: 1327877 - RNA, 17 nt, Human
auguuaucuucucaagu

SEQ ID NO: 1327878 - RNA, 19 nt, Human
auguucaucaaugaaugaa

SEQ ID NO: 1327879 - RNA, 15 nt, Human
auguuauauauaaau

SEQ ID NO: 1327880 - RNA, 17 nt, Human
auguuauauauaaauau

SEQ ID NO: 1327881 - RNA, 18 nt, Human
auguuauauauaaauaua

SEQ ID NO: 1327882 - RNA, 19 nt, Human
auguuauauauaaauauau

SEQ ID NO: 1327883 - RNA, 22 nt, Human
auguuauauauaaauauauuau

SEQ ID NO: 1327884 - RNA, 20 nt, Human
auguuaguaauaccucuaau

SEQ ID NO: 1327885 - RNA, 14 nt, Human
auguuauauauaaa

SEQ ID NO: 1327886 - RNA, 20 nt, Human
auguuaguuaccuuauaguu

SEQ ID NO: 1327887 - RNA, 21 nt, Human
auguuaguuaccuuauaguua

SEQ ID NO: 1327888 - RNA, 22 nt, Human
auguuaguuaccuuauaguuac

SEQ ID NO: 1327889 - RNA, 23 nt, Human
auguuaguuaccuuauaguuacu

SEQ ID NO: 1327890 - RNA, 21 nt, Human
auguuaguaauaccucuaaua

SEQ ID NO: 1327891 - RNA, 16 nt, Human
auguuaguaauaccuc

SEQ ID NO: 1327892 - RNA, 15 nt, Human
auguuaguaauaccu

SEQ ID NO: 1327893 - RNA, 14 nt, Human
uuuuaaguugcuga

SEQ ID NO: 1327894 - RNA, 19 nt, Human
auuagaaucaaacauuuug

SEQ ID NO: 1327895 - RNA, 20 nt, Human
auuagaaucaaacauuuuga

SEQ ID NO: 1327896 - RNA, 21 nt, Human
auuagaaucaaacauuuugaa

SEQ ID NO: 1327897 - RNA, 14 nt, Human
auuagaauuauuua

SEQ ID NO: 1327898 - RNA, 13 nt, Human
auuagaauuauuu

SEQ ID NO: 1327899 - RNA, 20 nt, Human
auuagagauuaccuccugag

SEQ ID NO: 1327900 - RNA, 13 nt, Human
auuagagccugua

SEQ ID NO: 1327901 - RNA, 16 nt, Human
auuagagccuguaaac

SEQ ID NO: 1327902 - RNA, 19 nt, Human
auuagagggaggagaauga

SEQ ID NO: 1327903 - RNA, 18 nt, Human
auuauaagggcaaauugg

SEQ ID NO: 1327904 - RNA, 23 nt, Human
auuauaagggcaaauuggagaaa

SEQ ID NO: 1327905 - RNA, 22 nt, Human
auuauaauauacuauauuuaug

SEQ ID NO: 1327906 - RNA, 12 nt, Human
auuauaauauuu

SEQ ID NO: 1327907 - RNA, 14 nt, Human
auuauaaucuuaua

SEQ ID NO: 1327908 - RNA, 17 nt, Human
auuacuggccuuuuuca

SEQ ID NO: 1327909 - RNA, 21 nt, Human
auuacuggccuuuuucauuua

SEQ ID NO: 1327910 - RNA, 22 nt, Human
auuacuggccuuuuucauuuau

SEQ ID NO: 1327911 - RNA, 21 nt, Human
auuacuuuggggcuaauuuaa

SEQ ID NO: 1327912 - RNA, 23 nt, Human
auuacuuuggggcuaauuuaaca

SEQ ID NO: 1327913 - RNA, 14 nt, Human
auuacuuugugaau

SEQ ID NO: 1327914 - RNA, 14 nt, Human
auuacuuuugcugu

SEQ ID NO: 1327915 - RNA, 15 nt, Human
auuagaaauaaagca

SEQ ID NO: 1327916 - RNA, 12 nt, Human
auuagaaauauu

SEQ ID NO: 1327917 - RNA, 14 nt, Human
auuagaaauauuuu

SEQ ID NO: 1327918 - RNA, 15 nt, Human
auuagaaauauuuua

SEQ ID NO: 1327919 - RNA, 17 nt, Human
auuagaaauauuuuaaa

SEQ ID NO: 1327920 - RNA, 24 nt, Human
auuagaaauauuuuaaaaucagcu

SEQ ID NO: 1327921 - RNA, 22 nt, Human
auuagaaauuaccuguggauau

SEQ ID NO: 1327922 - RNA, 21 nt, Human
auuagaaauauuuuaaaauca

SEQ ID NO: 1327923 - RNA, 21 nt, Human
auuagaagacaauugacaaca

SEQ ID NO: 1327924 - RNA, 16 nt, Human
auuauauuuacaaaug

SEQ ID NO: 1327925 - RNA, 23 nt, Human
auuauagcucuaauguuugcaua

SEQ ID NO: 1327926 - RNA, 22 nt, Human
auuauagcucuaauguuugcau

SEQ ID NO: 1327927 - RNA, 21 nt, Human
auuauagcucuaauguuugca

SEQ ID NO: 1327928 - RNA, 17 nt, Human
auuauaggaucauuugu

SEQ ID NO: 1327929 - RNA, 19 nt, Human
auuauagcucuaauguuug

SEQ ID NO: 1327930 - RNA, 18 nt, Human
auuauagcucuaauguuu

SEQ ID NO: 1327931 - RNA, 17 nt, Human
auuauagcucuaauguu

SEQ ID NO: 1327932 - RNA, 16 nt, Human
auuauagcucuaaugu

SEQ ID NO: 1327933 - RNA, 15 nt, Human
auuauagcucuaaug

SEQ ID NO: 1327934 - RNA, 13 nt, Human
auuauagcucuaa

SEQ ID NO: 1327935 - RNA, 12 nt, Human
auuauagcucua

SEQ ID NO: 1327936 - RNA, 19 nt, Human
auuauagauucuaaagauu

SEQ ID NO: 1327937 - RNA, 13 nt, Human
auuauaaugaauu

SEQ ID NO: 1327938 - RNA, 14 nt, Human
auuauaaugaauuu

SEQ ID NO: 1327939 - RNA, 18 nt, Human
auuauaaucuuauaauug

SEQ ID NO: 1327940 - RNA, 21 nt, Human
auuauacuuguaauuauggag

SEQ ID NO: 1327941 - RNA, 13 nt, Human
auuauagauucua

SEQ ID NO: 1327942 - RNA, 14 nt, Human
auuauagauucuaa

SEQ ID NO: 1327943 - RNA, 15 nt, Human
auuauagauucuaaa

SEQ ID NO: 1327944 - RNA, 16 nt, Human
auuauagauucuaaag

SEQ ID NO: 1327945 - RNA, 17 nt, Human
auuauagauucuaaaga

SEQ ID NO: 1327946 - RNA, 18 nt, Human
auuauagauucuaaagau

SEQ ID NO: 1327947 - RNA, 22 nt, Human
auuaucuauagcuaaguacaca

SEQ ID NO: 1327948 - RNA, 19 nt, Human
auuaucuauagcuaaguac

SEQ ID NO: 1327949 - RNA, 12 nt, Human
auuaucuuaaaa

SEQ ID NO: 1327950 - RNA, 14 nt, Human
auuaucugggcuua

SEQ ID NO: 1327951 - RNA, 23 nt, Human
auuauuaacauaccuaagaagua

SEQ ID NO: 1327952 - RNA, 14 nt, Human
auuauuaaguaacu

SEQ ID NO: 1327953 - RNA, 18 nt, Human
auuauuaaguaacuuauu

SEQ ID NO: 1327954 - RNA, 19 nt, Human
auuauuaaguaacuuauuu

SEQ ID NO: 1327955 - RNA, 21 nt, Human
auuauuaaguaacuuauuuau

SEQ ID NO: 1327956 - RNA, 14 nt, Human
auuauuaaugaaaa

SEQ ID NO: 1327957 - RNA, 19 nt, Human
auuaucguuuucuuaaagu

SEQ ID NO: 1327958 - RNA, 20 nt, Human
auuaucguuuucuuaaagug

SEQ ID NO: 1327959 - RNA, 17 nt, Human
auuauauuuacaaaugg

SEQ ID NO: 1327960 - RNA, 23 nt, Human
auuauagugauguaaucuugaau

SEQ ID NO: 1327961 - RNA, 19 nt, Human
auuaucaauuaccacacca

SEQ ID NO: 1327962 - RNA, 12 nt, Human
auuaucagaugc

SEQ ID NO: 1327963 - RNA, 20 nt, Human
auuaucaggcaaauuugcau

SEQ ID NO: 1327964 - RNA, 21 nt, Human
auuaucaggcaaauuugcauu

SEQ ID NO: 1327965 - RNA, 17 nt, Human
auuauccagguaaucca

SEQ ID NO: 1327966 - RNA, 14 nt, Human
auuauccauauuga

SEQ ID NO: 1327967 - RNA, 17 nt, Human
auuauccauauugaguc

SEQ ID NO: 1327968 - RNA, 14 nt, Human
auuaucccagcugc

SEQ ID NO: 1327969 - RNA, 18 nt, Human
auuauuuuauguugcaua

SEQ ID NO: 1327970 - RNA, 16 nt, Human
auuauuuuauguugca

SEQ ID NO: 1327971 - RNA, 12 nt, Human
auuauuuaugua

SEQ ID NO: 1327972 - RNA, 13 nt, Human
auuauuuauguau

SEQ ID NO: 1327973 - RNA, 14 nt, Human
auuauuuauguaug

SEQ ID NO: 1327974 - RNA, 16 nt, Human
auuauuuauguauggu

SEQ ID NO: 1327975 - RNA, 19 nt, Human
auuauuuauguauggugca

SEQ ID NO: 1327976 - RNA, 14 nt, Human
auuauuuauguauu

SEQ ID NO: 1327977 - RNA, 15 nt, Human
auuauuuauguauug

SEQ ID NO: 1327978 - RNA, 15 nt, Human
auuauuuguguuuua

SEQ ID NO: 1327979 - RNA, 22 nt, Human
auuauuuguguuuuaauuuaaa

SEQ ID NO: 1327980 - RNA, 12 nt, Human
auuauuuguguu

SEQ ID NO: 1327981 - RNA, 22 nt, Human
auuauuaaugaaaauaagaauu

SEQ ID NO: 1327982 - RNA, 16 nt, Human
auuauuaauuuaugca

SEQ ID NO: 1327983 - RNA, 15 nt, Human
auuauuacaguguuu

SEQ ID NO: 1327984 - RNA, 13 nt, Human
auuauuacagugu

SEQ ID NO: 1327985 - RNA, 16 nt, Human
auuauuccucaaaaaa

SEQ ID NO: 1327986 - RNA, 16 nt, Human
auuauuuauauaugua

SEQ ID NO: 1327987 - RNA, 13 nt, Human
auuaaguaaugau

SEQ ID NO: 1327988 - RNA, 15 nt, Human
auuaaguaaugauaa

SEQ ID NO: 1327989 - RNA, 21 nt, Human
auuaaguaaugauaacuggaa

SEQ ID NO: 1327990 - RNA, 17 nt, Human
auuaauauauauuaucu

SEQ ID NO: 1327991 - RNA, 18 nt, Human
auuaauaucccuacaugu

SEQ ID NO: 1327992 - RNA, 19 nt, Human
auuaauaucccuacaugua

SEQ ID NO: 1327993 - RNA, 20 nt, Human
auuaauaucccuacauguau

SEQ ID NO: 1327994 - RNA, 16 nt, Human
auuaaucuuaguguau

SEQ ID NO: 1327995 - RNA, 17 nt, Human
auuaaucuuaguguaug

SEQ ID NO: 1327996 - RNA, 19 nt, Human
auuaaucuuaguguaugau

SEQ ID NO: 1327997 - RNA, 20 nt, Human
auuaaucuuaguguaugauu

SEQ ID NO: 1327998 - RNA, 21 nt, Human
auuaaucuuaguguaugauua

SEQ ID NO: 1327999 - RNA, 22 nt, Human
auuaaucuuaguguaugauuac

SEQ ID NO: 1328000 - RNA, 16 nt, Human
auuaaucugccucccu

SEQ ID NO: 1328001 - RNA, 23 nt, Human
uuuuuuaaaaaagaaacauuugg

SEQ ID NO: 1328002 - RNA, 15 nt, Human
auuaaguaacuuauu

SEQ ID NO: 1328003 - RNA, 19 nt, Human
auuaaguaacuuauuuaug

SEQ ID NO: 1328004 - RNA, 20 nt, Human
uuuuuguucugguccuuuuu

SEQ ID NO: 1328005 - RNA, 13 nt, Human
uuuuuguugacau

SEQ ID NO: 1328006 - RNA, 15 nt, Human
uuuuuguuuguuugu

SEQ ID NO: 1328007 - RNA, 12 nt, Human
uuuuuguugaca

SEQ ID NO: 1328008 - RNA, 13 nt, Human
uuuuuuaaaaaag

SEQ ID NO: 1328009 - RNA, 20 nt, Human
auuaagagagucuauuuacg

SEQ ID NO: 1328010 - RNA, 23 nt, Human
auuaagaaugaucugauugaccg

SEQ ID NO: 1328011 - RNA, 15 nt, Human
auuaagaaugaucug

SEQ ID NO: 1328012 - RNA, 14 nt, Human
auuaagaaugaucu

SEQ ID NO: 1328013 - RNA, 21 nt, Human
auuaagauaugggacauuuuu

SEQ ID NO: 1328014 - RNA, 16 nt, Human
auuaagaaugaucuga

SEQ ID NO: 1328015 - RNA, 13 nt, Human
auuacauuuguau

SEQ ID NO: 1328016 - RNA, 11 nt, Human
auuaaugcacu

SEQ ID NO: 1328017 - RNA, 12 nt, Human
auuaaugcacuu

SEQ ID NO: 1328018 - RNA, 17 nt, Human
auuaaugaaaauaagaa

SEQ ID NO: 1328019 - RNA, 19 nt, Human
auuaaugaaaauaagaauu

SEQ ID NO: 1328020 - RNA, 15 nt, Human
auuacauuuguauaa

SEQ ID NO: 1328021 - RNA, 16 nt, Human
auuacauuuguauaaa

SEQ ID NO: 1328022 - RNA, 15 nt, Human
auuacauuuucagug

SEQ ID NO: 1328023 - RNA, 16 nt, Human
auuaccaaccuguuac

SEQ ID NO: 1328024 - RNA, 12 nt, Human
auuaccuccuga

SEQ ID NO: 1328025 - RNA, 13 nt, Human
auuaccuccugag

SEQ ID NO: 1328026 - RNA, 17 nt, Human
auuaccuccugagaaaa

SEQ ID NO: 1328027 - RNA, 12 nt, Human
auuaccagggac

SEQ ID NO: 1328028 - RNA, 14 nt, Human
auuaccaaccuguu

SEQ ID NO: 1328029 - RNA, 14 nt, Human
auuaccuguggaua

SEQ ID NO: 1328030 - RNA, 15 nt, Human
auuaccuguggauau

SEQ ID NO: 1328031 - RNA, 16 nt, Human
auuaccuguggauauu

SEQ ID NO: 1328032 - RNA, 19 nt, Human
auuaccuguggauauuugu

SEQ ID NO: 1328033 - RNA, 19 nt, Human
auuaccuucuauuggucuc

SEQ ID NO: 1328034 - RNA, 16 nt, Human
auuacugaaaacuuca

SEQ ID NO: 1328035 - RNA, 14 nt, Human
auuacugcaugcac

SEQ ID NO: 1328036 - RNA, 17 nt, Human
auuacugcaugcacuuc

SEQ ID NO: 1328037 - RNA, 13 nt, Human
auuacugccauuc

SEQ ID NO: 1328038 - RNA, 20 nt, Human
auuacugccauucacuucau

SEQ ID NO: 1328039 - RNA, 21 nt, Human
auuccauucuggaagugacuu

SEQ ID NO: 1328040 - RNA, 15 nt, Human
auuccaugugcccag

SEQ ID NO: 1328041 - RNA, 16 nt, Human
auuccauugguccaag

SEQ ID NO: 1328042 - RNA, 17 nt, Human
auuccauugguccaaga

SEQ ID NO: 1328043 - RNA, 23 nt, Human
auuccauugguccaagauuccgg

SEQ ID NO: 1328044 - RNA, 13 nt, Human
auuccaugacugc

SEQ ID NO: 1328045 - RNA, 14 nt, Human
auuccaugacugcu

SEQ ID NO: 1328046 - RNA, 20 nt, Human
auuccaugacugcuugcccu

SEQ ID NO: 1328047 - RNA, 17 nt, Human
auuccaugacugcuugc

SEQ ID NO: 1328048 - RNA, 14 nt, Human
auuccaugugccca

SEQ ID NO: 1328049 - RNA, 16 nt, Human
auuccaugugcccagu

SEQ ID NO: 1328050 - RNA, 20 nt, Human
auuccacuuauaggaauuga

SEQ ID NO: 1328051 - RNA, 16 nt, Human
auuccaccugcaauca

SEQ ID NO: 1328052 - RNA, 14 nt, Human
auucaguuuucauu

SEQ ID NO: 1328053 - RNA, 17 nt, Human
auucaguuucauaaaag

SEQ ID NO: 1328054 - RNA, 13 nt, Human
auucaguuuucau

SEQ ID NO: 1328055 - RNA, 15 nt, Human
auucaguuuucauuu

SEQ ID NO: 1328056 - RNA, 19 nt, Human
auucccuucaucuggaacc

SEQ ID NO: 1328057 - RNA, 16 nt, Human
auucccuucaucugga

SEQ ID NO: 1328058 - RNA, 15 nt, Human
auucccuuccugcca

SEQ ID NO: 1328059 - RNA, 23 nt, Human
auucccuuccugccagccccugc

SEQ ID NO: 1328060 - RNA, 19 nt, Human
auucccuuccugccagccc

SEQ ID NO: 1328061 - RNA, 13 nt, Human
auuccggauccua

SEQ ID NO: 1328062 - RNA, 15 nt, Human
auuccggauccuaag

SEQ ID NO: 1328063 - RNA, 16 nt, Human
auuccggauccuaagc

SEQ ID NO: 1328064 - RNA, 19 nt, Human
auuccggauccuaagcauc

SEQ ID NO: 1328065 - RNA, 12 nt, Human
auuccgucacca

SEQ ID NO: 1328066 - RNA, 14 nt, Human
auucagcucaugga

SEQ ID NO: 1328067 - RNA, 23 nt, Human
auuauuuucauccuugucuuauu

SEQ ID NO: 1328068 - RNA, 12 nt, Human
auuauuuucauc

SEQ ID NO: 1328069 - RNA, 16 nt, Human
auucaaaaugauguau

SEQ ID NO: 1328070 - RNA, 20 nt, Human
auucaaaauaggguauauuu

SEQ ID NO: 1328071 - RNA, 21 nt, Human
auucaaaaguuccaagagucu

SEQ ID NO: 1328072 - RNA, 18 nt, Human
auucaaaauaggguauau

SEQ ID NO: 1328073 - RNA, 19 nt, Human
auucaggacugcugguuug

SEQ ID NO: 1328074 - RNA, 13 nt, Human
auucaguuucaua

SEQ ID NO: 1328075 - RNA, 14 nt, Human
auucaguuucauaa

SEQ ID NO: 1328076 - RNA, 22 nt, Human
auugaccuauuuccagaaauac

SEQ ID NO: 1328077 - RNA, 12 nt, Human
auugcaaaucuu

SEQ ID NO: 1328078 - RNA, 16 nt, Human
auugcaaaucuugaaa

SEQ ID NO: 1328079 - RNA, 17 nt, Human
auugcaaaucuugaaau

SEQ ID NO: 1328080 - RNA, 19 nt, Human
auugcaaaucuugaaauua

SEQ ID NO: 1328081 - RNA, 21 nt, Human
auugaccguguuggucuguac

SEQ ID NO: 1328082 - RNA, 23 nt, Human
auugaccgcgacuaauuucaaaa

SEQ ID NO: 1328083 - RNA, 17 nt, Human
auugaccgcgacuaauu

SEQ ID NO: 1328084 - RNA, 20 nt, Human
auugaccgcgacuaauuuca

SEQ ID NO: 1328085 - RNA, 14 nt, Human
auugcaauaucuga

SEQ ID NO: 1328086 - RNA, 16 nt, Human
auugcaauaucugaag

SEQ ID NO: 1328087 - RNA, 17 nt, Human
auugcaauaucugaagc

SEQ ID NO: 1328088 - RNA, 16 nt, Human
auucucagaaaggcaa

SEQ ID NO: 1328089 - RNA, 14 nt, Human
auugcaggauggug

SEQ ID NO: 1328090 - RNA, 17 nt, Human
auugcaggauggugucu

SEQ ID NO: 1328091 - RNA, 18 nt, Human
auugcagaaaauucugug

SEQ ID NO: 1328092 - RNA, 17 nt, Human
auugcagaaaauucugu

SEQ ID NO: 1328093 - RNA, 14 nt, Human
auugccaagggcuu

SEQ ID NO: 1328094 - RNA, 12 nt, Human
auugccaccucu

SEQ ID NO: 1328095 - RNA, 21 nt, Human
auugccaccucuaacagcacc

SEQ ID NO: 1328096 - RNA, 22 nt, Human
auugccaccucuaacagcacca

SEQ ID NO: 1328097 - RNA, 17 nt, Human
auugcauuuccugacag

SEQ ID NO: 1328098 - RNA, 23 nt, Human
auugcaguuuaucauucaagugu

SEQ ID NO: 1328099 - RNA, 14 nt, Human
auugcaguuuauca

SEQ ID NO: 1328100 - RNA, 17 nt, Human
auugcaguuuaucauuc

SEQ ID NO: 1328101 - RNA, 18 nt, Human
auugcaguuuaucauuca

SEQ ID NO: 1328102 - RNA, 19 nt, Human
auugcaguuuaucauucaa

SEQ ID NO: 1328103 - RNA, 20 nt, Human
auugccaaaaagugaaauaa

SEQ ID NO: 1328104 - RNA, 20 nt, Human
auugccuaagaauaaacauu

SEQ ID NO: 1328105 - RNA, 21 nt, Human
auugccuaagaauaaacauuu

SEQ ID NO: 1328106 - RNA, 15 nt, Human
auugccucacuucag

SEQ ID NO: 1328107 - RNA, 14 nt, Human
auugccucugagag

SEQ ID NO: 1328108 - RNA, 19 nt, Human
auucucacagcuccaagaa

SEQ ID NO: 1328109 - RNA, 22 nt, Human
auucuagaucagaugcuccaag

SEQ ID NO: 1328110 - RNA, 23 nt, Human
auucuagaucagaugcuccaaga

SEQ ID NO: 1328111 - RNA, 21 nt, Human
auucucacagcuccaagaauu

SEQ ID NO: 1328112 - RNA, 22 nt, Human
auucucacagcuccaagaauuu

SEQ ID NO: 1328113 - RNA, 16 nt, Human
auuuaaccucuaaauu

SEQ ID NO: 1328114 - RNA, 18 nt, Human
auuuaaccccccuguaca

SEQ ID NO: 1328115 - RNA, 19 nt, Human
auuuaaccccccuguacac

SEQ ID NO: 1328116 - RNA, 20 nt, Human
auuuaaccccccuguacaca

SEQ ID NO: 1328117 - RNA, 21 nt, Human
auuuaaccccccuguacacaa

SEQ ID NO: 1328118 - RNA, 18 nt, Human
auuuaaccucuaaauucu

SEQ ID NO: 1328119 - RNA, 13 nt, Human
auuuaacucucuu

SEQ ID NO: 1328120 - RNA, 16 nt, Human
auuuaaccccccugua

SEQ ID NO: 1328121 - RNA, 23 nt, Human
auuuaaccccccuguacacaacu

SEQ ID NO: 1328122 - RNA, 13 nt, Human
auuuaacugacua

SEQ ID NO: 1328123 - RNA, 11 nt, Human
auuuaacuucu

SEQ ID NO: 1328124 - RNA, 12 nt, Human
auuuaacuucug

SEQ ID NO: 1328125 - RNA, 16 nt, Human
auuuacaaaugggaaa

SEQ ID NO: 1328126 - RNA, 19 nt, Human
auuuacaaaaauauaaaau

SEQ ID NO: 1328127 - RNA, 20 nt, Human
auuuacaaaaauauaaaaua

SEQ ID NO: 1328128 - RNA, 23 nt, Human
auuuacaaaaauauaaaauauga

SEQ ID NO: 1328129 - RNA, 15 nt, Human
auuuacaaacugaag

SEQ ID NO: 1328130 - RNA, 14 nt, Human
auuuacaaacugaa

SEQ ID NO: 1328131 - RNA, 19 nt, Human
auuuacccaacucuguaca

SEQ ID NO: 1328132 - RNA, 14 nt, Human
auuuaccuaagauu

SEQ ID NO: 1328133 - RNA, 15 nt, Human
auuuaccuaagauua

SEQ ID NO: 1328134 - RNA, 17 nt, Human
auuuaccuaagauuaca

SEQ ID NO: 1328135 - RNA, 18 nt, Human
auuuaccuaagauuacaa

SEQ ID NO: 1328136 - RNA, 11 nt, Human
auuuaccucag

SEQ ID NO: 1328137 - RNA, 12 nt, Human
auuuaccucagc

SEQ ID NO: 1328138 - RNA, 13 nt, Human
auuuaccucagcc

SEQ ID NO: 1328139 - RNA, 14 nt, Human
auuuaccucagccu

SEQ ID NO: 1328140 - RNA, 14 nt, Human
auuuaacagaaauu

SEQ ID NO: 1328141 - RNA, 16 nt, Human
auuuaacagaaauugu

SEQ ID NO: 1328142 - RNA, 17 nt, Human
auuuaacagaaauugua

SEQ ID NO: 1328143 - RNA, 18 nt, Human
auuuaacagaaauuguau

SEQ ID NO: 1328144 - RNA, 20 nt, Human
auuuaacagaaauuguauau

SEQ ID NO: 1328145 - RNA, 22 nt, Human
auuuaacagaaauuguauauug

SEQ ID NO: 1328146 - RNA, 22 nt, Human
auuuaaaguuguuugugccuuu

SEQ ID NO: 1328147 - RNA, 14 nt, Human
auuuaaaguuguuu

SEQ ID NO: 1328148 - RNA, 13 nt, Human
auuuaaaacauua

SEQ ID NO: 1328149 - RNA, 19 nt, Human
auuuaaaacauuaaaauau

SEQ ID NO: 1328150 - RNA, 20 nt, Human
auuuaaaacauuaaaauaua

SEQ ID NO: 1328151 - RNA, 21 nt, Human
auuuaaaacauuaaaauauaa

SEQ ID NO: 1328152 - RNA, 13 nt, Human
auuuaaaacuguu

SEQ ID NO: 1328153 - RNA, 11 nt, Human
auuuaaaacuu

SEQ ID NO: 1328154 - RNA, 18 nt, Human
auuuaaacagauguccau

SEQ ID NO: 1328155 - RNA, 12 nt, Human
auuuaaacagau

SEQ ID NO: 1328156 - RNA, 11 nt, Human
auuuaaacaga

SEQ ID NO: 1328157 - RNA, 11 nt, Human
auuuaaagcag

SEQ ID NO: 1328158 - RNA, 12 nt, Human
auuuaaagcagg

SEQ ID NO: 1328159 - RNA, 15 nt, Human
auuuaaagcagguuc

SEQ ID NO: 1328160 - RNA, 16 nt, Human
auuuaaagcagguucu

SEQ ID NO: 1328161 - RNA, 19 nt, Human
auuuaaagcagguucuugu

SEQ ID NO: 1328162 - RNA, 20 nt, Human
auuuaaagcagguucuuguu

SEQ ID NO: 1328163 - RNA, 15 nt, Human
auuuaaagccuccuc

SEQ ID NO: 1328164 - RNA, 18 nt, Human
auugugccaugucaaaca

SEQ ID NO: 1328165 - RNA, 13 nt, Human
auugugcuagugc

SEQ ID NO: 1328166 - RNA, 21 nt, Human
auugugccaugucaaacaaau

SEQ ID NO: 1328167 - RNA, 22 nt, Human
auugugccaugucaaacaaaua

SEQ ID NO: 1328168 - RNA, 22 nt, Human
auuguuucaauugcaucuccca

SEQ ID NO: 1328169 - RNA, 15 nt, Human
auuuaaaacagacac

SEQ ID NO: 1328170 - RNA, 16 nt, Human
auuuaaaacagacacu

SEQ ID NO: 1328171 - RNA, 17 nt, Human
auuuaaaacagacacug

SEQ ID NO: 1328172 - RNA, 18 nt, Human
auuuaaaacagacacugg

SEQ ID NO: 1328173 - RNA, 23 nt, Human
auuuaaaacagacacuggcaugg

SEQ ID NO: 1328174 - RNA, 15 nt, Human
auuguauuacaaauc

SEQ ID NO: 1328175 - RNA, 23 nt, Human
auugucugaaaagugaagacaga

SEQ ID NO: 1328176 - RNA, 16 nt, Human
auugucugaacuugca

SEQ ID NO: 1328177 - RNA, 18 nt, Human
auugucugaacuugcauu

SEQ ID NO: 1328178 - RNA, 14 nt, Human
auuguauuacaaau

SEQ ID NO: 1328179 - RNA, 15 nt, Human
auugugaaauuauuc

SEQ ID NO: 1328180 - RNA, 13 nt, Human
auugugccccugc

SEQ ID NO: 1328181 - RNA, 16 nt, Human
auugucuuaauauugu

SEQ ID NO: 1328182 - RNA, 15 nt, Human
auugucugugaagug

SEQ ID NO: 1328183 - RNA, 20 nt, Human
auuguauauuacaaugauca

SEQ ID NO: 1328184 - RNA, 19 nt, Human
auuguauauuacaaugauc

SEQ ID NO: 1328185 - RNA, 18 nt, Human
auuguauauuacaaugau

SEQ ID NO: 1328186 - RNA, 17 nt, Human
auuguauauuacaauga

SEQ ID NO: 1328187 - RNA, 13 nt, Human
auuguauauugua

SEQ ID NO: 1328188 - RNA, 15 nt, Human
auuguauauuacaau

SEQ ID NO: 1328189 - RNA, 17 nt, Human
auuguauauuguguuug

SEQ ID NO: 1328190 - RNA, 15 nt, Human
auuguauauuguaau

SEQ ID NO: 1328191 - RNA, 17 nt, Human
auuguauauuguaauuu

SEQ ID NO: 1328192 - RNA, 17 nt, Human
auuguaugaaguuugaa

SEQ ID NO: 1328193 - RNA, 15 nt, Human
auuguauguggucau

SEQ ID NO: 1328194 - RNA, 13 nt, Human
auugccucugaga

SEQ ID NO: 1328195 - RNA, 21 nt, Human
auugcgagagauguguguuga

SEQ ID NO: 1328196 - RNA, 20 nt, Human
auugcguuugaccuuuuaug

SEQ ID NO: 1328197 - RNA, 21 nt, Human
auugcguuugaccuuuuaugu

SEQ ID NO: 1328198 - RNA, 20 nt, Human
auugcgagagauguguguug

SEQ ID NO: 1328199 - RNA, 23 nt, Human
auuuccugggagcuuuuguagaa

SEQ ID NO: 1328200 - RNA, 22 nt, Human
auuuccugggagcuuuuguaga

SEQ ID NO: 1328201 - RNA, 14 nt, Human
auuuccuugaaugu

SEQ ID NO: 1328202 - RNA, 23 nt, Human
auuuaggaaguugacuuauagua

SEQ ID NO: 1328203 - RNA, 16 nt, Human
auuuaggaaguugacu

SEQ ID NO: 1328204 - RNA, 23 nt, Human
auuuagcuaaacggauuccaaag

SEQ ID NO: 1328205 - RNA, 14 nt, Human
auuuaggagaagcc

SEQ ID NO: 1328206 - RNA, 17 nt, Human
auuuaggagaagccagg

SEQ ID NO: 1328207 - RNA, 14 nt, Human
auuuagguuucuga

SEQ ID NO: 1328208 - RNA, 17 nt, Human
auuuagguuucugaguu

SEQ ID NO: 1328209 - RNA, 21 nt, Human
auuuagguuucugaguuccug

SEQ ID NO: 1328210 - RNA, 19 nt, Human
auuuacgcuuugauucaua

SEQ ID NO: 1328211 - RNA, 15 nt, Human
auuuagcauguuguu

SEQ ID NO: 1328212 - RNA, 16 nt, Human
auuuaccucagccugg

SEQ ID NO: 1328213 - RNA, 15 nt, Human
auuuaccucagccug

SEQ ID NO: 1328214 - RNA, 15 nt, Human
auuuacgcuuugauu

SEQ ID NO: 1328215 - RNA, 17 nt, Human
auuuacgcuuugauuca

SEQ ID NO: 1328216 - RNA, 13 nt, Human
auuuagcauugua

SEQ ID NO: 1328217 - RNA, 19 nt, Human
auuuagcauuguagugcuu

SEQ ID NO: 1328218 - RNA, 22 nt, Human
auuuagcauuguagugcuuuga

SEQ ID NO: 1328219 - RNA, 20 nt, Human
auuuagcauuguagugcuuu

SEQ ID NO: 1328220 - RNA, 14 nt, Human
auuuagccuguccu

SEQ ID NO: 1328221 - RNA, 15 nt, Human
auuuagccuguccug

SEQ ID NO: 1328222 - RNA, 16 nt, Human
auuuagccuguccugu

SEQ ID NO: 1328223 - RNA, 22 nt, Human
auuuagccuguccugucaucau

SEQ ID NO: 1328224 - RNA, 21 nt, Human
auuuagcuaaacggauuccaa

SEQ ID NO: 1328225 - RNA, 22 nt, Human
auuuagcuaaacggauuccaaa

SEQ ID NO: 1328226 - RNA, 22 nt, Human
auuuauuacuguaagaaaauau

SEQ ID NO: 1328227 - RNA, 22 nt, Human
auuuauuaaagaaaaaaaugua

SEQ ID NO: 1328228 - RNA, 23 nt, Human
auuuagguuucugaguuccugca

SEQ ID NO: 1328229 - RNA, 23 nt, Human
auuuagguuuuuguuuguuuccu

SEQ ID NO: 1328230 - RNA, 14 nt, Human
auuuaguaaaccaa

SEQ ID NO: 1328231 - RNA, 19 nt, Human
auuuaguaauagccugggu

SEQ ID NO: 1328232 - RNA, 12 nt, Human
auuuauuaaaga

SEQ ID NO: 1328233 - RNA, 13 nt, Human
auuuauuaaagaa

SEQ ID NO: 1328234 - RNA, 14 nt, Human
auuuauuaaagaaa

SEQ ID NO: 1328235 - RNA, 15 nt, Human
auuuauuaaagaaaa

SEQ ID NO: 1328236 - RNA, 16 nt, Human
auuuauuaaagaaaaa

SEQ ID NO: 1328237 - RNA, 17 nt, Human
auuuauuaaagaaaaaa

SEQ ID NO: 1328238 - RNA, 18 nt, Human
auuuauuaaagaaaaaaa

SEQ ID NO: 1328239 - RNA, 20 nt, Human
auuuauuaaagaaaaaaaug

SEQ ID NO: 1328240 - RNA, 23 nt, Human
auuuauuaaagaaaaaaauguau

SEQ ID NO: 1328241 - RNA, 16 nt, Human
auuuggaaccuuguuu

SEQ ID NO: 1328242 - RNA, 14 nt, Human
auuugagugcucug

SEQ ID NO: 1328243 - RNA, 16 nt, Human
auuugagugcucugau

SEQ ID NO: 1328244 - RNA, 22 nt, Human
auuugaggacaaccauuccaga

SEQ ID NO: 1328245 - RNA, 17 nt, Human
auuugaaugauuuuucu

SEQ ID NO: 1328246 - RNA, 20 nt, Human
auuugaaugauuuuucuuua

SEQ ID NO: 1328247 - RNA, 22 nt, Human
auuugaaugauuuuucuuuaca

SEQ ID NO: 1328248 - RNA, 18 nt, Human
auuucuaauguuggacac

SEQ ID NO: 1328249 - RNA, 14 nt, Human
auuucuaauuaugu

SEQ ID NO: 1328250 - RNA, 19 nt, Human
auuucuaauuauguagcuc

SEQ ID NO: 1328251 - RNA, 15 nt, Human
auuucuaauuaugua

SEQ ID NO: 1328252 - RNA, 18 nt, Human
auuuguaguguuggagaa

SEQ ID NO: 1328253 - RNA, 20 nt, Human
auuuguacuauuuaacugac

SEQ ID NO: 1328254 - RNA, 22 nt, Human
auuuguacuauuuaacugacua

SEQ ID NO: 1328255 - RNA, 15 nt, Human
auuuguaaaaugaca

SEQ ID NO: 1328256 - RNA, 16 nt, Human
auuuguaaaaugacaa

SEQ ID NO: 1328257 - RNA, 22 nt, Human
auuuguaaaaugacaaucaugu

SEQ ID NO: 1328258 - RNA, 19 nt, Human
auuuguaaaaugacaauca

SEQ ID NO: 1328259 - RNA, 23 nt, Human
auuuguacugaaaaaugguaauu

SEQ ID NO: 1328260 - RNA, 21 nt, Human
auuugguuuucacauuggaaa

SEQ ID NO: 1328261 - RNA, 22 nt, Human
auuugguuuucacauuggaaac

SEQ ID NO: 1328262 - RNA, 17 nt, Human
auuugguuuucacauug

SEQ ID NO: 1328263 - RNA, 23 nt, Human
auuugguaaggggaauugaggac

SEQ ID NO: 1328264 - RNA, 14 nt, Human
auuuggguccagga

SEQ ID NO: 1328265 - RNA, 15 nt, Human
auuuggguccaggag

SEQ ID NO: 1328266 - RNA, 16 nt, Human
auuuggguccaggagg

SEQ ID NO: 1328267 - RNA, 17 nt, Human
auuuggguccaggagga

SEQ ID NO: 1328268 - RNA, 14 nt, Human
auuugggugggagu

SEQ ID NO: 1328269 - RNA, 17 nt, Human
auuuggguucugccugc

SEQ ID NO: 1328270 - RNA, 17 nt, Human
auuuggaaccuuguuuu

SEQ ID NO: 1328271 - RNA, 13 nt, Human
auuuggaauacuu

SEQ ID NO: 1328272 - RNA, 14 nt, Human
auuuggaauacuuu

SEQ ID NO: 1328273 - RNA, 15 nt, Human
auuuggaauacuuuu

SEQ ID NO: 1328274 - RNA, 15 nt, Human
auuuggggcuuccaa

SEQ ID NO: 1328275 - RNA, 19 nt, Human
auuuguaguguuggagaag

SEQ ID NO: 1328276 - RNA, 16 nt, Human
auuuguaggguuucua

SEQ ID NO: 1328277 - RNA, 16 nt, Human
auuuguauaugguauu

SEQ ID NO: 1328278 - RNA, 14 nt, Human
auuuuaauaauguu

SEQ ID NO: 1328279 - RNA, 15 nt, Human
auuuuaauaauguuu

SEQ ID NO: 1328280 - RNA, 16 nt, Human
auuuuaauaauguuuc

SEQ ID NO: 1328281 - RNA, 22 nt, Human
auuuuacuguacagacagaaaa

SEQ ID NO: 1328282 - RNA, 20 nt, Human
auuuuacuguacagacagaa

SEQ ID NO: 1328283 - RNA, 13 nt, Human
auuuuacauaaau

SEQ ID NO: 1328284 - RNA, 12 nt, Human
auuuuacaauuu

SEQ ID NO: 1328285 - RNA, 21 nt, Human
auuuuacacgcuuuugugaug

SEQ ID NO: 1328286 - RNA, 16 nt, Human
auuuuauuaugaagaa

SEQ ID NO: 1328287 - RNA, 22 nt, Human
auuuuauuaugaagaaggugaa

SEQ ID NO: 1328288 - RNA, 23 nt, Human
auuuuauuaugaagaaggugaau

SEQ ID NO: 1328289 - RNA, 22 nt, Human
auuuuauuuaccccuccccuau

SEQ ID NO: 1328290 - RNA, 14 nt, Human
auuuuauuaugaag

SEQ ID NO: 1328291 - RNA, 15 nt, Human
auuuuauuaugaaga

SEQ ID NO: 1328292 - RNA, 12 nt, Human
auuuuauuauga

SEQ ID NO: 1328293 - RNA, 21 nt, Human
auuuuauguugcauagaauaa

SEQ ID NO: 1328294 - RNA, 18 nt, Human
auuuuauguugcauagaa

SEQ ID NO: 1328295 - RNA, 18 nt, Human
aucuguaaugguacugac

SEQ ID NO: 1328296 - RNA, 19 nt, Human
aucugguagaagggaaagc

SEQ ID NO: 1328297 - RNA, 13 nt, Human
aucuguaaacugu

SEQ ID NO: 1328298 - RNA, 14 nt, Human
aucuguaaacugug

SEQ ID NO: 1328299 - RNA, 17 nt, Human
aucuguaaacuguguau

SEQ ID NO: 1328300 - RNA, 22 nt, Human
aucuguaaacuguguauuccaa

SEQ ID NO: 1328301 - RNA, 15 nt, Human
aucuguaaaucuaca

SEQ ID NO: 1328302 - RNA, 16 nt, Human
aucuguaaaucuacac

SEQ ID NO: 1328303 - RNA, 23 nt, Human
aucugguagaagggaaagcccau

SEQ ID NO: 1328304 - RNA, 15 nt, Human
aucuuagauucucug

SEQ ID NO: 1328305 - RNA, 18 nt, Human
aucuuagauucucugugu

SEQ ID NO: 1328306 - RNA, 20 nt, Human
aucuuagauucucugugucu

SEQ ID NO: 1328307 - RNA, 22 nt, Human
aucuuagauucucugugucuaa

SEQ ID NO: 1328308 - RNA, 23 nt, Human
aucuuagauucucugugucuaag

SEQ ID NO: 1328309 - RNA, 16 nt, Human
aucuugacucacugca

SEQ ID NO: 1328310 - RNA, 17 nt, Human
aucuugacuacagucag

SEQ ID NO: 1328311 - RNA, 14 nt, Human
aucuugcuucccua

SEQ ID NO: 1328312 - RNA, 15 nt, Human
aucuugcuucccuaa

SEQ ID NO: 1328313 - RNA, 16 nt, Human
aucuuacuauuucaca

SEQ ID NO: 1328314 - RNA, 13 nt, Human
aucuuagauucuc

SEQ ID NO: 1328315 - RNA, 15 nt, Human
aucugugucuuguuu

SEQ ID NO: 1328316 - RNA, 20 nt, Human
aucugugugaaacuuucauu

SEQ ID NO: 1328317 - RNA, 15 nt, Human
aucugugugaaacuu

SEQ ID NO: 1328318 - RNA, 16 nt, Human
aucugagucagagcca

SEQ ID NO: 1328319 - RNA, 13 nt, Human
aucugaguccugg

SEQ ID NO: 1328320 - RNA, 23 nt, Human
uugccucaaauaaaaagugcuuu

SEQ ID NO: 1328321 - RNA, 18 nt, Human
aucugaugcaagcaagaa

SEQ ID NO: 1328322 - RNA, 18 nt, Human
aucugaucagaacaaaug

SEQ ID NO: 1328323 - RNA, 19 nt, Human
aucugaucagaacaaaugu

SEQ ID NO: 1328324 - RNA, 17 nt, Human
aucugaguccuggauga

SEQ ID NO: 1328325 - RNA, 14 nt, Human
aucugaguccugga

SEQ ID NO: 1328326 - RNA, 12 nt, Human
aucugauagggu

SEQ ID NO: 1328327 - RNA, 22 nt, Human
aucugauaggguuugugacagg

SEQ ID NO: 1328328 - RNA, 17 nt, Human
aucugauugugauguga

SEQ ID NO: 1328329 - RNA, 21 nt, Human
aucugauuuguaacccacuga

SEQ ID NO: 1328330 - RNA, 21 nt, Human
aucugcaauucaaaaguucca

SEQ ID NO: 1328331 - RNA, 20 nt, Human
aucugcagggggugugucug

SEQ ID NO: 1328332 - RNA, 19 nt, Human
uugccuaagaauaaacauu

SEQ ID NO: 1328333 - RNA, 22 nt, Human
uugccuaagaauaaacauuugu

SEQ ID NO: 1328334 - RNA, 23 nt, Human
uugccuaagaauaaacauuuguu

SEQ ID NO: 1328335 - RNA, 13 nt, Human
uugcauuaaauua

SEQ ID NO: 1328336 - RNA, 15 nt, Human
uugcauuaaauuaca

SEQ ID NO: 1328337 - RNA, 13 nt, Human
uugcauuaaauuc

SEQ ID NO: 1328338 - RNA, 20 nt, Human
uugcauuaaauucacaaacu

SEQ ID NO: 1328339 - RNA, 21 nt, Human
uugcauuaaauucacaaacuu

SEQ ID NO: 1328340 - RNA, 22 nt, Human
uugcauuaaauucacaaacuuu

SEQ ID NO: 1328341 - RNA, 14 nt, Human
uugcauuaugcaau

SEQ ID NO: 1328342 - RNA, 13 nt, Human
uugcauuaugcaa

SEQ ID NO: 1328343 - RNA, 18 nt, Human
uugcccugcugcccuccc

SEQ ID NO: 1328344 - RNA, 16 nt, Human
uugcccugcugcccuc

SEQ ID NO: 1328345 - RNA, 21 nt, Human
aucucauuuccaagcaaguau

SEQ ID NO: 1328346 - RNA, 20 nt, Human
aucucagugaagaauacuuc

SEQ ID NO: 1328347 - RNA, 14 nt, Human
aucucagugaagaa

SEQ ID NO: 1328348 - RNA, 15 nt, Human
aucucagugaagaau

SEQ ID NO: 1328349 - RNA, 17 nt, Human
aucucagugaagaauac

SEQ ID NO: 1328350 - RNA, 19 nt, Human
aucucaguugauuuucugg

SEQ ID NO: 1328351 - RNA, 21 nt, Human
aucucaguugauuuucuggau

SEQ ID NO: 1328352 - RNA, 23 nt, Human
aucucauuuccaagcaaguauua

SEQ ID NO: 1328353 - RNA, 20 nt, Human
aucucaucucagugaagaau

SEQ ID NO: 1328354 - RNA, 19 nt, Human
aucucaucucagugaagaa

SEQ ID NO: 1328355 - RNA, 21 nt, Human
aucucauuuuuccguaaaaau

SEQ ID NO: 1328356 - RNA, 16 nt, Human
aucuccagcggcccug

SEQ ID NO: 1328357 - RNA, 23 nt, Human
aucucauuuuuccguaaaaauga

SEQ ID NO: 1328358 - RNA, 16 nt, Human
aucuccccaucauugg

SEQ ID NO: 1328359 - RNA, 20 nt, Human
aucucccaccuagcagcacc

SEQ ID NO: 1328360 - RNA, 19 nt, Human
aucucccagauaaugugaa

SEQ ID NO: 1328361 - RNA, 20 nt, Human
aucucccagauaaugugaaa

SEQ ID NO: 1328362 - RNA, 17 nt, Human
aucucccauuuuggaau

SEQ ID NO: 1328363 - RNA, 18 nt, Human
aucucccauuuuggaauu

SEQ ID NO: 1328364 - RNA, 22 nt, Human
aucuccauugugccuaagucca

SEQ ID NO: 1328365 - RNA, 18 nt, Human
aucucccaccuagcagca

SEQ ID NO: 1328366 - RNA, 19 nt, Human
aucucccaccuagcagcac

SEQ ID NO: 1328367 - RNA, 19 nt, Human
aucucccauuuuggaauuu

SEQ ID NO: 1328368 - RNA, 16 nt, Human
aucucaauucuucccu

SEQ ID NO: 1328369 - RNA, 14 nt, Human
aucucaauucuucc

SEQ ID NO: 1328370 - RNA, 13 nt, Human
aucucaauauuuc

SEQ ID NO: 1328371 - RNA, 16 nt, Human
auccuaucucuccaac

SEQ ID NO: 1328372 - RNA, 21 nt, Human
auccuaucucuccaaccagau

SEQ ID NO: 1328373 - RNA, 13 nt, Human
auccuaugcaugg

SEQ ID NO: 1328374 - RNA, 17 nt, Human
auccuaugcaugguuuc

SEQ ID NO: 1328375 - RNA, 21 nt, Human
auccuaugcaugguuucagca

SEQ ID NO: 1328376 - RNA, 22 nt, Human
auccuaugcaugguuucagcac

SEQ ID NO: 1328377 - RNA, 23 nt, Human
auccuaugcaugguuucagcacu

SEQ ID NO: 1328378 - RNA, 15 nt, Human
aucucagcucacuac

SEQ ID NO: 1328379 - RNA, 13 nt, Human
aucucagcucacu

SEQ ID NO: 1328380 - RNA, 11 nt, Human
aucucagcuca

SEQ ID NO: 1328381 - RNA, 14 nt, Human
aucucagcucacug

SEQ ID NO: 1328382 - RNA, 16 nt, Human
aucucagcucaucuuc

SEQ ID NO: 1328383 - RNA, 12 nt, Human
aucucagcucau

SEQ ID NO: 1328384 - RNA, 18 nt, Human
aucucaggccagagccaa

SEQ ID NO: 1328385 - RNA, 14 nt, Human
aucucaggccagag

SEQ ID NO: 1328386 - RNA, 17 nt, Human
aucucaggccagagcca

SEQ ID NO: 1328387 - RNA, 12 nt, Human
aucucagaaagu

SEQ ID NO: 1328388 - RNA, 15 nt, Human
aucucagaaagugcc

SEQ ID NO: 1328389 - RNA, 16 nt, Human
aucucagaaagugccu

SEQ ID NO: 1328390 - RNA, 17 nt, Human
aucucagaaagugccug

SEQ ID NO: 1328391 - RNA, 11 nt, Human
aucucagccca

SEQ ID NO: 1328392 - RNA, 20 nt, Human
aucucagaucaguguaccau

SEQ ID NO: 1328393 - RNA, 18 nt, Human
aucucagaaagugccuga

SEQ ID NO: 1328394 - RNA, 19 nt, Human
aucucagaaagugccugac

SEQ ID NO: 1328395 - RNA, 20 nt, Human
aucucagaaagugccugaca

SEQ ID NO: 1328396 - RNA, 14 nt, Human
uugcaucugaaaau

SEQ ID NO: 1328397 - RNA, 23 nt, Human
uugcaucccaaaccacgccucuu

SEQ ID NO: 1328398 - RNA, 20 nt, Human
uugcaucucccagauaaugu

SEQ ID NO: 1328399 - RNA, 16 nt, Human
uugcacauguuuccuc

SEQ ID NO: 1328400 - RNA, 15 nt, Human
uugcauguggaucaa

SEQ ID NO: 1328401 - RNA, 19 nt, Human
uugcacagcaucucagcuc

SEQ ID NO: 1328402 - RNA, 18 nt, Human
uugcacagccaaauuuaa

SEQ ID NO: 1328403 - RNA, 16 nt, Human
uugcacagcuaugaag

SEQ ID NO: 1328404 - RNA, 21 nt, Human
uugcacagucacugcucuuca

SEQ ID NO: 1328405 - RNA, 19 nt, Human
uugcacagccaaauuuaaa

SEQ ID NO: 1328406 - RNA, 18 nt, Human
uugcacagcaucucagcu

SEQ ID NO: 1328407 - RNA, 15 nt, Human
uugcacagcaucuca

SEQ ID NO: 1328408 - RNA, 20 nt, Human
uugcacacuuugguaccaga

SEQ ID NO: 1328409 - RNA, 14 nt, Human
uugcacacuuuggu

SEQ ID NO: 1328410 - RNA, 21 nt, Human
aucucuucagucucuauacca

SEQ ID NO: 1328411 - RNA, 13 nt, Human
aucucuucagucu

SEQ ID NO: 1328412 - RNA, 12 nt, Human
aucucuucaguc

SEQ ID NO: 1328413 - RNA, 12 nt, Human
uugaugccuggc

SEQ ID NO: 1328414 - RNA, 19 nt, Human
aucucuucuggguuccuuc

SEQ ID NO: 1328415 - RNA, 15 nt, Human
uugaugggauuuggu

SEQ ID NO: 1328416 - RNA, 22 nt, Human
uugaugccaaaaaaaaauacau

SEQ ID NO: 1328417 - RNA, 14 nt, Human
uugaugccaaaaaa

SEQ ID NO: 1328418 - RNA, 18 nt, Human
uugauggugguauguuuu

SEQ ID NO: 1328419 - RNA, 20 nt, Human
uugauggcuaacuuacaaag

SEQ ID NO: 1328420 - RNA, 17 nt, Human
uugaugggauucuggac

SEQ ID NO: 1328421 - RNA, 19 nt, Human
uugauggugguauguuuuc

SEQ ID NO: 1328422 - RNA, 23 nt, Human
uugauggugaugaaauguaaaua

SEQ ID NO: 1328423 - RNA, 13 nt, Human
uugauguaaaauc

SEQ ID NO: 1328424 - RNA, 15 nt, Human
uugauguaaaaucuu

SEQ ID NO: 1328425 - RNA, 16 nt, Human
uugauguaaaaucuug

SEQ ID NO: 1328426 - RNA, 18 nt, Human
uugauguaaaaucuuguc

SEQ ID NO: 1328427 - RNA, 21 nt, Human
uugauguaaaaucuugucaug

SEQ ID NO: 1328428 - RNA, 14 nt, Human
uugauguaaagaug

SEQ ID NO: 1328429 - RNA, 23 nt, Human
uugauguaaagauguucuggaua

SEQ ID NO: 1328430 - RNA, 20 nt, Human
uugauguaaggaugggcaug

SEQ ID NO: 1328431 - RNA, 21 nt, Human
uugauguggugaaaagcaggu

SEQ ID NO: 1328432 - RNA, 16 nt, Human
augaagauacugaaau

SEQ ID NO: 1328433 - RNA, 17 nt, Human
augaagauacugaaaua

SEQ ID NO: 1328434 - RNA, 22 nt, Human
augaacuuagauuuuacaugaa

SEQ ID NO: 1328435 - RNA, 22 nt, Human
augaagauauuuuuccauuuuu

SEQ ID NO: 1328436 - RNA, 22 nt, Human
augaagaucuaaauaaaaugcu

SEQ ID NO: 1328437 - RNA, 18 nt, Human
augaagauguagaggaga

SEQ ID NO: 1328438 - RNA, 15 nt, Human
augaaugcuuaaaga

SEQ ID NO: 1328439 - RNA, 12 nt, Human
augaaugcuuaa

SEQ ID NO: 1328440 - RNA, 14 nt, Human
augaaugugaagcc

SEQ ID NO: 1328441 - RNA, 16 nt, Human
augaaugagaaucuac

SEQ ID NO: 1328442 - RNA, 17 nt, Human
augaaauauuauguuaa

SEQ ID NO: 1328443 - RNA, 18 nt, Human
augaaauauuauguuaaa

SEQ ID NO: 1328444 - RNA, 20 nt, Human
augaaauauuauguuaaaac

SEQ ID NO: 1328445 - RNA, 14 nt, Human
augaacucaacuuu

SEQ ID NO: 1328446 - RNA, 16 nt, Human
augaacucuuaaucaa

SEQ ID NO: 1328447 - RNA, 12 nt, Human
augaacuuagau

SEQ ID NO: 1328448 - RNA, 19 nt, Human
augaacuuagauuuuacau

SEQ ID NO: 1328449 - RNA, 20 nt, Human
augaacuuagauuuuacaug

SEQ ID NO: 1328450 - RNA, 15 nt, Human
augaagauacugaaa

SEQ ID NO: 1328451 - RNA, 16 nt, Human
uugggccugcuccaga

SEQ ID NO: 1328452 - RNA, 17 nt, Human
uugggccugcuccagac

SEQ ID NO: 1328453 - RNA, 20 nt, Human
uugggccugcuccagaccug

SEQ ID NO: 1328454 - RNA, 18 nt, Human
uugggccccagaggcugg

SEQ ID NO: 1328455 - RNA, 22 nt, Human
uugggcccacaccuccuucccu

SEQ ID NO: 1328456 - RNA, 20 nt, Human
uugggcccacaccuccuucc

SEQ ID NO: 1328457 - RNA, 15 nt, Human
augaauuaaguuuuu

SEQ ID NO: 1328458 - RNA, 16 nt, Human
augaauuaaauaaacc

SEQ ID NO: 1328459 - RNA, 17 nt, Human
uugggccagacaugcca

SEQ ID NO: 1328460 - RNA, 18 nt, Human
uugggccagcuuuucaaa

SEQ ID NO: 1328461 - RNA, 19 nt, Human
uugggcccacaccuccuuc

SEQ ID NO: 1328462 - RNA, 15 nt, Human
augaaugugaagccu

SEQ ID NO: 1328463 - RNA, 16 nt, Human
augaaugugaagccuu

SEQ ID NO: 1328464 - RNA, 18 nt, Human
augaaugugaagccuucc

SEQ ID NO: 1328465 - RNA, 17 nt, Human
augaaugugaagccuuc

SEQ ID NO: 1328466 - RNA, 11 nt, Human
augaauguuua

SEQ ID NO: 1328467 - RNA, 22 nt, Human
augaauguuuacacucuuugua

SEQ ID NO: 1328468 - RNA, 14 nt, Human
augaauuaaagugg

SEQ ID NO: 1328469 - RNA, 14 nt, Human
augaauuaaauaaa

SEQ ID NO: 1328470 - RNA, 19 nt, Human
uugggccugcuccagaccu

SEQ ID NO: 1328471 - RNA, 20 nt, Human
uuggggcaggaguagcugag

SEQ ID NO: 1328472 - RNA, 23 nt, Human
uuggggcaggaguagcugagcuc

SEQ ID NO: 1328473 - RNA, 22 nt, Human
uuggggcaggaguagcugagcu

SEQ ID NO: 1328474 - RNA, 19 nt, Human
uuggggggaaggggacccu

SEQ ID NO: 1328475 - RNA, 23 nt, Human
uuggggggaguaaagaauuauuu

SEQ ID NO: 1328476 - RNA, 20 nt, Human
uuggggggguggccgcugag

SEQ ID NO: 1328477 - RNA, 13 nt, Human
uuggggggguggc

SEQ ID NO: 1328478 - RNA, 20 nt, Human
uuggggguccuccuccaggg

SEQ ID NO: 1328479 - RNA, 17 nt, Human
uuggggguucaggcccg

SEQ ID NO: 1328480 - RNA, 15 nt, Human
uugguuccuucccaa

SEQ ID NO: 1328481 - RNA, 13 nt, Human
uugguucuaagga

SEQ ID NO: 1328482 - RNA, 14 nt, Human
uugguucuaaggac

SEQ ID NO: 1328483 - RNA, 18 nt, Human
uugguucuaaggaccuga

SEQ ID NO: 1328484 - RNA, 15 nt, Human
uuggagugcaguggc

SEQ ID NO: 1328485 - RNA, 23 nt, Human
aucuugcuuucuuuguuuggcug

SEQ ID NO: 1328486 - RNA, 23 nt, Human
aucuugcuucccuaaucuauggu

SEQ ID NO: 1328487 - RNA, 19 nt, Human
uuggaguguuccccuucca

SEQ ID NO: 1328488 - RNA, 22 nt, Human
uuggaguguuccccuuccacug

SEQ ID NO: 1328489 - RNA, 23 nt, Human
uuggaucucuucuuaauguacau

SEQ ID NO: 1328490 - RNA, 20 nt, Human
uuggauauguaaaacauuua

SEQ ID NO: 1328491 - RNA, 13 nt, Human
uuggauccugugu

SEQ ID NO: 1328492 - RNA, 18 nt, Human
uuggauccuguguggaga

SEQ ID NO: 1328493 - RNA, 19 nt, Human
uuggauacuuggauuuagu

SEQ ID NO: 1328494 - RNA, 19 nt, Human
uuggauauguaaaacauuu

SEQ ID NO: 1328495 - RNA, 19 nt, Human
uuggauauuuuuuacuuua

SEQ ID NO: 1328496 - RNA, 22 nt, Human
uuggcggggaggaggaaauccc

SEQ ID NO: 1328497 - RNA, 17 nt, Human
uuggcguaggcuacaga

SEQ ID NO: 1328498 - RNA, 18 nt, Human
uuggcguaggcuacagag

SEQ ID NO: 1328499 - RNA, 19 nt, Human
uuggcguaggcuacagaga

SEQ ID NO: 1328500 - RNA, 20 nt, Human
uuggcguaggcuacagagaa

SEQ ID NO: 1328501 - RNA, 21 nt, Human
uuggcguaggcuacagagaag

SEQ ID NO: 1328502 - RNA, 22 nt, Human
uuggcguaggcuacagagaagc

SEQ ID NO: 1328503 - RNA, 23 nt, Human
uuggcguaggcuacagagaagcc

SEQ ID NO: 1328504 - RNA, 22 nt, Human
uuggcucgaaucucugugccuu

SEQ ID NO: 1328505 - RNA, 12 nt, Human
uuggcucugcca

SEQ ID NO: 1328506 - RNA, 13 nt, Human
uuggcucugccag

SEQ ID NO: 1328507 - RNA, 14 nt, Human
uuggcucugccagu

SEQ ID NO: 1328508 - RNA, 16 nt, Human
uuggcucugccagucc

SEQ ID NO: 1328509 - RNA, 23 nt, Human
uuggcucugccaguccuguccuu

SEQ ID NO: 1328510 - RNA, 19 nt, Human
uuggcucugccaguccugu

SEQ ID NO: 1328511 - RNA, 19 nt, Human
uuggcugaaauucuccugg

SEQ ID NO: 1328512 - RNA, 20 nt, Human
uuggcugaaauucuccugga

SEQ ID NO: 1328513 - RNA, 21 nt, Human
uuggcugaaauucuccuggag

SEQ ID NO: 1328514 - RNA, 22 nt, Human
uuggcugaaauucuccuggagg

SEQ ID NO: 1328515 - RNA, 23 nt, Human
uuggcugagauaugaacauauug

SEQ ID NO: 1328516 - RNA, 13 nt, Human
aucuuuuuauuca

SEQ ID NO: 1328517 - RNA, 12 nt, Human
augaaagauuca

SEQ ID NO: 1328518 - RNA, 15 nt, Human
augaaagcagggacu

SEQ ID NO: 1328519 - RNA, 18 nt, Human
aucuuuuuaccuuucaua

SEQ ID NO: 1328520 - RNA, 19 nt, Human
aucuuuuuaccuuucauac

SEQ ID NO: 1328521 - RNA, 14 nt, Human
aucuuugccacccu

SEQ ID NO: 1328522 - RNA, 15 nt, Human
aucuuuauaaaugua

SEQ ID NO: 1328523 - RNA, 15 nt, Human
aucuuugccacccuc

SEQ ID NO: 1328524 - RNA, 16 nt, Human
aucuuugccacccuca

SEQ ID NO: 1328525 - RNA, 21 nt, Human
aucuuuaauuuuacauuuccu

SEQ ID NO: 1328526 - RNA, 16 nt, Human
aucuuuaauuuuacau

SEQ ID NO: 1328527 - RNA, 22 nt, Human
aucuuuaauuuuacauuuccua

SEQ ID NO: 1328528 - RNA, 17 nt, Human
aucuuuacaaaacuaca

SEQ ID NO: 1328529 - RNA, 21 nt, Human
aucuuuacaaaacuacaugag

SEQ ID NO: 1328530 - RNA, 23 nt, Human
uugguuuaaagaaaguguauuug

SEQ ID NO: 1328531 - RNA, 18 nt, Human
uugguugguaggguggga

SEQ ID NO: 1328532 - RNA, 17 nt, Human
uugguuuaaagaaagug

SEQ ID NO: 1328533 - RNA, 18 nt, Human
uugguuuaaagaaagugu

SEQ ID NO: 1328534 - RNA, 22 nt, Human
uugguuuaaagaaaguguauuu

SEQ ID NO: 1328535 - RNA, 20 nt, Human
uugguucuagcgcaguuuuu

SEQ ID NO: 1328536 - RNA, 18 nt, Human
uugguucuagcgcaguuu

SEQ ID NO: 1328537 - RNA, 15 nt, Human
uugguucuugagggg

SEQ ID NO: 1328538 - RNA, 23 nt, Human
uugguucuugaggggaccaggag

SEQ ID NO: 1328539 - RNA, 20 nt, Human
uugguugaaaauaaaaagau

SEQ ID NO: 1328540 - RNA, 22 nt, Human
uugguucuugaggggaccagga

SEQ ID NO: 1328541 - RNA, 23 nt, Human
uuguacaaaauaaacaaauaaca

SEQ ID NO: 1328542 - RNA, 21 nt, Human
uuguaggggaggggcuccuuu

SEQ ID NO: 1328543 - RNA, 23 nt, Human
uuguaguagcguuuuuuaaaugu

SEQ ID NO: 1328544 - RNA, 22 nt, Human
uuguaguagcguuuuuuaaaug

SEQ ID NO: 1328545 - RNA, 19 nt, Human
uuguagugccacuguuguu

SEQ ID NO: 1328546 - RNA, 21 nt, Human
uuguaguagcguuuuuuaaau

SEQ ID NO: 1328547 - RNA, 13 nt, Human
uuguaggguuucu

SEQ ID NO: 1328548 - RNA, 14 nt, Human
uuguaggguuucua

SEQ ID NO: 1328549 - RNA, 16 nt, Human
uuguauaaaauaauuu

SEQ ID NO: 1328550 - RNA, 17 nt, Human
uuguauaaaauaauuuu

SEQ ID NO: 1328551 - RNA, 23 nt, Human
uuguaguguuggagaagaacuga

SEQ ID NO: 1328552 - RNA, 19 nt, Human
uuguauaaaauaauuuuua

SEQ ID NO: 1328553 - RNA, 23 nt, Human
uuguagugcuuugagagagaaag

SEQ ID NO: 1328554 - RNA, 17 nt, Human
uuguagugcuuugagag

SEQ ID NO: 1328555 - RNA, 20 nt, Human
uuguauaccuuguaauuuga

SEQ ID NO: 1328556 - RNA, 13 nt, Human
uuguauaguuaac

SEQ ID NO: 1328557 - RNA, 16 nt, Human
uuguauaguuaacaca

SEQ ID NO: 1328558 - RNA, 19 nt, Human
uuguauaguuaacacacua

SEQ ID NO: 1328559 - RNA, 18 nt, Human
uuguauaguuaacacacu

SEQ ID NO: 1328560 - RNA, 14 nt, Human
uuguauauuguaau

SEQ ID NO: 1328561 - RNA, 13 nt, Human
uuguauauugugu

SEQ ID NO: 1328562 - RNA, 15 nt, Human
uuguauauuguguuu

SEQ ID NO: 1328563 - RNA, 19 nt, Human
augaauuuguaaugucuug

SEQ ID NO: 1328564 - RNA, 14 nt, Human
augaauuuguaaug

SEQ ID NO: 1328565 - RNA, 14 nt, Human
augaauuuuagcuu

SEQ ID NO: 1328566 - RNA, 16 nt, Human
augaauuuuagcuuuu

SEQ ID NO: 1328567 - RNA, 17 nt, Human
augaauuuuagcuuuug

SEQ ID NO: 1328568 - RNA, 18 nt, Human
augaauuuuagcuuuugu

SEQ ID NO: 1328569 - RNA, 19 nt, Human
uuguauauuguguuugugu

SEQ ID NO: 1328570 - RNA, 12 nt, Human
augaauuuagug

SEQ ID NO: 1328571 - RNA, 13 nt, Human
augagagacacac

SEQ ID NO: 1328572 - RNA, 14 nt, Human
augagagacacacu

SEQ ID NO: 1328573 - RNA, 17 nt, Human
augagagacacacugaa

SEQ ID NO: 1328574 - RNA, 19 nt, Human
augagagacacacugaaga

SEQ ID NO: 1328575 - RNA, 16 nt, Human
augagaaggaacuucc

SEQ ID NO: 1328576 - RNA, 11 nt, Human
augagaaucua

SEQ ID NO: 1328577 - RNA, 23 nt, Human
augagaaucuacccccagaucca

SEQ ID NO: 1328578 - RNA, 21 nt, Human
augagaauuugagugcucuga

SEQ ID NO: 1328579 - RNA, 18 nt, Human
augagaccacuguuauca

SEQ ID NO: 1328580 - RNA, 23 nt, Human
augagaaaucuaaaaaacgaaaa

SEQ ID NO: 1328581 - RNA, 14 nt, Human
augagaaagccuuc

SEQ ID NO: 1328582 - RNA, 15 nt, Human
augagaaagccuucu

SEQ ID NO: 1328583 - RNA, 19 nt, Human
augagaaagccuucuuuug

SEQ ID NO: 1328584 - RNA, 15 nt, Human
augagaaauacaaaa

SEQ ID NO: 1328585 - RNA, 13 nt, Human
augagaacaaaca

SEQ ID NO: 1328586 - RNA, 22 nt, Human
augagaaauacaaaaauacuca

SEQ ID NO: 1328587 - RNA, 14 nt, Human
augagaacucugag

SEQ ID NO: 1328588 - RNA, 18 nt, Human
augagaaaucuaaaaaac

SEQ ID NO: 1328589 - RNA, 15 nt, Human
augagaaaucuaaaa

SEQ ID NO: 1328590 - RNA, 22 nt, Human
augacauuuauaucacauguuu

SEQ ID NO: 1328591 - RNA, 18 nt, Human
augacauuuauuuuucau

SEQ ID NO: 1328592 - RNA, 15 nt, Human
augaccaaaguccuu

SEQ ID NO: 1328593 - RNA, 17 nt, Human
augacaaucaugugugu

SEQ ID NO: 1328594 - RNA, 18 nt, Human
augacaaucauguguguu

SEQ ID NO: 1328595 - RNA, 19 nt, Human
augacaauuuuuuccacuu

SEQ ID NO: 1328596 - RNA, 17 nt, Human
augacuuaguacaaagu

SEQ ID NO: 1328597 - RNA, 18 nt, Human
augacuugggcaccccca

SEQ ID NO: 1328598 - RNA, 23 nt, Human
augacuugggcacccccagccug

SEQ ID NO: 1328599 - RNA, 20 nt, Human
augacuugggcacccccagc

SEQ ID NO: 1328600 - RNA, 21 nt, Human
augacuugggcacccccagcc

SEQ ID NO: 1328601 - RNA, 22 nt, Human
augacuugggcacccccagccu

SEQ ID NO: 1328602 - RNA, 20 nt, Human
augacuuucuuuuuguagcu

SEQ ID NO: 1328603 - RNA, 21 nt, Human
augacuuucuuuuuguagcug

SEQ ID NO: 1328604 - RNA, 11 nt, Human
augagaaacuu

SEQ ID NO: 1328605 - RNA, 20 nt, Human
augagaaacuuaaauguuau

SEQ ID NO: 1328606 - RNA, 21 nt, Human
augagaaacuuaaauguuauu

SEQ ID NO: 1328607 - RNA, 21 nt, Human
uuuaguagcagugauugucuu

SEQ ID NO: 1328608 - RNA, 15 nt, Human
uuuagucaugugacc

SEQ ID NO: 1328609 - RNA, 16 nt, Human
uuuaguaucuuuuuau

SEQ ID NO: 1328610 - RNA, 21 nt, Human
uuuaguagauauuaccaguuu

SEQ ID NO: 1328611 - RNA, 23 nt, Human
uuuaguagauauuaccaguuuuc

SEQ ID NO: 1328612 - RNA, 22 nt, Human
uuuaguagcagugauugucuua

SEQ ID NO: 1328613 - RNA, 22 nt, Human
uuuaggaaguugacuuauagua

SEQ ID NO: 1328614 - RNA, 18 nt, Human
uuuaggaagcaagcuuaa

SEQ ID NO: 1328615 - RNA, 22 nt, Human
uuuagcuggaaaaguauguuag

SEQ ID NO: 1328616 - RNA, 10 nt, Human
uuuaggaaau

SEQ ID NO: 1328617 - RNA, 18 nt, Human
augccccgucccccucug

SEQ ID NO: 1328618 - RNA, 18 nt, Human
augccccaucccaugcug

SEQ ID NO: 1328619 - RNA, 22 nt, Human
augcccccuaauccccuucucc

SEQ ID NO: 1328620 - RNA, 21 nt, Human
uuuagaugauaaagagacagu

SEQ ID NO: 1328621 - RNA, 17 nt, Human
uuuagauguaauuuugu

SEQ ID NO: 1328622 - RNA, 19 nt, Human
uuuagauuuucugguucua

SEQ ID NO: 1328623 - RNA, 19 nt, Human
uuuagauuuucuuuugccu

SEQ ID NO: 1328624 - RNA, 13 nt, Human
uuuauuaaaaacu

SEQ ID NO: 1328625 - RNA, 18 nt, Human
uuuauuaaaaacugagug

SEQ ID NO: 1328626 - RNA, 20 nt, Human
uuuauguuaagggaagaauu

SEQ ID NO: 1328627 - RNA, 20 nt, Human
uuuauguuacuacaugcacu

SEQ ID NO: 1328628 - RNA, 14 nt, Human
uuuauguuauauau

SEQ ID NO: 1328629 - RNA, 17 nt, Human
uuuauguuauauauaaa

SEQ ID NO: 1328630 - RNA, 20 nt, Human
uuuauguuauauauaaauau

SEQ ID NO: 1328631 - RNA, 22 nt, Human
uuuauguuauauauaaauauau

SEQ ID NO: 1328632 - RNA, 19 nt, Human
uuuauguuccauuaaacga

SEQ ID NO: 1328633 - RNA, 21 nt, Human
uuuauguuauauauaaauaua

SEQ ID NO: 1328634 - RNA, 13 nt, Human
uuuauauaagcuu

SEQ ID NO: 1328635 - RNA, 12 nt, Human
uuuauaggaaaa

SEQ ID NO: 1328636 - RNA, 19 nt, Human
uuuauggugccuaguauug

SEQ ID NO: 1328637 - RNA, 24 nt, Human
uuuauggugccuaguauugacaaa

SEQ ID NO: 1328638 - RNA, 19 nt, Human
uuuaugguaaaaaauuuau

SEQ ID NO: 1328639 - RNA, 23 nt, Human
uuuaugguaacugcuuucuguuc

SEQ ID NO: 1328640 - RNA, 21 nt, Human
uuuaugguaacugcuuucugu

SEQ ID NO: 1328641 - RNA, 23 nt, Human
augcugucuacacuaagagagaa

SEQ ID NO: 1328642 - RNA, 22 nt, Human
augcugucuacacuaagagaga

SEQ ID NO: 1328643 - RNA, 12 nt, Human
augcuguacauc

SEQ ID NO: 1328644 - RNA, 16 nt, Human
augcuguacaucuauu

SEQ ID NO: 1328645 - RNA, 22 nt, Human
augcuguacaucuauuuuggau

SEQ ID NO: 1328646 - RNA, 15 nt, Human
augcuagaacucccu

SEQ ID NO: 1328647 - RNA, 14 nt, Human
uuuauuacguaugu

SEQ ID NO: 1328648 - RNA, 16 nt, Human
uuuauuacguaugucu

SEQ ID NO: 1328649 - RNA, 19 nt, Human
uuuauuacguaugucuggu

SEQ ID NO: 1328650 - RNA, 16 nt, Human
uuuauuacuguaagaa

SEQ ID NO: 1328651 - RNA, 18 nt, Human
uuuauuacguaugucugg

SEQ ID NO: 1328652 - RNA, 15 nt, Human
augcuccuugggccc

SEQ ID NO: 1328653 - RNA, 16 nt, Human
augcuccuugggcccu

SEQ ID NO: 1328654 - RNA, 19 nt, Human
augcuagaacucccuuuca

SEQ ID NO: 1328655 - RNA, 16 nt, Human
augcuagaacucccuu

SEQ ID NO: 1328656 - RNA, 19 nt, Human
augcucuccaaaccacuuu

SEQ ID NO: 1328657 - RNA, 12 nt, Human
augcuggcccag

SEQ ID NO: 1328658 - RNA, 13 nt, Human
augcuggcccagg

SEQ ID NO: 1328659 - RNA, 15 nt, Human
augcuggcccagggc

SEQ ID NO: 1328660 - RNA, 16 nt, Human
augcuggcccagggcc

SEQ ID NO: 1328661 - RNA, 18 nt, Human
augcuggcccagggccca

SEQ ID NO: 1328662 - RNA, 19 nt, Human
augcuggcccagggcccag

SEQ ID NO: 1328663 - RNA, 20 nt, Human
augcuggcccagggcccaga

SEQ ID NO: 1328664 - RNA, 21 nt, Human
augcuggcccagggcccagag

SEQ ID NO: 1328665 - RNA, 22 nt, Human
augcuggcccagggcccagagc

SEQ ID NO: 1328666 - RNA, 23 nt, Human
augcuggcccagggcccagagcc

SEQ ID NO: 1328667 - RNA, 22 nt, Human
augcuggcuauagaugucuuuu

SEQ ID NO: 1328668 - RNA, 21 nt, Human
augcuggcuauagaugucuuu

SEQ ID NO: 1328669 - RNA, 17 nt, Human
auggaauacucuuauau

SEQ ID NO: 1328670 - RNA, 16 nt, Human
auggaauacucuuaua

SEQ ID NO: 1328671 - RNA, 14 nt, Human
uuucacugcuggcu

SEQ ID NO: 1328672 - RNA, 17 nt, Human
uuucacugcuggcugcc

SEQ ID NO: 1328673 - RNA, 18 nt, Human
uuucacugcuggcugccu

SEQ ID NO: 1328674 - RNA, 20 nt, Human
uuucacugcuggcugccuua

SEQ ID NO: 1328675 - RNA, 22 nt, Human
uuucacugcuggcugccuuaga

SEQ ID NO: 1328676 - RNA, 24 nt, Human
uuucacugcuggcugccuuagaac

SEQ ID NO: 1328677 - RNA, 22 nt, Human
uuucaucauucacuucacugug

SEQ ID NO: 1328678 - RNA, 21 nt, Human
uuucaucauucacuucacugu

SEQ ID NO: 1328679 - RNA, 20 nt, Human
uuucaucauucacuucacug

SEQ ID NO: 1328680 - RNA, 17 nt, Human
uuucauauuuuaaacag

SEQ ID NO: 1328681 - RNA, 16 nt, Human
uuucagaaguuaguuu

SEQ ID NO: 1328682 - RNA, 20 nt, Human
uuucagaaguuaguuuguau

SEQ ID NO: 1328683 - RNA, 22 nt, Human
uuucagaaguuaguuuguauau

SEQ ID NO: 1328684 - RNA, 23 nt, Human
uuucagaaguuaguuuguauaua

SEQ ID NO: 1328685 - RNA, 15 nt, Human
uuucagaauauguca

SEQ ID NO: 1328686 - RNA, 21 nt, Human
uuucagacucccauuccugaa

SEQ ID NO: 1328687 - RNA, 11 nt, Human
uuucagacucc

SEQ ID NO: 1328688 - RNA, 24 nt, Human
uuucaugaccaguaaaggcugcug

SEQ ID NO: 1328689 - RNA, 17 nt, Human
uuucaugaccaguaaag

SEQ ID NO: 1328690 - RNA, 19 nt, Human
uuucaugauaaugaacaga

SEQ ID NO: 1328691 - RNA, 22 nt, Human
uuucaugauaaugaacagaaca

SEQ ID NO: 1328692 - RNA, 15 nt, Human
uuucaucuucaguug

SEQ ID NO: 1328693 - RNA, 16 nt, Human
uuucaucuucaguugu

SEQ ID NO: 1328694 - RNA, 17 nt, Human
uuucaucuucaguuguc

SEQ ID NO: 1328695 - RNA, 22 nt, Human
uuucaucuucaguugucucuga

SEQ ID NO: 1328696 - RNA, 19 nt, Human
uuucaugcuguucaugaaa

SEQ ID NO: 1328697 - RNA, 21 nt, Human
uuucaugcaaacucuuugguc

SEQ ID NO: 1328698 - RNA, 15 nt, Human
uuucauguacugcau

SEQ ID NO: 1328699 - RNA, 19 nt, Human
uuucaugcuaucucugugu

SEQ ID NO: 1328700 - RNA, 16 nt, Human
uuucaugauuuugaaa

SEQ ID NO: 1328701 - RNA, 16 nt, Human
uuucaugauuagaaau

SEQ ID NO: 1328702 - RNA, 13 nt, Human
uuucaugcaaacu

SEQ ID NO: 1328703 - RNA, 17 nt, Human
uuucaugcaaacucuuu

SEQ ID NO: 1328704 - RNA, 18 nt, Human
uuucaugcaaacucuuug

SEQ ID NO: 1328705 - RNA, 16 nt, Human
uuucaugcuaucucug

SEQ ID NO: 1328706 - RNA, 22 nt, Human
uuucauguacugcauuauuuga

SEQ ID NO: 1328707 - RNA, 20 nt, Human
uuucauguacugcauuauuu

SEQ ID NO: 1328708 - RNA, 16 nt, Human
uuucauguacugcauu

SEQ ID NO: 1328709 - RNA, 19 nt, Human
uuucauguuaguuaccuua

SEQ ID NO: 1328710 - RNA, 15 nt, Human
uuucauguuuuugau

SEQ ID NO: 1328711 - RNA, 14 nt, Human
uuucauuaaauaaa

SEQ ID NO: 1328712 - RNA, 15 nt, Human
uuucauuaaauaaau

SEQ ID NO: 1328713 - RNA, 17 nt, Human
uuucauuaaauaaauuu

SEQ ID NO: 1328714 - RNA, 18 nt, Human
uuucauuaaauaaauuug

SEQ ID NO: 1328715 - RNA, 19 nt, Human
uuucauuaaauaaauuuga

SEQ ID NO: 1328716 - RNA, 22 nt, Human
uuucauuaaauaaauuugacuu

SEQ ID NO: 1328717 - RNA, 19 nt, Human
auggacaucuugucauuuu

SEQ ID NO: 1328718 - RNA, 20 nt, Human
auggacaucuugucauuuuu

SEQ ID NO: 1328719 - RNA, 14 nt, Human
auggacaggcuggc

SEQ ID NO: 1328720 - RNA, 18 nt, Human
auggacagggcaugccac

SEQ ID NO: 1328721 - RNA, 19 nt, Human
auggacaggcuggcuccag

SEQ ID NO: 1328722 - RNA, 12 nt, Human
auggacaucuug

SEQ ID NO: 1328723 - RNA, 17 nt, Human
auggacaucuugucauu

SEQ ID NO: 1328724 - RNA, 21 nt, Human
uuucccaugauuucauguacu

SEQ ID NO: 1328725 - RNA, 18 nt, Human
uuucccaugauuucaugu

SEQ ID NO: 1328726 - RNA, 15 nt, Human
uuucccaugauuuca

SEQ ID NO: 1328727 - RNA, 16 nt, Human
uuucccauggggaggg

SEQ ID NO: 1328728 - RNA, 18 nt, Human
uuuccccaccagaugcug

SEQ ID NO: 1328729 - RNA, 15 nt, Human
uuuccccagacuugu

SEQ ID NO: 1328730 - RNA, 23 nt, Human
uuuccccauuuagguuucugagu

SEQ ID NO: 1328731 - RNA, 13 nt, Human
auggcagaaaagu

SEQ ID NO: 1328732 - RNA, 13 nt, Human
auggcagaaggca

SEQ ID NO: 1328733 - RNA, 19 nt, Human
auggcaaggacugcaggga

SEQ ID NO: 1328734 - RNA, 18 nt, Human
auggcaaccauuauaacc

SEQ ID NO: 1328735 - RNA, 16 nt, Human
auggcaacagaucugg

SEQ ID NO: 1328736 - RNA, 17 nt, Human
auggcaacagaucugga

SEQ ID NO: 1328737 - RNA, 24 nt, Human
auggcaacagaucuggaaccucag

SEQ ID NO: 1328738 - RNA, 15 nt, Human
auggcaaccauuaua

SEQ ID NO: 1328739 - RNA, 16 nt, Human
auggcaaccauuauaa

SEQ ID NO: 1328740 - RNA, 22 nt, Human
auggcacaaucucggcucacug

SEQ ID NO: 1328741 - RNA, 22 nt, Human
auggcaaucaaacauuuucugg

SEQ ID NO: 1328742 - RNA, 15 nt, Human
auggcaauuuuguaa

SEQ ID NO: 1328743 - RNA, 16 nt, Human
auggcaauuuuguaac

SEQ ID NO: 1328744 - RNA, 17 nt, Human
auggauuucuuugaaaa

SEQ ID NO: 1328745 - RNA, 15 nt, Human
auggauuuugggagu

SEQ ID NO: 1328746 - RNA, 21 nt, Human
auggauuuugggagugacuca

SEQ ID NO: 1328747 - RNA, 15 nt, Human
auggauuuuucuuua

SEQ ID NO: 1328748 - RNA, 16 nt, Human
auggauuuuucuuuaa

SEQ ID NO: 1328749 - RNA, 19 nt, Human
auggauuuuucuuuaacug

SEQ ID NO: 1328750 - RNA, 20 nt, Human
auggauuuuucuuuaacugc

SEQ ID NO: 1328751 - RNA, 18 nt, Human
auggcaaaggaaggugga

SEQ ID NO: 1328752 - RNA, 14 nt, Human
auggcaacagaucu

SEQ ID NO: 1328753 - RNA, 15 nt, Human
auggcaacagaucug

SEQ ID NO: 1328754 - RNA, 18 nt, Human
auggccggagaggaccgg

SEQ ID NO: 1328755 - RNA, 18 nt, Human
auggccgugaaugggugc

SEQ ID NO: 1328756 - RNA, 16 nt, Human
auggccagguggccac

SEQ ID NO: 1328757 - RNA, 22 nt, Human
auggccagccccuuagacagag

SEQ ID NO: 1328758 - RNA, 14 nt, Human
auggccagcuggag

SEQ ID NO: 1328759 - RNA, 20 nt, Human
auggccagcuggaggcaggg

SEQ ID NO: 1328760 - RNA, 22 nt, Human
auggccagguggccacuccaga

SEQ ID NO: 1328761 - RNA, 15 nt, Human
auggcagaaggcaaa

SEQ ID NO: 1328762 - RNA, 20 nt, Human
auggcagaaggcaaacccau

SEQ ID NO: 1328763 - RNA, 21 nt, Human
auggcagaaggcaaacccauc

SEQ ID NO: 1328764 - RNA, 19 nt, Human
auggcaugagaaauacaaa

SEQ ID NO: 1328765 - RNA, 22 nt, Human
auggccacaguagucuugauga

SEQ ID NO: 1328766 - RNA, 14 nt, Human
auggcagauguagg

SEQ ID NO: 1328767 - RNA, 13 nt, Human
auggccagcagca

SEQ ID NO: 1328768 - RNA, 13 nt, Human
auggccagccccu

SEQ ID NO: 1328769 - RNA, 17 nt, Human
auggccagccccuuaga

SEQ ID NO: 1328770 - RNA, 19 nt, Human
auggccagccccuuagaca

SEQ ID NO: 1328771 - RNA, 21 nt, Human
auggccagccccuuagacaga

SEQ ID NO: 1328772 - RNA, 22 nt, Human
auggccugcaaacugggaaccc

SEQ ID NO: 1328773 - RNA, 22 nt, Human
auggccgugaaugggugcccac

SEQ ID NO: 1328774 - RNA, 18 nt, Human
auggccugcaaacuggga

SEQ ID NO: 1328775 - RNA, 20 nt, Human
auggcuaguaucaaaagaaa

SEQ ID NO: 1328776 - RNA, 23 nt, Human
auggccuucauaucauccacaca

SEQ ID NO: 1328777 - RNA, 14 nt, Human
auggccuucauauc

SEQ ID NO: 1328778 - RNA, 13 nt, Human
auggcgcaggaac

SEQ ID NO: 1328779 - RNA, 12 nt, Human
augauucccagc

SEQ ID NO: 1328780 - RNA, 17 nt, Human
augauuucagcucacug

SEQ ID NO: 1328781 - RNA, 21 nt, Human
augauucaaaugucuauaaac

SEQ ID NO: 1328782 - RNA, 16 nt, Human
augauucaguguuaaa

SEQ ID NO: 1328783 - RNA, 13 nt, Human
augauucauuuua

SEQ ID NO: 1328784 - RNA, 20 nt, Human
augauuauuuuuuucuguaa

SEQ ID NO: 1328785 - RNA, 13 nt, Human
augauuccagcca

SEQ ID NO: 1328786 - RNA, 24 nt, Human
augauuaaauaagauucuaacggu

SEQ ID NO: 1328787 - RNA, 15 nt, Human
uuguugucugcaacu

SEQ ID NO: 1328788 - RNA, 18 nt, Human
uuguuguagagaaaacau

SEQ ID NO: 1328789 - RNA, 20 nt, Human
uuguuguagauugauuguau

SEQ ID NO: 1328790 - RNA, 23 nt, Human
uuguuguagauugauuguauugu

SEQ ID NO: 1328791 - RNA, 23 nt, Human
uuguuggcguaggcuacagagaa

SEQ ID NO: 1328792 - RNA, 22 nt, Human
uuguuggcguaggcuacagaga

SEQ ID NO: 1328793 - RNA, 15 nt, Human
uuguuggugcacagc

SEQ ID NO: 1328794 - RNA, 16 nt, Human
uuguugguugguuuuc

SEQ ID NO: 1328795 - RNA, 20 nt, Human
uuguugguugguuuucuucu

SEQ ID NO: 1328796 - RNA, 20 nt, Human
uuguugguuuuuaaagauuu

SEQ ID NO: 1328797 - RNA, 15 nt, Human
uuguuguaaccugcu

SEQ ID NO: 1328798 - RNA, 18 nt, Human
uuguuguaaccugcugug

SEQ ID NO: 1328799 - RNA, 22 nt, Human
augauuaugaauuacauuugua

SEQ ID NO: 1328800 - RNA, 23 nt, Human
augauuagaaauuaccuguggau

SEQ ID NO: 1328801 - RNA, 19 nt, Human
augauuaaauaagauucua

SEQ ID NO: 1328802 - RNA, 20 nt, Human
augauuaaauaagauucuaa

SEQ ID NO: 1328803 - RNA, 14 nt, Human
uuguuguccuuuuc

SEQ ID NO: 1328804 - RNA, 16 nt, Human
uuguuguccuuuucau

SEQ ID NO: 1328805 - RNA, 13 nt, Human
uuguugugcuuuu

SEQ ID NO: 1328806 - RNA, 14 nt, Human
augauuucauguac

SEQ ID NO: 1328807 - RNA, 14 nt, Human
augauuucuucuua

SEQ ID NO: 1328808 - RNA, 21 nt, Human
augauuuccuugaauguggcu

SEQ ID NO: 1328809 - RNA, 19 nt, Human
augauuucagcucacugca

SEQ ID NO: 1328810 - RNA, 14 nt, Human
augauuucaguagc

SEQ ID NO: 1328811 - RNA, 20 nt, Human
augauuucaguucuaggaaa

SEQ ID NO: 1328812 - RNA, 16 nt, Human
augauuucauguacug

SEQ ID NO: 1328813 - RNA, 13 nt, Human
augauuucaugua

SEQ ID NO: 1328814 - RNA, 21 nt, Human
augauuucaguucuaggaaaa

SEQ ID NO: 1328815 - RNA, 20 nt, Human
augauuucaugcuaucucug

SEQ ID NO: 1328816 - RNA, 21 nt, Human
augauuucaugcuaucucugu

SEQ ID NO: 1328817 - RNA, 21 nt, Human
augauuuuaaguuucucugca

SEQ ID NO: 1328818 - RNA, 14 nt, Human
augcacaucccugg

SEQ ID NO: 1328819 - RNA, 17 nt, Human
augcacaugaacuuaga

SEQ ID NO: 1328820 - RNA, 14 nt, Human
augcaccaccaagc

SEQ ID NO: 1328821 - RNA, 18 nt, Human
augcaaaucaauuacugg

SEQ ID NO: 1328822 - RNA, 15 nt, Human
augcaccaccaagcc

SEQ ID NO: 1328823 - RNA, 18 nt, Human
augcaccaccaagccaag

SEQ ID NO: 1328824 - RNA, 21 nt, Human
augcaccaccaagccaaggga

SEQ ID NO: 1328825 - RNA, 19 nt, Human
augcacuuauaauuuuccu

SEQ ID NO: 1328826 - RNA, 20 nt, Human
augcacuucaaauucaaaua

SEQ ID NO: 1328827 - RNA, 22 nt, Human
augcacuuucuauccucuguaa

SEQ ID NO: 1328828 - RNA, 12 nt, Human
augcacuuugcu

SEQ ID NO: 1328829 - RNA, 13 nt, Human
augcacuuugcuu

SEQ ID NO: 1328830 - RNA, 15 nt, Human
augcacuuugcuuua

SEQ ID NO: 1328831 - RNA, 16 nt, Human
augcacuuugcuuuaa

SEQ ID NO: 1328832 - RNA, 20 nt, Human
augagagacacacugaagaa

SEQ ID NO: 1328833 - RNA, 21 nt, Human
augagagacacacugaagaag

SEQ ID NO: 1328834 - RNA, 23 nt, Human
augagagacacacugaagaagca

SEQ ID NO: 1328835 - RNA, 22 nt, Human
uugugaguuuaccuuguauacu

SEQ ID NO: 1328836 - RNA, 17 nt, Human
uuguggccuaagaggcu

SEQ ID NO: 1328837 - RNA, 18 nt, Human
uuguggguuuuuauuucc

SEQ ID NO: 1328838 - RNA, 18 nt, Human
uugugggggacuguaagu

SEQ ID NO: 1328839 - RNA, 19 nt, Human
uugugggggacuguaaguu

SEQ ID NO: 1328840 - RNA, 20 nt, Human
uugugggccugggcuccugg

SEQ ID NO: 1328841 - RNA, 14 nt, Human
uuguggggccuggg

SEQ ID NO: 1328842 - RNA, 17 nt, Human
uuguggggccugggagg

SEQ ID NO: 1328843 - RNA, 16 nt, Human
uugugggggacuguaa

SEQ ID NO: 1328844 - RNA, 14 nt, Human
uugugggccugggc

SEQ ID NO: 1328845 - RNA, 15 nt, Human
uugugggccugggcu

SEQ ID NO: 1328846 - RNA, 18 nt, Human
uugugggccugggcuccu

SEQ ID NO: 1328847 - RNA, 19 nt, Human
uugugggccugggcuccug

SEQ ID NO: 1328848 - RNA, 23 nt, Human
uugugggccugggcuccuggacc

SEQ ID NO: 1328849 - RNA, 17 nt, Human
uuguggggaugaugaaa

SEQ ID NO: 1328850 - RNA, 18 nt, Human
uuguggccuuugcgcucc

SEQ ID NO: 1328851 - RNA, 13 nt, Human
uugugggccuggg

SEQ ID NO: 1328852 - RNA, 14 nt, Human
uuguguaagaaaua

SEQ ID NO: 1328853 - RNA, 23 nt, Human
uugugugaaagguacuucaaauc

SEQ ID NO: 1328854 - RNA, 20 nt, Human
uuguggguuuuuauuuccua

SEQ ID NO: 1328855 - RNA, 20 nt, Human
uugugguuuauauauuuaaa

SEQ ID NO: 1328856 - RNA, 18 nt, Human
uuguguaagaaauacaga

SEQ ID NO: 1328857 - RNA, 13 nt, Human
uugugugcucucc

SEQ ID NO: 1328858 - RNA, 14 nt, Human
uugugugcucucca

SEQ ID NO: 1328859 - RNA, 15 nt, Human
uugugugcucuccau

SEQ ID NO: 1328860 - RNA, 13 nt, Human
uuguguggauucu

SEQ ID NO: 1328861 - RNA, 16 nt, Human
uuguguggauucuuua

SEQ ID NO: 1328862 - RNA, 13 nt, Human
uuguguguugucu

SEQ ID NO: 1328863 - RNA, 15 nt, Human
uuguguguugucucu

SEQ ID NO: 1328864 - RNA, 17 nt, Human
uuguguguugucucuug

SEQ ID NO: 1328865 - RNA, 14 nt, Human
uuguucugucacca

SEQ ID NO: 1328866 - RNA, 14 nt, Human
uuguucuguuaacu

SEQ ID NO: 1328867 - RNA, 16 nt, Human
uuguuggcauagcucu

SEQ ID NO: 1328868 - RNA, 15 nt, Human
uuguucuguuaacug

SEQ ID NO: 1328869 - RNA, 18 nt, Human
uuguuggcguaggcuaca

SEQ ID NO: 1328870 - RNA, 21 nt, Human
uuguuggcguaggcuacagag

SEQ ID NO: 1328871 - RNA, 14 nt, Human
uuuaaauguuuuuu

SEQ ID NO: 1328872 - RNA, 15 nt, Human
uuuaaauguauacua

SEQ ID NO: 1328873 - RNA, 14 nt, Human
uuuaaauguauacu

SEQ ID NO: 1328874 - RNA, 15 nt, Human
uuguuuuacugucuu

SEQ ID NO: 1328875 - RNA, 22 nt, Human
augcacuuugcuuuaauauaaa

SEQ ID NO: 1328876 - RNA, 23 nt, Human
augcacuuugcuuuaauauaaau

SEQ ID NO: 1328877 - RNA, 18 nt, Human
augcacuuugcuuuaaua

SEQ ID NO: 1328878 - RNA, 19 nt, Human
augcacuuugcuuuaauau

SEQ ID NO: 1328879 - RNA, 20 nt, Human
augcacuuugcuuuaauaua

SEQ ID NO: 1328880 - RNA, 21 nt, Human
augcacuuugcuuuaauauaa

SEQ ID NO: 1328881 - RNA, 12 nt, Human
uuuaaauugugu

SEQ ID NO: 1328882 - RNA, 11 nt, Human
uuuaaauugug

SEQ ID NO: 1328883 - RNA, 15 nt, Human
uuuaagauaauuaua

SEQ ID NO: 1328884 - RNA, 14 nt, Human
uuuaagauaauuau

SEQ ID NO: 1328885 - RNA, 12 nt, Human
uuuaauuuuaca

SEQ ID NO: 1328886 - RNA, 15 nt, Human
uuuaauuguaaagua

SEQ ID NO: 1328887 - RNA, 21 nt, Human
uuuaauuguaaaguaaaagcu

SEQ ID NO: 1328888 - RNA, 12 nt, Human
uuuaauuguaaa

SEQ ID NO: 1328889 - RNA, 23 nt, Human
uuuaaugccgauauacucuagau

SEQ ID NO: 1328890 - RNA, 19 nt, Human
uuuaauggggugcaccugu

SEQ ID NO: 1328891 - RNA, 21 nt, Human
uuuaauguaauagggaaaauu

SEQ ID NO: 1328892 - RNA, 18 nt, Human
uuuaauguacuaauauuu

SEQ ID NO: 1328893 - RNA, 18 nt, Human
uuuaauguauaguaaauc

SEQ ID NO: 1328894 - RNA, 22 nt, Human
uuuaaugaaugcuuaaagaauu

SEQ ID NO: 1328895 - RNA, 16 nt, Human
uuuaaugaaugcuuaa

SEQ ID NO: 1328896 - RNA, 19 nt, Human
uuuaaugaagaucuaaaua

SEQ ID NO: 1328897 - RNA, 14 nt, Human
uuuaaugagauaau

SEQ ID NO: 1328898 - RNA, 14 nt, Human
uuuaagcucugagc

SEQ ID NO: 1328899 - RNA, 17 nt, Human
uuuaagcucugagcugu

SEQ ID NO: 1328900 - RNA, 18 nt, Human
uuuaagcucugagcuguc

SEQ ID NO: 1328901 - RNA, 19 nt, Human
uuuaagcucugagcuguca

SEQ ID NO: 1328902 - RNA, 15 nt, Human
uuuaaugaacaaaug

SEQ ID NO: 1328903 - RNA, 16 nt, Human
uuuaaugaacaaaugg

SEQ ID NO: 1328904 - RNA, 16 nt, Human
uuuaaugaagaucuaa

SEQ ID NO: 1328905 - RNA, 12 nt, Human
uuuaagccaaaa

SEQ ID NO: 1328906 - RNA, 20 nt, Human
uuuaagccaaaacaauguuu

SEQ ID NO: 1328907 - RNA, 18 nt, Human
uuuaagccaaaacaaugu

SEQ ID NO: 1328908 - RNA, 13 nt, Human
uuuaagcucugag

SEQ ID NO: 1328909 - RNA, 18 nt, Human
augcaguucugaagaaga

SEQ ID NO: 1328910 - RNA, 19 nt, Human
augcaguucugaagaagau

SEQ ID NO: 1328911 - RNA, 14 nt, Human
augcaguugucucu

SEQ ID NO: 1328912 - RNA, 15 nt, Human
augcaguugucucug

SEQ ID NO: 1328913 - RNA, 16 nt, Human
augcaguugucucugu

SEQ ID NO: 1328914 - RNA, 18 nt, Human
augcaguugucucuguuu

SEQ ID NO: 1328915 - RNA, 13 nt, Human
augccaaauuaaa

SEQ ID NO: 1328916 - RNA, 14 nt, Human
augccaaauuaaaa

SEQ ID NO: 1328917 - RNA, 15 nt, Human
augccaaauuaaaaa

SEQ ID NO: 1328918 - RNA, 18 nt, Human
augccaaauuaaaaaaga

SEQ ID NO: 1328919 - RNA, 22 nt, Human
augccaaauuaaaaaagauaaa

SEQ ID NO: 1328920 - RNA, 19 nt, Human
augccaaauuaaaaaagau

SEQ ID NO: 1328921 - RNA, 17 nt, Human
augcccagagacccagc

SEQ ID NO: 1328922 - RNA, 18 nt, Human
augcccagagacccagcg

SEQ ID NO: 1328923 - RNA, 10 nt, Human
augcccagag

SEQ ID NO: 1328924 - RNA, 11 nt, Human
augcccagaga

SEQ ID NO: 1328925 - RNA, 14 nt, Human
augcccagagaccc

SEQ ID NO: 1328926 - RNA, 16 nt, Human
augcccagagacccag

SEQ ID NO: 1328927 - RNA, 17 nt, Human
augccacuaaauugaca

SEQ ID NO: 1328928 - RNA, 15 nt, Human
augccacuaaauuga

SEQ ID NO: 1328929 - RNA, 14 nt, Human
augccacugccuuc

SEQ ID NO: 1328930 - RNA, 15 nt, Human
augccacugccuucg

SEQ ID NO: 1328931 - RNA, 13 nt, Human
augcagggcaguc

SEQ ID NO: 1328932 - RNA, 15 nt, Human
augcagggcagucau

SEQ ID NO: 1328933 - RNA, 15 nt, Human
augcaguucugaaga

SEQ ID NO: 1328934 - RNA, 17 nt, Human
augcaguucugaagaag

SEQ ID NO: 1328935 - RNA, 13 nt, Human
augcagugccagg

SEQ ID NO: 1328936 - RNA, 17 nt, Human
augcagugccuuucuuc

SEQ ID NO: 1328937 - RNA, 15 nt, Human
uucuaguguagaauu

SEQ ID NO: 1328938 - RNA, 16 nt, Human
uucuagagcacugcca

SEQ ID NO: 1328939 - RNA, 14 nt, Human
uucuagaguucaga

SEQ ID NO: 1328940 - RNA, 19 nt, Human
uucuagaguucagaguccu

SEQ ID NO: 1328941 - RNA, 16 nt, Human
uucuagaucagaugcu

SEQ ID NO: 1328942 - RNA, 22 nt, Human
uucuagaucagaugcuccaaga

SEQ ID NO: 1328943 - RNA, 23 nt, Human
uucuagaucagaugcuccaagau

SEQ ID NO: 1328944 - RNA, 21 nt, Human
uucuagguuucaaagaugcug

SEQ ID NO: 1328945 - RNA, 23 nt, Human
uucuaaggaccugaaauuccaaa

SEQ ID NO: 1328946 - RNA, 15 nt, Human
uucuaaggccuagga

SEQ ID NO: 1328947 - RNA, 17 nt, Human
uucuaaggccuaggauu

SEQ ID NO: 1328948 - RNA, 12 nt, Human
uucuagaaaaac

SEQ ID NO: 1328949 - RNA, 19 nt, Human
uucuagaaagagaaacagu

SEQ ID NO: 1328950 - RNA, 22 nt, Human
uucuagaaagagaaacaguugg

SEQ ID NO: 1328951 - RNA, 20 nt, Human
uucuagacauggagguucua

SEQ ID NO: 1328952 - RNA, 22 nt, Human
uucuagacauggagguucuaag

SEQ ID NO: 1328953 - RNA, 23 nt, Human
uucuagacauggagguucuaagg

SEQ ID NO: 1328954 - RNA, 12 nt, Human
uucuagaccaau

SEQ ID NO: 1328955 - RNA, 14 nt, Human
uucuauaauuuaaa

SEQ ID NO: 1328956 - RNA, 13 nt, Human
uucuauaauuuaa

SEQ ID NO: 1328957 - RNA, 15 nt, Human
uucuaguucugccag

SEQ ID NO: 1328958 - RNA, 16 nt, Human
uucuaguucugccagg

SEQ ID NO: 1328959 - RNA, 22 nt, Human
uucuauaaguuuuauguuaaau

SEQ ID NO: 1328960 - RNA, 19 nt, Human
aucagacuaugaaguuuuu

SEQ ID NO: 1328961 - RNA, 16 nt, Human
aucagacuaagccagc

SEQ ID NO: 1328962 - RNA, 17 nt, Human
aucagacuaagccagca

SEQ ID NO: 1328963 - RNA, 19 nt, Human
aucagacuaagccagcacc

SEQ ID NO: 1328964 - RNA, 20 nt, Human
aucagacuaagccagcaccg

SEQ ID NO: 1328965 - RNA, 17 nt, Human
aucagacugacaguuua

SEQ ID NO: 1328966 - RNA, 15 nt, Human
aucagaaagggaggg

SEQ ID NO: 1328967 - RNA, 16 nt, Human
aucagaaagggagggc

SEQ ID NO: 1328968 - RNA, 17 nt, Human
aucagaaagggagggcu

SEQ ID NO: 1328969 - RNA, 16 nt, Human
aucagaccauaauguu

SEQ ID NO: 1328970 - RNA, 20 nt, Human
aucagaccauaauguuacau

SEQ ID NO: 1328971 - RNA, 13 nt, Human
aucagacugacag

SEQ ID NO: 1328972 - RNA, 14 nt, Human
aucagagaaggaac

SEQ ID NO: 1328973 - RNA, 19 nt, Human
aucaggaauauuuuccaaa

SEQ ID NO: 1328974 - RNA, 22 nt, Human
aucaggaauauuuuccaaagag

SEQ ID NO: 1328975 - RNA, 16 nt, Human
aucaggacccagagga

SEQ ID NO: 1328976 - RNA, 18 nt, Human
aucaggacccagaggaag

SEQ ID NO: 1328977 - RNA, 20 nt, Human
aucaggacccagaggaaggg

SEQ ID NO: 1328978 - RNA, 20 nt, Human
aucagaaacacccucacacu

SEQ ID NO: 1328979 - RNA, 16 nt, Human
aucagaaacacccuca

SEQ ID NO: 1328980 - RNA, 14 nt, Human
aucagaaagaggca

SEQ ID NO: 1328981 - RNA, 20 nt, Human
aucagaaaggaaaaacaaac

SEQ ID NO: 1328982 - RNA, 22 nt, Human
aucagaaaggaaaaacaaacuc

SEQ ID NO: 1328983 - RNA, 21 nt, Human
aucacuuucucaguuuucaua

SEQ ID NO: 1328984 - RNA, 20 nt, Human
aucacuuucucaguuuucau

SEQ ID NO: 1328985 - RNA, 16 nt, Human
uucucagauuucugag

SEQ ID NO: 1328986 - RNA, 14 nt, Human
uucucagauuucug

SEQ ID NO: 1328987 - RNA, 20 nt, Human
uucucagauuucugaggaaa

SEQ ID NO: 1328988 - RNA, 13 nt, Human
uucucagcuccca

SEQ ID NO: 1328989 - RNA, 15 nt, Human
uucucagauuucuga

SEQ ID NO: 1328990 - RNA, 15 nt, Human
uucuaaaguaaaaac

SEQ ID NO: 1328991 - RNA, 12 nt, Human
uucuaaaguucu

SEQ ID NO: 1328992 - RNA, 13 nt, Human
uucuaaaguucua

SEQ ID NO: 1328993 - RNA, 14 nt, Human
uucuaaaguucuaa

SEQ ID NO: 1328994 - RNA, 16 nt, Human
uucuaaaguucuaaga

SEQ ID NO: 1328995 - RNA, 17 nt, Human
uucuaaaguucuaagau

SEQ ID NO: 1328996 - RNA, 18 nt, Human
uucuaaaguucuaagauu

SEQ ID NO: 1328997 - RNA, 20 nt, Human
uucuaaaguucuaagauucu

SEQ ID NO: 1328998 - RNA, 14 nt, Human
uucuaacaagucau

SEQ ID NO: 1328999 - RNA, 14 nt, Human
uucuaaccuuuaca

SEQ ID NO: 1329000 - RNA, 13 nt, Human
uucuaagaaguga

SEQ ID NO: 1329001 - RNA, 14 nt, Human
uucuaagaaacauu

SEQ ID NO: 1329002 - RNA, 16 nt, Human
uucuaagaaacauuua

SEQ ID NO: 1329003 - RNA, 23 nt, Human
uucuaagaaacauuuauauugau

SEQ ID NO: 1329004 - RNA, 15 nt, Human
uucuaaccuuuacau

SEQ ID NO: 1329005 - RNA, 16 nt, Human
uucuaaccuuuacaug

SEQ ID NO: 1329006 - RNA, 23 nt, Human
uucuaacuacaaagguuuaaaug

SEQ ID NO: 1329007 - RNA, 22 nt, Human
uucuaacuacaaagguuuaaau

SEQ ID NO: 1329008 - RNA, 20 nt, Human
uucuaagaaacauuuauauu

SEQ ID NO: 1329009 - RNA, 12 nt, Human
uucuaagaugug

SEQ ID NO: 1329010 - RNA, 19 nt, Human
uucuaagaugugauauucu

SEQ ID NO: 1329011 - RNA, 20 nt, Human
uucuaagaugugauauucua

SEQ ID NO: 1329012 - RNA, 21 nt, Human
uucuaagaugugauauucuaa

SEQ ID NO: 1329013 - RNA, 22 nt, Human
uucuaagaugugauauucuaag

SEQ ID NO: 1329014 - RNA, 23 nt, Human
uucuaagaugugauauucuaaga

SEQ ID NO: 1329015 - RNA, 12 nt, Human
uucuaagauucu

SEQ ID NO: 1329016 - RNA, 13 nt, Human
uucuaagauucua

SEQ ID NO: 1329017 - RNA, 14 nt, Human
uucuaagauucuaa

SEQ ID NO: 1329018 - RNA, 15 nt, Human
uucuaagauucuaaa

SEQ ID NO: 1329019 - RNA, 16 nt, Human
uucuaagauucuaaag

SEQ ID NO: 1329020 - RNA, 17 nt, Human
uucuaagauucuaaagg

SEQ ID NO: 1329021 - RNA, 15 nt, Human
uucuaagauucuaau

SEQ ID NO: 1329022 - RNA, 16 nt, Human
uucuaagauucuaaug

SEQ ID NO: 1329023 - RNA, 17 nt, Human
uucuaagauucuaauga

SEQ ID NO: 1329024 - RNA, 19 nt, Human
uucuaagauucuaaugaug

SEQ ID NO: 1329025 - RNA, 13 nt, Human
uucuaagauucug

SEQ ID NO: 1329026 - RNA, 17 nt, Human
uucuaagcauaaaagau

SEQ ID NO: 1329027 - RNA, 14 nt, Human
uucuaagauucuga

SEQ ID NO: 1329028 - RNA, 21 nt, Human
uucuaaggaccugaaauucca

SEQ ID NO: 1329029 - RNA, 22 nt, Human
uucuaaggaccugaaauuccaa

SEQ ID NO: 1329030 - RNA, 19 nt, Human
uucuaaggccuaggauucu

SEQ ID NO: 1329031 - RNA, 16 nt, Human
aucaauaauauauuuu

SEQ ID NO: 1329032 - RNA, 13 nt, Human
uucgaaaaucaaa

SEQ ID NO: 1329033 - RNA, 14 nt, Human
uuccuuuuuuugua

SEQ ID NO: 1329034 - RNA, 16 nt, Human
uuccuuuuuuuguacc

SEQ ID NO: 1329035 - RNA, 21 nt, Human
uucgacuguuguuaucuguuu

SEQ ID NO: 1329036 - RNA, 16 nt, Human
uucgacuguuguuauc

SEQ ID NO: 1329037 - RNA, 14 nt, Human
uucgacacuguucu

SEQ ID NO: 1329038 - RNA, 15 nt, Human
uucgaaugacacugu

SEQ ID NO: 1329039 - RNA, 15 nt, Human
uucgacacuguucuu

SEQ ID NO: 1329040 - RNA, 11 nt, Human
uucgcagccac

SEQ ID NO: 1329041 - RNA, 13 nt, Human
uucgcagccaccc

SEQ ID NO: 1329042 - RNA, 14 nt, Human
uucgcagccacccu

SEQ ID NO: 1329043 - RNA, 15 nt, Human
uucgcagccacccug

SEQ ID NO: 1329044 - RNA, 16 nt, Human
uucgcagccacccuga

SEQ ID NO: 1329045 - RNA, 18 nt, Human
uucgcagccacccugagg

SEQ ID NO: 1329046 - RNA, 20 nt, Human
uucgauacaccgggccugga

SEQ ID NO: 1329047 - RNA, 23 nt, Human
uucgagauuaucguuuucuuaaa

SEQ ID NO: 1329048 - RNA, 19 nt, Human
uucgcagccacccugagga

SEQ ID NO: 1329049 - RNA, 24 nt, Human
uucgcagccacccugaggagucug

SEQ ID NO: 1329050 - RNA, 22 nt, Human
uucgcaguccacuucugacagc

SEQ ID NO: 1329051 - RNA, 14 nt, Human
uucgcauggucaca

SEQ ID NO: 1329052 - RNA, 16 nt, Human
uucgcauggucacaca

SEQ ID NO: 1329053 - RNA, 17 nt, Human
uucgcauggucacacac

SEQ ID NO: 1329054 - RNA, 18 nt, Human
uucgcauggucacacacu

SEQ ID NO: 1329055 - RNA, 19 nt, Human
uucgcauggucacacacug

SEQ ID NO: 1329056 - RNA, 20 nt, Human
uucgcauggucacacacuga

SEQ ID NO: 1329057 - RNA, 21 nt, Human
uucgcauggucacacacugau

SEQ ID NO: 1329058 - RNA, 23 nt, Human
uucgcauggucacacacugaugc

SEQ ID NO: 1329059 - RNA, 15 nt, Human
auauuuuacauaaau

SEQ ID NO: 1329060 - RNA, 16 nt, Human
auauuuuacauaaauu

SEQ ID NO: 1329061 - RNA, 20 nt, Human
auauuuuacauaaauuuagu

SEQ ID NO: 1329062 - RNA, 23 nt, Human
uucccagagcaaaauaauuuuaa

SEQ ID NO: 1329063 - RNA, 11 nt, Human
uucccagaggg

SEQ ID NO: 1329064 - RNA, 13 nt, Human
auauuuuaaugua

SEQ ID NO: 1329065 - RNA, 20 nt, Human
uucccacggccuuucuagcc

SEQ ID NO: 1329066 - RNA, 21 nt, Human
uucccacuccaagcccagccc

SEQ ID NO: 1329067 - RNA, 14 nt, Human
uucccacuccaagc

SEQ ID NO: 1329068 - RNA, 15 nt, Human
uucccacuguuuaag

SEQ ID NO: 1329069 - RNA, 20 nt, Human
uucccacuuaaaaauuaaau

SEQ ID NO: 1329070 - RNA, 17 nt, Human
uucccacuuucccaccc

SEQ ID NO: 1329071 - RNA, 18 nt, Human
uucccacuuucccacccc

SEQ ID NO: 1329072 - RNA, 20 nt, Human
uucccacuuucccaccccac

SEQ ID NO: 1329073 - RNA, 18 nt, Human
uucccagagcaaaauaau

SEQ ID NO: 1329074 - RNA, 14 nt, Human
uucccccucuccca

SEQ ID NO: 1329075 - RNA, 18 nt, Human
uucccccucucccaguug

SEQ ID NO: 1329076 - RNA, 17 nt, Human
uucccccucucccaguu

SEQ ID NO: 1329077 - RNA, 22 nt, Human
uucccccuguuucagaggcuca

SEQ ID NO: 1329078 - RNA, 12 nt, Human
uuccccucugcu

SEQ ID NO: 1329079 - RNA, 14 nt, Human
uuccccucugcugc

SEQ ID NO: 1329080 - RNA, 15 nt, Human
uuccccucugcugcu

SEQ ID NO: 1329081 - RNA, 18 nt, Human
uuccccucugcugcuguc

SEQ ID NO: 1329082 - RNA, 16 nt, Human
uucccuaucuuugcca

SEQ ID NO: 1329083 - RNA, 12 nt, Human
uucccuaucacu

SEQ ID NO: 1329084 - RNA, 15 nt, Human
uucccuauccaauca

SEQ ID NO: 1329085 - RNA, 17 nt, Human
uucccuacuuccuguga

SEQ ID NO: 1329086 - RNA, 22 nt, Human
uucccuagaaacuuccaaaucc

SEQ ID NO: 1329087 - RNA, 14 nt, Human
uucccuacuuccug

SEQ ID NO: 1329088 - RNA, 16 nt, Human
uucccuacuuccugug

SEQ ID NO: 1329089 - RNA, 14 nt, Human
uuccccuguucacu

SEQ ID NO: 1329090 - RNA, 17 nt, Human
uuccccuguucacucua

SEQ ID NO: 1329091 - RNA, 19 nt, Human
uuccccuguuuauucauau

SEQ ID NO: 1329092 - RNA, 18 nt, Human
uuccccuguuuauucaua

SEQ ID NO: 1329093 - RNA, 22 nt, Human
uuccccuuccuaauuccacagc

SEQ ID NO: 1329094 - RNA, 21 nt, Human
uuccccuuccacugagggcag

SEQ ID NO: 1329095 - RNA, 16 nt, Human
uuccccuuauccuccc

SEQ ID NO: 1329096 - RNA, 17 nt, Human
uuccccuuauccucccu

SEQ ID NO: 1329097 - RNA, 19 nt, Human
uuccccuuauccucccugu

SEQ ID NO: 1329098 - RNA, 20 nt, Human
uuccccuuauccucccugua

SEQ ID NO: 1329099 - RNA, 14 nt, Human
uuccccuuccacug

SEQ ID NO: 1329100 - RNA, 15 nt, Human
uuccccuuccacuga

SEQ ID NO: 1329101 - RNA, 14 nt, Human
uucccuuuucuguu

SEQ ID NO: 1329102 - RNA, 19 nt, Human
uuccuaccaagucaaacuu

SEQ ID NO: 1329103 - RNA, 15 nt, Human
uuccuucagcacuuu

SEQ ID NO: 1329104 - RNA, 13 nt, Human
auauuuuccuaua

SEQ ID NO: 1329105 - RNA, 19 nt, Human
auauuuuccuauauuacgg

SEQ ID NO: 1329106 - RNA, 13 nt, Human
auauuuuccuccu

SEQ ID NO: 1329107 - RNA, 12 nt, Human
auauuuucucua

SEQ ID NO: 1329108 - RNA, 19 nt, Human
auauuuucucuaggaaaua

SEQ ID NO: 1329109 - RNA, 13 nt, Human
auauuuucucuag

SEQ ID NO: 1329110 - RNA, 16 nt, Human
auauuuucucuaggaa

SEQ ID NO: 1329111 - RNA, 12 nt, Human
auauuuucuguu

SEQ ID NO: 1329112 - RNA, 13 nt, Human
auauuuucuguuu

SEQ ID NO: 1329113 - RNA, 14 nt, Human
uuccuucagcacuu

SEQ ID NO: 1329114 - RNA, 21 nt, Human
uuccuucagagagcagugcuu

SEQ ID NO: 1329115 - RNA, 12 nt, Human
uuccuucagauu

SEQ ID NO: 1329116 - RNA, 22 nt, Human
uuccuucagagagcagugcuuu

SEQ ID NO: 1329117 - RNA, 20 nt, Human
uuccuucaaagcaaaugucu

SEQ ID NO: 1329118 - RNA, 22 nt, Human
uuccuuagacucuuuuccuucc

SEQ ID NO: 1329119 - RNA, 12 nt, Human
uuccucuccacu

SEQ ID NO: 1329120 - RNA, 15 nt, Human
uuccucuccacacag

SEQ ID NO: 1329121 - RNA, 15 nt, Human
uuccuacuggucucu

SEQ ID NO: 1329122 - RNA, 13 nt, Human
uuccucuccacug

SEQ ID NO: 1329123 - RNA, 14 nt, Human
uuccucuccacugc

SEQ ID NO: 1329124 - RNA, 15 nt, Human
uuccucuccacugcc

SEQ ID NO: 1329125 - RNA, 16 nt, Human
uuccucuccacugccu

SEQ ID NO: 1329126 - RNA, 14 nt, Human
uuccuggugcugga

SEQ ID NO: 1329127 - RNA, 15 nt, Human
uuccuggugcuggag

SEQ ID NO: 1329128 - RNA, 20 nt, Human
uuccuguauuuguucccaag

SEQ ID NO: 1329129 - RNA, 22 nt, Human
uuccuguauuuguucccaagag

SEQ ID NO: 1329130 - RNA, 21 nt, Human
uuccuguauuuguucccaaga

SEQ ID NO: 1329131 - RNA, 15 nt, Human
uuccuguccagcucc

SEQ ID NO: 1329132 - RNA, 16 nt, Human
uuccuguccagcucca

SEQ ID NO: 1329133 - RNA, 17 nt, Human
uuccuguccagcuccaa

SEQ ID NO: 1329134 - RNA, 22 nt, Human
uuccuguccagcuccaaccugc

SEQ ID NO: 1329135 - RNA, 13 nt, Human
auauuuuuagaua

SEQ ID NO: 1329136 - RNA, 15 nt, Human
aucaaauguuuaauc

SEQ ID NO: 1329137 - RNA, 14 nt, Human
aucaaauguuuaau

SEQ ID NO: 1329138 - RNA, 13 nt, Human
aucaaauguuuaa

SEQ ID NO: 1329139 - RNA, 12 nt, Human
aucaaauguuua

SEQ ID NO: 1329140 - RNA, 18 nt, Human
aucaaaugguaucuuuug

SEQ ID NO: 1329141 - RNA, 18 nt, Human
aucaaauguaacuuacug

SEQ ID NO: 1329142 - RNA, 20 nt, Human
aucaaaucuaccacuguaug

SEQ ID NO: 1329143 - RNA, 17 nt, Human
aucaaaugguaucuuuu

SEQ ID NO: 1329144 - RNA, 14 nt, Human
aucaaguuauuuuu

SEQ ID NO: 1329145 - RNA, 23 nt, Human
aucaagucuguuuacugcaaggu

SEQ ID NO: 1329146 - RNA, 15 nt, Human
aucaagucuguuuac

SEQ ID NO: 1329147 - RNA, 21 nt, Human
aucaaguauuugggaagugaa

SEQ ID NO: 1329148 - RNA, 20 nt, Human
aucaaguauuugggaaguga

SEQ ID NO: 1329149 - RNA, 13 nt, Human
aucaagucuguuu

SEQ ID NO: 1329150 - RNA, 22 nt, Human
aucaaguuggcuucuaaucaaa

SEQ ID NO: 1329151 - RNA, 23 nt, Human
aucaaguuggcuucuaaucaaag

SEQ ID NO: 1329152 - RNA, 18 nt, Human
aucaaauguuuaaucaua

SEQ ID NO: 1329153 - RNA, 18 nt, Human
aucaaccccagacacugg

SEQ ID NO: 1329154 - RNA, 19 nt, Human
aucaaccccagacacuggu

SEQ ID NO: 1329155 - RNA, 21 nt, Human
aucaaauguuuaaucauauaa

SEQ ID NO: 1329156 - RNA, 17 nt, Human
aucaaauguuuaaucau

SEQ ID NO: 1329157 - RNA, 16 nt, Human
aucaaauguuuaauca

SEQ ID NO: 1329158 - RNA, 23 nt, Human
uucucuuguauaagauccuagau

SEQ ID NO: 1329159 - RNA, 16 nt, Human
uucucuuuccaugaca

SEQ ID NO: 1329160 - RNA, 21 nt, Human
uucucuuucccuggucccuug

SEQ ID NO: 1329161 - RNA, 21 nt, Human
uucucuaauauggcaaccauu

SEQ ID NO: 1329162 - RNA, 21 nt, Human
uucucuaauucuuccuuugua

SEQ ID NO: 1329163 - RNA, 12 nt, Human
uucucuaauaug

SEQ ID NO: 1329164 - RNA, 24 nt, Human
uucucuaagagaacaaugugcuau

SEQ ID NO: 1329165 - RNA, 14 nt, Human
uucucuuucccugg

SEQ ID NO: 1329166 - RNA, 14 nt, Human
uucucuuugccuca

SEQ ID NO: 1329167 - RNA, 15 nt, Human
uucucuuugccucaa

SEQ ID NO: 1329168 - RNA, 15 nt, Human
uucucuuuuccuuug

SEQ ID NO: 1329169 - RNA, 13 nt, Human
uucugacagccuc

SEQ ID NO: 1329170 - RNA, 15 nt, Human
uucugcacacagcac

SEQ ID NO: 1329171 - RNA, 16 nt, Human
uucugcacuauaugca

SEQ ID NO: 1329172 - RNA, 22 nt, Human
uucugcacuugcgguuccggca

SEQ ID NO: 1329173 - RNA, 19 nt, Human
aucauugcuuccuccuccc

SEQ ID NO: 1329174 - RNA, 12 nt, Human
uucuccugccuc

SEQ ID NO: 1329175 - RNA, 13 nt, Human
uucuccugccuca

SEQ ID NO: 1329176 - RNA, 14 nt, Human
uucuccugccucag

SEQ ID NO: 1329177 - RNA, 19 nt, Human
uucucuaagagaacaaugu

SEQ ID NO: 1329178 - RNA, 21 nt, Human
uucuccugaggauguguccca

SEQ ID NO: 1329179 - RNA, 16 nt, Human
aucauuucacuuguca

SEQ ID NO: 1329180 - RNA, 18 nt, Human
aucauuucuauuaaauga

SEQ ID NO: 1329181 - RNA, 21 nt, Human
aucauuucuauuaaaugagca

SEQ ID NO: 1329182 - RNA, 15 nt, Human
aucauuucuauuucu

SEQ ID NO: 1329183 - RNA, 22 nt, Human
auccaauggacugcauaaauaa

SEQ ID NO: 1329184 - RNA, 16 nt, Human
auccaaguuaaaugua

SEQ ID NO: 1329185 - RNA, 21 nt, Human
auccaaguuaaauguagaguu

SEQ ID NO: 1329186 - RNA, 13 nt, Human
auccaaucaaucu

SEQ ID NO: 1329187 - RNA, 18 nt, Human
auccaaucaaucuugcau

SEQ ID NO: 1329188 - RNA, 13 nt, Human
auccaaaagaagc

SEQ ID NO: 1329189 - RNA, 18 nt, Human
auccaaaagaagccccca

SEQ ID NO: 1329190 - RNA, 19 nt, Human
auccaaaagaagcccccag

SEQ ID NO: 1329191 - RNA, 22 nt, Human
auccaaaagaagcccccagcua

SEQ ID NO: 1329192 - RNA, 13 nt, Human
auccaaaagcuuu

SEQ ID NO: 1329193 - RNA, 19 nt, Human
auccaaaaucuugaucagu

SEQ ID NO: 1329194 - RNA, 15 nt, Human
auccaaagcagacag

SEQ ID NO: 1329195 - RNA, 21 nt, Human
auccaaggugggguggaagcu

SEQ ID NO: 1329196 - RNA, 14 nt, Human
auccaaguuaaaug

SEQ ID NO: 1329197 - RNA, 15 nt, Human
auccaaguuaaaugu

SEQ ID NO: 1329198 - RNA, 14 nt, Human
auccauuucuaauu

SEQ ID NO: 1329199 - RNA, 15 nt, Human
auccauuucuaauua

SEQ ID NO: 1329200 - RNA, 23 nt, Human
auccauuucuaauuauguagcuc

SEQ ID NO: 1329201 - RNA, 20 nt, Human
aucccaaguagaaucucagu

SEQ ID NO: 1329202 - RNA, 15 nt, Human
aucccaccaacccuc

SEQ ID NO: 1329203 - RNA, 14 nt, Human
auccauacauuugu

SEQ ID NO: 1329204 - RNA, 11 nt, Human
auccauaaaga

SEQ ID NO: 1329205 - RNA, 14 nt, Human
auccauaacugaac

SEQ ID NO: 1329206 - RNA, 15 nt, Human
auccauaacugaaca

SEQ ID NO: 1329207 - RNA, 13 nt, Human
auccauuuccccu

SEQ ID NO: 1329208 - RNA, 18 nt, Human
auccauuuccccuccuuc

SEQ ID NO: 1329209 - RNA, 19 nt, Human
auccauuuccccuccuucc

SEQ ID NO: 1329210 - RNA, 12 nt, Human
auccauuucuaa

SEQ ID NO: 1329211 - RNA, 13 nt, Human
auccauuucuaau

SEQ ID NO: 1329212 - RNA, 22 nt, Human
uucugguugaugccugugaacu

SEQ ID NO: 1329213 - RNA, 18 nt, Human
uucugguguuggacaagc

SEQ ID NO: 1329214 - RNA, 12 nt, Human
uucugguucuaa

SEQ ID NO: 1329215 - RNA, 14 nt, Human
uucugguucuaaca

SEQ ID NO: 1329216 - RNA, 21 nt, Human
uucugguucuuguguuggcug

SEQ ID NO: 1329217 - RNA, 13 nt, Human
uucuguauaaaug

SEQ ID NO: 1329218 - RNA, 14 nt, Human
aucauuuuuuacuu

SEQ ID NO: 1329219 - RNA, 23 nt, Human
uucugguguuggacaagcuucug

SEQ ID NO: 1329220 - RNA, 15 nt, Human
uucugguuccagggu

SEQ ID NO: 1329221 - RNA, 17 nt, Human
uucugguuccagggucc

SEQ ID NO: 1329222 - RNA, 12 nt, Human
uugaaccaauaa

SEQ ID NO: 1329223 - RNA, 18 nt, Human
uugaacccgggaggcaga

SEQ ID NO: 1329224 - RNA, 20 nt, Human
uugaacacaaacuguaaaua

SEQ ID NO: 1329225 - RNA, 21 nt, Human
uugaacacaaacuguaaauaa

SEQ ID NO: 1329226 - RNA, 18 nt, Human
auccuaagggucgaaagc

SEQ ID NO: 1329227 - RNA, 19 nt, Human
auccuaagggucgaaagcu

SEQ ID NO: 1329228 - RNA, 21 nt, Human
auccuaagggucgaaagcucu

SEQ ID NO: 1329229 - RNA, 16 nt, Human
auccuaggcugacacc

SEQ ID NO: 1329230 - RNA, 14 nt, Human
auccuaggcugaca

SEQ ID NO: 1329231 - RNA, 12 nt, Human
auccuaaugaau

SEQ ID NO: 1329232 - RNA, 13 nt, Human
auccuaaugaaug

SEQ ID NO: 1329233 - RNA, 19 nt, Human
auccuaaugaaugcauaaa

SEQ ID NO: 1329234 - RNA, 22 nt, Human
auccuaagggucgaaagcucua

SEQ ID NO: 1329235 - RNA, 23 nt, Human
auccuaagggucgaaagcucuag

SEQ ID NO: 1329236 - RNA, 14 nt, Human
auccuacaagacac

SEQ ID NO: 1329237 - RNA, 19 nt, Human
uugaaauauugacuuuuua

SEQ ID NO: 1329238 - RNA, 18 nt, Human
uugaaauauccugcuuga

SEQ ID NO: 1329239 - RNA, 21 nt, Human
uugaaauauggucuuuugguu

SEQ ID NO: 1329240 - RNA, 14 nt, Human
uugaacacaaacug

SEQ ID NO: 1329241 - RNA, 15 nt, Human
uugaacacaaacugu

SEQ ID NO: 1329242 - RNA, 18 nt, Human
uugaacacaaacuguaaa

SEQ ID NO: 1329243 - RNA, 16 nt, Human
uugaaaguuuacagga

SEQ ID NO: 1329244 - RNA, 15 nt, Human
uucuuuuugaaguau

SEQ ID NO: 1329245 - RNA, 18 nt, Human
uucuuuuugaaguauuua

SEQ ID NO: 1329246 - RNA, 16 nt, Human
uucuuuuugaaguauu

SEQ ID NO: 1329247 - RNA, 19 nt, Human
uugaaagugggcaaaagcu

SEQ ID NO: 1329248 - RNA, 20 nt, Human
uugaaagugggcaaaagcuu

SEQ ID NO: 1329249 - RNA, 15 nt, Human
uugaaauaagcuauu

SEQ ID NO: 1329250 - RNA, 16 nt, Human
uugaaauaagaauuca

SEQ ID NO: 1329251 - RNA, 21 nt, Human
uugaaauaagaauucagacau

SEQ ID NO: 1329252 - RNA, 12 nt, Human
uugaaauaagcu

SEQ ID NO: 1329253 - RNA, 22 nt, Human
uucuuuuuacccauuuguucau

SEQ ID NO: 1329254 - RNA, 13 nt, Human
uucuuuucccccu

SEQ ID NO: 1329255 - RNA, 15 nt, Human
uucuguugcugccuc

SEQ ID NO: 1329256 - RNA, 16 nt, Human
uucuguugcugccuca

SEQ ID NO: 1329257 - RNA, 18 nt, Human
aucccaccuccaucccag

SEQ ID NO: 1329258 - RNA, 17 nt, Human
uucuguugcugccucau

SEQ ID NO: 1329259 - RNA, 17 nt, Human
uucuguuuuguuucgcu

SEQ ID NO: 1329260 - RNA, 14 nt, Human
uucuuaaaaaguua

SEQ ID NO: 1329261 - RNA, 15 nt, Human
uucuuaauguacaua

SEQ ID NO: 1329262 - RNA, 14 nt, Human
uucuuaauguacau

SEQ ID NO: 1329263 - RNA, 15 nt, Human
uucuuaaagugccag

SEQ ID NO: 1329264 - RNA, 21 nt, Human
uucuuaauguacauagugcua

SEQ ID NO: 1329265 - RNA, 20 nt, Human
uucuuaaagugccaguauuu

SEQ ID NO: 1329266 - RNA, 16 nt, Human
uucuuaaacacuugca

SEQ ID NO: 1329267 - RNA, 17 nt, Human
uucuuaaacacuugcaa

SEQ ID NO: 1329268 - RNA, 17 nt, Human
uucuuaaagucaagauu

SEQ ID NO: 1329269 - RNA, 11 nt, Human
uucuuccucug

SEQ ID NO: 1329270 - RNA, 12 nt, Human
uucuuccucugc

SEQ ID NO: 1329271 - RNA, 13 nt, Human
uucuuccucugcu

SEQ ID NO: 1329272 - RNA, 14 nt, Human
uucuuccuggccgc

SEQ ID NO: 1329273 - RNA, 13 nt, Human
uucuuccuggccg

SEQ ID NO: 1329274 - RNA, 13 nt, Human
uucuuacaaacca

SEQ ID NO: 1329275 - RNA, 14 nt, Human
uucuuacaaaccau

SEQ ID NO: 1329276 - RNA, 13 nt, Human
uucuuucuuccuc

SEQ ID NO: 1329277 - RNA, 15 nt, Human
uucuuucuuccucug

SEQ ID NO: 1329278 - RNA, 16 nt, Human
uucuugguugaggaaa

SEQ ID NO: 1329279 - RNA, 15 nt, Human
uucuuucugucuuua

SEQ ID NO: 1329280 - RNA, 20 nt, Human
uucuuugaaaaaaaauaaau

SEQ ID NO: 1329281 - RNA, 19 nt, Human
uucuuugaaaaaaaauaaa

SEQ ID NO: 1329282 - RNA, 12 nt, Human
uucuuuguguag

SEQ ID NO: 1329283 - RNA, 19 nt, Human
uucuuuguguagcuuugcu

SEQ ID NO: 1329284 - RNA, 17 nt, Human
uucuuuguuucuuucuu

SEQ ID NO: 1329285 - RNA, 14 nt, Human
uucuugauguaaaa

SEQ ID NO: 1329286 - RNA, 15 nt, Human
uucuugauguaaaau

SEQ ID NO: 1329287 - RNA, 20 nt, Human
uucuugauguaaaaucuugu

SEQ ID NO: 1329288 - RNA, 19 nt, Human
uucuugauguaaaaucuug

SEQ ID NO: 1329289 - RNA, 19 nt, Human
uucuucgacuguuguuauc

SEQ ID NO: 1329290 - RNA, 16 nt, Human
uucuucgacuguuguu

SEQ ID NO: 1329291 - RNA, 21 nt, Human
uucuugaauuuaauaaucugu

SEQ ID NO: 1329292 - RNA, 16 nt, Human
uucuuccuuuucacug

SEQ ID NO: 1329293 - RNA, 21 nt, Human
uucuuccuuuucacugcuguu

SEQ ID NO: 1329294 - RNA, 21 nt, Human
uucuugaggggaagcuagucu

SEQ ID NO: 1329295 - RNA, 23 nt, Human
uucuugaggggaagcuagucuuu

SEQ ID NO: 1329296 - RNA, 20 nt, Human
uucuugaggggaccaggagu

SEQ ID NO: 1329297 - RNA, 19 nt, Human
uucuugaggggaccaggag

SEQ ID NO: 1329298 - RNA, 17 nt, Human
uucuugcuucuuucuag

SEQ ID NO: 1329299 - RNA, 19 nt, Human
uucuugcuucuuucuagaa

SEQ ID NO: 1329300 - RNA, 17 nt, Human
uucuuggccaugggagg

SEQ ID NO: 1329301 - RNA, 22 nt, Human
auagcuuuucccuuuuuuuaag

SEQ ID NO: 1329302 - RNA, 15 nt, Human
auagcuuuuuucucu

SEQ ID NO: 1329303 - RNA, 16 nt, Human
uucacauuagaagaca

SEQ ID NO: 1329304 - RNA, 15 nt, Human
uucacauuagaagac

SEQ ID NO: 1329305 - RNA, 17 nt, Human
auaggcguaacuaauuu

SEQ ID NO: 1329306 - RNA, 14 nt, Human
auaggaccuuucca

SEQ ID NO: 1329307 - RNA, 20 nt, Human
auaggaccuuuccaccacag

SEQ ID NO: 1329308 - RNA, 23 nt, Human
auaggaccuuuccaccacagcca

SEQ ID NO: 1329309 - RNA, 13 nt, Human
uucacagaaaaua

SEQ ID NO: 1329310 - RNA, 19 nt, Human
uucacagccuauaaccaga

SEQ ID NO: 1329311 - RNA, 12 nt, Human
uucacagcuccu

SEQ ID NO: 1329312 - RNA, 20 nt, Human
uucacaguucuuugggccag

SEQ ID NO: 1329313 - RNA, 21 nt, Human
uucacaguucuuugggccaga

SEQ ID NO: 1329314 - RNA, 14 nt, Human
uucacaguuugaaa

SEQ ID NO: 1329315 - RNA, 16 nt, Human
uucacaguuugaaaua

SEQ ID NO: 1329316 - RNA, 17 nt, Human
uucacaguuugaaauaa

SEQ ID NO: 1329317 - RNA, 23 nt, Human
uucacaguuugaaauaagcuauu

SEQ ID NO: 1329318 - RNA, 22 nt, Human
uucacaguuugaaauaagcuau

SEQ ID NO: 1329319 - RNA, 21 nt, Human
uucacaucgcagauucucccu

SEQ ID NO: 1329320 - RNA, 18 nt, Human
uucacaucuaaccucauc

SEQ ID NO: 1329321 - RNA, 19 nt, Human
uucacaucuaaccucaucu

SEQ ID NO: 1329322 - RNA, 20 nt, Human
uucacaucuaaccucaucuu

SEQ ID NO: 1329323 - RNA, 13 nt, Human
uucacaucucauu

SEQ ID NO: 1329324 - RNA, 23 nt, Human
uucacaagacccaaaaggcagaa

SEQ ID NO: 1329325 - RNA, 17 nt, Human
uucaagugauucucaug

SEQ ID NO: 1329326 - RNA, 20 nt, Human
uucaagucuaccaauuauaa

SEQ ID NO: 1329327 - RNA, 15 nt, Human
uucaagguucuaacc

SEQ ID NO: 1329328 - RNA, 13 nt, Human
uucacaauguuaa

SEQ ID NO: 1329329 - RNA, 19 nt, Human
uucaagucaguucugugau

SEQ ID NO: 1329330 - RNA, 12 nt, Human
uucaaaagaaag

SEQ ID NO: 1329331 - RNA, 17 nt, Human
uucaaaaccuuuugaaa

SEQ ID NO: 1329332 - RNA, 18 nt, Human
uucaaaacauugugccau

SEQ ID NO: 1329333 - RNA, 17 nt, Human
uuauuuuuuucugaauu

SEQ ID NO: 1329334 - RNA, 13 nt, Human
uuauuuuuuucug

SEQ ID NO: 1329335 - RNA, 23 nt, Human
uuauuuuuuaaagaaaucuauuu

SEQ ID NO: 1329336 - RNA, 14 nt, Human
uuauuuuuuaauua

SEQ ID NO: 1329337 - RNA, 16 nt, Human
uuauuuuuuaauuauu

SEQ ID NO: 1329338 - RNA, 14 nt, Human
uuauuuuucuuguc

SEQ ID NO: 1329339 - RNA, 23 nt, Human
uuauuuuugacaguguugaaaau

SEQ ID NO: 1329340 - RNA, 23 nt, Human
uuauuuuuggcguggcugacuua

SEQ ID NO: 1329341 - RNA, 18 nt, Human
uuauuuuuacauucugaa

SEQ ID NO: 1329342 - RNA, 16 nt, Human
uuaguuuguguguugu

SEQ ID NO: 1329343 - RNA, 16 nt, Human
uuaguuuugaugaguu

SEQ ID NO: 1329344 - RNA, 12 nt, Human
uuaguuuugauu

SEQ ID NO: 1329345 - RNA, 13 nt, Human
uuaguuuuucauu

SEQ ID NO: 1329346 - RNA, 17 nt, Human
uuaguuuuucauuaaau

SEQ ID NO: 1329347 - RNA, 16 nt, Human
uuaguuuuucauuaaa

SEQ ID NO: 1329348 - RNA, 14 nt, Human
uucaaacauauaua

SEQ ID NO: 1329349 - RNA, 23 nt, Human
uucaagaauaaucacgcuuuccu

SEQ ID NO: 1329350 - RNA, 13 nt, Human
uucaaaagaaagu

SEQ ID NO: 1329351 - RNA, 20 nt, Human
uucaaaaccagguccaauga

SEQ ID NO: 1329352 - RNA, 12 nt, Human
uucaaaaguucc

SEQ ID NO: 1329353 - RNA, 14 nt, Human
uucaaaaguuccaa

SEQ ID NO: 1329354 - RNA, 15 nt, Human
uucaaaaguuccaag

SEQ ID NO: 1329355 - RNA, 21 nt, Human
uucaaaauuguuacaaauugu

SEQ ID NO: 1329356 - RNA, 20 nt, Human
uucaaaaguuuguuugcuua

SEQ ID NO: 1329357 - RNA, 16 nt, Human
uucaaaaguuccaaga

SEQ ID NO: 1329358 - RNA, 16 nt, Human
uucaagcaauccuccc

SEQ ID NO: 1329359 - RNA, 14 nt, Human
uucaagcaauccuc

SEQ ID NO: 1329360 - RNA, 17 nt, Human
uucaagaucccauuuga

SEQ ID NO: 1329361 - RNA, 23 nt, Human
uucaagaggagcccccacccugu

SEQ ID NO: 1329362 - RNA, 15 nt, Human
uucaagaggagcccc

SEQ ID NO: 1329363 - RNA, 21 nt, Human
uucaagaggagcccccacccu

SEQ ID NO: 1329364 - RNA, 22 nt, Human
uucaagaggagcccccacccug

SEQ ID NO: 1329365 - RNA, 18 nt, Human
uucaagcgauucuccugc

SEQ ID NO: 1329366 - RNA, 20 nt, Human
uucaagccugugcaaugcau

SEQ ID NO: 1329367 - RNA, 11 nt, Human
uucaagauucc

SEQ ID NO: 1329368 - RNA, 23 nt, Human
uucaagcagucgugccugugucc

SEQ ID NO: 1329369 - RNA, 17 nt, Human
uucaagcagucgugccu

SEQ ID NO: 1329370 - RNA, 18 nt, Human
uucaagcagucgugccug

SEQ ID NO: 1329371 - RNA, 22 nt, Human
uucaagcagucgugccuguguc

SEQ ID NO: 1329372 - RNA, 17 nt, Human
uucaaggucugcuuuuc

SEQ ID NO: 1329373 - RNA, 14 nt, Human
uucaagguucuaac

SEQ ID NO: 1329374 - RNA, 16 nt, Human
uucaaggaauuucuua

SEQ ID NO: 1329375 - RNA, 21 nt, Human
uucaagcgauucuccugccuc

SEQ ID NO: 1329376 - RNA, 12 nt, Human
uucaagcucuga

SEQ ID NO: 1329377 - RNA, 14 nt, Human
uucaagcucugagg

SEQ ID NO: 1329378 - RNA, 16 nt, Human
uucaagcucugaggga

SEQ ID NO: 1329379 - RNA, 21 nt, Human
auauauauuuuuuucugaaau

SEQ ID NO: 1329380 - RNA, 23 nt, Human
auauauauucuauuacauuuuca

SEQ ID NO: 1329381 - RNA, 20 nt, Human
auauauauuaucuuuucaua

SEQ ID NO: 1329382 - RNA, 17 nt, Human
auauaucacccagacau

SEQ ID NO: 1329383 - RNA, 21 nt, Human
auauaucacccagacauaaag

SEQ ID NO: 1329384 - RNA, 15 nt, Human
auauaucaugaguga

SEQ ID NO: 1329385 - RNA, 15 nt, Human
auauauauguacagu

SEQ ID NO: 1329386 - RNA, 16 nt, Human
auauauauguacaguu

SEQ ID NO: 1329387 - RNA, 20 nt, Human
auauauauguacaguuaucu

SEQ ID NO: 1329388 - RNA, 12 nt, Human
auauauauuaua

SEQ ID NO: 1329389 - RNA, 14 nt, Human
auauauauuauacu

SEQ ID NO: 1329390 - RNA, 16 nt, Human
auauauauuaucuuuu

SEQ ID NO: 1329391 - RNA, 16 nt, Human
auauauauauauaugu

SEQ ID NO: 1329392 - RNA, 14 nt, Human
auauauauauaugu

SEQ ID NO: 1329393 - RNA, 15 nt, Human
auauauauauguaca

SEQ ID NO: 1329394 - RNA, 15 nt, Human
auauauauaaauaua

SEQ ID NO: 1329395 - RNA, 14 nt, Human
auauauauaaauau

SEQ ID NO: 1329396 - RNA, 15 nt, Human
auauauauauaaaga

SEQ ID NO: 1329397 - RNA, 15 nt, Human
uucacuuacagcacc

SEQ ID NO: 1329398 - RNA, 13 nt, Human
uucacugugcugu

SEQ ID NO: 1329399 - RNA, 18 nt, Human
uucacugugcuguuguua

SEQ ID NO: 1329400 - RNA, 12 nt, Human
uucacugugcug

SEQ ID NO: 1329401 - RNA, 16 nt, Human
uucacugucuuuaauu

SEQ ID NO: 1329402 - RNA, 15 nt, Human
uucacuuaacaaaca

SEQ ID NO: 1329403 - RNA, 22 nt, Human
uucacuuaaguuaguuccacug

SEQ ID NO: 1329404 - RNA, 13 nt, Human
auauaugaggacu

SEQ ID NO: 1329405 - RNA, 23 nt, Human
uucacugucaccacccugcucau

SEQ ID NO: 1329406 - RNA, 20 nt, Human
uucacugucaccacccugcu

SEQ ID NO: 1329407 - RNA, 19 nt, Human
uucacugucuuuaauucug

SEQ ID NO: 1329408 - RNA, 24 nt, Human
auauaucuaccccagacuagaugu

SEQ ID NO: 1329409 - RNA, 14 nt, Human
auauauaacaaugc

SEQ ID NO: 1329410 - RNA, 11 nt, Human
auauauaaaua

SEQ ID NO: 1329411 - RNA, 13 nt, Human
auauauaaauaua

SEQ ID NO: 1329412 - RNA, 10 nt, Human
auauauaaau

SEQ ID NO: 1329413 - RNA, 14 nt, Human
auauauaaauauau

SEQ ID NO: 1329414 - RNA, 18 nt, Human
auauauaaauauauuauu

SEQ ID NO: 1329415 - RNA, 19 nt, Human
auauauaaauauauuauua

SEQ ID NO: 1329416 - RNA, 15 nt, Human
auauauaaguguaca

SEQ ID NO: 1329417 - RNA, 16 nt, Human
auauauaaguguacau

SEQ ID NO: 1329418 - RNA, 20 nt, Human
auauauaaguguacauaugu

SEQ ID NO: 1329419 - RNA, 22 nt, Human
auauaaauagaauguaaauguc

SEQ ID NO: 1329420 - RNA, 13 nt, Human
auauaacuaacaa

SEQ ID NO: 1329421 - RNA, 17 nt, Human
auauaacuguauuugaa

SEQ ID NO: 1329422 - RNA, 20 nt, Human
auauaacuguauuugaaaua

SEQ ID NO: 1329423 - RNA, 21 nt, Human
auauaaauagaauguaaaugu

SEQ ID NO: 1329424 - RNA, 19 nt, Human
auauaaauagaauguaaau

SEQ ID NO: 1329425 - RNA, 15 nt, Human
auauaaauagaaugu

SEQ ID NO: 1329426 - RNA, 13 nt, Human
auauaaaguuuua

SEQ ID NO: 1329427 - RNA, 17 nt, Human
auauaaaguuuuauaua

SEQ ID NO: 1329428 - RNA, 22 nt, Human
auauaaaguuuuauauauuaua

SEQ ID NO: 1329429 - RNA, 19 nt, Human
auauaaaguuuuauauauu

SEQ ID NO: 1329430 - RNA, 19 nt, Human
auauaaaguaguccuguga

SEQ ID NO: 1329431 - RNA, 24 nt, Human
auauaaaguaucaucaguguagaa

SEQ ID NO: 1329432 - RNA, 21 nt, Human
auagucucuuuaaaaggaaag

SEQ ID NO: 1329433 - RNA, 14 nt, Human
auagucucuuuaaa

SEQ ID NO: 1329434 - RNA, 19 nt, Human
auaggcggggcuugccuuc

SEQ ID NO: 1329435 - RNA, 20 nt, Human
auaggcggggcuugccuucu

SEQ ID NO: 1329436 - RNA, 21 nt, Human
auagugaggcaucgcaaugua

SEQ ID NO: 1329437 - RNA, 20 nt, Human
auagugauguaaucuugaau

SEQ ID NO: 1329438 - RNA, 19 nt, Human
auagugcuaacaugaagac

SEQ ID NO: 1329439 - RNA, 14 nt, Human
auagugcuaacaug

SEQ ID NO: 1329440 - RNA, 14 nt, Human
auagucuuuugcuu

SEQ ID NO: 1329441 - RNA, 16 nt, Human
auagucuuuugcuuuu

SEQ ID NO: 1329442 - RNA, 17 nt, Human
auagucuuuugcuuuug

SEQ ID NO: 1329443 - RNA, 16 nt, Human
auagucuuuggagaaa

SEQ ID NO: 1329444 - RNA, 18 nt, Human
auagucuuuuucaguucc

SEQ ID NO: 1329445 - RNA, 13 nt, Human
auagugaauacug

SEQ ID NO: 1329446 - RNA, 21 nt, Human
auagugcuaacaugaagaccu

SEQ ID NO: 1329447 - RNA, 22 nt, Human
auagugcuaacaugaagaccuu

SEQ ID NO: 1329448 - RNA, 19 nt, Human
auaguguagcugaggaggc

SEQ ID NO: 1329449 - RNA, 14 nt, Human
auaguuaacacacu

SEQ ID NO: 1329450 - RNA, 15 nt, Human
auaguuaacacacua

SEQ ID NO: 1329451 - RNA, 17 nt, Human
auaguuaacacacuacc

SEQ ID NO: 1329452 - RNA, 13 nt, Human
auaguuacugugu

SEQ ID NO: 1329453 - RNA, 14 nt, Human
auaguuacugugua

SEQ ID NO: 1329454 - RNA, 17 nt, Human
auaguuacuguguaauu

SEQ ID NO: 1329455 - RNA, 18 nt, Human
auaguuacuguguaauua

SEQ ID NO: 1329456 - RNA, 20 nt, Human
auaguuacuguguaauuagu

SEQ ID NO: 1329457 - RNA, 15 nt, Human
auaguuagaaccugg

SEQ ID NO: 1329458 - RNA, 16 nt, Human
auaguuagcuaauaaa

SEQ ID NO: 1329459 - RNA, 21 nt, Human
auaguucagaauuuaguguau

SEQ ID NO: 1329460 - RNA, 18 nt, Human
auaguucagaauuuagug

SEQ ID NO: 1329461 - RNA, 15 nt, Human
auaguuccugcuaaa

SEQ ID NO: 1329462 - RNA, 12 nt, Human
auaguucuagac

SEQ ID NO: 1329463 - RNA, 13 nt, Human
auaguucuagaca

SEQ ID NO: 1329464 - RNA, 14 nt, Human
auaguucuagacau

SEQ ID NO: 1329465 - RNA, 23 nt, Human
auaguucuagacauggagguucu

SEQ ID NO: 1329466 - RNA, 12 nt, Human
auaguucuaggc

SEQ ID NO: 1329467 - RNA, 20 nt, Human
auaguuguaccgcaauguga

SEQ ID NO: 1329468 - RNA, 13 nt, Human
auaguuguaacua

SEQ ID NO: 1329469 - RNA, 13 nt, Human
auaguuuucaucc

SEQ ID NO: 1329470 - RNA, 20 nt, Human
auaguuuucauccauaacug

SEQ ID NO: 1329471 - RNA, 23 nt, Human
auaguuuucauccauaacugaac

SEQ ID NO: 1329472 - RNA, 22 nt, Human
auaguuuucauccauaacugaa

SEQ ID NO: 1329473 - RNA, 14 nt, Human
uucauuccuccagg

SEQ ID NO: 1329474 - RNA, 22 nt, Human
uucauuccuucagauuuggcuu

SEQ ID NO: 1329475 - RNA, 21 nt, Human
uucauuccuucagauuuggcu

SEQ ID NO: 1329476 - RNA, 18 nt, Human
uucauucucccuuucacu

SEQ ID NO: 1329477 - RNA, 18 nt, Human
uucauucugcaaguauac

SEQ ID NO: 1329478 - RNA, 13 nt, Human
uucauucugcaag

SEQ ID NO: 1329479 - RNA, 13 nt, Human
uucauuccuccag

SEQ ID NO: 1329480 - RNA, 12 nt, Human
uucauuccucca

SEQ ID NO: 1329481 - RNA, 22 nt, Human
uucauucaugucauguguacaa

SEQ ID NO: 1329482 - RNA, 16 nt, Human
uucauuccauucugga

SEQ ID NO: 1329483 - RNA, 18 nt, Human
auaugugcuggaauucua

SEQ ID NO: 1329484 - RNA, 19 nt, Human
auaugugcuggaauucuaa

SEQ ID NO: 1329485 - RNA, 9 nt, Human
uucauucag

SEQ ID NO: 1329486 - RNA, 12 nt, Human
uuccaagagucu

SEQ ID NO: 1329487 - RNA, 13 nt, Human
uuccaagagucua

SEQ ID NO: 1329488 - RNA, 14 nt, Human
uuccaagagucuaa

SEQ ID NO: 1329489 - RNA, 21 nt, Human
uucauuuagcuaaacggauuc

SEQ ID NO: 1329490 - RNA, 14 nt, Human
uucauugucuguga

SEQ ID NO: 1329491 - RNA, 23 nt, Human
uuccacccagugcugaauuuccc

SEQ ID NO: 1329492 - RNA, 19 nt, Human
uuccacccaggggcagccc

SEQ ID NO: 1329493 - RNA, 21 nt, Human
uuccacccaggggcagcccca

SEQ ID NO: 1329494 - RNA, 13 nt, Human
uuccacagaggac

SEQ ID NO: 1329495 - RNA, 10 nt, Human
uuccacagac

SEQ ID NO: 1329496 - RNA, 12 nt, Human
uuccacagacgg

SEQ ID NO: 1329497 - RNA, 12 nt, Human
uuccacccaggg

SEQ ID NO: 1329498 - RNA, 24 nt, Human
uuccagcuagugacccacaugcca

SEQ ID NO: 1329499 - RNA, 23 nt, Human
uuccagcuagugacccacaugcc

SEQ ID NO: 1329500 - RNA, 14 nt, Human
uuccagcuccugua

SEQ ID NO: 1329501 - RNA, 11 nt, Human
uuccagcuccu

SEQ ID NO: 1329502 - RNA, 18 nt, Human
uuccagcuggaugagaau

SEQ ID NO: 1329503 - RNA, 17 nt, Human
uuccagcugucccccca

SEQ ID NO: 1329504 - RNA, 16 nt, Human
uuccaggacuguuuca

SEQ ID NO: 1329505 - RNA, 20 nt, Human
uuccaggacuguuucaaaca

SEQ ID NO: 1329506 - RNA, 21 nt, Human
uuccaggacuguuucaaacau

SEQ ID NO: 1329507 - RNA, 23 nt, Human
uuccaggacuguuucaaacaugc

SEQ ID NO: 1329508 - RNA, 15 nt, Human
uuccacaccuuuuau

SEQ ID NO: 1329509 - RNA, 22 nt, Human
uuccacaccuuuuauugacaca

SEQ ID NO: 1329510 - RNA, 15 nt, Human
uuccaagagucuaaa

SEQ ID NO: 1329511 - RNA, 17 nt, Human
uuccaagagucuaaaga

SEQ ID NO: 1329512 - RNA, 15 nt, Human
uuccaagucuccacc

SEQ ID NO: 1329513 - RNA, 16 nt, Human
uuccaaguugcuaaua

SEQ ID NO: 1329514 - RNA, 18 nt, Human
uucccaacuccagaaagu

SEQ ID NO: 1329515 - RNA, 13 nt, Human
uucccaacacaaa

SEQ ID NO: 1329516 - RNA, 15 nt, Human
uucccaacacaaaga

SEQ ID NO: 1329517 - RNA, 20 nt, Human
uucccaagagcaucaugccu

SEQ ID NO: 1329518 - RNA, 21 nt, Human
uucccaagagcaucaugccuc

SEQ ID NO: 1329519 - RNA, 22 nt, Human
uucccaagagcaucaugccucu

SEQ ID NO: 1329520 - RNA, 11 nt, Human
uucccaagcuc

SEQ ID NO: 1329521 - RNA, 13 nt, Human
uucccaagggcug

SEQ ID NO: 1329522 - RNA, 16 nt, Human
uucccaagggcugccg

SEQ ID NO: 1329523 - RNA, 23 nt, Human
uucccaagugagucucucugggc

SEQ ID NO: 1329524 - RNA, 14 nt, Human
uucccaauucacau

SEQ ID NO: 1329525 - RNA, 13 nt, Human
uucccaauugcuu

SEQ ID NO: 1329526 - RNA, 18 nt, Human
uucccacaggacauuucu

SEQ ID NO: 1329527 - RNA, 16 nt, Human
uucccacauuaaagaa

SEQ ID NO: 1329528 - RNA, 13 nt, Human
uucccacauuugu

SEQ ID NO: 1329529 - RNA, 16 nt, Human
uucccacauuugucuu

SEQ ID NO: 1329530 - RNA, 21 nt, Human
uucccacccaauucaaaacau

SEQ ID NO: 1329531 - RNA, 22 nt, Human
uucccaccccaaccugcucucc

SEQ ID NO: 1329532 - RNA, 20 nt, Human
uucccaccccaaccugcucu

SEQ ID NO: 1329533 - RNA, 21 nt, Human
uucccaccccaaccugcucuc

SEQ ID NO: 1329534 - RNA, 14 nt, Human
uucccacgaggaau

SEQ ID NO: 1329535 - RNA, 23 nt, Human
uucccaaaggcauuauaaaaaga

SEQ ID NO: 1329536 - RNA, 17 nt, Human
uuccaguucuucgacug

SEQ ID NO: 1329537 - RNA, 19 nt, Human
uuccauaaucuggacuccu

SEQ ID NO: 1329538 - RNA, 22 nt, Human
uuccauaaucuggacuccucug

SEQ ID NO: 1329539 - RNA, 23 nt, Human
uuccauaaucuggacuccucugu

SEQ ID NO: 1329540 - RNA, 16 nt, Human
uuccagggucccucug

SEQ ID NO: 1329541 - RNA, 18 nt, Human
uuccagggucccucugug

SEQ ID NO: 1329542 - RNA, 19 nt, Human
uuccagggucccucugugu

SEQ ID NO: 1329543 - RNA, 20 nt, Human
uuccagggucccucugugua

SEQ ID NO: 1329544 - RNA, 22 nt, Human
uuccagguagcugaaaggggaa

SEQ ID NO: 1329545 - RNA, 15 nt, Human
auauauuuuaagacg

SEQ ID NO: 1329546 - RNA, 14 nt, Human
auauauuuuaagac

SEQ ID NO: 1329547 - RNA, 21 nt, Human
auaucuagguuuaugacagua

SEQ ID NO: 1329548 - RNA, 19 nt, Human
auaucuagguuuaugacag

SEQ ID NO: 1329549 - RNA, 18 nt, Human
auaucuagguuuaugaca

SEQ ID NO: 1329550 - RNA, 17 nt, Human
auaucuagguuuaugac

SEQ ID NO: 1329551 - RNA, 22 nt, Human
auaucuagguuuaugacaguaa

SEQ ID NO: 1329552 - RNA, 23 nt, Human
auaucuagguuuaugacaguaau

SEQ ID NO: 1329553 - RNA, 19 nt, Human
auaucuccgucaacucaua

SEQ ID NO: 1329554 - RNA, 20 nt, Human
auaucuccgucaacucauau

SEQ ID NO: 1329555 - RNA, 21 nt, Human
auaucuccgucaacucauauu

SEQ ID NO: 1329556 - RNA, 12 nt, Human
auaucucaucuc

SEQ ID NO: 1329557 - RNA, 13 nt, Human
auaucuccugaaa

SEQ ID NO: 1329558 - RNA, 15 nt, Human
auaucuccugaaaag

SEQ ID NO: 1329559 - RNA, 22 nt, Human
auaucuccugaaaagguuuaug

SEQ ID NO: 1329560 - RNA, 23 nt, Human
auaucuccugaaaagguuuauga

SEQ ID NO: 1329561 - RNA, 12 nt, Human
auaugauucaaa

SEQ ID NO: 1329562 - RNA, 21 nt, Human
auaugauguuaaaaaaauaag

SEQ ID NO: 1329563 - RNA, 15 nt, Human
auaugauguuaaaaa

SEQ ID NO: 1329564 - RNA, 15 nt, Human
auaugaucugucugu

SEQ ID NO: 1329565 - RNA, 16 nt, Human
auaugaucugucugug

SEQ ID NO: 1329566 - RNA, 17 nt, Human
auaugaucugucugugg

SEQ ID NO: 1329567 - RNA, 13 nt, Human
auaugaaagcuga

SEQ ID NO: 1329568 - RNA, 12 nt, Human
auauguaaaaca

SEQ ID NO: 1329569 - RNA, 13 nt, Human
auauguaaaacau

SEQ ID NO: 1329570 - RNA, 14 nt, Human
auauguaaaacauu

SEQ ID NO: 1329571 - RNA, 15 nt, Human
auauguaaaacauuu

SEQ ID NO: 1329572 - RNA, 16 nt, Human
auauguaaaacauuua

SEQ ID NO: 1329573 - RNA, 18 nt, Human
auauguaaaacauuuauu

SEQ ID NO: 1329574 - RNA, 24 nt, Human
auauguaaaacauuuauuuugaca

SEQ ID NO: 1329575 - RNA, 22 nt, Human
auauguaaaugguaugucauuc

SEQ ID NO: 1329576 - RNA, 14 nt, Human
auauguacaguuau

SEQ ID NO: 1329577 - RNA, 16 nt, Human
auauguacaguuaucu

SEQ ID NO: 1329578 - RNA, 14 nt, Human
auauguacaugaga

SEQ ID NO: 1329579 - RNA, 11 nt, Human
auauguaccaa

SEQ ID NO: 1329580 - RNA, 14 nt, Human
auauguaccaugua

SEQ ID NO: 1329581 - RNA, 19 nt, Human
auauguaccauguacauga

SEQ ID NO: 1329582 - RNA, 17 nt, Human
auauguacccucugaaa

SEQ ID NO: 1329583 - RNA, 19 nt, Human
auauguacccucugaaaua

SEQ ID NO: 1329584 - RNA, 20 nt, Human
auauguacccucugaaauac

SEQ ID NO: 1329585 - RNA, 19 nt, Human
uucauaauuauuauuuggc

SEQ ID NO: 1329586 - RNA, 14 nt, Human
uucauacaaagcau

SEQ ID NO: 1329587 - RNA, 22 nt, Human
uucauauuaagaaugaucugau

SEQ ID NO: 1329588 - RNA, 16 nt, Human
uucauauuaagaauga

SEQ ID NO: 1329589 - RNA, 20 nt, Human
uucauauguaccauguacau

SEQ ID NO: 1329590 - RNA, 15 nt, Human
uucacuucacugugc

SEQ ID NO: 1329591 - RNA, 14 nt, Human
uucacuucacugug

SEQ ID NO: 1329592 - RNA, 12 nt, Human
uucacuucacug

SEQ ID NO: 1329593 - RNA, 22 nt, Human
uucagaaaugaggccauggacu

SEQ ID NO: 1329594 - RNA, 13 nt, Human
auauauuuuaaga

SEQ ID NO: 1329595 - RNA, 12 nt, Human
auauauuuuaag

SEQ ID NO: 1329596 - RNA, 18 nt, Human
auauauuuaaaaguguca

SEQ ID NO: 1329597 - RNA, 18 nt, Human
auauauuuaaaauauauu

SEQ ID NO: 1329598 - RNA, 15 nt, Human
auauauugaauauuu

SEQ ID NO: 1329599 - RNA, 18 nt, Human
auauauugaauauuuuau

SEQ ID NO: 1329600 - RNA, 13 nt, Human
auauauugaauua

SEQ ID NO: 1329601 - RNA, 14 nt, Human
auauauugaauuaa

SEQ ID NO: 1329602 - RNA, 16 nt, Human
auauauuuaaaaauaa

SEQ ID NO: 1329603 - RNA, 21 nt, Human
uucaucccacuccaacucuuc

SEQ ID NO: 1329604 - RNA, 23 nt, Human
uucauauuguugcauugcuuuuu

SEQ ID NO: 1329605 - RNA, 15 nt, Human
uucauccauaacuga

SEQ ID NO: 1329606 - RNA, 17 nt, Human
uucauccauaacugaac

SEQ ID NO: 1329607 - RNA, 24 nt, Human
uucaucccaaaggacagccgccug

SEQ ID NO: 1329608 - RNA, 14 nt, Human
auauauguacaguu

SEQ ID NO: 1329609 - RNA, 15 nt, Human
auauauguauauaca

SEQ ID NO: 1329610 - RNA, 12 nt, Human
auauauguauuu

SEQ ID NO: 1329611 - RNA, 13 nt, Human
auauauguacagu

SEQ ID NO: 1329612 - RNA, 17 nt, Human
uuagggaaaacauucca

SEQ ID NO: 1329613 - RNA, 16 nt, Human
uuagggaacaauuugg

SEQ ID NO: 1329614 - RNA, 15 nt, Human
uuagggaaaacauuc

SEQ ID NO: 1329615 - RNA, 21 nt, Human
uuagccuuuuuuccccagacu

SEQ ID NO: 1329616 - RNA, 14 nt, Human
uuagggaagggccu

SEQ ID NO: 1329617 - RNA, 18 nt, Human
uuaggugcaauuucaagg

SEQ ID NO: 1329618 - RNA, 22 nt, Human
uuaggugcaauuucaagguucu

SEQ ID NO: 1329619 - RNA, 20 nt, Human
uuaguuucugaguuuuacca

SEQ ID NO: 1329620 - RNA, 13 nt, Human
uuaguuucugagu

SEQ ID NO: 1329621 - RNA, 15 nt, Human
uuaguuuguauauau

SEQ ID NO: 1329622 - RNA, 15 nt, Human
uuaguuuguguguug

SEQ ID NO: 1329623 - RNA, 14 nt, Human
uuaggugucugucc

SEQ ID NO: 1329624 - RNA, 18 nt, Human
uuaguaaagucaaggaga

SEQ ID NO: 1329625 - RNA, 12 nt, Human
uuaguaaaccaa

SEQ ID NO: 1329626 - RNA, 12 nt, Human
uuaguaacaugu

SEQ ID NO: 1329627 - RNA, 23 nt, Human
uuaguaacauguguuaaguauuu

SEQ ID NO: 1329628 - RNA, 22 nt, Human
uuaguuucaguagauugcagaa

SEQ ID NO: 1329629 - RNA, 11 nt, Human
uuaguuuccuu

SEQ ID NO: 1329630 - RNA, 20 nt, Human
uuaguuuccuuuuuaauaug

SEQ ID NO: 1329631 - RNA, 12 nt, Human
uuagcaccaggg

SEQ ID NO: 1329632 - RNA, 23 nt, Human
auaauuuaccuaagauuacaaau

SEQ ID NO: 1329633 - RNA, 23 nt, Human
auaauuguuguucuguuaacuga

SEQ ID NO: 1329634 - RNA, 22 nt, Human
uuagcaaagauaucucaucucu

SEQ ID NO: 1329635 - RNA, 13 nt, Human
auaauuuaccuaa

SEQ ID NO: 1329636 - RNA, 16 nt, Human
auaauuuaccuaagau

SEQ ID NO: 1329637 - RNA, 21 nt, Human
auaauuguuuuaucugaauuu

SEQ ID NO: 1329638 - RNA, 21 nt, Human
auaauuguuguucuguuaacu

SEQ ID NO: 1329639 - RNA, 22 nt, Human
auaauuguuguucuguuaacug

SEQ ID NO: 1329640 - RNA, 23 nt, Human
auaauuguucucagaaucccuua

SEQ ID NO: 1329641 - RNA, 15 nt, Human
auaauuguucucaga

SEQ ID NO: 1329642 - RNA, 15 nt, Human
auaauuguuguucug

SEQ ID NO: 1329643 - RNA, 17 nt, Human
auaauuguuguucuguu

SEQ ID NO: 1329644 - RNA, 18 nt, Human
auaauuguuguucuguua

SEQ ID NO: 1329645 - RNA, 19 nt, Human
auaauuguuguucuguuaa

SEQ ID NO: 1329646 - RNA, 15 nt, Human
uuagccaguaauccu

SEQ ID NO: 1329647 - RNA, 20 nt, Human
uuagcauuuucugcaucucc

SEQ ID NO: 1329648 - RNA, 19 nt, Human
uuagcauguuguugaaagg

SEQ ID NO: 1329649 - RNA, 22 nt, Human
uuagcauuguagugcuuugaga

SEQ ID NO: 1329650 - RNA, 21 nt, Human
uuagccuucucuguucauuuc

SEQ ID NO: 1329651 - RNA, 12 nt, Human
uuagccuguccu

SEQ ID NO: 1329652 - RNA, 17 nt, Human
uuagccuuuuuucccca

SEQ ID NO: 1329653 - RNA, 18 nt, Human
uuagccuuuuuuccccag

SEQ ID NO: 1329654 - RNA, 20 nt, Human
uuagccuuuuuuccccagac

SEQ ID NO: 1329655 - RNA, 23 nt, Human
uuagccuuuuuuccccagacuug

SEQ ID NO: 1329656 - RNA, 15 nt, Human
uuagccuucucuguu

SEQ ID NO: 1329657 - RNA, 17 nt, Human
uuagccuucucuguuca

SEQ ID NO: 1329658 - RNA, 22 nt, Human
uuagccuggaccucugacagca

SEQ ID NO: 1329659 - RNA, 14 nt, Human
uuagccuguccugu

SEQ ID NO: 1329660 - RNA, 12 nt, Human
uuagccuucucu

SEQ ID NO: 1329661 - RNA, 14 nt, Human
uuagccuucucugu

SEQ ID NO: 1329662 - RNA, 19 nt, Human
auaauacuugcuuuggaaa

SEQ ID NO: 1329663 - RNA, 22 nt, Human
auaauacugcugagauacauac

SEQ ID NO: 1329664 - RNA, 12 nt, Human
auaauagauucu

SEQ ID NO: 1329665 - RNA, 21 nt, Human
auaauacugcugagauacaua

SEQ ID NO: 1329666 - RNA, 15 nt, Human
auaauaaauguacau

SEQ ID NO: 1329667 - RNA, 18 nt, Human
auaauaaaggacuguaau

SEQ ID NO: 1329668 - RNA, 13 nt, Human
auaauaaaggacu

SEQ ID NO: 1329669 - RNA, 11 nt, Human
auaauaaagga

SEQ ID NO: 1329670 - RNA, 23 nt, Human
auaauaaagaauagcuuuaauga

SEQ ID NO: 1329671 - RNA, 13 nt, Human
auaauaaagaaua

SEQ ID NO: 1329672 - RNA, 14 nt, Human
auaauaaagaauag

SEQ ID NO: 1329673 - RNA, 15 nt, Human
auaagagaaucaaca

SEQ ID NO: 1329674 - RNA, 16 nt, Human
auaagaauucagacau

SEQ ID NO: 1329675 - RNA, 17 nt, Human
auaagaauuauuuugau

SEQ ID NO: 1329676 - RNA, 17 nt, Human
auaagacggauuuauuu

SEQ ID NO: 1329677 - RNA, 21 nt, Human
auaagacggauuuauuuuucc

SEQ ID NO: 1329678 - RNA, 18 nt, Human
auaauccuaaacauauga

SEQ ID NO: 1329679 - RNA, 13 nt, Human
auaauagauucuc

SEQ ID NO: 1329680 - RNA, 18 nt, Human
auaaucuggacuccucug

SEQ ID NO: 1329681 - RNA, 19 nt, Human
auaaucuggacuccucugu

SEQ ID NO: 1329682 - RNA, 20 nt, Human
auaaucuggacuccucuguc

SEQ ID NO: 1329683 - RNA, 22 nt, Human
auaaucuggacuccucugucca

SEQ ID NO: 1329684 - RNA, 12 nt, Human
auaaucuagaac

SEQ ID NO: 1329685 - RNA, 15 nt, Human
auaaucuagaacaca

SEQ ID NO: 1329686 - RNA, 23 nt, Human
auaauucuuucaauacagauaua

SEQ ID NO: 1329687 - RNA, 15 nt, Human
auaauucuuucaaua

SEQ ID NO: 1329688 - RNA, 19 nt, Human
auaauucuuucaauacaga

SEQ ID NO: 1329689 - RNA, 22 nt, Human
auaaaguuuuauauauuauaug

SEQ ID NO: 1329690 - RNA, 14 nt, Human
auaaaguuuuauau

SEQ ID NO: 1329691 - RNA, 17 nt, Human
auaaaguuuuauauauu

SEQ ID NO: 1329692 - RNA, 18 nt, Human
auaaaguuuuauauauua

SEQ ID NO: 1329693 - RNA, 20 nt, Human
auaaaguuuuauauauuaua

SEQ ID NO: 1329694 - RNA, 21 nt, Human
auaaaguuuuauauauuauau

SEQ ID NO: 1329695 - RNA, 14 nt, Human
auaaauaaaaauaa

SEQ ID NO: 1329696 - RNA, 15 nt, Human
auaaauaguuuauga

SEQ ID NO: 1329697 - RNA, 15 nt, Human
auaaagguucaugca

SEQ ID NO: 1329698 - RNA, 18 nt, Human
uuaauugggccagcuuuu

SEQ ID NO: 1329699 - RNA, 22 nt, Human
uuaauugggccagcuuuucaaa

SEQ ID NO: 1329700 - RNA, 21 nt, Human
uuaauugggccagcuuuucaa

SEQ ID NO: 1329701 - RNA, 14 nt, Human
uuaauuguaaagua

SEQ ID NO: 1329702 - RNA, 14 nt, Human
uuaauuguaaucug

SEQ ID NO: 1329703 - RNA, 15 nt, Human
uuaauuguaaaguaa

SEQ ID NO: 1329704 - RNA, 17 nt, Human
auaaagguucaugcaaa

SEQ ID NO: 1329705 - RNA, 13 nt, Human
auaaauaaaaaua

SEQ ID NO: 1329706 - RNA, 14 nt, Human
auaacguauaaaag

SEQ ID NO: 1329707 - RNA, 22 nt, Human
auaaccugucucaccuggacuu

SEQ ID NO: 1329708 - RNA, 14 nt, Human
auaaccuuaauuua

SEQ ID NO: 1329709 - RNA, 22 nt, Human
auaacgauaaaagacagugaaa

SEQ ID NO: 1329710 - RNA, 22 nt, Human
auaacguuuaagccaaaacaau

SEQ ID NO: 1329711 - RNA, 20 nt, Human
auaacguuuaagccaaaaca

SEQ ID NO: 1329712 - RNA, 18 nt, Human
auaacguguucaauauuu

SEQ ID NO: 1329713 - RNA, 17 nt, Human
auaacguuuaagccaaa

SEQ ID NO: 1329714 - RNA, 18 nt, Human
auaacguuuaagccaaaa

SEQ ID NO: 1329715 - RNA, 13 nt, Human
auaaauuauuguu

SEQ ID NO: 1329716 - RNA, 19 nt, Human
auaaauuauuguuuuucuu

SEQ ID NO: 1329717 - RNA, 19 nt, Human
auaaaucauuuuaugucaa

SEQ ID NO: 1329718 - RNA, 18 nt, Human
auaaaucauuuuauguca

SEQ ID NO: 1329719 - RNA, 16 nt, Human
auaaaucauuuuaugu

SEQ ID NO: 1329720 - RNA, 15 nt, Human
auaaaucauuuuaug

SEQ ID NO: 1329721 - RNA, 14 nt, Human
auaaaucauuuuau

SEQ ID NO: 1329722 - RNA, 12 nt, Human
auaacccacuuu

SEQ ID NO: 1329723 - RNA, 20 nt, Human
uuaccuuugacaaagguaaa

SEQ ID NO: 1329724 - RNA, 13 nt, Human
uuaccuuugacaa

SEQ ID NO: 1329725 - RNA, 18 nt, Human
uuaccuuauaguuacugu

SEQ ID NO: 1329726 - RNA, 15 nt, Human
uuaccuuauugcacu

SEQ ID NO: 1329727 - RNA, 13 nt, Human
uuaccuacuuuga

SEQ ID NO: 1329728 - RNA, 23 nt, Human
uuaccuacuuugacuuuuugcau

SEQ ID NO: 1329729 - RNA, 12 nt, Human
uuaccucagccu

SEQ ID NO: 1329730 - RNA, 13 nt, Human
uuaccucagccug

SEQ ID NO: 1329731 - RNA, 14 nt, Human
uuaccucagccugg

SEQ ID NO: 1329732 - RNA, 15 nt, Human
uuaccucagccuggg

SEQ ID NO: 1329733 - RNA, 20 nt, Human
uuaccucagccugggcgcug

SEQ ID NO: 1329734 - RNA, 18 nt, Human
uuaccucagccugggcgc

SEQ ID NO: 1329735 - RNA, 11 nt, Human
uuaccuccuga

SEQ ID NO: 1329736 - RNA, 19 nt, Human
uuaccuccugagaaaaaag

SEQ ID NO: 1329737 - RNA, 17 nt, Human
uuacccauuuguucaua

SEQ ID NO: 1329738 - RNA, 19 nt, Human
uuacccauuuguucauauu

SEQ ID NO: 1329739 - RNA, 23 nt, Human
uuacccauuugggugggaguguu

SEQ ID NO: 1329740 - RNA, 20 nt, Human
uuacaggcaugagccacugc

SEQ ID NO: 1329741 - RNA, 24 nt, Human
uuacaggcgugagccaccgugccu

SEQ ID NO: 1329742 - RNA, 16 nt, Human
uuacaggcuccugcca

SEQ ID NO: 1329743 - RNA, 18 nt, Human
uuacaggcuccugccacc

SEQ ID NO: 1329744 - RNA, 17 nt, Human
uuagaacacacacacuu

SEQ ID NO: 1329745 - RNA, 17 nt, Human
uuagaaauugcauuucc

SEQ ID NO: 1329746 - RNA, 20 nt, Human
uuagaacacacacacuuacu

SEQ ID NO: 1329747 - RNA, 16 nt, Human
uuagaaaugcagaauc

SEQ ID NO: 1329748 - RNA, 19 nt, Human
uuagaaauuaccuguggau

SEQ ID NO: 1329749 - RNA, 23 nt, Human
uuagaaauuaccuguggauauuu

SEQ ID NO: 1329750 - RNA, 16 nt, Human
uuagaaagauaauuca

SEQ ID NO: 1329751 - RNA, 13 nt, Human
uuagaaauauuuu

SEQ ID NO: 1329752 - RNA, 22 nt, Human
uuagaaauauuuuaaaaucagc

SEQ ID NO: 1329753 - RNA, 13 nt, Human
uuagaaaucauuu

SEQ ID NO: 1329754 - RNA, 23 nt, Human
uuacucuucaguuaagccuuugg

SEQ ID NO: 1329755 - RNA, 18 nt, Human
uuacucugccuacagaac

SEQ ID NO: 1329756 - RNA, 16 nt, Human
uuaccuuguauacugu

SEQ ID NO: 1329757 - RNA, 13 nt, Human
uuaccuuucauac

SEQ ID NO: 1329758 - RNA, 14 nt, Human
uuacucugccuaca

SEQ ID NO: 1329759 - RNA, 23 nt, Human
aguugcugcuucaauuuauaccu

SEQ ID NO: 1329760 - RNA, 18 nt, Human
aguugcugcuucucccag

SEQ ID NO: 1329761 - RNA, 21 nt, Human
aguugcugcuucucccaggca

SEQ ID NO: 1329762 - RNA, 13 nt, Human
uguuucaaacaua

SEQ ID NO: 1329763 - RNA, 12 nt, Human
uguuuauuuuuc

SEQ ID NO: 1329764 - RNA, 19 nt, Human
uguuuauuuuucuugucuu

SEQ ID NO: 1329765 - RNA, 19 nt, Human
uguuucaaacauauauaac

SEQ ID NO: 1329766 - RNA, 23 nt, Human
uguuuauuuuucuugucuuuauu

SEQ ID NO: 1329767 - RNA, 19 nt, Human
aguuggaguuuuuuguacc

SEQ ID NO: 1329768 - RNA, 20 nt, Human
aguuggaguuuuuuguacca

SEQ ID NO: 1329769 - RNA, 15 nt, Human
aguugggcuugcuau

SEQ ID NO: 1329770 - RNA, 19 nt, Human
aguugggcuugcuauucug

SEQ ID NO: 1329771 - RNA, 15 nt, Human
aguugguaacuuuug

SEQ ID NO: 1329772 - RNA, 16 nt, Human
aguuggggacacaugu

SEQ ID NO: 1329773 - RNA, 20 nt, Human
aguugggcuugcuauucugu

SEQ ID NO: 1329774 - RNA, 17 nt, Human
aguuggggucuggcagc

SEQ ID NO: 1329775 - RNA, 21 nt, Human
aguuggggucuggcagccucc

SEQ ID NO: 1329776 - RNA, 13 nt, Human
aguugcuuuucag

SEQ ID NO: 1329777 - RNA, 19 nt, Human
aguuggagcuccagccuga

SEQ ID NO: 1329778 - RNA, 17 nt, Human
aguuggagucacucuua

SEQ ID NO: 1329779 - RNA, 14 nt, Human
aguuuaaauuguaa

SEQ ID NO: 1329780 - RNA, 21 nt, Human
aguuuaaaaucaucagaaagg

SEQ ID NO: 1329781 - RNA, 18 nt, Human
aguuuaaaacagaagccu

SEQ ID NO: 1329782 - RNA, 21 nt, Human
aguuuaaaagcacgacagugg

SEQ ID NO: 1329783 - RNA, 15 nt, Human
aguuuaaaaucauca

SEQ ID NO: 1329784 - RNA, 16 nt, Human
aguugguaacuuuugu

SEQ ID NO: 1329785 - RNA, 20 nt, Human
aguugguaacuuuugugaau

SEQ ID NO: 1329786 - RNA, 12 nt, Human
uuaaaaaaauaa

SEQ ID NO: 1329787 - RNA, 19 nt, Human
uuaaagugcuaagguucua

SEQ ID NO: 1329788 - RNA, 21 nt, Human
uuaaagugcuaagguucuaag

SEQ ID NO: 1329789 - RNA, 22 nt, Human
uuaaagugcuaagguucuaagg

SEQ ID NO: 1329790 - RNA, 13 nt, Human
uuaaaguauucuu

SEQ ID NO: 1329791 - RNA, 21 nt, Human
uuaaagugacuaauggcauga

SEQ ID NO: 1329792 - RNA, 20 nt, Human
uuaaagugacuaauggcaug

SEQ ID NO: 1329793 - RNA, 13 nt, Human
uuaaagugccagu

SEQ ID NO: 1329794 - RNA, 21 nt, Human
uuaaacaguugcacagcaucu

SEQ ID NO: 1329795 - RNA, 19 nt, Human
uuaaacauuaauagcagcc

SEQ ID NO: 1329796 - RNA, 23 nt, Human
uuaaacauuaauagcagccuuuc

SEQ ID NO: 1329797 - RNA, 23 nt, Human
uuaaacaguugcacagcaucuca

SEQ ID NO: 1329798 - RNA, 19 nt, Human
uuaaacaguugcacagcau

SEQ ID NO: 1329799 - RNA, 18 nt, Human
uuaaacaguugcacagca

SEQ ID NO: 1329800 - RNA, 17 nt, Human
uuaaacaguugcacagc

SEQ ID NO: 1329801 - RNA, 13 nt, Human
uuaaacaguugca

SEQ ID NO: 1329802 - RNA, 19 nt, Human
uuaaacaucaaucuuuaaa

SEQ ID NO: 1329803 - RNA, 16 nt, Human
uuaaacagauguccau

SEQ ID NO: 1329804 - RNA, 13 nt, Human
uuaaacagaggau

SEQ ID NO: 1329805 - RNA, 18 nt, Human
uuaaacagugagccugaa

SEQ ID NO: 1329806 - RNA, 23 nt, Human
uuaaacagugagccugaauuuug

SEQ ID NO: 1329807 - RNA, 14 nt, Human
uuaaacaaagguug

SEQ ID NO: 1329808 - RNA, 13 nt, Human
uuaaacaccuccu

SEQ ID NO: 1329809 - RNA, 16 nt, Human
uuaaacaccuccucau

SEQ ID NO: 1329810 - RNA, 20 nt, Human
uuaaaguuaguaucuuuuga

SEQ ID NO: 1329811 - RNA, 10 nt, Human
uuaaauacag

SEQ ID NO: 1329812 - RNA, 14 nt, Human
uuaaauacaggaaa

SEQ ID NO: 1329813 - RNA, 15 nt, Human
uuaaauacaggaaac

SEQ ID NO: 1329814 - RNA, 17 nt, Human
uuaaauacaggaaacag

SEQ ID NO: 1329815 - RNA, 19 nt, Human
uuaaauacaggaaacaguu

SEQ ID NO: 1329816 - RNA, 20 nt, Human
uuaaauacaggaaacaguug

SEQ ID NO: 1329817 - RNA, 13 nt, Human
uuaaauacagucu

SEQ ID NO: 1329818 - RNA, 18 nt, Human
uuaacaccuuuaaagugu

SEQ ID NO: 1329819 - RNA, 17 nt, Human
uuaacaauuaggcagac

SEQ ID NO: 1329820 - RNA, 12 nt, Human
uuaacacacuac

SEQ ID NO: 1329821 - RNA, 13 nt, Human
uuaacagaaauug

SEQ ID NO: 1329822 - RNA, 15 nt, Human
uuaacagaaauugua

SEQ ID NO: 1329823 - RNA, 16 nt, Human
uuaacagaaauuguau

SEQ ID NO: 1329824 - RNA, 17 nt, Human
uuaacagaaauuguaua

SEQ ID NO: 1329825 - RNA, 19 nt, Human
uuaacagaaauuguauauu

SEQ ID NO: 1329826 - RNA, 21 nt, Human
uuaacagaaauuguauauugu

SEQ ID NO: 1329827 - RNA, 20 nt, Human
uuaacagaagggagggcaga

SEQ ID NO: 1329828 - RNA, 14 nt, Human
uuaacagaagggag

SEQ ID NO: 1329829 - RNA, 13 nt, Human
uuaacagagucug

SEQ ID NO: 1329830 - RNA, 14 nt, Human
uuaacagagucuga

SEQ ID NO: 1329831 - RNA, 20 nt, Human
aguuucaguagauugcagaa

SEQ ID NO: 1329832 - RNA, 16 nt, Human
aguuucauauaaagua

SEQ ID NO: 1329833 - RNA, 15 nt, Human
aguuucauguacaag

SEQ ID NO: 1329834 - RNA, 18 nt, Human
aguuucauguacaagaug

SEQ ID NO: 1329835 - RNA, 21 nt, Human
aguuucauguacaagaugaag

SEQ ID NO: 1329836 - RNA, 13 nt, Human
auaaaagccuguu

SEQ ID NO: 1329837 - RNA, 17 nt, Human
aguuuuuauauguugua

SEQ ID NO: 1329838 - RNA, 16 nt, Human
aguuuuuaugagaaac

SEQ ID NO: 1329839 - RNA, 18 nt, Human
aguuuuuaugagaaacuu

SEQ ID NO: 1329840 - RNA, 19 nt, Human
aguuuuuauuaaaccccuu

SEQ ID NO: 1329841 - RNA, 19 nt, Human
auaaaagccuguuuaagag

SEQ ID NO: 1329842 - RNA, 18 nt, Human
auaaaagccuguuuaaga

SEQ ID NO: 1329843 - RNA, 12 nt, Human
auaaaauaauuu

SEQ ID NO: 1329844 - RNA, 23 nt, Human
auaaaauaaugggauuuucuuuu

SEQ ID NO: 1329845 - RNA, 22 nt, Human
auaaaauaauuuuaucucuuuc

SEQ ID NO: 1329846 - RNA, 15 nt, Human
auaaaauaauuuuua

SEQ ID NO: 1329847 - RNA, 21 nt, Human
auaaaauaugaagacauaaac

SEQ ID NO: 1329848 - RNA, 18 nt, Human
aguuuugauauuucuagc

SEQ ID NO: 1329849 - RNA, 16 nt, Human
aguuuugcaaagugca

SEQ ID NO: 1329850 - RNA, 24 nt, Human
uuaaggggaggaaccagagugcug

SEQ ID NO: 1329851 - RNA, 14 nt, Human
uuaagguguagcca

SEQ ID NO: 1329852 - RNA, 17 nt, Human
uuaagguguagccacac

SEQ ID NO: 1329853 - RNA, 20 nt, Human
uuaagaagacugcauuauau

SEQ ID NO: 1329854 - RNA, 15 nt, Human
uuaagaaauagaauu

SEQ ID NO: 1329855 - RNA, 22 nt, Human
uuaagaaauagacagcaugaga

SEQ ID NO: 1329856 - RNA, 16 nt, Human
uuaauauugauuuauu

SEQ ID NO: 1329857 - RNA, 13 nt, Human
uuaauauugauuu

SEQ ID NO: 1329858 - RNA, 13 nt, Human
uuaagucagaaca

SEQ ID NO: 1329859 - RNA, 22 nt, Human
uuaauauuuauaggucacuuug

SEQ ID NO: 1329860 - RNA, 21 nt, Human
uuaaucugggccagaauuuca

SEQ ID NO: 1329861 - RNA, 17 nt, Human
uuaaucucuaacagugg

SEQ ID NO: 1329862 - RNA, 18 nt, Human
uuaaucucuaacagugga

SEQ ID NO: 1329863 - RNA, 16 nt, Human
uuaaucuguauuuccc

SEQ ID NO: 1329864 - RNA, 14 nt, Human
uuaaucuuagugua

SEQ ID NO: 1329865 - RNA, 16 nt, Human
uuaaucuuaguguaug

SEQ ID NO: 1329866 - RNA, 15 nt, Human
uuaaugaaaauaaga

SEQ ID NO: 1329867 - RNA, 19 nt, Human
uuaauugccaccucuaaca

SEQ ID NO: 1329868 - RNA, 23 nt, Human
aguguuggagaagaacugaaauc

SEQ ID NO: 1329869 - RNA, 21 nt, Human
aguuacucuucaguuaagccu

SEQ ID NO: 1329870 - RNA, 17 nt, Human
aguguuggagaagaacu

SEQ ID NO: 1329871 - RNA, 18 nt, Human
aguguuggagaagaacug

SEQ ID NO: 1329872 - RNA, 20 nt, Human
aguguugagcaucugucccc

SEQ ID NO: 1329873 - RNA, 17 nt, Human
aguguugagccuuuucc

SEQ ID NO: 1329874 - RNA, 14 nt, Human
aguguuggagaaga

SEQ ID NO: 1329875 - RNA, 16 nt, Human
aguguuggagaagaac

SEQ ID NO: 1329876 - RNA, 11 nt, Human
aguuacugugu

SEQ ID NO: 1329877 - RNA, 14 nt, Human
aguuacuguguaau

SEQ ID NO: 1329878 - RNA, 15 nt, Human
aguuacuguguaauu

SEQ ID NO: 1329879 - RNA, 16 nt, Human
aguuacuguguaauua

SEQ ID NO: 1329880 - RNA, 18 nt, Human
aguuacuguguaauuagu

SEQ ID NO: 1329881 - RNA, 19 nt, Human
aguuacuguguaauuagug

SEQ ID NO: 1329882 - RNA, 14 nt, Human
aguuauagugaaua

SEQ ID NO: 1329883 - RNA, 15 nt, Human
aguuauagugaauac

SEQ ID NO: 1329884 - RNA, 20 nt, Human
aguuauagugaauacugcua

SEQ ID NO: 1329885 - RNA, 23 nt, Human
aguuauagugaauacugcuacag

SEQ ID NO: 1329886 - RNA, 21 nt, Human
aguguucauaaauaaaguuug

SEQ ID NO: 1329887 - RNA, 17 nt, Human
aguguuauuuucauuca

SEQ ID NO: 1329888 - RNA, 16 nt, Human
aguguuaucagucaua

SEQ ID NO: 1329889 - RNA, 23 nt, Human
aguguuaucagucauaacuaaau

SEQ ID NO: 1329890 - RNA, 15 nt, Human
aguguuagggaaggg

SEQ ID NO: 1329891 - RNA, 18 nt, Human
aguguuagggaagggccu

SEQ ID NO: 1329892 - RNA, 19 nt, Human
aguguuagggaagggccug

SEQ ID NO: 1329893 - RNA, 23 nt, Human
aguguuagggaagggccugccac

SEQ ID NO: 1329894 - RNA, 15 nt, Human
aguguuaaaugugau

SEQ ID NO: 1329895 - RNA, 23 nt, Human
aguguuagccuuuuuuccccaga

SEQ ID NO: 1329896 - RNA, 21 nt, Human
aguguuagccuuuuuucccca

SEQ ID NO: 1329897 - RNA, 13 nt, Human
uguucuugaauuu

SEQ ID NO: 1329898 - RNA, 23 nt, Human
uguucuugaauuuaauaaucugu

SEQ ID NO: 1329899 - RNA, 10 nt, Human
uguucuugua

SEQ ID NO: 1329900 - RNA, 14 nt, Human
uguucuuguauuua

SEQ ID NO: 1329901 - RNA, 13 nt, Human
uguucuuguauuu

SEQ ID NO: 1329902 - RNA, 17 nt, Human
uguucuaaguuucuaag

SEQ ID NO: 1329903 - RNA, 18 nt, Human
uguucuaaguuucuaaga

SEQ ID NO: 1329904 - RNA, 19 nt, Human
uguucuaaguuucuaagau

SEQ ID NO: 1329905 - RNA, 22 nt, Human
uguucuaaguuucuaagauucu

SEQ ID NO: 1329906 - RNA, 23 nt, Human
uguucuaaguuucuaagauucua

SEQ ID NO: 1329907 - RNA, 16 nt, Human
uguucccuauccaauc

SEQ ID NO: 1329908 - RNA, 15 nt, Human
uguucuaaggcucug

SEQ ID NO: 1329909 - RNA, 16 nt, Human
uguucuaaggcucuga

SEQ ID NO: 1329910 - RNA, 18 nt, Human
uguucuaaggcucugaga

SEQ ID NO: 1329911 - RNA, 23 nt, Human
uguucuaaggcucugagagucua

SEQ ID NO: 1329912 - RNA, 17 nt, Human
uguucuaagucuuucca

SEQ ID NO: 1329913 - RNA, 19 nt, Human
uguucuaaggcucugagag

SEQ ID NO: 1329914 - RNA, 12 nt, Human
uguucuaaguuu

SEQ ID NO: 1329915 - RNA, 14 nt, Human
uguucuaaguuucu

SEQ ID NO: 1329916 - RNA, 16 nt, Human
uguucuaaguuucuaa

SEQ ID NO: 1329917 - RNA, 10 nt, Human
uguucuuccu

SEQ ID NO: 1329918 - RNA, 15 nt, Human
uguucuuccucagcc

SEQ ID NO: 1329919 - RNA, 16 nt, Human
uguucuuccucagcca

SEQ ID NO: 1329920 - RNA, 17 nt, Human
uguucuuccucagccag

SEQ ID NO: 1329921 - RNA, 20 nt, Human
uguucuuccucagccagccu

SEQ ID NO: 1329922 - RNA, 21 nt, Human
uguucuuccucagccagccuc

SEQ ID NO: 1329923 - RNA, 13 nt, Human
uguucuuccuggc

SEQ ID NO: 1329924 - RNA, 15 nt, Human
uguucuuccuggccg

SEQ ID NO: 1329925 - RNA, 23 nt, Human
uguuauuucccuacauuaaacau

SEQ ID NO: 1329926 - RNA, 21 nt, Human
uguuauuucccuacauuaaac

SEQ ID NO: 1329927 - RNA, 20 nt, Human
uguuauuucccuacauuaaa

SEQ ID NO: 1329928 - RNA, 14 nt, Human
uguuauuuaaagaa

SEQ ID NO: 1329929 - RNA, 14 nt, Human
uguuccccuuccac

SEQ ID NO: 1329930 - RNA, 17 nt, Human
uguuccccuuccacuga

SEQ ID NO: 1329931 - RNA, 20 nt, Human
uguuccccuuccacugaggg

SEQ ID NO: 1329932 - RNA, 21 nt, Human
uguuccccuuccacugagggc

SEQ ID NO: 1329933 - RNA, 23 nt, Human
uguuccccuuccacugagggcag

SEQ ID NO: 1329934 - RNA, 22 nt, Human
uguuccccuuugcuucauucaa

SEQ ID NO: 1329935 - RNA, 15 nt, Human
aguggaucacaaagu

SEQ ID NO: 1329936 - RNA, 18 nt, Human
aguggaucacucaccauu

SEQ ID NO: 1329937 - RNA, 14 nt, Human
aguggagucugcca

SEQ ID NO: 1329938 - RNA, 17 nt, Human
aguggagucugccaccc

SEQ ID NO: 1329939 - RNA, 19 nt, Human
aguggagucugccacccag

SEQ ID NO: 1329940 - RNA, 20 nt, Human
aguggagucugccacccagg

SEQ ID NO: 1329941 - RNA, 18 nt, Human
agugcuuuuggcggggag

SEQ ID NO: 1329942 - RNA, 14 nt, Human
aguggaaaaggcac

SEQ ID NO: 1329943 - RNA, 22 nt, Human
aguggaaagacagcuucucauc

SEQ ID NO: 1329944 - RNA, 16 nt, Human
aguggaacgaaaauga

SEQ ID NO: 1329945 - RNA, 24 nt, Human
aguggaacgaaaaugaaagcuacu

SEQ ID NO: 1329946 - RNA, 16 nt, Human
aguggaucacaaagug

SEQ ID NO: 1329947 - RNA, 19 nt, Human
uguuauauguuguucuuac

SEQ ID NO: 1329948 - RNA, 13 nt, Human
uguuauauuucau

SEQ ID NO: 1329949 - RNA, 20 nt, Human
uguuaucaaaacuuucuuuu

SEQ ID NO: 1329950 - RNA, 22 nt, Human
uguuaucaaacaccaacauaaa

SEQ ID NO: 1329951 - RNA, 19 nt, Human
uguuaucaccgugggcucc

SEQ ID NO: 1329952 - RNA, 21 nt, Human
uguuaucagucaauauuuuua

SEQ ID NO: 1329953 - RNA, 18 nt, Human
uguuaucuguuugagaaa

SEQ ID NO: 1329954 - RNA, 15 nt, Human
uguuaucuucucaag

SEQ ID NO: 1329955 - RNA, 19 nt, Human
uguuaucuguuugagaaag

SEQ ID NO: 1329956 - RNA, 17 nt, Human
uguuaucuguuugagaa

SEQ ID NO: 1329957 - RNA, 14 nt, Human
uguuaucuguuuga

SEQ ID NO: 1329958 - RNA, 20 nt, Human
uguuaucuucucaaguucua

SEQ ID NO: 1329959 - RNA, 16 nt, Human
uguuaucuucucaagu

SEQ ID NO: 1329960 - RNA, 21 nt, Human
uguuauuagagauuaccuccu

SEQ ID NO: 1329961 - RNA, 23 nt, Human
uguuauuagagauuaccuccuga

SEQ ID NO: 1329962 - RNA, 16 nt, Human
uguuauuaucugggcu

SEQ ID NO: 1329963 - RNA, 23 nt, Human
uguuauuaucugggcuuauaucu

SEQ ID NO: 1329964 - RNA, 22 nt, Human
uguuauuauuacuuauuuuuga

SEQ ID NO: 1329965 - RNA, 13 nt, Human
uguugucugcaac

SEQ ID NO: 1329966 - RNA, 16 nt, Human
uguugucugcaacucu

SEQ ID NO: 1329967 - RNA, 16 nt, Human
uguuggucuguacuga

SEQ ID NO: 1329968 - RNA, 15 nt, Human
uguuggucuguacug

SEQ ID NO: 1329969 - RNA, 14 nt, Human
uguuggucuguacu

SEQ ID NO: 1329970 - RNA, 11 nt, Human
uguuggugcac

SEQ ID NO: 1329971 - RNA, 14 nt, Human
uguuggugcacagc

SEQ ID NO: 1329972 - RNA, 18 nt, Human
uguuggugcacagcacaa

SEQ ID NO: 1329973 - RNA, 14 nt, Human
uguuggucauuuua

SEQ ID NO: 1329974 - RNA, 15 nt, Human
uguugguugguuuuc

SEQ ID NO: 1329975 - RNA, 20 nt, Human
uguugguugguuuucuucuu

SEQ ID NO: 1329976 - RNA, 15 nt, Human
uguugguuuuuaaag

SEQ ID NO: 1329977 - RNA, 15 nt, Human
uguugucucuugagu

SEQ ID NO: 1329978 - RNA, 13 nt, Human
uguugugcuuuua

SEQ ID NO: 1329979 - RNA, 21 nt, Human
uguuguuaucuguuugagaaa

SEQ ID NO: 1329980 - RNA, 17 nt, Human
uguuguuaugaugugcu

SEQ ID NO: 1329981 - RNA, 23 nt, Human
uguuguuccaaauacuaaugaaa

SEQ ID NO: 1329982 - RNA, 11 nt, Human
uguuguucugu

SEQ ID NO: 1329983 - RNA, 13 nt, Human
uguuguucuguua

SEQ ID NO: 1329984 - RNA, 18 nt, Human
uguuguucuguuaacuga

SEQ ID NO: 1329985 - RNA, 19 nt, Human
uguuguuaugaugugcuua

SEQ ID NO: 1329986 - RNA, 15 nt, Human
uguuguuaugaugug

SEQ ID NO: 1329987 - RNA, 14 nt, Human
uguuguuaugaugu

SEQ ID NO: 1329988 - RNA, 11 nt, Human
uguuguuauuu

SEQ ID NO: 1329989 - RNA, 13 nt, Human
uguuguuauuuaa

SEQ ID NO: 1329990 - RNA, 22 nt, Human
uguuguucuguuaacugaauac

SEQ ID NO: 1329991 - RNA, 16 nt, Human
uguuuaguagcaguga

SEQ ID NO: 1329992 - RNA, 18 nt, Human
uguuuaguagcagugauu

SEQ ID NO: 1329993 - RNA, 15 nt, Human
uguuuauccuuucau

SEQ ID NO: 1329994 - RNA, 16 nt, Human
uguuuauccuuucaua

SEQ ID NO: 1329995 - RNA, 17 nt, Human
uguuuauccuuucauau

SEQ ID NO: 1329996 - RNA, 21 nt, Human
uguuuauccuuucauauaguu

SEQ ID NO: 1329997 - RNA, 18 nt, Human
uguuuauccuuucauaua

SEQ ID NO: 1329998 - RNA, 17 nt, Human
uguuuaguaaucauauu

SEQ ID NO: 1329999 - RNA, 14 nt, Human
uguuuaguaaucau

SEQ ID NO: 1330000 - RNA, 13 nt, Human
uguuuaguaauca

SEQ ID NO: 1330001 - RNA, 19 nt, Human
uguuuaguaaacucaauaa

SEQ ID NO: 1330002 - RNA, 19 nt, Human
uguuuauucauaugcauau

SEQ ID NO: 1330003 - RNA, 18 nt, Human
uguuuauucauaugcaua

SEQ ID NO: 1330004 - RNA, 17 nt, Human
uguuuauucauaugcau

SEQ ID NO: 1330005 - RNA, 16 nt, Human
uguuuauucauaugca

SEQ ID NO: 1330006 - RNA, 13 nt, Human
uguuuauucauau

SEQ ID NO: 1330007 - RNA, 16 nt, Human
uguuuauucuucuaga

SEQ ID NO: 1330008 - RNA, 17 nt, Human
uguuuauucuucuagag

SEQ ID NO: 1330009 - RNA, 20 nt, Human
uguuuauugaauucauuuca

SEQ ID NO: 1330010 - RNA, 23 nt, Human
uguuuauugaauucauuucacug

SEQ ID NO: 1330011 - RNA, 16 nt, Human
uguuuaugguaaaaaa

SEQ ID NO: 1330012 - RNA, 13 nt, Human
uguuuaugguaaa

SEQ ID NO: 1330013 - RNA, 14 nt, Human
uguuuauguaauuu

SEQ ID NO: 1330014 - RNA, 16 nt, Human
uguuuauguaauuuca

SEQ ID NO: 1330015 - RNA, 15 nt, Human
uguuuauguaauuuc

SEQ ID NO: 1330016 - RNA, 20 nt, Human
aguucggugagcuacaaaug

SEQ ID NO: 1330017 - RNA, 13 nt, Human
aguuccugcuaaa

SEQ ID NO: 1330018 - RNA, 13 nt, Human
aguucgcagccac

SEQ ID NO: 1330019 - RNA, 14 nt, Human
aguucgcagccacc

SEQ ID NO: 1330020 - RNA, 17 nt, Human
aguucgcagccacccug

SEQ ID NO: 1330021 - RNA, 21 nt, Human
aguucgcagccacccugagga

SEQ ID NO: 1330022 - RNA, 18 nt, Human
aguucgcagccacccuga

SEQ ID NO: 1330023 - RNA, 21 nt, Human
aguucuaauaauuucuaaugu

SEQ ID NO: 1330024 - RNA, 20 nt, Human
aguucuaccucaggcagcuc

SEQ ID NO: 1330025 - RNA, 19 nt, Human
aguucggugagcuacaaau

SEQ ID NO: 1330026 - RNA, 20 nt, Human
aguuccccuguuuauucaua

SEQ ID NO: 1330027 - RNA, 19 nt, Human
aguuccccuguuuauucau

SEQ ID NO: 1330028 - RNA, 18 nt, Human
aguuccccuguuuauuca

SEQ ID NO: 1330029 - RNA, 21 nt, Human
aguuccucuaacuuggcucac

SEQ ID NO: 1330030 - RNA, 19 nt, Human
aguuccucuaacuuggcuc

SEQ ID NO: 1330031 - RNA, 13 nt, Human
aguucucccugua

SEQ ID NO: 1330032 - RNA, 22 nt, Human
aguucucccuguacaguguuac

SEQ ID NO: 1330033 - RNA, 22 nt, Human
aguucuaccucaggcagcucaa

SEQ ID NO: 1330034 - RNA, 23 nt, Human
aguucuaccucaggcagcucaag

SEQ ID NO: 1330035 - RNA, 12 nt, Human
aguucuagaaaa

SEQ ID NO: 1330036 - RNA, 14 nt, Human
aguucuagaaaaac

SEQ ID NO: 1330037 - RNA, 15 nt, Human
aguucuagaaaaaca

SEQ ID NO: 1330038 - RNA, 10 nt, Human
aguucuagac

SEQ ID NO: 1330039 - RNA, 21 nt, Human
aguucuagacauggagguucu

SEQ ID NO: 1330040 - RNA, 22 nt, Human
aguucuagacauggagguucua

SEQ ID NO: 1330041 - RNA, 23 nt, Human
aguucuagacauggagguucuaa

SEQ ID NO: 1330042 - RNA, 13 nt, Human
aguucuaggaaaa

SEQ ID NO: 1330043 - RNA, 14 nt, Human
aguucuaggaaaau

SEQ ID NO: 1330044 - RNA, 15 nt, Human
aguucuaggaaaaua

SEQ ID NO: 1330045 - RNA, 10 nt, Human
aguucuaggc

SEQ ID NO: 1330046 - RNA, 14 nt, Human
aguucuaggcacug

SEQ ID NO: 1330047 - RNA, 22 nt, Human
aguucuaggcacuguaguucua

SEQ ID NO: 1330048 - RNA, 15 nt, Human
aguucagaauuuagu

SEQ ID NO: 1330049 - RNA, 17 nt, Human
aguucccacauuaaaga

SEQ ID NO: 1330050 - RNA, 18 nt, Human
aguucccacauuaaagaa

SEQ ID NO: 1330051 - RNA, 19 nt, Human
aguucccacauuaaagaag

SEQ ID NO: 1330052 - RNA, 22 nt, Human
aguucccacauuaaagaagacc

SEQ ID NO: 1330053 - RNA, 15 nt, Human
aguucccuacuuccu

SEQ ID NO: 1330054 - RNA, 18 nt, Human
aguuccccuauguggaag

SEQ ID NO: 1330055 - RNA, 17 nt, Human
aguucccaguuggagcu

SEQ ID NO: 1330056 - RNA, 18 nt, Human
aguucccaguuggagcuc

SEQ ID NO: 1330057 - RNA, 19 nt, Human
aguucccaguuggagcucc

SEQ ID NO: 1330058 - RNA, 20 nt, Human
aguucccaguuggagcucca

SEQ ID NO: 1330059 - RNA, 21 nt, Human
aguucccaguuggagcuccag

SEQ ID NO: 1330060 - RNA, 14 nt, Human
aguuccccuaugug

SEQ ID NO: 1330061 - RNA, 19 nt, Human
aguuaucauguuaguaaua

SEQ ID NO: 1330062 - RNA, 22 nt, Human
aguuaucauguuaguaauaccu

SEQ ID NO: 1330063 - RNA, 18 nt, Human
aguuaucauguuaguaau

SEQ ID NO: 1330064 - RNA, 17 nt, Human
aguuaucauguuaguaa

SEQ ID NO: 1330065 - RNA, 15 nt, Human
aguuaucauguuagu

SEQ ID NO: 1330066 - RNA, 14 nt, Human
aguuaucauguuag

SEQ ID NO: 1330067 - RNA, 13 nt, Human
aguuaucauguua

SEQ ID NO: 1330068 - RNA, 12 nt, Human
aguuaucauguu

SEQ ID NO: 1330069 - RNA, 16 nt, Human
aguuauauuuugcagu

SEQ ID NO: 1330070 - RNA, 14 nt, Human
aguuauauuuugca

SEQ ID NO: 1330071 - RNA, 16 nt, Human
uguggugagggaagac

SEQ ID NO: 1330072 - RNA, 17 nt, Human
uguggugaaaagcaggu

SEQ ID NO: 1330073 - RNA, 21 nt, Human
ugugguucugagauggcuccc

SEQ ID NO: 1330074 - RNA, 14 nt, Human
ugugguuuauauau

SEQ ID NO: 1330075 - RNA, 13 nt, Human
agugcuugcuuuu

SEQ ID NO: 1330076 - RNA, 17 nt, Human
agugcuugcuuuucaug

SEQ ID NO: 1330077 - RNA, 22 nt, Human
agugcuugcuuuucaugcaaac

SEQ ID NO: 1330078 - RNA, 20 nt, Human
agugcuggcauuacaggugu

SEQ ID NO: 1330079 - RNA, 20 nt, Human
agugcugggauuacaggcgu

SEQ ID NO: 1330080 - RNA, 20 nt, Human
agugcugggauuacaggugu

SEQ ID NO: 1330081 - RNA, 20 nt, Human
agugcuguuuuguuauauaa

SEQ ID NO: 1330082 - RNA, 19 nt, Human
agugcugggauuacaggcu

SEQ ID NO: 1330083 - RNA, 23 nt, Human
agugcuguuuuguuauauaauuu

SEQ ID NO: 1330084 - RNA, 22 nt, Human
agugcuguuuuguuauauaauu

SEQ ID NO: 1330085 - RNA, 21 nt, Human
agugccuguaaucacagcuac

SEQ ID NO: 1330086 - RNA, 13 nt, Human
agugcccugagcc

SEQ ID NO: 1330087 - RNA, 15 nt, Human
agugcccugagccag

SEQ ID NO: 1330088 - RNA, 16 nt, Human
agugcccugagccagg

SEQ ID NO: 1330089 - RNA, 20 nt, Human
agugcccugagccagggucu

SEQ ID NO: 1330090 - RNA, 23 nt, Human
agugcccugagccagggucucca

SEQ ID NO: 1330091 - RNA, 21 nt, Human
agugcccugagccagggucuc

SEQ ID NO: 1330092 - RNA, 18 nt, Human
agugccugacacacuaac

SEQ ID NO: 1330093 - RNA, 13 nt, Human
uguuaacagaagg

SEQ ID NO: 1330094 - RNA, 21 nt, Human
uguuaacagaagggagggcag

SEQ ID NO: 1330095 - RNA, 22 nt, Human
uguuaacagaagggagggcaga

SEQ ID NO: 1330096 - RNA, 15 nt, Human
uguuaacauuccaag

SEQ ID NO: 1330097 - RNA, 16 nt, Human
uguuaacauuccaaga

SEQ ID NO: 1330098 - RNA, 20 nt, Human
uguuaacauuccaagacucu

SEQ ID NO: 1330099 - RNA, 21 nt, Human
uguuaacauuccaagacucua

SEQ ID NO: 1330100 - RNA, 16 nt, Human
uguguugccaagcucc

SEQ ID NO: 1330101 - RNA, 17 nt, Human
uguguucccauuucagc

SEQ ID NO: 1330102 - RNA, 12 nt, Human
uguguuggcugu

SEQ ID NO: 1330103 - RNA, 22 nt, Human
uguguugggauugagucugugc

SEQ ID NO: 1330104 - RNA, 13 nt, Human
uguguugucucua

SEQ ID NO: 1330105 - RNA, 19 nt, Human
uguguugucucuugaguuu

SEQ ID NO: 1330106 - RNA, 14 nt, Human
agugcuuugagaga

SEQ ID NO: 1330107 - RNA, 19 nt, Human
agugcuuuuaagugaaaau

SEQ ID NO: 1330108 - RNA, 23 nt, Human
agugcuuuuaagugaaaaugguc

SEQ ID NO: 1330109 - RNA, 15 nt, Human
ugugguuuauauauu

SEQ ID NO: 1330110 - RNA, 17 nt, Human
ugugguuucauguuagu

SEQ ID NO: 1330111 - RNA, 22 nt, Human
ugugguuucauguuaguuaccu

SEQ ID NO: 1330112 - RNA, 16 nt, Human
ugugucuaagauucua

SEQ ID NO: 1330113 - RNA, 17 nt, Human
ugugucuaagauucuag

SEQ ID NO: 1330114 - RNA, 18 nt, Human
ugugucuaagauucuaga

SEQ ID NO: 1330115 - RNA, 19 nt, Human
ugugucuaagauucuagau

SEQ ID NO: 1330116 - RNA, 20 nt, Human
ugugucuaagauucuagauc

SEQ ID NO: 1330117 - RNA, 19 nt, Human
uguguuaugcaaaagcaag

SEQ ID NO: 1330118 - RNA, 15 nt, Human
uguguguugauacug

SEQ ID NO: 1330119 - RNA, 16 nt, Human
uguguucccauuucag

SEQ ID NO: 1330120 - RNA, 23 nt, Human
uguguugauacuguugcacgugu

SEQ ID NO: 1330121 - RNA, 13 nt, Human
uguguugccaagc

SEQ ID NO: 1330122 - RNA, 20 nt, Human
uguguguuaagcucugcuau

SEQ ID NO: 1330123 - RNA, 16 nt, Human
uguguguugauacugu

SEQ ID NO: 1330124 - RNA, 14 nt, Human
agugcacuaaugug

SEQ ID NO: 1330125 - RNA, 16 nt, Human
agugcaccaaagagaa

SEQ ID NO: 1330126 - RNA, 18 nt, Human
agugcaccaaagagaaug

SEQ ID NO: 1330127 - RNA, 20 nt, Human
agugcaccaaagagaaugcc

SEQ ID NO: 1330128 - RNA, 15 nt, Human
agugcaucucagccc

SEQ ID NO: 1330129 - RNA, 14 nt, Human
agugcaucucagcc

SEQ ID NO: 1330130 - RNA, 16 nt, Human
agugcaguccugauca

SEQ ID NO: 1330131 - RNA, 22 nt, Human
agugcaguccugaucagagccg

SEQ ID NO: 1330132 - RNA, 16 nt, Human
agugcaucucagccca

SEQ ID NO: 1330133 - RNA, 17 nt, Human
agugcaucucagcccac

SEQ ID NO: 1330134 - RNA, 14 nt, Human
agugcaucuggaga

SEQ ID NO: 1330135 - RNA, 19 nt, Human
agugcaucuggagagaaca

SEQ ID NO: 1330136 - RNA, 21 nt, Human
agugcaucuggagagaacagg

SEQ ID NO: 1330137 - RNA, 14 nt, Human
agugccacuuaaug

SEQ ID NO: 1330138 - RNA, 16 nt, Human
agugccacuuaaugua

SEQ ID NO: 1330139 - RNA, 17 nt, Human
agugccacuuaauguau

SEQ ID NO: 1330140 - RNA, 17 nt, Human
agugccacuguuguuuu

SEQ ID NO: 1330141 - RNA, 14 nt, Human
agugcccccacuga

SEQ ID NO: 1330142 - RNA, 16 nt, Human
agugcccccacugacc

SEQ ID NO: 1330143 - RNA, 15 nt, Human
agugcccucuccccu

SEQ ID NO: 1330144 - RNA, 22 nt, Human
agugcaaauugucacaggacag

SEQ ID NO: 1330145 - RNA, 13 nt, Human
agugcaccaaaga

SEQ ID NO: 1330146 - RNA, 18 nt, Human
agugcaaauugucacagg

SEQ ID NO: 1330147 - RNA, 21 nt, Human
agugcaaauugucacaggaca

SEQ ID NO: 1330148 - RNA, 16 nt, Human
agugauuguaugaauu

SEQ ID NO: 1330149 - RNA, 15 nt, Human
agugauugucuuaau

SEQ ID NO: 1330150 - RNA, 17 nt, Human
agugauugucuuaauau

SEQ ID NO: 1330151 - RNA, 13 nt, Human
agugagucucucu

SEQ ID NO: 1330152 - RNA, 23 nt, Human
uguggccccacccugggcccugg

SEQ ID NO: 1330153 - RNA, 17 nt, Human
uguggccccugaacaag

SEQ ID NO: 1330154 - RNA, 22 nt, Human
uguggccccugaacaagaauug

SEQ ID NO: 1330155 - RNA, 14 nt, Human
agugagucucucug

SEQ ID NO: 1330156 - RNA, 15 nt, Human
agugagucucucugg

SEQ ID NO: 1330157 - RNA, 24 nt, Human
agugagucucucugggccuuagga

SEQ ID NO: 1330158 - RNA, 17 nt, Human
agugagucucucugggc

SEQ ID NO: 1330159 - RNA, 14 nt, Human
agugaguggcccuu

SEQ ID NO: 1330160 - RNA, 12 nt, Human
ugugccucugcc

SEQ ID NO: 1330161 - RNA, 13 nt, Human
ugugccucugccu

SEQ ID NO: 1330162 - RNA, 21 nt, Human
ugugccucgcuccccacucug

SEQ ID NO: 1330163 - RNA, 20 nt, Human
ugugccucgcuccccacucu

SEQ ID NO: 1330164 - RNA, 16 nt, Human
ugugccucagagacca

SEQ ID NO: 1330165 - RNA, 14 nt, Human
ugugccucagagac

SEQ ID NO: 1330166 - RNA, 14 nt, Human
ugugccuccucacc

SEQ ID NO: 1330167 - RNA, 15 nt, Human
ugugccuccucaccc

SEQ ID NO: 1330168 - RNA, 16 nt, Human
ugugccuccucacccc

SEQ ID NO: 1330169 - RNA, 13 nt, Human
ugugccuccuccc

SEQ ID NO: 1330170 - RNA, 14 nt, Human
ugugccuccucccu

SEQ ID NO: 1330171 - RNA, 15 nt, Human
ugugccuccucccuc

SEQ ID NO: 1330172 - RNA, 16 nt, Human
ugugccuccucccucc

SEQ ID NO: 1330173 - RNA, 21 nt, Human
ugugccuccucccucccucuc

SEQ ID NO: 1330174 - RNA, 18 nt, Human
agucucacugcuugaacu

SEQ ID NO: 1330175 - RNA, 18 nt, Human
ugugccccuuccgccacu

SEQ ID NO: 1330176 - RNA, 20 nt, Human
ugugccccuuccgccacugg

SEQ ID NO: 1330177 - RNA, 21 nt, Human
ugugccccuuccgccacuggg

SEQ ID NO: 1330178 - RNA, 16 nt, Human
ugugccccuugacaac

SEQ ID NO: 1330179 - RNA, 23 nt, Human
ugugccccuugacaacuggcagg

SEQ ID NO: 1330180 - RNA, 13 nt, Human
ugugcccuaucac

SEQ ID NO: 1330181 - RNA, 13 nt, Human
ugugcccucccug

SEQ ID NO: 1330182 - RNA, 19 nt, Human
uguggcacuggggcagggg

SEQ ID NO: 1330183 - RNA, 17 nt, Human
uguggcaaggaaaaaca

SEQ ID NO: 1330184 - RNA, 15 nt, Human
uguggcaagugaauu

SEQ ID NO: 1330185 - RNA, 14 nt, Human
uguggcaagugaau

SEQ ID NO: 1330186 - RNA, 14 nt, Human
uguggcagaguuac

SEQ ID NO: 1330187 - RNA, 15 nt, Human
uguggcagaguuaca

SEQ ID NO: 1330188 - RNA, 19 nt, Human
uguggcagaguuacaguuc

SEQ ID NO: 1330189 - RNA, 20 nt, Human
uguggcagaguuacaguucu

SEQ ID NO: 1330190 - RNA, 12 nt, Human
uguggccccacc

SEQ ID NO: 1330191 - RNA, 13 nt, Human
uguggccccaccc

SEQ ID NO: 1330192 - RNA, 17 nt, Human
uguggccccacccuggg

SEQ ID NO: 1330193 - RNA, 19 nt, Human
uguggccccacccugggcc

SEQ ID NO: 1330194 - RNA, 17 nt, Human
uguggagagggaaugug

SEQ ID NO: 1330195 - RNA, 20 nt, Human
uguggagagggaaugugaaa

SEQ ID NO: 1330196 - RNA, 19 nt, Human
uguggagagggaaugugaa

SEQ ID NO: 1330197 - RNA, 16 nt, Human
uguggagccgaggccu

SEQ ID NO: 1330198 - RNA, 19 nt, Human
uguggagccgaggccuacc

SEQ ID NO: 1330199 - RNA, 20 nt, Human
uguggagccgaggccuaccc

SEQ ID NO: 1330200 - RNA, 22 nt, Human
uguggauuuuuuccuucaaagu

SEQ ID NO: 1330201 - RNA, 17 nt, Human
uguaagaaaauaucacu

SEQ ID NO: 1330202 - RNA, 20 nt, Human
uguaacuuuuguaagacaaa

SEQ ID NO: 1330203 - RNA, 17 nt, Human
uguaacuuucucuauga

SEQ ID NO: 1330204 - RNA, 18 nt, Human
uguaacuuucucuaugaa

SEQ ID NO: 1330205 - RNA, 15 nt, Human
uguaacuuuuguaag

SEQ ID NO: 1330206 - RNA, 16 nt, Human
uguaacuuuuguaaga

SEQ ID NO: 1330207 - RNA, 20 nt, Human
uguaagacaaagguuuuccu

SEQ ID NO: 1330208 - RNA, 21 nt, Human
uguaagacaaagguuuuccuc

SEQ ID NO: 1330209 - RNA, 18 nt, Human
uguaagacccuuauugcu

SEQ ID NO: 1330210 - RNA, 22 nt, Human
uguaagacccuuauugcugucc

SEQ ID NO: 1330211 - RNA, 22 nt, Human
uguaacuugauccauuucuaau

SEQ ID NO: 1330212 - RNA, 23 nt, Human
uguaacuugauccauuucuaauu

SEQ ID NO: 1330213 - RNA, 19 nt, Human
agguguagccacaccagga

SEQ ID NO: 1330214 - RNA, 13 nt, Human
aggugguguuucu

SEQ ID NO: 1330215 - RNA, 20 nt, Human
agguugauaaaucauuuuau

SEQ ID NO: 1330216 - RNA, 22 nt, Human
agguugauaaaucauuuuaugu

SEQ ID NO: 1330217 - RNA, 12 nt, Human
agguugauaaau

SEQ ID NO: 1330218 - RNA, 17 nt, Human
agguugagcucuucuua

SEQ ID NO: 1330219 - RNA, 24 nt, Human
agguugagcucuucuuaaaguauu

SEQ ID NO: 1330220 - RNA, 16 nt, Human
agguuggcucugccag

SEQ ID NO: 1330221 - RNA, 18 nt, Human
agguuggcucugccaguc

SEQ ID NO: 1330222 - RNA, 19 nt, Human
agguuggcucugccagucc

SEQ ID NO: 1330223 - RNA, 21 nt, Human
agguuggcucugccaguccug

SEQ ID NO: 1330224 - RNA, 22 nt, Human
agguuggcucugccaguccugu

SEQ ID NO: 1330225 - RNA, 14 nt, Human
agguugcagugagc

SEQ ID NO: 1330226 - RNA, 16 nt, Human
agguugcacacuuugg

SEQ ID NO: 1330227 - RNA, 17 nt, Human
agguugcacacuuuggu

SEQ ID NO: 1330228 - RNA, 19 nt, Human
agguugcacacuuugguac

SEQ ID NO: 1330229 - RNA, 12 nt, Human
agguugcacacu

SEQ ID NO: 1330230 - RNA, 13 nt, Human
agguugcacacuu

SEQ ID NO: 1330231 - RNA, 21 nt, Human
uguaauuagugccacuuaaug

SEQ ID NO: 1330232 - RNA, 23 nt, Human
uguaauuagugccacuuaaugua

SEQ ID NO: 1330233 - RNA, 14 nt, Human
uguaaguugggcuu

SEQ ID NO: 1330234 - RNA, 18 nt, Human
uguaaguugggcuugcua

SEQ ID NO: 1330235 - RNA, 21 nt, Human
uguaaguugggcuugcuauuc

SEQ ID NO: 1330236 - RNA, 19 nt, Human
uguaaguugggcuugcuau

SEQ ID NO: 1330237 - RNA, 20 nt, Human
uguaauuauuuauguauggu

SEQ ID NO: 1330238 - RNA, 15 nt, Human
uguaaguaaacgguc

SEQ ID NO: 1330239 - RNA, 21 nt, Human
uguaagggccagaaauaucuu

SEQ ID NO: 1330240 - RNA, 23 nt, Human
uguaagauuauagauucuaaaga

SEQ ID NO: 1330241 - RNA, 13 nt, Human
uguaagauuuguu

SEQ ID NO: 1330242 - RNA, 21 nt, Human
uguaagauuuguuuuuaaacu

SEQ ID NO: 1330243 - RNA, 17 nt, Human
uguaagugaaaaacaug

SEQ ID NO: 1330244 - RNA, 18 nt, Human
uguaagugaaaaacauga

SEQ ID NO: 1330245 - RNA, 16 nt, Human
uguaaguugaagcaaa

SEQ ID NO: 1330246 - RNA, 18 nt, Human
uguaagauuauagauucu

SEQ ID NO: 1330247 - RNA, 19 nt, Human
uguaagauuauagauucua

SEQ ID NO: 1330248 - RNA, 20 nt, Human
uguaagauuauagauucuaa

SEQ ID NO: 1330249 - RNA, 21 nt, Human
uguaagauuauagauucuaaa

SEQ ID NO: 1330250 - RNA, 22 nt, Human
uguaagauuauagauucuaaag

SEQ ID NO: 1330251 - RNA, 23 nt, Human
uguaagauuuguuuuuaaacugu

SEQ ID NO: 1330252 - RNA, 21 nt, Human
aggucuuggaacuugccugcc

SEQ ID NO: 1330253 - RNA, 19 nt, Human
aggucuuggaacuugccug

SEQ ID NO: 1330254 - RNA, 18 nt, Human
aggucuuugguucagcua

SEQ ID NO: 1330255 - RNA, 10 nt, Human
aggucccuaa

SEQ ID NO: 1330256 - RNA, 11 nt, Human
aggucccuaau

SEQ ID NO: 1330257 - RNA, 15 nt, Human
uguaaaucuacacac

SEQ ID NO: 1330258 - RNA, 21 nt, Human
aggugcaacagacuugaaugc

SEQ ID NO: 1330259 - RNA, 15 nt, Human
aggugcaauuucaag

SEQ ID NO: 1330260 - RNA, 21 nt, Human
agguggugguagagaagcaag

SEQ ID NO: 1330261 - RNA, 19 nt, Human
aggugggcacuggauuagu

SEQ ID NO: 1330262 - RNA, 14 nt, Human
agguggcccuacug

SEQ ID NO: 1330263 - RNA, 19 nt, Human
agguggccaaguuccucua

SEQ ID NO: 1330264 - RNA, 20 nt, Human
aggugcauauuuauaaaaau

SEQ ID NO: 1330265 - RNA, 14 nt, Human
agguggccacucca

SEQ ID NO: 1330266 - RNA, 17 nt, Human
agguggccacuccagac

SEQ ID NO: 1330267 - RNA, 16 nt, Human
agguggccaaguuccu

SEQ ID NO: 1330268 - RNA, 17 nt, Human
agguggccaaguuccuc

SEQ ID NO: 1330269 - RNA, 16 nt, Human
aggugcaauuucaagg

SEQ ID NO: 1330270 - RNA, 18 nt, Human
aggugcaauuucaagguu

SEQ ID NO: 1330271 - RNA, 19 nt, Human
aggugcaauuucaagguuc

SEQ ID NO: 1330272 - RNA, 20 nt, Human
aggugcaauuucaagguucu

SEQ ID NO: 1330273 - RNA, 21 nt, Human
aggugcaauuucaagguucua

SEQ ID NO: 1330274 - RNA, 22 nt, Human
aggugcaauuucaagguucuaa

SEQ ID NO: 1330275 - RNA, 15 nt, Human
aggugcacugggagg

SEQ ID NO: 1330276 - RNA, 22 nt, Human
aggugcacugggaggcuccccu

SEQ ID NO: 1330277 - RNA, 23 nt, Human
aggugcacugggaggcuccccuu

SEQ ID NO: 1330278 - RNA, 12 nt, Human
uguaccauguac

SEQ ID NO: 1330279 - RNA, 17 nt, Human
uguaccauguacaugaa

SEQ ID NO: 1330280 - RNA, 18 nt, Human
uguagaggagaaacugga

SEQ ID NO: 1330281 - RNA, 23 nt, Human
uguaauuucaggaggaauacuga

SEQ ID NO: 1330282 - RNA, 18 nt, Human
uguaccaaccauccaauu

SEQ ID NO: 1330283 - RNA, 19 nt, Human
uguaauuucaggaggaaua

SEQ ID NO: 1330284 - RNA, 15 nt, Human
uguaccaagaaucuu

SEQ ID NO: 1330285 - RNA, 11 nt, Human
uguaccaguua

SEQ ID NO: 1330286 - RNA, 12 nt, Human
uguaccaguuaa

SEQ ID NO: 1330287 - RNA, 14 nt, Human
uguaccaguuaauu

SEQ ID NO: 1330288 - RNA, 15 nt, Human
uguaccaguuaauuu

SEQ ID NO: 1330289 - RNA, 21 nt, Human
uguaccaguuaauuuuuccaa

SEQ ID NO: 1330290 - RNA, 22 nt, Human
uguaccaguuaauuuuuccaac

SEQ ID NO: 1330291 - RNA, 23 nt, Human
uguaccaguuaauuuuuccaacu

SEQ ID NO: 1330292 - RNA, 23 nt, Human
aguaaggaauuuuauuuuuuucu

SEQ ID NO: 1330293 - RNA, 20 nt, Human
aguaaaacaaacaauaccug

SEQ ID NO: 1330294 - RNA, 16 nt, Human
aguaaaacaaacaaua

SEQ ID NO: 1330295 - RNA, 19 nt, Human
aguaaaacaaacaauaccu

SEQ ID NO: 1330296 - RNA, 22 nt, Human
aguaagggcacugacggacuca

SEQ ID NO: 1330297 - RNA, 22 nt, Human
aguaauaugccugcuauuugaa

SEQ ID NO: 1330298 - RNA, 10 nt, Human
agguuuucag

SEQ ID NO: 1330299 - RNA, 22 nt, Human
agguuuuccucuucuauuuugu

SEQ ID NO: 1330300 - RNA, 21 nt, Human
uguaauuauaucuaaaauauu

SEQ ID NO: 1330301 - RNA, 12 nt, Human
aguaaaaauaaa

SEQ ID NO: 1330302 - RNA, 15 nt, Human
aguaaaaauaaaauu

SEQ ID NO: 1330303 - RNA, 22 nt, Human
aguacacaauaagcaaaaacaa

SEQ ID NO: 1330304 - RNA, 21 nt, Human
aguacacaauaagcaaaaaca

SEQ ID NO: 1330305 - RNA, 18 nt, Human
aguacacaauaagcaaaa

SEQ ID NO: 1330306 - RNA, 17 nt, Human
aguacacaauaagcaaa

SEQ ID NO: 1330307 - RNA, 16 nt, Human
aguacacaauaagcaa

SEQ ID NO: 1330308 - RNA, 15 nt, Human
aguaauuugaggaca

SEQ ID NO: 1330309 - RNA, 21 nt, Human
aguaauuuguuuaaaaaguaa

SEQ ID NO: 1330310 - RNA, 15 nt, Human
aguaauuuguagauu

SEQ ID NO: 1330311 - RNA, 21 nt, Human
aguaauccaagcaaaugugaa

SEQ ID NO: 1330312 - RNA, 15 nt, Human
aguaauccaagcaaa

SEQ ID NO: 1330313 - RNA, 22 nt, Human
aguaaucaaucuacucaaagca

SEQ ID NO: 1330314 - RNA, 19 nt, Human
aguacuuuuggcauuuuac

SEQ ID NO: 1330315 - RNA, 13 nt, Human
aguacuuugugca

SEQ ID NO: 1330316 - RNA, 15 nt, Human
aguacuuugugcauu

SEQ ID NO: 1330317 - RNA, 16 nt, Human
aguacuuugugcauuc

SEQ ID NO: 1330318 - RNA, 20 nt, Human
aguacacagcaccagaaugu

SEQ ID NO: 1330319 - RNA, 14 nt, Human
aguacacucugcug

SEQ ID NO: 1330320 - RNA, 15 nt, Human
aguacacucugcugu

SEQ ID NO: 1330321 - RNA, 17 nt, Human
aguacacucugcuguuu

SEQ ID NO: 1330322 - RNA, 22 nt, Human
aguagagacgagguuucacugu

SEQ ID NO: 1330323 - RNA, 19 nt, Human
aguagaagucucuuccagu

SEQ ID NO: 1330324 - RNA, 13 nt, Human
aguagagacaggg

SEQ ID NO: 1330325 - RNA, 12 nt, Human
aguagagacagg

SEQ ID NO: 1330326 - RNA, 12 nt, Human
aguagaaaucau

SEQ ID NO: 1330327 - RNA, 19 nt, Human
aguagauaggccaugggca

SEQ ID NO: 1330328 - RNA, 21 nt, Human
aguagaugcauuuggguccag

SEQ ID NO: 1330329 - RNA, 23 nt, Human
aguagaugcauuuggguccagga

SEQ ID NO: 1330330 - RNA, 22 nt, Human
aguagaugcauuuggguccagg

SEQ ID NO: 1330331 - RNA, 22 nt, Human
uguagguuauuaugauuagcuu

SEQ ID NO: 1330332 - RNA, 14 nt, Human
uguagguugcacac

SEQ ID NO: 1330333 - RNA, 20 nt, Human
uguaggagagguugucugug

SEQ ID NO: 1330334 - RNA, 13 nt, Human
aguauuucuauga

SEQ ID NO: 1330335 - RNA, 15 nt, Human
aguauuucuaugaaa

SEQ ID NO: 1330336 - RNA, 13 nt, Human
aguauguauuauu

SEQ ID NO: 1330337 - RNA, 23 nt, Human
aguaugugggcagauuuucagca

SEQ ID NO: 1330338 - RNA, 17 nt, Human
aguauaaagaauugugg

SEQ ID NO: 1330339 - RNA, 16 nt, Human
aguauuucuaugaaau

SEQ ID NO: 1330340 - RNA, 17 nt, Human
aguauuugggaagugaa

SEQ ID NO: 1330341 - RNA, 19 nt, Human
agucacauuccugaacagg

SEQ ID NO: 1330342 - RNA, 20 nt, Human
agucacauuccugaacagga

SEQ ID NO: 1330343 - RNA, 21 nt, Human
aguauuugggaagugaagacu

SEQ ID NO: 1330344 - RNA, 13 nt, Human
agucacugcacag

SEQ ID NO: 1330345 - RNA, 23 nt, Human
agucacugagaccaaggcuuucu

SEQ ID NO: 1330346 - RNA, 13 nt, Human
agucacugagacc

SEQ ID NO: 1330347 - RNA, 22 nt, Human
ugucagcugcaagguacucugg

SEQ ID NO: 1330348 - RNA, 23 nt, Human
ugucagcugcaagguacucuggu

SEQ ID NO: 1330349 - RNA, 23 nt, Human
ugucagggaguguucccuaucca

SEQ ID NO: 1330350 - RNA, 16 nt, Human
ugucaggagugugugu

SEQ ID NO: 1330351 - RNA, 13 nt, Human
ugucaggauugcg

SEQ ID NO: 1330352 - RNA, 19 nt, Human
ugucaggauugcgagagau

SEQ ID NO: 1330353 - RNA, 21 nt, Human
ugucaggauugcgagagaugu

SEQ ID NO: 1330354 - RNA, 22 nt, Human
ugucaggauugcgagagaugug

SEQ ID NO: 1330355 - RNA, 14 nt, Human
ugucaggcacuggg

SEQ ID NO: 1330356 - RNA, 23 nt, Human
ugucaggauugcgagagaugugu

SEQ ID NO: 1330357 - RNA, 20 nt, Human
ugucaguaccuucaaacuag

SEQ ID NO: 1330358 - RNA, 19 nt, Human
ugucagggaguguucccua

SEQ ID NO: 1330359 - RNA, 17 nt, Human
uguauuuuuaguagaga

SEQ ID NO: 1330360 - RNA, 13 nt, Human
uguauuccaagac

SEQ ID NO: 1330361 - RNA, 15 nt, Human
uguauuccaagacau

SEQ ID NO: 1330362 - RNA, 20 nt, Human
uguauuccaagacaugucug

SEQ ID NO: 1330363 - RNA, 21 nt, Human
uguauuccaagacaugucugu

SEQ ID NO: 1330364 - RNA, 14 nt, Human
uguauucagacaga

SEQ ID NO: 1330365 - RNA, 14 nt, Human
uguauucagcuuua

SEQ ID NO: 1330366 - RNA, 18 nt, Human
uguauucagacagaugag

SEQ ID NO: 1330367 - RNA, 15 nt, Human
uguagguugcacacu

SEQ ID NO: 1330368 - RNA, 18 nt, Human
uguagguugcacacuuug

SEQ ID NO: 1330369 - RNA, 20 nt, Human
uguagguugcacacuuuggu

SEQ ID NO: 1330370 - RNA, 16 nt, Human
uguaguaaauaaugcu

SEQ ID NO: 1330371 - RNA, 17 nt, Human
uguaguaaauaaugcuu

SEQ ID NO: 1330372 - RNA, 18 nt, Human
uguaguaaauaaugcuuu

SEQ ID NO: 1330373 - RNA, 21 nt, Human
uguaguaaauaaugcuuugaa

SEQ ID NO: 1330374 - RNA, 14 nt, Human
uguaguaacacuaa

SEQ ID NO: 1330375 - RNA, 15 nt, Human
uguaguaacacuaau

SEQ ID NO: 1330376 - RNA, 17 nt, Human
uguaguaacacuaauau

SEQ ID NO: 1330377 - RNA, 20 nt, Human
uguaguaacacuaauauauu

SEQ ID NO: 1330378 - RNA, 19 nt, Human
uguaguaaucugcauuauu

SEQ ID NO: 1330379 - RNA, 14 nt, Human
uguaguaauugaca

SEQ ID NO: 1330380 - RNA, 15 nt, Human
uguaguaauugacau

SEQ ID NO: 1330381 - RNA, 16 nt, Human
uguaguaauugacaug

SEQ ID NO: 1330382 - RNA, 18 nt, Human
uguaguaauugacaugug

SEQ ID NO: 1330383 - RNA, 18 nt, Human
uguauuauuuacauuuaa

SEQ ID NO: 1330384 - RNA, 21 nt, Human
uguauuauuuacauuuaauag

SEQ ID NO: 1330385 - RNA, 16 nt, Human
ugucaagauucagcua

SEQ ID NO: 1330386 - RNA, 15 nt, Human
ugucaagauucagcu

SEQ ID NO: 1330387 - RNA, 21 nt, Human
ugucaagaauagcauuguaaa

SEQ ID NO: 1330388 - RNA, 20 nt, Human
ugucaaucagccuaguugau

SEQ ID NO: 1330389 - RNA, 15 nt, Human
ugucaaucuguccgu

SEQ ID NO: 1330390 - RNA, 23 nt, Human
aguaguuaucauguuaguaauac

SEQ ID NO: 1330391 - RNA, 17 nt, Human
aguaguuaucauguuag

SEQ ID NO: 1330392 - RNA, 16 nt, Human
aguaguuaucauguua

SEQ ID NO: 1330393 - RNA, 15 nt, Human
aguaguuaucauguu

SEQ ID NO: 1330394 - RNA, 12 nt, Human
aguaguucacau

SEQ ID NO: 1330395 - RNA, 15 nt, Human
aguaguucucaaagu

SEQ ID NO: 1330396 - RNA, 14 nt, Human
aguaguuaucaugu

SEQ ID NO: 1330397 - RNA, 13 nt, Human
aguaguuaucaug

SEQ ID NO: 1330398 - RNA, 12 nt, Human
aguaguuaucau

SEQ ID NO: 1330399 - RNA, 13 nt, Human
aguaggagcccag

SEQ ID NO: 1330400 - RNA, 17 nt, Human
aguaggcauuuuuacca

SEQ ID NO: 1330401 - RNA, 22 nt, Human
aguaggcauuuuuaccaucacu

SEQ ID NO: 1330402 - RNA, 21 nt, Human
aguagucccugcacagugacu

SEQ ID NO: 1330403 - RNA, 12 nt, Human
aguaguccugug

SEQ ID NO: 1330404 - RNA, 13 nt, Human
aguaguccuguga

SEQ ID NO: 1330405 - RNA, 14 nt, Human
aguaguccugugaa

SEQ ID NO: 1330406 - RNA, 22 nt, Human
aguccaggcuuuuuuaucaugu

SEQ ID NO: 1330407 - RNA, 14 nt, Human
aguccaggcugccg

SEQ ID NO: 1330408 - RNA, 17 nt, Human
aguccaggcugccgugg

SEQ ID NO: 1330409 - RNA, 18 nt, Human
aguccaggcugccguggg

SEQ ID NO: 1330410 - RNA, 12 nt, Human
agucaggaaagg

SEQ ID NO: 1330411 - RNA, 17 nt, Human
agucaggcccaggcacu

SEQ ID NO: 1330412 - RNA, 22 nt, Human
aguccaggaugcuaacaucuaa

SEQ ID NO: 1330413 - RNA, 14 nt, Human
agucccugccugga

SEQ ID NO: 1330414 - RNA, 19 nt, Human
agucccugcacagugacuu

SEQ ID NO: 1330415 - RNA, 21 nt, Human
agucccugcacagugacuucu

SEQ ID NO: 1330416 - RNA, 15 nt, Human
agucccugccuggac

SEQ ID NO: 1330417 - RNA, 21 nt, Human
agucccugccuggaccagccu

SEQ ID NO: 1330418 - RNA, 22 nt, Human
agucccugccuggaccagccuc

SEQ ID NO: 1330419 - RNA, 23 nt, Human
agucccugccuggaccagccucu

SEQ ID NO: 1330420 - RNA, 21 nt, Human
aguccggccccaguacacagg

SEQ ID NO: 1330421 - RNA, 15 nt, Human
aguccgucaaaacag

SEQ ID NO: 1330422 - RNA, 14 nt, Human
aguccgucaaaaca

SEQ ID NO: 1330423 - RNA, 23 nt, Human
aguccgugggacgggaugguucu

SEQ ID NO: 1330424 - RNA, 13 nt, Human
aguccgugggacg

SEQ ID NO: 1330425 - RNA, 21 nt, Human
agucgugaccugcuaggccag

SEQ ID NO: 1330426 - RNA, 12 nt, Human
agucgugccugu

SEQ ID NO: 1330427 - RNA, 13 nt, Human
agucgugccugug

SEQ ID NO: 1330428 - RNA, 14 nt, Human
agucgugccugugu

SEQ ID NO: 1330429 - RNA, 15 nt, Human
agucgugccuguguc

SEQ ID NO: 1330430 - RNA, 17 nt, Human
agucgugaccugcuagg

SEQ ID NO: 1330431 - RNA, 17 nt, Human
agucguggggugugcug

SEQ ID NO: 1330432 - RNA, 13 nt, Human
agucuagauucuc

SEQ ID NO: 1330433 - RNA, 14 nt, Human
agucuagauucucu

SEQ ID NO: 1330434 - RNA, 20 nt, Human
agucuagauucucuggcugu

SEQ ID NO: 1330435 - RNA, 16 nt, Human
agucuagauucucugg

SEQ ID NO: 1330436 - RNA, 21 nt, Human
agucucacaugauuccagcca

SEQ ID NO: 1330437 - RNA, 22 nt, Human
agucucacaugauuccagccau

SEQ ID NO: 1330438 - RNA, 23 nt, Human
agucucacaugauuccagccauc

SEQ ID NO: 1330439 - RNA, 24 nt, Human
agucucacaugauuccagccauca

SEQ ID NO: 1330440 - RNA, 18 nt, Human
agucguggggugugcugg

SEQ ID NO: 1330441 - RNA, 19 nt, Human
agucguggggugugcuggg

SEQ ID NO: 1330442 - RNA, 20 nt, Human
agucguggggugugcuggga

SEQ ID NO: 1330443 - RNA, 21 nt, Human
agucguggggugugcugggag

SEQ ID NO: 1330444 - RNA, 20 nt, Human
agucuaaagauggaguuucu

SEQ ID NO: 1330445 - RNA, 21 nt, Human
agucuaaagauggaguuucua

SEQ ID NO: 1330446 - RNA, 22 nt, Human
agucuaaagauggaguuucuaa

SEQ ID NO: 1330447 - RNA, 23 nt, Human
agucuagauguuuauucuucuag

SEQ ID NO: 1330448 - RNA, 14 nt, Human
agucuagauucaaa

SEQ ID NO: 1330449 - RNA, 15 nt, Human
agucuagauucaaag

SEQ ID NO: 1330450 - RNA, 18 nt, Human
agucuagauucaaagguu

SEQ ID NO: 1330451 - RNA, 20 nt, Human
agucuagauucaaagguucu

SEQ ID NO: 1330452 - RNA, 21 nt, Human
agucuagauucaaagguucua

SEQ ID NO: 1330453 - RNA, 22 nt, Human
agucuagauucaaagguucuag

SEQ ID NO: 1330454 - RNA, 16 nt, Human
agucaggaaagagaac

SEQ ID NO: 1330455 - RNA, 23 nt, Human
agucagagccaugucuucucccu

SEQ ID NO: 1330456 - RNA, 16 nt, Human
agucagacagaugugg

SEQ ID NO: 1330457 - RNA, 20 nt, Human
ugucguggacacacacagac

SEQ ID NO: 1330458 - RNA, 13 nt, Human
ugucgccucugca

SEQ ID NO: 1330459 - RNA, 18 nt, Human
ugucgauuagacuggaca

SEQ ID NO: 1330460 - RNA, 20 nt, Human
ugucgauuagacuggacagc

SEQ ID NO: 1330461 - RNA, 23 nt, Human
ugucgauuagacuggacagcuug

SEQ ID NO: 1330462 - RNA, 16 nt, Human
ugucguaaagauuugg

SEQ ID NO: 1330463 - RNA, 17 nt, Human
ugucguuaaaaacagau

SEQ ID NO: 1330464 - RNA, 16 nt, Human
uguccuacagaaaaac

SEQ ID NO: 1330465 - RNA, 18 nt, Human
uguccuacagaaaaaccu

SEQ ID NO: 1330466 - RNA, 13 nt, Human
uguccuuucccuu

SEQ ID NO: 1330467 - RNA, 14 nt, Human
uguccuuucccuuc

SEQ ID NO: 1330468 - RNA, 22 nt, Human
uguccuaauaauaucccacugg

SEQ ID NO: 1330469 - RNA, 12 nt, Human
uguccuacagaa

SEQ ID NO: 1330470 - RNA, 13 nt, Human
uguccuacagaaa

SEQ ID NO: 1330471 - RNA, 14 nt, Human
uguccuacagaaaa

SEQ ID NO: 1330472 - RNA, 15 nt, Human
uguccuacagaaaaa

SEQ ID NO: 1330473 - RNA, 15 nt, Human
ugucgcccaggcugg

SEQ ID NO: 1330474 - RNA, 16 nt, Human
ugucgcccaggcugga

SEQ ID NO: 1330475 - RNA, 14 nt, Human
ugucgauuagacug

SEQ ID NO: 1330476 - RNA, 23 nt, Human
uguccuuucccuucaguacccuc

SEQ ID NO: 1330477 - RNA, 13 nt, Human
uguccuuucuaga

SEQ ID NO: 1330478 - RNA, 14 nt, Human
uguccuuucuagag

SEQ ID NO: 1330479 - RNA, 18 nt, Human
uguccuuucuagagcacu

SEQ ID NO: 1330480 - RNA, 19 nt, Human
uguccuuucuagagcacug

SEQ ID NO: 1330481 - RNA, 13 nt, Human
uguccuuuucaua

SEQ ID NO: 1330482 - RNA, 22 nt, Human
uguccuuuucauaggucugaaa

SEQ ID NO: 1330483 - RNA, 15 nt, Human
uguccuuuugcaaag

SEQ ID NO: 1330484 - RNA, 15 nt, Human
uguccuuuuuccucu

SEQ ID NO: 1330485 - RNA, 16 nt, Human
uguccuuuuuccucuc

SEQ ID NO: 1330486 - RNA, 17 nt, Human
uguccuuuuuccucucc

SEQ ID NO: 1330487 - RNA, 18 nt, Human
uguccuuuuuccucucca

SEQ ID NO: 1330488 - RNA, 21 nt, Human
uguccuuuuuccucuccacac

SEQ ID NO: 1330489 - RNA, 15 nt, Human
uguccgcuggguggu

SEQ ID NO: 1330490 - RNA, 20 nt, Human
uguccgcugggugguacccu

SEQ ID NO: 1330491 - RNA, 22 nt, Human
uguccgcugggugguacccucu

SEQ ID NO: 1330492 - RNA, 23 nt, Human
uguccgcugggugguacccucug

SEQ ID NO: 1330493 - RNA, 13 nt, Human
ugucauuuuggua

SEQ ID NO: 1330494 - RNA, 15 nt, Human
ugucauuuuuuuucu

SEQ ID NO: 1330495 - RNA, 16 nt, Human
uguccaaaaccgccag

SEQ ID NO: 1330496 - RNA, 15 nt, Human
uguccaaaacugccu

SEQ ID NO: 1330497 - RNA, 18 nt, Human
uguccaaaaccgccagcu

SEQ ID NO: 1330498 - RNA, 19 nt, Human
uguccaaaaccgccagcuc

SEQ ID NO: 1330499 - RNA, 20 nt, Human
uguccaaaaccgccagcucu

SEQ ID NO: 1330500 - RNA, 21 nt, Human
uguccaaaaccgccagcucug

SEQ ID NO: 1330501 - RNA, 22 nt, Human
uguccaaaaccgccagcucugu

SEQ ID NO: 1330502 - RNA, 23 nt, Human
uguccaaaaccgccagcucuguu

SEQ ID NO: 1330503 - RNA, 15 nt, Human
uguccgacucuucug

SEQ ID NO: 1330504 - RNA, 20 nt, Human
ugguaaggggaauugaggac

SEQ ID NO: 1330505 - RNA, 18 nt, Human
ugguaagcaacauggcuu

SEQ ID NO: 1330506 - RNA, 19 nt, Human
ugguaagcaacauggcuuu

SEQ ID NO: 1330507 - RNA, 20 nt, Human
ugguaagcaacauggcuuug

SEQ ID NO: 1330508 - RNA, 17 nt, Human
ugguaagcuauguccca

SEQ ID NO: 1330509 - RNA, 14 nt, Human
ugguaauauugacu

SEQ ID NO: 1330510 - RNA, 14 nt, Human
uggguggcuacucu

SEQ ID NO: 1330511 - RNA, 19 nt, Human
uggguggcuacucugugcc

SEQ ID NO: 1330512 - RNA, 20 nt, Human
uggguggcuacucugugcca

SEQ ID NO: 1330513 - RNA, 23 nt, Human
uggguggcuacucugugccagag

SEQ ID NO: 1330514 - RNA, 14 nt, Human
uggguggcucacuc

SEQ ID NO: 1330515 - RNA, 17 nt, Human
ugguacucccucucagg

SEQ ID NO: 1330516 - RNA, 20 nt, Human
ugguagcuuuucccuucuuu

SEQ ID NO: 1330517 - RNA, 22 nt, Human
ugguacucccucucaggaucca

SEQ ID NO: 1330518 - RNA, 17 nt, Human
ugguacugacuuugcuu

SEQ ID NO: 1330519 - RNA, 21 nt, Human
ugguacugacuuugcuugcuu

SEQ ID NO: 1330520 - RNA, 17 nt, Human
ugguacuguacagcugg

SEQ ID NO: 1330521 - RNA, 19 nt, Human
ugguacuguacagcuggcu

SEQ ID NO: 1330522 - RNA, 21 nt, Human
ugguacuguacagcuggcucu

SEQ ID NO: 1330523 - RNA, 17 nt, Human
ugguaggaauagcaugu

SEQ ID NO: 1330524 - RNA, 21 nt, Human
ugguagcuuuucccuucuuuu

SEQ ID NO: 1330525 - RNA, 22 nt, Human
uggucacaggacucugccuccu

SEQ ID NO: 1330526 - RNA, 23 nt, Human
uggucacaggacucugccuccuc

SEQ ID NO: 1330527 - RNA, 16 nt, Human
ugguaggaccaagcau

SEQ ID NO: 1330528 - RNA, 22 nt, Human
ugguaggaccaagcaucuuggg

SEQ ID NO: 1330529 - RNA, 16 nt, Human
aggguggcagcaacaa

SEQ ID NO: 1330530 - RNA, 15 nt, Human
aggguggcagcaaca

SEQ ID NO: 1330531 - RNA, 13 nt, Human
aggguggcagcaa

SEQ ID NO: 1330532 - RNA, 11 nt, Human
aggguggcagc

SEQ ID NO: 1330533 - RNA, 12 nt, Human
agggugggaagg

SEQ ID NO: 1330534 - RNA, 22 nt, Human
ugggucuaggacacaguuccug

SEQ ID NO: 1330535 - RNA, 21 nt, Human
ugggucuaggacacaguuccu

SEQ ID NO: 1330536 - RNA, 23 nt, Human
ugggucucaccggcucucaccug

SEQ ID NO: 1330537 - RNA, 21 nt, Human
ugggucugggagucacacagu

SEQ ID NO: 1330538 - RNA, 18 nt, Human
ugggucucaccggcucuc

SEQ ID NO: 1330539 - RNA, 15 nt, Human
aggggcuaccaggaa

SEQ ID NO: 1330540 - RNA, 14 nt, Human
aggggcuaccagga

SEQ ID NO: 1330541 - RNA, 17 nt, Human
aggggcuaccaggaaag

SEQ ID NO: 1330542 - RNA, 13 nt, Human
aggggcucccucc

SEQ ID NO: 1330543 - RNA, 15 nt, Human
aggggcucccuccgc

SEQ ID NO: 1330544 - RNA, 22 nt, Human
agggggaaggugggguccugga

SEQ ID NO: 1330545 - RNA, 16 nt, Human
agggggaauggcagca

SEQ ID NO: 1330546 - RNA, 15 nt, Human
agggggagagggcug

SEQ ID NO: 1330547 - RNA, 16 nt, Human
agggggagagggcugc

SEQ ID NO: 1330548 - RNA, 21 nt, Human
agggggagccccuucugcuca

SEQ ID NO: 1330549 - RNA, 22 nt, Human
agggggagccccuucugcucag

SEQ ID NO: 1330550 - RNA, 22 nt, Human
agggggagcugggccuggucuc

SEQ ID NO: 1330551 - RNA, 18 nt, Human
aggggccuggcagccgug

SEQ ID NO: 1330552 - RNA, 23 nt, Human
aggggccuggcagccgugccuuc

SEQ ID NO: 1330553 - RNA, 19 nt, Human
ugggguauggauucuaaaa

SEQ ID NO: 1330554 - RNA, 20 nt, Human
ugggguauggauucuaaaau

SEQ ID NO: 1330555 - RNA, 19 nt, Human
aggggagaccucagaagua

SEQ ID NO: 1330556 - RNA, 21 nt, Human
aggggagaccucagaaguaaa

SEQ ID NO: 1330557 - RNA, 16 nt, Human
agggggcaagaggaau

SEQ ID NO: 1330558 - RNA, 19 nt, Human
agggggucguggagagcua

SEQ ID NO: 1330559 - RNA, 14 nt, Human
aggggcucccuccg

SEQ ID NO: 1330560 - RNA, 23 nt, Human
agggggucguggagagcuaggag

SEQ ID NO: 1330561 - RNA, 19 nt, Human
agggggauccgacugcuuu

SEQ ID NO: 1330562 - RNA, 20 nt, Human
agggggauccgacugcuuug

SEQ ID NO: 1330563 - RNA, 11 nt, Human
agggggucugg

SEQ ID NO: 1330564 - RNA, 15 nt, Human
agggggucuggcugg

SEQ ID NO: 1330565 - RNA, 16 nt, Human
agggggucuggcuggu

SEQ ID NO: 1330566 - RNA, 17 nt, Human
agggggucuggcuggug

SEQ ID NO: 1330567 - RNA, 23 nt, Human
agggggugauuagagggaggaga

SEQ ID NO: 1330568 - RNA, 13 nt, Human
aggggugggcugg

SEQ ID NO: 1330569 - RNA, 14 nt, Human
aggggugggcuggu

SEQ ID NO: 1330570 - RNA, 14 nt, Human
aggggugucuuggg

SEQ ID NO: 1330571 - RNA, 22 nt, Human
aggggugucuugggcagagcug

SEQ ID NO: 1330572 - RNA, 24 nt, Human
aggggugucuugggcagagcuggc

SEQ ID NO: 1330573 - RNA, 15 nt, Human
agggguguggcuccu

SEQ ID NO: 1330574 - RNA, 15 nt, Human
agggguuagagcagg

SEQ ID NO: 1330575 - RNA, 14 nt, Human
agggguuccucccc

SEQ ID NO: 1330576 - RNA, 15 nt, Human
agggguuccuccccu

SEQ ID NO: 1330577 - RNA, 17 nt, Human
agggguuccuccccucc

SEQ ID NO: 1330578 - RNA, 21 nt, Human
agggguuccuccccuccagcu

SEQ ID NO: 1330579 - RNA, 22 nt, Human
agggguuccuccccuccagcuc

SEQ ID NO: 1330580 - RNA, 17 nt, Human
aggguuaugauuaagua

SEQ ID NO: 1330581 - RNA, 12 nt, Human
agggugugugcu

SEQ ID NO: 1330582 - RNA, 20 nt, Human
agggugguucaacaaagaaa

SEQ ID NO: 1330583 - RNA, 15 nt, Human
uggucucgaacuccu

SEQ ID NO: 1330584 - RNA, 15 nt, Human
uggucucccuucucu

SEQ ID NO: 1330585 - RNA, 16 nt, Human
uggucuuguggaauug

SEQ ID NO: 1330586 - RNA, 18 nt, Human
ugguaggaauagcauguc

SEQ ID NO: 1330587 - RNA, 15 nt, Human
uggucagcccuaggg

SEQ ID NO: 1330588 - RNA, 19 nt, Human
uggucagcccuagggugga

SEQ ID NO: 1330589 - RNA, 22 nt, Human
uggucagcccuaggguggagag

SEQ ID NO: 1330590 - RNA, 19 nt, Human
uggucuaucuuugagcgcc

SEQ ID NO: 1330591 - RNA, 15 nt, Human
uggucucacccugga

SEQ ID NO: 1330592 - RNA, 17 nt, Human
uggucucacccuggagg

SEQ ID NO: 1330593 - RNA, 23 nt, Human
uggucucacccuggaggcaccug

SEQ ID NO: 1330594 - RNA, 18 nt, Human
uggucucaaacuccugac

SEQ ID NO: 1330595 - RNA, 23 nt, Human
uggucucaaacuccugaccucag

SEQ ID NO: 1330596 - RNA, 14 nt, Human
uggucucacccugg

SEQ ID NO: 1330597 - RNA, 20 nt, Human
agguauucguuaucuaauag

SEQ ID NO: 1330598 - RNA, 14 nt, Human
agguauuuaucuuu

SEQ ID NO: 1330599 - RNA, 15 nt, Human
aggucacauaaaacu

SEQ ID NO: 1330600 - RNA, 18 nt, Human
agguauucguuaucuaau

SEQ ID NO: 1330601 - RNA, 14 nt, Human
agguauuacacucu

SEQ ID NO: 1330602 - RNA, 13 nt, Human
agguauaccucac

SEQ ID NO: 1330603 - RNA, 18 nt, Human
aggucaccuuuauucugg

SEQ ID NO: 1330604 - RNA, 15 nt, Human
aggucacccuuugcu

SEQ ID NO: 1330605 - RNA, 19 nt, Human
aggucaccuuuauucuggc

SEQ ID NO: 1330606 - RNA, 23 nt, Human
agguccagcucuggaggggaggg

SEQ ID NO: 1330607 - RNA, 23 nt, Human
agguacuucaaauccuugaagau

SEQ ID NO: 1330608 - RNA, 22 nt, Human
agguacuguaugaucaaauguu

SEQ ID NO: 1330609 - RNA, 23 nt, Human
agguacuuucauauuuuaaacag

SEQ ID NO: 1330610 - RNA, 23 nt, Human
agguacuguaugaucaaauguuu

SEQ ID NO: 1330611 - RNA, 21 nt, Human
agguacuguaugaucaaaugu

SEQ ID NO: 1330612 - RNA, 19 nt, Human
agguacuguaugaucaaau

SEQ ID NO: 1330613 - RNA, 15 nt, Human
agguacuguaugauc

SEQ ID NO: 1330614 - RNA, 23 nt, Human
agguauaauucacauuguauuca

SEQ ID NO: 1330615 - RNA, 19 nt, Human
agguauaaguggugugugu

SEQ ID NO: 1330616 - RNA, 20 nt, Human
agguauaaguggugugugua

SEQ ID NO: 1330617 - RNA, 15 nt, Human
agguauaccucacuu

SEQ ID NO: 1330618 - RNA, 21 nt, Human
agguagaauguaaagcuuguc

SEQ ID NO: 1330619 - RNA, 14 nt, Human
agguagaauguaaa

SEQ ID NO: 1330620 - RNA, 22 nt, Human
agguagaauuaucuaauuuaua

SEQ ID NO: 1330621 - RNA, 19 nt, Human
agguagaauguaaagcuug

SEQ ID NO: 1330622 - RNA, 15 nt, Human
agguagucucacugc

SEQ ID NO: 1330623 - RNA, 14 nt, Human
uggggaaugaagau

SEQ ID NO: 1330624 - RNA, 15 nt, Human
uggggaaugaagaua

SEQ ID NO: 1330625 - RNA, 22 nt, Human
uggggaagagagccugcaggau

SEQ ID NO: 1330626 - RNA, 17 nt, Human
uggggaagagagccugc

SEQ ID NO: 1330627 - RNA, 16 nt, Human
uggggaagggccugcc

SEQ ID NO: 1330628 - RNA, 20 nt, Human
uggggaagguuaucagugcu

SEQ ID NO: 1330629 - RNA, 24 nt, Human
uggggaagacccauuccuucccag

SEQ ID NO: 1330630 - RNA, 18 nt, Human
uggggaagacaguggccc

SEQ ID NO: 1330631 - RNA, 15 nt, Human
uggggaagagagccu

SEQ ID NO: 1330632 - RNA, 18 nt, Human
ugggcuggaaucaggaau

SEQ ID NO: 1330633 - RNA, 15 nt, Human
ugggcuggaugagcu

SEQ ID NO: 1330634 - RNA, 16 nt, Human
ugggcuggaugagcuc

SEQ ID NO: 1330635 - RNA, 18 nt, Human
ugggcuggaugagcuccc

SEQ ID NO: 1330636 - RNA, 19 nt, Human
ugggcuggcaguccuggaa

SEQ ID NO: 1330637 - RNA, 22 nt, Human
uggggaccagcagccccacacc

SEQ ID NO: 1330638 - RNA, 15 nt, Human
uggggaccagcagcc

SEQ ID NO: 1330639 - RNA, 17 nt, Human
uggggacagagcagaac

SEQ ID NO: 1330640 - RNA, 17 nt, Human
ugggcugcccuggugcu

SEQ ID NO: 1330641 - RNA, 19 nt, Human
ugggcugcccuggugcugc

SEQ ID NO: 1330642 - RNA, 20 nt, Human
ugggcugcccuggugcugcc

SEQ ID NO: 1330643 - RNA, 21 nt, Human
ugggcugcccuggugcugcca

SEQ ID NO: 1330644 - RNA, 11 nt, Human
ugggcugaggg

SEQ ID NO: 1330645 - RNA, 20 nt, Human
agggccucaaaggcccgcuc

SEQ ID NO: 1330646 - RNA, 23 nt, Human
uggggcuaggaaauccagggugg

SEQ ID NO: 1330647 - RNA, 20 nt, Human
uggggcuagggggagccccu

SEQ ID NO: 1330648 - RNA, 22 nt, Human
uggggcucuaacgccugagccc

SEQ ID NO: 1330649 - RNA, 23 nt, Human
uggggcucuaacgccugagccca

SEQ ID NO: 1330650 - RNA, 24 nt, Human
uggggcucuaacgccugagcccag

SEQ ID NO: 1330651 - RNA, 19 nt, Human
uggggccgccgccucuuuc

SEQ ID NO: 1330652 - RNA, 17 nt, Human
uggggaguggggguggg

SEQ ID NO: 1330653 - RNA, 18 nt, Human
uggggaccugguacccuc

SEQ ID NO: 1330654 - RNA, 14 nt, Human
uggggacuuggccu

SEQ ID NO: 1330655 - RNA, 19 nt, Human
uggggacuuggccucucuc

SEQ ID NO: 1330656 - RNA, 16 nt, Human
uggggacuugugucug

SEQ ID NO: 1330657 - RNA, 23 nt, Human
uggggagacauaaccacugcuuc

SEQ ID NO: 1330658 - RNA, 18 nt, Human
uggggaguuuaggguggg

SEQ ID NO: 1330659 - RNA, 19 nt, Human
uggggaguuuagggugggg

SEQ ID NO: 1330660 - RNA, 16 nt, Human
uggggaguuaagaccu

SEQ ID NO: 1330661 - RNA, 17 nt, Human
uggggaguuaagaccug

SEQ ID NO: 1330662 - RNA, 18 nt, Human
uggggaguuaagaccugg

SEQ ID NO: 1330663 - RNA, 19 nt, Human
uggggaguuaagaccuggc

SEQ ID NO: 1330664 - RNA, 20 nt, Human
uggggaguuaagaccuggca

SEQ ID NO: 1330665 - RNA, 18 nt, Human
uggggguuguaaauuggc

SEQ ID NO: 1330666 - RNA, 12 nt, Human
uggggguuuuuu

SEQ ID NO: 1330667 - RNA, 20 nt, Human
ugggggaacucagauccagg

SEQ ID NO: 1330668 - RNA, 16 nt, Human
uggggcuugggggcuc

SEQ ID NO: 1330669 - RNA, 15 nt, Human
ugggggaaagcaaag

SEQ ID NO: 1330670 - RNA, 17 nt, Human
ugggggaaagcaaagca

SEQ ID NO: 1330671 - RNA, 20 nt, Human
ugggggaaagcaaagcacag

SEQ ID NO: 1330672 - RNA, 22 nt, Human
ugggggaaagcaaagcacagag

SEQ ID NO: 1330673 - RNA, 21 nt, Human
ugggggaaagcaaagcacaga

SEQ ID NO: 1330674 - RNA, 18 nt, Human
ugggggaacucagaucca

SEQ ID NO: 1330675 - RNA, 16 nt, Human
uggggcugguucugua

SEQ ID NO: 1330676 - RNA, 16 nt, Human
ugggauuuggucaaca

SEQ ID NO: 1330677 - RNA, 14 nt, Human
ugggauuugcugug

SEQ ID NO: 1330678 - RNA, 21 nt, Human
ugggauucuggacaggaugug

SEQ ID NO: 1330679 - RNA, 16 nt, Human
ugggauugagucugug

SEQ ID NO: 1330680 - RNA, 19 nt, Human
ugggauugagucugugcca

SEQ ID NO: 1330681 - RNA, 19 nt, Human
ugggaggugagaccaccuc

SEQ ID NO: 1330682 - RNA, 14 nt, Human
ugggaguacaaaag

SEQ ID NO: 1330683 - RNA, 20 nt, Human
ugggagguguuggcugcacg

SEQ ID NO: 1330684 - RNA, 23 nt, Human
ugggauucaggaaaaggccuggg

SEQ ID NO: 1330685 - RNA, 18 nt, Human
aggccuguuuggccucuc

SEQ ID NO: 1330686 - RNA, 16 nt, Human
aggccuguuuggccuc

SEQ ID NO: 1330687 - RNA, 17 nt, Human
ugggccagaauuucaaa

SEQ ID NO: 1330688 - RNA, 20 nt, Human
ugggccagaaguaccagacu

SEQ ID NO: 1330689 - RNA, 19 nt, Human
ugggcacccccagccuggg

SEQ ID NO: 1330690 - RNA, 20 nt, Human
ugggcacccccagccugggc

SEQ ID NO: 1330691 - RNA, 21 nt, Human
ugggcacccccagccugggcc

SEQ ID NO: 1330692 - RNA, 22 nt, Human
ugggcacccccagccugggccu

SEQ ID NO: 1330693 - RNA, 23 nt, Human
ugggcacccccagccugggccua

SEQ ID NO: 1330694 - RNA, 15 nt, Human
ugggcacccccagcc

SEQ ID NO: 1330695 - RNA, 16 nt, Human
ugggcacccccagccu

SEQ ID NO: 1330696 - RNA, 17 nt, Human
ugggcacccccagccug

SEQ ID NO: 1330697 - RNA, 18 nt, Human
ugggcacccccagccugg

SEQ ID NO: 1330698 - RNA, 21 nt, Human
ugggccagaaguaccagacua

SEQ ID NO: 1330699 - RNA, 18 nt, Human
ugggccagcuuuucaaac

SEQ ID NO: 1330700 - RNA, 18 nt, Human
ugggccagaauuucaaac

SEQ ID NO: 1330701 - RNA, 13 nt, Human
ugggccagacaug

SEQ ID NO: 1330702 - RNA, 18 nt, Human
ugggccagacaugccaca

SEQ ID NO: 1330703 - RNA, 19 nt, Human
ugggccagacaugccacaa

SEQ ID NO: 1330704 - RNA, 19 nt, Human
ugggccauucuccacagca

SEQ ID NO: 1330705 - RNA, 20 nt, Human
ugggccauucuccacagcaa

SEQ ID NO: 1330706 - RNA, 13 nt, Human
agggaggggcugu

SEQ ID NO: 1330707 - RNA, 15 nt, Human
agggagucugccagg

SEQ ID NO: 1330708 - RNA, 18 nt, Human
agggagucugccagggcc

SEQ ID NO: 1330709 - RNA, 12 nt, Human
agggcagcagcc

SEQ ID NO: 1330710 - RNA, 13 nt, Human
agggcagcagcca

SEQ ID NO: 1330711 - RNA, 14 nt, Human
agggcagcagccag

SEQ ID NO: 1330712 - RNA, 15 nt, Human
agggcagcagccagc

SEQ ID NO: 1330713 - RNA, 16 nt, Human
agggcagcagccagcc

SEQ ID NO: 1330714 - RNA, 17 nt, Human
agggcagcagccagccc

SEQ ID NO: 1330715 - RNA, 18 nt, Human
agggcagcagccagcccu

SEQ ID NO: 1330716 - RNA, 19 nt, Human
agggcagcagccagcccug

SEQ ID NO: 1330717 - RNA, 20 nt, Human
agggcagcagccagcccugc

SEQ ID NO: 1330718 - RNA, 21 nt, Human
agggcagcagccagcccugcc

SEQ ID NO: 1330719 - RNA, 22 nt, Human
agggcagcagccagcccugccu

SEQ ID NO: 1330720 - RNA, 23 nt, Human
agggcagcagccagcccugccug

SEQ ID NO: 1330721 - RNA, 15 nt, Human
ugggcccacaccucc

SEQ ID NO: 1330722 - RNA, 20 nt, Human
ugggcccacaccuccuuccc

SEQ ID NO: 1330723 - RNA, 16 nt, Human
ugggcccacaccuccu

SEQ ID NO: 1330724 - RNA, 15 nt, Human
ugggcccaggccuca

SEQ ID NO: 1330725 - RNA, 16 nt, Human
ugggccccacccucgg

SEQ ID NO: 1330726 - RNA, 14 nt, Human
ugggccccacccuc

SEQ ID NO: 1330727 - RNA, 12 nt, Human
agggcccagagc

SEQ ID NO: 1330728 - RNA, 13 nt, Human
agggcccagagcc

SEQ ID NO: 1330729 - RNA, 14 nt, Human
agggcccagagccc

SEQ ID NO: 1330730 - RNA, 15 nt, Human
agggcccagagccca

SEQ ID NO: 1330731 - RNA, 16 nt, Human
agggcccagagcccag

SEQ ID NO: 1330732 - RNA, 18 nt, Human
agggccggggaacuggcc

SEQ ID NO: 1330733 - RNA, 19 nt, Human
agggccggggaacuggcca

SEQ ID NO: 1330734 - RNA, 20 nt, Human
agggccggggaacuggccaa

SEQ ID NO: 1330735 - RNA, 21 nt, Human
agggccggggaacuggccaag

SEQ ID NO: 1330736 - RNA, 22 nt, Human
agggccggggaacuggccaagc

SEQ ID NO: 1330737 - RNA, 23 nt, Human
agggccggggaacuggccaagcu

SEQ ID NO: 1330738 - RNA, 14 nt, Human
agggcagcagggcu

SEQ ID NO: 1330739 - RNA, 15 nt, Human
agggcagcagggcua

SEQ ID NO: 1330740 - RNA, 13 nt, Human
agggcagccaggg

SEQ ID NO: 1330741 - RNA, 14 nt, Human
agggcagccaggga

SEQ ID NO: 1330742 - RNA, 15 nt, Human
agggcagccagggag

SEQ ID NO: 1330743 - RNA, 19 nt, Human
agggcagccagggagagcc

SEQ ID NO: 1330744 - RNA, 21 nt, Human
agggcagccagggagagccca

SEQ ID NO: 1330745 - RNA, 22 nt, Human
agggcagccagggagagcccag

SEQ ID NO: 1330746 - RNA, 23 nt, Human
agggcagccagggagagcccagg

SEQ ID NO: 1330747 - RNA, 14 nt, Human
agggcagcgccagg

SEQ ID NO: 1330748 - RNA, 16 nt, Human
agggcagcgccaggcu

SEQ ID NO: 1330749 - RNA, 22 nt, Human
agggcagggaccacacccugua

SEQ ID NO: 1330750 - RNA, 12 nt, Human
agggcagggccc

SEQ ID NO: 1330751 - RNA, 17 nt, Human
agggcagggccccaggc

SEQ ID NO: 1330752 - RNA, 16 nt, Human
agggcaggugcuucag

SEQ ID NO: 1330753 - RNA, 16 nt, Human
agggcagggggccccu

SEQ ID NO: 1330754 - RNA, 15 nt, Human
agggcaguaccugag

SEQ ID NO: 1330755 - RNA, 18 nt, Human
agggcaguaccugagggu

SEQ ID NO: 1330756 - RNA, 22 nt, Human
agggcaguaccugagggucugu

SEQ ID NO: 1330757 - RNA, 20 nt, Human
agggcagucauuggcugucu

SEQ ID NO: 1330758 - RNA, 20 nt, Human
agggcagucgauagagcugu

SEQ ID NO: 1330759 - RNA, 18 nt, Human
agggccagccucuagagc

SEQ ID NO: 1330760 - RNA, 23 nt, Human
aggacagcccuucuuuccacaga

SEQ ID NO: 1330761 - RNA, 17 nt, Human
aggacagaugccuccuu

SEQ ID NO: 1330762 - RNA, 20 nt, Human
aggacagaugccuccuuccu

SEQ ID NO: 1330763 - RNA, 21 nt, Human
aggacagaugccuccuuccuc

SEQ ID NO: 1330764 - RNA, 15 nt, Human
aggacagcacagacu

SEQ ID NO: 1330765 - RNA, 18 nt, Human
ugcuugauagaaaugcca

SEQ ID NO: 1330766 - RNA, 13 nt, Human
ugcuugauagaaa

SEQ ID NO: 1330767 - RNA, 19 nt, Human
ugcuugaugggauucugga

SEQ ID NO: 1330768 - RNA, 20 nt, Human
ugcuugaugggauucuggac

SEQ ID NO: 1330769 - RNA, 22 nt, Human
ugcuugaugggauucuggacag

SEQ ID NO: 1330770 - RNA, 12 nt, Human
ugcuugauuuuu

SEQ ID NO: 1330771 - RNA, 16 nt, Human
ugcuugcauaagagcu

SEQ ID NO: 1330772 - RNA, 17 nt, Human
ugcuugcauaagagcuu

SEQ ID NO: 1330773 - RNA, 15 nt, Human
ugcuugcuuugaagu

SEQ ID NO: 1330774 - RNA, 23 nt, Human
ugcuugcuuuucaugcaaacucu

SEQ ID NO: 1330775 - RNA, 15 nt, Human
ugcuuggagcugagc

SEQ ID NO: 1330776 - RNA, 17 nt, Human
ugcuuggagcugagcaa

SEQ ID NO: 1330777 - RNA, 15 nt, Human
ugcuuguaacuaaaa

SEQ ID NO: 1330778 - RNA, 12 nt, Human
ugcuuuugccca

SEQ ID NO: 1330779 - RNA, 14 nt, Human
ugcuuuugcccauu

SEQ ID NO: 1330780 - RNA, 19 nt, Human
ugcuuuuggcaaaacucua

SEQ ID NO: 1330781 - RNA, 21 nt, Human
ugcuuuuggcaaaacucuacu

SEQ ID NO: 1330782 - RNA, 17 nt, Human
ugcuuuuggcggggagg

SEQ ID NO: 1330783 - RNA, 18 nt, Human
ugcuuuugcccauuuuga

SEQ ID NO: 1330784 - RNA, 19 nt, Human
uggaaaggugugagacugg

SEQ ID NO: 1330785 - RNA, 22 nt, Human
uggaaaggugugagacugggaa

SEQ ID NO: 1330786 - RNA, 13 nt, Human
uggaagguauuua

SEQ ID NO: 1330787 - RNA, 17 nt, Human
uggaagguauuuaauag

SEQ ID NO: 1330788 - RNA, 23 nt, Human
uggaaggggacacgugacagccg

SEQ ID NO: 1330789 - RNA, 16 nt, Human
aggagcuaaggcucua

SEQ ID NO: 1330790 - RNA, 17 nt, Human
aggagcuaaggcucuau

SEQ ID NO: 1330791 - RNA, 19 nt, Human
aggagcuaaggcucuauga

SEQ ID NO: 1330792 - RNA, 20 nt, Human
aggagcuaaggcucuaugag

SEQ ID NO: 1330793 - RNA, 16 nt, Human
uggaagcuuggggaag

SEQ ID NO: 1330794 - RNA, 12 nt, Human
uggaaggagcag

SEQ ID NO: 1330795 - RNA, 20 nt, Human
uggaaggcaagauugugucc

SEQ ID NO: 1330796 - RNA, 14 nt, Human
uggaaggagcagaa

SEQ ID NO: 1330797 - RNA, 13 nt, Human
uggaaggagcaga

SEQ ID NO: 1330798 - RNA, 11 nt, Human
uggaaggcaug

SEQ ID NO: 1330799 - RNA, 14 nt, Human
uggaaggcauggcg

SEQ ID NO: 1330800 - RNA, 16 nt, Human
uggaagggaggugggc

SEQ ID NO: 1330801 - RNA, 19 nt, Human
uggaaaguacacucugcug

SEQ ID NO: 1330802 - RNA, 20 nt, Human
uggaaaguacacucugcugu

SEQ ID NO: 1330803 - RNA, 21 nt, Human
uggaagauggggaccagcagc

SEQ ID NO: 1330804 - RNA, 14 nt, Human
uggaagauagcugu

SEQ ID NO: 1330805 - RNA, 16 nt, Human
uggaagauagcuguga

SEQ ID NO: 1330806 - RNA, 18 nt, Human
uggaagauagcugugacu

SEQ ID NO: 1330807 - RNA, 21 nt, Human
uggaagauccugcgggugggg

SEQ ID NO: 1330808 - RNA, 13 nt, Human
uggaagauccugc

SEQ ID NO: 1330809 - RNA, 23 nt, Human
uggaagauggggaccagcagccc

SEQ ID NO: 1330810 - RNA, 19 nt, Human
aggaucccaugagcuccuu

SEQ ID NO: 1330811 - RNA, 14 nt, Human
aggauagaugcugg

SEQ ID NO: 1330812 - RNA, 14 nt, Human
aggauccggaaaga

SEQ ID NO: 1330813 - RNA, 16 nt, Human
aggauccggaaagaag

SEQ ID NO: 1330814 - RNA, 17 nt, Human
aggaggaaaucccuuca

SEQ ID NO: 1330815 - RNA, 23 nt, Human
aggagcuuugacucaggagccug

SEQ ID NO: 1330816 - RNA, 15 nt, Human
aggauaccauauaca

SEQ ID NO: 1330817 - RNA, 22 nt, Human
aggauaccauauacagcucaga

SEQ ID NO: 1330818 - RNA, 18 nt, Human
aggauacgacaguacacu

SEQ ID NO: 1330819 - RNA, 20 nt, Human
aggauacgacaguacacugu

SEQ ID NO: 1330820 - RNA, 18 nt, Human
aggauacuauauuuuagg

SEQ ID NO: 1330821 - RNA, 18 nt, Human
aggauacuggcacagagg

SEQ ID NO: 1330822 - RNA, 23 nt, Human
aggauagaaguauaccugauuuu

SEQ ID NO: 1330823 - RNA, 14 nt, Human
aggauagagacugg

SEQ ID NO: 1330824 - RNA, 21 nt, Human
aggagcuaaggcucuaugagu

SEQ ID NO: 1330825 - RNA, 12 nt, Human
aggagcuaccug

SEQ ID NO: 1330826 - RNA, 14 nt, Human
aggagcuaccugug

SEQ ID NO: 1330827 - RNA, 15 nt, Human
aggagcuaccugugu

SEQ ID NO: 1330828 - RNA, 16 nt, Human
aggagcuaccugugug

SEQ ID NO: 1330829 - RNA, 17 nt, Human
aggagcuaccugugugg

SEQ ID NO: 1330830 - RNA, 18 nt, Human
aggagcuaccugugugga

SEQ ID NO: 1330831 - RNA, 23 nt, Human
aggagcuaccuguguggacagga

SEQ ID NO: 1330832 - RNA, 22 nt, Human
aggagcuaccuguguggacagg

SEQ ID NO: 1330833 - RNA, 14 nt, Human
aggagcuccagugu

SEQ ID NO: 1330834 - RNA, 22 nt, Human
aggagcuccaguguccugagcu

SEQ ID NO: 1330835 - RNA, 12 nt, Human
aggagcuccccu

SEQ ID NO: 1330836 - RNA, 15 nt, Human
aggagcuccccuccc

SEQ ID NO: 1330837 - RNA, 17 nt, Human
aggagcuccccucccca

SEQ ID NO: 1330838 - RNA, 20 nt, Human
aggagcuccccuccccaacu

SEQ ID NO: 1330839 - RNA, 23 nt, Human
aggagcucuuaacuacaguggcu

SEQ ID NO: 1330840 - RNA, 22 nt, Human
aggagcugacucacaccugaac

SEQ ID NO: 1330841 - RNA, 15 nt, Human
aggagcugauacuuu

SEQ ID NO: 1330842 - RNA, 21 nt, Human
aggagcuccccuccccaacug

SEQ ID NO: 1330843 - RNA, 12 nt, Human
aggagcugggga

SEQ ID NO: 1330844 - RNA, 20 nt, Human
aggagcuggggaucccuccc

SEQ ID NO: 1330845 - RNA, 21 nt, Human
aggagcuggggaucccucccc

SEQ ID NO: 1330846 - RNA, 17 nt, Human
aggagcuuugacucagg

SEQ ID NO: 1330847 - RNA, 18 nt, Human
aggagcuuugacucagga

SEQ ID NO: 1330848 - RNA, 19 nt, Human
aggagcuuugacucaggag

SEQ ID NO: 1330849 - RNA, 14 nt, Human
uggaccugccugca

SEQ ID NO: 1330850 - RNA, 15 nt, Human
uggaccugccugcau

SEQ ID NO: 1330851 - RNA, 20 nt, Human
uggacacacacagacuauuu

SEQ ID NO: 1330852 - RNA, 16 nt, Human
uggacacacacagacu

SEQ ID NO: 1330853 - RNA, 13 nt, Human
uggaauucuaaca

SEQ ID NO: 1330854 - RNA, 22 nt, Human
uggaauucuuagucacaaaaua

SEQ ID NO: 1330855 - RNA, 12 nt, Human
uggaauugauuu

SEQ ID NO: 1330856 - RNA, 15 nt, Human
uggaauugauuugca

SEQ ID NO: 1330857 - RNA, 16 nt, Human
uggaauugauuugcau

SEQ ID NO: 1330858 - RNA, 17 nt, Human
uggaauugauuugcauu

SEQ ID NO: 1330859 - RNA, 18 nt, Human
uggaauugauuugcauug

SEQ ID NO: 1330860 - RNA, 19 nt, Human
uggaauugauuugcauuga

SEQ ID NO: 1330861 - RNA, 20 nt, Human
uggaauugauuugcauugaa

SEQ ID NO: 1330862 - RNA, 22 nt, Human
uggaauugauuugcauugaaca

SEQ ID NO: 1330863 - RNA, 23 nt, Human
uggaauugauuugcauugaacac

SEQ ID NO: 1330864 - RNA, 16 nt, Human
uggacaagcuucugag

SEQ ID NO: 1330865 - RNA, 17 nt, Human
uggacaagcuucugaga

SEQ ID NO: 1330866 - RNA, 19 nt, Human
uggacaagcuucugagacg

SEQ ID NO: 1330867 - RNA, 19 nt, Human
aggcaaaauugcaaaucuu

SEQ ID NO: 1330868 - RNA, 20 nt, Human
aggcaaaauugcaaaucuug

SEQ ID NO: 1330869 - RNA, 22 nt, Human
aggcaaacccaucaacaaaaau

SEQ ID NO: 1330870 - RNA, 13 nt, Human
aggcaaucauggu

SEQ ID NO: 1330871 - RNA, 14 nt, Human
uggagcucguggaa

SEQ ID NO: 1330872 - RNA, 22 nt, Human
aggcaaggcuguggaccaugga

SEQ ID NO: 1330873 - RNA, 16 nt, Human
uggagcuccagccuga

SEQ ID NO: 1330874 - RNA, 14 nt, Human
uggagcuccagccu

SEQ ID NO: 1330875 - RNA, 15 nt, Human
uggagcuccagccug

SEQ ID NO: 1330876 - RNA, 17 nt, Human
uggagcuccagccugac

SEQ ID NO: 1330877 - RNA, 20 nt, Human
aggcaccuaccaccacgccc

SEQ ID NO: 1330878 - RNA, 21 nt, Human
aggcaccuacacucaccugca

SEQ ID NO: 1330879 - RNA, 23 nt, Human
aggcaccuacacucaccugcacu

SEQ ID NO: 1330880 - RNA, 20 nt, Human
aggcaccucacaggccccag

SEQ ID NO: 1330881 - RNA, 14 nt, Human
aggcacccaucugu

SEQ ID NO: 1330882 - RNA, 14 nt, Human
uggagaagaacuga

SEQ ID NO: 1330883 - RNA, 15 nt, Human
uggacugugugcuca

SEQ ID NO: 1330884 - RNA, 14 nt, Human
uggacuugccucug

SEQ ID NO: 1330885 - RNA, 13 nt, Human
uggacuuuccugc

SEQ ID NO: 1330886 - RNA, 13 nt, Human
uggagaagaacug

SEQ ID NO: 1330887 - RNA, 14 nt, Human
uggagaacuagaga

SEQ ID NO: 1330888 - RNA, 19 nt, Human
uggacuuuccugcaacuca

SEQ ID NO: 1330889 - RNA, 14 nt, Human
uggacuuuccugca

SEQ ID NO: 1330890 - RNA, 18 nt, Human
uggacuuuccugcaacuc

SEQ ID NO: 1330891 - RNA, 17 nt, Human
aggccugacugccaagc

SEQ ID NO: 1330892 - RNA, 18 nt, Human
aggccugacugccaagcc

SEQ ID NO: 1330893 - RNA, 19 nt, Human
aggccugacugccaagcca

SEQ ID NO: 1330894 - RNA, 22 nt, Human
aggccugacugccaagccaugg

SEQ ID NO: 1330895 - RNA, 21 nt, Human
aggccugacugccaagccaug

SEQ ID NO: 1330896 - RNA, 14 nt, Human
uggcauagcucugg

SEQ ID NO: 1330897 - RNA, 15 nt, Human
uggcauagcucuggg

SEQ ID NO: 1330898 - RNA, 16 nt, Human
uggcauagcucugggg

SEQ ID NO: 1330899 - RNA, 13 nt, Human
uggcaucccuggg

SEQ ID NO: 1330900 - RNA, 14 nt, Human
uggcaucccugggc

SEQ ID NO: 1330901 - RNA, 15 nt, Human
uggcaucccugggcc

SEQ ID NO: 1330902 - RNA, 16 nt, Human
uggcaucccugggccu

SEQ ID NO: 1330903 - RNA, 20 nt, Human
uggcaucccugggccuuggg

SEQ ID NO: 1330904 - RNA, 21 nt, Human
uggcaucgcaccauucugacu

SEQ ID NO: 1330905 - RNA, 22 nt, Human
uggcaucgcaccauucugacuc

SEQ ID NO: 1330906 - RNA, 23 nt, Human
uggcaucgcaccauucugacucg

SEQ ID NO: 1330907 - RNA, 13 nt, Human
uggcaugagaaau

SEQ ID NO: 1330908 - RNA, 21 nt, Human
uggcaugagaaauacaaaaau

SEQ ID NO: 1330909 - RNA, 18 nt, Human
uggcaugagaaauacaaa

SEQ ID NO: 1330910 - RNA, 12 nt, Human
uggccacagcca

SEQ ID NO: 1330911 - RNA, 13 nt, Human
uggccacagccag

SEQ ID NO: 1330912 - RNA, 14 nt, Human
uggccacagccagg

SEQ ID NO: 1330913 - RNA, 18 nt, Human
uggccacagccaggggag

SEQ ID NO: 1330914 - RNA, 16 nt, Human
uggccacagccagggg

SEQ ID NO: 1330915 - RNA, 11 nt, Human
uggccaggugg

SEQ ID NO: 1330916 - RNA, 15 nt, Human
uggccagguggccac

SEQ ID NO: 1330917 - RNA, 11 nt, Human
uggccaccagu

SEQ ID NO: 1330918 - RNA, 17 nt, Human
uggccacaguagucuug

SEQ ID NO: 1330919 - RNA, 16 nt, Human
uggccaguccaggcug

SEQ ID NO: 1330920 - RNA, 16 nt, Human
uggccagguggccacu

SEQ ID NO: 1330921 - RNA, 17 nt, Human
uggccagguggccacuc

SEQ ID NO: 1330922 - RNA, 19 nt, Human
uggccagguggccacucca

SEQ ID NO: 1330923 - RNA, 14 nt, Human
uggccaguccaggc

SEQ ID NO: 1330924 - RNA, 15 nt, Human
uggccaguccaggcu

SEQ ID NO: 1330925 - RNA, 19 nt, Human
uggccaguguuuaaaacuu

SEQ ID NO: 1330926 - RNA, 18 nt, Human
uggccaguguuuaaaacu

SEQ ID NO: 1330927 - RNA, 16 nt, Human
uggccauacugugucc

SEQ ID NO: 1330928 - RNA, 15 nt, Human
uggccauauuuaccu

SEQ ID NO: 1330929 - RNA, 18 nt, Human
uggccauauuuaccucag

SEQ ID NO: 1330930 - RNA, 19 nt, Human
uggccauauuuaccucagc

SEQ ID NO: 1330931 - RNA, 20 nt, Human
uggccauauuuaccucagcc

SEQ ID NO: 1330932 - RNA, 21 nt, Human
uggccauauuuaccucagccu

SEQ ID NO: 1330933 - RNA, 22 nt, Human
uggccauauuuaccucagccug

SEQ ID NO: 1330934 - RNA, 24 nt, Human
uggccauauuuaccucagccuggg

SEQ ID NO: 1330935 - RNA, 23 nt, Human
uggccauauuuaccucagccugg

SEQ ID NO: 1330936 - RNA, 14 nt, Human
uggccaucugcucc

SEQ ID NO: 1330937 - RNA, 18 nt, Human
uggccaucugcuccugga

SEQ ID NO: 1330938 - RNA, 15 nt, Human
uggccaucugcuccu

SEQ ID NO: 1330939 - RNA, 14 nt, Human
uggccaugacccug

SEQ ID NO: 1330940 - RNA, 15 nt, Human
uggccaugacccugc

SEQ ID NO: 1330941 - RNA, 16 nt, Human
uggccaugacccugcc

SEQ ID NO: 1330942 - RNA, 17 nt, Human
uggccaugacccugccu

SEQ ID NO: 1330943 - RNA, 20 nt, Human
uggccaugacccugccucuc

SEQ ID NO: 1330944 - RNA, 14 nt, Human
uggcccugcccugg

SEQ ID NO: 1330945 - RNA, 19 nt, Human
uggcccaccccacccacuu

SEQ ID NO: 1330946 - RNA, 22 nt, Human
uggcccaccccacccacuucug

SEQ ID NO: 1330947 - RNA, 14 nt, Human
uggccauuugcuuu

SEQ ID NO: 1330948 - RNA, 15 nt, Human
uggccauuugcuuuu

SEQ ID NO: 1330949 - RNA, 21 nt, Human
uggccaugacccugccucucc

SEQ ID NO: 1330950 - RNA, 16 nt, Human
uggccaugcuccucuu

SEQ ID NO: 1330951 - RNA, 17 nt, Human
uggccaugcuccucuuc

SEQ ID NO: 1330952 - RNA, 21 nt, Human
uggccaugcuccucuucccca

SEQ ID NO: 1330953 - RNA, 22 nt, Human
uggccaugcuccucuuccccag

SEQ ID NO: 1330954 - RNA, 16 nt, Human
uggccauggagaaagc

SEQ ID NO: 1330955 - RNA, 17 nt, Human
uggccauggagaaagcu

SEQ ID NO: 1330956 - RNA, 18 nt, Human
uggccauggagaaagcug

SEQ ID NO: 1330957 - RNA, 22 nt, Human
uggccauggagaaagcugacuu

SEQ ID NO: 1330958 - RNA, 23 nt, Human
uggccauggagaaagcugacuug

SEQ ID NO: 1330959 - RNA, 13 nt, Human
uggccauggccug

SEQ ID NO: 1330960 - RNA, 14 nt, Human
uggccauggccugc

SEQ ID NO: 1330961 - RNA, 14 nt, Human
uggccaugggaggc

SEQ ID NO: 1330962 - RNA, 15 nt, Human
uggccaugggaggcc

SEQ ID NO: 1330963 - RNA, 16 nt, Human
uggccaugggaggccu

SEQ ID NO: 1330964 - RNA, 22 nt, Human
uggccaugggaggccuuucccu

SEQ ID NO: 1330965 - RNA, 23 nt, Human
uggccaugggaggccuuucccua

SEQ ID NO: 1330966 - RNA, 16 nt, Human
uggccuaaccugccga

SEQ ID NO: 1330967 - RNA, 17 nt, Human
uggccgugaaugggugc

SEQ ID NO: 1330968 - RNA, 21 nt, Human
uggccgugaaugggugcccac

SEQ ID NO: 1330969 - RNA, 23 nt, Human
uggcccaccccacccacuucugc

SEQ ID NO: 1330970 - RNA, 14 nt, Human
uggcccugcuuccu

SEQ ID NO: 1330971 - RNA, 17 nt, Human
uggcccugcuuccugcu

SEQ ID NO: 1330972 - RNA, 23 nt, Human
uggcccugggagaaucgcuccug

SEQ ID NO: 1330973 - RNA, 22 nt, Human
uggcccugggagaaucgcuccu

SEQ ID NO: 1330974 - RNA, 21 nt, Human
uggcccugggucccaggaccc

SEQ ID NO: 1330975 - RNA, 16 nt, Human
aggccugggcugggaa

SEQ ID NO: 1330976 - RNA, 22 nt, Human
aggccuguguagcugugaccug

SEQ ID NO: 1330977 - RNA, 24 nt, Human
aggccuguguagcugugaccugcu

SEQ ID NO: 1330978 - RNA, 23 nt, Human
aggccuguguagcugugaccugc

SEQ ID NO: 1330979 - RNA, 14 nt, Human
uggccuucggccuc

SEQ ID NO: 1330980 - RNA, 20 nt, Human
aggccugggccgcugccacg

SEQ ID NO: 1330981 - RNA, 21 nt, Human
aggccugggccgcugccacgu

SEQ ID NO: 1330982 - RNA, 17 nt, Human
uggccucuugagcagug

SEQ ID NO: 1330983 - RNA, 19 nt, Human
uggccucuugagcaguggc

SEQ ID NO: 1330984 - RNA, 20 nt, Human
uggccucuugagcaguggcu

SEQ ID NO: 1330985 - RNA, 22 nt, Human
uggccucuugagcaguggcugg

SEQ ID NO: 1330986 - RNA, 20 nt, Human
uggccucuuuccucagccuu

SEQ ID NO: 1330987 - RNA, 17 nt, Human
uggauuauauuaugaag

SEQ ID NO: 1330988 - RNA, 13 nt, Human
uggauggggcagg

SEQ ID NO: 1330989 - RNA, 20 nt, Human
uggauuacugccauucacuu

SEQ ID NO: 1330990 - RNA, 20 nt, Human
uggcaaucaaacauuuucug

SEQ ID NO: 1330991 - RNA, 13 nt, Human
uggcaaugccaca

SEQ ID NO: 1330992 - RNA, 14 nt, Human
uggcaaugccacag

SEQ ID NO: 1330993 - RNA, 15 nt, Human
uggaguacuuagcua

SEQ ID NO: 1330994 - RNA, 13 nt, Human
uggagguucuaag

SEQ ID NO: 1330995 - RNA, 15 nt, Human
uggagguucuaaggc

SEQ ID NO: 1330996 - RNA, 16 nt, Human
uggagguucuaaggcc

SEQ ID NO: 1330997 - RNA, 15 nt, Human
uggauggaaggggcu

SEQ ID NO: 1330998 - RNA, 14 nt, Human
uggauggccccagc

SEQ ID NO: 1330999 - RNA, 15 nt, Human
uggauggccccagca

SEQ ID NO: 1331000 - RNA, 16 nt, Human
uggauggccccagcac

SEQ ID NO: 1331001 - RNA, 17 nt, Human
uggauggccccagcaca

SEQ ID NO: 1331002 - RNA, 18 nt, Human
uggauggccccagcacag

SEQ ID NO: 1331003 - RNA, 21 nt, Human
uggauggccccagcacagcuu

SEQ ID NO: 1331004 - RNA, 20 nt, Human
uggauggggcaggccaccug

SEQ ID NO: 1331005 - RNA, 18 nt, Human
uggaugggggaacucaga

SEQ ID NO: 1331006 - RNA, 21 nt, Human
uggaugggggaacucagaucc

SEQ ID NO: 1331007 - RNA, 22 nt, Human
uggaugggggaacucagaucca

SEQ ID NO: 1331008 - RNA, 17 nt, Human
aggcagccagugcccug

SEQ ID NO: 1331009 - RNA, 18 nt, Human
aggcagccagugcccuga

SEQ ID NO: 1331010 - RNA, 19 nt, Human
aggcagccagugcccugag

SEQ ID NO: 1331011 - RNA, 20 nt, Human
aggcagccagugcccugagc

SEQ ID NO: 1331012 - RNA, 22 nt, Human
aggcagccagugcccugagcca

SEQ ID NO: 1331013 - RNA, 12 nt, Human
aggcagcccagg

SEQ ID NO: 1331014 - RNA, 15 nt, Human
aggcagcccaggaag

SEQ ID NO: 1331015 - RNA, 17 nt, Human
aggcagcccaggaaguc

SEQ ID NO: 1331016 - RNA, 21 nt, Human
aggcagcccaggaagucucau

SEQ ID NO: 1331017 - RNA, 17 nt, Human
uggagggguaggggcug

SEQ ID NO: 1331018 - RNA, 20 nt, Human
uggagggguaggggcuggga

SEQ ID NO: 1331019 - RNA, 22 nt, Human
uggagggguaggggcugggaac

SEQ ID NO: 1331020 - RNA, 21 nt, Human
uggagggguaggggcugggaa

SEQ ID NO: 1331021 - RNA, 13 nt, Human
uggaggggugugg

SEQ ID NO: 1331022 - RNA, 14 nt, Human
uggagggguguggc

SEQ ID NO: 1331023 - RNA, 23 nt, Human
uggagggguguggcuccuuccca

SEQ ID NO: 1331024 - RNA, 18 nt, Human
uggcacagggcaguggga

SEQ ID NO: 1331025 - RNA, 14 nt, Human
uggcaauuuugugg

SEQ ID NO: 1331026 - RNA, 18 nt, Human
uggcaauuuauuuuaaga

SEQ ID NO: 1331027 - RNA, 13 nt, Human
uggcaauuuugua

SEQ ID NO: 1331028 - RNA, 14 nt, Human
uggcaauuuuguaa

SEQ ID NO: 1331029 - RNA, 15 nt, Human
uggcaauuuuguaac

SEQ ID NO: 1331030 - RNA, 15 nt, Human
uggcaaugccacagc

SEQ ID NO: 1331031 - RNA, 19 nt, Human
uggcaaugccacagcccug

SEQ ID NO: 1331032 - RNA, 20 nt, Human
uggcaaugccacagcccugu

SEQ ID NO: 1331033 - RNA, 21 nt, Human
uggcaaugccacagcccuguc

SEQ ID NO: 1331034 - RNA, 19 nt, Human
uggcaaugccaucaucucc

SEQ ID NO: 1331035 - RNA, 23 nt, Human
uggcaaugccacagcccugucag

SEQ ID NO: 1331036 - RNA, 12 nt, Human
aggccccagccu

SEQ ID NO: 1331037 - RNA, 13 nt, Human
aggccccagccuc

SEQ ID NO: 1331038 - RNA, 14 nt, Human
aggccccagccucc

SEQ ID NO: 1331039 - RNA, 15 nt, Human
aggccccaacccugu

SEQ ID NO: 1331040 - RNA, 13 nt, Human
aggccagccuggc

SEQ ID NO: 1331041 - RNA, 20 nt, Human
aggcccagccgacccccucu

SEQ ID NO: 1331042 - RNA, 18 nt, Human
aggcccagccgacccccu

SEQ ID NO: 1331043 - RNA, 13 nt, Human
aggcccaggcugc

SEQ ID NO: 1331044 - RNA, 15 nt, Human
aggcccaggcugccg

SEQ ID NO: 1331045 - RNA, 17 nt, Human
aggcccaggcugccguc

SEQ ID NO: 1331046 - RNA, 18 nt, Human
aggcccaggcugccgucc

SEQ ID NO: 1331047 - RNA, 13 nt, Human
aggcccaggcugg

SEQ ID NO: 1331048 - RNA, 15 nt, Human
aggcccaggcuggga

SEQ ID NO: 1331049 - RNA, 16 nt, Human
aggcccaggcugggaa

SEQ ID NO: 1331050 - RNA, 17 nt, Human
aggcccaggcugggaac

SEQ ID NO: 1331051 - RNA, 17 nt, Human
aggcccaguucacccug

SEQ ID NO: 1331052 - RNA, 12 nt, Human
uggcagccuugu

SEQ ID NO: 1331053 - RNA, 15 nt, Human
uggcagccuugugau

SEQ ID NO: 1331054 - RNA, 22 nt, Human
aggccagaggcccccagcccag

SEQ ID NO: 1331055 - RNA, 22 nt, Human
aggccagcacucgcuagcagug

SEQ ID NO: 1331056 - RNA, 18 nt, Human
aggccagauuacaaauua

SEQ ID NO: 1331057 - RNA, 12 nt, Human
aggccagccugg

SEQ ID NO: 1331058 - RNA, 22 nt, Human
aggccagccgcgcaucagacug

SEQ ID NO: 1331059 - RNA, 14 nt, Human
ugcucauuucagga

SEQ ID NO: 1331060 - RNA, 14 nt, Human
ugcuccaagauucu

SEQ ID NO: 1331061 - RNA, 15 nt, Human
ugcuccaagauucua

SEQ ID NO: 1331062 - RNA, 16 nt, Human
ugcuccaagauucuag

SEQ ID NO: 1331063 - RNA, 17 nt, Human
ugcuccaagauucuaga

SEQ ID NO: 1331064 - RNA, 18 nt, Human
ugcuccaagauucuagau

SEQ ID NO: 1331065 - RNA, 19 nt, Human
ugcuccaagauucuagaug

SEQ ID NO: 1331066 - RNA, 14 nt, Human
ugcucauggaauug

SEQ ID NO: 1331067 - RNA, 15 nt, Human
ugcucccucacaugu

SEQ ID NO: 1331068 - RNA, 12 nt, Human
ugcucccucaga

SEQ ID NO: 1331069 - RNA, 13 nt, Human
ugcucccucagac

SEQ ID NO: 1331070 - RNA, 19 nt, Human
ugcucccucagacuggggc

SEQ ID NO: 1331071 - RNA, 14 nt, Human
ugcucccucagacu

SEQ ID NO: 1331072 - RNA, 16 nt, Human
ugcugacuguacuccu

SEQ ID NO: 1331073 - RNA, 19 nt, Human
ugcugacuguacuccuccc

SEQ ID NO: 1331074 - RNA, 21 nt, Human
agcuuuaaugauaugcuugua

SEQ ID NO: 1331075 - RNA, 18 nt, Human
agcuuuaacuuaaauagu

SEQ ID NO: 1331076 - RNA, 18 nt, Human
agcuuuagaaacagugca

SEQ ID NO: 1331077 - RNA, 18 nt, Human
agcuuuagaaucccagcc

SEQ ID NO: 1331078 - RNA, 16 nt, Human
ugcuaucucugugugc

SEQ ID NO: 1331079 - RNA, 21 nt, Human
ugcuaucucugugugcacaaa

SEQ ID NO: 1331080 - RNA, 20 nt, Human
ugcuaucucugugugcacaa

SEQ ID NO: 1331081 - RNA, 15 nt, Human
ugcuauggugcucug

SEQ ID NO: 1331082 - RNA, 17 nt, Human
ugcuaugguuuucucca

SEQ ID NO: 1331083 - RNA, 14 nt, Human
ugcuaugguuuucu

SEQ ID NO: 1331084 - RNA, 16 nt, Human
ugcuauucugucccua

SEQ ID NO: 1331085 - RNA, 17 nt, Human
ugcuauucugucccuag

SEQ ID NO: 1331086 - RNA, 20 nt, Human
ugcuauucugucccuaggug

SEQ ID NO: 1331087 - RNA, 20 nt, Human
ugcuauguuuugacauuuuu

SEQ ID NO: 1331088 - RNA, 11 nt, Human
ugcuauucugu

SEQ ID NO: 1331089 - RNA, 12 nt, Human
ugcuauucuguc

SEQ ID NO: 1331090 - RNA, 13 nt, Human
ugcuauucugucc

SEQ ID NO: 1331091 - RNA, 14 nt, Human
ugcuauucuguccc

SEQ ID NO: 1331092 - RNA, 15 nt, Human
ugcuauucugucccu

SEQ ID NO: 1331093 - RNA, 22 nt, Human
aggaagcccccaccgugggcag

SEQ ID NO: 1331094 - RNA, 14 nt, Human
aggaagccguccug

SEQ ID NO: 1331095 - RNA, 13 nt, Human
aggaagccucaga

SEQ ID NO: 1331096 - RNA, 14 nt, Human
aggaagccucagau

SEQ ID NO: 1331097 - RNA, 20 nt, Human
aggaagccucagauuccuuc

SEQ ID NO: 1331098 - RNA, 22 nt, Human
aggaagccucagauuccuuccc

SEQ ID NO: 1331099 - RNA, 19 nt, Human
aggaagccugcaguccugg

SEQ ID NO: 1331100 - RNA, 20 nt, Human
aggaagccugcaguccugga

SEQ ID NO: 1331101 - RNA, 12 nt, Human
aggaagccuucc

SEQ ID NO: 1331102 - RNA, 15 nt, Human
aggaaauccagggug

SEQ ID NO: 1331103 - RNA, 13 nt, Human
aggaaaucaaaug

SEQ ID NO: 1331104 - RNA, 21 nt, Human
aggaaaucaacuugcuuauca

SEQ ID NO: 1331105 - RNA, 15 nt, Human
aggaagcaagcuuaa

SEQ ID NO: 1331106 - RNA, 17 nt, Human
aggaagcaagcuuaaug

SEQ ID NO: 1331107 - RNA, 19 nt, Human
aggaagcccaauugcugga

SEQ ID NO: 1331108 - RNA, 13 nt, Human
aggaaauauuuau

SEQ ID NO: 1331109 - RNA, 14 nt, Human
aggaaauccagggu

SEQ ID NO: 1331110 - RNA, 15 nt, Human
aggaaauauacuuuu

SEQ ID NO: 1331111 - RNA, 12 nt, Human
aggaaauauuua

SEQ ID NO: 1331112 - RNA, 14 nt, Human
ugcugacuguagcu

SEQ ID NO: 1331113 - RNA, 17 nt, Human
ugcugacuguagcuuug

SEQ ID NO: 1331114 - RNA, 22 nt, Human
ugcugacuguagcuuuggaagu

SEQ ID NO: 1331115 - RNA, 21 nt, Human
ugcugacuguacuccucccag

SEQ ID NO: 1331116 - RNA, 22 nt, Human
ugcugacuguacuccucccagg

SEQ ID NO: 1331117 - RNA, 21 nt, Human
ugcuguauuuuaaaagaauga

SEQ ID NO: 1331118 - RNA, 22 nt, Human
ugcuguauuuuaaaagaaugau

SEQ ID NO: 1331119 - RNA, 13 nt, Human
ugcuguauuuuaa

SEQ ID NO: 1331120 - RNA, 16 nt, Human
ugcugggacucagccu

SEQ ID NO: 1331121 - RNA, 18 nt, Human
ugcugggacucagccuuc

SEQ ID NO: 1331122 - RNA, 22 nt, Human
ugcugggacucagccuucagac

SEQ ID NO: 1331123 - RNA, 23 nt, Human
ugcugggacucagccuucagaca

SEQ ID NO: 1331124 - RNA, 13 nt, Human
ugcuggcugccuu

SEQ ID NO: 1331125 - RNA, 23 nt, Human
ugcuggccgcccccagcccccuc

SEQ ID NO: 1331126 - RNA, 13 nt, Human
ugcuggccucugc

SEQ ID NO: 1331127 - RNA, 16 nt, Human
ugcuggccucugcgag

SEQ ID NO: 1331128 - RNA, 14 nt, Human
aggaauggaagucc

SEQ ID NO: 1331129 - RNA, 16 nt, Human
aggaaggacuaugaaa

SEQ ID NO: 1331130 - RNA, 23 nt, Human
aggaaugggaaggaugaagggcc

SEQ ID NO: 1331131 - RNA, 20 nt, Human
ugcuggaguuucauguacaa

SEQ ID NO: 1331132 - RNA, 13 nt, Human
aggacacaugucc

SEQ ID NO: 1331133 - RNA, 12 nt, Human
aggacacauguc

SEQ ID NO: 1331134 - RNA, 11 nt, Human
aggacacaugu

SEQ ID NO: 1331135 - RNA, 18 nt, Human
aggacacgggccugucca

SEQ ID NO: 1331136 - RNA, 23 nt, Human
aggacacgggccuguccacaggc

SEQ ID NO: 1331137 - RNA, 17 nt, Human
aggacagccccuccucc

SEQ ID NO: 1331138 - RNA, 15 nt, Human
aggacagagagaaau

SEQ ID NO: 1331139 - RNA, 14 nt, Human
aggacagagagaaa

SEQ ID NO: 1331140 - RNA, 16 nt, Human
aggacagaugccuccu

SEQ ID NO: 1331141 - RNA, 14 nt, Human
ugcuucaacugucu

SEQ ID NO: 1331142 - RNA, 16 nt, Human
ugcuucaagagaaaau

SEQ ID NO: 1331143 - RNA, 23 nt, Human
ugcuucaagagaaaaugcgguua

SEQ ID NO: 1331144 - RNA, 15 nt, Human
ugcuucauguguccc

SEQ ID NO: 1331145 - RNA, 17 nt, Human
ugcuucaugugucccag

SEQ ID NO: 1331146 - RNA, 19 nt, Human
ugcuucaugugucccagaa

SEQ ID NO: 1331147 - RNA, 21 nt, Human
ugcuucaugugucccagaaga

SEQ ID NO: 1331148 - RNA, 15 nt, Human
ugcuuccaauuuucu

SEQ ID NO: 1331149 - RNA, 23 nt, Human
ugcuguauuuuaaaagaaugauu

SEQ ID NO: 1331150 - RNA, 13 nt, Human
ugcugugcaaaug

SEQ ID NO: 1331151 - RNA, 20 nt, Human
ugcugugauacgaugcuuca

SEQ ID NO: 1331152 - RNA, 22 nt, Human
ugcugugauacgaugcuucaag

SEQ ID NO: 1331153 - RNA, 16 nt, Human
ugcugugcgcccaggg

SEQ ID NO: 1331154 - RNA, 17 nt, Human
ugcugugcgcccagggc

SEQ ID NO: 1331155 - RNA, 18 nt, Human
ugcugugcgcccagggcu

SEQ ID NO: 1331156 - RNA, 15 nt, Human
ugcugugcugugcua

SEQ ID NO: 1331157 - RNA, 22 nt, Human
ugcuguggaacuacauuacugu

SEQ ID NO: 1331158 - RNA, 18 nt, Human
ugcugugcugugcuaugg

SEQ ID NO: 1331159 - RNA, 13 nt, Human
ugcuguggccagg

SEQ ID NO: 1331160 - RNA, 14 nt, Human
ugcuguggccagga

SEQ ID NO: 1331161 - RNA, 15 nt, Human
ugcuguggccaggag

SEQ ID NO: 1331162 - RNA, 16 nt, Human
ugcuguggccaggagg

SEQ ID NO: 1331163 - RNA, 17 nt, Human
ugcuguggccaggaggu

SEQ ID NO: 1331164 - RNA, 14 nt, Human
ugcuuacugauaua

SEQ ID NO: 1331165 - RNA, 22 nt, Human
ugcuuacugauauauuuuacaa

SEQ ID NO: 1331166 - RNA, 18 nt, Human
ugcuuauuuauuguauuc

SEQ ID NO: 1331167 - RNA, 19 nt, Human
ugcuuauuuauuguauucu

SEQ ID NO: 1331168 - RNA, 21 nt, Human
ugcuuauuuauuguauucugg

SEQ ID NO: 1331169 - RNA, 23 nt, Human
ugcuuauuugacaacguuucagc

SEQ ID NO: 1331170 - RNA, 16 nt, Human
agcuguguggcagucu

SEQ ID NO: 1331171 - RNA, 14 nt, Human
agcuguguggcagu

SEQ ID NO: 1331172 - RNA, 16 nt, Human
agcugucuuuuggagg

SEQ ID NO: 1331173 - RNA, 14 nt, Human
agcuguccuuuuuc

SEQ ID NO: 1331174 - RNA, 16 nt, Human
agcuguccuuuuuccu

SEQ ID NO: 1331175 - RNA, 17 nt, Human
agcuguccuuuuuccuc

SEQ ID NO: 1331176 - RNA, 18 nt, Human
agcuguccuuuuuccucu

SEQ ID NO: 1331177 - RNA, 20 nt, Human
agcuguccuuuuuccucucc

SEQ ID NO: 1331178 - RNA, 23 nt, Human
agcuguccuuuuuccucuccaca

SEQ ID NO: 1331179 - RNA, 11 nt, Human
agcugucugcu

SEQ ID NO: 1331180 - RNA, 17 nt, Human
agcugucugcucagaca

SEQ ID NO: 1331181 - RNA, 21 nt, Human
agcuguccuuuuuccucucca

SEQ ID NO: 1331182 - RNA, 21 nt, Human
agcuggcucugugagggugcu

SEQ ID NO: 1331183 - RNA, 21 nt, Human
agcugggacaccccgacuuuu

SEQ ID NO: 1331184 - RNA, 18 nt, Human
agcuggcucugugagggu

SEQ ID NO: 1331185 - RNA, 20 nt, Human
agcuggcucugugagggugc

SEQ ID NO: 1331186 - RNA, 19 nt, Human
agcugucaucaauuaaagg

SEQ ID NO: 1331187 - RNA, 14 nt, Human
agcuguccccccac

SEQ ID NO: 1331188 - RNA, 23 nt, Human
agcuguccccccacucccucaca

SEQ ID NO: 1331189 - RNA, 22 nt, Human
agcuguccccccacucccucac

SEQ ID NO: 1331190 - RNA, 13 nt, Human
agcuggcucugag

SEQ ID NO: 1331191 - RNA, 14 nt, Human
agcuggcucugagc

SEQ ID NO: 1331192 - RNA, 19 nt, Human
agcuggcucugagcgccuc

SEQ ID NO: 1331193 - RNA, 20 nt, Human
agcuggcucugagcgccucc

SEQ ID NO: 1331194 - RNA, 23 nt, Human
agcuggcucugagcgccuccauc

SEQ ID NO: 1331195 - RNA, 11 nt, Human
agcuggcucua

SEQ ID NO: 1331196 - RNA, 14 nt, Human
agcuggcucuguga

SEQ ID NO: 1331197 - RNA, 22 nt, Human
agcuggcucugugagggugcug

SEQ ID NO: 1331198 - RNA, 14 nt, Human
ugccuguuucccag

SEQ ID NO: 1331199 - RNA, 16 nt, Human
ugccuguuucccaggc

SEQ ID NO: 1331200 - RNA, 19 nt, Human
ugccuguuucccaggccca

SEQ ID NO: 1331201 - RNA, 15 nt, Human
ugccuuagucucagu

SEQ ID NO: 1331202 - RNA, 22 nt, Human
agcuguguguuuggaagacuau

SEQ ID NO: 1331203 - RNA, 14 nt, Human
agcugucuuuugga

SEQ ID NO: 1331204 - RNA, 15 nt, Human
ugccugcccuauucu

SEQ ID NO: 1331205 - RNA, 21 nt, Human
ugccugccccuacccuggacu

SEQ ID NO: 1331206 - RNA, 22 nt, Human
ugccugccccuacccuggacuu

SEQ ID NO: 1331207 - RNA, 13 nt, Human
ugccugcccuggu

SEQ ID NO: 1331208 - RNA, 15 nt, Human
ugccugcccugguga

SEQ ID NO: 1331209 - RNA, 13 nt, Human
ugccugccugcuc

SEQ ID NO: 1331210 - RNA, 12 nt, Human
ugccuggacccg

SEQ ID NO: 1331211 - RNA, 12 nt, Human
ugcccaggcacu

SEQ ID NO: 1331212 - RNA, 15 nt, Human
ugcccaggcacugca

SEQ ID NO: 1331213 - RNA, 20 nt, Human
ugccuggagacuuagggcac

SEQ ID NO: 1331214 - RNA, 11 nt, Human
ugccuggagga

SEQ ID NO: 1331215 - RNA, 15 nt, Human
ugccuggaggaccug

SEQ ID NO: 1331216 - RNA, 16 nt, Human
ugccuggaggaccuga

SEQ ID NO: 1331217 - RNA, 18 nt, Human
ugccuggaggaccugagc

SEQ ID NO: 1331218 - RNA, 19 nt, Human
ugccuggaggaccugagcc

SEQ ID NO: 1331219 - RNA, 20 nt, Human
ugccuggaggaccugagccu

SEQ ID NO: 1331220 - RNA, 22 nt, Human
ugccuggaggaccugagccugc

SEQ ID NO: 1331221 - RNA, 23 nt, Human
ugccuggaguguaugacugcaca

SEQ ID NO: 1331222 - RNA, 21 nt, Human
ugccuggaggaccugagccug

SEQ ID NO: 1331223 - RNA, 19 nt, Human
agcugccggucgcccuuug

SEQ ID NO: 1331224 - RNA, 21 nt, Human
agcugccuagauucagggaaa

SEQ ID NO: 1331225 - RNA, 16 nt, Human
agcugccggucgcccu

SEQ ID NO: 1331226 - RNA, 14 nt, Human
agcuggaugagaau

SEQ ID NO: 1331227 - RNA, 15 nt, Human
agcuggcauuacagc

SEQ ID NO: 1331228 - RNA, 21 nt, Human
agcuggcauuacagcuggaga

SEQ ID NO: 1331229 - RNA, 15 nt, Human
ugcuaaggucuugga

SEQ ID NO: 1331230 - RNA, 23 nt, Human
ugcuaaggucuuggaacuugccu

SEQ ID NO: 1331231 - RNA, 12 nt, Human
ugcuaagguucu

SEQ ID NO: 1331232 - RNA, 13 nt, Human
ugcuaagguucua

SEQ ID NO: 1331233 - RNA, 14 nt, Human
ugcuaagguucuaa

SEQ ID NO: 1331234 - RNA, 15 nt, Human
ugcuaagguucuaag

SEQ ID NO: 1331235 - RNA, 16 nt, Human
ugcuaagguucuaagg

SEQ ID NO: 1331236 - RNA, 17 nt, Human
ugcuaagguucuaaggc

SEQ ID NO: 1331237 - RNA, 18 nt, Human
ugcuaagguucuaaggcc

SEQ ID NO: 1331238 - RNA, 12 nt, Human
ugcuacaauguc

SEQ ID NO: 1331239 - RNA, 15 nt, Human
agcuuagacuaaggc

SEQ ID NO: 1331240 - RNA, 20 nt, Human
agcuugaccugaggcugugg

SEQ ID NO: 1331241 - RNA, 14 nt, Human
agcuuggggaagac

SEQ ID NO: 1331242 - RNA, 23 nt, Human
ugccuuugaccugccucccuuca

SEQ ID NO: 1331243 - RNA, 17 nt, Human
ugccuuugaccugccuc

SEQ ID NO: 1331244 - RNA, 13 nt, Human
ugccuuugaccug

SEQ ID NO: 1331245 - RNA, 16 nt, Human
ugccuuagucucaguu

SEQ ID NO: 1331246 - RNA, 20 nt, Human
ugccuuagucucaguuugug

SEQ ID NO: 1331247 - RNA, 14 nt, Human
ugccuuaucuugca

SEQ ID NO: 1331248 - RNA, 17 nt, Human
ugccuuucaggaucuau

SEQ ID NO: 1331249 - RNA, 19 nt, Human
ugccuuucaggaucuauuu

SEQ ID NO: 1331250 - RNA, 22 nt, Human
ugccuuuccauccauggccagc

SEQ ID NO: 1331251 - RNA, 20 nt, Human
ugccuuuccauccauggcca

SEQ ID NO: 1331252 - RNA, 21 nt, Human
ugccuuuccauccauggccag

SEQ ID NO: 1331253 - RNA, 16 nt, Human
ugccuuuuaguuccug

SEQ ID NO: 1331254 - RNA, 16 nt, Human
ugccuuugccagguga

SEQ ID NO: 1331255 - RNA, 17 nt, Human
ugccuuugccaggugac

SEQ ID NO: 1331256 - RNA, 23 nt, Human
ugcggaggaaggaggacccagga

SEQ ID NO: 1331257 - RNA, 22 nt, Human
ugcggaggaaggaggacccagg

SEQ ID NO: 1331258 - RNA, 21 nt, Human
ugcggaggaaggaggacccag

SEQ ID NO: 1331259 - RNA, 13 nt, Human
ugcggauggccgg

SEQ ID NO: 1331260 - RNA, 17 nt, Human
ugccuuuucccaacucc

SEQ ID NO: 1331261 - RNA, 18 nt, Human
ugccuuuuaguuccugug

SEQ ID NO: 1331262 - RNA, 14 nt, Human
ugccuuuuauccca

SEQ ID NO: 1331263 - RNA, 18 nt, Human
ugcggaccacccucacug

SEQ ID NO: 1331264 - RNA, 22 nt, Human
ugcggaccacccucacuggcuc

SEQ ID NO: 1331265 - RNA, 22 nt, Human
ugcgggugaacaaagcagccac

SEQ ID NO: 1331266 - RNA, 23 nt, Human
ugcgggugaacaaagcagccacg

SEQ ID NO: 1331267 - RNA, 23 nt, Human
ugcggguggggcuuggggcucac

SEQ ID NO: 1331268 - RNA, 16 nt, Human
ugcgggugagaguaau

SEQ ID NO: 1331269 - RNA, 14 nt, Human
ugcgggucacagga

SEQ ID NO: 1331270 - RNA, 16 nt, Human
ugcgggucacaggagg

SEQ ID NO: 1331271 - RNA, 22 nt, Human
ugcggggguuccguguccaccc

SEQ ID NO: 1331272 - RNA, 15 nt, Human
ugcggggugggggca

SEQ ID NO: 1331273 - RNA, 17 nt, Human
ugcgggucacaggaggg

SEQ ID NO: 1331274 - RNA, 18 nt, Human
ugcgggugaacaaagcag

SEQ ID NO: 1331275 - RNA, 21 nt, Human
ugcgggugaacaaagcagcca

SEQ ID NO: 1331276 - RNA, 13 nt, Human
ugcggcuccucag

SEQ ID NO: 1331277 - RNA, 15 nt, Human
ugcggcuccucaggg

SEQ ID NO: 1331278 - RNA, 14 nt, Human
ugcggcuggccaug

SEQ ID NO: 1331279 - RNA, 15 nt, Human
ugcggcuggccaugg

SEQ ID NO: 1331280 - RNA, 23 nt, Human
ugcggcuggccauggagaaagcu

SEQ ID NO: 1331281 - RNA, 22 nt, Human
ugcggcuggccauggagaaagc

SEQ ID NO: 1331282 - RNA, 12 nt, Human
ugcggcugugug

SEQ ID NO: 1331283 - RNA, 13 nt, Human
ugcggcugugugu

SEQ ID NO: 1331284 - RNA, 14 nt, Human
ugcggcugugugug

SEQ ID NO: 1331285 - RNA, 18 nt, Human
agcuaggaauuguguuua

SEQ ID NO: 1331286 - RNA, 18 nt, Human
agcuaggaagagcaggac

SEQ ID NO: 1331287 - RNA, 21 nt, Human
agcuaggaagagcaggacucc

SEQ ID NO: 1331288 - RNA, 12 nt, Human
agcuaggaauga

SEQ ID NO: 1331289 - RNA, 13 nt, Human
agcuaggaaugaa

SEQ ID NO: 1331290 - RNA, 15 nt, Human
agcuaggagcaaagc

SEQ ID NO: 1331291 - RNA, 16 nt, Human
agcuaggagcaaagcc

SEQ ID NO: 1331292 - RNA, 17 nt, Human
agcuaggagcaaagccu

SEQ ID NO: 1331293 - RNA, 18 nt, Human
agcuaggagcaaagccug

SEQ ID NO: 1331294 - RNA, 19 nt, Human
agcuaggagcaaagccugu

SEQ ID NO: 1331295 - RNA, 20 nt, Human
agcuaggagcaaagccuguu

SEQ ID NO: 1331296 - RNA, 21 nt, Human
agcuaggagcaaagccuguuc

SEQ ID NO: 1331297 - RNA, 13 nt, Human
agcucagcugcau

SEQ ID NO: 1331298 - RNA, 19 nt, Human
agcucagcugcauuccgca

SEQ ID NO: 1331299 - RNA, 13 nt, Human
agcucaggacaga

SEQ ID NO: 1331300 - RNA, 17 nt, Human
agcucaggacagaugcc

SEQ ID NO: 1331301 - RNA, 18 nt, Human
agcucaggacagaugcca

SEQ ID NO: 1331302 - RNA, 20 nt, Human
agcucaggaaccgaggcagg

SEQ ID NO: 1331303 - RNA, 23 nt, Human
agcucagcugcauuccgcagccc

SEQ ID NO: 1331304 - RNA, 21 nt, Human
agcucaggaaccgaggcaggg

SEQ ID NO: 1331305 - RNA, 22 nt, Human
agcucaggaaccgaggcaggga

SEQ ID NO: 1331306 - RNA, 17 nt, Human
agcucaucuucacugca

SEQ ID NO: 1331307 - RNA, 16 nt, Human
agcucaucuucacugc

SEQ ID NO: 1331308 - RNA, 22 nt, Human
agcucaugugcauuauuuucca

SEQ ID NO: 1331309 - RNA, 21 nt, Human
agcucauccaugccucagaag

SEQ ID NO: 1331310 - RNA, 21 nt, Human
ugcccaagaauagaugcugac

SEQ ID NO: 1331311 - RNA, 16 nt, Human
agcuccaaccugcaaa

SEQ ID NO: 1331312 - RNA, 18 nt, Human
agcuccaaccugcaaaga

SEQ ID NO: 1331313 - RNA, 13 nt, Human
agcuccaaccugc

SEQ ID NO: 1331314 - RNA, 14 nt, Human
agcuccaaccugca

SEQ ID NO: 1331315 - RNA, 15 nt, Human
agcuccaaccugcaa

SEQ ID NO: 1331316 - RNA, 22 nt, Human
ugcccaagaauagaugcugacu

SEQ ID NO: 1331317 - RNA, 23 nt, Human
ugcccaagaauagaugcugacug

SEQ ID NO: 1331318 - RNA, 11 nt, Human
ugcccaagcca

SEQ ID NO: 1331319 - RNA, 13 nt, Human
ugcccaagccaga

SEQ ID NO: 1331320 - RNA, 14 nt, Human
ugcccaagccagag

SEQ ID NO: 1331321 - RNA, 15 nt, Human
ugcccaagccagagg

SEQ ID NO: 1331322 - RNA, 22 nt, Human
ugcccaagccagaggcuggguu

SEQ ID NO: 1331323 - RNA, 16 nt, Human
ugcccaagccagaggc

SEQ ID NO: 1331324 - RNA, 18 nt, Human
ugcccaagccagaggcug

SEQ ID NO: 1331325 - RNA, 20 nt, Human
ugcccaagccagaggcuggg

SEQ ID NO: 1331326 - RNA, 12 nt, Human
ugcccacaggcc

SEQ ID NO: 1331327 - RNA, 14 nt, Human
ugcccacaggccgc

SEQ ID NO: 1331328 - RNA, 21 nt, Human
ugcccacaggccgcccugcgg

SEQ ID NO: 1331329 - RNA, 19 nt, Human
ugcccagcccuaaacauca

SEQ ID NO: 1331330 - RNA, 19 nt, Human
agcuacuaauuuuaaaaug

SEQ ID NO: 1331331 - RNA, 18 nt, Human
agcuaccuguguggacag

SEQ ID NO: 1331332 - RNA, 19 nt, Human
agcuaccuguguggacagg

SEQ ID NO: 1331333 - RNA, 20 nt, Human
agcuaccuguguggacagga

SEQ ID NO: 1331334 - RNA, 22 nt, Human
agcuaccuguguggacaggacu

SEQ ID NO: 1331335 - RNA, 16 nt, Human
agcuacguauuuaaua

SEQ ID NO: 1331336 - RNA, 14 nt, Human
agcuacuaaaauca

SEQ ID NO: 1331337 - RNA, 15 nt, Human
agcgugagcugagca

SEQ ID NO: 1331338 - RNA, 16 nt, Human
agcgugagcugagcag

SEQ ID NO: 1331339 - RNA, 12 nt, Human
agcgugagcuua

SEQ ID NO: 1331340 - RNA, 20 nt, Human
agcgugagcuuaaaauacaa

SEQ ID NO: 1331341 - RNA, 21 nt, Human
agcuacccuuuuucuccagcu

SEQ ID NO: 1331342 - RNA, 22 nt, Human
agcuaccugcucagcccugcac

SEQ ID NO: 1331343 - RNA, 22 nt, Human
ugccacacuucaggcucuucuc

SEQ ID NO: 1331344 - RNA, 23 nt, Human
ugccacacuucaggcucuucucc

SEQ ID NO: 1331345 - RNA, 21 nt, Human
ugccagagaacccagcccacc

SEQ ID NO: 1331346 - RNA, 13 nt, Human
ugccagagaaccc

SEQ ID NO: 1331347 - RNA, 12 nt, Human
agcgggggaggg

SEQ ID NO: 1331348 - RNA, 21 nt, Human
agcgggggaggguaggcagga

SEQ ID NO: 1331349 - RNA, 18 nt, Human
agcgggggccuaaaaaaa

SEQ ID NO: 1331350 - RNA, 16 nt, Human
agcgggucugcuccca

SEQ ID NO: 1331351 - RNA, 13 nt, Human
agcgggucugcuc

SEQ ID NO: 1331352 - RNA, 14 nt, Human
agcggugucucucc

SEQ ID NO: 1331353 - RNA, 20 nt, Human
agcggugucucuccugcccc

SEQ ID NO: 1331354 - RNA, 13 nt, Human
agcuagaauuuga

SEQ ID NO: 1331355 - RNA, 16 nt, Human
agcuagaauuugauau

SEQ ID NO: 1331356 - RNA, 15 nt, Human
agcuagaacccucug

SEQ ID NO: 1331357 - RNA, 16 nt, Human
agcuagaacccucugu

SEQ ID NO: 1331358 - RNA, 17 nt, Human
agcuagaacccucuguu

SEQ ID NO: 1331359 - RNA, 18 nt, Human
agcuacuugggaggcuga

SEQ ID NO: 1331360 - RNA, 17 nt, Human
agcuacuugggaggcug

SEQ ID NO: 1331361 - RNA, 16 nt, Human
agcuacuaaaaucagu

SEQ ID NO: 1331362 - RNA, 14 nt, Human
agcuagaauugagu

SEQ ID NO: 1331363 - RNA, 20 nt, Human
agcuagaauugaguguuuaa

SEQ ID NO: 1331364 - RNA, 15 nt, Human
agcuagacacaugaa

SEQ ID NO: 1331365 - RNA, 16 nt, Human
agcuagacacaugaag

SEQ ID NO: 1331366 - RNA, 17 nt, Human
agcuagacacaugaagg

SEQ ID NO: 1331367 - RNA, 15 nt, Human
agccuguuuaagaga

SEQ ID NO: 1331368 - RNA, 13 nt, Human
agccuguuuaaga

SEQ ID NO: 1331369 - RNA, 14 nt, Human
agccuguucauggc

SEQ ID NO: 1331370 - RNA, 16 nt, Human
agccuguucauggcag

SEQ ID NO: 1331371 - RNA, 17 nt, Human
agccuguucauggcaga

SEQ ID NO: 1331372 - RNA, 18 nt, Human
agccuguucauggcagau

SEQ ID NO: 1331373 - RNA, 19 nt, Human
agccuguucauggcagaug

SEQ ID NO: 1331374 - RNA, 20 nt, Human
agccuuagcucucccaacuc

SEQ ID NO: 1331375 - RNA, 13 nt, Human
agccuucaagcuc

SEQ ID NO: 1331376 - RNA, 14 nt, Human
agccuucaagcucu

SEQ ID NO: 1331377 - RNA, 15 nt, Human
agccuucaagcucug

SEQ ID NO: 1331378 - RNA, 16 nt, Human
agccuucaagcucuga

SEQ ID NO: 1331379 - RNA, 17 nt, Human
agccuucaagcucugag

SEQ ID NO: 1331380 - RNA, 18 nt, Human
agccuucaagcucugagg

SEQ ID NO: 1331381 - RNA, 19 nt, Human
agccuucaagcucugaggg

SEQ ID NO: 1331382 - RNA, 20 nt, Human
agccuucaagcucugaggga

SEQ ID NO: 1331383 - RNA, 23 nt, Human
agccuucaagcucugagggaaag

SEQ ID NO: 1331384 - RNA, 22 nt, Human
agccuggguguaaaaccuggag

SEQ ID NO: 1331385 - RNA, 21 nt, Human
agccuggguguaaaaccugga

SEQ ID NO: 1331386 - RNA, 20 nt, Human
ugcauacauucuucaagauc

SEQ ID NO: 1331387 - RNA, 22 nt, Human
ugcauacacuuuuucucuuucc

SEQ ID NO: 1331388 - RNA, 14 nt, Human
agccugggggccug

SEQ ID NO: 1331389 - RNA, 15 nt, Human
agccugggggccugg

SEQ ID NO: 1331390 - RNA, 16 nt, Human
agccugggggccuggc

SEQ ID NO: 1331391 - RNA, 17 nt, Human
agccugggggccuggcu

SEQ ID NO: 1331392 - RNA, 18 nt, Human
agccugggggccuggcug

SEQ ID NO: 1331393 - RNA, 19 nt, Human
agccugggggccuggcugg

SEQ ID NO: 1331394 - RNA, 20 nt, Human
agccugggggccuggcuggc

SEQ ID NO: 1331395 - RNA, 21 nt, Human
agccugggggccuggcuggcu

SEQ ID NO: 1331396 - RNA, 22 nt, Human
agccugggggccuggcuggcug

SEQ ID NO: 1331397 - RNA, 15 nt, Human
agccuggggucugga

SEQ ID NO: 1331398 - RNA, 23 nt, Human
agccugggggccuggcuggcuga

SEQ ID NO: 1331399 - RNA, 12 nt, Human
agccugggugua

SEQ ID NO: 1331400 - RNA, 20 nt, Human
agccuggguguaaaaccugg

SEQ ID NO: 1331401 - RNA, 23 nt, Human
agcgccuccaacccuagcaaaag

SEQ ID NO: 1331402 - RNA, 22 nt, Human
agcgccuccaacccuagcaaaa

SEQ ID NO: 1331403 - RNA, 19 nt, Human
agcgccuccaacccuagca

SEQ ID NO: 1331404 - RNA, 18 nt, Human
agcgccuccaacccuagc

SEQ ID NO: 1331405 - RNA, 18 nt, Human
agcgccuccauccaaggc

SEQ ID NO: 1331406 - RNA, 20 nt, Human
agcgccuccauccaaggcca

SEQ ID NO: 1331407 - RNA, 23 nt, Human
agcgccuccauccaaggccaggu

SEQ ID NO: 1331408 - RNA, 22 nt, Human
agcgccuccauccaaggccagg

SEQ ID NO: 1331409 - RNA, 14 nt, Human
agcggaggugugga

SEQ ID NO: 1331410 - RNA, 20 nt, Human
agccuuggggcugaugcagu

SEQ ID NO: 1331411 - RNA, 13 nt, Human
agccuuccaccca

SEQ ID NO: 1331412 - RNA, 14 nt, Human
agccuuccacccag

SEQ ID NO: 1331413 - RNA, 15 nt, Human
agccuuccacccagg

SEQ ID NO: 1331414 - RNA, 16 nt, Human
agccuuguaauucuaa

SEQ ID NO: 1331415 - RNA, 18 nt, Human
agccuuguaauucuaaau

SEQ ID NO: 1331416 - RNA, 21 nt, Human
agccuugugaugucauacaga

SEQ ID NO: 1331417 - RNA, 22 nt, Human
agccuugugaugucauacagag

SEQ ID NO: 1331418 - RNA, 23 nt, Human
agccuugugaugucauacagaga

SEQ ID NO: 1331419 - RNA, 13 nt, Human
ugcauuaugcaau

SEQ ID NO: 1331420 - RNA, 18 nt, Human
ugcauuaugcaauuuuua

SEQ ID NO: 1331421 - RNA, 23 nt, Human
ugcauugaacacaaacuguaaau

SEQ ID NO: 1331422 - RNA, 22 nt, Human
ugcauugaccgcgacuaauuuc

SEQ ID NO: 1331423 - RNA, 20 nt, Human
ugcauugaccgcgacuaauu

SEQ ID NO: 1331424 - RNA, 17 nt, Human
ugcauugacuuucccca

SEQ ID NO: 1331425 - RNA, 22 nt, Human
ugcauugacuuuccccaccaga

SEQ ID NO: 1331426 - RNA, 18 nt, Human
ugcauugacuuuccccac

SEQ ID NO: 1331427 - RNA, 19 nt, Human
ugcauugcuuuuuuuuccu

SEQ ID NO: 1331428 - RNA, 17 nt, Human
ugcauuggaacuggagg

SEQ ID NO: 1331429 - RNA, 18 nt, Human
ugcauuggaacuggaggc

SEQ ID NO: 1331430 - RNA, 21 nt, Human
ugcauuggaacuggaggcagg

SEQ ID NO: 1331431 - RNA, 22 nt, Human
ugcauuggaacuggaggcaggg

SEQ ID NO: 1331432 - RNA, 17 nt, Human
ugccaagggcauaaauu

SEQ ID NO: 1331433 - RNA, 21 nt, Human
ugccaagggcauaaauuauug

SEQ ID NO: 1331434 - RNA, 21 nt, Human
ugccaagggcuuuguuuugca

SEQ ID NO: 1331435 - RNA, 13 nt, Human
ugccaaguccagg

SEQ ID NO: 1331436 - RNA, 15 nt, Human
ugccaaguccagguc

SEQ ID NO: 1331437 - RNA, 17 nt, Human
ugccaaguccagguccu

SEQ ID NO: 1331438 - RNA, 20 nt, Human
ugccaaguccagguccuggu

SEQ ID NO: 1331439 - RNA, 21 nt, Human
ugccaauaauaauaccucccu

SEQ ID NO: 1331440 - RNA, 22 nt, Human
ugccaauaauaauaccucccuu

SEQ ID NO: 1331441 - RNA, 21 nt, Human
ugccaaguccagguccuggug

SEQ ID NO: 1331442 - RNA, 13 nt, Human
ugccaauuucaag

SEQ ID NO: 1331443 - RNA, 15 nt, Human
ugccaauuagcaauu

SEQ ID NO: 1331444 - RNA, 13 nt, Human
ugccacacuucag

SEQ ID NO: 1331445 - RNA, 14 nt, Human
ugccacacuucagg

SEQ ID NO: 1331446 - RNA, 15 nt, Human
ugccacacuucaggc

SEQ ID NO: 1331447 - RNA, 16 nt, Human
ugccacacuucaggcu

SEQ ID NO: 1331448 - RNA, 15 nt, Human
ugccacaaggacuuc

SEQ ID NO: 1331449 - RNA, 16 nt, Human
ugccacaaggacuucc

SEQ ID NO: 1331450 - RNA, 23 nt, Human
ugcagcccccacugccuuugacc

SEQ ID NO: 1331451 - RNA, 17 nt, Human
ugcagcccccacugccu

SEQ ID NO: 1331452 - RNA, 19 nt, Human
agccugaaccccagggcug

SEQ ID NO: 1331453 - RNA, 22 nt, Human
agccugaaagaggaaugaagua

SEQ ID NO: 1331454 - RNA, 18 nt, Human
agccugacccucaucuuu

SEQ ID NO: 1331455 - RNA, 22 nt, Human
agccugacaucaaaaaaggcag

SEQ ID NO: 1331456 - RNA, 20 nt, Human
agccugaauuuuguugcugu

SEQ ID NO: 1331457 - RNA, 21 nt, Human
agccugaauuuuguugcuguu

SEQ ID NO: 1331458 - RNA, 17 nt, Human
agccugacaacauuucu

SEQ ID NO: 1331459 - RNA, 18 nt, Human
agccugaaccccagggcu

SEQ ID NO: 1331460 - RNA, 14 nt, Human
ugcagcccugcugc

SEQ ID NO: 1331461 - RNA, 14 nt, Human
ugcagccugcgcca

SEQ ID NO: 1331462 - RNA, 17 nt, Human
ugcagcgacuggcauac

SEQ ID NO: 1331463 - RNA, 20 nt, Human
ugcagcucaagagaucccaa

SEQ ID NO: 1331464 - RNA, 16 nt, Human
ugcaggucccuaauaa

SEQ ID NO: 1331465 - RNA, 15 nt, Human
ugcaggucccuaaua

SEQ ID NO: 1331466 - RNA, 14 nt, Human
ugcaggucccuaau

SEQ ID NO: 1331467 - RNA, 12 nt, Human
ugcaggucccua

SEQ ID NO: 1331468 - RNA, 17 nt, Human
ugcaggucccuaauaaa

SEQ ID NO: 1331469 - RNA, 14 nt, Human
ugcaguaaaucuuu

SEQ ID NO: 1331470 - RNA, 15 nt, Human
ugcaguaaaucuuuu

SEQ ID NO: 1331471 - RNA, 18 nt, Human
ugcaguaaaucuuuuaca

SEQ ID NO: 1331472 - RNA, 21 nt, Human
ugcaguaaaucuuuuacaacu

SEQ ID NO: 1331473 - RNA, 11 nt, Human
ugcaguaacug

SEQ ID NO: 1331474 - RNA, 16 nt, Human
ugcaguaacuguuuuu

SEQ ID NO: 1331475 - RNA, 18 nt, Human
ugcaguaacuguuuuuua

SEQ ID NO: 1331476 - RNA, 18 nt, Human
ugcaguacuuuaccuccu

SEQ ID NO: 1331477 - RNA, 21 nt, Human
ugcaguaacuguuuuuuaagu

SEQ ID NO: 1331478 - RNA, 17 nt, Human
ugcaguacuuugugcau

SEQ ID NO: 1331479 - RNA, 18 nt, Human
ugcaguacuuugugcauu

SEQ ID NO: 1331480 - RNA, 22 nt, Human
ugcagucucuauaccaauaaag

SEQ ID NO: 1331481 - RNA, 23 nt, Human
ugcagucucuauaccaauaaagu

SEQ ID NO: 1331482 - RNA, 21 nt, Human
ugcagucucuauaccaauaaa

SEQ ID NO: 1331483 - RNA, 20 nt, Human
ugcagucucuauaccaauaa

SEQ ID NO: 1331484 - RNA, 19 nt, Human
ugcagucucuauaccaaua

SEQ ID NO: 1331485 - RNA, 18 nt, Human
ugcagucucuauaccaau

SEQ ID NO: 1331486 - RNA, 16 nt, Human
ugcagucucuauacca

SEQ ID NO: 1331487 - RNA, 19 nt, Human
ugcaguccugaucagagcc

SEQ ID NO: 1331488 - RNA, 22 nt, Human
ugcaguccugaucagagccgug

SEQ ID NO: 1331489 - RNA, 11 nt, Human
ugcagucccaa

SEQ ID NO: 1331490 - RNA, 13 nt, Human
ugcagucccaagc

SEQ ID NO: 1331491 - RNA, 14 nt, Human
ugcagucccaagcg

SEQ ID NO: 1331492 - RNA, 20 nt, Human
ugcagucccaagcggugucu

SEQ ID NO: 1331493 - RNA, 21 nt, Human
ugcagucccaagcggugucuc

SEQ ID NO: 1331494 - RNA, 22 nt, Human
ugcagucccaagcggugucucu

SEQ ID NO: 1331495 - RNA, 23 nt, Human
ugcagucccaagcggugucucuc

SEQ ID NO: 1331496 - RNA, 23 nt, Human
ugcauaacguauaaaagccuguu

SEQ ID NO: 1331497 - RNA, 22 nt, Human
agcccuucuauacccacccaga

SEQ ID NO: 1331498 - RNA, 20 nt, Human
agcccuucuauacccaccca

SEQ ID NO: 1331499 - RNA, 19 nt, Human
agcccuucuauacccaccc

SEQ ID NO: 1331500 - RNA, 15 nt, Human
ugcacuaucuuucag

SEQ ID NO: 1331501 - RNA, 14 nt, Human
ugcacucaaccuua

SEQ ID NO: 1331502 - RNA, 11 nt, Human
ugcacgugugu

SEQ ID NO: 1331503 - RNA, 12 nt, Human
ugcacguguguu

SEQ ID NO: 1331504 - RNA, 13 nt, Human
ugcacguguguuu

SEQ ID NO: 1331505 - RNA, 15 nt, Human
ugcacguguguuuuu

SEQ ID NO: 1331506 - RNA, 18 nt, Human
ugcacguguguuuuucua

SEQ ID NO: 1331507 - RNA, 22 nt, Human
ugcacguguguuuuucuauuaa

SEQ ID NO: 1331508 - RNA, 20 nt, Human
ugcacuauaugcaaacaggg

SEQ ID NO: 1331509 - RNA, 18 nt, Human
ugcacuauaugcaaacag

SEQ ID NO: 1331510 - RNA, 16 nt, Human
ugcacuaucuuucagc

SEQ ID NO: 1331511 - RNA, 17 nt, Human
ugcacuauaugcaaaca

SEQ ID NO: 1331512 - RNA, 16 nt, Human
ugcacuauaugcaaac

SEQ ID NO: 1331513 - RNA, 15 nt, Human
ugcacuauaugcaaa

SEQ ID NO: 1331514 - RNA, 14 nt, Human
ugcacuauaugcaa

SEQ ID NO: 1331515 - RNA, 12 nt, Human
ugcacuauaugc

SEQ ID NO: 1331516 - RNA, 19 nt, Human
ugcacguguguuuuucuau

SEQ ID NO: 1331517 - RNA, 23 nt, Human
agcccuucuccauggcccugcca

SEQ ID NO: 1331518 - RNA, 21 nt, Human
agccgacaccuuuuuucaaca

SEQ ID NO: 1331519 - RNA, 20 nt, Human
agccgacccccucucccugc

SEQ ID NO: 1331520 - RNA, 21 nt, Human
agcccuucuccauggcccugc

SEQ ID NO: 1331521 - RNA, 23 nt, Human
agcccuucuauacccacccagaa

SEQ ID NO: 1331522 - RNA, 17 nt, Human
agcccuucuuuccacag

SEQ ID NO: 1331523 - RNA, 13 nt, Human
agccgacccccuc

SEQ ID NO: 1331524 - RNA, 14 nt, Human
agccguggcuuccc

SEQ ID NO: 1331525 - RNA, 21 nt, Human
agccguggcuucccgcucagc

SEQ ID NO: 1331526 - RNA, 22 nt, Human
agccguggcuucccgcucagcc

SEQ ID NO: 1331527 - RNA, 23 nt, Human
agccguggcuucccgcucagccc

SEQ ID NO: 1331528 - RNA, 19 nt, Human
agccguuuguuccccaaga

SEQ ID NO: 1331529 - RNA, 16 nt, Human
agccgugguccuuugg

SEQ ID NO: 1331530 - RNA, 13 nt, Human
agccucccaaagu

SEQ ID NO: 1331531 - RNA, 14 nt, Human
agccucccaaagug

SEQ ID NO: 1331532 - RNA, 20 nt, Human
agccucauguccacugguuc

SEQ ID NO: 1331533 - RNA, 18 nt, Human
agccuccaugcugccucc

SEQ ID NO: 1331534 - RNA, 20 nt, Human
agccuccaugcugccuccag

SEQ ID NO: 1331535 - RNA, 15 nt, Human
agccucauguccacu

SEQ ID NO: 1331536 - RNA, 22 nt, Human
ugcacaccuacuagucaccaga

SEQ ID NO: 1331537 - RNA, 20 nt, Human
ugcacaccuacuagucacca

SEQ ID NO: 1331538 - RNA, 19 nt, Human
ugcacaccccacucccaca

SEQ ID NO: 1331539 - RNA, 20 nt, Human
ugcacacccuccagagacaa

SEQ ID NO: 1331540 - RNA, 19 nt, Human
ugcaccaugcugcugggga

SEQ ID NO: 1331541 - RNA, 23 nt, Human
ugcaccaugcugcuggggaagac

SEQ ID NO: 1331542 - RNA, 22 nt, Human
ugcaccaugcugcuggggaaga

SEQ ID NO: 1331543 - RNA, 16 nt, Human
ugcacaccccacuccc

SEQ ID NO: 1331544 - RNA, 18 nt, Human
ugcacaccccacucccac

SEQ ID NO: 1331545 - RNA, 19 nt, Human
ugcacguggccucuugagc

SEQ ID NO: 1331546 - RNA, 22 nt, Human
ugcacguggccucuugagcagu

SEQ ID NO: 1331547 - RNA, 21 nt, Human
agcccugcuuugggcugcccu

SEQ ID NO: 1331548 - RNA, 15 nt, Human
agccccuucugcuca

SEQ ID NO: 1331549 - RNA, 16 nt, Human
agccccuucugcucag

SEQ ID NO: 1331550 - RNA, 19 nt, Human
agccccuucugcucagcuc

SEQ ID NO: 1331551 - RNA, 22 nt, Human
agccccuucugcucagcucugg

SEQ ID NO: 1331552 - RNA, 22 nt, Human
agcccugcuuugggcugcccug

SEQ ID NO: 1331553 - RNA, 23 nt, Human
agcccugcuuugggcugcccugg

SEQ ID NO: 1331554 - RNA, 12 nt, Human
ugcacacagcac

SEQ ID NO: 1331555 - RNA, 24 nt, Human
ugcacacagcacgggggccaagga

SEQ ID NO: 1331556 - RNA, 20 nt, Human
agcccugucagcaugaauuu

SEQ ID NO: 1331557 - RNA, 16 nt, Human
agccccugccccuccu

SEQ ID NO: 1331558 - RNA, 22 nt, Human
agccccuaagucaacuuagcau

SEQ ID NO: 1331559 - RNA, 22 nt, Human
agcccccagcucccaccucccc

SEQ ID NO: 1331560 - RNA, 19 nt, Human
agcccauggagauugaccu

SEQ ID NO: 1331561 - RNA, 21 nt, Human
agcccauggagauugaccugg

SEQ ID NO: 1331562 - RNA, 22 nt, Human
agcccauggagauugaccugga

SEQ ID NO: 1331563 - RNA, 13 nt, Human
agcccccacccug

SEQ ID NO: 1331564 - RNA, 17 nt, Human
agcccccacccuguucc

SEQ ID NO: 1331565 - RNA, 18 nt, Human
agcccccacccuguuccu

SEQ ID NO: 1331566 - RNA, 19 nt, Human
agcccccacccuguuccug

SEQ ID NO: 1331567 - RNA, 22 nt, Human
agcccccacccuguuccugcug

SEQ ID NO: 1331568 - RNA, 23 nt, Human
agcccccacccuguuccugcugc

SEQ ID NO: 1331569 - RNA, 19 nt, Human
agcccccaccgugggcagg

SEQ ID NO: 1331570 - RNA, 12 nt, Human
agcccccagagc

SEQ ID NO: 1331571 - RNA, 13 nt, Human
agcccccagagcc

SEQ ID NO: 1331572 - RNA, 18 nt, Human
agcccccagagcccaggc

SEQ ID NO: 1331573 - RNA, 14 nt, Human
agcccccagagccc

SEQ ID NO: 1331574 - RNA, 13 nt, Human
agcccccagccug

SEQ ID NO: 1331575 - RNA, 14 nt, Human
agcccccagccugu

SEQ ID NO: 1331576 - RNA, 15 nt, Human
agcccccagccuguc

SEQ ID NO: 1331577 - RNA, 12 nt, Human
agcccccagcua

SEQ ID NO: 1331578 - RNA, 19 nt, Human
agcccccagcuaagaaccu

SEQ ID NO: 1331579 - RNA, 20 nt, Human
agcccccagcuaagaaccug

SEQ ID NO: 1331580 - RNA, 22 nt, Human
agcccccagcuaagaaccugga

SEQ ID NO: 1331581 - RNA, 16 nt, Human
agcccccagccuguca

SEQ ID NO: 1331582 - RNA, 17 nt, Human
agcccccagcucccacc

SEQ ID NO: 1331583 - RNA, 18 nt, Human
agcccauggcacucuaug

SEQ ID NO: 1331584 - RNA, 21 nt, Human
agcccauaugcuaccaccagc

SEQ ID NO: 1331585 - RNA, 14 nt, Human
agcccauaugcuac

SEQ ID NO: 1331586 - RNA, 14 nt, Human
agcccauccugacc

SEQ ID NO: 1331587 - RNA, 15 nt, Human
agcccauccugacca

SEQ ID NO: 1331588 - RNA, 16 nt, Human
agcccauccugaccag

SEQ ID NO: 1331589 - RNA, 23 nt, Human
agcccauccugaccagcugcucc

SEQ ID NO: 1331590 - RNA, 17 nt, Human
agcccauccugaccagc

SEQ ID NO: 1331591 - RNA, 17 nt, Human
agcccauggagauugac

SEQ ID NO: 1331592 - RNA, 18 nt, Human
ugauucgaaugacacugu

SEQ ID NO: 1331593 - RNA, 21 nt, Human
ugauucuauuuauauguacau

SEQ ID NO: 1331594 - RNA, 22 nt, Human
ugauucuauuuauauguacaug

SEQ ID NO: 1331595 - RNA, 18 nt, Human
agcccaguagaccuuguu

SEQ ID NO: 1331596 - RNA, 18 nt, Human
agcccagugcacugaaag

SEQ ID NO: 1331597 - RNA, 15 nt, Human
agcccaguagaccuu

SEQ ID NO: 1331598 - RNA, 15 nt, Human
ugagucaaaaaaucu

SEQ ID NO: 1331599 - RNA, 18 nt, Human
ugagucaaguuguuccuu

SEQ ID NO: 1331600 - RNA, 17 nt, Human
ugaguauuaaaauguau

SEQ ID NO: 1331601 - RNA, 14 nt, Human
ugaguauuaaaaug

SEQ ID NO: 1331602 - RNA, 18 nt, Human
ugaguauuaaaauguaug

SEQ ID NO: 1331603 - RNA, 12 nt, Human
ugagugcucuga

SEQ ID NO: 1331604 - RNA, 13 nt, Human
ugagugcucugau

SEQ ID NO: 1331605 - RNA, 19 nt, Human
ugagugcucugaucccucu

SEQ ID NO: 1331606 - RNA, 19 nt, Human
ugagugcuugcuuuucaug

SEQ ID NO: 1331607 - RNA, 21 nt, Human
ugagugggguuaucucugugu

SEQ ID NO: 1331608 - RNA, 22 nt, Human
ugagugggguuaucucuguguu

SEQ ID NO: 1331609 - RNA, 12 nt, Human
ugauacagaaaa

SEQ ID NO: 1331610 - RNA, 21 nt, Human
ugauacagaaaaguugaauuu

SEQ ID NO: 1331611 - RNA, 16 nt, Human
ugauacgaugcuucaa

SEQ ID NO: 1331612 - RNA, 14 nt, Human
ugauacuaagcauu

SEQ ID NO: 1331613 - RNA, 16 nt, Human
ugauacuaagcauuga

SEQ ID NO: 1331614 - RNA, 13 nt, Human
ugauacuaauaaa

SEQ ID NO: 1331615 - RNA, 14 nt, Human
ugauacuaauaaac

SEQ ID NO: 1331616 - RNA, 15 nt, Human
ugauacuaauaaacu

SEQ ID NO: 1331617 - RNA, 17 nt, Human
ugauaagagaaucaaca

SEQ ID NO: 1331618 - RNA, 18 nt, Human
ugauaagagaaucaacau

SEQ ID NO: 1331619 - RNA, 12 nt, Human
ugauaagaucuu

SEQ ID NO: 1331620 - RNA, 15 nt, Human
ugauaagaucuuuua

SEQ ID NO: 1331621 - RNA, 22 nt, Human
ugauaagaucuuuuauuuugcc

SEQ ID NO: 1331622 - RNA, 15 nt, Human
ugauaaugaacagaa

SEQ ID NO: 1331623 - RNA, 16 nt, Human
ugauaaugaacagaac

SEQ ID NO: 1331624 - RNA, 20 nt, Human
ugauaaugaacagaacauag

SEQ ID NO: 1331625 - RNA, 18 nt, Human
ugauaaugaacagaacau

SEQ ID NO: 1331626 - RNA, 23 nt, Human
agcauaaauguugacaugggaca

SEQ ID NO: 1331627 - RNA, 17 nt, Human
agcauaaguuucuggga

SEQ ID NO: 1331628 - RNA, 23 nt, Human
agcauaaguuucugggaccucag

SEQ ID NO: 1331629 - RNA, 21 nt, Human
agcauaauacuugcuuuggaa

SEQ ID NO: 1331630 - RNA, 20 nt, Human
ugagaauuugagugcucuga

SEQ ID NO: 1331631 - RNA, 21 nt, Human
ugagacaagaaaauaagagcu

SEQ ID NO: 1331632 - RNA, 23 nt, Human
ugagacaagaaaauaagagcuca

SEQ ID NO: 1331633 - RNA, 16 nt, Human
ugagacaaugccuugu

SEQ ID NO: 1331634 - RNA, 15 nt, Human
ugagacaaugccuug

SEQ ID NO: 1331635 - RNA, 22 nt, Human
ugaguaacugauuuguaacaag

SEQ ID NO: 1331636 - RNA, 10 nt, Human
ugaguaacau

SEQ ID NO: 1331637 - RNA, 15 nt, Human
ugaguaacauuugcu

SEQ ID NO: 1331638 - RNA, 16 nt, Human
ugaguaacauuugcug

SEQ ID NO: 1331639 - RNA, 17 nt, Human
ugaguaacauuugcugu

SEQ ID NO: 1331640 - RNA, 18 nt, Human
ugaguaacauuugcuguu

SEQ ID NO: 1331641 - RNA, 19 nt, Human
ugaguaacauuugcuguuu

SEQ ID NO: 1331642 - RNA, 14 nt, Human
ugaguagaguugau

SEQ ID NO: 1331643 - RNA, 20 nt, Human
ugaguagagagcaagggaag

SEQ ID NO: 1331644 - RNA, 20 nt, Human
ugaguacuccacacugcaca

SEQ ID NO: 1331645 - RNA, 21 nt, Human
ugaguacuccacacugcacaa

SEQ ID NO: 1331646 - RNA, 17 nt, Human
ugaguagaguugaucaa

SEQ ID NO: 1331647 - RNA, 13 nt, Human
ugaguagcuggga

SEQ ID NO: 1331648 - RNA, 19 nt, Human
ugaguagcuuauacaauua

SEQ ID NO: 1331649 - RNA, 18 nt, Human
ugauagacaauugaggua

SEQ ID NO: 1331650 - RNA, 17 nt, Human
ugauagacaauugaggu

SEQ ID NO: 1331651 - RNA, 19 nt, Human
ugauagaaaugccaagcac

SEQ ID NO: 1331652 - RNA, 12 nt, Human
ugauaugggucu

SEQ ID NO: 1331653 - RNA, 15 nt, Human
ugauaugugaacagu

SEQ ID NO: 1331654 - RNA, 16 nt, Human
ugauaugugaacaguu

SEQ ID NO: 1331655 - RNA, 17 nt, Human
ugauacuucgacacugu

SEQ ID NO: 1331656 - RNA, 18 nt, Human
ugauacuucgacacuguu

SEQ ID NO: 1331657 - RNA, 21 nt, Human
ugauacuucgacacuguucuu

SEQ ID NO: 1331658 - RNA, 20 nt, Human
ugauacuucgacacuguucu

SEQ ID NO: 1331659 - RNA, 16 nt, Human
ugauacuaauaaacua

SEQ ID NO: 1331660 - RNA, 22 nt, Human
ugauacuaauaaacuaauaauu

SEQ ID NO: 1331661 - RNA, 11 nt, Human
ugauacuguug

SEQ ID NO: 1331662 - RNA, 13 nt, Human
ugauacuguugca

SEQ ID NO: 1331663 - RNA, 14 nt, Human
ugauacuguugcac

SEQ ID NO: 1331664 - RNA, 16 nt, Human
ugauacuguugcacgu

SEQ ID NO: 1331665 - RNA, 18 nt, Human
ugauacuguugcacgugu

SEQ ID NO: 1331666 - RNA, 19 nt, Human
ugauacuguugcacgugug

SEQ ID NO: 1331667 - RNA, 20 nt, Human
ugauacuguugcacgugugu

SEQ ID NO: 1331668 - RNA, 19 nt, Human
ugauauuuucaacgcagcc

SEQ ID NO: 1331669 - RNA, 21 nt, Human
ugauauuuucaacgcagcccu

SEQ ID NO: 1331670 - RNA, 22 nt, Human
ugauauuuucaacgcagcccug

SEQ ID NO: 1331671 - RNA, 23 nt, Human
ugauauuuucaacgcagcccugc

SEQ ID NO: 1331672 - RNA, 19 nt, Human
ugauauuuccccaugguuu

SEQ ID NO: 1331673 - RNA, 17 nt, Human
ugauauuucuagcuuau

SEQ ID NO: 1331674 - RNA, 12 nt, Human
ugauauucuaag

SEQ ID NO: 1331675 - RNA, 15 nt, Human
ugauauucuaagacu

SEQ ID NO: 1331676 - RNA, 17 nt, Human
ugauauucuaagacuua

SEQ ID NO: 1331677 - RNA, 17 nt, Human
ugauauuguuauauaca

SEQ ID NO: 1331678 - RNA, 19 nt, Human
ugauauuguuauauacaua

SEQ ID NO: 1331679 - RNA, 19 nt, Human
ugaucaaaaucaauuaaaa

SEQ ID NO: 1331680 - RNA, 15 nt, Human
ugauauuuucucuag

SEQ ID NO: 1331681 - RNA, 16 nt, Human
ugaucaaauguuuaau

SEQ ID NO: 1331682 - RNA, 15 nt, Human
ugaucaaauguuuaa

SEQ ID NO: 1331683 - RNA, 14 nt, Human
ugaucaaauguuua

SEQ ID NO: 1331684 - RNA, 13 nt, Human
ugaucaaauguuu

SEQ ID NO: 1331685 - RNA, 19 nt, Human
ugaucaaauguuuaaucau

SEQ ID NO: 1331686 - RNA, 22 nt, Human
ugaucaaauguuuaaucauaua

SEQ ID NO: 1331687 - RNA, 18 nt, Human
ugaucaaauguuuaauca

SEQ ID NO: 1331688 - RNA, 17 nt, Human
ugaucaaauguuuaauc

SEQ ID NO: 1331689 - RNA, 14 nt, Human
ugauauuuucucua

SEQ ID NO: 1331690 - RNA, 17 nt, Human
ugauauuuucugugccu

SEQ ID NO: 1331691 - RNA, 20 nt, Human
ugauauuuucugugccugaa

SEQ ID NO: 1331692 - RNA, 11 nt, Human
ugaucaaggcc

SEQ ID NO: 1331693 - RNA, 13 nt, Human
ugaucaaggccuu

SEQ ID NO: 1331694 - RNA, 12 nt, Human
ugaucaaggccu

SEQ ID NO: 1331695 - RNA, 20 nt, Human
agcaucacaugaacuuguaa

SEQ ID NO: 1331696 - RNA, 14 nt, Human
agcaucacagaaug

SEQ ID NO: 1331697 - RNA, 13 nt, Human
agcaucacagaau

SEQ ID NO: 1331698 - RNA, 20 nt, Human
agcaugucgucaaagcugaa

SEQ ID NO: 1331699 - RNA, 17 nt, Human
agcaugucgucaaagcu

SEQ ID NO: 1331700 - RNA, 15 nt, Human
agcauggcuauuuua

SEQ ID NO: 1331701 - RNA, 18 nt, Human
agcauggcuauuuuauau

SEQ ID NO: 1331702 - RNA, 17 nt, Human
agcauggcuauuuuaua

SEQ ID NO: 1331703 - RNA, 20 nt, Human
agcauguacggauuuucagu

SEQ ID NO: 1331704 - RNA, 21 nt, Human
agcauguacggauuuucaguu

SEQ ID NO: 1331705 - RNA, 21 nt, Human
agcauguacugagccuuguaa

SEQ ID NO: 1331706 - RNA, 16 nt, Human
agcaugucacuaaagc

SEQ ID NO: 1331707 - RNA, 17 nt, Human
agcauuucccuuccuuc

SEQ ID NO: 1331708 - RNA, 14 nt, Human
agcauuucucauca

SEQ ID NO: 1331709 - RNA, 22 nt, Human
agcauuguaaaauuauuucaug

SEQ ID NO: 1331710 - RNA, 15 nt, Human
agcauuguagugcuu

SEQ ID NO: 1331711 - RNA, 18 nt, Human
agcauuguagugcuuuga

SEQ ID NO: 1331712 - RNA, 22 nt, Human
agcauuguagugcuuugagaga

SEQ ID NO: 1331713 - RNA, 20 nt, Human
agcauuguagugcuuugaga

SEQ ID NO: 1331714 - RNA, 17 nt, Human
agcauuucacuuauuua

SEQ ID NO: 1331715 - RNA, 17 nt, Human
agcauuguaaaagcauu

SEQ ID NO: 1331716 - RNA, 14 nt, Human
agcauuguaaaaua

SEQ ID NO: 1331717 - RNA, 15 nt, Human
agcauuguaaaauaa

SEQ ID NO: 1331718 - RNA, 16 nt, Human
agcauuguaaaauaau

SEQ ID NO: 1331719 - RNA, 20 nt, Human
agcauuguaaaauaauucug

SEQ ID NO: 1331720 - RNA, 17 nt, Human
agcaugucuauucagcu

SEQ ID NO: 1331721 - RNA, 19 nt, Human
agcaugucuauucagcuuc

SEQ ID NO: 1331722 - RNA, 12 nt, Human
agcauguuacug

SEQ ID NO: 1331723 - RNA, 12 nt, Human
agcauguuuaga

SEQ ID NO: 1331724 - RNA, 13 nt, Human
agcauguuuagac

SEQ ID NO: 1331725 - RNA, 18 nt, Human
agcauguuuagacuuuaa

SEQ ID NO: 1331726 - RNA, 21 nt, Human
agcauguuuagacuuuaacau

SEQ ID NO: 1331727 - RNA, 22 nt, Human
agcauguuuagacuuuaacaua

SEQ ID NO: 1331728 - RNA, 24 nt, Human
agcauguuuagacuuuaacauaag

SEQ ID NO: 1331729 - RNA, 23 nt, Human
agcauguuuagacuuuaacauaa

SEQ ID NO: 1331730 - RNA, 15 nt, Human
agcauugaauggcua

SEQ ID NO: 1331731 - RNA, 17 nt, Human
ugaugaagaaguugaua

SEQ ID NO: 1331732 - RNA, 15 nt, Human
ugaucgccuuuccca

SEQ ID NO: 1331733 - RNA, 17 nt, Human
ugaucgccuuucccagg

SEQ ID NO: 1331734 - RNA, 15 nt, Human
ugaucgccuucccca

SEQ ID NO: 1331735 - RNA, 13 nt, Human
ugaugaagaggag

SEQ ID NO: 1331736 - RNA, 14 nt, Human
ugaugaagaggagu

SEQ ID NO: 1331737 - RNA, 14 nt, Human
ugaugaagagagag

SEQ ID NO: 1331738 - RNA, 14 nt, Human
ugaugaauacugua

SEQ ID NO: 1331739 - RNA, 14 nt, Human
ugaugaggcccucc

SEQ ID NO: 1331740 - RNA, 15 nt, Human
ugaugaggcccucca

SEQ ID NO: 1331741 - RNA, 16 nt, Human
ugaugaggcccuccac

SEQ ID NO: 1331742 - RNA, 17 nt, Human
ugaugaggcccuccaca

SEQ ID NO: 1331743 - RNA, 21 nt, Human
ugaugaggcccuccacaccug

SEQ ID NO: 1331744 - RNA, 23 nt, Human
ugaugaggcccuccacaccugcg

SEQ ID NO: 1331745 - RNA, 13 nt, Human
ugaugagggcagc

SEQ ID NO: 1331746 - RNA, 15 nt, Human
ugaugagggcagcag

SEQ ID NO: 1331747 - RNA, 16 nt, Human
ugaugagggcagcagc

SEQ ID NO: 1331748 - RNA, 17 nt, Human
ugaugagggcagcagcc

SEQ ID NO: 1331749 - RNA, 19 nt, Human
ugaugagggcagcagccag

SEQ ID NO: 1331750 - RNA, 21 nt, Human
ugaugagggcagcagccagcc

SEQ ID NO: 1331751 - RNA, 22 nt, Human
ugaugagggcagcagccagccc

SEQ ID NO: 1331752 - RNA, 23 nt, Human
ugaugagggcagcagccagcccu

SEQ ID NO: 1331753 - RNA, 12 nt, Human
ugauccauguaa

SEQ ID NO: 1331754 - RNA, 13 nt, Human
ugauccauguaac

SEQ ID NO: 1331755 - RNA, 14 nt, Human
ugauccauguaacu

SEQ ID NO: 1331756 - RNA, 15 nt, Human
ugauccauguaacug

SEQ ID NO: 1331757 - RNA, 21 nt, Human
ugauccuguauucagacagau

SEQ ID NO: 1331758 - RNA, 18 nt, Human
ugauccuuuuggagucag

SEQ ID NO: 1331759 - RNA, 20 nt, Human
ugauccuguauucagacaga

SEQ ID NO: 1331760 - RNA, 15 nt, Human
ugauccuuacaaguu

SEQ ID NO: 1331761 - RNA, 13 nt, Human
ugaucgccuuccc

SEQ ID NO: 1331762 - RNA, 14 nt, Human
ugaucgccuucccc

SEQ ID NO: 1331763 - RNA, 18 nt, Human
agccaccgugccuggcca

SEQ ID NO: 1331764 - RNA, 22 nt, Human
agccaccgaagccgccugugga

SEQ ID NO: 1331765 - RNA, 14 nt, Human
agccacccugaguu

SEQ ID NO: 1331766 - RNA, 21 nt, Human
agccacauuuggaauacuuuu

SEQ ID NO: 1331767 - RNA, 22 nt, Human
agccacauuuggaauacuuuuu

SEQ ID NO: 1331768 - RNA, 23 nt, Human
agccacauuuggaauacuuuuug

SEQ ID NO: 1331769 - RNA, 12 nt, Human
agccacccugag

SEQ ID NO: 1331770 - RNA, 13 nt, Human
agccacccugagg

SEQ ID NO: 1331771 - RNA, 14 nt, Human
agccacccugagga

SEQ ID NO: 1331772 - RNA, 18 nt, Human
agccacccugaggagucu

SEQ ID NO: 1331773 - RNA, 19 nt, Human
agccacccugaggagucug

SEQ ID NO: 1331774 - RNA, 20 nt, Human
agccacccugaggagucuga

SEQ ID NO: 1331775 - RNA, 21 nt, Human
agccacccugaggagucugag

SEQ ID NO: 1331776 - RNA, 22 nt, Human
agccacccugaggagucugagg

SEQ ID NO: 1331777 - RNA, 15 nt, Human
agccaccgaagccgc

SEQ ID NO: 1331778 - RNA, 20 nt, Human
agccaccgaagccgccugug

SEQ ID NO: 1331779 - RNA, 21 nt, Human
agccaccgaagccgccugugg

SEQ ID NO: 1331780 - RNA, 18 nt, Human
agcauuucucaucaguag

SEQ ID NO: 1331781 - RNA, 15 nt, Human
agccacauuuggaau

SEQ ID NO: 1331782 - RNA, 20 nt, Human
agccacauuuggaauacuuu

SEQ ID NO: 1331783 - RNA, 15 nt, Human
ugauggugguauguu

SEQ ID NO: 1331784 - RNA, 13 nt, Human
ugaugauccauua

SEQ ID NO: 1331785 - RNA, 23 nt, Human
ugauuaaaaugcuuccucccagc

SEQ ID NO: 1331786 - RNA, 24 nt, Human
ugaugagggcagcagccagcccug

SEQ ID NO: 1331787 - RNA, 13 nt, Human
ugaugaguuguga

SEQ ID NO: 1331788 - RNA, 20 nt, Human
agccacuuucaaucuucaau

SEQ ID NO: 1331789 - RNA, 19 nt, Human
agccacuugccugugcuac

SEQ ID NO: 1331790 - RNA, 22 nt, Human
agccacuugccugugcuacaau

SEQ ID NO: 1331791 - RNA, 23 nt, Human
agccacuuucaaucuucaauccu

SEQ ID NO: 1331792 - RNA, 15 nt, Human
agccacuugccugug

SEQ ID NO: 1331793 - RNA, 12 nt, Human
agccacugccau

SEQ ID NO: 1331794 - RNA, 17 nt, Human
agccacuuaaaauguuc

SEQ ID NO: 1331795 - RNA, 16 nt, Human
ugauuaccagggacug

SEQ ID NO: 1331796 - RNA, 14 nt, Human
agccacuccucuga

SEQ ID NO: 1331797 - RNA, 15 nt, Human
agccacuccucugac

SEQ ID NO: 1331798 - RNA, 14 nt, Human
ugauuaccagggac

SEQ ID NO: 1331799 - RNA, 21 nt, Human
agccacuccucugacucaggg

SEQ ID NO: 1331800 - RNA, 22 nt, Human
agccacuccucugacucagggc

SEQ ID NO: 1331801 - RNA, 16 nt, Human
ugauuacagugcagug

SEQ ID NO: 1331802 - RNA, 12 nt, Human
ugauuaaaccaa

SEQ ID NO: 1331803 - RNA, 15 nt, Human
ugauuaaagaugagc

SEQ ID NO: 1331804 - RNA, 22 nt, Human
ugauuaaagaugagcuuugucu

SEQ ID NO: 1331805 - RNA, 14 nt, Human
ugauuacagugcag

SEQ ID NO: 1331806 - RNA, 22 nt, Human
agccaggaagaucccccagaaa

SEQ ID NO: 1331807 - RNA, 21 nt, Human
agccaggaagaucccccagaa

SEQ ID NO: 1331808 - RNA, 17 nt, Human
agccaggaauuucccag

SEQ ID NO: 1331809 - RNA, 19 nt, Human
agccaggaauuucccagga

SEQ ID NO: 1331810 - RNA, 20 nt, Human
agccaggaagaucccccaga

SEQ ID NO: 1331811 - RNA, 22 nt, Human
agccagcuuucccugccucuca

SEQ ID NO: 1331812 - RNA, 16 nt, Human
agccagcuuucccugc

SEQ ID NO: 1331813 - RNA, 18 nt, Human
agccagcuuucccugccu

SEQ ID NO: 1331814 - RNA, 20 nt, Human
agccaggaauuucccaggac

SEQ ID NO: 1331815 - RNA, 21 nt, Human
agccaggaauuucccaggacc

SEQ ID NO: 1331816 - RNA, 22 nt, Human
agccaggaauuucccaggaccc

SEQ ID NO: 1331817 - RNA, 23 nt, Human
agccaggaauuucccaggacccu

SEQ ID NO: 1331818 - RNA, 13 nt, Human
agccaggagaagc

SEQ ID NO: 1331819 - RNA, 14 nt, Human
agccaggagaagcu

SEQ ID NO: 1331820 - RNA, 15 nt, Human
agccaggagaagcuc

SEQ ID NO: 1331821 - RNA, 20 nt, Human
agccaggagaagcucagcug

SEQ ID NO: 1331822 - RNA, 14 nt, Human
agccaggaggccug

SEQ ID NO: 1331823 - RNA, 16 nt, Human
agccaggaggccugcu

SEQ ID NO: 1331824 - RNA, 19 nt, Human
agccaggaggccugcuagg

SEQ ID NO: 1331825 - RNA, 22 nt, Human
agccagaacuugacccugagcu

SEQ ID NO: 1331826 - RNA, 15 nt, Human
agccagaccagcagg

SEQ ID NO: 1331827 - RNA, 13 nt, Human
agccagcugcccc

SEQ ID NO: 1331828 - RNA, 14 nt, Human
agccagcugccccc

SEQ ID NO: 1331829 - RNA, 19 nt, Human
agccagcugcccccagagc

SEQ ID NO: 1331830 - RNA, 20 nt, Human
agccagcugcccccagagcc

SEQ ID NO: 1331831 - RNA, 12 nt, Human
agccagcuuguu

SEQ ID NO: 1331832 - RNA, 19 nt, Human
agccagcuuguuuacaugc

SEQ ID NO: 1331833 - RNA, 20 nt, Human
agccagcuuguuuacaugcu

SEQ ID NO: 1331834 - RNA, 21 nt, Human
agccagcuuguuuacaugcuu

SEQ ID NO: 1331835 - RNA, 13 nt, Human
agccagcuuuccc

SEQ ID NO: 1331836 - RNA, 14 nt, Human
agccagcuuucccu

SEQ ID NO: 1331837 - RNA, 15 nt, Human
agccagggucuccag

SEQ ID NO: 1331838 - RNA, 15 nt, Human
agccaguaauccugu

SEQ ID NO: 1331839 - RNA, 14 nt, Human
agccaguaauccug

SEQ ID NO: 1331840 - RNA, 13 nt, Human
agccaguaauccu

SEQ ID NO: 1331841 - RNA, 15 nt, Human
agccagugcccugag

SEQ ID NO: 1331842 - RNA, 16 nt, Human
agccagugcccugagc

SEQ ID NO: 1331843 - RNA, 17 nt, Human
agccagugcccugagcc

SEQ ID NO: 1331844 - RNA, 18 nt, Human
agccagugcccugagcca

SEQ ID NO: 1331845 - RNA, 23 nt, Human
agccagugcccugagccaggguc

SEQ ID NO: 1331846 - RNA, 22 nt, Human
agccaguuuggguaaaauacuu

SEQ ID NO: 1331847 - RNA, 23 nt, Human
agccaguuuggguaaaauacuuu

SEQ ID NO: 1331848 - RNA, 10 nt, Human
agccauagug

SEQ ID NO: 1331849 - RNA, 14 nt, Human
agccauauuuguaa

SEQ ID NO: 1331850 - RNA, 16 nt, Human
agccauauuuguaaaa

SEQ ID NO: 1331851 - RNA, 19 nt, Human
agccagggggagcugggcc

SEQ ID NO: 1331852 - RNA, 21 nt, Human
agccagggggagcugggccug

SEQ ID NO: 1331853 - RNA, 14 nt, Human
agccagggucucca

SEQ ID NO: 1331854 - RNA, 16 nt, Human
agccagggucuccaga

SEQ ID NO: 1331855 - RNA, 17 nt, Human
agccaggggagcagagg

SEQ ID NO: 1331856 - RNA, 18 nt, Human
agccaggggagcagaggg

SEQ ID NO: 1331857 - RNA, 23 nt, Human
agccaggggagcagaggggcaga

SEQ ID NO: 1331858 - RNA, 14 nt, Human
agccaggcccagcc

SEQ ID NO: 1331859 - RNA, 13 nt, Human
agccaggcccagc

SEQ ID NO: 1331860 - RNA, 21 nt, Human
agccaugucuucucccuggaa

SEQ ID NO: 1331861 - RNA, 10 nt, Human
agcccagaga

SEQ ID NO: 1331862 - RNA, 11 nt, Human
agcccagagac

SEQ ID NO: 1331863 - RNA, 12 nt, Human
agcccagagaca

SEQ ID NO: 1331864 - RNA, 21 nt, Human
agcccagagacauacuugaag

SEQ ID NO: 1331865 - RNA, 22 nt, Human
agcccagagacauacuugaagg

SEQ ID NO: 1331866 - RNA, 15 nt, Human
agccaugucuucucc

SEQ ID NO: 1331867 - RNA, 16 nt, Human
agccaugucuucuccc

SEQ ID NO: 1331868 - RNA, 17 nt, Human
agccaugucuucucccu

SEQ ID NO: 1331869 - RNA, 13 nt, Human
agccaucaaaaug

SEQ ID NO: 1331870 - RNA, 14 nt, Human
agccaucaaaaugc

SEQ ID NO: 1331871 - RNA, 15 nt, Human
agccaucaaaaugcu

SEQ ID NO: 1331872 - RNA, 16 nt, Human
agccaucaaaaugcuu

SEQ ID NO: 1331873 - RNA, 21 nt, Human
agccauauuuguaaaaugaca

SEQ ID NO: 1331874 - RNA, 18 nt, Human
agccauggguagccuggg

SEQ ID NO: 1331875 - RNA, 14 nt, Human
agcccagcucugaa

SEQ ID NO: 1331876 - RNA, 13 nt, Human
agcccagcugggu

SEQ ID NO: 1331877 - RNA, 15 nt, Human
agcccagcuggguca

SEQ ID NO: 1331878 - RNA, 16 nt, Human
agcccagcugggucag

SEQ ID NO: 1331879 - RNA, 11 nt, Human
agcccagccca

SEQ ID NO: 1331880 - RNA, 16 nt, Human
agcccagccccacucc

SEQ ID NO: 1331881 - RNA, 19 nt, Human
agcccagccccacuccucu

SEQ ID NO: 1331882 - RNA, 12 nt, Human
agcccagcucca

SEQ ID NO: 1331883 - RNA, 17 nt, Human
agcccagcugggucagg

SEQ ID NO: 1331884 - RNA, 21 nt, Human
agcccaggaagucucaucugg

SEQ ID NO: 1331885 - RNA, 24 nt, Human
ugauucaguguuaaaugugaugaa

SEQ ID NO: 1331886 - RNA, 20 nt, Human
ugauucauuuuaacaucuga

SEQ ID NO: 1331887 - RNA, 12 nt, Human
ugauucaguguu

SEQ ID NO: 1331888 - RNA, 21 nt, Human
ugauucaguguuaaaugugau

SEQ ID NO: 1331889 - RNA, 22 nt, Human
ugauucauuuuaacaucugaga

SEQ ID NO: 1331890 - RNA, 15 nt, Human
ugauuccagccauca

SEQ ID NO: 1331891 - RNA, 19 nt, Human
ugauuccagccaucaccuu

SEQ ID NO: 1331892 - RNA, 16 nt, Human
ugauuccauccaccuu

SEQ ID NO: 1331893 - RNA, 18 nt, Human
ugauuccauccaccuuuc

SEQ ID NO: 1331894 - RNA, 15 nt, Human
ugauuccuuuaacaa

SEQ ID NO: 1331895 - RNA, 14 nt, Human
ugauuccuuuaaca

SEQ ID NO: 1331896 - RNA, 16 nt, Human
agaugcaguucugaag

SEQ ID NO: 1331897 - RNA, 17 nt, Human
agaugcaguucugaaga

SEQ ID NO: 1331898 - RNA, 13 nt, Human
agaugcagggcag

SEQ ID NO: 1331899 - RNA, 17 nt, Human
ugacacuuaaaaauggu

SEQ ID NO: 1331900 - RNA, 14 nt, Human
ugacacucccuugg

SEQ ID NO: 1331901 - RNA, 16 nt, Human
agaugcagggcaguca

SEQ ID NO: 1331902 - RNA, 15 nt, Human
agaugcccaaauccu

SEQ ID NO: 1331903 - RNA, 15 nt, Human
agaugcagugccagg

SEQ ID NO: 1331904 - RNA, 20 nt, Human
agaugcugacuguacuccuc

SEQ ID NO: 1331905 - RNA, 16 nt, Human
agaugcugaaaauguc

SEQ ID NO: 1331906 - RNA, 15 nt, Human
agaugcuccuugggc

SEQ ID NO: 1331907 - RNA, 20 nt, Human
agaugcuccuugggcccuuu

SEQ ID NO: 1331908 - RNA, 23 nt, Human
agaugcugacuguacuccuccca

SEQ ID NO: 1331909 - RNA, 20 nt, Human
agaugcugauggagccuucc

SEQ ID NO: 1331910 - RNA, 20 nt, Human
agauuaaccuucucuguccg

SEQ ID NO: 1331911 - RNA, 13 nt, Human
agauuaagaaaua

SEQ ID NO: 1331912 - RNA, 21 nt, Human
ugaccccaaacaccuuccagc

SEQ ID NO: 1331913 - RNA, 18 nt, Human
agauguuuauucuucuag

SEQ ID NO: 1331914 - RNA, 19 nt, Human
agauguuuauucuucuaga

SEQ ID NO: 1331915 - RNA, 20 nt, Human
agauguuuauucuucuagag

SEQ ID NO: 1331916 - RNA, 21 nt, Human
agauguuuauucuucuagagu

SEQ ID NO: 1331917 - RNA, 22 nt, Human
agauguuuauucuucuagaguu

SEQ ID NO: 1331918 - RNA, 15 nt, Human
agauguuuauuucag

SEQ ID NO: 1331919 - RNA, 16 nt, Human
agauguuuauuucagg

SEQ ID NO: 1331920 - RNA, 17 nt, Human
agauguuugauagauuu

SEQ ID NO: 1331921 - RNA, 19 nt, Human
agauguuugauagauuuuc

SEQ ID NO: 1331922 - RNA, 16 nt, Human
ugacucgggggugggg

SEQ ID NO: 1331923 - RNA, 17 nt, Human
ugacucgggggugggga

SEQ ID NO: 1331924 - RNA, 17 nt, Human
ugacuccauagaccuuu

SEQ ID NO: 1331925 - RNA, 21 nt, Human
ugacuccauagaccuuuucau

SEQ ID NO: 1331926 - RNA, 14 nt, Human
ugacucacaccuga

SEQ ID NO: 1331927 - RNA, 19 nt, Human
ugacucacaccugaacuga

SEQ ID NO: 1331928 - RNA, 23 nt, Human
ugacuagaugauggaugccaaua

SEQ ID NO: 1331929 - RNA, 13 nt, Human
ugacuagggagcc

SEQ ID NO: 1331930 - RNA, 17 nt, Human
ugacuagggagccaugu

SEQ ID NO: 1331931 - RNA, 18 nt, Human
ugacuagggagccauguu

SEQ ID NO: 1331932 - RNA, 20 nt, Human
ugacuagggagccauguuuc

SEQ ID NO: 1331933 - RNA, 21 nt, Human
ugacuagggagccauguuuca

SEQ ID NO: 1331934 - RNA, 12 nt, Human
ugacucaagaag

SEQ ID NO: 1331935 - RNA, 14 nt, Human
ugacucaagaagug

SEQ ID NO: 1331936 - RNA, 15 nt, Human
ugacucaagaaguga

SEQ ID NO: 1331937 - RNA, 22 nt, Human
ugacucaagaagugaagaaugc

SEQ ID NO: 1331938 - RNA, 21 nt, Human
ugacccucaucuuucuuccaa

SEQ ID NO: 1331939 - RNA, 19 nt, Human
ugacccggcacccccugca

SEQ ID NO: 1331940 - RNA, 20 nt, Human
ugacccggcacccccugcag

SEQ ID NO: 1331941 - RNA, 22 nt, Human
ugacccggcacccccugcagcu

SEQ ID NO: 1331942 - RNA, 18 nt, Human
ugacccggcacccccugc

SEQ ID NO: 1331943 - RNA, 22 nt, Human
ugaccccaaacaccuuccagcu

SEQ ID NO: 1331944 - RNA, 13 nt, Human
ugaccccagagga

SEQ ID NO: 1331945 - RNA, 11 nt, Human
ugaccccaggg

SEQ ID NO: 1331946 - RNA, 12 nt, Human
ugaccccagggc

SEQ ID NO: 1331947 - RNA, 13 nt, Human
ugaccccagggca

SEQ ID NO: 1331948 - RNA, 17 nt, Human
ugaccccagggcacagg

SEQ ID NO: 1331949 - RNA, 18 nt, Human
ugaccccagggcacagga

SEQ ID NO: 1331950 - RNA, 19 nt, Human
ugaccccagggcacaggag

SEQ ID NO: 1331951 - RNA, 20 nt, Human
ugaccccagggcacaggagc

SEQ ID NO: 1331952 - RNA, 21 nt, Human
ugaccccagggcacaggagcu

SEQ ID NO: 1331953 - RNA, 13 nt, Human
ugaccccugcuca

SEQ ID NO: 1331954 - RNA, 14 nt, Human
ugaccuuaaaugca

SEQ ID NO: 1331955 - RNA, 16 nt, Human
ugaccuuaaaugcaac

SEQ ID NO: 1331956 - RNA, 21 nt, Human
ugacccggcacccccugcagc

SEQ ID NO: 1331957 - RNA, 12 nt, Human
ugaccugaggcu

SEQ ID NO: 1331958 - RNA, 21 nt, Human
ugacccuaugggucuaggaca

SEQ ID NO: 1331959 - RNA, 15 nt, Human
ugaccugaggcugug

SEQ ID NO: 1331960 - RNA, 17 nt, Human
ugaccugaggcuguggu

SEQ ID NO: 1331961 - RNA, 20 nt, Human
ugaccugugagcccagcugg

SEQ ID NO: 1331962 - RNA, 17 nt, Human
agcaagaccccaucuca

SEQ ID NO: 1331963 - RNA, 21 nt, Human
agcaagacccuaaacauccau

SEQ ID NO: 1331964 - RNA, 21 nt, Human
agcaagacuucucuuugccuc

SEQ ID NO: 1331965 - RNA, 23 nt, Human
agcaagacuucucuuugccucaa

SEQ ID NO: 1331966 - RNA, 22 nt, Human
agcaagacuucucuuugccuca

SEQ ID NO: 1331967 - RNA, 19 nt, Human
agcaagaggccguggcugc

SEQ ID NO: 1331968 - RNA, 15 nt, Human
agcaagauaaacauu

SEQ ID NO: 1331969 - RNA, 16 nt, Human
agcaagauaaacauua

SEQ ID NO: 1331970 - RNA, 17 nt, Human
agcaagauaaacauuau

SEQ ID NO: 1331971 - RNA, 21 nt, Human
agcaagaggccguggcugcug

SEQ ID NO: 1331972 - RNA, 18 nt, Human
ugagaagugaaugcuggg

SEQ ID NO: 1331973 - RNA, 19 nt, Human
ugagaagugaaugcuggga

SEQ ID NO: 1331974 - RNA, 21 nt, Human
ugagaagugaaugcugggacu

SEQ ID NO: 1331975 - RNA, 22 nt, Human
ugagaagugaaugcugggacuc

SEQ ID NO: 1331976 - RNA, 13 nt, Human
agauuuuuuaaua

SEQ ID NO: 1331977 - RNA, 14 nt, Human
agauuuuuuaauaa

SEQ ID NO: 1331978 - RNA, 16 nt, Human
agauuuuuuaauaauu

SEQ ID NO: 1331979 - RNA, 18 nt, Human
agauuuuuuuuuuuucuc

SEQ ID NO: 1331980 - RNA, 12 nt, Human
agcaaaaaagaa

SEQ ID NO: 1331981 - RNA, 14 nt, Human
agcaaaaaagaaaa

SEQ ID NO: 1331982 - RNA, 18 nt, Human
agcaacgcuauuccagcu

SEQ ID NO: 1331983 - RNA, 19 nt, Human
agcaacgcuauuccagcug

SEQ ID NO: 1331984 - RNA, 20 nt, Human
agcaacgcuauuccagcugu

SEQ ID NO: 1331985 - RNA, 23 nt, Human
agcaacgcuauuccagcuguccc

SEQ ID NO: 1331986 - RNA, 13 nt, Human
agcaacggcacag

SEQ ID NO: 1331987 - RNA, 21 nt, Human
agcaacuacagucuaaagcug

SEQ ID NO: 1331988 - RNA, 16 nt, Human
agcaacuaggccuuca

SEQ ID NO: 1331989 - RNA, 16 nt, Human
agcaacuaucagacua

SEQ ID NO: 1331990 - RNA, 14 nt, Human
agcaacucuugauu

SEQ ID NO: 1331991 - RNA, 14 nt, Human
agcaacuuguccua

SEQ ID NO: 1331992 - RNA, 19 nt, Human
agcaagaaggcaaaaauag

SEQ ID NO: 1331993 - RNA, 16 nt, Human
agcaacucuugauuau

SEQ ID NO: 1331994 - RNA, 20 nt, Human
agcaacucuugauuauccau

SEQ ID NO: 1331995 - RNA, 11 nt, Human
agcaacuauuc

SEQ ID NO: 1331996 - RNA, 21 nt, Human
agcaacuuguccuagcacaga

SEQ ID NO: 1331997 - RNA, 19 nt, Human
agauuuucugcuacuuugc

SEQ ID NO: 1331998 - RNA, 12 nt, Human
agauuuucuggu

SEQ ID NO: 1331999 - RNA, 16 nt, Human
agauuuucugguucua

SEQ ID NO: 1332000 - RNA, 17 nt, Human
agauuuucugguucuaa

SEQ ID NO: 1332001 - RNA, 18 nt, Human
agauuuucugguucuaac

SEQ ID NO: 1332002 - RNA, 19 nt, Human
agauuuucugguucuaaca

SEQ ID NO: 1332003 - RNA, 22 nt, Human
agauuuucuuuugccuuuugca

SEQ ID NO: 1332004 - RNA, 17 nt, Human
agauuuuucaugauuuu

SEQ ID NO: 1332005 - RNA, 15 nt, Human
agauuucugaggaaa

SEQ ID NO: 1332006 - RNA, 14 nt, Human
agauuucugaggaa

SEQ ID NO: 1332007 - RNA, 21 nt, Human
agauuuccuucuuuuuuucuu

SEQ ID NO: 1332008 - RNA, 22 nt, Human
agauuucucagaagucuuucag

SEQ ID NO: 1332009 - RNA, 20 nt, Human
agauuucucauuugccaaua

SEQ ID NO: 1332010 - RNA, 18 nt, Human
agauuuccauauaaauau

SEQ ID NO: 1332011 - RNA, 16 nt, Human
agauuuccuucuuuuu

SEQ ID NO: 1332012 - RNA, 18 nt, Human
agauuccagagaguggcu

SEQ ID NO: 1332013 - RNA, 18 nt, Human
ugacucggggguggggaa

SEQ ID NO: 1332014 - RNA, 11 nt, Human
agauucuaaag

SEQ ID NO: 1332015 - RNA, 12 nt, Human
agauucuaaaga

SEQ ID NO: 1332016 - RNA, 14 nt, Human
agauucuaaagauu

SEQ ID NO: 1332017 - RNA, 22 nt, Human
agauugcugaaauuuuauaugc

SEQ ID NO: 1332018 - RNA, 13 nt, Human
agauucuaaagau

SEQ ID NO: 1332019 - RNA, 19 nt, Human
agauuccagagaguggcuc

SEQ ID NO: 1332020 - RNA, 16 nt, Human
agauuccggauccuaa

SEQ ID NO: 1332021 - RNA, 18 nt, Human
agauuccggauccuaagc

SEQ ID NO: 1332022 - RNA, 20 nt, Human
agauuccggauccuaagcau

SEQ ID NO: 1332023 - RNA, 23 nt, Human
agauuccggauccuaagcaucua

SEQ ID NO: 1332024 - RNA, 24 nt, Human
agauuccggauccuaagcaucuaa

SEQ ID NO: 1332025 - RNA, 13 nt, Human
agauuccuuccca

SEQ ID NO: 1332026 - RNA, 15 nt, Human
agauuccuucccaug

SEQ ID NO: 1332027 - RNA, 17 nt, Human
agauuccuucccaugga

SEQ ID NO: 1332028 - RNA, 20 nt, Human
ugaagcuaucguaaaauuaa

SEQ ID NO: 1332029 - RNA, 14 nt, Human
ugaagcuacugugu

SEQ ID NO: 1332030 - RNA, 22 nt, Human
ugaagcuacugugugugugaau

SEQ ID NO: 1332031 - RNA, 16 nt, Human
ugaagcucacuucugg

SEQ ID NO: 1332032 - RNA, 19 nt, Human
ugaagggccagagccaggg

SEQ ID NO: 1332033 - RNA, 14 nt, Human
ugaagggcccgaga

SEQ ID NO: 1332034 - RNA, 15 nt, Human
ugaagggggcggccu

SEQ ID NO: 1332035 - RNA, 18 nt, Human
ugaagggggcggccuaug

SEQ ID NO: 1332036 - RNA, 12 nt, Human
ugaagccuuugu

SEQ ID NO: 1332037 - RNA, 19 nt, Human
ugaagccaauucagacagg

SEQ ID NO: 1332038 - RNA, 24 nt, Human
agaggugggccagucuguggauca

SEQ ID NO: 1332039 - RNA, 16 nt, Human
agagguguuauuugga

SEQ ID NO: 1332040 - RNA, 21 nt, Human
agagcugauggagaaggaagg

SEQ ID NO: 1332041 - RNA, 20 nt, Human
agagcugauggagaaggaag

SEQ ID NO: 1332042 - RNA, 19 nt, Human
agagcugauggagaaggaa

SEQ ID NO: 1332043 - RNA, 18 nt, Human
ugaaagguuuuuuuucag

SEQ ID NO: 1332044 - RNA, 17 nt, Human
ugaaagguuuuuuuuca

SEQ ID NO: 1332045 - RNA, 19 nt, Human
ugaaagucacggcugcgca

SEQ ID NO: 1332046 - RNA, 12 nt, Human
ugaaagucuguc

SEQ ID NO: 1332047 - RNA, 15 nt, Human
ugaaagucuguccuu

SEQ ID NO: 1332048 - RNA, 16 nt, Human
ugaaagucuguccuug

SEQ ID NO: 1332049 - RNA, 23 nt, Human
ugaaagucuguccuugaaggacu

SEQ ID NO: 1332050 - RNA, 12 nt, Human
agaggccccagc

SEQ ID NO: 1332051 - RNA, 13 nt, Human
agaggccccagcc

SEQ ID NO: 1332052 - RNA, 14 nt, Human
agaggccccagccu

SEQ ID NO: 1332053 - RNA, 15 nt, Human
agaggccccagccuc

SEQ ID NO: 1332054 - RNA, 16 nt, Human
agaggccccagccucc

SEQ ID NO: 1332055 - RNA, 23 nt, Human
agaggccccagccucccugaagc

SEQ ID NO: 1332056 - RNA, 14 nt, Human
agaggcccccagcc

SEQ ID NO: 1332057 - RNA, 16 nt, Human
agaggcccccagccca

SEQ ID NO: 1332058 - RNA, 17 nt, Human
agaggcccccagcccag

SEQ ID NO: 1332059 - RNA, 20 nt, Human
agaggcccccagcccagggc

SEQ ID NO: 1332060 - RNA, 21 nt, Human
agaggcccccagcccagggcu

SEQ ID NO: 1332061 - RNA, 22 nt, Human
agaggcccccagcccagggcuc

SEQ ID NO: 1332062 - RNA, 17 nt, Human
ugaaagucuguccuuga

SEQ ID NO: 1332063 - RNA, 14 nt, Human
agaggcccucaagu

SEQ ID NO: 1332064 - RNA, 24 nt, Human
agagggaggagaaugagccucggc

SEQ ID NO: 1332065 - RNA, 14 nt, Human
agaggcccucgcug

SEQ ID NO: 1332066 - RNA, 19 nt, Human
agaggcccucgcugccagc

SEQ ID NO: 1332067 - RNA, 14 nt, Human
agaggcuggguuca

SEQ ID NO: 1332068 - RNA, 14 nt, Human
agaggcugucuguu

SEQ ID NO: 1332069 - RNA, 20 nt, Human
agaggcuuccuucauuuccu

SEQ ID NO: 1332070 - RNA, 18 nt, Human
ugaauauuuaguguucau

SEQ ID NO: 1332071 - RNA, 22 nt, Human
ugaauaugucaucacucuaggu

SEQ ID NO: 1332072 - RNA, 13 nt, Human
ugaauauuauucc

SEQ ID NO: 1332073 - RNA, 15 nt, Human
ugaauauuauuccuc

SEQ ID NO: 1332074 - RNA, 16 nt, Human
ugaauauugccauuau

SEQ ID NO: 1332075 - RNA, 18 nt, Human
ugaauauugccauuaugc

SEQ ID NO: 1332076 - RNA, 17 nt, Human
ugaauacuuugaaugug

SEQ ID NO: 1332077 - RNA, 18 nt, Human
ugaauacuuugaaugugu

SEQ ID NO: 1332078 - RNA, 19 nt, Human
ugaauacuuugaauguguu

SEQ ID NO: 1332079 - RNA, 20 nt, Human
ugaauacuuugaauguguuu

SEQ ID NO: 1332080 - RNA, 16 nt, Human
ugaauacuuuuuacaa

SEQ ID NO: 1332081 - RNA, 21 nt, Human
ugaauagauaugaaagcugau

SEQ ID NO: 1332082 - RNA, 18 nt, Human
ugaauagauaugaaagcu

SEQ ID NO: 1332083 - RNA, 16 nt, Human
ugaauagccauauuug

SEQ ID NO: 1332084 - RNA, 18 nt, Human
ugaauagccauauuugua

SEQ ID NO: 1332085 - RNA, 20 nt, Human
ugaauagccauauuuguaaa

SEQ ID NO: 1332086 - RNA, 22 nt, Human
ugaauagccauauuuguaaaau

SEQ ID NO: 1332087 - RNA, 18 nt, Human
ugaaugggacagaguuga

SEQ ID NO: 1332088 - RNA, 22 nt, Human
ugaauguaaauuuguacuauuu

SEQ ID NO: 1332089 - RNA, 21 nt, Human
ugaauguaaauuuguacuauu

SEQ ID NO: 1332090 - RNA, 15 nt, Human
ugaauacuuuauaaa

SEQ ID NO: 1332091 - RNA, 14 nt, Human
ugaauacugcuaca

SEQ ID NO: 1332092 - RNA, 16 nt, Human
ugaauacuguauuuug

SEQ ID NO: 1332093 - RNA, 13 nt, Human
ugaauacuuugaa

SEQ ID NO: 1332094 - RNA, 14 nt, Human
ugaauacuuugaau

SEQ ID NO: 1332095 - RNA, 15 nt, Human
ugaauacuuugaaug

SEQ ID NO: 1332096 - RNA, 16 nt, Human
ugaauacuuugaaugu

SEQ ID NO: 1332097 - RNA, 22 nt, Human
ugaauaccuuagugcaguuauu

SEQ ID NO: 1332098 - RNA, 21 nt, Human
ugaauaccuuagugcaguuau

SEQ ID NO: 1332099 - RNA, 16 nt, Human
ugaauaccuuagugca

SEQ ID NO: 1332100 - RNA, 20 nt, Human
ugaauaccacucuguaauug

SEQ ID NO: 1332101 - RNA, 16 nt, Human
ugaauacccuuuucug

SEQ ID NO: 1332102 - RNA, 14 nt, Human
ugaauaccugcuca

SEQ ID NO: 1332103 - RNA, 15 nt, Human
ugaauaaaugucuug

SEQ ID NO: 1332104 - RNA, 17 nt, Human
ugaauaccacucuguaa

SEQ ID NO: 1332105 - RNA, 18 nt, Human
ugaauaccacucuguaau

SEQ ID NO: 1332106 - RNA, 19 nt, Human
ugaauaccacucuguaauu

SEQ ID NO: 1332107 - RNA, 23 nt, Human
ugaauaccacucuguaauugcaa

SEQ ID NO: 1332108 - RNA, 12 nt, Human
ugaauaaauguc

SEQ ID NO: 1332109 - RNA, 13 nt, Human
ugaauaaauguca

SEQ ID NO: 1332110 - RNA, 15 nt, Human
ugaauaaaugucacu

SEQ ID NO: 1332111 - RNA, 16 nt, Human
ugaauaaaugucacuu

SEQ ID NO: 1332112 - RNA, 19 nt, Human
ugaauaaaugucacuuuuu

SEQ ID NO: 1332113 - RNA, 20 nt, Human
ugaauaaaugucacuuuuug

SEQ ID NO: 1332114 - RNA, 13 nt, Human
ugaauaaaugucu

SEQ ID NO: 1332115 - RNA, 14 nt, Human
ugaauaaaugucuu

SEQ ID NO: 1332116 - RNA, 14 nt, Human
ugaauaaagcaauu

SEQ ID NO: 1332117 - RNA, 17 nt, Human
ugaauaaaguguaacaa

SEQ ID NO: 1332118 - RNA, 15 nt, Human
ugaagucacugcaca

SEQ ID NO: 1332119 - RNA, 16 nt, Human
ugaagucacugcacag

SEQ ID NO: 1332120 - RNA, 21 nt, Human
ugaagucacugcacagugcau

SEQ ID NO: 1332121 - RNA, 16 nt, Human
ugaauaaagacaccua

SEQ ID NO: 1332122 - RNA, 22 nt, Human
ugaaggguaauuauauaguuac

SEQ ID NO: 1332123 - RNA, 14 nt, Human
ugaagguaaauaaa

SEQ ID NO: 1332124 - RNA, 20 nt, Human
ugaagguaaauaaaaagaaa

SEQ ID NO: 1332125 - RNA, 14 nt, Human
ugaagucacugcac

SEQ ID NO: 1332126 - RNA, 15 nt, Human
ugaagguauaucuag

SEQ ID NO: 1332127 - RNA, 18 nt, Human
ugaagguaaauaaaaaga

SEQ ID NO: 1332128 - RNA, 14 nt, Human
agauacauacagaa

SEQ ID NO: 1332129 - RNA, 15 nt, Human
agauacauacagaau

SEQ ID NO: 1332130 - RNA, 16 nt, Human
agauacauacagaauu

SEQ ID NO: 1332131 - RNA, 13 nt, Human
agaguuuccugaa

SEQ ID NO: 1332132 - RNA, 15 nt, Human
agauaacugaaaauu

SEQ ID NO: 1332133 - RNA, 18 nt, Human
agauaacugaaaauuauu

SEQ ID NO: 1332134 - RNA, 22 nt, Human
agauaacugaaaauuauuuaaa

SEQ ID NO: 1332135 - RNA, 11 nt, Human
agauaacuuuu

SEQ ID NO: 1332136 - RNA, 18 nt, Human
agaguuugaugaggcccu

SEQ ID NO: 1332137 - RNA, 20 nt, Human
agaguuugaugaggcccucc

SEQ ID NO: 1332138 - RNA, 23 nt, Human
agaguuugaugaggcccuccaca

SEQ ID NO: 1332139 - RNA, 22 nt, Human
agaguuugaugaggcccuccac

SEQ ID NO: 1332140 - RNA, 13 nt, Human
agauaacuaggaa

SEQ ID NO: 1332141 - RNA, 20 nt, Human
ugacaaagguaaaucagacu

SEQ ID NO: 1332142 - RNA, 22 nt, Human
ugacaaagcagauucagaaaug

SEQ ID NO: 1332143 - RNA, 17 nt, Human
ugacaaaggcaagcacu

SEQ ID NO: 1332144 - RNA, 16 nt, Human
ugacacauggccccuc

SEQ ID NO: 1332145 - RNA, 22 nt, Human
ugacacauggccccucccccug

SEQ ID NO: 1332146 - RNA, 14 nt, Human
ugacacccuucucc

SEQ ID NO: 1332147 - RNA, 18 nt, Human
ugacacuagcccaaugaa

SEQ ID NO: 1332148 - RNA, 19 nt, Human
ugacacuagcccaaugaaa

SEQ ID NO: 1332149 - RNA, 21 nt, Human
ugacacuagcccaaugaaaug

SEQ ID NO: 1332150 - RNA, 22 nt, Human
ugacacuagcccaaugaaauga

SEQ ID NO: 1332151 - RNA, 23 nt, Human
ugacacuagcccaaugaaaugaa

SEQ ID NO: 1332152 - RNA, 16 nt, Human
ugacacucauauaauu

SEQ ID NO: 1332153 - RNA, 22 nt, Human
ugacacucauauaauuauaugu

SEQ ID NO: 1332154 - RNA, 22 nt, Human
ugacacucccuugggcucccug

SEQ ID NO: 1332155 - RNA, 14 nt, Human
ugaauuuuguugcu

SEQ ID NO: 1332156 - RNA, 23 nt, Human
ugaauuugugaagguggaaauaa

SEQ ID NO: 1332157 - RNA, 13 nt, Human
ugaauuuguaaug

SEQ ID NO: 1332158 - RNA, 17 nt, Human
ugaauuuguaaugucuu

SEQ ID NO: 1332159 - RNA, 21 nt, Human
ugaauuuguaaugucuugagc

SEQ ID NO: 1332160 - RNA, 20 nt, Human
ugacaaaauguuauuucccu

SEQ ID NO: 1332161 - RNA, 15 nt, Human
ugacaaaauguuauu

SEQ ID NO: 1332162 - RNA, 14 nt, Human
ugacaaaauguuau

SEQ ID NO: 1332163 - RNA, 13 nt, Human
ugacaaaauguua

SEQ ID NO: 1332164 - RNA, 12 nt, Human
ugacaaaauguu

SEQ ID NO: 1332165 - RNA, 22 nt, Human
ugacaaaauacuugucuguuuu

SEQ ID NO: 1332166 - RNA, 16 nt, Human
ugaauuuuguugcugu

SEQ ID NO: 1332167 - RNA, 22 nt, Human
ugaauuuuuaaaacccauuuaa

SEQ ID NO: 1332168 - RNA, 17 nt, Human
ugaauuuuuaaacaagu

SEQ ID NO: 1332169 - RNA, 19 nt, Human
ugaauuuuuaaacaaguau

SEQ ID NO: 1332170 - RNA, 23 nt, Human
ugaauuuuuaaacaaguauuugu

SEQ ID NO: 1332171 - RNA, 21 nt, Human
ugaauuuuuaaacaaguauuu

SEQ ID NO: 1332172 - RNA, 21 nt, Human
ugaauuugugaagguggaaau

SEQ ID NO: 1332173 - RNA, 13 nt, Human
ugaauuugugaag

SEQ ID NO: 1332174 - RNA, 12 nt, Human
agaucaaagaug

SEQ ID NO: 1332175 - RNA, 13 nt, Human
agaucaaagauga

SEQ ID NO: 1332176 - RNA, 12 nt, Human
ugaaacuuuugg

SEQ ID NO: 1332177 - RNA, 23 nt, Human
ugaaacuuucauuccuucagauu

SEQ ID NO: 1332178 - RNA, 14 nt, Human
ugaaacuuucauuc

SEQ ID NO: 1332179 - RNA, 13 nt, Human
ugaaagaagaaaa

SEQ ID NO: 1332180 - RNA, 20 nt, Human
ugaaagaauagaacacaguu

SEQ ID NO: 1332181 - RNA, 17 nt, Human
agagacgggcccuggug

SEQ ID NO: 1332182 - RNA, 16 nt, Human
agagaccuuccagaaa

SEQ ID NO: 1332183 - RNA, 16 nt, Human
agagacuccagcuggg

SEQ ID NO: 1332184 - RNA, 20 nt, Human
agagaucaggaagagaagga

SEQ ID NO: 1332185 - RNA, 19 nt, Human
agagaucaggaagagaagg

SEQ ID NO: 1332186 - RNA, 18 nt, Human
agagauccaaaagaagcc

SEQ ID NO: 1332187 - RNA, 12 nt, Human
agagaugugugu

SEQ ID NO: 1332188 - RNA, 13 nt, Human
agagauguguguu

SEQ ID NO: 1332189 - RNA, 14 nt, Human
agagauguguguug

SEQ ID NO: 1332190 - RNA, 20 nt, Human
agagauguguguugauacug

SEQ ID NO: 1332191 - RNA, 15 nt, Human
agagauguguguuga

SEQ ID NO: 1332192 - RNA, 17 nt, Human
agagauguguguugaua

SEQ ID NO: 1332193 - RNA, 18 nt, Human
agagauguguguugauac

SEQ ID NO: 1332194 - RNA, 15 nt, Human
agagaucaggaagag

SEQ ID NO: 1332195 - RNA, 14 nt, Human
agagaucaggaaga

SEQ ID NO: 1332196 - RNA, 14 nt, Human
agagaucaaagaug

SEQ ID NO: 1332197 - RNA, 15 nt, Human
agagaucaaagauga

SEQ ID NO: 1332198 - RNA, 15 nt, Human
agagagaaaggacuc

SEQ ID NO: 1332199 - RNA, 18 nt, Human
agagcugauggagaagga

SEQ ID NO: 1332200 - RNA, 17 nt, Human
agagcugauggagaagg

SEQ ID NO: 1332201 - RNA, 16 nt, Human
agagcugauggagaag

SEQ ID NO: 1332202 - RNA, 19 nt, Human
agagcugaagguuguggcc

SEQ ID NO: 1332203 - RNA, 20 nt, Human
agagcugaagguuguggccu

SEQ ID NO: 1332204 - RNA, 23 nt, Human
agagcugaagguuguggccuuug

SEQ ID NO: 1332205 - RNA, 13 nt, Human
agagcuaggagca

SEQ ID NO: 1332206 - RNA, 18 nt, Human
agagcuaggagcaaagcc

SEQ ID NO: 1332207 - RNA, 19 nt, Human
agagcuaggagcaaagccu

SEQ ID NO: 1332208 - RNA, 20 nt, Human
agagcuaggagcaaagccug

SEQ ID NO: 1332209 - RNA, 21 nt, Human
agagcuaggagcaaagccugu

SEQ ID NO: 1332210 - RNA, 10 nt, Human
agagcucagg

SEQ ID NO: 1332211 - RNA, 12 nt, Human
agagcucaggau

SEQ ID NO: 1332212 - RNA, 13 nt, Human
agagcucaggaug

SEQ ID NO: 1332213 - RNA, 12 nt, Human
agagcuccuccc

SEQ ID NO: 1332214 - RNA, 17 nt, Human
agagcuccucccucuca

SEQ ID NO: 1332215 - RNA, 13 nt, Human
agagcuccucccu

SEQ ID NO: 1332216 - RNA, 23 nt, Human
agagccaggggggugaggagcug

SEQ ID NO: 1332217 - RNA, 11 nt, Human
agagcuacaua

SEQ ID NO: 1332218 - RNA, 14 nt, Human
agagcuacauaauu

SEQ ID NO: 1332219 - RNA, 16 nt, Human
agagcuacauaauuua

SEQ ID NO: 1332220 - RNA, 18 nt, Human
agagcuacauaauuuagu

SEQ ID NO: 1332221 - RNA, 14 nt, Human
agagcuacguauuu

SEQ ID NO: 1332222 - RNA, 16 nt, Human
agagcuacguauuuaa

SEQ ID NO: 1332223 - RNA, 17 nt, Human
agagcuacguauuuaau

SEQ ID NO: 1332224 - RNA, 18 nt, Human
agagcaagaccccaucuc

SEQ ID NO: 1332225 - RNA, 21 nt, Human
agagcacgccuguacuagagc

SEQ ID NO: 1332226 - RNA, 20 nt, Human
agagcacgccuguacuagag

SEQ ID NO: 1332227 - RNA, 12 nt, Human
agagcacugcca

SEQ ID NO: 1332228 - RNA, 13 nt, Human
agagcacugccac

SEQ ID NO: 1332229 - RNA, 14 nt, Human
agagcacugccacc

SEQ ID NO: 1332230 - RNA, 12 nt, Human
agagcagcaccu

SEQ ID NO: 1332231 - RNA, 16 nt, Human
agagcagcaccuccuc

SEQ ID NO: 1332232 - RNA, 23 nt, Human
agagcagcaccuccucagccuga

SEQ ID NO: 1332233 - RNA, 22 nt, Human
agagcagcaccuccucagccug

SEQ ID NO: 1332234 - RNA, 14 nt, Human
agagcaggaauggg

SEQ ID NO: 1332235 - RNA, 13 nt, Human
agagcaggacucc

SEQ ID NO: 1332236 - RNA, 15 nt, Human
agagcaggacuccag

SEQ ID NO: 1332237 - RNA, 17 nt, Human
agagcaggacuccaggc

SEQ ID NO: 1332238 - RNA, 20 nt, Human
agagcaggacuccaggccca

SEQ ID NO: 1332239 - RNA, 21 nt, Human
agagcaggacuccaggcccaa

SEQ ID NO: 1332240 - RNA, 22 nt, Human
agagcaggacuccaggcccaag

SEQ ID NO: 1332241 - RNA, 17 nt, Human
agagcaggacugauguc

SEQ ID NO: 1332242 - RNA, 19 nt, Human
agagcaggacugaugucuc

SEQ ID NO: 1332243 - RNA, 22 nt, Human
agagcaggacugaugucuccua

SEQ ID NO: 1332244 - RNA, 13 nt, Human
agagcauaggguc

SEQ ID NO: 1332245 - RNA, 15 nt, Human
agagcaucaggccua

SEQ ID NO: 1332246 - RNA, 19 nt, Human
agagcaucaggccuagagg

SEQ ID NO: 1332247 - RNA, 14 nt, Human
agagcaucaugccu

SEQ ID NO: 1332248 - RNA, 15 nt, Human
agagcaucaugccuc

SEQ ID NO: 1332249 - RNA, 16 nt, Human
agagcaucaugccucu

SEQ ID NO: 1332250 - RNA, 17 nt, Human
agagcaucaugccucug

SEQ ID NO: 1332251 - RNA, 18 nt, Human
agagcaucaugccucuga

SEQ ID NO: 1332252 - RNA, 19 nt, Human
agagcaucaugccucugag

SEQ ID NO: 1332253 - RNA, 20 nt, Human
agagcaucaugccucugagg

SEQ ID NO: 1332254 - RNA, 21 nt, Human
agagcaucaugccucugaggc

SEQ ID NO: 1332255 - RNA, 22 nt, Human
agagcaucaugccucugaggcc

SEQ ID NO: 1332256 - RNA, 23 nt, Human
agagcaucaugccucugaggcca

SEQ ID NO: 1332257 - RNA, 21 nt, Human
agagccagcuaaggggugggg

SEQ ID NO: 1332258 - RNA, 12 nt, Human
agagccaggaga

SEQ ID NO: 1332259 - RNA, 13 nt, Human
agagccaggagaa

SEQ ID NO: 1332260 - RNA, 15 nt, Human
agagccaggagaagc

SEQ ID NO: 1332261 - RNA, 16 nt, Human
agagccaggagaagcu

SEQ ID NO: 1332262 - RNA, 18 nt, Human
agagccaggagaagcuca

SEQ ID NO: 1332263 - RNA, 22 nt, Human
agagccaggagaagcucagcug

SEQ ID NO: 1332264 - RNA, 19 nt, Human
agagccaggagaagcucag

SEQ ID NO: 1332265 - RNA, 22 nt, Human
agagccaggggggugaggagcu

SEQ ID NO: 1332266 - RNA, 15 nt, Human
ugaaacgcaucuagu

SEQ ID NO: 1332267 - RNA, 22 nt, Human
ugaaacuagaaagcagagauuu

SEQ ID NO: 1332268 - RNA, 19 nt, Human
ugaaacucauagacacuga

SEQ ID NO: 1332269 - RNA, 18 nt, Human
ugaaacucauagacacug

SEQ ID NO: 1332270 - RNA, 17 nt, Human
ugaaacuccagaugcca

SEQ ID NO: 1332271 - RNA, 19 nt, Human
ugaaacucguuaauuugua

SEQ ID NO: 1332272 - RNA, 18 nt, Human
ugaaacuccagaugccac

SEQ ID NO: 1332273 - RNA, 19 nt, Human
ugaaacuccagaugccaca

SEQ ID NO: 1332274 - RNA, 14 nt, Human
ugaaaaugucuugu

SEQ ID NO: 1332275 - RNA, 15 nt, Human
ugaaaaugucuugug

SEQ ID NO: 1332276 - RNA, 16 nt, Human
ugaaaauguccaggaa

SEQ ID NO: 1332277 - RNA, 20 nt, Human
ugaaaauguccaggaaagug

SEQ ID NO: 1332278 - RNA, 13 nt, Human
ugaaaauguccuu

SEQ ID NO: 1332279 - RNA, 14 nt, Human
ugaaaauguccuug

SEQ ID NO: 1332280 - RNA, 16 nt, Human
ugaaaauguccuugug

SEQ ID NO: 1332281 - RNA, 17 nt, Human
ugaaaauguccuuguga

SEQ ID NO: 1332282 - RNA, 18 nt, Human
ugaaaauguccuugugau

SEQ ID NO: 1332283 - RNA, 19 nt, Human
ugaaaauguccuugugaug

SEQ ID NO: 1332284 - RNA, 23 nt, Human
ugaaaauguccuugugaugugca

SEQ ID NO: 1332285 - RNA, 13 nt, Human
ugaaaaugucuug

SEQ ID NO: 1332286 - RNA, 20 nt, Human
ugaaaaucuuauaauuuaaa

SEQ ID NO: 1332287 - RNA, 23 nt, Human
ugaaaauauuguuuuacaauagu

SEQ ID NO: 1332288 - RNA, 20 nt, Human
ugaaaauauuguuuuacaau

SEQ ID NO: 1332289 - RNA, 16 nt, Human
ugaaaauauuguuuua

SEQ ID NO: 1332290 - RNA, 20 nt, Human
ugaaaaggguguugggaggg

SEQ ID NO: 1332291 - RNA, 19 nt, Human
ugaaaagguuuaugaaaaa

SEQ ID NO: 1332292 - RNA, 21 nt, Human
ugaaaagguuuaugaaaaaga

SEQ ID NO: 1332293 - RNA, 22 nt, Human
ugaaaagguuuaugaaaaagaa

SEQ ID NO: 1332294 - RNA, 20 nt, Human
ugaaaaguagcaauuaugga

SEQ ID NO: 1332295 - RNA, 21 nt, Human
ugaaaaguauauugauaaccu

SEQ ID NO: 1332296 - RNA, 17 nt, Human
ugaaaagugaagacaga

SEQ ID NO: 1332297 - RNA, 14 nt, Human
ugaaaauauaacca

SEQ ID NO: 1332298 - RNA, 16 nt, Human
ugaaaauauaaccagc

SEQ ID NO: 1332299 - RNA, 22 nt, Human
ugaaaaaguucugcagauaaac

SEQ ID NO: 1332300 - RNA, 15 nt, Human
ugaaaaaguuuguuu

SEQ ID NO: 1332301 - RNA, 19 nt, Human
ugaaaaaugggcacuuaaa

SEQ ID NO: 1332302 - RNA, 21 nt, Human
ugaaaaauuccacucaaaaua

SEQ ID NO: 1332303 - RNA, 14 nt, Human
ugaaaaauugcuga

SEQ ID NO: 1332304 - RNA, 16 nt, Human
ugaaaaauugcugacu

SEQ ID NO: 1332305 - RNA, 23 nt, Human
ugaaaaauugcugacuguagcuu

SEQ ID NO: 1332306 - RNA, 22 nt, Human
ugaaaaauugcugacuguagcu

SEQ ID NO: 1332307 - RNA, 23 nt, Human
ugaaaaaauauauaucaaauaua

SEQ ID NO: 1332308 - RNA, 18 nt, Human
ugaaaaaauguauaugca

SEQ ID NO: 1332309 - RNA, 13 nt, Human
ugaaaaaauauau

SEQ ID NO: 1332310 - RNA, 12 nt, Human
ugaaaaacauga

SEQ ID NO: 1332311 - RNA, 16 nt, Human
ugaaaaaaaauaaauu

SEQ ID NO: 1332312 - RNA, 22 nt, Human
ugaaaaaauagagccugaggga

SEQ ID NO: 1332313 - RNA, 12 nt, Human
ugaaaaaauaua

SEQ ID NO: 1332314 - RNA, 13 nt, Human
ugaaaaagcgaaa

SEQ ID NO: 1332315 - RNA, 13 nt, Human
ugaaaaagaagaa

SEQ ID NO: 1332316 - RNA, 18 nt, Human
ucuuuguuaagacugcug

SEQ ID NO: 1332317 - RNA, 16 nt, Human
ucuuuguucauagccc

SEQ ID NO: 1332318 - RNA, 23 nt, Human
ucuuuguucauagcccaguagac

SEQ ID NO: 1332319 - RNA, 15 nt, Human
ucuuuguuucuuucu

SEQ ID NO: 1332320 - RNA, 16 nt, Human
ucuuuguuuugugucu

SEQ ID NO: 1332321 - RNA, 17 nt, Human
ucuuuguuuugugucuc

SEQ ID NO: 1332322 - RNA, 18 nt, Human
ucuuuguuuugugucucu

SEQ ID NO: 1332323 - RNA, 19 nt, Human
ucuuuguuuugugucucuu

SEQ ID NO: 1332324 - RNA, 20 nt, Human
ucuuuguuuugugucucuua

SEQ ID NO: 1332325 - RNA, 12 nt, Human
ucuuuuacaacu

SEQ ID NO: 1332326 - RNA, 22 nt, Human
ucuuuuacccuggccccucucc

SEQ ID NO: 1332327 - RNA, 13 nt, Human
ucuuuuacccugg

SEQ ID NO: 1332328 - RNA, 17 nt, Human
ucuuuuacccuggcccc

SEQ ID NO: 1332329 - RNA, 18 nt, Human
ucuuuuacccuggccccu

SEQ ID NO: 1332330 - RNA, 16 nt, Human
ugaaaaaaaacagugg

SEQ ID NO: 1332331 - RNA, 22 nt, Human
ugaaaaaaaaccugagauuuau

SEQ ID NO: 1332332 - RNA, 21 nt, Human
ugaaaaaaaaccugagauuua

SEQ ID NO: 1332333 - RNA, 11 nt, Human
ucuuucucugc

SEQ ID NO: 1332334 - RNA, 12 nt, Human
ucuuucucugcc

SEQ ID NO: 1332335 - RNA, 13 nt, Human
ucuuucucugcca

SEQ ID NO: 1332336 - RNA, 15 nt, Human
ucuuucucugccagu

SEQ ID NO: 1332337 - RNA, 16 nt, Human
ucuuucucugccagug

SEQ ID NO: 1332338 - RNA, 17 nt, Human
ucuuucucugccaguga

SEQ ID NO: 1332339 - RNA, 16 nt, Human
ucuuucucuuucccug

SEQ ID NO: 1332340 - RNA, 17 nt, Human
ucuuucucuuucccugg

SEQ ID NO: 1332341 - RNA, 10 nt, Human
ucuuucugua

SEQ ID NO: 1332342 - RNA, 15 nt, Human
agagacaucagcccu

SEQ ID NO: 1332343 - RNA, 15 nt, Human
agagacaugcagaga

SEQ ID NO: 1332344 - RNA, 18 nt, Human
agagacauuaacucauua

SEQ ID NO: 1332345 - RNA, 22 nt, Human
agagacauuaacucauuagacu

SEQ ID NO: 1332346 - RNA, 17 nt, Human
agagacauacuugaagg

SEQ ID NO: 1332347 - RNA, 22 nt, Human
agagacauacuugaagggccag

SEQ ID NO: 1332348 - RNA, 23 nt, Human
agagacauacuugaagggccaga

SEQ ID NO: 1332349 - RNA, 13 nt, Human
agagacaucagcc

SEQ ID NO: 1332350 - RNA, 23 nt, Human
agagacauuaacucauuagacug

SEQ ID NO: 1332351 - RNA, 12 nt, Human
ucuuugguucua

SEQ ID NO: 1332352 - RNA, 14 nt, Human
ucuuugguucuaag

SEQ ID NO: 1332353 - RNA, 15 nt, Human
ucuuugguucuaagg

SEQ ID NO: 1332354 - RNA, 16 nt, Human
ucuuugguucuaagga

SEQ ID NO: 1332355 - RNA, 21 nt, Human
ucuuugguucuaaggaccuga

SEQ ID NO: 1332356 - RNA, 13 nt, Human
ucuuuguguagcu

SEQ ID NO: 1332357 - RNA, 15 nt, Human
ucuuuguguagcuuu

SEQ ID NO: 1332358 - RNA, 18 nt, Human
ucuuuguguagcuuugcu

SEQ ID NO: 1332359 - RNA, 21 nt, Human
ucuugaugccuggcggggugg

SEQ ID NO: 1332360 - RNA, 14 nt, Human
ucuugauguaaaau

SEQ ID NO: 1332361 - RNA, 15 nt, Human
ucuugauguaaaauc

SEQ ID NO: 1332362 - RNA, 16 nt, Human
ucuugauguaaaaucu

SEQ ID NO: 1332363 - RNA, 19 nt, Human
ucuugauguaaaaucuugu

SEQ ID NO: 1332364 - RNA, 21 nt, Human
ucuugauguaaggaugggcau

SEQ ID NO: 1332365 - RNA, 22 nt, Human
ucuugauguaaaaucuugucau

SEQ ID NO: 1332366 - RNA, 14 nt, Human
ucuugauuauccau

SEQ ID NO: 1332367 - RNA, 23 nt, Human
ucuugauuauccauauugaguca

SEQ ID NO: 1332368 - RNA, 22 nt, Human
ucuugagcaguggcugguccag

SEQ ID NO: 1332369 - RNA, 13 nt, Human
ucuugagcucuau

SEQ ID NO: 1332370 - RNA, 14 nt, Human
ucuugagcucuauu

SEQ ID NO: 1332371 - RNA, 16 nt, Human
ucuugagcucuauuau

SEQ ID NO: 1332372 - RNA, 22 nt, Human
ucuugaggggaagcuagucuuu

SEQ ID NO: 1332373 - RNA, 15 nt, Human
ucuugaggggaccag

SEQ ID NO: 1332374 - RNA, 17 nt, Human
ucuugaggggaccagga

SEQ ID NO: 1332375 - RNA, 18 nt, Human
ucuugaggggaccaggag

SEQ ID NO: 1332376 - RNA, 19 nt, Human
ucuugaggggaccaggagu

SEQ ID NO: 1332377 - RNA, 13 nt, Human
ucuugaguuuguc

SEQ ID NO: 1332378 - RNA, 14 nt, Human
ucuugaguuugucg

SEQ ID NO: 1332379 - RNA, 20 nt, Human
ucuugaguuugucgcucaug

SEQ ID NO: 1332380 - RNA, 14 nt, Human
ucuugagcaguggc

SEQ ID NO: 1332381 - RNA, 13 nt, Human
agacucagcucug

SEQ ID NO: 1332382 - RNA, 18 nt, Human
agacucagcucugacauu

SEQ ID NO: 1332383 - RNA, 20 nt, Human
agacucagcucugacauucu

SEQ ID NO: 1332384 - RNA, 19 nt, Human
agacucaggccaagaaacg

SEQ ID NO: 1332385 - RNA, 20 nt, Human
agacucaggccaagaaacgu

SEQ ID NO: 1332386 - RNA, 23 nt, Human
agacucaggccaagaaacgucuu

SEQ ID NO: 1332387 - RNA, 19 nt, Human
agaccuguuagcagacagg

SEQ ID NO: 1332388 - RNA, 14 nt, Human
agaccccuggcuuu

SEQ ID NO: 1332389 - RNA, 11 nt, Human
agaccuggcag

SEQ ID NO: 1332390 - RNA, 14 nt, Human
agaccuggcagcuc

SEQ ID NO: 1332391 - RNA, 15 nt, Human
agaccuggcagcucu

SEQ ID NO: 1332392 - RNA, 16 nt, Human
agaccuggcagcucug

SEQ ID NO: 1332393 - RNA, 17 nt, Human
agaccuggcagcucugg

SEQ ID NO: 1332394 - RNA, 18 nt, Human
agaccuggcagcucugga

SEQ ID NO: 1332395 - RNA, 23 nt, Human
agaccuggcagcucuggacagcc

SEQ ID NO: 1332396 - RNA, 13 nt, Human
agaccuguaauca

SEQ ID NO: 1332397 - RNA, 18 nt, Human
agaccuguuagcagacag

SEQ ID NO: 1332398 - RNA, 18 nt, Human
agaccuuguuacuucuga

SEQ ID NO: 1332399 - RNA, 19 nt, Human
agaccuuguuacuucugag

SEQ ID NO: 1332400 - RNA, 21 nt, Human
agaccuuguuacuucugaggu

SEQ ID NO: 1332401 - RNA, 22 nt, Human
agaccuuguuacuucugaggua

SEQ ID NO: 1332402 - RNA, 20 nt, Human
agacuaucuuacuauuucac

SEQ ID NO: 1332403 - RNA, 15 nt, Human
agacuaugaaaaugc

SEQ ID NO: 1332404 - RNA, 18 nt, Human
ucuuucuaaugugugaau

SEQ ID NO: 1332405 - RNA, 19 nt, Human
ucuuucuaaugugugaauc

SEQ ID NO: 1332406 - RNA, 13 nt, Human
ucuuucucugagg

SEQ ID NO: 1332407 - RNA, 15 nt, Human
ucuuucucugaggac

SEQ ID NO: 1332408 - RNA, 15 nt, Human
ucuuuaugcuugcaa

SEQ ID NO: 1332409 - RNA, 14 nt, Human
ucuuuaugcuugca

SEQ ID NO: 1332410 - RNA, 23 nt, Human
ucuuuauuuuaaccuuugauaga

SEQ ID NO: 1332411 - RNA, 12 nt, Human
ucuuuauuuuga

SEQ ID NO: 1332412 - RNA, 17 nt, Human
ucuuuaaccaaacaaua

SEQ ID NO: 1332413 - RNA, 23 nt, Human
ucuuuaacucccauuaccaugua

SEQ ID NO: 1332414 - RNA, 11 nt, Human
ucuuuaacugc

SEQ ID NO: 1332415 - RNA, 20 nt, Human
ucuuuaacugccguaauuua

SEQ ID NO: 1332416 - RNA, 21 nt, Human
ucuuuaacugccguaauuuaa

SEQ ID NO: 1332417 - RNA, 22 nt, Human
ucuuuaacugccguaauuuaac

SEQ ID NO: 1332418 - RNA, 20 nt, Human
ucuuuaacuuaauugcuaug

SEQ ID NO: 1332419 - RNA, 11 nt, Human
ucuuuauauga

SEQ ID NO: 1332420 - RNA, 15 nt, Human
ucuuuauaugaagaa

SEQ ID NO: 1332421 - RNA, 16 nt, Human
ucuuggccaugggagg

SEQ ID NO: 1332422 - RNA, 22 nt, Human
ucuuggccaugggaggccuuuc

SEQ ID NO: 1332423 - RNA, 14 nt, Human
ucuuggcuggaccc

SEQ ID NO: 1332424 - RNA, 17 nt, Human
ucuuggcuggacccagc

SEQ ID NO: 1332425 - RNA, 18 nt, Human
ucuuggcuggacccagcc

SEQ ID NO: 1332426 - RNA, 19 nt, Human
ucuuggcuggacccagcca

SEQ ID NO: 1332427 - RNA, 20 nt, Human
ucuuggcuggacccagccag

SEQ ID NO: 1332428 - RNA, 19 nt, Human
ucuuggggggguggccgcu

SEQ ID NO: 1332429 - RNA, 20 nt, Human
ucuuggggggguggccgcug

SEQ ID NO: 1332430 - RNA, 22 nt, Human
ucuuggggaguuuagggugggg

SEQ ID NO: 1332431 - RNA, 23 nt, Human
ucuugggcagagcuggcucugag

SEQ ID NO: 1332432 - RNA, 23 nt, Human
ucuuggggaguuuaggguggggg

SEQ ID NO: 1332433 - RNA, 13 nt, Human
ucuuggggaagau

SEQ ID NO: 1332434 - RNA, 13 nt, Human
ucuugggaacuga

SEQ ID NO: 1332435 - RNA, 14 nt, Human
ucuugggaacugaa

SEQ ID NO: 1332436 - RNA, 19 nt, Human
ucuugggcagagcuggcuc

SEQ ID NO: 1332437 - RNA, 20 nt, Human
ucuugggcagagcuggcucu

SEQ ID NO: 1332438 - RNA, 21 nt, Human
ucuugggcagagcuggcucug

SEQ ID NO: 1332439 - RNA, 22 nt, Human
ucuucuuaauauguucuuuuaa

SEQ ID NO: 1332440 - RNA, 14 nt, Human
agacauaaaggaaa

SEQ ID NO: 1332441 - RNA, 18 nt, Human
ucuucuggguuccuuccu

SEQ ID NO: 1332442 - RNA, 22 nt, Human
ucuucuggggcaggcugggcca

SEQ ID NO: 1332443 - RNA, 19 nt, Human
ucuucucuuccuuuuauca

SEQ ID NO: 1332444 - RNA, 21 nt, Human
ucuucucuuccuuuuaucagu

SEQ ID NO: 1332445 - RNA, 19 nt, Human
ucuucugaacucaaacuga

SEQ ID NO: 1332446 - RNA, 24 nt, Human
ucuucugaacucaaacugaggaau

SEQ ID NO: 1332447 - RNA, 22 nt, Human
ucuucugggagggcagcagggc

SEQ ID NO: 1332448 - RNA, 23 nt, Human
ucuucugggagggcagcagggcu

SEQ ID NO: 1332449 - RNA, 18 nt, Human
ucuucuggggcaggcugg

SEQ ID NO: 1332450 - RNA, 20 nt, Human
ucuucuggggcaggcugggc

SEQ ID NO: 1332451 - RNA, 21 nt, Human
ucuucuggggcaggcugggcc

SEQ ID NO: 1332452 - RNA, 15 nt, Human
agacauaaaggaaaa

SEQ ID NO: 1332453 - RNA, 16 nt, Human
agacauaaaggaaaag

SEQ ID NO: 1332454 - RNA, 21 nt, Human
agacauaaaggaaaagacaca

SEQ ID NO: 1332455 - RNA, 23 nt, Human
agacauaaaggaaaagacacauu

SEQ ID NO: 1332456 - RNA, 18 nt, Human
agacauaaccacugcuuc

SEQ ID NO: 1332457 - RNA, 21 nt, Human
agacauagaauuaacacauga

SEQ ID NO: 1332458 - RNA, 18 nt, Human
agacaucaacagauaaau

SEQ ID NO: 1332459 - RNA, 17 nt, Human
agacaucaacagauaaa

SEQ ID NO: 1332460 - RNA, 14 nt, Human
agacaucagcccuu

SEQ ID NO: 1332461 - RNA, 16 nt, Human
agacaucagcccuugg

SEQ ID NO: 1332462 - RNA, 20 nt, Human
agacauccaaacuaaaagga

SEQ ID NO: 1332463 - RNA, 24 nt, Human
agaccccuaacccuuugugugcuc

SEQ ID NO: 1332464 - RNA, 14 nt, Human
agacccccagcacu

SEQ ID NO: 1332465 - RNA, 19 nt, Human
agacaucugagguuuuauu

SEQ ID NO: 1332466 - RNA, 22 nt, Human
agacauuaacucauuagacugg

SEQ ID NO: 1332467 - RNA, 20 nt, Human
agacauuaacucauuagacu

SEQ ID NO: 1332468 - RNA, 15 nt, Human
agacauuggcaccua

SEQ ID NO: 1332469 - RNA, 14 nt, Human
agaaucacuugaac

SEQ ID NO: 1332470 - RNA, 13 nt, Human
agaaucagagaag

SEQ ID NO: 1332471 - RNA, 15 nt, Human
ucuucaacucccugc

SEQ ID NO: 1332472 - RNA, 23 nt, Human
agaaucagagaaggaacauaccc

SEQ ID NO: 1332473 - RNA, 16 nt, Human
ucuucaacugaccagc

SEQ ID NO: 1332474 - RNA, 19 nt, Human
ucuucaacugaccagccuc

SEQ ID NO: 1332475 - RNA, 16 nt, Human
ucuucaagaucccauu

SEQ ID NO: 1332476 - RNA, 14 nt, Human
ucuucaagaaaucu

SEQ ID NO: 1332477 - RNA, 14 nt, Human
ucuuccaugcugug

SEQ ID NO: 1332478 - RNA, 15 nt, Human
ucuuccaugcugugc

SEQ ID NO: 1332479 - RNA, 17 nt, Human
ucuuccaugcugugcgc

SEQ ID NO: 1332480 - RNA, 13 nt, Human
ucuuccauuugca

SEQ ID NO: 1332481 - RNA, 14 nt, Human
ucuuccauuugcaa

SEQ ID NO: 1332482 - RNA, 11 nt, Human
ucuuccucugc

SEQ ID NO: 1332483 - RNA, 12 nt, Human
ucuuccucugcu

SEQ ID NO: 1332484 - RNA, 14 nt, Human
ucuuccucugcuga

SEQ ID NO: 1332485 - RNA, 16 nt, Human
ucuuccucuuccccca

SEQ ID NO: 1332486 - RNA, 13 nt, Human
ucuuccugacacu

SEQ ID NO: 1332487 - RNA, 15 nt, Human
ucuuccugacacuuu

SEQ ID NO: 1332488 - RNA, 16 nt, Human
ucuuccugacacuuua

SEQ ID NO: 1332489 - RNA, 14 nt, Human
ucuuccugaguggu

SEQ ID NO: 1332490 - RNA, 18 nt, Human
ucuuccugaguggugcca

SEQ ID NO: 1332491 - RNA, 14 nt, Human
ucuucucuccagcu

SEQ ID NO: 1332492 - RNA, 18 nt, Human
ucuucucuccagcugacu

SEQ ID NO: 1332493 - RNA, 20 nt, Human
ucuucucucucaauuuuauc

SEQ ID NO: 1332494 - RNA, 13 nt, Human
ucuucucuguugu

SEQ ID NO: 1332495 - RNA, 16 nt, Human
ucuuccucagccagcc

SEQ ID NO: 1332496 - RNA, 17 nt, Human
ucuuccucagccagccu

SEQ ID NO: 1332497 - RNA, 18 nt, Human
ucuuccucagccagccuc

SEQ ID NO: 1332498 - RNA, 13 nt, Human
ucuuccccagacg

SEQ ID NO: 1332499 - RNA, 19 nt, Human
ucuuccccagacgccuggc

SEQ ID NO: 1332500 - RNA, 21 nt, Human
ucuuccccagacgccuggcug

SEQ ID NO: 1332501 - RNA, 14 nt, Human
ucuucccccaccac

SEQ ID NO: 1332502 - RNA, 14 nt, Human
ucuucccccucucc

SEQ ID NO: 1332503 - RNA, 16 nt, Human
ucuucccccucuccca

SEQ ID NO: 1332504 - RNA, 17 nt, Human
ucuucccccucucccag

SEQ ID NO: 1332505 - RNA, 18 nt, Human
ucuucccccucucccagu

SEQ ID NO: 1332506 - RNA, 21 nt, Human
ucuucccccucucccaguugu

SEQ ID NO: 1332507 - RNA, 22 nt, Human
ucuggauuccagagcacugcuc

SEQ ID NO: 1332508 - RNA, 20 nt, Human
ucuggauuccccaucucagg

SEQ ID NO: 1332509 - RNA, 15 nt, Human
ucuggcaacaucuuu

SEQ ID NO: 1332510 - RNA, 16 nt, Human
ucuggcaacaucuuua

SEQ ID NO: 1332511 - RNA, 12 nt, Human
ucuggcaaggac

SEQ ID NO: 1332512 - RNA, 18 nt, Human
ucuggcaaggacuuugua

SEQ ID NO: 1332513 - RNA, 23 nt, Human
ucuggcaaggacuuuguacauuu

SEQ ID NO: 1332514 - RNA, 14 nt, Human
ucuggcaaugccac

SEQ ID NO: 1332515 - RNA, 15 nt, Human
ucuggcaaugccaca

SEQ ID NO: 1332516 - RNA, 16 nt, Human
ucuggcaaugccacag

SEQ ID NO: 1332517 - RNA, 17 nt, Human
ucuggcaaugccacagc

SEQ ID NO: 1332518 - RNA, 20 nt, Human
ucuggcaaugccacagcccu

SEQ ID NO: 1332519 - RNA, 21 nt, Human
ucuggcaaugccacagcccug

SEQ ID NO: 1332520 - RNA, 23 nt, Human
ucuggcaaugccacagcccuguc

SEQ ID NO: 1332521 - RNA, 22 nt, Human
ucuggcaaugccacagcccugu

SEQ ID NO: 1332522 - RNA, 22 nt, Human
ucuggaagugacuuuggcugca

SEQ ID NO: 1332523 - RNA, 19 nt, Human
ucuggaagugacuuuggcu

SEQ ID NO: 1332524 - RNA, 18 nt, Human
ucuggaagugacuuuggc

SEQ ID NO: 1332525 - RNA, 13 nt, Human
ucuggaaguccaa

SEQ ID NO: 1332526 - RNA, 14 nt, Human
ucuggauuccagag

SEQ ID NO: 1332527 - RNA, 17 nt, Human
ucuggaagccccugggc

SEQ ID NO: 1332528 - RNA, 18 nt, Human
ucuggaaccucagccugg

SEQ ID NO: 1332529 - RNA, 19 nt, Human
ucuggaaccucagccuggc

SEQ ID NO: 1332530 - RNA, 20 nt, Human
ucuggaaccucagccuggcc

SEQ ID NO: 1332531 - RNA, 21 nt, Human
ucuggaaccucagccuggcca

SEQ ID NO: 1332532 - RNA, 23 nt, Human
ucuggaaccucagccuggccaga

SEQ ID NO: 1332533 - RNA, 15 nt, Human
ucuggaagaugggga

SEQ ID NO: 1332534 - RNA, 23 nt, Human
ucuggaagauggggaccagcagc

SEQ ID NO: 1332535 - RNA, 18 nt, Human
ucuggaagccccugggcc

SEQ ID NO: 1332536 - RNA, 20 nt, Human
ucugcuuugcucuucaagaa

SEQ ID NO: 1332537 - RNA, 17 nt, Human
ucuggaaccucagccug

SEQ ID NO: 1332538 - RNA, 12 nt, Human
ucugccugucuc

SEQ ID NO: 1332539 - RNA, 14 nt, Human
ucugccugucuccc

SEQ ID NO: 1332540 - RNA, 15 nt, Human
ucugccuuagucuca

SEQ ID NO: 1332541 - RNA, 19 nt, Human
ucugccuuagucucaguuu

SEQ ID NO: 1332542 - RNA, 23 nt, Human
ucuggcccuugcuuaccucucag

SEQ ID NO: 1332543 - RNA, 22 nt, Human
ucuggcacagccuggcuguggc

SEQ ID NO: 1332544 - RNA, 10 nt, Human
ucuggccuuc

SEQ ID NO: 1332545 - RNA, 15 nt, Human
ucuggccucugcuuu

SEQ ID NO: 1332546 - RNA, 13 nt, Human
ucuggccuggcca

SEQ ID NO: 1332547 - RNA, 19 nt, Human
ucuggccuggccagugccc

SEQ ID NO: 1332548 - RNA, 14 nt, Human
ucuggccuggccag

SEQ ID NO: 1332549 - RNA, 17 nt, Human
ucuggccuggccagugc

SEQ ID NO: 1332550 - RNA, 17 nt, Human
agaagccugaugcugac

SEQ ID NO: 1332551 - RNA, 21 nt, Human
agaagccugaugcugacauuc

SEQ ID NO: 1332552 - RNA, 13 nt, Human
agaaguugauaug

SEQ ID NO: 1332553 - RNA, 23 nt, Human
agaagugcaucuggagagaacag

SEQ ID NO: 1332554 - RNA, 16 nt, Human
agaaguuuagauuuua

SEQ ID NO: 1332555 - RNA, 15 nt, Human
agaaguuuagauuuu

SEQ ID NO: 1332556 - RNA, 13 nt, Human
agaaguuucuguc

SEQ ID NO: 1332557 - RNA, 21 nt, Human
agaaguuguaaaguauguauu

SEQ ID NO: 1332558 - RNA, 22 nt, Human
agaaguuggggacacauguauu

SEQ ID NO: 1332559 - RNA, 23 nt, Human
agaagcucccugaaguaagcaaa

SEQ ID NO: 1332560 - RNA, 13 nt, Human
agaagcuccccca

SEQ ID NO: 1332561 - RNA, 15 nt, Human
agaagcucccccagc

SEQ ID NO: 1332562 - RNA, 16 nt, Human
agaagcucccccagca

SEQ ID NO: 1332563 - RNA, 14 nt, Human
agaagcuccucucc

SEQ ID NO: 1332564 - RNA, 17 nt, Human
agaagcuccucucccca

SEQ ID NO: 1332565 - RNA, 18 nt, Human
agaagcuccucuccccag

SEQ ID NO: 1332566 - RNA, 20 nt, Human
agaagcuccucuccccagcc

SEQ ID NO: 1332567 - RNA, 22 nt, Human
agaagcuccucuccccagccca

SEQ ID NO: 1332568 - RNA, 23 nt, Human
agaagcuccucuccccagcccag

SEQ ID NO: 1332569 - RNA, 19 nt, Human
agaagcucugaagaacucu

SEQ ID NO: 1332570 - RNA, 11 nt, Human
agaaggcaaaa

SEQ ID NO: 1332571 - RNA, 16 nt, Human
agaaggcaaaaauagu

SEQ ID NO: 1332572 - RNA, 17 nt, Human
agaagugacauugcauc

SEQ ID NO: 1332573 - RNA, 16 nt, Human
agaagugacauugcau

SEQ ID NO: 1332574 - RNA, 13 nt, Human
agaaguuugcacu

SEQ ID NO: 1332575 - RNA, 16 nt, Human
agaaguuugcacuauc

SEQ ID NO: 1332576 - RNA, 21 nt, Human
agaaguuugcacuaucuuuca

SEQ ID NO: 1332577 - RNA, 23 nt, Human
agaaguuugcacuaucuuucagc

SEQ ID NO: 1332578 - RNA, 13 nt, Human
agaauaaaggcag

SEQ ID NO: 1332579 - RNA, 14 nt, Human
agaauaaaggcagu

SEQ ID NO: 1332580 - RNA, 15 nt, Human
agaauaaaggcaguu

SEQ ID NO: 1332581 - RNA, 18 nt, Human
agaauaaaggcaguuuuc

SEQ ID NO: 1332582 - RNA, 20 nt, Human
agaauaaaggcaguuuucua

SEQ ID NO: 1332583 - RNA, 21 nt, Human
agaauaaaggcaguuuucuaa

SEQ ID NO: 1332584 - RNA, 17 nt, Human
agaauaaucacgcuuuc

SEQ ID NO: 1332585 - RNA, 20 nt, Human
agaauaaucacgcuuuccug

SEQ ID NO: 1332586 - RNA, 21 nt, Human
agaauaaucacgcuuuccuga

SEQ ID NO: 1332587 - RNA, 15 nt, Human
agaauaaauugauuu

SEQ ID NO: 1332588 - RNA, 20 nt, Human
agaauagccacauuuggaau

SEQ ID NO: 1332589 - RNA, 21 nt, Human
agaauagccacauuuggaaua

SEQ ID NO: 1332590 - RNA, 14 nt, Human
agaaucaaacauuu

SEQ ID NO: 1332591 - RNA, 21 nt, Human
agaaucaacauuucucaauaa

SEQ ID NO: 1332592 - RNA, 23 nt, Human
agaaucaacauuucucaauaauu

SEQ ID NO: 1332593 - RNA, 12 nt, Human
agaaauuaugug

SEQ ID NO: 1332594 - RNA, 13 nt, Human
agaaccuggaacu

SEQ ID NO: 1332595 - RNA, 20 nt, Human
agaaccuggaacuuggggag

SEQ ID NO: 1332596 - RNA, 21 nt, Human
agaaccuggaacuuggggagu

SEQ ID NO: 1332597 - RNA, 12 nt, Human
agaaccuggccu

SEQ ID NO: 1332598 - RNA, 13 nt, Human
agaaccuggccuu

SEQ ID NO: 1332599 - RNA, 14 nt, Human
agaaccuggccuuc

SEQ ID NO: 1332600 - RNA, 22 nt, Human
agaaccuggccuucaguguacc

SEQ ID NO: 1332601 - RNA, 21 nt, Human
agaaccuggguugcagacagg

SEQ ID NO: 1332602 - RNA, 15 nt, Human
ucugcaguaaaucuu

SEQ ID NO: 1332603 - RNA, 18 nt, Human
agaaauuacacccaaaga

SEQ ID NO: 1332604 - RNA, 18 nt, Human
agaaauuaccuguggaua

SEQ ID NO: 1332605 - RNA, 19 nt, Human
agaaauuaccuguggauau

SEQ ID NO: 1332606 - RNA, 20 nt, Human
agaaauuaccuguggauauu

SEQ ID NO: 1332607 - RNA, 23 nt, Human
ucugcaggucccuaauaaagcug

SEQ ID NO: 1332608 - RNA, 22 nt, Human
ucugcaggucccuaauaaagcu

SEQ ID NO: 1332609 - RNA, 21 nt, Human
ucugcaggucccuaauaaagc

SEQ ID NO: 1332610 - RNA, 17 nt, Human
ucugaauaaagcaauua

SEQ ID NO: 1332611 - RNA, 17 nt, Human
ucugaauaaaguguaac

SEQ ID NO: 1332612 - RNA, 18 nt, Human
ucugaauaaaguguaaca

SEQ ID NO: 1332613 - RNA, 14 nt, Human
ucugaauaaagcaa

SEQ ID NO: 1332614 - RNA, 13 nt, Human
agaacggaagaag

SEQ ID NO: 1332615 - RNA, 18 nt, Human
agaacuaccaccugacau

SEQ ID NO: 1332616 - RNA, 12 nt, Human
agaacggaagaa

SEQ ID NO: 1332617 - RNA, 16 nt, Human
agaacgcugauuuaaa

SEQ ID NO: 1332618 - RNA, 17 nt, Human
agaacuagaauuugauu

SEQ ID NO: 1332619 - RNA, 17 nt, Human
agaacuagccaaaccag

SEQ ID NO: 1332620 - RNA, 21 nt, Human
agaacuagccaaaccaggacc

SEQ ID NO: 1332621 - RNA, 19 nt, Human
agaacuagccaaaccagga

SEQ ID NO: 1332622 - RNA, 19 nt, Human
agaacucaaauggggccag

SEQ ID NO: 1332623 - RNA, 12 nt, Human
agaaccuucucu

SEQ ID NO: 1332624 - RNA, 14 nt, Human
agaaccuucucuau

SEQ ID NO: 1332625 - RNA, 18 nt, Human
agaaccuucucuaugggg

SEQ ID NO: 1332626 - RNA, 17 nt, Human
agaacucccuuucaaca

SEQ ID NO: 1332627 - RNA, 20 nt, Human
agaacucaaauggggccaga

SEQ ID NO: 1332628 - RNA, 16 nt, Human
agaacucccuuucaac

SEQ ID NO: 1332629 - RNA, 12 nt, Human
agaacugcaggc

SEQ ID NO: 1332630 - RNA, 15 nt, Human
agaacugcaggcccu

SEQ ID NO: 1332631 - RNA, 16 nt, Human
agaacugcaggcccug

SEQ ID NO: 1332632 - RNA, 18 nt, Human
agaacugcaggcccuggc

SEQ ID NO: 1332633 - RNA, 20 nt, Human
agaacugcaggcccuggccu

SEQ ID NO: 1332634 - RNA, 12 nt, Human
agaagcccccag

SEQ ID NO: 1332635 - RNA, 14 nt, Human
agaagcccccagcu

SEQ ID NO: 1332636 - RNA, 17 nt, Human
agaagcccccagcuaag

SEQ ID NO: 1332637 - RNA, 23 nt, Human
agaagcccccagcuaagaaccug

SEQ ID NO: 1332638 - RNA, 24 nt, Human
agaagcccccagcuaagaaccugg

SEQ ID NO: 1332639 - RNA, 13 nt, Human
agaagcccggcuc

SEQ ID NO: 1332640 - RNA, 14 nt, Human
agaagcccggcucc

SEQ ID NO: 1332641 - RNA, 15 nt, Human
agaagcccggcuccu

SEQ ID NO: 1332642 - RNA, 16 nt, Human
agaagcccggcuccug

SEQ ID NO: 1332643 - RNA, 17 nt, Human
agaagcccggcuccugg

SEQ ID NO: 1332644 - RNA, 18 nt, Human
agaagcccggcuccuggu

SEQ ID NO: 1332645 - RNA, 20 nt, Human
ucugcccauccugccccuga

SEQ ID NO: 1332646 - RNA, 22 nt, Human
ucugcccaggcacugcuaggcu

SEQ ID NO: 1332647 - RNA, 13 nt, Human
ucugcccaggcac

SEQ ID NO: 1332648 - RNA, 20 nt, Human
agaagcccgugugagaagug

SEQ ID NO: 1332649 - RNA, 20 nt, Human
agaagcccggcuccugguca

SEQ ID NO: 1332650 - RNA, 14 nt, Human
ucugcccccugcag

SEQ ID NO: 1332651 - RNA, 16 nt, Human
ucugcccccugcagaa

SEQ ID NO: 1332652 - RNA, 22 nt, Human
ucugcccugcgggucacaggag

SEQ ID NO: 1332653 - RNA, 15 nt, Human
ucugcccccugcaga

SEQ ID NO: 1332654 - RNA, 13 nt, Human
agaagcaaguaaa

SEQ ID NO: 1332655 - RNA, 23 nt, Human
agaagcaaccucaguaauuuaga

SEQ ID NO: 1332656 - RNA, 21 nt, Human
agaagcaaccucaguaauuua

SEQ ID NO: 1332657 - RNA, 19 nt, Human
agaagcaccaaucaugaau

SEQ ID NO: 1332658 - RNA, 15 nt, Human
agaacuugacccuga

SEQ ID NO: 1332659 - RNA, 18 nt, Human
agaacuuggauguaccug

SEQ ID NO: 1332660 - RNA, 23 nt, Human
agaacuuggauguaccugccccc

SEQ ID NO: 1332661 - RNA, 15 nt, Human
agaacuuugagcuac

SEQ ID NO: 1332662 - RNA, 20 nt, Human
agaacuuugagcuacugccg

SEQ ID NO: 1332663 - RNA, 15 nt, Human
agaagcaguggccuu

SEQ ID NO: 1332664 - RNA, 13 nt, Human
agaagccagcuug

SEQ ID NO: 1332665 - RNA, 14 nt, Human
agaagccagcuugu

SEQ ID NO: 1332666 - RNA, 15 nt, Human
agaagccagcuuguu

SEQ ID NO: 1332667 - RNA, 19 nt, Human
agaagccagcuuguuuaca

SEQ ID NO: 1332668 - RNA, 20 nt, Human
agaagccagcuuguuuacau

SEQ ID NO: 1332669 - RNA, 21 nt, Human
agaagccagcuuguuuacaug

SEQ ID NO: 1332670 - RNA, 12 nt, Human
agaagccaggaa

SEQ ID NO: 1332671 - RNA, 13 nt, Human
agaagccaggaau

SEQ ID NO: 1332672 - RNA, 22 nt, Human
agaagccaggaauuucccagga

SEQ ID NO: 1332673 - RNA, 16 nt, Human
agaagccaucaccuca

SEQ ID NO: 1332674 - RNA, 18 nt, Human
agaagccaucaccucaga

SEQ ID NO: 1332675 - RNA, 20 nt, Human
agaagccaucaccucagaug

SEQ ID NO: 1332676 - RNA, 22 nt, Human
agaagccaucaccucagauggc

SEQ ID NO: 1332677 - RNA, 22 nt, Human
ucucucacuuguuuuauuuaac

SEQ ID NO: 1332678 - RNA, 15 nt, Human
ucucggcucacugca

SEQ ID NO: 1332679 - RNA, 18 nt, Human
ucucggccuucacaaucu

SEQ ID NO: 1332680 - RNA, 18 nt, Human
ucucuccagcugacuaaa

SEQ ID NO: 1332681 - RNA, 19 nt, Human
ucucuccagcugacuaaac

SEQ ID NO: 1332682 - RNA, 13 nt, Human
ucucuccagugca

SEQ ID NO: 1332683 - RNA, 17 nt, Human
ucucgaacuccugaccu

SEQ ID NO: 1332684 - RNA, 14 nt, Human
ucuccuucuuagcu

SEQ ID NO: 1332685 - RNA, 14 nt, Human
ucucgagcgcccug

SEQ ID NO: 1332686 - RNA, 16 nt, Human
ucucgagcgcccugca

SEQ ID NO: 1332687 - RNA, 17 nt, Human
ucucgagcgcccugcag

SEQ ID NO: 1332688 - RNA, 18 nt, Human
ucucgagcgcccugcaga

SEQ ID NO: 1332689 - RNA, 19 nt, Human
ucucgagcgcccugcagac

SEQ ID NO: 1332690 - RNA, 22 nt, Human
ucucgagcgcccugcagacccu

SEQ ID NO: 1332691 - RNA, 14 nt, Human
ucucgaugcaauga

SEQ ID NO: 1332692 - RNA, 17 nt, Human
ucucgaugcaaugaaca

SEQ ID NO: 1332693 - RNA, 13 nt, Human
ucucgaucuccug

SEQ ID NO: 1332694 - RNA, 20 nt, Human
ucucgcuauugucaccaggg

SEQ ID NO: 1332695 - RNA, 16 nt, Human
ucucgcauaggaccuu

SEQ ID NO: 1332696 - RNA, 23 nt, Human
ucucgcauaggaccuuuccacca

SEQ ID NO: 1332697 - RNA, 14 nt, Human
ucucgcacaccucu

SEQ ID NO: 1332698 - RNA, 18 nt, Human
acuuugugcauucuggau

SEQ ID NO: 1332699 - RNA, 20 nt, Human
acuuugucgcccaggcugga

SEQ ID NO: 1332700 - RNA, 14 nt, Human
acuuugugaauaga

SEQ ID NO: 1332701 - RNA, 19 nt, Human
agaaaaaaaaauucacaug

SEQ ID NO: 1332702 - RNA, 14 nt, Human
agaaaaaaauguau

SEQ ID NO: 1332703 - RNA, 13 nt, Human
ucuccuucuuagc

SEQ ID NO: 1332704 - RNA, 16 nt, Human
agaaaaaaauguauuu

SEQ ID NO: 1332705 - RNA, 18 nt, Human
agaaaaaaauguauuuua

SEQ ID NO: 1332706 - RNA, 23 nt, Human
agaaaaaaauguauuuuauguua

SEQ ID NO: 1332707 - RNA, 22 nt, Human
agaaaaaaauguauuuuauguu

SEQ ID NO: 1332708 - RNA, 18 nt, Human
agaaaaaaauugaaaugu

SEQ ID NO: 1332709 - RNA, 14 nt, Human
agaaaaaaauugaa

SEQ ID NO: 1332710 - RNA, 16 nt, Human
agaaaaaaauugaaau

SEQ ID NO: 1332711 - RNA, 17 nt, Human
agaaaaaaauugaaaug

SEQ ID NO: 1332712 - RNA, 13 nt, Human
acuuuagggaagu

SEQ ID NO: 1332713 - RNA, 13 nt, Human
acuuucuuucuca

SEQ ID NO: 1332714 - RNA, 22 nt, Human
acuuucuuucucacuaaaucuu

SEQ ID NO: 1332715 - RNA, 15 nt, Human
acuuucuuuucugga

SEQ ID NO: 1332716 - RNA, 19 nt, Human
acuuucuuuucuggaaugu

SEQ ID NO: 1332717 - RNA, 16 nt, Human
acuuucuuucucacua

SEQ ID NO: 1332718 - RNA, 18 nt, Human
acuuucuuuuuguagcug

SEQ ID NO: 1332719 - RNA, 23 nt, Human
acuuucuuuuuguagcuggggcu

SEQ ID NO: 1332720 - RNA, 17 nt, Human
acuuucuuuuuugauau

SEQ ID NO: 1332721 - RNA, 23 nt, Human
acuuucuuuuuugauauagaagu

SEQ ID NO: 1332722 - RNA, 22 nt, Human
acuuucuuuuuuuucuauuuca

SEQ ID NO: 1332723 - RNA, 23 nt, Human
acuuucuuuuuuuucuauuucac

SEQ ID NO: 1332724 - RNA, 18 nt, Human
acuuugaaaggagauguc

SEQ ID NO: 1332725 - RNA, 17 nt, Human
acuuuagaauaugccuu

SEQ ID NO: 1332726 - RNA, 15 nt, Human
acuuuagaagccugc

SEQ ID NO: 1332727 - RNA, 16 nt, Human
acuuuagaagccugca

SEQ ID NO: 1332728 - RNA, 22 nt, Human
acuuguuuuauuuaaccucuaa

SEQ ID NO: 1332729 - RNA, 16 nt, Human
acuuguuuucugggaa

SEQ ID NO: 1332730 - RNA, 21 nt, Human
acuugugcccucccuguccuu

SEQ ID NO: 1332731 - RNA, 20 nt, Human
acuugugcccucccuguccu

SEQ ID NO: 1332732 - RNA, 16 nt, Human
acuuguuuuggaugcc

SEQ ID NO: 1332733 - RNA, 13 nt, Human
acuuguuuuggau

SEQ ID NO: 1332734 - RNA, 12 nt, Human
acuugucuguuu

SEQ ID NO: 1332735 - RNA, 13 nt, Human
acuugucuguuuu

SEQ ID NO: 1332736 - RNA, 20 nt, Human
acuuugcuugcuuugaagua

SEQ ID NO: 1332737 - RNA, 15 nt, Human
acuuugcuuuaauau

SEQ ID NO: 1332738 - RNA, 16 nt, Human
acuuugcuuuaauaua

SEQ ID NO: 1332739 - RNA, 17 nt, Human
acuuugcuuuaauauaa

SEQ ID NO: 1332740 - RNA, 18 nt, Human
acuuugcuuuaauauaaa

SEQ ID NO: 1332741 - RNA, 19 nt, Human
acuuugcuuuaauauaaau

SEQ ID NO: 1332742 - RNA, 21 nt, Human
acuuugcuuuaauauaaaugc

SEQ ID NO: 1332743 - RNA, 22 nt, Human
acuuugcuuuaauauaaaugca

SEQ ID NO: 1332744 - RNA, 19 nt, Human
acuuuguauaaaagggacu

SEQ ID NO: 1332745 - RNA, 20 nt, Human
acuuugaaaggagaugucuu

SEQ ID NO: 1332746 - RNA, 14 nt, Human
acuuugaaguuagc

SEQ ID NO: 1332747 - RNA, 17 nt, Human
acuuugcacugauauau

SEQ ID NO: 1332748 - RNA, 18 nt, Human
acuuugcacugauauauc

SEQ ID NO: 1332749 - RNA, 19 nt, Human
acuuugcacugauauauca

SEQ ID NO: 1332750 - RNA, 21 nt, Human
acuuugcacugauauaucaug

SEQ ID NO: 1332751 - RNA, 22 nt, Human
acuuugcagcacagcugagagg

SEQ ID NO: 1332752 - RNA, 23 nt, Human
acuuugcagccggcacagggucu

SEQ ID NO: 1332753 - RNA, 16 nt, Human
acuuugcaucucagua

SEQ ID NO: 1332754 - RNA, 17 nt, Human
acuuugcuaaagacaug

SEQ ID NO: 1332755 - RNA, 20 nt, Human
acuuugcuaaagacaugaag

SEQ ID NO: 1332756 - RNA, 21 nt, Human
acuuugcuaaagacaugaagc

SEQ ID NO: 1332757 - RNA, 11 nt, Human
acuuugcuugc

SEQ ID NO: 1332758 - RNA, 13 nt, Human
acuuugcuugcuu

SEQ ID NO: 1332759 - RNA, 14 nt, Human
acuuugcuugcuuu

SEQ ID NO: 1332760 - RNA, 15 nt, Human
acuuugcuugcuuug

SEQ ID NO: 1332761 - RNA, 12 nt, Human
agaaaugaaaaa

SEQ ID NO: 1332762 - RNA, 22 nt, Human
agaaaucuauagaacugaauga

SEQ ID NO: 1332763 - RNA, 13 nt, Human
agaaaugaaaaaa

SEQ ID NO: 1332764 - RNA, 16 nt, Human
agaaaugaaaaaauau

SEQ ID NO: 1332765 - RNA, 13 nt, Human
agaaaucuauuuc

SEQ ID NO: 1332766 - RNA, 23 nt, Human
agaaauacuacuguguaagggcc

SEQ ID NO: 1332767 - RNA, 16 nt, Human
agaaauagaauuauaa

SEQ ID NO: 1332768 - RNA, 13 nt, Human
agaaauagaacaa

SEQ ID NO: 1332769 - RNA, 19 nt, Human
agaaauagcuuaugaaaag

SEQ ID NO: 1332770 - RNA, 15 nt, Human
agaaauagucgguga

SEQ ID NO: 1332771 - RNA, 20 nt, Human
agaaauagcuuaugaaaaga

SEQ ID NO: 1332772 - RNA, 20 nt, Human
ucugaaggguaauuauauag

SEQ ID NO: 1332773 - RNA, 20 nt, Human
ucugaaggagccccauuccu

SEQ ID NO: 1332774 - RNA, 21 nt, Human
ucugaaggagccccauuccug

SEQ ID NO: 1332775 - RNA, 17 nt, Human
agaaaucuggcuucugg

SEQ ID NO: 1332776 - RNA, 15 nt, Human
agaaaugcuuagaaa

SEQ ID NO: 1332777 - RNA, 22 nt, Human
agaaagcaucccucacccaucc

SEQ ID NO: 1332778 - RNA, 19 nt, Human
agaaagcaucccucaccca

SEQ ID NO: 1332779 - RNA, 17 nt, Human
agaaagcaucccucacc

SEQ ID NO: 1332780 - RNA, 23 nt, Human
agaaauacaaaaauacucagaua

SEQ ID NO: 1332781 - RNA, 14 nt, Human
agaaauacaaaaau

SEQ ID NO: 1332782 - RNA, 20 nt, Human
agaaagcagaacagugauua

SEQ ID NO: 1332783 - RNA, 14 nt, Human
agaaagcagagauu

SEQ ID NO: 1332784 - RNA, 18 nt, Human
agaaagcagaacagugau

SEQ ID NO: 1332785 - RNA, 17 nt, Human
agaaagcagaacaguga

SEQ ID NO: 1332786 - RNA, 20 nt, Human
agaaagaggugaccccaggg

SEQ ID NO: 1332787 - RNA, 21 nt, Human
agaaagaggugaccccagggc

SEQ ID NO: 1332788 - RNA, 23 nt, Human
agaaagaggugaccccagggcac

SEQ ID NO: 1332789 - RNA, 22 nt, Human
agaaagaggugaccccagggca

SEQ ID NO: 1332790 - RNA, 23 nt, Human
agaaacuuaaauguuauuaucug

SEQ ID NO: 1332791 - RNA, 22 nt, Human
agaaagaggcaccaggaagccg

SEQ ID NO: 1332792 - RNA, 19 nt, Human
agaaagaggugaccccagg

SEQ ID NO: 1332793 - RNA, 12 nt, Human
agaaagacuugg

SEQ ID NO: 1332794 - RNA, 22 nt, Human
agaaagacuugguugguagggu

SEQ ID NO: 1332795 - RNA, 17 nt, Human
agaaagagaaacaguug

SEQ ID NO: 1332796 - RNA, 16 nt, Human
agaaaacaaggaugaa

SEQ ID NO: 1332797 - RNA, 12 nt, Human
agaaaagaugca

SEQ ID NO: 1332798 - RNA, 13 nt, Human
agaaaagaugcac

SEQ ID NO: 1332799 - RNA, 15 nt, Human
agaaaagaugcacuu

SEQ ID NO: 1332800 - RNA, 19 nt, Human
agaaaagaugcacuuugcu

SEQ ID NO: 1332801 - RNA, 16 nt, Human
agaaaagaugcacuuu

SEQ ID NO: 1332802 - RNA, 16 nt, Human
agaaacacaacuauau

SEQ ID NO: 1332803 - RNA, 17 nt, Human
agaaaagcuaagagaag

SEQ ID NO: 1332804 - RNA, 13 nt, Human
agaaaagcuauaa

SEQ ID NO: 1332805 - RNA, 21 nt, Human
agaaaagcuauaaaaugaaua

SEQ ID NO: 1332806 - RNA, 14 nt, Human
agaaaagcuuugaa

SEQ ID NO: 1332807 - RNA, 20 nt, Human
agaaacaacucuuugagaaa

SEQ ID NO: 1332808 - RNA, 18 nt, Human
agaaacaagguuuucagu

SEQ ID NO: 1332809 - RNA, 17 nt, Human
agaaacacccucacacu

SEQ ID NO: 1332810 - RNA, 21 nt, Human
agaaacaguugguaacuuuug

SEQ ID NO: 1332811 - RNA, 22 nt, Human
agaaacaguugguaacuuuugu

SEQ ID NO: 1332812 - RNA, 12 nt, Human
agaaacauuuau

SEQ ID NO: 1332813 - RNA, 15 nt, Human
agaaacauuuauauu

SEQ ID NO: 1332814 - RNA, 19 nt, Human
agaaacauuuauauugaua

SEQ ID NO: 1332815 - RNA, 21 nt, Human
agaaacuuaaauuuuaguucu

SEQ ID NO: 1332816 - RNA, 18 nt, Human
agaaacuuaaauguuauu

SEQ ID NO: 1332817 - RNA, 20 nt, Human
agaaacuuaaauguuauuau

SEQ ID NO: 1332818 - RNA, 17 nt, Human
agaaacuuaaauguuau

SEQ ID NO: 1332819 - RNA, 15 nt, Human
agaaacauuugguaa

SEQ ID NO: 1332820 - RNA, 21 nt, Human
ucucugcaggucccuaauaaa

SEQ ID NO: 1332821 - RNA, 20 nt, Human
ucucugcaggucccuaauaa

SEQ ID NO: 1332822 - RNA, 19 nt, Human
ucucugcaggucccuaaua

SEQ ID NO: 1332823 - RNA, 22 nt, Human
ucucugcaggucccuaauaaag

SEQ ID NO: 1332824 - RNA, 18 nt, Human
ucucuuguaauuuggauc

SEQ ID NO: 1332825 - RNA, 23 nt, Human
agaaaaacaaacucguuuuuuac

SEQ ID NO: 1332826 - RNA, 22 nt, Human
ucucuuguauaagauccuagau

SEQ ID NO: 1332827 - RNA, 13 nt, Human
agaaaaacaggca

SEQ ID NO: 1332828 - RNA, 15 nt, Human
agaaaaacaggcacu

SEQ ID NO: 1332829 - RNA, 14 nt, Human
agaaaaacaggcac

SEQ ID NO: 1332830 - RNA, 19 nt, Human
agaaaaauguguauuuuaa

SEQ ID NO: 1332831 - RNA, 21 nt, Human
agaaaacaaaacugcauuuca

SEQ ID NO: 1332832 - RNA, 13 nt, Human
agaaaacaaaacu

SEQ ID NO: 1332833 - RNA, 20 nt, Human
acuuccagauccuggaaauc

SEQ ID NO: 1332834 - RNA, 20 nt, Human
acuuccagguguuacuguaa

SEQ ID NO: 1332835 - RNA, 21 nt, Human
acuuccagguguuacuguaau

SEQ ID NO: 1332836 - RNA, 17 nt, Human
acuuccauaaucuggac

SEQ ID NO: 1332837 - RNA, 19 nt, Human
acuuccaaacuaauuuuua

SEQ ID NO: 1332838 - RNA, 19 nt, Human
acuuccaaauccccuaagc

SEQ ID NO: 1332839 - RNA, 21 nt, Human
acuuccaaauccccuaagcag

SEQ ID NO: 1332840 - RNA, 16 nt, Human
acuuccacaggguccc

SEQ ID NO: 1332841 - RNA, 20 nt, Human
acuuccacagggucccacag

SEQ ID NO: 1332842 - RNA, 21 nt, Human
acuuccacagggucccacagc

SEQ ID NO: 1332843 - RNA, 17 nt, Human
acuucaggcucuucucc

SEQ ID NO: 1332844 - RNA, 18 nt, Human
acuucaggcucuucuccu

SEQ ID NO: 1332845 - RNA, 20 nt, Human
acuucaggcucuucuccuuu

SEQ ID NO: 1332846 - RNA, 16 nt, Human
acuuaucugaucagaa

SEQ ID NO: 1332847 - RNA, 13 nt, Human
acuucauuucaga

SEQ ID NO: 1332848 - RNA, 14 nt, Human
acuuccaaacuaau

SEQ ID NO: 1332849 - RNA, 16 nt, Human
acuuccaaacuaauuu

SEQ ID NO: 1332850 - RNA, 17 nt, Human
acuuccaaacuaauuuu

SEQ ID NO: 1332851 - RNA, 18 nt, Human
acuuccaaacuaauuuuu

SEQ ID NO: 1332852 - RNA, 16 nt, Human
acuuacucuaagaucu

SEQ ID NO: 1332853 - RNA, 18 nt, Human
acuuacugcgacuaaacu

SEQ ID NO: 1332854 - RNA, 15 nt, Human
acuuagauuuuacau

SEQ ID NO: 1332855 - RNA, 16 nt, Human
acuuagauuuuacaug

SEQ ID NO: 1332856 - RNA, 17 nt, Human
acuuagauuuuacauga

SEQ ID NO: 1332857 - RNA, 18 nt, Human
acuuagauuuuacaugaa

SEQ ID NO: 1332858 - RNA, 19 nt, Human
acuuagauuuuacaugaag

SEQ ID NO: 1332859 - RNA, 20 nt, Human
acuuagauuuuacaugaagu

SEQ ID NO: 1332860 - RNA, 21 nt, Human
acuuagcauuuucugcaucuc

SEQ ID NO: 1332861 - RNA, 16 nt, Human
acuuagcuaguuuuau

SEQ ID NO: 1332862 - RNA, 22 nt, Human
acuuagcauuuucugcaucucc

SEQ ID NO: 1332863 - RNA, 20 nt, Human
acuuagcauuuucugcaucu

SEQ ID NO: 1332864 - RNA, 24 nt, Human
acuuagauuuuacaugaaguauuu

SEQ ID NO: 1332865 - RNA, 21 nt, Human
acuuagauuuuacaugaagua

SEQ ID NO: 1332866 - RNA, 19 nt, Human
ucuaccucaggcagcucaa

SEQ ID NO: 1332867 - RNA, 21 nt, Human
ucuaccuggucucuccuuguu

SEQ ID NO: 1332868 - RNA, 13 nt, Human
acuuacucuaaga

SEQ ID NO: 1332869 - RNA, 14 nt, Human
acuuacucuaagau

SEQ ID NO: 1332870 - RNA, 13 nt, Human
ucuauaauuuaaa

SEQ ID NO: 1332871 - RNA, 20 nt, Human
ucuaguuuuuucuuccuuuu

SEQ ID NO: 1332872 - RNA, 22 nt, Human
ucuaguuuuuucuuccuuuuca

SEQ ID NO: 1332873 - RNA, 22 nt, Human
ucuaguuuuuuacuuuuguuua

SEQ ID NO: 1332874 - RNA, 13 nt, Human
ucuauaaaccgaa

SEQ ID NO: 1332875 - RNA, 12 nt, Human
ucuauaauuuac

SEQ ID NO: 1332876 - RNA, 16 nt, Human
ucuauaauuuaccuaa

SEQ ID NO: 1332877 - RNA, 17 nt, Human
ucuauagccaaaaauag

SEQ ID NO: 1332878 - RNA, 20 nt, Human
ucuauagccaaaaauagcua

SEQ ID NO: 1332879 - RNA, 19 nt, Human
ucuaguguaucaaaaugcu

SEQ ID NO: 1332880 - RNA, 22 nt, Human
ucuaguguaucaaaaugcucuu

SEQ ID NO: 1332881 - RNA, 22 nt, Human
ucuaggaaauauacuuuuacaa

SEQ ID NO: 1332882 - RNA, 16 nt, Human
ucuaguguaucaaaau

SEQ ID NO: 1332883 - RNA, 14 nt, Human
ucuaguguaucaaa

SEQ ID NO: 1332884 - RNA, 13 nt, Human
ucuaguguaucaa

SEQ ID NO: 1332885 - RNA, 12 nt, Human
ucuaguguauca

SEQ ID NO: 1332886 - RNA, 14 nt, Human
ucuagcuuaucuac

SEQ ID NO: 1332887 - RNA, 15 nt, Human
ucuaggaaauauacu

SEQ ID NO: 1332888 - RNA, 14 nt, Human
ucuaguucugccag

SEQ ID NO: 1332889 - RNA, 14 nt, Human
ucuaguucauugaa

SEQ ID NO: 1332890 - RNA, 17 nt, Human
ucuaguuccccuguuua

SEQ ID NO: 1332891 - RNA, 21 nt, Human
ucuaguuccccuguuuauuca

SEQ ID NO: 1332892 - RNA, 20 nt, Human
acuuccccauggcccugagc

SEQ ID NO: 1332893 - RNA, 23 nt, Human
acuucccagcuaggaagagcagg

SEQ ID NO: 1332894 - RNA, 15 nt, Human
ucuagauaucgacuu

SEQ ID NO: 1332895 - RNA, 16 nt, Human
ucuagaucagaugcuc

SEQ ID NO: 1332896 - RNA, 18 nt, Human
ucuagaucagaugcucca

SEQ ID NO: 1332897 - RNA, 20 nt, Human
ucuagaucagaugcuccaag

SEQ ID NO: 1332898 - RNA, 21 nt, Human
ucuagaucagaugcuccaaga

SEQ ID NO: 1332899 - RNA, 22 nt, Human
ucuagaucagaugcuccaagau

SEQ ID NO: 1332900 - RNA, 14 nt, Human
ucuagaucauaagg

SEQ ID NO: 1332901 - RNA, 19 nt, Human
ucuagaugaaguuuuacau

SEQ ID NO: 1332902 - RNA, 20 nt, Human
ucuagaugaaguuuuacauu

SEQ ID NO: 1332903 - RNA, 21 nt, Human
ucuagaugaaguuuuacauug

SEQ ID NO: 1332904 - RNA, 22 nt, Human
ucuagaugaaguuuuacauugu

SEQ ID NO: 1332905 - RNA, 23 nt, Human
ucuagaugaaguuuuacauuguu

SEQ ID NO: 1332906 - RNA, 22 nt, Human
ucuagaugauuaaauaagauuc

SEQ ID NO: 1332907 - RNA, 21 nt, Human
ucuagauguuuauucuucuag

SEQ ID NO: 1332908 - RNA, 23 nt, Human
ucuagauguuuauucuucuagag

SEQ ID NO: 1332909 - RNA, 22 nt, Human
ucuagauguuuauucuucuaga

SEQ ID NO: 1332910 - RNA, 13 nt, Human
ucuagauucaaag

SEQ ID NO: 1332911 - RNA, 17 nt, Human
ucuagauucaaagguuc

SEQ ID NO: 1332912 - RNA, 18 nt, Human
ucuagauucaaagguucu

SEQ ID NO: 1332913 - RNA, 19 nt, Human
ucuagauucaaagguucua

SEQ ID NO: 1332914 - RNA, 20 nt, Human
ucuagauucaaagguucuag

SEQ ID NO: 1332915 - RNA, 22 nt, Human
ucuagauucaaagguucuaggu

SEQ ID NO: 1332916 - RNA, 23 nt, Human
ucuagauucaaagguucuagguu

SEQ ID NO: 1332917 - RNA, 19 nt, Human
ucuagauuccauuggucca

SEQ ID NO: 1332918 - RNA, 21 nt, Human
ucuagauuccauugguccaag

SEQ ID NO: 1332919 - RNA, 22 nt, Human
ucuagauuccauugguccaaga

SEQ ID NO: 1332920 - RNA, 23 nt, Human
ucuagauuccauugguccaagau

SEQ ID NO: 1332921 - RNA, 11 nt, Human
ucuagauucuc

SEQ ID NO: 1332922 - RNA, 14 nt, Human
ucuagauucucugg

SEQ ID NO: 1332923 - RNA, 15 nt, Human
ucuagauugagagaa

SEQ ID NO: 1332924 - RNA, 21 nt, Human
ucuagauucucuggcuguaag

SEQ ID NO: 1332925 - RNA, 13 nt, Human
ucuagccuggcua

SEQ ID NO: 1332926 - RNA, 23 nt, Human
ucuagcgcaguuuuuuuuuucuu

SEQ ID NO: 1332927 - RNA, 18 nt, Human
acuugaaaauuaacauga

SEQ ID NO: 1332928 - RNA, 15 nt, Human
acuucugacagccuc

SEQ ID NO: 1332929 - RNA, 16 nt, Human
acuucugacagccuca

SEQ ID NO: 1332930 - RNA, 12 nt, Human
acuugaaagaaa

SEQ ID NO: 1332931 - RNA, 17 nt, Human
acuugaaaauuaacaug

SEQ ID NO: 1332932 - RNA, 21 nt, Human
acuucucuuguuagguaauuu

SEQ ID NO: 1332933 - RNA, 14 nt, Human
acuucucuuugccu

SEQ ID NO: 1332934 - RNA, 15 nt, Human
acuucucuuugccuc

SEQ ID NO: 1332935 - RNA, 16 nt, Human
acuucucuuugccuca

SEQ ID NO: 1332936 - RNA, 17 nt, Human
acuucucuuugccucaa

SEQ ID NO: 1332937 - RNA, 21 nt, Human
acuucucuuugccucaaauaa

SEQ ID NO: 1332938 - RNA, 14 nt, Human
acuucugacagccu

SEQ ID NO: 1332939 - RNA, 20 nt, Human
acuugaaauauccugcuuga

SEQ ID NO: 1332940 - RNA, 23 nt, Human
acuugaacccgggaggcagaggu

SEQ ID NO: 1332941 - RNA, 17 nt, Human
acuugaacguuuucuaa

SEQ ID NO: 1332942 - RNA, 18 nt, Human
acuugaacguuuucuaau

SEQ ID NO: 1332943 - RNA, 19 nt, Human
acuugaacguuuucuaauu

SEQ ID NO: 1332944 - RNA, 20 nt, Human
acuugaacguuuucuaauug

SEQ ID NO: 1332945 - RNA, 21 nt, Human
acuugaacguuuucuaauugc

SEQ ID NO: 1332946 - RNA, 22 nt, Human
acuugaacguuuucuaauugcu

SEQ ID NO: 1332947 - RNA, 19 nt, Human
acuugaggacacaugucca

SEQ ID NO: 1332948 - RNA, 18 nt, Human
acuugaggacacaugucc

SEQ ID NO: 1332949 - RNA, 17 nt, Human
acuugaggacacauguc

SEQ ID NO: 1332950 - RNA, 21 nt, Human
acuugaacugauucacaucuc

SEQ ID NO: 1332951 - RNA, 13 nt, Human
acuugaacugauu

SEQ ID NO: 1332952 - RNA, 14 nt, Human
acuugaagggccag

SEQ ID NO: 1332953 - RNA, 12 nt, Human
acuugacagugg

SEQ ID NO: 1332954 - RNA, 14 nt, Human
acuugacaguggaa

SEQ ID NO: 1332955 - RNA, 13 nt, Human
acuugacagugga

SEQ ID NO: 1332956 - RNA, 14 nt, Human
acuugacccugagc

SEQ ID NO: 1332957 - RNA, 15 nt, Human
acuugacccugagcu

SEQ ID NO: 1332958 - RNA, 18 nt, Human
acuugacccugagcugac

SEQ ID NO: 1332959 - RNA, 14 nt, Human
acuuguauuaugug

SEQ ID NO: 1332960 - RNA, 13 nt, Human
acuuguauuaugu

SEQ ID NO: 1332961 - RNA, 14 nt, Human
acuuguaugaaaga

SEQ ID NO: 1332962 - RNA, 20 nt, Human
acuuguauauuuuaagaaau

SEQ ID NO: 1332963 - RNA, 14 nt, Human
acuuguauauuuua

SEQ ID NO: 1332964 - RNA, 15 nt, Human
acuuguauuaugugu

SEQ ID NO: 1332965 - RNA, 17 nt, Human
acuuguccuagcacaga

SEQ ID NO: 1332966 - RNA, 18 nt, Human
acuuguccuagcacagau

SEQ ID NO: 1332967 - RNA, 21 nt, Human
acuuguccuuagccuggaccu

SEQ ID NO: 1332968 - RNA, 20 nt, Human
acuuguccuuagccuggacc

SEQ ID NO: 1332969 - RNA, 16 nt, Human
acuugucuauuaccug

SEQ ID NO: 1332970 - RNA, 12 nt, Human
acuugccucuuc

SEQ ID NO: 1332971 - RNA, 13 nt, Human
acuugccucuucc

SEQ ID NO: 1332972 - RNA, 23 nt, Human
acuuggaacugaagggggcggcc

SEQ ID NO: 1332973 - RNA, 13 nt, Human
acuugccucugca

SEQ ID NO: 1332974 - RNA, 14 nt, Human
acuugccaaauuua

SEQ ID NO: 1332975 - RNA, 19 nt, Human
acuugccaaauuuagauuu

SEQ ID NO: 1332976 - RNA, 20 nt, Human
ucuauuuuuugaaaagcaga

SEQ ID NO: 1332977 - RNA, 22 nt, Human
ucuauuuuuggagguuuauuac

SEQ ID NO: 1332978 - RNA, 21 nt, Human
ucuauuuuuggagguuuauua

SEQ ID NO: 1332979 - RNA, 17 nt, Human
ucucacauauacaagua

SEQ ID NO: 1332980 - RNA, 19 nt, Human
ucucacaugauuccagcca

SEQ ID NO: 1332981 - RNA, 22 nt, Human
ucucacaugauuccagccauca

SEQ ID NO: 1332982 - RNA, 13 nt, Human
ucucacuccuacc

SEQ ID NO: 1332983 - RNA, 18 nt, Human
ucucaccaggcagccucu

SEQ ID NO: 1332984 - RNA, 19 nt, Human
ucucaccaggcagccucug

SEQ ID NO: 1332985 - RNA, 22 nt, Human
ucucaccaggcagccucugggg

SEQ ID NO: 1332986 - RNA, 21 nt, Human
ucucaccaggcagccucuggg

SEQ ID NO: 1332987 - RNA, 20 nt, Human
ucucacaugauuccagccau

SEQ ID NO: 1332988 - RNA, 13 nt, Human
ucucaccaggcag

SEQ ID NO: 1332989 - RNA, 14 nt, Human
ucucaccaggcagc

SEQ ID NO: 1332990 - RNA, 16 nt, Human
ucucaccaggcagccu

SEQ ID NO: 1332991 - RNA, 17 nt, Human
ucucaccaggcagccuc

SEQ ID NO: 1332992 - RNA, 22 nt, Human
ucuauuguuguacacagaaaua

SEQ ID NO: 1332993 - RNA, 23 nt, Human
ucuauuguuguacacagaaauac

SEQ ID NO: 1332994 - RNA, 15 nt, Human
ucuauuuuuaucuga

SEQ ID NO: 1332995 - RNA, 15 nt, Human
ucuauuuuuggaggu

SEQ ID NO: 1332996 - RNA, 18 nt, Human
ucuauuuuuggagguuua

SEQ ID NO: 1332997 - RNA, 19 nt, Human
ucuauuuuuggagguuuau

SEQ ID NO: 1332998 - RNA, 15 nt, Human
ucuauaguucuagac

SEQ ID NO: 1332999 - RNA, 19 nt, Human
ucuauagccaaaaauagcu

SEQ ID NO: 1333000 - RNA, 12 nt, Human
ucuauaguucua

SEQ ID NO: 1333001 - RNA, 14 nt, Human
ucuauaguucuaga

SEQ ID NO: 1333002 - RNA, 12 nt, Human
ucuauuggucuc

SEQ ID NO: 1333003 - RNA, 18 nt, Human
acuuccucucgcggcccu

SEQ ID NO: 1333004 - RNA, 16 nt, Human
ucucacuccuaccugg

SEQ ID NO: 1333005 - RNA, 17 nt, Human
ucucacuccuaccuggu

SEQ ID NO: 1333006 - RNA, 18 nt, Human
ucucacuccuaccuggua

SEQ ID NO: 1333007 - RNA, 20 nt, Human
acuuccuaaauauuaugaga

SEQ ID NO: 1333008 - RNA, 15 nt, Human
acuuccuccucccca

SEQ ID NO: 1333009 - RNA, 17 nt, Human
acuuccuccuccccacu

SEQ ID NO: 1333010 - RNA, 18 nt, Human
acuuccuccuccccacuu

SEQ ID NO: 1333011 - RNA, 22 nt, Human
acuuccucucgcggcccucagu

SEQ ID NO: 1333012 - RNA, 19 nt, Human
acuucuaagacuuuacuua

SEQ ID NO: 1333013 - RNA, 12 nt, Human
ucgccucagccu

SEQ ID NO: 1333014 - RNA, 11 nt, Human
ucgccugacaa

SEQ ID NO: 1333015 - RNA, 20 nt, Human
ucgccugacaaccacugguc

SEQ ID NO: 1333016 - RNA, 21 nt, Human
ucgccugacaaccacuggucu

SEQ ID NO: 1333017 - RNA, 22 nt, Human
ucgccugacaaccacuggucug

SEQ ID NO: 1333018 - RNA, 16 nt, Human
ucgccuguaaucucac

SEQ ID NO: 1333019 - RNA, 12 nt, Human
ucgccuguaauc

SEQ ID NO: 1333020 - RNA, 14 nt, Human
ucgcucucaguucu

SEQ ID NO: 1333021 - RNA, 17 nt, Human
ucgccggaucugaggga

SEQ ID NO: 1333022 - RNA, 16 nt, Human
ucgccggaucugaggg

SEQ ID NO: 1333023 - RNA, 16 nt, Human
ucgcccuuugcugcau

SEQ ID NO: 1333024 - RNA, 18 nt, Human
ucgcccuggacugugugc

SEQ ID NO: 1333025 - RNA, 22 nt, Human
acugaagaagcaccaaucauga

SEQ ID NO: 1333026 - RNA, 12 nt, Human
acugaagaguaa

SEQ ID NO: 1333027 - RNA, 19 nt, Human
acugaacaccauugaaggc

SEQ ID NO: 1333028 - RNA, 13 nt, Human
acugaagcagccu

SEQ ID NO: 1333029 - RNA, 14 nt, Human
acugaagcagccuc

SEQ ID NO: 1333030 - RNA, 21 nt, Human
acugaagcagccucuccccag

SEQ ID NO: 1333031 - RNA, 19 nt, Human
ucgcccaugcuggagugca

SEQ ID NO: 1333032 - RNA, 14 nt, Human
ucgccccagcaggu

SEQ ID NO: 1333033 - RNA, 20 nt, Human
ucgccccagcaggugcugac

SEQ ID NO: 1333034 - RNA, 14 nt, Human
ucgccccuggcaga

SEQ ID NO: 1333035 - RNA, 23 nt, Human
ucgcuggacucucagucucugag

SEQ ID NO: 1333036 - RNA, 16 nt, Human
ucgcugucacaggcgg

SEQ ID NO: 1333037 - RNA, 17 nt, Human
ucgcuguccuuucuaga

SEQ ID NO: 1333038 - RNA, 11 nt, Human
ucgcuguccuu

SEQ ID NO: 1333039 - RNA, 13 nt, Human
ucgcucuuugaga

SEQ ID NO: 1333040 - RNA, 15 nt, Human
ucgcucuuugagaaa

SEQ ID NO: 1333041 - RNA, 19 nt, Human
ucgcugccagcucuguauc

SEQ ID NO: 1333042 - RNA, 20 nt, Human
ucgcugccagcucuguauca

SEQ ID NO: 1333043 - RNA, 16 nt, Human
ucgcugcuucguggga

SEQ ID NO: 1333044 - RNA, 20 nt, Human
ucgcuggacucucagucucu

SEQ ID NO: 1333045 - RNA, 22 nt, Human
ucgcuggacucucagucucuga

SEQ ID NO: 1333046 - RNA, 13 nt, Human
acuggggcucaga

SEQ ID NO: 1333047 - RNA, 15 nt, Human
acuggggcucagagc

SEQ ID NO: 1333048 - RNA, 18 nt, Human
acuggggcucagagccgg

SEQ ID NO: 1333049 - RNA, 16 nt, Human
acuggggcucagagcc

SEQ ID NO: 1333050 - RNA, 15 nt, Human
acugggggaaaagau

SEQ ID NO: 1333051 - RNA, 13 nt, Human
acugggcugaggg

SEQ ID NO: 1333052 - RNA, 14 nt, Human
acugggcugaggga

SEQ ID NO: 1333053 - RNA, 17 nt, Human
acugggcugagggagcc

SEQ ID NO: 1333054 - RNA, 16 nt, Human
acuggggcaggggccg

SEQ ID NO: 1333055 - RNA, 18 nt, Human
acuguacagacagaaaaa

SEQ ID NO: 1333056 - RNA, 14 nt, Human
acuggguaaugaaa

SEQ ID NO: 1333057 - RNA, 20 nt, Human
acuggguaaugaaacaaaga

SEQ ID NO: 1333058 - RNA, 20 nt, Human
acuguacagacagaaaaaac

SEQ ID NO: 1333059 - RNA, 23 nt, Human
acuguacuugcucuugaugccug

SEQ ID NO: 1333060 - RNA, 14 nt, Human
acuguauauucagg

SEQ ID NO: 1333061 - RNA, 15 nt, Human
acuguacuugcucuu

SEQ ID NO: 1333062 - RNA, 20 nt, Human
acuguacuccucccaggcgc

SEQ ID NO: 1333063 - RNA, 19 nt, Human
acuguaugaucaaauguuu

SEQ ID NO: 1333064 - RNA, 18 nt, Human
acuguaugaucaaauguu

SEQ ID NO: 1333065 - RNA, 17 nt, Human
acuguaugaucaaaugu

SEQ ID NO: 1333066 - RNA, 16 nt, Human
acuguaugaucaaaug

SEQ ID NO: 1333067 - RNA, 15 nt, Human
acuguaugaucaaau

SEQ ID NO: 1333068 - RNA, 14 nt, Human
acuguaugaucaaa

SEQ ID NO: 1333069 - RNA, 13 nt, Human
acuguaugaucaa

SEQ ID NO: 1333070 - RNA, 15 nt, Human
acuguaucuaggcaa

SEQ ID NO: 1333071 - RNA, 22 nt, Human
acuguaucuaggcaacauagua

SEQ ID NO: 1333072 - RNA, 23 nt, Human
acuguaucuaggcaacauaguau

SEQ ID NO: 1333073 - RNA, 22 nt, Human
acuguaugaucaaauguuuaau

SEQ ID NO: 1333074 - RNA, 12 nt, Human
acuguauuugaa

SEQ ID NO: 1333075 - RNA, 23 nt, Human
acuguauuugaaauaagaauuca

SEQ ID NO: 1333076 - RNA, 24 nt, Human
acuguaugaucaaauguuuaauca

SEQ ID NO: 1333077 - RNA, 21 nt, Human
acuguaugaucaaauguuuaa

SEQ ID NO: 1333078 - RNA, 20 nt, Human
acuguaugaucaaauguuua

SEQ ID NO: 1333079 - RNA, 21 nt, Human
acuguauuuuguauuguuuca

SEQ ID NO: 1333080 - RNA, 13 nt, Human
acugucauagaaa

SEQ ID NO: 1333081 - RNA, 21 nt, Human
acugucauccucaaagaaagu

SEQ ID NO: 1333082 - RNA, 22 nt, Human
acugucauccucaaagaaagug

SEQ ID NO: 1333083 - RNA, 14 nt, Human
ucguuaucuaauag

SEQ ID NO: 1333084 - RNA, 15 nt, Human
ucguucaaagcauga

SEQ ID NO: 1333085 - RNA, 22 nt, Human
ucguaugauacuucgacacugu

SEQ ID NO: 1333086 - RNA, 21 nt, Human
ucguaugauacuucgacacug

SEQ ID NO: 1333087 - RNA, 11 nt, Human
ucguucugugg

SEQ ID NO: 1333088 - RNA, 20 nt, Human
ucguuuaaugaaugcuuaaa

SEQ ID NO: 1333089 - RNA, 18 nt, Human
ucguuuaaugaaugcuua

SEQ ID NO: 1333090 - RNA, 14 nt, Human
ucguuuaaugaaug

SEQ ID NO: 1333091 - RNA, 19 nt, Human
ucguuuauuuucaagaaua

SEQ ID NO: 1333092 - RNA, 18 nt, Human
ucuaaaaugugauguucu

SEQ ID NO: 1333093 - RNA, 19 nt, Human
ucuaaaaugugauguucua

SEQ ID NO: 1333094 - RNA, 20 nt, Human
ucuaaaaugugauguucuaa

SEQ ID NO: 1333095 - RNA, 21 nt, Human
ucuaaaaugugauguucuaag

SEQ ID NO: 1333096 - RNA, 22 nt, Human
ucuaaaaugugauguucuaagg

SEQ ID NO: 1333097 - RNA, 18 nt, Human
ucuaaaauuauaaaugac

SEQ ID NO: 1333098 - RNA, 16 nt, Human
ucuaaacccaauccaa

SEQ ID NO: 1333099 - RNA, 19 nt, Human
ucuaaacccaauccaaaug

SEQ ID NO: 1333100 - RNA, 12 nt, Human
ucgggcugugcc

SEQ ID NO: 1333101 - RNA, 20 nt, Human
ucggggagccgggagccuga

SEQ ID NO: 1333102 - RNA, 19 nt, Human
ucggggagaggcugaggac

SEQ ID NO: 1333103 - RNA, 13 nt, Human
ucgggcugugccc

SEQ ID NO: 1333104 - RNA, 17 nt, Human
ucggggauguguccuga

SEQ ID NO: 1333105 - RNA, 15 nt, Human
ucggggcaucuggcc

SEQ ID NO: 1333106 - RNA, 16 nt, Human
ucggggcugggaaguc

SEQ ID NO: 1333107 - RNA, 20 nt, Human
ucguaagauuuccuucuuuu

SEQ ID NO: 1333108 - RNA, 15 nt, Human
ucguacagaaagcug

SEQ ID NO: 1333109 - RNA, 16 nt, Human
ucguacagaaagcugc

SEQ ID NO: 1333110 - RNA, 18 nt, Human
ucguaugauacuucgaca

SEQ ID NO: 1333111 - RNA, 13 nt, Human
acuguggguagac

SEQ ID NO: 1333112 - RNA, 14 nt, Human
acugugugugcccu

SEQ ID NO: 1333113 - RNA, 17 nt, Human
acugugugugcccucug

SEQ ID NO: 1333114 - RNA, 18 nt, Human
acugugugugcccucugg

SEQ ID NO: 1333115 - RNA, 19 nt, Human
acugugugugcccucuggg

SEQ ID NO: 1333116 - RNA, 20 nt, Human
acugugugugcccucugggc

SEQ ID NO: 1333117 - RNA, 21 nt, Human
acugugugugcccucugggcu

SEQ ID NO: 1333118 - RNA, 22 nt, Human
acugugugugcccucugggcuc

SEQ ID NO: 1333119 - RNA, 23 nt, Human
acugugugugcccucugggcucu

SEQ ID NO: 1333120 - RNA, 15 nt, Human
acugugugugugaau

SEQ ID NO: 1333121 - RNA, 16 nt, Human
acugugugugugaaug

SEQ ID NO: 1333122 - RNA, 18 nt, Human
acugugugugugaaugaa

SEQ ID NO: 1333123 - RNA, 22 nt, Human
acugugugugugaaugaacacu

SEQ ID NO: 1333124 - RNA, 14 nt, Human
acuguccugggccu

SEQ ID NO: 1333125 - RNA, 16 nt, Human
acuguccugggccugc

SEQ ID NO: 1333126 - RNA, 15 nt, Human
acuguggauauuguu

SEQ ID NO: 1333127 - RNA, 21 nt, Human
acuguguuaugcaaaagcaag

SEQ ID NO: 1333128 - RNA, 16 nt, Human
acuguguuaugcaaaa

SEQ ID NO: 1333129 - RNA, 14 nt, Human
acuguguuccuucc

SEQ ID NO: 1333130 - RNA, 12 nt, Human
acuguguuccuu

SEQ ID NO: 1333131 - RNA, 16 nt, Human
ucgggagacagcauca

SEQ ID NO: 1333132 - RNA, 21 nt, Human
ucgggagacagcaucaggguu

SEQ ID NO: 1333133 - RNA, 17 nt, Human
ucuaccaaaaaucucaa

SEQ ID NO: 1333134 - RNA, 15 nt, Human
ucuacccauauuaca

SEQ ID NO: 1333135 - RNA, 21 nt, Human
ucuacauaugaucugucugug

SEQ ID NO: 1333136 - RNA, 15 nt, Human
ucuacaucuucugcc

SEQ ID NO: 1333137 - RNA, 16 nt, Human
ucuacaucuucugccu

SEQ ID NO: 1333138 - RNA, 17 nt, Human
ucuacaucuucugccuu

SEQ ID NO: 1333139 - RNA, 16 nt, Human
ucuacauaugaucugu

SEQ ID NO: 1333140 - RNA, 16 nt, Human
ucuaccccagacuaga

SEQ ID NO: 1333141 - RNA, 18 nt, Human
ucuaccccagacuagaug

SEQ ID NO: 1333142 - RNA, 21 nt, Human
ucuaccccagacuagauguag

SEQ ID NO: 1333143 - RNA, 23 nt, Human
ucuaccccagacuagauguagua

SEQ ID NO: 1333144 - RNA, 12 nt, Human
ucuaagauucua

SEQ ID NO: 1333145 - RNA, 13 nt, Human
ucuaagauucuaa

SEQ ID NO: 1333146 - RNA, 14 nt, Human
ucuaagauucuaaa

SEQ ID NO: 1333147 - RNA, 15 nt, Human
ucuaagauucuaaag

SEQ ID NO: 1333148 - RNA, 16 nt, Human
ucuaagauucuaaagg

SEQ ID NO: 1333149 - RNA, 17 nt, Human
ucuaagauucuaaaggu

SEQ ID NO: 1333150 - RNA, 18 nt, Human
ucuaagauucuaaagguc

SEQ ID NO: 1333151 - RNA, 19 nt, Human
ucuaagauucuaaaggucc

SEQ ID NO: 1333152 - RNA, 14 nt, Human
ucuaagauucuaau

SEQ ID NO: 1333153 - RNA, 15 nt, Human
ucuaagauucuaaug

SEQ ID NO: 1333154 - RNA, 16 nt, Human
ucuaagauucuaauga

SEQ ID NO: 1333155 - RNA, 17 nt, Human
ucuaagauucuaaugau

SEQ ID NO: 1333156 - RNA, 19 nt, Human
ucuaagauucuaaugauga

SEQ ID NO: 1333157 - RNA, 20 nt, Human
ucuaagauucuaaugaugau

SEQ ID NO: 1333158 - RNA, 13 nt, Human
ucuaagauucuag

SEQ ID NO: 1333159 - RNA, 14 nt, Human
ucuaagauucuaga

SEQ ID NO: 1333160 - RNA, 15 nt, Human
ucuaagauucuagau

SEQ ID NO: 1333161 - RNA, 16 nt, Human
ucuaagauucuagauc

SEQ ID NO: 1333162 - RNA, 19 nt, Human
ucuaagauucuagaucaga

SEQ ID NO: 1333163 - RNA, 12 nt, Human
ucuaagauucug

SEQ ID NO: 1333164 - RNA, 19 nt, Human
ucuaagauucugauuuuag

SEQ ID NO: 1333165 - RNA, 13 nt, Human
ucuaagauucuga

SEQ ID NO: 1333166 - RNA, 17 nt, Human
ucuaagcauaaaagaug

SEQ ID NO: 1333167 - RNA, 20 nt, Human
ucuaaguaaauacaauuuuu

SEQ ID NO: 1333168 - RNA, 19 nt, Human
ucuaaguaaauacaauuuu

SEQ ID NO: 1333169 - RNA, 13 nt, Human
ucuaagucuuucc

SEQ ID NO: 1333170 - RNA, 14 nt, Human
ucuaagucuuucca

SEQ ID NO: 1333171 - RNA, 13 nt, Human
ucuaagugauaua

SEQ ID NO: 1333172 - RNA, 18 nt, Human
ucuaaguguuucauaaau

SEQ ID NO: 1333173 - RNA, 14 nt, Human
ucuaaguuaauuua

SEQ ID NO: 1333174 - RNA, 16 nt, Human
ucuaaguuaauuuaaa

SEQ ID NO: 1333175 - RNA, 18 nt, Human
ucuaaguuaauuuaaagu

SEQ ID NO: 1333176 - RNA, 20 nt, Human
ucuaaguuaauuuaaaguug

SEQ ID NO: 1333177 - RNA, 21 nt, Human
ucuaaguuaauuuaaaguugu

SEQ ID NO: 1333178 - RNA, 14 nt, Human
ucuaaguuauaaga

SEQ ID NO: 1333179 - RNA, 16 nt, Human
ucuaaguuauaagacu

SEQ ID NO: 1333180 - RNA, 17 nt, Human
ucuaaguuauaagacuc

SEQ ID NO: 1333181 - RNA, 20 nt, Human
ucuaaguuauaagacucuca

SEQ ID NO: 1333182 - RNA, 22 nt, Human
ucuaaguuauaagacucucaca

SEQ ID NO: 1333183 - RNA, 12 nt, Human
ucuaaguuucua

SEQ ID NO: 1333184 - RNA, 18 nt, Human
ucuaaagauggaguuucu

SEQ ID NO: 1333185 - RNA, 19 nt, Human
ucuaaagcugguuuaaugu

SEQ ID NO: 1333186 - RNA, 21 nt, Human
ucuaaagcugguuuaauguuu

SEQ ID NO: 1333187 - RNA, 13 nt, Human
ucuaaaggaguuu

SEQ ID NO: 1333188 - RNA, 13 nt, Human
ucuaaacugcccc

SEQ ID NO: 1333189 - RNA, 16 nt, Human
ucuaaacugcccccuc

SEQ ID NO: 1333190 - RNA, 22 nt, Human
ucuaaacugcccccucugcccu

SEQ ID NO: 1333191 - RNA, 23 nt, Human
ucuaaacugcccccucugcccug

SEQ ID NO: 1333192 - RNA, 13 nt, Human
ucuaaacuggaga

SEQ ID NO: 1333193 - RNA, 14 nt, Human
ucuaaacuggagac

SEQ ID NO: 1333194 - RNA, 15 nt, Human
ucuaaacuggagacu

SEQ ID NO: 1333195 - RNA, 21 nt, Human
ucuaaacuggauucacagcuc

SEQ ID NO: 1333196 - RNA, 17 nt, Human
ucuaaacuuccccaucu

SEQ ID NO: 1333197 - RNA, 19 nt, Human
ucuaaacuggagacugugu

SEQ ID NO: 1333198 - RNA, 17 nt, Human
ucuaaaggaguuuaugu

SEQ ID NO: 1333199 - RNA, 18 nt, Human
ucuaaaggaguuuauguu

SEQ ID NO: 1333200 - RNA, 13 nt, Human
ucuaagaaacauu

SEQ ID NO: 1333201 - RNA, 19 nt, Human
ucuaacuuggcucacacuc

SEQ ID NO: 1333202 - RNA, 15 nt, Human
ucuaagaaacauuua

SEQ ID NO: 1333203 - RNA, 17 nt, Human
ucuaagaaacauuuaua

SEQ ID NO: 1333204 - RNA, 22 nt, Human
ucuaagaaacauuuauauugau

SEQ ID NO: 1333205 - RNA, 13 nt, Human
ucuaagaaagaac

SEQ ID NO: 1333206 - RNA, 18 nt, Human
ucuaagaaacauuuauau

SEQ ID NO: 1333207 - RNA, 12 nt, Human
ucuaagaaagaa

SEQ ID NO: 1333208 - RNA, 12 nt, Human
ucuaagaaauug

SEQ ID NO: 1333209 - RNA, 16 nt, Human
ucuaagaaauugaaua

SEQ ID NO: 1333210 - RNA, 24 nt, Human
ucuaagaaauugaauacuuugaau

SEQ ID NO: 1333211 - RNA, 19 nt, Human
ucuaagaaauugaauacuu

SEQ ID NO: 1333212 - RNA, 16 nt, Human
ucuaagacucaaaugu

SEQ ID NO: 1333213 - RNA, 18 nt, Human
ucuaagacucaaauguuc

SEQ ID NO: 1333214 - RNA, 19 nt, Human
ucuaagacucaaauguucu

SEQ ID NO: 1333215 - RNA, 21 nt, Human
ucuaagacucaaauguucuaa

SEQ ID NO: 1333216 - RNA, 22 nt, Human
ucuaagacucaaauguucuaag

SEQ ID NO: 1333217 - RNA, 19 nt, Human
ucuaagacuuacucuaaga

SEQ ID NO: 1333218 - RNA, 20 nt, Human
ucuaagacuuacucuaagau

SEQ ID NO: 1333219 - RNA, 20 nt, Human
ucuaagagaacaaugugcua

SEQ ID NO: 1333220 - RNA, 23 nt, Human
ucuaagacuuacucuaagaucuu

SEQ ID NO: 1333221 - RNA, 12 nt, Human
ucuaagaucuua

SEQ ID NO: 1333222 - RNA, 15 nt, Human
ucuaagaucuuagau

SEQ ID NO: 1333223 - RNA, 17 nt, Human
ucuaagaucuuagauuc

SEQ ID NO: 1333224 - RNA, 19 nt, Human
ucuaagaucuuagauucuc

SEQ ID NO: 1333225 - RNA, 21 nt, Human
ucuaagaucuuagauucucug

SEQ ID NO: 1333226 - RNA, 12 nt, Human
ucuaagauguga

SEQ ID NO: 1333227 - RNA, 13 nt, Human
ucuaagaugugau

SEQ ID NO: 1333228 - RNA, 18 nt, Human
ucuaagaugugauauucu

SEQ ID NO: 1333229 - RNA, 19 nt, Human
ucuaagaugugauauucua

SEQ ID NO: 1333230 - RNA, 20 nt, Human
ucuaagaugugauauucuaa

SEQ ID NO: 1333231 - RNA, 21 nt, Human
ucuaagaugugauauucuaag

SEQ ID NO: 1333232 - RNA, 22 nt, Human
ucuaagaugugauauucuaaga

SEQ ID NO: 1333233 - RNA, 24 nt, Human
ucuaagaugugauauucuaagacu

SEQ ID NO: 1333234 - RNA, 19 nt, Human
uaugugccagauuuaugca

SEQ ID NO: 1333235 - RNA, 14 nt, Human
uaugugccagauuu

SEQ ID NO: 1333236 - RNA, 23 nt, Human
uaugugccagauuuaugcauauu

SEQ ID NO: 1333237 - RNA, 16 nt, Human
uaugugguuuuagauu

SEQ ID NO: 1333238 - RNA, 18 nt, Human
uaugugguuuuagauuuu

SEQ ID NO: 1333239 - RNA, 19 nt, Human
uaugugguuuuagauuuuc

SEQ ID NO: 1333240 - RNA, 20 nt, Human
acaucuuuaaggggaggaac

SEQ ID NO: 1333241 - RNA, 11 nt, Human
acaucuuuaag

SEQ ID NO: 1333242 - RNA, 13 nt, Human
acaucuuuauccg

SEQ ID NO: 1333243 - RNA, 14 nt, Human
acaucuuugaaauu

SEQ ID NO: 1333244 - RNA, 17 nt, Human
acaucuuugaaauuaug

SEQ ID NO: 1333245 - RNA, 22 nt, Human
acaucuuugaaauuauguaaau

SEQ ID NO: 1333246 - RNA, 23 nt, Human
acaucuuugaaauuauguaaauu

SEQ ID NO: 1333247 - RNA, 23 nt, Human
acaucuugucauuuuuuuucuuu

SEQ ID NO: 1333248 - RNA, 22 nt, Human
uauuuuaagacgaaacauuugu

SEQ ID NO: 1333249 - RNA, 14 nt, Human
uauuuuaagacgaa

SEQ ID NO: 1333250 - RNA, 22 nt, Human
uauuuuaaaauagcguucuugu

SEQ ID NO: 1333251 - RNA, 23 nt, Human
uauuuuaaaauagcguucuugua

SEQ ID NO: 1333252 - RNA, 18 nt, Human
uauuuuaaaaucugucac

SEQ ID NO: 1333253 - RNA, 13 nt, Human
uauuuuaaaauuu

SEQ ID NO: 1333254 - RNA, 14 nt, Human
uauuuuaaaauuug

SEQ ID NO: 1333255 - RNA, 17 nt, Human
uauuuuaaaauuuguuc

SEQ ID NO: 1333256 - RNA, 14 nt, Human
uauuuuaaaagaau

SEQ ID NO: 1333257 - RNA, 17 nt, Human
uauuuguucccaagagc

SEQ ID NO: 1333258 - RNA, 21 nt, Human
uauuuguuuaugguaaaaaau

SEQ ID NO: 1333259 - RNA, 18 nt, Human
uauuuuaaaagaaugauu

SEQ ID NO: 1333260 - RNA, 14 nt, Human
uauuuguaauagau

SEQ ID NO: 1333261 - RNA, 15 nt, Human
uauuuguaauagaug

SEQ ID NO: 1333262 - RNA, 20 nt, Human
uauuuguaauagauguuuga

SEQ ID NO: 1333263 - RNA, 12 nt, Human
uauuuguaauua

SEQ ID NO: 1333264 - RNA, 13 nt, Human
uauuuguaauuaa

SEQ ID NO: 1333265 - RNA, 14 nt, Human
uauuuguaauuaaa

SEQ ID NO: 1333266 - RNA, 15 nt, Human
uauuuguaauuaaaa

SEQ ID NO: 1333267 - RNA, 12 nt, Human
uauuuguacaua

SEQ ID NO: 1333268 - RNA, 18 nt, Human
uauuuguauaaaagugug

SEQ ID NO: 1333269 - RNA, 22 nt, Human
uauuuguauaaaagugugaaau

SEQ ID NO: 1333270 - RNA, 20 nt, Human
uauuugucaugcugggauuu

SEQ ID NO: 1333271 - RNA, 12 nt, Human
uauuuguguuuu

SEQ ID NO: 1333272 - RNA, 19 nt, Human
uauuuguguuuuaauuuaa

SEQ ID NO: 1333273 - RNA, 21 nt, Human
uauuuguguuuuaauuuaaac

SEQ ID NO: 1333274 - RNA, 19 nt, Human
uauuuguuaauaguuccug

SEQ ID NO: 1333275 - RNA, 14 nt, Human
uauuuuaauaaaca

SEQ ID NO: 1333276 - RNA, 12 nt, Human
uauuuuaaagaa

SEQ ID NO: 1333277 - RNA, 13 nt, Human
uauuuuaaagaau

SEQ ID NO: 1333278 - RNA, 16 nt, Human
uauuuuaaagaauugu

SEQ ID NO: 1333279 - RNA, 14 nt, Human
uauuuuaaagaauu

SEQ ID NO: 1333280 - RNA, 17 nt, Human
uauuuuaauaaacacuc

SEQ ID NO: 1333281 - RNA, 19 nt, Human
uauuuuaauaauguuucaa

SEQ ID NO: 1333282 - RNA, 22 nt, Human
uauuuuaauaauguuucaaaca

SEQ ID NO: 1333283 - RNA, 13 nt, Human
uauuuuacauaaa

SEQ ID NO: 1333284 - RNA, 14 nt, Human
uauuuuacaauuuu

SEQ ID NO: 1333285 - RNA, 23 nt, Human
uauuuuacaauuuuuuaucaugc

SEQ ID NO: 1333286 - RNA, 20 nt, Human
uauuuuggauuguauauugu

SEQ ID NO: 1333287 - RNA, 23 nt, Human
uauuuuggauuguauauuguguu

SEQ ID NO: 1333288 - RNA, 17 nt, Human
uauuuugauguaaagau

SEQ ID NO: 1333289 - RNA, 21 nt, Human
uauuuugcaguucccacauua

SEQ ID NO: 1333290 - RNA, 22 nt, Human
uauuuugccaagggcauaaauu

SEQ ID NO: 1333291 - RNA, 23 nt, Human
uauuuugccaagggcauaaauua

SEQ ID NO: 1333292 - RNA, 14 nt, Human
uauuuugcuggaau

SEQ ID NO: 1333293 - RNA, 20 nt, Human
uauuuuguguuuaggaacua

SEQ ID NO: 1333294 - RNA, 17 nt, Human
uauuuuguguuuaggaa

SEQ ID NO: 1333295 - RNA, 13 nt, Human
uauuuuguaaacu

SEQ ID NO: 1333296 - RNA, 20 nt, Human
uauuuuguaaacucaaaaua

SEQ ID NO: 1333297 - RNA, 21 nt, Human
uauuuuguaaacucaaaauau

SEQ ID NO: 1333298 - RNA, 16 nt, Human
uauuuuuggagguuua

SEQ ID NO: 1333299 - RNA, 16 nt, Human
uauuuuucauccuaaa

SEQ ID NO: 1333300 - RNA, 12 nt, Human
uauuuuucauga

SEQ ID NO: 1333301 - RNA, 20 nt, Human
uauuuuucaugauuuugaaa

SEQ ID NO: 1333302 - RNA, 13 nt, Human
uauuuuucuaacu

SEQ ID NO: 1333303 - RNA, 12 nt, Human
uauuuuuggagg

SEQ ID NO: 1333304 - RNA, 19 nt, Human
uauuuuuggcagucugaau

SEQ ID NO: 1333305 - RNA, 20 nt, Human
uauuuuuggcagucugaauu

SEQ ID NO: 1333306 - RNA, 21 nt, Human
uauuuuguuuugugcagagau

SEQ ID NO: 1333307 - RNA, 21 nt, Human
uauuuuuaauauauacuauga

SEQ ID NO: 1333308 - RNA, 21 nt, Human
ucaaauacgugggcauucaaa

SEQ ID NO: 1333309 - RNA, 22 nt, Human
ucaaauacgugggcauucaaau

SEQ ID NO: 1333310 - RNA, 13 nt, Human
ucaaauauauuca

SEQ ID NO: 1333311 - RNA, 23 nt, Human
ucaaauacgugggcauucaaaug

SEQ ID NO: 1333312 - RNA, 18 nt, Human
ucaaaguguuuucucuga

SEQ ID NO: 1333313 - RNA, 12 nt, Human
ucaaagguucua

SEQ ID NO: 1333314 - RNA, 16 nt, Human
ucaaagguucuagguu

SEQ ID NO: 1333315 - RNA, 20 nt, Human
ucaaagguucuagguuucaa

SEQ ID NO: 1333316 - RNA, 21 nt, Human
ucaaagguucuagguuucaaa

SEQ ID NO: 1333317 - RNA, 23 nt, Human
ucaaagguucuagguuucaaaga

SEQ ID NO: 1333318 - RNA, 18 nt, Human
ucaaagguuuggaaggag

SEQ ID NO: 1333319 - RNA, 19 nt, Human
ucaaaguguuuucucugaa

SEQ ID NO: 1333320 - RNA, 21 nt, Human
ucaaauauauucagccuggcu

SEQ ID NO: 1333321 - RNA, 13 nt, Human
acaugaaacagaa

SEQ ID NO: 1333322 - RNA, 15 nt, Human
acaugaaacagaaac

SEQ ID NO: 1333323 - RNA, 17 nt, Human
acaugaaaggacccugu

SEQ ID NO: 1333324 - RNA, 14 nt, Human
acaugaacuuagau

SEQ ID NO: 1333325 - RNA, 19 nt, Human
acaugaacuuagauuuuac

SEQ ID NO: 1333326 - RNA, 18 nt, Human
acaugacuccauagaccu

SEQ ID NO: 1333327 - RNA, 15 nt, Human
acaugagaacaaaca

SEQ ID NO: 1333328 - RNA, 20 nt, Human
acaugacuccauagaccuuu

SEQ ID NO: 1333329 - RNA, 20 nt, Human
acaugaacuuagauuuuaca

SEQ ID NO: 1333330 - RNA, 22 nt, Human
acaugaacuuagauuuuacaug

SEQ ID NO: 1333331 - RNA, 13 nt, Human
acaugaagaagcu

SEQ ID NO: 1333332 - RNA, 19 nt, Human
acaugaauuuuagcuuuug

SEQ ID NO: 1333333 - RNA, 22 nt, Human
acaugaauuuuagcuuuugugg

SEQ ID NO: 1333334 - RNA, 19 nt, Human
acaugacccuaaaucuuga

SEQ ID NO: 1333335 - RNA, 21 nt, Human
acaugacccuaaaucuugacu

SEQ ID NO: 1333336 - RNA, 22 nt, Human
ucaaacaguacacuaucuuaau

SEQ ID NO: 1333337 - RNA, 12 nt, Human
ucaaagaugcug

SEQ ID NO: 1333338 - RNA, 15 nt, Human
ucaaagcaaaugucu

SEQ ID NO: 1333339 - RNA, 23 nt, Human
ucaaagcaaaugucuuccuggau

SEQ ID NO: 1333340 - RNA, 19 nt, Human
ucaaagaugcugugagucu

SEQ ID NO: 1333341 - RNA, 13 nt, Human
ucaaagcaagcau

SEQ ID NO: 1333342 - RNA, 15 nt, Human
ucaaagcaagcauuc

SEQ ID NO: 1333343 - RNA, 19 nt, Human
ucaaagcaagcauucagaa

SEQ ID NO: 1333344 - RNA, 21 nt, Human
ucaaagcaagcauucagaaga

SEQ ID NO: 1333345 - RNA, 22 nt, Human
ucaaagcaagcauucagaagaa

SEQ ID NO: 1333346 - RNA, 15 nt, Human
ucaaagcaaggaaac

SEQ ID NO: 1333347 - RNA, 16 nt, Human
ucaaagcaaggaaacu

SEQ ID NO: 1333348 - RNA, 20 nt, Human
ucaaagcaaggaaacuaugu

SEQ ID NO: 1333349 - RNA, 14 nt, Human
ucaaaagggccaaa

SEQ ID NO: 1333350 - RNA, 21 nt, Human
ucaaaagggccaaagaaccaa

SEQ ID NO: 1333351 - RNA, 20 nt, Human
ucaaaagggccaaagaacca

SEQ ID NO: 1333352 - RNA, 13 nt, Human
ucaaaaguuccaa

SEQ ID NO: 1333353 - RNA, 14 nt, Human
ucaaaaguuccaag

SEQ ID NO: 1333354 - RNA, 15 nt, Human
ucaaaaguuccaaga

SEQ ID NO: 1333355 - RNA, 17 nt, Human
ucaaaaguuccaagagu

SEQ ID NO: 1333356 - RNA, 21 nt, Human
ucaaaaguuccaagagucuaa

SEQ ID NO: 1333357 - RNA, 22 nt, Human
ucaaaaguuccaagagucuaaa

SEQ ID NO: 1333358 - RNA, 22 nt, Human
acauggcuggagcuagaauuug

SEQ ID NO: 1333359 - RNA, 13 nt, Human
acauggcacagag

SEQ ID NO: 1333360 - RNA, 21 nt, Human
acauggccccucccccugcca

SEQ ID NO: 1333361 - RNA, 22 nt, Human
acauggccccucccccugccag

SEQ ID NO: 1333362 - RNA, 14 nt, Human
acauggagguucua

SEQ ID NO: 1333363 - RNA, 15 nt, Human
acauggagguucuaa

SEQ ID NO: 1333364 - RNA, 16 nt, Human
acauggagguucuaag

SEQ ID NO: 1333365 - RNA, 17 nt, Human
acauggagguucuaagg

SEQ ID NO: 1333366 - RNA, 18 nt, Human
acauggagguucuaaggc

SEQ ID NO: 1333367 - RNA, 19 nt, Human
acauggagguucuaaggcc

SEQ ID NO: 1333368 - RNA, 13 nt, Human
acaugaggacucu

SEQ ID NO: 1333369 - RNA, 18 nt, Human
acaugaggacucuauucu

SEQ ID NO: 1333370 - RNA, 20 nt, Human
acaugaggacucuauucuuu

SEQ ID NO: 1333371 - RNA, 21 nt, Human
acaugaggacucuauucuuua

SEQ ID NO: 1333372 - RNA, 22 nt, Human
acaugaggacucuauucuuuaa

SEQ ID NO: 1333373 - RNA, 15 nt, Human
acaugaggccacugg

SEQ ID NO: 1333374 - RNA, 13 nt, Human
acaugaggccacu

SEQ ID NO: 1333375 - RNA, 16 nt, Human
acaugagguacugaga

SEQ ID NO: 1333376 - RNA, 18 nt, Human
acauuaauagcagccuuu

SEQ ID NO: 1333377 - RNA, 18 nt, Human
acauuaauauacuugaau

SEQ ID NO: 1333378 - RNA, 19 nt, Human
acauuaauagcagccuuuc

SEQ ID NO: 1333379 - RNA, 15 nt, Human
acauuacugaaaacu

SEQ ID NO: 1333380 - RNA, 17 nt, Human
acauuacugaaaacuuc

SEQ ID NO: 1333381 - RNA, 20 nt, Human
acauuacugaaaacuucauu

SEQ ID NO: 1333382 - RNA, 14 nt, Human
acauuagaagacaa

SEQ ID NO: 1333383 - RNA, 15 nt, Human
acauuagaagacaau

SEQ ID NO: 1333384 - RNA, 20 nt, Human
acauuagaagacaauugaca

SEQ ID NO: 1333385 - RNA, 21 nt, Human
acauuagaagacaauugacaa

SEQ ID NO: 1333386 - RNA, 16 nt, Human
acauggugcugggaga

SEQ ID NO: 1333387 - RNA, 23 nt, Human
acauggugcugggagaggcagcc

SEQ ID NO: 1333388 - RNA, 18 nt, Human
acaugguggguccauggg

SEQ ID NO: 1333389 - RNA, 19 nt, Human
acaugguggguccaugggc

SEQ ID NO: 1333390 - RNA, 19 nt, Human
acaugguuaccaugucuuu

SEQ ID NO: 1333391 - RNA, 18 nt, Human
acaugguuaccaugucuu

SEQ ID NO: 1333392 - RNA, 18 nt, Human
acauguaucuaugcauuu

SEQ ID NO: 1333393 - RNA, 21 nt, Human
acauguaucuaugcauuuucu

SEQ ID NO: 1333394 - RNA, 18 nt, Human
acauguauugcacauugu

SEQ ID NO: 1333395 - RNA, 19 nt, Human
acauguauugcacauugua

SEQ ID NO: 1333396 - RNA, 21 nt, Human
acauguauugcacauuguaaa

SEQ ID NO: 1333397 - RNA, 22 nt, Human
acauugguucuuucauuugcuu

SEQ ID NO: 1333398 - RNA, 14 nt, Human
acauuuaaaacauu

SEQ ID NO: 1333399 - RNA, 18 nt, Human
acauuuaaaacauuaaaa

SEQ ID NO: 1333400 - RNA, 16 nt, Human
acauuggaaacaaguc

SEQ ID NO: 1333401 - RNA, 12 nt, Human
acauugcuuuuc

SEQ ID NO: 1333402 - RNA, 15 nt, Human
acauuggaauguucu

SEQ ID NO: 1333403 - RNA, 17 nt, Human
acauuggaauguucuca

SEQ ID NO: 1333404 - RNA, 21 nt, Human
acauuggcaccuaauccaggc

SEQ ID NO: 1333405 - RNA, 22 nt, Human
acauuggcaccuaauccaggca

SEQ ID NO: 1333406 - RNA, 15 nt, Human
acauugcguuugacc

SEQ ID NO: 1333407 - RNA, 23 nt, Human
acauugcguuugaccuuuuaugu

SEQ ID NO: 1333408 - RNA, 14 nt, Human
acauuuuacauuaa

SEQ ID NO: 1333409 - RNA, 16 nt, Human
acauuuacaaacugaa

SEQ ID NO: 1333410 - RNA, 17 nt, Human
acauuuacaaacugaag

SEQ ID NO: 1333411 - RNA, 21 nt, Human
acauuuacaaacugaagagua

SEQ ID NO: 1333412 - RNA, 22 nt, Human
acauuuaaaacauuaaaauaua

SEQ ID NO: 1333413 - RNA, 15 nt, Human
acauuuacaaacuga

SEQ ID NO: 1333414 - RNA, 18 nt, Human
acauuuuacauuaaauuu

SEQ ID NO: 1333415 - RNA, 15 nt, Human
acauuuuacauuaaa

SEQ ID NO: 1333416 - RNA, 20 nt, Human
acauuuuauggugccuagua

SEQ ID NO: 1333417 - RNA, 16 nt, Human
acauuuuuuaggaaau

SEQ ID NO: 1333418 - RNA, 20 nt, Human
acauuuuuuaggaaauguuu

SEQ ID NO: 1333419 - RNA, 14 nt, Human
ucaaggucugcuuu

SEQ ID NO: 1333420 - RNA, 21 nt, Human
ucaaggucguuuuuuucauuc

SEQ ID NO: 1333421 - RNA, 11 nt, Human
ucaagguucua

SEQ ID NO: 1333422 - RNA, 14 nt, Human
ucaagguucuaacc

SEQ ID NO: 1333423 - RNA, 13 nt, Human
ucaagguuuuagg

SEQ ID NO: 1333424 - RNA, 18 nt, Human
ucaagguuuuagguucua

SEQ ID NO: 1333425 - RNA, 20 nt, Human
ucaagguuuuagguucuaaa

SEQ ID NO: 1333426 - RNA, 15 nt, Human
ucaaggucugcuuuu

SEQ ID NO: 1333427 - RNA, 16 nt, Human
ucaaggcggugcuuga

SEQ ID NO: 1333428 - RNA, 11 nt, Human
ucaaggcucag

SEQ ID NO: 1333429 - RNA, 17 nt, Human
ucaaggcacucuagauu

SEQ ID NO: 1333430 - RNA, 18 nt, Human
ucaaggcacucuagauuc

SEQ ID NO: 1333431 - RNA, 20 nt, Human
ucaaggcacucuagauucca

SEQ ID NO: 1333432 - RNA, 21 nt, Human
ucaaggcacucuagauuccau

SEQ ID NO: 1333433 - RNA, 19 nt, Human
ucaagauuguuccugcuuu

SEQ ID NO: 1333434 - RNA, 21 nt, Human
ucaagcaaacagcuucacaaa

SEQ ID NO: 1333435 - RNA, 18 nt, Human
ucaagcagcgaccgcccc

SEQ ID NO: 1333436 - RNA, 21 nt, Human
ucaagcagcgaccgcccccuc

SEQ ID NO: 1333437 - RNA, 22 nt, Human
ucaagcagcgaccgcccccucc

SEQ ID NO: 1333438 - RNA, 13 nt, Human
ucaaggcacucua

SEQ ID NO: 1333439 - RNA, 14 nt, Human
ucaaggcacucuag

SEQ ID NO: 1333440 - RNA, 15 nt, Human
ucaaggcacucuaga

SEQ ID NO: 1333441 - RNA, 16 nt, Human
ucaaggcacucuagau

SEQ ID NO: 1333442 - RNA, 20 nt, Human
ucaagagggcacugguggcc

SEQ ID NO: 1333443 - RNA, 21 nt, Human
ucaagagggcacugguggccc

SEQ ID NO: 1333444 - RNA, 18 nt, Human
ucaagagugguaucuugc

SEQ ID NO: 1333445 - RNA, 19 nt, Human
ucaagagugaauucccuca

SEQ ID NO: 1333446 - RNA, 20 nt, Human
ucaagagugaauucccucac

SEQ ID NO: 1333447 - RNA, 13 nt, Human
ucaagaggagccc

SEQ ID NO: 1333448 - RNA, 21 nt, Human
ucaagagugaauucccucacu

SEQ ID NO: 1333449 - RNA, 16 nt, Human
ucaagauuguuccugc

SEQ ID NO: 1333450 - RNA, 20 nt, Human
acauuauauuucuauuuuau

SEQ ID NO: 1333451 - RNA, 19 nt, Human
acauuaugugguuuuagau

SEQ ID NO: 1333452 - RNA, 21 nt, Human
acauuaugugguuuuagauuu

SEQ ID NO: 1333453 - RNA, 22 nt, Human
acauuaugugguuuuagauuuu

SEQ ID NO: 1333454 - RNA, 18 nt, Human
acauuauuaucaacaaua

SEQ ID NO: 1333455 - RNA, 22 nt, Human
acauuauuaaguaacuuauuua

SEQ ID NO: 1333456 - RNA, 24 nt, Human
acauucaaaauaggguauauuuuc

SEQ ID NO: 1333457 - RNA, 18 nt, Human
acauucaacagagacuga

SEQ ID NO: 1333458 - RNA, 20 nt, Human
ucaagaggagcccccacccu

SEQ ID NO: 1333459 - RNA, 21 nt, Human
ucaagugauucucaugccuca

SEQ ID NO: 1333460 - RNA, 22 nt, Human
ucaagugauucucaugccucag

SEQ ID NO: 1333461 - RNA, 21 nt, Human
ucaagguuuuagguucuaaag

SEQ ID NO: 1333462 - RNA, 22 nt, Human
ucaagguuuuagguucuaaagu

SEQ ID NO: 1333463 - RNA, 23 nt, Human
ucaagguuuuagguucuaaaguu

SEQ ID NO: 1333464 - RNA, 15 nt, Human
ucaaguaauacaaac

SEQ ID NO: 1333465 - RNA, 16 nt, Human
ucaauauuuuuagaua

SEQ ID NO: 1333466 - RNA, 17 nt, Human
ucaauauuuucuuuucc

SEQ ID NO: 1333467 - RNA, 19 nt, Human
ucaaucagucucagaaugu

SEQ ID NO: 1333468 - RNA, 22 nt, Human
ucaaucagucucagaaugucau

SEQ ID NO: 1333469 - RNA, 21 nt, Human
ucaaucagucucagaauguca

SEQ ID NO: 1333470 - RNA, 13 nt, Human
ucaaucauuucua

SEQ ID NO: 1333471 - RNA, 16 nt, Human
ucaaucauuucuauua

SEQ ID NO: 1333472 - RNA, 15 nt, Human
ucaauccagcuaugu

SEQ ID NO: 1333473 - RNA, 16 nt, Human
ucacagaccuuugaac

SEQ ID NO: 1333474 - RNA, 23 nt, Human
ucacagaaguguuaacuuuucua

SEQ ID NO: 1333475 - RNA, 12 nt, Human
ucaauuuaaaaa

SEQ ID NO: 1333476 - RNA, 17 nt, Human
accacacccacacucag

SEQ ID NO: 1333477 - RNA, 13 nt, Human
ucaauuuaaaaaa

SEQ ID NO: 1333478 - RNA, 21 nt, Human
ucacagaacccuuggagccaa

SEQ ID NO: 1333479 - RNA, 19 nt, Human
ucacagcuccaagaauuuc

SEQ ID NO: 1333480 - RNA, 15 nt, Human
ucacagcccagcccg

SEQ ID NO: 1333481 - RNA, 13 nt, Human
ucacagcccagcc

SEQ ID NO: 1333482 - RNA, 16 nt, Human
ucacagccaccccuga

SEQ ID NO: 1333483 - RNA, 13 nt, Human
ucacauuccugaa

SEQ ID NO: 1333484 - RNA, 17 nt, Human
ucacauuccugaacagg

SEQ ID NO: 1333485 - RNA, 22 nt, Human
ucacauuagaagacaauugaca

SEQ ID NO: 1333486 - RNA, 22 nt, Human
ucacauuccucugcccuuccug

SEQ ID NO: 1333487 - RNA, 20 nt, Human
ucacauuccugaacaggaua

SEQ ID NO: 1333488 - RNA, 20 nt, Human
ucacaugauuccagccauca

SEQ ID NO: 1333489 - RNA, 16 nt, Human
ucacaugguuuacauc

SEQ ID NO: 1333490 - RNA, 21 nt, Human
ucacaugucaguaccuucaaa

SEQ ID NO: 1333491 - RNA, 12 nt, Human
ucacauuagaag

SEQ ID NO: 1333492 - RNA, 14 nt, Human
ucacauuagaagac

SEQ ID NO: 1333493 - RNA, 15 nt, Human
ucacauuagaagaca

SEQ ID NO: 1333494 - RNA, 14 nt, Human
ucacaggaaguaga

SEQ ID NO: 1333495 - RNA, 11 nt, Human
ucacagcuccu

SEQ ID NO: 1333496 - RNA, 14 nt, Human
ucacagcuccuccc

SEQ ID NO: 1333497 - RNA, 16 nt, Human
ucacagcuccucccac

SEQ ID NO: 1333498 - RNA, 14 nt, Human
ucacauauuuuaaa

SEQ ID NO: 1333499 - RNA, 22 nt, Human
ucacauauuuuaaaauuuguuc

SEQ ID NO: 1333500 - RNA, 20 nt, Human
ucacaucagagugacaucca

SEQ ID NO: 1333501 - RNA, 21 nt, Human
ucacaugaugcacuucaaauu

SEQ ID NO: 1333502 - RNA, 17 nt, Human
ucacaugauuccagcca

SEQ ID NO: 1333503 - RNA, 19 nt, Human
ucacaugauuccagccauc

SEQ ID NO: 1333504 - RNA, 21 nt, Human
ucacaugauuccagccaucac

SEQ ID NO: 1333505 - RNA, 23 nt, Human
accaaaaaucucaauauuucaga

SEQ ID NO: 1333506 - RNA, 14 nt, Human
accaaaguucuaau

SEQ ID NO: 1333507 - RNA, 15 nt, Human
accaaaguucuaaua

SEQ ID NO: 1333508 - RNA, 20 nt, Human
accaaaguucuaauaauuuc

SEQ ID NO: 1333509 - RNA, 21 nt, Human
accaaaguucuaauaauuucu

SEQ ID NO: 1333510 - RNA, 23 nt, Human
accaaaguucuaauaauuucuaa

SEQ ID NO: 1333511 - RNA, 14 nt, Human
accaaaucaaaauc

SEQ ID NO: 1333512 - RNA, 15 nt, Human
accaaaucaaaaucu

SEQ ID NO: 1333513 - RNA, 20 nt, Human
accaaaucaaaaucucucca

SEQ ID NO: 1333514 - RNA, 22 nt, Human
accaaaucaaaaucucuccacu

SEQ ID NO: 1333515 - RNA, 13 nt, Human
accaaaucuggaa

SEQ ID NO: 1333516 - RNA, 15 nt, Human
accaaaucuggaagc

SEQ ID NO: 1333517 - RNA, 23 nt, Human
accaaaucaaaaucucuccacuu

SEQ ID NO: 1333518 - RNA, 14 nt, Human
accaacauaaaaau

SEQ ID NO: 1333519 - RNA, 15 nt, Human
accaacauaaaaaug

SEQ ID NO: 1333520 - RNA, 23 nt, Human
accaacauaaaaaugaucuaaac

SEQ ID NO: 1333521 - RNA, 21 nt, Human
accaacaucuacaaaacauua

SEQ ID NO: 1333522 - RNA, 20 nt, Human
accaaaugugcuuugagaag

SEQ ID NO: 1333523 - RNA, 20 nt, Human
accaacaaucuuccuguuua

SEQ ID NO: 1333524 - RNA, 20 nt, Human
accaacacguggccaagaga

SEQ ID NO: 1333525 - RNA, 16 nt, Human
accacaagacugcaca

SEQ ID NO: 1333526 - RNA, 22 nt, Human
accacaaacuguaauacaauga

SEQ ID NO: 1333527 - RNA, 13 nt, Human
accacaacaugag

SEQ ID NO: 1333528 - RNA, 17 nt, Human
accacaacaugaggcca

SEQ ID NO: 1333529 - RNA, 21 nt, Human
accacaacaugaggccacugg

SEQ ID NO: 1333530 - RNA, 14 nt, Human
accaauguacccac

SEQ ID NO: 1333531 - RNA, 12 nt, Human
accaaugucuug

SEQ ID NO: 1333532 - RNA, 13 nt, Human
accaaugucuuga

SEQ ID NO: 1333533 - RNA, 21 nt, Human
accaauguacccaccgggcca

SEQ ID NO: 1333534 - RNA, 15 nt, Human
accaacccucagagc

SEQ ID NO: 1333535 - RNA, 13 nt, Human
accaacccucagg

SEQ ID NO: 1333536 - RNA, 15 nt, Human
accaacccucagggc

SEQ ID NO: 1333537 - RNA, 14 nt, Human
accaacccucaggg

SEQ ID NO: 1333538 - RNA, 17 nt, Human
accaauccuaugcaugg

SEQ ID NO: 1333539 - RNA, 13 nt, Human
accaauccuggac

SEQ ID NO: 1333540 - RNA, 14 nt, Human
accaaugaaaaaau

SEQ ID NO: 1333541 - RNA, 17 nt, Human
accaaugaaaaaaugua

SEQ ID NO: 1333542 - RNA, 20 nt, Human
accacaacuauuuucagaug

SEQ ID NO: 1333543 - RNA, 17 nt, Human
accacaaugcagugccu

SEQ ID NO: 1333544 - RNA, 21 nt, Human
ucacugaacuuugcugagccu

SEQ ID NO: 1333545 - RNA, 15 nt, Human
ucacugagcacuguu

SEQ ID NO: 1333546 - RNA, 14 nt, Human
ucacugagcacugu

SEQ ID NO: 1333547 - RNA, 18 nt, Human
ucacugagaccaaggcuu

SEQ ID NO: 1333548 - RNA, 16 nt, Human
ucacugaagcuuuuua

SEQ ID NO: 1333549 - RNA, 16 nt, Human
ucaccagcccuggcaa

SEQ ID NO: 1333550 - RNA, 19 nt, Human
ucacauuccugaacaggau

SEQ ID NO: 1333551 - RNA, 20 nt, Human
ucacucaaggcggugcuuga

SEQ ID NO: 1333552 - RNA, 12 nt, Human
ucacucaaggcg

SEQ ID NO: 1333553 - RNA, 19 nt, Human
ucacucagccacccugagu

SEQ ID NO: 1333554 - RNA, 20 nt, Human
ucacucagccacccugaguu

SEQ ID NO: 1333555 - RNA, 21 nt, Human
ucacucaucaauggggccagu

SEQ ID NO: 1333556 - RNA, 18 nt, Human
ucacugcaaccuccaccu

SEQ ID NO: 1333557 - RNA, 20 nt, Human
ucacugcaacaugaugaggu

SEQ ID NO: 1333558 - RNA, 14 nt, Human
ucacugcaaccucc

SEQ ID NO: 1333559 - RNA, 21 nt, Human
ucacugaguuuuccauggcag

SEQ ID NO: 1333560 - RNA, 17 nt, Human
ucacugcaacaugauga

SEQ ID NO: 1333561 - RNA, 19 nt, Human
ucacugagcacuguuuucu

SEQ ID NO: 1333562 - RNA, 17 nt, Human
ucacugaguuuuccaug

SEQ ID NO: 1333563 - RNA, 23 nt, Human
ucacugaguuuuccauggcagga

SEQ ID NO: 1333564 - RNA, 22 nt, Human
ucacugagcacuguuuucuagu

SEQ ID NO: 1333565 - RNA, 18 nt, Human
ucacugagcacuguuuuc

SEQ ID NO: 1333566 - RNA, 16 nt, Human
ucacugagcacuguuu

SEQ ID NO: 1333567 - RNA, 18 nt, Human
ucacugcaaccucugccu

SEQ ID NO: 1333568 - RNA, 21 nt, Human
ucacugcaaccuucgccaccu

SEQ ID NO: 1333569 - RNA, 15 nt, Human
ucacugcacagugca

SEQ ID NO: 1333570 - RNA, 16 nt, Human
ucacugcaaccuucac

SEQ ID NO: 1333571 - RNA, 18 nt, Human
ucacugcaagcuccgccu

SEQ ID NO: 1333572 - RNA, 22 nt, Human
ucacuuaaacuugcaucacuua

SEQ ID NO: 1333573 - RNA, 15 nt, Human
ucacuuaacaaacaa

SEQ ID NO: 1333574 - RNA, 22 nt, Human
ucacuuaaguuaguuccacuga

SEQ ID NO: 1333575 - RNA, 16 nt, Human
ucacuuaauugcuaca

SEQ ID NO: 1333576 - RNA, 21 nt, Human
ucacuuaggaaauggcuuugu

SEQ ID NO: 1333577 - RNA, 21 nt, Human
ucacuucacugugcuguuguu

SEQ ID NO: 1333578 - RNA, 21 nt, Human
ucacuucagguauaccucacu

SEQ ID NO: 1333579 - RNA, 15 nt, Human
ucacuucacugugcu

SEQ ID NO: 1333580 - RNA, 14 nt, Human
ucacuucacugugc

SEQ ID NO: 1333581 - RNA, 16 nt, Human
ucacuucauaauccag

SEQ ID NO: 1333582 - RNA, 12 nt, Human
ucacuucacugu

SEQ ID NO: 1333583 - RNA, 20 nt, Human
ucacuuauuuagauucacuu

SEQ ID NO: 1333584 - RNA, 22 nt, Human
accaugucaaggguucaagauu

SEQ ID NO: 1333585 - RNA, 12 nt, Human
accaugucauuu

SEQ ID NO: 1333586 - RNA, 15 nt, Human
accaugucauuucag

SEQ ID NO: 1333587 - RNA, 18 nt, Human
accaugucauuucagaag

SEQ ID NO: 1333588 - RNA, 16 nt, Human
accaugucuuucucuc

SEQ ID NO: 1333589 - RNA, 14 nt, Human
accaugucuuucuc

SEQ ID NO: 1333590 - RNA, 20 nt, Human
accauggccagcuaauuuuu

SEQ ID NO: 1333591 - RNA, 21 nt, Human
accauggaguggcagcccagc

SEQ ID NO: 1333592 - RNA, 22 nt, Human
accauggaguggcagcccagcc

SEQ ID NO: 1333593 - RNA, 23 nt, Human
accauggaguggcagcccagcca

SEQ ID NO: 1333594 - RNA, 24 nt, Human
accauggacacuacacccagcaau

SEQ ID NO: 1333595 - RNA, 16 nt, Human
accauggaguggcagc

SEQ ID NO: 1333596 - RNA, 23 nt, Human
accauggacacuacacccagcaa

SEQ ID NO: 1333597 - RNA, 22 nt, Human
accauggacacuacacccagca

SEQ ID NO: 1333598 - RNA, 21 nt, Human
accauggacacuacacccagc

SEQ ID NO: 1333599 - RNA, 18 nt, Human
accaugcugcuggggaag

SEQ ID NO: 1333600 - RNA, 19 nt, Human
accaugcugcuggggaaga

SEQ ID NO: 1333601 - RNA, 21 nt, Human
accaugcugcuggggaagaca

SEQ ID NO: 1333602 - RNA, 22 nt, Human
accaugcugcuggggaagacag

SEQ ID NO: 1333603 - RNA, 23 nt, Human
accaugcugcuggggaagacagu

SEQ ID NO: 1333604 - RNA, 14 nt, Human
accagggguuucuc

SEQ ID NO: 1333605 - RNA, 16 nt, Human
accagggguuucucgc

SEQ ID NO: 1333606 - RNA, 17 nt, Human
accagggguuucucgca

SEQ ID NO: 1333607 - RNA, 21 nt, Human
accaggguccuuuugacacug

SEQ ID NO: 1333608 - RNA, 20 nt, Human
accaggguugaccccagagg

SEQ ID NO: 1333609 - RNA, 21 nt, Human
accaggguugaccccagagga

SEQ ID NO: 1333610 - RNA, 18 nt, Human
accagguccaaugagcuu

SEQ ID NO: 1333611 - RNA, 19 nt, Human
accagguccaaugagcuuu

SEQ ID NO: 1333612 - RNA, 21 nt, Human
accagguccaaugagcuuucu

SEQ ID NO: 1333613 - RNA, 15 nt, Human
accaugauuccuuua

SEQ ID NO: 1333614 - RNA, 18 nt, Human
accaugauuccuuuaaca

SEQ ID NO: 1333615 - RNA, 16 nt, Human
accaugcaaaugcuau

SEQ ID NO: 1333616 - RNA, 19 nt, Human
accaugccaggcuaauuuu

SEQ ID NO: 1333617 - RNA, 20 nt, Human
accaugcccggcuaauuuuu

SEQ ID NO: 1333618 - RNA, 22 nt, Human
accaugcccggcuaauuuuugu

SEQ ID NO: 1333619 - RNA, 19 nt, Human
accaugcucaucugcuggu

SEQ ID NO: 1333620 - RNA, 20 nt, Human
accaugcucaucugcugguc

SEQ ID NO: 1333621 - RNA, 20 nt, Human
accaugccaggcuaauuuuu

SEQ ID NO: 1333622 - RNA, 14 nt, Human
accaugcugcuggg

SEQ ID NO: 1333623 - RNA, 16 nt, Human
accaugcugcugggga

SEQ ID NO: 1333624 - RNA, 17 nt, Human
accaugcugcuggggaa

SEQ ID NO: 1333625 - RNA, 23 nt, Human
accauguuggccaggcuugucuc

SEQ ID NO: 1333626 - RNA, 17 nt, Human
accauguguuauguuuu

SEQ ID NO: 1333627 - RNA, 18 nt, Human
accauguuggccaggcug

SEQ ID NO: 1333628 - RNA, 13 nt, Human
accauucugacuc

SEQ ID NO: 1333629 - RNA, 21 nt, Human
accauucugacucgguuucuc

SEQ ID NO: 1333630 - RNA, 14 nt, Human
acccacuggacuca

SEQ ID NO: 1333631 - RNA, 17 nt, Human
acccacuggacucaccu

SEQ ID NO: 1333632 - RNA, 21 nt, Human
acccacuggacucaccucccc

SEQ ID NO: 1333633 - RNA, 15 nt, Human
acccacuucugcacu

SEQ ID NO: 1333634 - RNA, 13 nt, Human
acccacuucugca

SEQ ID NO: 1333635 - RNA, 14 nt, Human
acccacuucugcac

SEQ ID NO: 1333636 - RNA, 24 nt, Human
accauucugacucgguuucuccaa

SEQ ID NO: 1333637 - RNA, 18 nt, Human
acccaaagagguauuuau

SEQ ID NO: 1333638 - RNA, 20 nt, Human
acccaaauguucaucaauga

SEQ ID NO: 1333639 - RNA, 16 nt, Human
acccaaauguucauca

SEQ ID NO: 1333640 - RNA, 22 nt, Human
accccagcuggggccaggcugg

SEQ ID NO: 1333641 - RNA, 19 nt, Human
accccagcuggggccaggc

SEQ ID NO: 1333642 - RNA, 13 nt, Human
acccagggcucug

SEQ ID NO: 1333643 - RNA, 12 nt, Human
acccagggcucu

SEQ ID NO: 1333644 - RNA, 15 nt, Human
acccagggcucugua

SEQ ID NO: 1333645 - RNA, 21 nt, Human
acccaggggcagccccaggcc

SEQ ID NO: 1333646 - RNA, 15 nt, Human
acccaggggcagccc

SEQ ID NO: 1333647 - RNA, 14 nt, Human
acccaggucucccu

SEQ ID NO: 1333648 - RNA, 17 nt, Human
accccagggcagccagg

SEQ ID NO: 1333649 - RNA, 22 nt, Human
accccagggcuguaacugccag

SEQ ID NO: 1333650 - RNA, 23 nt, Human
accccagggcuguaacugccagg

SEQ ID NO: 1333651 - RNA, 19 nt, Human
accccagggcacaggagcu

SEQ ID NO: 1333652 - RNA, 15 nt, Human
accccagggcagcca

SEQ ID NO: 1333653 - RNA, 16 nt, Human
accccagggcagccag

SEQ ID NO: 1333654 - RNA, 21 nt, Human
accccagggcagccagggaga

SEQ ID NO: 1333655 - RNA, 14 nt, Human
acccccacccccag

SEQ ID NO: 1333656 - RNA, 15 nt, Human
acccccacccccagc

SEQ ID NO: 1333657 - RNA, 18 nt, Human
acccccacccccagcuca

SEQ ID NO: 1333658 - RNA, 19 nt, Human
acccccacccccagcucaa

SEQ ID NO: 1333659 - RNA, 15 nt, Human
ucagauuucugagga

SEQ ID NO: 1333660 - RNA, 19 nt, Human
ucagcccuaggguggagag

SEQ ID NO: 1333661 - RNA, 18 nt, Human
ucagcccucacacacccu

SEQ ID NO: 1333662 - RNA, 14 nt, Human
ucagauucuugcau

SEQ ID NO: 1333663 - RNA, 13 nt, Human
ucagauucuugca

SEQ ID NO: 1333664 - RNA, 15 nt, Human
ucagauuccuuccca

SEQ ID NO: 1333665 - RNA, 14 nt, Human
ucagauuccuuccc

SEQ ID NO: 1333666 - RNA, 16 nt, Human
ucagauuccuucccau

SEQ ID NO: 1333667 - RNA, 12 nt, Human
ucagauggaaaa

SEQ ID NO: 1333668 - RNA, 19 nt, Human
ucagauggaaaauucauuu

SEQ ID NO: 1333669 - RNA, 20 nt, Human
ucagauggaaaauucauuuu

SEQ ID NO: 1333670 - RNA, 19 nt, Human
ucagauucccagagcaaaa

SEQ ID NO: 1333671 - RNA, 21 nt, Human
ucagauucccagagcaaaaua

SEQ ID NO: 1333672 - RNA, 22 nt, Human
ucagauucccagagcaaaauaa

SEQ ID NO: 1333673 - RNA, 20 nt, Human
acccaggacaggauccaggc

SEQ ID NO: 1333674 - RNA, 17 nt, Human
acccaggacaggaucca

SEQ ID NO: 1333675 - RNA, 23 nt, Human
acccaggacuuauuuaaacucug

SEQ ID NO: 1333676 - RNA, 23 nt, Human
ucagcccuaggguggagagccac

SEQ ID NO: 1333677 - RNA, 16 nt, Human
ucagaauagaaauuag

SEQ ID NO: 1333678 - RNA, 14 nt, Human
acccagcccacccc

SEQ ID NO: 1333679 - RNA, 15 nt, Human
acccagcccaccccc

SEQ ID NO: 1333680 - RNA, 21 nt, Human
ucagaauagccacauuuggaa

SEQ ID NO: 1333681 - RNA, 22 nt, Human
ucagaauagccacauuuggaau

SEQ ID NO: 1333682 - RNA, 23 nt, Human
ucagaauagccacauuuggaaua

SEQ ID NO: 1333683 - RNA, 15 nt, Human
ucagaauaugucagu

SEQ ID NO: 1333684 - RNA, 16 nt, Human
acccagcccacccccg

SEQ ID NO: 1333685 - RNA, 18 nt, Human
ucagaaucccuuaacagu

SEQ ID NO: 1333686 - RNA, 14 nt, Human
acccagcaauagag

SEQ ID NO: 1333687 - RNA, 13 nt, Human
acccagccaggcc

SEQ ID NO: 1333688 - RNA, 14 nt, Human
acccagccaggccc

SEQ ID NO: 1333689 - RNA, 18 nt, Human
acccagccaggcccagcc

SEQ ID NO: 1333690 - RNA, 17 nt, Human
acccagccaggcccagc

SEQ ID NO: 1333691 - RNA, 23 nt, Human
ucagagaauuucuaccauuucag

SEQ ID NO: 1333692 - RNA, 22 nt, Human
ucagaauuagagcaugggaggu

SEQ ID NO: 1333693 - RNA, 19 nt, Human
ucagagacaucagcccuug

SEQ ID NO: 1333694 - RNA, 12 nt, Human
ucagagaccagg

SEQ ID NO: 1333695 - RNA, 15 nt, Human
ucagagacaugcaga

SEQ ID NO: 1333696 - RNA, 14 nt, Human
ucagagaccagggc

SEQ ID NO: 1333697 - RNA, 15 nt, Human
ucagagaccagggcu

SEQ ID NO: 1333698 - RNA, 16 nt, Human
ucagagaccagggcuc

SEQ ID NO: 1333699 - RNA, 20 nt, Human
ucagagaccagggcuccagc

SEQ ID NO: 1333700 - RNA, 21 nt, Human
ucagaugcugugcaaauguua

SEQ ID NO: 1333701 - RNA, 14 nt, Human
ucagaugcuccaag

SEQ ID NO: 1333702 - RNA, 15 nt, Human
ucagaugcuccaaga

SEQ ID NO: 1333703 - RNA, 16 nt, Human
ucagaugcuccaagau

SEQ ID NO: 1333704 - RNA, 18 nt, Human
ucagaugcuccaagauuc

SEQ ID NO: 1333705 - RNA, 19 nt, Human
ucagaugcuccaagauucu

SEQ ID NO: 1333706 - RNA, 20 nt, Human
ucagaugcuccaagauucua

SEQ ID NO: 1333707 - RNA, 22 nt, Human
ucagaugcuccaagauucuaga

SEQ ID NO: 1333708 - RNA, 20 nt, Human
ucagagccgugguccuuugg

SEQ ID NO: 1333709 - RNA, 19 nt, Human
ucagagagaauggcuuugg

SEQ ID NO: 1333710 - RNA, 12 nt, Human
ucagagagcagu

SEQ ID NO: 1333711 - RNA, 15 nt, Human
ucagagagcagugcu

SEQ ID NO: 1333712 - RNA, 20 nt, Human
ucagagagcagugcuuuugg

SEQ ID NO: 1333713 - RNA, 18 nt, Human
ucagagagcagugcuuuu

SEQ ID NO: 1333714 - RNA, 16 nt, Human
ucagagaggccuuuug

SEQ ID NO: 1333715 - RNA, 16 nt, Human
ucagagaugcaccacc

SEQ ID NO: 1333716 - RNA, 21 nt, Human
ucagagaugcaccaccaagcc

SEQ ID NO: 1333717 - RNA, 21 nt, Human
ucagagccaccccuaaagaga

SEQ ID NO: 1333718 - RNA, 22 nt, Human
ucagagaugcaccaccaagcca

SEQ ID NO: 1333719 - RNA, 19 nt, Human
ucagagcaggugcuggcuc

SEQ ID NO: 1333720 - RNA, 22 nt, Human
ucagagccaugucuucucccug

SEQ ID NO: 1333721 - RNA, 16 nt, Human
ucagagccgugguccu

SEQ ID NO: 1333722 - RNA, 20 nt, Human
acccucaugcugugugacuc

SEQ ID NO: 1333723 - RNA, 17 nt, Human
acccucauucuacugaa

SEQ ID NO: 1333724 - RNA, 15 nt, Human
acccgggaggcagag

SEQ ID NO: 1333725 - RNA, 22 nt, Human
acccuccccaaaggcuuugccc

SEQ ID NO: 1333726 - RNA, 23 nt, Human
acccuccccgcaccccccaagcu

SEQ ID NO: 1333727 - RNA, 17 nt, Human
acccucccucccuaccc

SEQ ID NO: 1333728 - RNA, 11 nt, Human
acccucccucc

SEQ ID NO: 1333729 - RNA, 15 nt, Human
acccggaggggccug

SEQ ID NO: 1333730 - RNA, 17 nt, Human
acccugaccagcucccc

SEQ ID NO: 1333731 - RNA, 13 nt, Human
acccugaccuggc

SEQ ID NO: 1333732 - RNA, 16 nt, Human
acccugaccuggcccc

SEQ ID NO: 1333733 - RNA, 20 nt, Human
acccugaccuggcccccuca

SEQ ID NO: 1333734 - RNA, 12 nt, Human
acccugagccgg

SEQ ID NO: 1333735 - RNA, 22 nt, Human
acccugagcugaccagccguga

SEQ ID NO: 1333736 - RNA, 17 nt, Human
acccugagcugaggcag

SEQ ID NO: 1333737 - RNA, 22 nt, Human
acccugagcugaggcagcagug

SEQ ID NO: 1333738 - RNA, 23 nt, Human
acccugagcugaggcagcagugu

SEQ ID NO: 1333739 - RNA, 13 nt, Human
acccugaggaguc

SEQ ID NO: 1333740 - RNA, 14 nt, Human
acccugaggagucu

SEQ ID NO: 1333741 - RNA, 17 nt, Human
acccugaggagucugag

SEQ ID NO: 1333742 - RNA, 19 nt, Human
acccugaggagucugaggu

SEQ ID NO: 1333743 - RNA, 22 nt, Human
acccugaggagucugagguccu

SEQ ID NO: 1333744 - RNA, 23 nt, Human
acccugaggagucugagguccug

SEQ ID NO: 1333745 - RNA, 16 nt, Human
acccugaguugcuuuu

SEQ ID NO: 1333746 - RNA, 19 nt, Human
acccugauaggaagagggg

SEQ ID NO: 1333747 - RNA, 19 nt, Human
acccugaguugcuuuucag

SEQ ID NO: 1333748 - RNA, 20 nt, Human
acccugauuuaggagaagcc

SEQ ID NO: 1333749 - RNA, 22 nt, Human
acccugauuuaggagaagccag

SEQ ID NO: 1333750 - RNA, 23 nt, Human
acccugauuuaggagaagccagg

SEQ ID NO: 1333751 - RNA, 17 nt, Human
acccugccccagcuggg

SEQ ID NO: 1333752 - RNA, 13 nt, Human
acccugccucucc

SEQ ID NO: 1333753 - RNA, 16 nt, Human
acccugccucucccag

SEQ ID NO: 1333754 - RNA, 20 nt, Human
acccugccucucccaggcag

SEQ ID NO: 1333755 - RNA, 14 nt, Human
acccugccuuaucu

SEQ ID NO: 1333756 - RNA, 18 nt, Human
acccugccuuaucuugca

SEQ ID NO: 1333757 - RNA, 13 nt, Human
ucaggccacuuga

SEQ ID NO: 1333758 - RNA, 14 nt, Human
ucaggccagagcca

SEQ ID NO: 1333759 - RNA, 17 nt, Human
ucaggccagagccaagg

SEQ ID NO: 1333760 - RNA, 12 nt, Human
acccccagccug

SEQ ID NO: 1333761 - RNA, 12 nt, Human
acccccagcacu

SEQ ID NO: 1333762 - RNA, 13 nt, Human
ucaggcagcucaa

SEQ ID NO: 1333763 - RNA, 16 nt, Human
ucaggcaggggccucc

SEQ ID NO: 1333764 - RNA, 17 nt, Human
ucaggcaggggccucca

SEQ ID NO: 1333765 - RNA, 21 nt, Human
ucaggcaggggccuccauggg

SEQ ID NO: 1333766 - RNA, 18 nt, Human
ucagguaaucgaccugcc

SEQ ID NO: 1333767 - RNA, 19 nt, Human
ucagguaaucgaccugccu

SEQ ID NO: 1333768 - RNA, 20 nt, Human
ucagguaaucgaccugccuc

SEQ ID NO: 1333769 - RNA, 15 nt, Human
acccgccccacuccc

SEQ ID NO: 1333770 - RNA, 23 nt, Human
acccgauuccaccaaaugugcuu

SEQ ID NO: 1333771 - RNA, 21 nt, Human
ucagguaaucgaccugccucg

SEQ ID NO: 1333772 - RNA, 14 nt, Human
ucagguacuuguaa

SEQ ID NO: 1333773 - RNA, 17 nt, Human
ucagguauaccucacuu

SEQ ID NO: 1333774 - RNA, 15 nt, Human
ucagguauaccucac

SEQ ID NO: 1333775 - RNA, 17 nt, Human
ucagggggcgccugugg

SEQ ID NO: 1333776 - RNA, 20 nt, Human
ucaggggucugagcuccagc

SEQ ID NO: 1333777 - RNA, 21 nt, Human
accgaacugauguaaguaaac

SEQ ID NO: 1333778 - RNA, 16 nt, Human
acccuugcugugaauu

SEQ ID NO: 1333779 - RNA, 14 nt, Human
acccuggacccagc

SEQ ID NO: 1333780 - RNA, 23 nt, Human
acccugccucucccaggcagggg

SEQ ID NO: 1333781 - RNA, 18 nt, Human
acccugcucauccacucu

SEQ ID NO: 1333782 - RNA, 16 nt, Human
acccuugggccagaag

SEQ ID NO: 1333783 - RNA, 17 nt, Human
acccuugggccagaagu

SEQ ID NO: 1333784 - RNA, 18 nt, Human
acccuugggccagaagua

SEQ ID NO: 1333785 - RNA, 20 nt, Human
acccuugggccagaaguacc

SEQ ID NO: 1333786 - RNA, 17 nt, Human
acccuugguuccuaacu

SEQ ID NO: 1333787 - RNA, 14 nt, Human
ucagguguugccaa

SEQ ID NO: 1333788 - RNA, 22 nt, Human
ucagguugucugaagucacugc

SEQ ID NO: 1333789 - RNA, 22 nt, Human
ucagguuuuuccuuuuuuugua

SEQ ID NO: 1333790 - RNA, 17 nt, Human
ucaguaaauaacuggaa

SEQ ID NO: 1333791 - RNA, 18 nt, Human
ucaguaaauaacuggaaa

SEQ ID NO: 1333792 - RNA, 12 nt, Human
ucaguaagaggu

SEQ ID NO: 1333793 - RNA, 18 nt, Human
ucaguaauuuagaaauca

SEQ ID NO: 1333794 - RNA, 19 nt, Human
ucaguaauuuagaaaucau

SEQ ID NO: 1333795 - RNA, 20 nt, Human
ucaguaauuuagaaaucauu

SEQ ID NO: 1333796 - RNA, 14 nt, Human
ucaguaauuugagg

SEQ ID NO: 1333797 - RNA, 15 nt, Human
ucaguaauuugagga

SEQ ID NO: 1333798 - RNA, 17 nt, Human
ucaguaauuugaggaca

SEQ ID NO: 1333799 - RNA, 18 nt, Human
ucaguaauuugaggacaa

SEQ ID NO: 1333800 - RNA, 18 nt, Human
ucaguaauuuguuuaaaa

SEQ ID NO: 1333801 - RNA, 16 nt, Human
ucaguacccucucagc

SEQ ID NO: 1333802 - RNA, 17 nt, Human
ucaguacccucucagcu

SEQ ID NO: 1333803 - RNA, 19 nt, Human
ucaguacccucucagcucc

SEQ ID NO: 1333804 - RNA, 17 nt, Human
ucaguagauugcagaaa

SEQ ID NO: 1333805 - RNA, 23 nt, Human
ucaguaggugcccagaauaaguu

SEQ ID NO: 1333806 - RNA, 18 nt, Human
ucauaaauaaaguuuguu

SEQ ID NO: 1333807 - RNA, 24 nt, Human
ucauaaagcaggcagaacucaucu

SEQ ID NO: 1333808 - RNA, 18 nt, Human
ucauaagauauuuuucau

SEQ ID NO: 1333809 - RNA, 21 nt, Human
ucauaagauauuuuucaugau

SEQ ID NO: 1333810 - RNA, 14 nt, Human
ucauaaggcuucaa

SEQ ID NO: 1333811 - RNA, 15 nt, Human
ucauaaggcuucaaa

SEQ ID NO: 1333812 - RNA, 20 nt, Human
ucauaaguauuaugucucuu

SEQ ID NO: 1333813 - RNA, 15 nt, Human
ucauaaguauuucaa

SEQ ID NO: 1333814 - RNA, 20 nt, Human
ucauaaguauuucaaauugg

SEQ ID NO: 1333815 - RNA, 15 nt, Human
ucaguuguucuuuuu

SEQ ID NO: 1333816 - RNA, 19 nt, Human
ucaguuuaaaagcacgaca

SEQ ID NO: 1333817 - RNA, 17 nt, Human
ucaguuucacagaaaau

SEQ ID NO: 1333818 - RNA, 18 nt, Human
ucaguuucacagaaaaua

SEQ ID NO: 1333819 - RNA, 19 nt, Human
ucaguuucacagaaaauaa

SEQ ID NO: 1333820 - RNA, 14 nt, Human
ucaguuucauaaaa

SEQ ID NO: 1333821 - RNA, 19 nt, Human
ucaguuucauaaaaggaga

SEQ ID NO: 1333822 - RNA, 15 nt, Human
ucaguuugugugucu

SEQ ID NO: 1333823 - RNA, 16 nt, Human
ucaguuugugugucuu

SEQ ID NO: 1333824 - RNA, 17 nt, Human
ucaguuugugugucuua

SEQ ID NO: 1333825 - RNA, 15 nt, Human
ucagugcuucgcaga

SEQ ID NO: 1333826 - RNA, 14 nt, Human
ucagugcugugcug

SEQ ID NO: 1333827 - RNA, 16 nt, Human
ucagugcugugcugug

SEQ ID NO: 1333828 - RNA, 22 nt, Human
ucagugcugugcugugcuaugg

SEQ ID NO: 1333829 - RNA, 12 nt, Human
ucagugcucccu

SEQ ID NO: 1333830 - RNA, 13 nt, Human
ucagugcucccuc

SEQ ID NO: 1333831 - RNA, 19 nt, Human
ucagugcucccucacaugu

SEQ ID NO: 1333832 - RNA, 13 nt, Human
ucagugcugugcu

SEQ ID NO: 1333833 - RNA, 15 nt, Human
ucaguagucccugca

SEQ ID NO: 1333834 - RNA, 14 nt, Human
ucaguauuauaugu

SEQ ID NO: 1333835 - RNA, 15 nt, Human
ucaguauuauaugua

SEQ ID NO: 1333836 - RNA, 16 nt, Human
ucaguauuauauguac

SEQ ID NO: 1333837 - RNA, 21 nt, Human
uccugaaaacccuugccaugu

SEQ ID NO: 1333838 - RNA, 22 nt, Human
uccugaaaacccuugccaugug

SEQ ID NO: 1333839 - RNA, 18 nt, Human
uccucuuuuccuucccaa

SEQ ID NO: 1333840 - RNA, 13 nt, Human
uccugaagaacca

SEQ ID NO: 1333841 - RNA, 14 nt, Human
uccugaagaaccag

SEQ ID NO: 1333842 - RNA, 16 nt, Human
uccugaagaaccaguc

SEQ ID NO: 1333843 - RNA, 18 nt, Human
uccugaagaaccaguccc

SEQ ID NO: 1333844 - RNA, 23 nt, Human
uccugaagaaccaguccccccac

SEQ ID NO: 1333845 - RNA, 17 nt, Human
uccucuuucagcuccug

SEQ ID NO: 1333846 - RNA, 12 nt, Human
uccucuuucagc

SEQ ID NO: 1333847 - RNA, 13 nt, Human
uccucuuucagcu

SEQ ID NO: 1333848 - RNA, 14 nt, Human
uccucuuucagcuc

SEQ ID NO: 1333849 - RNA, 15 nt, Human
uccucuuucagcucc

SEQ ID NO: 1333850 - RNA, 16 nt, Human
uccucuuucagcuccu

SEQ ID NO: 1333851 - RNA, 19 nt, Human
uccucuugccacugccucu

SEQ ID NO: 1333852 - RNA, 21 nt, Human
uccucugcugaccugcugacc

SEQ ID NO: 1333853 - RNA, 16 nt, Human
uccucugcccgggagc

SEQ ID NO: 1333854 - RNA, 22 nt, Human
uccucugcccgggagcucagga

SEQ ID NO: 1333855 - RNA, 14 nt, Human
uccucugaggcuga

SEQ ID NO: 1333856 - RNA, 18 nt, Human
uccucugacucagggcuc

SEQ ID NO: 1333857 - RNA, 12 nt, Human
uccucugcacuc

SEQ ID NO: 1333858 - RNA, 16 nt, Human
uccucugcacucccac

SEQ ID NO: 1333859 - RNA, 18 nt, Human
acugaaaauauuguuuua

SEQ ID NO: 1333860 - RNA, 20 nt, Human
acugaaaaggaggggucugg

SEQ ID NO: 1333861 - RNA, 15 nt, Human
acugaaaaugugcua

SEQ ID NO: 1333862 - RNA, 17 nt, Human
acugaaaauuauuuaaa

SEQ ID NO: 1333863 - RNA, 19 nt, Human
acugaaaaugugcuauacu

SEQ ID NO: 1333864 - RNA, 19 nt, Human
acucuuucuuucaauaaaa

SEQ ID NO: 1333865 - RNA, 13 nt, Human
acucuuugagaaa

SEQ ID NO: 1333866 - RNA, 21 nt, Human
acucuuucuguauauacuuuu

SEQ ID NO: 1333867 - RNA, 22 nt, Human
acucuuucuguauauacuuuuu

SEQ ID NO: 1333868 - RNA, 16 nt, Human
acucuuugagaaacaa

SEQ ID NO: 1333869 - RNA, 18 nt, Human
acucuuugagaaacaaca

SEQ ID NO: 1333870 - RNA, 12 nt, Human
acucuuugagag

SEQ ID NO: 1333871 - RNA, 15 nt, Human
acucuuugcugcugc

SEQ ID NO: 1333872 - RNA, 14 nt, Human
acucuuuggucguu

SEQ ID NO: 1333873 - RNA, 19 nt, Human
acucuuuggucguuuuuuu

SEQ ID NO: 1333874 - RNA, 21 nt, Human
uccugaccccaaguuauccac

SEQ ID NO: 1333875 - RNA, 15 nt, Human
uccugaccucaggca

SEQ ID NO: 1333876 - RNA, 16 nt, Human
uccugaccucagguga

SEQ ID NO: 1333877 - RNA, 15 nt, Human
uccugaccuccgcca

SEQ ID NO: 1333878 - RNA, 16 nt, Human
uccugaccuccgccau

SEQ ID NO: 1333879 - RNA, 20 nt, Human
uccugaccuccgccauccac

SEQ ID NO: 1333880 - RNA, 14 nt, Human
acucuuucuguaua

SEQ ID NO: 1333881 - RNA, 22 nt, Human
uccugaauccaaacuaauccau

SEQ ID NO: 1333882 - RNA, 17 nt, Human
uccugaaggccugaggu

SEQ ID NO: 1333883 - RNA, 11 nt, Human
uccugaccagc

SEQ ID NO: 1333884 - RNA, 14 nt, Human
uccugaccaguugc

SEQ ID NO: 1333885 - RNA, 22 nt, Human
uccugaccaguugcagucacuc

SEQ ID NO: 1333886 - RNA, 21 nt, Human
uccugaccaguugcagucacu

SEQ ID NO: 1333887 - RNA, 17 nt, Human
uccucuccccaugaugu

SEQ ID NO: 1333888 - RNA, 21 nt, Human
uccucuccccagcccagagac

SEQ ID NO: 1333889 - RNA, 23 nt, Human
uccucuccccagcccagagacau

SEQ ID NO: 1333890 - RNA, 13 nt, Human
uccucuccugucu

SEQ ID NO: 1333891 - RNA, 17 nt, Human
uccucuccuagccccug

SEQ ID NO: 1333892 - RNA, 17 nt, Human
uccucuccacugccuuc

SEQ ID NO: 1333893 - RNA, 18 nt, Human
uccucuccacugccuucg

SEQ ID NO: 1333894 - RNA, 12 nt, Human
uccucucugccc

SEQ ID NO: 1333895 - RNA, 13 nt, Human
uccucucugcccu

SEQ ID NO: 1333896 - RNA, 14 nt, Human
uccucucugcccua

SEQ ID NO: 1333897 - RNA, 15 nt, Human
uccucucugcccuaa

SEQ ID NO: 1333898 - RNA, 15 nt, Human
uccucucgcggcccu

SEQ ID NO: 1333899 - RNA, 19 nt, Human
uccucucgcggcccucagu

SEQ ID NO: 1333900 - RNA, 17 nt, Human
uccucucgcggcccuca

SEQ ID NO: 1333901 - RNA, 16 nt, Human
uccucucucuguguua

SEQ ID NO: 1333902 - RNA, 12 nt, Human
uccucugagccu

SEQ ID NO: 1333903 - RNA, 16 nt, Human
uccucugacucagggc

SEQ ID NO: 1333904 - RNA, 17 nt, Human
uccucugacucagggcu

SEQ ID NO: 1333905 - RNA, 13 nt, Human
uccucugagccuu

SEQ ID NO: 1333906 - RNA, 17 nt, Human
uccucugagccuuggga

SEQ ID NO: 1333907 - RNA, 14 nt, Human
uccucucuuccucu

SEQ ID NO: 1333908 - RNA, 17 nt, Human
uccucucuuccucuucc

SEQ ID NO: 1333909 - RNA, 15 nt, Human
uccucugacucaggg

SEQ ID NO: 1333910 - RNA, 20 nt, Human
uccucccacuucagccuccc

SEQ ID NO: 1333911 - RNA, 19 nt, Human
acucuucuugaaauuuuaa

SEQ ID NO: 1333912 - RNA, 21 nt, Human
uccuccccacuuguccgcugg

SEQ ID NO: 1333913 - RNA, 19 nt, Human
uccuccccuccagcucccu

SEQ ID NO: 1333914 - RNA, 11 nt, Human
uccucccugua

SEQ ID NO: 1333915 - RNA, 12 nt, Human
uccucccuguaa

SEQ ID NO: 1333916 - RNA, 14 nt, Human
uccucccuguaacu

SEQ ID NO: 1333917 - RNA, 15 nt, Human
uccucccuguaacuu

SEQ ID NO: 1333918 - RNA, 14 nt, Human
uccucccuuccucc

SEQ ID NO: 1333919 - RNA, 19 nt, Human
acucuugaaaaaugcaugu

SEQ ID NO: 1333920 - RNA, 14 nt, Human
acucuugaaaaaug

SEQ ID NO: 1333921 - RNA, 21 nt, Human
acucuugaaaaaugcauguug

SEQ ID NO: 1333922 - RNA, 23 nt, Human
acucguguguuucuauuuuuuga

SEQ ID NO: 1333923 - RNA, 13 nt, Human
acucuauucuuua

SEQ ID NO: 1333924 - RNA, 15 nt, Human
acucguguguuucua

SEQ ID NO: 1333925 - RNA, 19 nt, Human
acucguauagcaugcaucu

SEQ ID NO: 1333926 - RNA, 15 nt, Human
acucuauucuuuaac

SEQ ID NO: 1333927 - RNA, 14 nt, Human
acucuauucuuuaa

SEQ ID NO: 1333928 - RNA, 22 nt, Human
acucgugucuggcacagccugg

SEQ ID NO: 1333929 - RNA, 23 nt, Human
acucgugucuggcacagccuggc

SEQ ID NO: 1333930 - RNA, 14 nt, Human
acucguauaugucu

SEQ ID NO: 1333931 - RNA, 15 nt, Human
acucgucucccccaa

SEQ ID NO: 1333932 - RNA, 14 nt, Human
acucgguuucucca

SEQ ID NO: 1333933 - RNA, 16 nt, Human
acucgguuucuccaaa

SEQ ID NO: 1333934 - RNA, 11 nt, Human
acucugcucug

SEQ ID NO: 1333935 - RNA, 18 nt, Human
acucugacaacagacuuc

SEQ ID NO: 1333936 - RNA, 20 nt, Human
acucugacaacagacuucug

SEQ ID NO: 1333937 - RNA, 22 nt, Human
acucugacaacagacuucugaa

SEQ ID NO: 1333938 - RNA, 23 nt, Human
acucugacaacagacuucugaaa

SEQ ID NO: 1333939 - RNA, 17 nt, Human
acucugacaacagacuu

SEQ ID NO: 1333940 - RNA, 17 nt, Human
acucucagucucugagc

SEQ ID NO: 1333941 - RNA, 18 nt, Human
acucucagucucugagca

SEQ ID NO: 1333942 - RNA, 22 nt, Human
acucucaggaccaaagcuuuca

SEQ ID NO: 1333943 - RNA, 13 nt, Human
acucucagucucu

SEQ ID NO: 1333944 - RNA, 14 nt, Human
acucucagucucug

SEQ ID NO: 1333945 - RNA, 16 nt, Human
acucucagucucugag

SEQ ID NO: 1333946 - RNA, 13 nt, Human
acucuugaaaaau

SEQ ID NO: 1333947 - RNA, 15 nt, Human
acucuucuugaaauu

SEQ ID NO: 1333948 - RNA, 16 nt, Human
acucuucuugaaauuu

SEQ ID NO: 1333949 - RNA, 23 nt, Human
acucuucugagcaccuacuuaca

SEQ ID NO: 1333950 - RNA, 19 nt, Human
acucuucaaggucugcuuu

SEQ ID NO: 1333951 - RNA, 16 nt, Human
acucuucacucuucaa

SEQ ID NO: 1333952 - RNA, 20 nt, Human
acucuucaaggucugcuuuu

SEQ ID NO: 1333953 - RNA, 20 nt, Human
acucuucaguuaagccuuug

SEQ ID NO: 1333954 - RNA, 21 nt, Human
acucuucaguuaagccuuugg

SEQ ID NO: 1333955 - RNA, 15 nt, Human
acucuucacucuuca

SEQ ID NO: 1333956 - RNA, 14 nt, Human
acucuucccucucu

SEQ ID NO: 1333957 - RNA, 12 nt, Human
acucugcucuga

SEQ ID NO: 1333958 - RNA, 13 nt, Human
acucugcucugau

SEQ ID NO: 1333959 - RNA, 14 nt, Human
acucugcucugaug

SEQ ID NO: 1333960 - RNA, 15 nt, Human
acucugcucugaugc

SEQ ID NO: 1333961 - RNA, 16 nt, Human
acucugcucugaugca

SEQ ID NO: 1333962 - RNA, 12 nt, Human
acucugcuucuc

SEQ ID NO: 1333963 - RNA, 14 nt, Human
acucugcuucucug

SEQ ID NO: 1333964 - RNA, 15 nt, Human
acucugcuucucuga

SEQ ID NO: 1333965 - RNA, 14 nt, Human
acucugcuguuuga

SEQ ID NO: 1333966 - RNA, 16 nt, Human
acucugcuucucugac

SEQ ID NO: 1333967 - RNA, 15 nt, Human
acucuucaaaugccu

SEQ ID NO: 1333968 - RNA, 14 nt, Human
acuccagaaaguga

SEQ ID NO: 1333969 - RNA, 18 nt, Human
acuccagaaagugacaag

SEQ ID NO: 1333970 - RNA, 13 nt, Human
acuccaccuuccc

SEQ ID NO: 1333971 - RNA, 19 nt, Human
uccggcagcuucugccccc

SEQ ID NO: 1333972 - RNA, 19 nt, Human
uccggcauggacaauggac

SEQ ID NO: 1333973 - RNA, 13 nt, Human
uccggcauggaca

SEQ ID NO: 1333974 - RNA, 21 nt, Human
uccgugcuuaaccaaagaagc

SEQ ID NO: 1333975 - RNA, 14 nt, Human
uccgugcuuaacca

SEQ ID NO: 1333976 - RNA, 16 nt, Human
uccgugggacggugcc

SEQ ID NO: 1333977 - RNA, 23 nt, Human
uccgugggacggugcccaagcca

SEQ ID NO: 1333978 - RNA, 17 nt, Human
uccgugggacggugccc

SEQ ID NO: 1333979 - RNA, 16 nt, Human
uccguguccaccccca

SEQ ID NO: 1333980 - RNA, 16 nt, Human
uccgugugggagaccg

SEQ ID NO: 1333981 - RNA, 15 nt, Human
uccguuagcuccugu

SEQ ID NO: 1333982 - RNA, 16 nt, Human
uccguuagcuccugug

SEQ ID NO: 1333983 - RNA, 17 nt, Human
uccguuagcuccugugg

SEQ ID NO: 1333984 - RNA, 19 nt, Human
uccguuagcuccuguggcc

SEQ ID NO: 1333985 - RNA, 15 nt, Human
uccguguccaccccc

SEQ ID NO: 1333986 - RNA, 15 nt, Human
uccuaccucaaaauu

SEQ ID NO: 1333987 - RNA, 12 nt, Human
acuccuuccugc

SEQ ID NO: 1333988 - RNA, 14 nt, Human
acuccuuucucauc

SEQ ID NO: 1333989 - RNA, 14 nt, Human
acuccuuuuaaaga

SEQ ID NO: 1333990 - RNA, 23 nt, Human
acuccuuuuaaagaaaaaaauug

SEQ ID NO: 1333991 - RNA, 15 nt, Human
acucgaaucugugug

SEQ ID NO: 1333992 - RNA, 15 nt, Human
acuccugugggagcc

SEQ ID NO: 1333993 - RNA, 16 nt, Human
acuccugugggagccu

SEQ ID NO: 1333994 - RNA, 17 nt, Human
acuccugugggagccuc

SEQ ID NO: 1333995 - RNA, 18 nt, Human
acuccugugggagccucg

SEQ ID NO: 1333996 - RNA, 20 nt, Human
acuccugugggagccucgca

SEQ ID NO: 1333997 - RNA, 19 nt, Human
acuccugugggagccucgc

SEQ ID NO: 1333998 - RNA, 20 nt, Human
acuccuucaacaauucuaaa

SEQ ID NO: 1333999 - RNA, 22 nt, Human
acuccuucaacaauucuaaaau

SEQ ID NO: 1334000 - RNA, 12 nt, Human
acuccuuccagc

SEQ ID NO: 1334001 - RNA, 13 nt, Human
acuccuuccagcu

SEQ ID NO: 1334002 - RNA, 11 nt, Human
acuccuuccug

SEQ ID NO: 1334003 - RNA, 13 nt, Human
acuccuuccugcc

SEQ ID NO: 1334004 - RNA, 13 nt, Human
uccuaccgucuuu

SEQ ID NO: 1334005 - RNA, 21 nt, Human
acuccaaacugacucuuaaga

SEQ ID NO: 1334006 - RNA, 23 nt, Human
acucauuuuucaugauaaugaac

SEQ ID NO: 1334007 - RNA, 20 nt, Human
acucauuuuucaugauaaug

SEQ ID NO: 1334008 - RNA, 13 nt, Human
acuccaaaauguu

SEQ ID NO: 1334009 - RNA, 22 nt, Human
acuccaaaauguuggucauuuu

SEQ ID NO: 1334010 - RNA, 22 nt, Human
acuccaaacagaccccuguuca

SEQ ID NO: 1334011 - RNA, 19 nt, Human
acuccaaacagaccccugu

SEQ ID NO: 1334012 - RNA, 13 nt, Human
acucaucuuuccc

SEQ ID NO: 1334013 - RNA, 16 nt, Human
acucaucuuucccucc

SEQ ID NO: 1334014 - RNA, 19 nt, Human
acucauuuuucaugauaau

SEQ ID NO: 1334015 - RNA, 23 nt, Human
acucaucuagguaaauuacaguu

SEQ ID NO: 1334016 - RNA, 22 nt, Human
acucagauaagguaaaaugcca

SEQ ID NO: 1334017 - RNA, 18 nt, Human
acucagacauuggcaccu

SEQ ID NO: 1334018 - RNA, 12 nt, Human
acucagaccuga

SEQ ID NO: 1334019 - RNA, 14 nt, Human
acucagagacaugc

SEQ ID NO: 1334020 - RNA, 17 nt, Human
acucagagacaugcaga

SEQ ID NO: 1334021 - RNA, 20 nt, Human
acucagagacaugcagagau

SEQ ID NO: 1334022 - RNA, 22 nt, Human
acucaccugcacuaacagagug

SEQ ID NO: 1334023 - RNA, 13 nt, Human
acucagaagccug

SEQ ID NO: 1334024 - RNA, 14 nt, Human
acucagaagccugg

SEQ ID NO: 1334025 - RNA, 15 nt, Human
acucagaagccuggg

SEQ ID NO: 1334026 - RNA, 16 nt, Human
acucagaagccugggg

SEQ ID NO: 1334027 - RNA, 17 nt, Human
acucagaagccuggggg

SEQ ID NO: 1334028 - RNA, 21 nt, Human
acucagaagccugggggccug

SEQ ID NO: 1334029 - RNA, 22 nt, Human
acucagaagccugggggccugg

SEQ ID NO: 1334030 - RNA, 23 nt, Human
acucagaagccugggggccuggc

SEQ ID NO: 1334031 - RNA, 23 nt, Human
ucccucuuccuucccugcuguga

SEQ ID NO: 1334032 - RNA, 22 nt, Human
ucccucuuccuucccugcugug

SEQ ID NO: 1334033 - RNA, 23 nt, Human
ucccucccagaggagccaccagu

SEQ ID NO: 1334034 - RNA, 12 nt, Human
ucccuccccccc

SEQ ID NO: 1334035 - RNA, 14 nt, Human
ucccucccccccau

SEQ ID NO: 1334036 - RNA, 16 nt, Human
ucccucccccccaugc

SEQ ID NO: 1334037 - RNA, 21 nt, Human
ucccucccccccaugcacugu

SEQ ID NO: 1334038 - RNA, 12 nt, Human
ucccucccccuu

SEQ ID NO: 1334039 - RNA, 14 nt, Human
ucccucccccuugu

SEQ ID NO: 1334040 - RNA, 19 nt, Human
ucccucacucgucuccccc

SEQ ID NO: 1334041 - RNA, 20 nt, Human
ucccucacucgucuccccca

SEQ ID NO: 1334042 - RNA, 22 nt, Human
ucccucacucgucucccccaac

SEQ ID NO: 1334043 - RNA, 21 nt, Human
ucccucacucgucucccccaa

SEQ ID NO: 1334044 - RNA, 22 nt, Human
ucccucaccuuggcaccagaca

SEQ ID NO: 1334045 - RNA, 13 nt, Human
uccccugcacugu

SEQ ID NO: 1334046 - RNA, 18 nt, Human
ucccucacucgucucccc

SEQ ID NO: 1334047 - RNA, 12 nt, Human
ucccucagacug

SEQ ID NO: 1334048 - RNA, 14 nt, Human
ucccucagacuggg

SEQ ID NO: 1334049 - RNA, 16 nt, Human
ucccucagacuggggc

SEQ ID NO: 1334050 - RNA, 22 nt, Human
ucccugacucauucugaaggag

SEQ ID NO: 1334051 - RNA, 19 nt, Human
acucaccucccccaucucu

SEQ ID NO: 1334052 - RNA, 20 nt, Human
acucaccucccccaucucuu

SEQ ID NO: 1334053 - RNA, 14 nt, Human
ucccugacucauuc

SEQ ID NO: 1334054 - RNA, 16 nt, Human
ucccugacucauucug

SEQ ID NO: 1334055 - RNA, 19 nt, Human
ucccugacucauucugaag

SEQ ID NO: 1334056 - RNA, 18 nt, Human
ucccucuuuggcuccccu

SEQ ID NO: 1334057 - RNA, 23 nt, Human
ucccucuuuggcuccccuguacc

SEQ ID NO: 1334058 - RNA, 20 nt, Human
acuagaguuuagcuggaaaa

SEQ ID NO: 1334059 - RNA, 14 nt, Human
acuagaggugagaa

SEQ ID NO: 1334060 - RNA, 18 nt, Human
acuagaggugagaaauuu

SEQ ID NO: 1334061 - RNA, 21 nt, Human
acuagaggugagaaauuuaaa

SEQ ID NO: 1334062 - RNA, 15 nt, Human
acuagagucugaaca

SEQ ID NO: 1334063 - RNA, 12 nt, Human
acuagacaagcc

SEQ ID NO: 1334064 - RNA, 15 nt, Human
acuagacaagccaga

SEQ ID NO: 1334065 - RNA, 17 nt, Human
acuagacaagccagaac

SEQ ID NO: 1334066 - RNA, 21 nt, Human
acuagacaagccagaacuuga

SEQ ID NO: 1334067 - RNA, 17 nt, Human
acuagacaccaaaguuc

SEQ ID NO: 1334068 - RNA, 18 nt, Human
acuagacaccaaaguucu

SEQ ID NO: 1334069 - RNA, 20 nt, Human
acuagacaccaaaguucuaa

SEQ ID NO: 1334070 - RNA, 23 nt, Human
acuacuucuuuuuucaaaagaaa

SEQ ID NO: 1334071 - RNA, 17 nt, Human
acuacuugggagcaccg

SEQ ID NO: 1334072 - RNA, 12 nt, Human
acuacuuuauaa

SEQ ID NO: 1334073 - RNA, 14 nt, Human
acuacuagggaaau

SEQ ID NO: 1334074 - RNA, 16 nt, Human
acuacuuugcugcuaa

SEQ ID NO: 1334075 - RNA, 13 nt, Human
acuacgccuggcu

SEQ ID NO: 1334076 - RNA, 19 nt, Human
acuacuaauagaauaaagg

SEQ ID NO: 1334077 - RNA, 17 nt, Human
acuaccuugaaaauaag

SEQ ID NO: 1334078 - RNA, 18 nt, Human
acuaccuugguuccccca

SEQ ID NO: 1334079 - RNA, 23 nt, Human
ucccccagcaaagcccccagagc

SEQ ID NO: 1334080 - RNA, 16 nt, Human
uccccacucugcucug

SEQ ID NO: 1334081 - RNA, 17 nt, Human
uccccacucugcucuga

SEQ ID NO: 1334082 - RNA, 20 nt, Human
uccccacucugcucugaugc

SEQ ID NO: 1334083 - RNA, 18 nt, Human
uccccacucugcucugau

SEQ ID NO: 1334084 - RNA, 12 nt, Human
uccccacuggag

SEQ ID NO: 1334085 - RNA, 13 nt, Human
uccccacuggagc

SEQ ID NO: 1334086 - RNA, 14 nt, Human
uccccacuggagca

SEQ ID NO: 1334087 - RNA, 15 nt, Human
uccccacuggagcag

SEQ ID NO: 1334088 - RNA, 15 nt, Human
uccccacuguaucua

SEQ ID NO: 1334089 - RNA, 19 nt, Human
uccccacuguaucuaggca

SEQ ID NO: 1334090 - RNA, 23 nt, Human
uccccauacuccuaugaucugag

SEQ ID NO: 1334091 - RNA, 18 nt, Human
uccccaucguugccccca

SEQ ID NO: 1334092 - RNA, 22 nt, Human
uccccaucguugcccccauuuc

SEQ ID NO: 1334093 - RNA, 13 nt, Human
uccccaucucagg

SEQ ID NO: 1334094 - RNA, 14 nt, Human
uccccaucucaggc

SEQ ID NO: 1334095 - RNA, 14 nt, Human
uccccaucuucuaa

SEQ ID NO: 1334096 - RNA, 10 nt, Human
ucccccaaga

SEQ ID NO: 1334097 - RNA, 12 nt, Human
ucccccacuuuc

SEQ ID NO: 1334098 - RNA, 21 nt, Human
ucccccagcaaagcccccaga

SEQ ID NO: 1334099 - RNA, 22 nt, Human
ucccccagcaaagcccccagag

SEQ ID NO: 1334100 - RNA, 16 nt, Human
acuauguaaacuacuu

SEQ ID NO: 1334101 - RNA, 14 nt, Human
acuauguaaacuac

SEQ ID NO: 1334102 - RNA, 14 nt, Human
acuauguaacaugu

SEQ ID NO: 1334103 - RNA, 12 nt, Human
acuauguaaacu

SEQ ID NO: 1334104 - RNA, 11 nt, Human
acuauguaaac

SEQ ID NO: 1334105 - RNA, 14 nt, Human
acuauguggaugug

SEQ ID NO: 1334106 - RNA, 13 nt, Human
acuauguugauaa

SEQ ID NO: 1334107 - RNA, 15 nt, Human
acuaugauuuggaaa

SEQ ID NO: 1334108 - RNA, 15 nt, Human
acuaugauuauuaac

SEQ ID NO: 1334109 - RNA, 19 nt, Human
acuaugauuuaauuugaaa

SEQ ID NO: 1334110 - RNA, 16 nt, Human
acuaugauuuggaaaa

SEQ ID NO: 1334111 - RNA, 20 nt, Human
acuaugcauggugccccagg

SEQ ID NO: 1334112 - RNA, 21 nt, Human
acuaugcauggugccccagga

SEQ ID NO: 1334113 - RNA, 22 nt, Human
acuaugcauggugccccaggac

SEQ ID NO: 1334114 - RNA, 23 nt, Human
acuaugcauggugccccaggacc

SEQ ID NO: 1334115 - RNA, 24 nt, Human
acuaugcauggugccccaggacca

SEQ ID NO: 1334116 - RNA, 20 nt, Human
acuagagucugaacagcugu

SEQ ID NO: 1334117 - RNA, 21 nt, Human
acuagagucugaacagcugua

SEQ ID NO: 1334118 - RNA, 13 nt, Human
acuagaugaugga

SEQ ID NO: 1334119 - RNA, 18 nt, Human
acucaaguugauuagaaa

SEQ ID NO: 1334120 - RNA, 16 nt, Human
uccccggacucaagcc

SEQ ID NO: 1334121 - RNA, 15 nt, Human
uccccuaaagccuca

SEQ ID NO: 1334122 - RNA, 22 nt, Human
uccccuaaagccucaaaacaaa

SEQ ID NO: 1334123 - RNA, 15 nt, Human
uccccuccuucccaa

SEQ ID NO: 1334124 - RNA, 13 nt, Human
uccccucugcugc

SEQ ID NO: 1334125 - RNA, 14 nt, Human
uccccucugcugcu

SEQ ID NO: 1334126 - RNA, 15 nt, Human
uccccucugcugcug

SEQ ID NO: 1334127 - RNA, 17 nt, Human
uccccucugcugcuguc

SEQ ID NO: 1334128 - RNA, 20 nt, Human
uccccucugcugcugucccu

SEQ ID NO: 1334129 - RNA, 14 nt, Human
uccauuuaaacaga

SEQ ID NO: 1334130 - RNA, 13 nt, Human
uccauuuaaacag

SEQ ID NO: 1334131 - RNA, 22 nt, Human
uccauugguccaagauuccgga

SEQ ID NO: 1334132 - RNA, 23 nt, Human
uccaugacugcuugcccuaagca

SEQ ID NO: 1334133 - RNA, 22 nt, Human
uccaugacugcuugcccuaagc

SEQ ID NO: 1334134 - RNA, 16 nt, Human
uccauuggaucucauu

SEQ ID NO: 1334135 - RNA, 15 nt, Human
uccauugguccaaga

SEQ ID NO: 1334136 - RNA, 16 nt, Human
uccauugguccaagau

SEQ ID NO: 1334137 - RNA, 18 nt, Human
uccauugguccaagauuc

SEQ ID NO: 1334138 - RNA, 19 nt, Human
uccauugguccaagauucc

SEQ ID NO: 1334139 - RNA, 20 nt, Human
uccaugaccuaguuuuccau

SEQ ID NO: 1334140 - RNA, 15 nt, Human
uccaugacaucaaga

SEQ ID NO: 1334141 - RNA, 13 nt, Human
uccaugacugcuu

SEQ ID NO: 1334142 - RNA, 15 nt, Human
uccaugacugcuugc

SEQ ID NO: 1334143 - RNA, 19 nt, Human
uccaugacugcuugcccua

SEQ ID NO: 1334144 - RNA, 20 nt, Human
uccaugacugcuugcccuaa

SEQ ID NO: 1334145 - RNA, 11 nt, Human
uccauccugag

SEQ ID NO: 1334146 - RNA, 21 nt, Human
uccaucugguagaagggaaag

SEQ ID NO: 1334147 - RNA, 22 nt, Human
uccaucugguagaagggaaagc

SEQ ID NO: 1334148 - RNA, 13 nt, Human
uccaucuuuacaa

SEQ ID NO: 1334149 - RNA, 14 nt, Human
uccaugacaucaag

SEQ ID NO: 1334150 - RNA, 14 nt, Human
acggccuuucuagc

SEQ ID NO: 1334151 - RNA, 21 nt, Human
acggccuuucuagccuggcua

SEQ ID NO: 1334152 - RNA, 15 nt, Human
uccagucuuccugac

SEQ ID NO: 1334153 - RNA, 19 nt, Human
uccagucuuccugacacuu

SEQ ID NO: 1334154 - RNA, 21 nt, Human
uccagucuuccugacacuuua

SEQ ID NO: 1334155 - RNA, 22 nt, Human
uccagucuuccugacacuuuaa

SEQ ID NO: 1334156 - RNA, 23 nt, Human
uccagucuuccugacacuuuaau

SEQ ID NO: 1334157 - RNA, 14 nt, Human
uccagugagacagc

SEQ ID NO: 1334158 - RNA, 16 nt, Human
uccauccuacccccug

SEQ ID NO: 1334159 - RNA, 13 nt, Human
uccaucccuggcc

SEQ ID NO: 1334160 - RNA, 14 nt, Human
uccaucccuggccc

SEQ ID NO: 1334161 - RNA, 15 nt, Human
uccaucccuggcccc

SEQ ID NO: 1334162 - RNA, 20 nt, Human
uccaucccuggcccccuccc

SEQ ID NO: 1334163 - RNA, 20 nt, Human
uccauccuacccccugugcc

SEQ ID NO: 1334164 - RNA, 22 nt, Human
uccaucccuggcccccucccug

SEQ ID NO: 1334165 - RNA, 23 nt, Human
uccaucccuggcccccucccugg

SEQ ID NO: 1334166 - RNA, 24 nt, Human
uccaucccuggcccccucccugga

SEQ ID NO: 1334167 - RNA, 16 nt, Human
ucccaauugagaaaaa

SEQ ID NO: 1334168 - RNA, 17 nt, Human
ucccaauuucagacucc

SEQ ID NO: 1334169 - RNA, 18 nt, Human
ucccaauuucagacuccc

SEQ ID NO: 1334170 - RNA, 23 nt, Human
ucccaauuucagacucccauucc

SEQ ID NO: 1334171 - RNA, 21 nt, Human
ucccaaagugcugggauuaca

SEQ ID NO: 1334172 - RNA, 15 nt, Human
ucccaauucacaucu

SEQ ID NO: 1334173 - RNA, 20 nt, Human
ucccaauucauccucacuca

SEQ ID NO: 1334174 - RNA, 18 nt, Human
ucccacaggacauuucuc

SEQ ID NO: 1334175 - RNA, 21 nt, Human
ucccacaggacauuucucuaa

SEQ ID NO: 1334176 - RNA, 15 nt, Human
ucccacaggcccuuc

SEQ ID NO: 1334177 - RNA, 17 nt, Human
ucccacaggcccuuccu

SEQ ID NO: 1334178 - RNA, 21 nt, Human
ucccacaggcccuuccucucc

SEQ ID NO: 1334179 - RNA, 22 nt, Human
ucccacaggcccuuccucucca

SEQ ID NO: 1334180 - RNA, 18 nt, Human
ucccacagguucaggcga

SEQ ID NO: 1334181 - RNA, 21 nt, Human
ucccacagucccaucugcuuc

SEQ ID NO: 1334182 - RNA, 16 nt, Human
uccauuugcauuuguu

SEQ ID NO: 1334183 - RNA, 15 nt, Human
uccauuugcaaggga

SEQ ID NO: 1334184 - RNA, 12 nt, Human
uccauuugcauu

SEQ ID NO: 1334185 - RNA, 15 nt, Human
uccauuugcauuugu

SEQ ID NO: 1334186 - RNA, 21 nt, Human
uccauuuaaacagauguccau

SEQ ID NO: 1334187 - RNA, 18 nt, Human
uccauuuaaacagauguc

SEQ ID NO: 1334188 - RNA, 15 nt, Human
uccauuuaaacagau

SEQ ID NO: 1334189 - RNA, 20 nt, Human
ucccaaagugcugggauuac

SEQ ID NO: 1334190 - RNA, 19 nt, Human
ucccacccaauucaaaaca

SEQ ID NO: 1334191 - RNA, 19 nt, Human
ucccaccccaaccugcucu

SEQ ID NO: 1334192 - RNA, 19 nt, Human
ucccaccaacccucagagc

SEQ ID NO: 1334193 - RNA, 22 nt, Human
ucccacaugggcccaggccuca

SEQ ID NO: 1334194 - RNA, 15 nt, Human
ucccacauuaaagaa

SEQ ID NO: 1334195 - RNA, 19 nt, Human
ucccacauuaaagaagacc

SEQ ID NO: 1334196 - RNA, 22 nt, Human
ucccacauuaaagaagaccuga

SEQ ID NO: 1334197 - RNA, 13 nt, Human
ucccacaucccug

SEQ ID NO: 1334198 - RNA, 14 nt, Human
ucccacaucccugg

SEQ ID NO: 1334199 - RNA, 15 nt, Human
ucccacaucccuggg

SEQ ID NO: 1334200 - RNA, 16 nt, Human
ucccacaucccugggc

SEQ ID NO: 1334201 - RNA, 17 nt, Human
ucccacaucccugggcc

SEQ ID NO: 1334202 - RNA, 18 nt, Human
ucccacaucccugggccu

SEQ ID NO: 1334203 - RNA, 20 nt, Human
ucccacaucccugggccugc

SEQ ID NO: 1334204 - RNA, 21 nt, Human
ucccacaucccugggccugcu

SEQ ID NO: 1334205 - RNA, 22 nt, Human
ucccacaucccugggccugcug

SEQ ID NO: 1334206 - RNA, 23 nt, Human
ucccacaucccugggccugcugc

SEQ ID NO: 1334207 - RNA, 13 nt, Human
ucccacaugggcc

SEQ ID NO: 1334208 - RNA, 16 nt, Human
ucccacaugggcccag

SEQ ID NO: 1334209 - RNA, 19 nt, Human
ucccacaugggcccaggcc

SEQ ID NO: 1334210 - RNA, 20 nt, Human
ucccaccccaaccugcucuc

SEQ ID NO: 1334211 - RNA, 21 nt, Human
ucccaccccaaccugcucucc

SEQ ID NO: 1334212 - RNA, 23 nt, Human
ucccaccccaaccugcucuccuc

SEQ ID NO: 1334213 - RNA, 22 nt, Human
ucccacccccacccccagcuca

SEQ ID NO: 1334214 - RNA, 23 nt, Human
ucccacccccacccccagcucaa

SEQ ID NO: 1334215 - RNA, 12 nt, Human
ucccacccucuu

SEQ ID NO: 1334216 - RNA, 15 nt, Human
ucccacccucuuccu

SEQ ID NO: 1334217 - RNA, 21 nt, Human
ucccacccucuuccuacuggu

SEQ ID NO: 1334218 - RNA, 24 nt, Human
ucccaccgcccagcggcuugccug

SEQ ID NO: 1334219 - RNA, 23 nt, Human
ucccaccgcccagcggcuugccu

SEQ ID NO: 1334220 - RNA, 16 nt, Human
ucccaccuagcagcac

SEQ ID NO: 1334221 - RNA, 15 nt, Human
acgggguuucaccau

SEQ ID NO: 1334222 - RNA, 15 nt, Human
acgggugccagaagc

SEQ ID NO: 1334223 - RNA, 15 nt, Human
acggcagccacagcu

SEQ ID NO: 1334224 - RNA, 20 nt, Human
acggcaccugggcccugggg

SEQ ID NO: 1334225 - RNA, 21 nt, Human
acggcaccugggcccuggggc

SEQ ID NO: 1334226 - RNA, 23 nt, Human
acggcaccugggcccuggggccu

SEQ ID NO: 1334227 - RNA, 17 nt, Human
acggccagggagaagcu

SEQ ID NO: 1334228 - RNA, 23 nt, Human
acggccagggagaagcuccucuc

SEQ ID NO: 1334229 - RNA, 18 nt, Human
acggccagggagaagcuc

SEQ ID NO: 1334230 - RNA, 12 nt, Human
acggauuccaaa

SEQ ID NO: 1334231 - RNA, 15 nt, Human
acggauuuauuuuuc

SEQ ID NO: 1334232 - RNA, 15 nt, Human
acggauuuucaguua

SEQ ID NO: 1334233 - RNA, 14 nt, Human
acggauuuucaguu

SEQ ID NO: 1334234 - RNA, 19 nt, Human
acggcaccugggcccuggg

SEQ ID NO: 1334235 - RNA, 12 nt, Human
acgcugcuguca

SEQ ID NO: 1334236 - RNA, 14 nt, Human
acgcugcugucaca

SEQ ID NO: 1334237 - RNA, 21 nt, Human
acggagccacuccucugacuc

SEQ ID NO: 1334238 - RNA, 17 nt, Human
acgcucucuggccuucg

SEQ ID NO: 1334239 - RNA, 16 nt, Human
acgcucucuggccuuc

SEQ ID NO: 1334240 - RNA, 15 nt, Human
acgcucucuggccuu

SEQ ID NO: 1334241 - RNA, 15 nt, Human
acgcccaggacccca

SEQ ID NO: 1334242 - RNA, 16 nt, Human
acgcccguccugccug

SEQ ID NO: 1334243 - RNA, 18 nt, Human
acgcccguccugccugug

SEQ ID NO: 1334244 - RNA, 19 nt, Human
acgcccguccugccugugg

SEQ ID NO: 1334245 - RNA, 20 nt, Human
acgcccguccugccuguggc

SEQ ID NO: 1334246 - RNA, 21 nt, Human
acgcccuuuccuccucaggca

SEQ ID NO: 1334247 - RNA, 17 nt, Human
acgcccuuuccuccuca

SEQ ID NO: 1334248 - RNA, 18 nt, Human
acgcccuuuccuccucag

SEQ ID NO: 1334249 - RNA, 21 nt, Human
acgacacggucggggcaucug

SEQ ID NO: 1334250 - RNA, 14 nt, Human
acgacacugcagcc

SEQ ID NO: 1334251 - RNA, 13 nt, Human
acgacacugcagc

SEQ ID NO: 1334252 - RNA, 12 nt, Human
acgacugucucc

SEQ ID NO: 1334253 - RNA, 20 nt, Human
acgagggcuggcuggccuca

SEQ ID NO: 1334254 - RNA, 11 nt, Human
acgagggcugg

SEQ ID NO: 1334255 - RNA, 12 nt, Human
acgagggcuggc

SEQ ID NO: 1334256 - RNA, 14 nt, Human
acgagggcuggcug

SEQ ID NO: 1334257 - RNA, 16 nt, Human
acgagggcuggcuggc

SEQ ID NO: 1334258 - RNA, 18 nt, Human
acgaggggugucuugggc

SEQ ID NO: 1334259 - RNA, 20 nt, Human
acgaggggugucuugggcag

SEQ ID NO: 1334260 - RNA, 21 nt, Human
acgaggggugucuugggcaga

SEQ ID NO: 1334261 - RNA, 16 nt, Human
uccaggcugccguggg

SEQ ID NO: 1334262 - RNA, 22 nt, Human
uccacgagcuguuuacuaggga

SEQ ID NO: 1334263 - RNA, 14 nt, Human
uccacggagccacu

SEQ ID NO: 1334264 - RNA, 15 nt, Human
uccacggagccacuc

SEQ ID NO: 1334265 - RNA, 20 nt, Human
uccacggagccacuccucug

SEQ ID NO: 1334266 - RNA, 21 nt, Human
uccacggagccacuccucuga

SEQ ID NO: 1334267 - RNA, 22 nt, Human
uccacggagccacuccucugac

SEQ ID NO: 1334268 - RNA, 14 nt, Human
acgaauacuuuugc

SEQ ID NO: 1334269 - RNA, 22 nt, Human
acgaauacuuuugcccuuugau

SEQ ID NO: 1334270 - RNA, 13 nt, Human
acgaaggagccca

SEQ ID NO: 1334271 - RNA, 14 nt, Human
acgaaggagcccau

SEQ ID NO: 1334272 - RNA, 14 nt, Human
uccagggacagagg

SEQ ID NO: 1334273 - RNA, 15 nt, Human
uccagggacagaggc

SEQ ID NO: 1334274 - RNA, 19 nt, Human
uccagggacagaggcccca

SEQ ID NO: 1334275 - RNA, 21 nt, Human
uccagggacagaggccccagc

SEQ ID NO: 1334276 - RNA, 23 nt, Human
uccagggacagaggccccagccu

SEQ ID NO: 1334277 - RNA, 12 nt, Human
uccagggacagc

SEQ ID NO: 1334278 - RNA, 14 nt, Human
uccagggacagcaa

SEQ ID NO: 1334279 - RNA, 13 nt, Human
uccagggacagca

SEQ ID NO: 1334280 - RNA, 14 nt, Human
uccagggaggcugg

SEQ ID NO: 1334281 - RNA, 17 nt, Human
uccagggaggcuggucc

SEQ ID NO: 1334282 - RNA, 22 nt, Human
uccagggaggcugguccuaugg

SEQ ID NO: 1334283 - RNA, 18 nt, Human
uccagggaggcugguccu

SEQ ID NO: 1334284 - RNA, 19 nt, Human
acgaaccuacaguuuuaac

SEQ ID NO: 1334285 - RNA, 18 nt, Human
uccacauuucccccuagc

SEQ ID NO: 1334286 - RNA, 12 nt, Human
uccacccagggg

SEQ ID NO: 1334287 - RNA, 22 nt, Human
uccacccaggggcagccccagg

SEQ ID NO: 1334288 - RNA, 22 nt, Human
uccaccccaauccucccagaaa

SEQ ID NO: 1334289 - RNA, 12 nt, Human
uccaccccaucc

SEQ ID NO: 1334290 - RNA, 20 nt, Human
uccaccccaucccuccccag

SEQ ID NO: 1334291 - RNA, 22 nt, Human
uccaccccaucccuccccaguu

SEQ ID NO: 1334292 - RNA, 17 nt, Human
accuggcccaucagggu

SEQ ID NO: 1334293 - RNA, 18 nt, Human
accuggcccaucagggua

SEQ ID NO: 1334294 - RNA, 15 nt, Human
accuggcccugcuuc

SEQ ID NO: 1334295 - RNA, 17 nt, Human
accuggcccugcuuccu

SEQ ID NO: 1334296 - RNA, 18 nt, Human
accuggcccugcuuccug

SEQ ID NO: 1334297 - RNA, 19 nt, Human
accuggcccugcuuccugc

SEQ ID NO: 1334298 - RNA, 16 nt, Human
accuggcugccauacu

SEQ ID NO: 1334299 - RNA, 22 nt, Human
accugggagaaaucuggcuucu

SEQ ID NO: 1334300 - RNA, 22 nt, Human
accugggaggcggauguugaag

SEQ ID NO: 1334301 - RNA, 17 nt, Human
accugggcaagcuggcg

SEQ ID NO: 1334302 - RNA, 13 nt, Human
accugggcccugg

SEQ ID NO: 1334303 - RNA, 14 nt, Human
accugggcccuggg

SEQ ID NO: 1334304 - RNA, 15 nt, Human
accugggcccugggg

SEQ ID NO: 1334305 - RNA, 16 nt, Human
accugggcccuggggc

SEQ ID NO: 1334306 - RNA, 18 nt, Human
accugggcccuggggccu

SEQ ID NO: 1334307 - RNA, 19 nt, Human
accugggcccuggggccug

SEQ ID NO: 1334308 - RNA, 21 nt, Human
uccaaugagcuuucugaacag

SEQ ID NO: 1334309 - RNA, 15 nt, Human
uccaaugucuggaga

SEQ ID NO: 1334310 - RNA, 16 nt, Human
uccaaugucuggagac

SEQ ID NO: 1334311 - RNA, 17 nt, Human
uccaaugucuggagacc

SEQ ID NO: 1334312 - RNA, 18 nt, Human
uccaaugucuggagacca

SEQ ID NO: 1334313 - RNA, 20 nt, Human
uccaauuagcuuauguuaac

SEQ ID NO: 1334314 - RNA, 15 nt, Human
uccaauuaguuuccu

SEQ ID NO: 1334315 - RNA, 17 nt, Human
uccaauuagcuuauguu

SEQ ID NO: 1334316 - RNA, 23 nt, Human
uccaaugucuggagaccaccagg

SEQ ID NO: 1334317 - RNA, 18 nt, Human
uccaauguggcaaggaaa

SEQ ID NO: 1334318 - RNA, 16 nt, Human
uccaauuaguuuccuu

SEQ ID NO: 1334319 - RNA, 19 nt, Human
uccaauuaguuuccuuuuu

SEQ ID NO: 1334320 - RNA, 20 nt, Human
uccaauuaguuuccuuuuua

SEQ ID NO: 1334321 - RNA, 23 nt, Human
uccaauuaguuuccuuuuuaaua

SEQ ID NO: 1334322 - RNA, 22 nt, Human
uccaauuauaagaggauaugaa

SEQ ID NO: 1334323 - RNA, 19 nt, Human
uccacauacccugaccugg

SEQ ID NO: 1334324 - RNA, 12 nt, Human
uccacauccucc

SEQ ID NO: 1334325 - RNA, 13 nt, Human
uccacauccucca

SEQ ID NO: 1334326 - RNA, 19 nt, Human
uccacauccuccacguucu

SEQ ID NO: 1334327 - RNA, 16 nt, Human
uccacauagguuuaga

SEQ ID NO: 1334328 - RNA, 15 nt, Human
uccacaugggagccg

SEQ ID NO: 1334329 - RNA, 19 nt, Human
uccaaaugcagcuuuaaaa

SEQ ID NO: 1334330 - RNA, 18 nt, Human
uccaaauggcgucuggaa

SEQ ID NO: 1334331 - RNA, 20 nt, Human
uccaaauggcgucuggaagu

SEQ ID NO: 1334332 - RNA, 12 nt, Human
uccaaauucagu

SEQ ID NO: 1334333 - RNA, 14 nt, Human
uccaaauucaguuu

SEQ ID NO: 1334334 - RNA, 16 nt, Human
uccaaauucaguuuca

SEQ ID NO: 1334335 - RNA, 18 nt, Human
uccaaauucaguuucaua

SEQ ID NO: 1334336 - RNA, 19 nt, Human
uccaaauucaguuucauaa

SEQ ID NO: 1334337 - RNA, 23 nt, Human
uccaacaagaagggacugagaga

SEQ ID NO: 1334338 - RNA, 20 nt, Human
uccaaggaggggcuguaaaa

SEQ ID NO: 1334339 - RNA, 21 nt, Human
uccaaggggaaucagaacuca

SEQ ID NO: 1334340 - RNA, 22 nt, Human
accuucucuauggggcauccuc

SEQ ID NO: 1334341 - RNA, 23 nt, Human
accuucucuauggggcauccucu

SEQ ID NO: 1334342 - RNA, 15 nt, Human
accuucugaguacag

SEQ ID NO: 1334343 - RNA, 18 nt, Human
accuugccugguacagua

SEQ ID NO: 1334344 - RNA, 15 nt, Human
accuugccugguaca

SEQ ID NO: 1334345 - RNA, 20 nt, Human
accugggcccuggggccugu

SEQ ID NO: 1334346 - RNA, 21 nt, Human
accugggcccuggggccugua

SEQ ID NO: 1334347 - RNA, 23 nt, Human
accugggcccuggggccuguacu

SEQ ID NO: 1334348 - RNA, 19 nt, Human
accuucaguuaugauuuuu

SEQ ID NO: 1334349 - RNA, 17 nt, Human
accuucccaugcccugg

SEQ ID NO: 1334350 - RNA, 14 nt, Human
accuuccucaucua

SEQ ID NO: 1334351 - RNA, 13 nt, Human
accuuccuuuuac

SEQ ID NO: 1334352 - RNA, 15 nt, Human
accuucgccaccugg

SEQ ID NO: 1334353 - RNA, 17 nt, Human
accuucgccaccugggu

SEQ ID NO: 1334354 - RNA, 14 nt, Human
accuucgggcugug

SEQ ID NO: 1334355 - RNA, 15 nt, Human
accuucgggcugugc

SEQ ID NO: 1334356 - RNA, 16 nt, Human
accuucgggcugugcc

SEQ ID NO: 1334357 - RNA, 17 nt, Human
accuucgggcugugccc

SEQ ID NO: 1334358 - RNA, 18 nt, Human
accuucgggcugugcccg

SEQ ID NO: 1334359 - RNA, 20 nt, Human
accuuccuuuuacuuuucuu

SEQ ID NO: 1334360 - RNA, 21 nt, Human
accuuccuuuuacuuuucuuc

SEQ ID NO: 1334361 - RNA, 23 nt, Human
accugccucccuucaugcaugga

SEQ ID NO: 1334362 - RNA, 21 nt, Human
accugccucccuucaugcaug

SEQ ID NO: 1334363 - RNA, 22 nt, Human
accugccucccuucaugcaugg

SEQ ID NO: 1334364 - RNA, 17 nt, Human
accugccucggccuccc

SEQ ID NO: 1334365 - RNA, 15 nt, Human
accugcaaagaucug

SEQ ID NO: 1334366 - RNA, 16 nt, Human
accugcaaagaucugu

SEQ ID NO: 1334367 - RNA, 22 nt, Human
accugcaaagaucuguccucag

SEQ ID NO: 1334368 - RNA, 16 nt, Human
accugagccugccgag

SEQ ID NO: 1334369 - RNA, 14 nt, Human
accugaggcugguu

SEQ ID NO: 1334370 - RNA, 12 nt, Human
accugaggcugu

SEQ ID NO: 1334371 - RNA, 14 nt, Human
accugaggcugugg

SEQ ID NO: 1334372 - RNA, 13 nt, Human
accugauccugga

SEQ ID NO: 1334373 - RNA, 20 nt, Human
accugauccuggaggcccag

SEQ ID NO: 1334374 - RNA, 22 nt, Human
accugauccuggaggcccaguu

SEQ ID NO: 1334375 - RNA, 13 nt, Human
accugaugaaaau

SEQ ID NO: 1334376 - RNA, 14 nt, Human
accugaugaaaaua

SEQ ID NO: 1334377 - RNA, 16 nt, Human
accugauuuuuuuucc

SEQ ID NO: 1334378 - RNA, 17 nt, Human
accugauuuuuuuuccu

SEQ ID NO: 1334379 - RNA, 20 nt, Human
accugauuuuuuuuccuuuu

SEQ ID NO: 1334380 - RNA, 15 nt, Human
accugaugaaaauaa

SEQ ID NO: 1334381 - RNA, 18 nt, Human
accugaugaaaauaaaga

SEQ ID NO: 1334382 - RNA, 19 nt, Human
accugaugaaaauaaagaa

SEQ ID NO: 1334383 - RNA, 21 nt, Human
accugaugaaaauaaagaaug

SEQ ID NO: 1334384 - RNA, 22 nt, Human
accugaugaaaauaaagaaugg

SEQ ID NO: 1334385 - RNA, 16 nt, Human
ucauaauaaguugcau

SEQ ID NO: 1334386 - RNA, 20 nt, Human
ucauaaggcuucaaaauguu

SEQ ID NO: 1334387 - RNA, 19 nt, Human
accugaaauuccaaagucu

SEQ ID NO: 1334388 - RNA, 20 nt, Human
accugaaauuccaaagucuc

SEQ ID NO: 1334389 - RNA, 22 nt, Human
accugaaauuccaaagucucua

SEQ ID NO: 1334390 - RNA, 16 nt, Human
accugaacugaacacc

SEQ ID NO: 1334391 - RNA, 11 nt, Human
accugaagaau

SEQ ID NO: 1334392 - RNA, 14 nt, Human
accugaagaaucac

SEQ ID NO: 1334393 - RNA, 16 nt, Human
accugaagaaucacaa

SEQ ID NO: 1334394 - RNA, 22 nt, Human
accugaagcuaucguaaaauua

SEQ ID NO: 1334395 - RNA, 19 nt, Human
accugacacaccaggcgcu

SEQ ID NO: 1334396 - RNA, 21 nt, Human
accugacacaccaggcgcuaa

SEQ ID NO: 1334397 - RNA, 16 nt, Human
accugacacucccuug

SEQ ID NO: 1334398 - RNA, 17 nt, Human
accugacacucccuugg

SEQ ID NO: 1334399 - RNA, 17 nt, Human
accugaccccugacccc

SEQ ID NO: 1334400 - RNA, 19 nt, Human
accugacacucccuugggc

SEQ ID NO: 1334401 - RNA, 15 nt, Human
accugaccccugcuc

SEQ ID NO: 1334402 - RNA, 10 nt, Human
accugagccu

SEQ ID NO: 1334403 - RNA, 12 nt, Human
accugagccugc

SEQ ID NO: 1334404 - RNA, 13 nt, Human
accugagccugcc

SEQ ID NO: 1334405 - RNA, 14 nt, Human
accugagccugccg

SEQ ID NO: 1334406 - RNA, 17 nt, Human
accugagccccaaaagg

SEQ ID NO: 1334407 - RNA, 12 nt, Human
accugagcccca

SEQ ID NO: 1334408 - RNA, 21 nt, Human
accugcugucuggguggcuca

SEQ ID NO: 1334409 - RNA, 20 nt, Human
accugcugugauacgaugcu

SEQ ID NO: 1334410 - RNA, 21 nt, Human
accugcugugauacgaugcuu

SEQ ID NO: 1334411 - RNA, 15 nt, Human
accuggaccccugca

SEQ ID NO: 1334412 - RNA, 16 nt, Human
accuggaccccugcau

SEQ ID NO: 1334413 - RNA, 20 nt, Human
accuggaccccugcauugga

SEQ ID NO: 1334414 - RNA, 21 nt, Human
accuggaccccugcauuggaa

SEQ ID NO: 1334415 - RNA, 22 nt, Human
accuggacuuaagcaucuggcu

SEQ ID NO: 1334416 - RNA, 12 nt, Human
accugcucuccu

SEQ ID NO: 1334417 - RNA, 13 nt, Human
accugcucuccuc

SEQ ID NO: 1334418 - RNA, 14 nt, Human
accugcucuccucu

SEQ ID NO: 1334419 - RNA, 15 nt, Human
accugcucuccucuu

SEQ ID NO: 1334420 - RNA, 16 nt, Human
accugcucuccucuuc

SEQ ID NO: 1334421 - RNA, 18 nt, Human
accugcugagcucugaga

SEQ ID NO: 1334422 - RNA, 17 nt, Human
accugcucuccucuucu

SEQ ID NO: 1334423 - RNA, 23 nt, Human
accugcucuccucuucuacucac

SEQ ID NO: 1334424 - RNA, 19 nt, Human
accugcugagcucugagag

SEQ ID NO: 1334425 - RNA, 20 nt, Human
accugcugagcucugagagg

SEQ ID NO: 1334426 - RNA, 23 nt, Human
accugcugagcucugagaggccc

SEQ ID NO: 1334427 - RNA, 21 nt, Human
accugcugagcucugagaggc

SEQ ID NO: 1334428 - RNA, 21 nt, Human
accugccucggccucccaaag

SEQ ID NO: 1334429 - RNA, 23 nt, Human
accugccucggccucccaaagug

SEQ ID NO: 1334430 - RNA, 21 nt, Human
accugccugacauuuggagug

SEQ ID NO: 1334431 - RNA, 16 nt, Human
accugcggcccaaucc

SEQ ID NO: 1334432 - RNA, 18 nt, Human
accugcuaggccagagcc

SEQ ID NO: 1334433 - RNA, 21 nt, Human
accugcuaggccagagcccac

SEQ ID NO: 1334434 - RNA, 22 nt, Human
accugcuaggccagagcccacu

SEQ ID NO: 1334435 - RNA, 16 nt, Human
accugcucacgucaaa

SEQ ID NO: 1334436 - RNA, 20 nt, Human
accugcucacgucaaaugca

SEQ ID NO: 1334437 - RNA, 16 nt, Human
accugcucagcccugc

SEQ ID NO: 1334438 - RNA, 17 nt, Human
accugcucagcccugca

SEQ ID NO: 1334439 - RNA, 14 nt, Human
ucauuuuugaauac

SEQ ID NO: 1334440 - RNA, 15 nt, Human
ucauuuuuccguaaa

SEQ ID NO: 1334441 - RNA, 20 nt, Human
ucauuuuuuuucuuugaaua

SEQ ID NO: 1334442 - RNA, 22 nt, Human
ucauuuuuuuucuuugaauaaa

SEQ ID NO: 1334443 - RNA, 23 nt, Human
ucauuuuuuuucuuugaauaaau

SEQ ID NO: 1334444 - RNA, 12 nt, Human
ucauuuuuacaa

SEQ ID NO: 1334445 - RNA, 20 nt, Human
ucauuuuuacaauguaauua

SEQ ID NO: 1334446 - RNA, 21 nt, Human
ucauuuuuacaauguaauuau

SEQ ID NO: 1334447 - RNA, 19 nt, Human
ucauuuuucaauagcacau

SEQ ID NO: 1334448 - RNA, 22 nt, Human
ucauuuugguaaaauacuucuu

SEQ ID NO: 1334449 - RNA, 14 nt, Human
ucauuuugguacuu

SEQ ID NO: 1334450 - RNA, 16 nt, Human
ucauuugcuuuggaag

SEQ ID NO: 1334451 - RNA, 18 nt, Human
ucauuugguucauuaauu

SEQ ID NO: 1334452 - RNA, 16 nt, Human
accuggagauggugga

SEQ ID NO: 1334453 - RNA, 20 nt, Human
ucauuugguucauuaauucu

SEQ ID NO: 1334454 - RNA, 12 nt, Human
ucauuuucucua

SEQ ID NO: 1334455 - RNA, 13 nt, Human
ucauuuucucuaa

SEQ ID NO: 1334456 - RNA, 15 nt, Human
ucauuuucucuaaua

SEQ ID NO: 1334457 - RNA, 16 nt, Human
ucauuuucucuaauau

SEQ ID NO: 1334458 - RNA, 14 nt, Human
ucauuuucucucag

SEQ ID NO: 1334459 - RNA, 15 nt, Human
ucauuuucucucagg

SEQ ID NO: 1334460 - RNA, 15 nt, Human
uagaaacacaacuau

SEQ ID NO: 1334461 - RNA, 16 nt, Human
uagaaacagugcaaca

SEQ ID NO: 1334462 - RNA, 22 nt, Human
uagaaaauuuaaaacauuacuc

SEQ ID NO: 1334463 - RNA, 22 nt, Human
uagaaaauuuguuauuuugcaa

SEQ ID NO: 1334464 - RNA, 23 nt, Human
uagaaaauuuguuauuuugcaac

SEQ ID NO: 1334465 - RNA, 16 nt, Human
uagaaaauuagacugu

SEQ ID NO: 1334466 - RNA, 13 nt, Human
uagaaacaaaaua

SEQ ID NO: 1334467 - RNA, 16 nt, Human
uagaaacaaaauacaa

SEQ ID NO: 1334468 - RNA, 17 nt, Human
uagaaacaaaauacaau

SEQ ID NO: 1334469 - RNA, 13 nt, Human
uagaaacaacacu

SEQ ID NO: 1334470 - RNA, 16 nt, Human
uagaaacaacacugua

SEQ ID NO: 1334471 - RNA, 17 nt, Human
uagaaacaacacuguag

SEQ ID NO: 1334472 - RNA, 18 nt, Human
uagaaacaacacuguagu

SEQ ID NO: 1334473 - RNA, 19 nt, Human
uagaaacaacacuguagua

SEQ ID NO: 1334474 - RNA, 20 nt, Human
uagaaacaacacuguaguaa

SEQ ID NO: 1334475 - RNA, 11 nt, Human
uagaaaacuuu

SEQ ID NO: 1334476 - RNA, 16 nt, Human
uagaaaacuuuaaagc

SEQ ID NO: 1334477 - RNA, 15 nt, Human
uagaaaacuuuaaag

SEQ ID NO: 1334478 - RNA, 17 nt, Human
uagaaaaggacuauaag

SEQ ID NO: 1334479 - RNA, 21 nt, Human
uagaaaaggcuagguacacag

SEQ ID NO: 1334480 - RNA, 16 nt, Human
uagaaaaguauguucu

SEQ ID NO: 1334481 - RNA, 18 nt, Human
uagaaaaguauguucuaa

SEQ ID NO: 1334482 - RNA, 12 nt, Human
uagaaaaugguc

SEQ ID NO: 1334483 - RNA, 17 nt, Human
uagaaaauuuaaaacau

SEQ ID NO: 1334484 - RNA, 18 nt, Human
uagaagacaaaauguuca

SEQ ID NO: 1334485 - RNA, 18 nt, Human
uagaacucccuuucaaca

SEQ ID NO: 1334486 - RNA, 17 nt, Human
uagaacucccuuucaac

SEQ ID NO: 1334487 - RNA, 16 nt, Human
uagaacucccuuucaa

SEQ ID NO: 1334488 - RNA, 15 nt, Human
uagaaaaaaaauuau

SEQ ID NO: 1334489 - RNA, 13 nt, Human
uacuuuuuauaua

SEQ ID NO: 1334490 - RNA, 16 nt, Human
uacuuuuuauauauau

SEQ ID NO: 1334491 - RNA, 14 nt, Human
uacuuuuuauauau

SEQ ID NO: 1334492 - RNA, 14 nt, Human
uagaaaaacaggca

SEQ ID NO: 1334493 - RNA, 15 nt, Human
uagaaaaacaggcac

SEQ ID NO: 1334494 - RNA, 16 nt, Human
uagaaaaacaggcacu

SEQ ID NO: 1334495 - RNA, 16 nt, Human
uagaaaacauaaucuu

SEQ ID NO: 1334496 - RNA, 23 nt, Human
uacuuuuacaaguaacaaaaaua

SEQ ID NO: 1334497 - RNA, 20 nt, Human
uacuuuuacaaguaacaaaa

SEQ ID NO: 1334498 - RNA, 22 nt, Human
uacuuuucuucuauugccucug

SEQ ID NO: 1334499 - RNA, 21 nt, Human
uacuuuucuucuauugccucu

SEQ ID NO: 1334500 - RNA, 15 nt, Human
uacuuuugcccuuug

SEQ ID NO: 1334501 - RNA, 14 nt, Human
uacuuuuuaaaugu

SEQ ID NO: 1334502 - RNA, 21 nt, Human
aauucauuaaucugccucccu

SEQ ID NO: 1334503 - RNA, 16 nt, Human
aauuccacaccuuuua

SEQ ID NO: 1334504 - RNA, 12 nt, Human
aauuccacagcu

SEQ ID NO: 1334505 - RNA, 13 nt, Human
aauuccacagcug

SEQ ID NO: 1334506 - RNA, 14 nt, Human
aauuccacagcugc

SEQ ID NO: 1334507 - RNA, 20 nt, Human
aauuccacaccuuuuauuga

SEQ ID NO: 1334508 - RNA, 13 nt, Human
aauuccacucaaa

SEQ ID NO: 1334509 - RNA, 20 nt, Human
uacuuuggggcuaauuuaac

SEQ ID NO: 1334510 - RNA, 22 nt, Human
uacuuugguggccacauaagcc

SEQ ID NO: 1334511 - RNA, 17 nt, Human
uacuuuggaauucuuag

SEQ ID NO: 1334512 - RNA, 22 nt, Human
uagaauuugauaugugaacagu

SEQ ID NO: 1334513 - RNA, 16 nt, Human
uagaaguauaaagaau

SEQ ID NO: 1334514 - RNA, 17 nt, Human
uagaaguauaaagaauu

SEQ ID NO: 1334515 - RNA, 13 nt, Human
uagaauuugauua

SEQ ID NO: 1334516 - RNA, 20 nt, Human
uagaauuugauaugugaaca

SEQ ID NO: 1334517 - RNA, 19 nt, Human
uagaaguauaaagaauugu

SEQ ID NO: 1334518 - RNA, 20 nt, Human
uagaagacaauugacaacag

SEQ ID NO: 1334519 - RNA, 18 nt, Human
uagaaggcuguggugagg

SEQ ID NO: 1334520 - RNA, 23 nt, Human
uagaaggcuguggugagggaaga

SEQ ID NO: 1334521 - RNA, 17 nt, Human
uagaagggaaagcccau

SEQ ID NO: 1334522 - RNA, 13 nt, Human
uagacacacauga

SEQ ID NO: 1334523 - RNA, 13 nt, Human
uagacacaugaag

SEQ ID NO: 1334524 - RNA, 19 nt, Human
uagacacaugaagguaaau

SEQ ID NO: 1334525 - RNA, 20 nt, Human
uagacacaugaagguaaaua

SEQ ID NO: 1334526 - RNA, 22 nt, Human
uagacacaugaagguaaauaaa

SEQ ID NO: 1334527 - RNA, 21 nt, Human
uagacacaugaagguaaauaa

SEQ ID NO: 1334528 - RNA, 14 nt, Human
uagacaccaaaguu

SEQ ID NO: 1334529 - RNA, 17 nt, Human
uagacaccaaaguucua

SEQ ID NO: 1334530 - RNA, 18 nt, Human
uagacaccaaaguucuaa

SEQ ID NO: 1334531 - RNA, 20 nt, Human
uagacaccaaaguucuaaua

SEQ ID NO: 1334532 - RNA, 21 nt, Human
uagacaccaaaguucuaauaa

SEQ ID NO: 1334533 - RNA, 16 nt, Human
uagacacgcacggcag

SEQ ID NO: 1334534 - RNA, 21 nt, Human
uagacacuccccgaagucuuu

SEQ ID NO: 1334535 - RNA, 15 nt, Human
uagacacuuuggaag

SEQ ID NO: 1334536 - RNA, 14 nt, Human
uagacagaacaccu

SEQ ID NO: 1334537 - RNA, 15 nt, Human
uagacagaacaccua

SEQ ID NO: 1334538 - RNA, 12 nt, Human
uagacagaagaa

SEQ ID NO: 1334539 - RNA, 14 nt, Human
uagacagaagaaac

SEQ ID NO: 1334540 - RNA, 23 nt, Human
aauuuggaucucuucuuaaugua

SEQ ID NO: 1334541 - RNA, 12 nt, Human
aauuuggauuua

SEQ ID NO: 1334542 - RNA, 23 nt, Human
aauuuggauuuaaaagccugcuc

SEQ ID NO: 1334543 - RNA, 13 nt, Human
aauuuggcaauuu

SEQ ID NO: 1334544 - RNA, 18 nt, Human
aauuuggcaauuuugugg

SEQ ID NO: 1334545 - RNA, 15 nt, Human
aauuuggcaauuuug

SEQ ID NO: 1334546 - RNA, 16 nt, Human
aauuuuaaugaagaaa

SEQ ID NO: 1334547 - RNA, 18 nt, Human
uagacagucucacuuugu

SEQ ID NO: 1334548 - RNA, 15 nt, Human
uagacagaagaaaca

SEQ ID NO: 1334549 - RNA, 15 nt, Human
uagacagaggcccuc

SEQ ID NO: 1334550 - RNA, 19 nt, Human
uagacagaggcccucaagu

SEQ ID NO: 1334551 - RNA, 17 nt, Human
uagacauggagguucua

SEQ ID NO: 1334552 - RNA, 18 nt, Human
uagacauggagguucuaa

SEQ ID NO: 1334553 - RNA, 19 nt, Human
uagacauggagguucuaag

SEQ ID NO: 1334554 - RNA, 20 nt, Human
uagacauggagguucuaagg

SEQ ID NO: 1334555 - RNA, 21 nt, Human
uagacauggagguucuaaggc

SEQ ID NO: 1334556 - RNA, 22 nt, Human
uagacauggagguucuaaggcc

SEQ ID NO: 1334557 - RNA, 23 nt, Human
uagacauggagguucuaaggccu

SEQ ID NO: 1334558 - RNA, 22 nt, Human
aauuuggaucucuucuuaaugu

SEQ ID NO: 1334559 - RNA, 13 nt, Human
uagaccaaaauaa

SEQ ID NO: 1334560 - RNA, 14 nt, Human
uagaccaaaauaaa

SEQ ID NO: 1334561 - RNA, 12 nt, Human
aauuuuacauuu

SEQ ID NO: 1334562 - RNA, 20 nt, Human
aauuuuacauggcuggagcu

SEQ ID NO: 1334563 - RNA, 19 nt, Human
aauuuuacacgcuuuugug

SEQ ID NO: 1334564 - RNA, 20 nt, Human
aauuuuacacgcuuuuguga

SEQ ID NO: 1334565 - RNA, 16 nt, Human
acaaaaagcuacuuau

SEQ ID NO: 1334566 - RNA, 20 nt, Human
acaaaaagccacaaugaaca

SEQ ID NO: 1334567 - RNA, 19 nt, Human
acaaaaagcuaauaccagu

SEQ ID NO: 1334568 - RNA, 14 nt, Human
acaaaaauuaaaau

SEQ ID NO: 1334569 - RNA, 20 nt, Human
acaaaaagguucucaggugu

SEQ ID NO: 1334570 - RNA, 12 nt, Human
acaaaaauaaaa

SEQ ID NO: 1334571 - RNA, 16 nt, Human
acaaaaauacucagau

SEQ ID NO: 1334572 - RNA, 13 nt, Human
acaaaaauauaaa

SEQ ID NO: 1334573 - RNA, 13 nt, Human
acaaaacaaacuc

SEQ ID NO: 1334574 - RNA, 19 nt, Human
acaaaacaaagcaauucuu

SEQ ID NO: 1334575 - RNA, 19 nt, Human
acaaaaccccccagauauc

SEQ ID NO: 1334576 - RNA, 20 nt, Human
acaaaaccccccagauauca

SEQ ID NO: 1334577 - RNA, 15 nt, Human
acaaaacuacaugag

SEQ ID NO: 1334578 - RNA, 22 nt, Human
acaaaaguuucauccuuuucau

SEQ ID NO: 1334579 - RNA, 12 nt, Human
acaaaauaaaca

SEQ ID NO: 1334580 - RNA, 14 nt, Human
acaaaauaaacaaa

SEQ ID NO: 1334581 - RNA, 14 nt, Human
acaaauaauuuaga

SEQ ID NO: 1334582 - RNA, 13 nt, Human
acaaauaauuuag

SEQ ID NO: 1334583 - RNA, 23 nt, Human
acaaagguuuaaaugaacaagag

SEQ ID NO: 1334584 - RNA, 16 nt, Human
acaaauacuaaaaaga

SEQ ID NO: 1334585 - RNA, 16 nt, Human
acaaauaacaagaaua

SEQ ID NO: 1334586 - RNA, 16 nt, Human
acaaauaacaaugugc

SEQ ID NO: 1334587 - RNA, 21 nt, Human
acaaagguuuuccucuucuau

SEQ ID NO: 1334588 - RNA, 22 nt, Human
acaaaauaaccaauccuggaca

SEQ ID NO: 1334589 - RNA, 20 nt, Human
acaaaaucagguaacuaacu

SEQ ID NO: 1334590 - RNA, 24 nt, Human
acaaagguugagauguaaaaggua

SEQ ID NO: 1334591 - RNA, 14 nt, Human
acaaagguuuaaau

SEQ ID NO: 1334592 - RNA, 15 nt, Human
acaaagguuuaaaug

SEQ ID NO: 1334593 - RNA, 16 nt, Human
acaaagguuuaaauga

SEQ ID NO: 1334594 - RNA, 17 nt, Human
acaaagguuuaaaugaa

SEQ ID NO: 1334595 - RNA, 18 nt, Human
acaaagguuuaaaugaac

SEQ ID NO: 1334596 - RNA, 19 nt, Human
acaaagguuuaaaugaaca

SEQ ID NO: 1334597 - RNA, 20 nt, Human
acaaagguuuaaaugaacaa

SEQ ID NO: 1334598 - RNA, 22 nt, Human
acaaagguuuaaaugaacaaga

SEQ ID NO: 1334599 - RNA, 19 nt, Human
acaaauaggaugcuuggga

SEQ ID NO: 1334600 - RNA, 18 nt, Human
uagagccgggugucccca

SEQ ID NO: 1334601 - RNA, 14 nt, Human
uagagccugaggga

SEQ ID NO: 1334602 - RNA, 13 nt, Human
acaaauagaaaau

SEQ ID NO: 1334603 - RNA, 15 nt, Human
acaaauagaaaaugg

SEQ ID NO: 1334604 - RNA, 16 nt, Human
acaaauagaaaauggu

SEQ ID NO: 1334605 - RNA, 21 nt, Human
uagagccggguguccccaaca

SEQ ID NO: 1334606 - RNA, 17 nt, Human
uagagccuguaaacuuu

SEQ ID NO: 1334607 - RNA, 10 nt, Human
uagagcuccu

SEQ ID NO: 1334608 - RNA, 13 nt, Human
uagagcuccuccc

SEQ ID NO: 1334609 - RNA, 21 nt, Human
uagaggccugacugccaagcc

SEQ ID NO: 1334610 - RNA, 22 nt, Human
uagaggccugacugccaagcca

SEQ ID NO: 1334611 - RNA, 16 nt, Human
uagaggcuuccuucau

SEQ ID NO: 1334612 - RNA, 17 nt, Human
uagaggcuuccuucauu

SEQ ID NO: 1334613 - RNA, 18 nt, Human
uagaggcuuccuucauuu

SEQ ID NO: 1334614 - RNA, 19 nt, Human
uagaggcuuccuucauuuc

SEQ ID NO: 1334615 - RNA, 14 nt, Human
uagaggguguguaa

SEQ ID NO: 1334616 - RNA, 23 nt, Human
uagagggaggagaaugagccucg

SEQ ID NO: 1334617 - RNA, 14 nt, Human
uagcaaaagaagaa

SEQ ID NO: 1334618 - RNA, 16 nt, Human
uagcaaaagaagaagu

SEQ ID NO: 1334619 - RNA, 12 nt, Human
uagcaaagaauu

SEQ ID NO: 1334620 - RNA, 14 nt, Human
uagcaaagaauuga

SEQ ID NO: 1334621 - RNA, 16 nt, Human
uagcaaagauaucuca

SEQ ID NO: 1334622 - RNA, 13 nt, Human
uagcacaaguuau

SEQ ID NO: 1334623 - RNA, 19 nt, Human
uagcacaaguuauuuaaau

SEQ ID NO: 1334624 - RNA, 14 nt, Human
uagccaaaccucac

SEQ ID NO: 1334625 - RNA, 22 nt, Human
uagccaaaccucaccaacuccu

SEQ ID NO: 1334626 - RNA, 17 nt, Human
uagccaaaccucaccaa

SEQ ID NO: 1334627 - RNA, 20 nt, Human
uagccacauuuggaauacuu

SEQ ID NO: 1334628 - RNA, 21 nt, Human
uagccacauuuggaauacuuu

SEQ ID NO: 1334629 - RNA, 20 nt, Human
uagccacuaaccuugccugg

SEQ ID NO: 1334630 - RNA, 21 nt, Human
uagccacuaaccuugccuggu

SEQ ID NO: 1334631 - RNA, 14 nt, Human
acaaaucagaaguc

SEQ ID NO: 1334632 - RNA, 15 nt, Human
acaaaucagaaguca

SEQ ID NO: 1334633 - RNA, 16 nt, Human
acaaaucagaagucau

SEQ ID NO: 1334634 - RNA, 23 nt, Human
acaaaucagaagucaucuugcua

SEQ ID NO: 1334635 - RNA, 14 nt, Human
uagcuaaguacaca

SEQ ID NO: 1334636 - RNA, 18 nt, Human
uagcguucuuguaauuuu

SEQ ID NO: 1334637 - RNA, 22 nt, Human
uagcguuuuuuaaauguauacu

SEQ ID NO: 1334638 - RNA, 18 nt, Human
uagcuaaacggauuccaa

SEQ ID NO: 1334639 - RNA, 19 nt, Human
uagcuaaacggauuccaaa

SEQ ID NO: 1334640 - RNA, 20 nt, Human
uagcuaaacggauuccaaag

SEQ ID NO: 1334641 - RNA, 22 nt, Human
uagcuucccuccccucuaguuu

SEQ ID NO: 1334642 - RNA, 16 nt, Human
uagcuuuaacuuaaau

SEQ ID NO: 1334643 - RNA, 22 nt, Human
uagcuuuaacuuaaauaguauu

SEQ ID NO: 1334644 - RNA, 23 nt, Human
uagcuuuaaugauaugcuuguaa

SEQ ID NO: 1334645 - RNA, 13 nt, Human
uagcuuuuuucuc

SEQ ID NO: 1334646 - RNA, 23 nt, Human
uagcuuuuuucucugauacagaa

SEQ ID NO: 1334647 - RNA, 20 nt, Human
uagcuuuugugggggacugu

SEQ ID NO: 1334648 - RNA, 13 nt, Human
uagcuuuucccuu

SEQ ID NO: 1334649 - RNA, 12 nt, Human
uagcuuuugugg

SEQ ID NO: 1334650 - RNA, 19 nt, Human
uagcuuuugugggggacug

SEQ ID NO: 1334651 - RNA, 22 nt, Human
uagcuuuggaaguuuagcucug

SEQ ID NO: 1334652 - RNA, 15 nt, Human
uagcuuugcucuuug

SEQ ID NO: 1334653 - RNA, 17 nt, Human
uagcuuuggaaguuuag

SEQ ID NO: 1334654 - RNA, 11 nt, Human
uagcuuugcuc

SEQ ID NO: 1334655 - RNA, 18 nt, Human
uagcguuuuuuaaaugua

SEQ ID NO: 1334656 - RNA, 17 nt, Human
uagcguuuuuuaaaugu

SEQ ID NO: 1334657 - RNA, 16 nt, Human
uagcguuuuuuaaaug

SEQ ID NO: 1334658 - RNA, 21 nt, Human
uagcguucuuguaauuuuaca

SEQ ID NO: 1334659 - RNA, 17 nt, Human
uagcgugcucacugacc

SEQ ID NO: 1334660 - RNA, 13 nt, Human
uagcguucuugua

SEQ ID NO: 1334661 - RNA, 14 nt, Human
uagcguucuuguaa

SEQ ID NO: 1334662 - RNA, 15 nt, Human
uagcguucuuguaau

SEQ ID NO: 1334663 - RNA, 16 nt, Human
uagcguucuuguaauu

SEQ ID NO: 1334664 - RNA, 17 nt, Human
uagcguucuuguaauuu

SEQ ID NO: 1334665 - RNA, 16 nt, Human
uagcgcacucuucaug

SEQ ID NO: 1334666 - RNA, 21 nt, Human
uagcgcuaucucccugccucc

SEQ ID NO: 1334667 - RNA, 18 nt, Human
uagcgggauggggcuccc

SEQ ID NO: 1334668 - RNA, 16 nt, Human
uagcgugcucacugac

SEQ ID NO: 1334669 - RNA, 16 nt, Human
acaaucagaaacucuu

SEQ ID NO: 1334670 - RNA, 18 nt, Human
acaaucagcuccuuccug

SEQ ID NO: 1334671 - RNA, 22 nt, Human
acaaucagcuccuuccuggaga

SEQ ID NO: 1334672 - RNA, 20 nt, Human
acaaaucagaagucaucuug

SEQ ID NO: 1334673 - RNA, 21 nt, Human
acaaaucucaagcaaacagcu

SEQ ID NO: 1334674 - RNA, 11 nt, Human
acaaaugaaaa

SEQ ID NO: 1334675 - RNA, 23 nt, Human
uaggggcuuauaauaaaggacug

SEQ ID NO: 1334676 - RNA, 22 nt, Human
uaggggcuuauaauaaaggacu

SEQ ID NO: 1334677 - RNA, 21 nt, Human
uaggggcuuauaauaaaggac

SEQ ID NO: 1334678 - RNA, 11 nt, Human
uaggggcuggg

SEQ ID NO: 1334679 - RNA, 14 nt, Human
uaggggcugggaac

SEQ ID NO: 1334680 - RNA, 18 nt, Human
uaggggaggggcuccuuu

SEQ ID NO: 1334681 - RNA, 21 nt, Human
uaggggaggggcuccuuucca

SEQ ID NO: 1334682 - RNA, 19 nt, Human
uaggggccccucucagccc

SEQ ID NO: 1334683 - RNA, 23 nt, Human
uaggggccccucucagcccucac

SEQ ID NO: 1334684 - RNA, 15 nt, Human
uagggggcuggagga

SEQ ID NO: 1334685 - RNA, 16 nt, Human
uagggggcuggaggag

SEQ ID NO: 1334686 - RNA, 18 nt, Human
uagggggcuggaggagcc

SEQ ID NO: 1334687 - RNA, 20 nt, Human
uagggggcuggaggagccca

SEQ ID NO: 1334688 - RNA, 16 nt, Human
uagggccaagcccagc

SEQ ID NO: 1334689 - RNA, 23 nt, Human
uagggccaagcccagcacugcuu

SEQ ID NO: 1334690 - RNA, 23 nt, Human
uagggcaauuaauuccuucagca

SEQ ID NO: 1334691 - RNA, 21 nt, Human
uagggcaauuaauuccuucag

SEQ ID NO: 1334692 - RNA, 15 nt, Human
uagggcaccaggggu

SEQ ID NO: 1334693 - RNA, 20 nt, Human
uagggcaccagggguuucuc

SEQ ID NO: 1334694 - RNA, 18 nt, Human
uagggcaauuaauuccuu

SEQ ID NO: 1334695 - RNA, 16 nt, Human
uagggaugccuccuuu

SEQ ID NO: 1334696 - RNA, 19 nt, Human
uagggauggggcugugggg

SEQ ID NO: 1334697 - RNA, 14 nt, Human
uagggaugccuccu

SEQ ID NO: 1334698 - RNA, 15 nt, Human
uagggaugccuccuu

SEQ ID NO: 1334699 - RNA, 17 nt, Human
uagggaucccucaucug

SEQ ID NO: 1334700 - RNA, 18 nt, Human
uagggaaaacauuccauc

SEQ ID NO: 1334701 - RNA, 16 nt, Human
uagggaaaacauucca

SEQ ID NO: 1334702 - RNA, 20 nt, Human
uaggcauucuggaccucugg

SEQ ID NO: 1334703 - RNA, 13 nt, Human
uagggaaaacauu

SEQ ID NO: 1334704 - RNA, 13 nt, Human
uagggaacaauuu

SEQ ID NO: 1334705 - RNA, 14 nt, Human
uagggaacaauuug

SEQ ID NO: 1334706 - RNA, 15 nt, Human
uagggaacaauuugg

SEQ ID NO: 1334707 - RNA, 13 nt, Human
uaggaaaauaaaa

SEQ ID NO: 1334708 - RNA, 19 nt, Human
uaggaaagaccauuuuucc

SEQ ID NO: 1334709 - RNA, 23 nt, Human
uaggaguuuagggaacaauuugg

SEQ ID NO: 1334710 - RNA, 20 nt, Human
uaggaucauuuguuggaaug

SEQ ID NO: 1334711 - RNA, 21 nt, Human
uaggauccagugauccuuaca

SEQ ID NO: 1334712 - RNA, 13 nt, Human
uaggauguugaaa

SEQ ID NO: 1334713 - RNA, 12 nt, Human
uaggauucuaaa

SEQ ID NO: 1334714 - RNA, 14 nt, Human
uaggauucuaaaau

SEQ ID NO: 1334715 - RNA, 16 nt, Human
uaggauuuauuuaaaa

SEQ ID NO: 1334716 - RNA, 17 nt, Human
uaggauuuauuuaaaau

SEQ ID NO: 1334717 - RNA, 22 nt, Human
uaggauuuauuuaaaauagcaa

SEQ ID NO: 1334718 - RNA, 21 nt, Human
uaggauuuauuuaaaauagca

SEQ ID NO: 1334719 - RNA, 21 nt, Human
uaggauuuuuuuuaauguuua

SEQ ID NO: 1334720 - RNA, 22 nt, Human
uaggauuuuuuuuaauguuuaa

SEQ ID NO: 1334721 - RNA, 12 nt, Human
uaggcaacauag

SEQ ID NO: 1334722 - RNA, 12 nt, Human
uaguaaucauau

SEQ ID NO: 1334723 - RNA, 17 nt, Human
uaguaaucugcauuauu

SEQ ID NO: 1334724 - RNA, 14 nt, Human
uaguaaucugcauu

SEQ ID NO: 1334725 - RNA, 14 nt, Human
uaguaauugacaug

SEQ ID NO: 1334726 - RNA, 12 nt, Human
uaguacaaaguu

SEQ ID NO: 1334727 - RNA, 14 nt, Human
uaguacaaaguuuc

SEQ ID NO: 1334728 - RNA, 13 nt, Human
uaguagagacggg

SEQ ID NO: 1334729 - RNA, 19 nt, Human
acacaguaccauuuaaugg

SEQ ID NO: 1334730 - RNA, 23 nt, Human
uagguuuuaauaauuuuuuaauu

SEQ ID NO: 1334731 - RNA, 14 nt, Human
uagguuuuacagau

SEQ ID NO: 1334732 - RNA, 11 nt, Human
acacagggcag

SEQ ID NO: 1334733 - RNA, 22 nt, Human
acacaggggcuugacuuuuuca

SEQ ID NO: 1334734 - RNA, 16 nt, Human
acacaggggcuugacu

SEQ ID NO: 1334735 - RNA, 13 nt, Human
uaguaaaaauaaa

SEQ ID NO: 1334736 - RNA, 16 nt, Human
uaguaaaaauaaaauu

SEQ ID NO: 1334737 - RNA, 15 nt, Human
uagguuuuuguuugu

SEQ ID NO: 1334738 - RNA, 16 nt, Human
acacaggcauuuccug

SEQ ID NO: 1334739 - RNA, 23 nt, Human
acacacagauuugagcucagccc

SEQ ID NO: 1334740 - RNA, 18 nt, Human
acacaggcauuuccuggg

SEQ ID NO: 1334741 - RNA, 20 nt, Human
acacaggcauuuccugggug

SEQ ID NO: 1334742 - RNA, 23 nt, Human
acacaggcauuuccuggguggcu

SEQ ID NO: 1334743 - RNA, 13 nt, Human
acacaggcccucc

SEQ ID NO: 1334744 - RNA, 16 nt, Human
acacaggcccucccug

SEQ ID NO: 1334745 - RNA, 12 nt, Human
acacaggccugu

SEQ ID NO: 1334746 - RNA, 13 nt, Human
acacaggccugug

SEQ ID NO: 1334747 - RNA, 16 nt, Human
acacaggccuguguag

SEQ ID NO: 1334748 - RNA, 22 nt, Human
acacaggccuguguagcuguga

SEQ ID NO: 1334749 - RNA, 13 nt, Human
acacaauaagcaa

SEQ ID NO: 1334750 - RNA, 14 nt, Human
acacaauaagcaaa

SEQ ID NO: 1334751 - RNA, 19 nt, Human
acacaaggauagaugcugg

SEQ ID NO: 1334752 - RNA, 23 nt, Human
acacaaggauagaugcuggccca

SEQ ID NO: 1334753 - RNA, 13 nt, Human
acacaacuauauu

SEQ ID NO: 1334754 - RNA, 14 nt, Human
acacaacuauauug

SEQ ID NO: 1334755 - RNA, 23 nt, Human
acacaagauugguguuuuuuucu

SEQ ID NO: 1334756 - RNA, 18 nt, Human
acacaaauuaucuuaaaa

SEQ ID NO: 1334757 - RNA, 22 nt, Human
acaaugauccuguauucagaca

SEQ ID NO: 1334758 - RNA, 21 nt, Human
acaaugaucaccgacugaaaa

SEQ ID NO: 1334759 - RNA, 20 nt, Human
acaaugauccuguauucaga

SEQ ID NO: 1334760 - RNA, 16 nt, Human
uagguaaauuacaguu

SEQ ID NO: 1334761 - RNA, 19 nt, Human
uaggguuucccuacugaag

SEQ ID NO: 1334762 - RNA, 19 nt, Human
uaggguuugugacagggcg

SEQ ID NO: 1334763 - RNA, 12 nt, Human
uaggguaaauca

SEQ ID NO: 1334764 - RNA, 13 nt, Human
uaggguaaaucag

SEQ ID NO: 1334765 - RNA, 16 nt, Human
uaggguaaaucaguaa

SEQ ID NO: 1334766 - RNA, 22 nt, Human
uaggguaaaucaguaagaggug

SEQ ID NO: 1334767 - RNA, 15 nt, Human
uaggguacauggugc

SEQ ID NO: 1334768 - RNA, 13 nt, Human
uaggguccugggg

SEQ ID NO: 1334769 - RNA, 19 nt, Human
uaggguacauggugcuggg

SEQ ID NO: 1334770 - RNA, 15 nt, Human
uaggguauauuuucc

SEQ ID NO: 1334771 - RNA, 22 nt, Human
uagggucuggaacaccaggcug

SEQ ID NO: 1334772 - RNA, 15 nt, Human
uagggugggccuuca

SEQ ID NO: 1334773 - RNA, 16 nt, Human
uaggguggagagccac

SEQ ID NO: 1334774 - RNA, 13 nt, Human
uaucuauagcuaa

SEQ ID NO: 1334775 - RNA, 22 nt, Human
uaucuaguuuaauuaaucugua

SEQ ID NO: 1334776 - RNA, 13 nt, Human
uaucuauaauuua

SEQ ID NO: 1334777 - RNA, 14 nt, Human
uaucuauaauuuac

SEQ ID NO: 1334778 - RNA, 16 nt, Human
uaucuauaauuuaccu

SEQ ID NO: 1334779 - RNA, 19 nt, Human
uaucuauaauuuaccuaag

SEQ ID NO: 1334780 - RNA, 15 nt, Human
uaucccggcugcccu

SEQ ID NO: 1334781 - RNA, 14 nt, Human
uaucccagcugccu

SEQ ID NO: 1334782 - RNA, 15 nt, Human
uauccccccaucuug

SEQ ID NO: 1334783 - RNA, 17 nt, Human
uauccccccaucuugcu

SEQ ID NO: 1334784 - RNA, 19 nt, Human
uauccccccaucuugcuuc

SEQ ID NO: 1334785 - RNA, 20 nt, Human
uauccccccaucuugcuucc

SEQ ID NO: 1334786 - RNA, 22 nt, Human
uaucccaccugacauguccuuc

SEQ ID NO: 1334787 - RNA, 20 nt, Human
uaucccaccuccaucccaga

SEQ ID NO: 1334788 - RNA, 16 nt, Human
uaucccagcugccuag

SEQ ID NO: 1334789 - RNA, 16 nt, Human
uauccccauuucuuuu

SEQ ID NO: 1334790 - RNA, 23 nt, Human
uauccaccaaaagggcucccuga

SEQ ID NO: 1334791 - RNA, 16 nt, Human
uaucacacaaagcaga

SEQ ID NO: 1334792 - RNA, 15 nt, Human
uauccaaucaaucuu

SEQ ID NO: 1334793 - RNA, 17 nt, Human
uaucagacuaagccagc

SEQ ID NO: 1334794 - RNA, 21 nt, Human
uaucagacucggaaucuauuu

SEQ ID NO: 1334795 - RNA, 14 nt, Human
acagaccuuugaac

SEQ ID NO: 1334796 - RNA, 18 nt, Human
acagacgcugcugucaca

SEQ ID NO: 1334797 - RNA, 17 nt, Human
acagacggaaggguaaa

SEQ ID NO: 1334798 - RNA, 21 nt, Human
acagacggaaggguaaacaau

SEQ ID NO: 1334799 - RNA, 13 nt, Human
acagacaggcucu

SEQ ID NO: 1334800 - RNA, 15 nt, Human
acagacaggcucuua

SEQ ID NO: 1334801 - RNA, 23 nt, Human
acagacggaaggguaaacaauau

SEQ ID NO: 1334802 - RNA, 23 nt, Human
uaucaaauacauuuaaaacauua

SEQ ID NO: 1334803 - RNA, 15 nt, Human
uaucaaaucuaccac

SEQ ID NO: 1334804 - RNA, 14 nt, Human
uaucacacaaagca

SEQ ID NO: 1334805 - RNA, 20 nt, Human
uaucacccagacauaaagga

SEQ ID NO: 1334806 - RNA, 22 nt, Human
uaucacccagacauaaaggaaa

SEQ ID NO: 1334807 - RNA, 23 nt, Human
uaucacccagacauaaaggaaaa

SEQ ID NO: 1334808 - RNA, 19 nt, Human
uaucaccgugggcucccug

SEQ ID NO: 1334809 - RNA, 23 nt, Human
uaucaccgugggcucccugacug

SEQ ID NO: 1334810 - RNA, 18 nt, Human
uaucaccuagcugaaugu

SEQ ID NO: 1334811 - RNA, 16 nt, Human
uaucaccuagcugaau

SEQ ID NO: 1334812 - RNA, 19 nt, Human
uaucaauuaccacaccauc

SEQ ID NO: 1334813 - RNA, 17 nt, Human
acacuuacuuuuucugg

SEQ ID NO: 1334814 - RNA, 20 nt, Human
acacuuauuggaacucugcu

SEQ ID NO: 1334815 - RNA, 16 nt, Human
acacuucaaacuacuu

SEQ ID NO: 1334816 - RNA, 15 nt, Human
acacuucaggcucuu

SEQ ID NO: 1334817 - RNA, 19 nt, Human
acacuucaggcucuucucc

SEQ ID NO: 1334818 - RNA, 22 nt, Human
acacuucaggcucuucuccuuu

SEQ ID NO: 1334819 - RNA, 14 nt, Human
acacuuccauaauc

SEQ ID NO: 1334820 - RNA, 14 nt, Human
acacuuaauacuac

SEQ ID NO: 1334821 - RNA, 24 nt, Human
acagaaaugauuacuaaggaagau

SEQ ID NO: 1334822 - RNA, 13 nt, Human
acagaaagcugcc

SEQ ID NO: 1334823 - RNA, 14 nt, Human
acacuucucaggac

SEQ ID NO: 1334824 - RNA, 16 nt, Human
acacuucucaggacac

SEQ ID NO: 1334825 - RNA, 20 nt, Human
acacuucucaggacacaggc

SEQ ID NO: 1334826 - RNA, 22 nt, Human
acacuucucaggacacaggccu

SEQ ID NO: 1334827 - RNA, 24 nt, Human
acacuucucaggacacaggccugu

SEQ ID NO: 1334828 - RNA, 23 nt, Human
acacuucucaggacacaggccug

SEQ ID NO: 1334829 - RNA, 13 nt, Human
acacuugcaaccu

SEQ ID NO: 1334830 - RNA, 14 nt, Human
acacuugguaauug

SEQ ID NO: 1334831 - RNA, 21 nt, Human
acacuuguaauuuuguaucuu

SEQ ID NO: 1334832 - RNA, 21 nt, Human
acacuuuuucucuuuccauga

SEQ ID NO: 1334833 - RNA, 11 nt, Human
acagaaaaacc

SEQ ID NO: 1334834 - RNA, 14 nt, Human
acagaaaaaccuug

SEQ ID NO: 1334835 - RNA, 21 nt, Human
acagaaaaaccuuggguuaga

SEQ ID NO: 1334836 - RNA, 19 nt, Human
acagaaaaauauguaccaa

SEQ ID NO: 1334837 - RNA, 23 nt, Human
uauauauguguaugcacaguaaa

SEQ ID NO: 1334838 - RNA, 21 nt, Human
uauauauguguaugcacagua

SEQ ID NO: 1334839 - RNA, 19 nt, Human
uauauauguacaguuaucu

SEQ ID NO: 1334840 - RNA, 17 nt, Human
uauauauguacaguuau

SEQ ID NO: 1334841 - RNA, 13 nt, Human
uauauauuauacu

SEQ ID NO: 1334842 - RNA, 14 nt, Human
uauauauuauacuu

SEQ ID NO: 1334843 - RNA, 16 nt, Human
uauauauuauacuugu

SEQ ID NO: 1334844 - RNA, 18 nt, Human
uauauauuauacuuguaa

SEQ ID NO: 1334845 - RNA, 15 nt, Human
uauauauuauaugga

SEQ ID NO: 1334846 - RNA, 16 nt, Human
uauauauuauauggaa

SEQ ID NO: 1334847 - RNA, 17 nt, Human
uauauauuauauggaaa

SEQ ID NO: 1334848 - RNA, 14 nt, Human
uauauauuaucuuu

SEQ ID NO: 1334849 - RNA, 18 nt, Human
uauauauuaucuuuucau

SEQ ID NO: 1334850 - RNA, 14 nt, Human
uauauauucuauua

SEQ ID NO: 1334851 - RNA, 15 nt, Human
uauauauuuaaaagu

SEQ ID NO: 1334852 - RNA, 19 nt, Human
uauauauuuaaaaguguca

SEQ ID NO: 1334853 - RNA, 21 nt, Human
uauauagccaauauaacuauc

SEQ ID NO: 1334854 - RNA, 22 nt, Human
uauauauggggaugguaguuuu

SEQ ID NO: 1334855 - RNA, 14 nt, Human
uauauauguacagu

SEQ ID NO: 1334856 - RNA, 19 nt, Human
uauauauuuuuuucugaaa

SEQ ID NO: 1334857 - RNA, 20 nt, Human
uauauauuuuuuucugaaau

SEQ ID NO: 1334858 - RNA, 21 nt, Human
uauaucuauauuuuacauaaa

SEQ ID NO: 1334859 - RNA, 18 nt, Human
uauaucuagguuuaugac

SEQ ID NO: 1334860 - RNA, 22 nt, Human
uauaucuagguuuaugacagua

SEQ ID NO: 1334861 - RNA, 21 nt, Human
uauaucuaccccagacuagau

SEQ ID NO: 1334862 - RNA, 19 nt, Human
acacucaugcauuguccuc

SEQ ID NO: 1334863 - RNA, 23 nt, Human
uauagaugggggaaagcaaagca

SEQ ID NO: 1334864 - RNA, 22 nt, Human
uauagaugggggaaagcaaagc

SEQ ID NO: 1334865 - RNA, 14 nt, Human
uauagaugucuuuu

SEQ ID NO: 1334866 - RNA, 18 nt, Human
uauagaugucuuuuccca

SEQ ID NO: 1334867 - RNA, 15 nt, Human
uauagaugucuuuuc

SEQ ID NO: 1334868 - RNA, 18 nt, Human
uauagccaaaaauagcua

SEQ ID NO: 1334869 - RNA, 19 nt, Human
uauagccaaaaauagcuaa

SEQ ID NO: 1334870 - RNA, 22 nt, Human
uauagccaaaaauagcuaaaua

SEQ ID NO: 1334871 - RNA, 23 nt, Human
uauagcucuaauguuugcauaua

SEQ ID NO: 1334872 - RNA, 14 nt, Human
uauagccaauauaa

SEQ ID NO: 1334873 - RNA, 17 nt, Human
uauagccaauauaacua

SEQ ID NO: 1334874 - RNA, 17 nt, Human
uauagcugcuuccagug

SEQ ID NO: 1334875 - RNA, 22 nt, Human
uauagcugcuuccaguguagac

SEQ ID NO: 1334876 - RNA, 12 nt, Human
uauaggaauuga

SEQ ID NO: 1334877 - RNA, 15 nt, Human
uauaggaucauuugu

SEQ ID NO: 1334878 - RNA, 19 nt, Human
uauaggauuuauuuaaaau

SEQ ID NO: 1334879 - RNA, 15 nt, Human
uauaggcaccuacca

SEQ ID NO: 1334880 - RNA, 19 nt, Human
uauaggcauaccuccuaug

SEQ ID NO: 1334881 - RNA, 21 nt, Human
uauaggauuuauuuaaaauag

SEQ ID NO: 1334882 - RNA, 19 nt, Human
uauaagugauugcugguuu

SEQ ID NO: 1334883 - RNA, 16 nt, Human
uauaacuggaaagaag

SEQ ID NO: 1334884 - RNA, 13 nt, Human
uauaacuguauuu

SEQ ID NO: 1334885 - RNA, 23 nt, Human
uauaacuguauuugaaauaagaa

SEQ ID NO: 1334886 - RNA, 21 nt, Human
acacuaauauauuuaaaaaua

SEQ ID NO: 1334887 - RNA, 22 nt, Human
acacuaauauauuuaaaaauaa

SEQ ID NO: 1334888 - RNA, 13 nt, Human
acacuaauucaua

SEQ ID NO: 1334889 - RNA, 12 nt, Human
acacuaauucau

SEQ ID NO: 1334890 - RNA, 18 nt, Human
uagucaccagagacuuua

SEQ ID NO: 1334891 - RNA, 15 nt, Human
uagucaccagagacu

SEQ ID NO: 1334892 - RNA, 13 nt, Human
acacuaauauauu

SEQ ID NO: 1334893 - RNA, 14 nt, Human
acacuaauauauuu

SEQ ID NO: 1334894 - RNA, 17 nt, Human
acacuaauauauuuaaa

SEQ ID NO: 1334895 - RNA, 19 nt, Human
acacuaauauauuuaaaaa

SEQ ID NO: 1334896 - RNA, 20 nt, Human
acacuaauauauuuaaaaau

SEQ ID NO: 1334897 - RNA, 14 nt, Human
uauaauuuaccuaa

SEQ ID NO: 1334898 - RNA, 16 nt, Human
uauaauuuaccuaaga

SEQ ID NO: 1334899 - RNA, 13 nt, Human
uauaaguguacau

SEQ ID NO: 1334900 - RNA, 14 nt, Human
uauaaguguacaua

SEQ ID NO: 1334901 - RNA, 22 nt, Human
uauaauuguuuuaucugaauuu

SEQ ID NO: 1334902 - RNA, 18 nt, Human
uauaauuguuuuaucuga

SEQ ID NO: 1334903 - RNA, 17 nt, Human
uauaauuuaccuaagau

SEQ ID NO: 1334904 - RNA, 18 nt, Human
uauaauuuaccuaagauu

SEQ ID NO: 1334905 - RNA, 20 nt, Human
uauaauuuaccuaagauuac

SEQ ID NO: 1334906 - RNA, 16 nt, Human
uauacauacuaugaaa

SEQ ID NO: 1334907 - RNA, 21 nt, Human
uauacauacuaugaaauaugu

SEQ ID NO: 1334908 - RNA, 20 nt, Human
uauacagcuguauugucuga

SEQ ID NO: 1334909 - RNA, 13 nt, Human
uauagaucagcca

SEQ ID NO: 1334910 - RNA, 15 nt, Human
uaugccccauucaac

SEQ ID NO: 1334911 - RNA, 19 nt, Human
uaugccauugggguaguug

SEQ ID NO: 1334912 - RNA, 17 nt, Human
uaugccauauaauucac

SEQ ID NO: 1334913 - RNA, 20 nt, Human
uaugccaccugaauaaagaa

SEQ ID NO: 1334914 - RNA, 14 nt, Human
uaugcauuauauca

SEQ ID NO: 1334915 - RNA, 17 nt, Human
uaugauacuugaaaauu

SEQ ID NO: 1334916 - RNA, 17 nt, Human
uaugauaauagauucuc

SEQ ID NO: 1334917 - RNA, 20 nt, Human
uaugauacuucgacacuguu

SEQ ID NO: 1334918 - RNA, 24 nt, Human
uaugauagguuauuuugauguaaa

SEQ ID NO: 1334919 - RNA, 18 nt, Human
uaugaucaaauguuuaau

SEQ ID NO: 1334920 - RNA, 16 nt, Human
uaugaucaaauguuua

SEQ ID NO: 1334921 - RNA, 15 nt, Human
uaugaucaaauguuu

SEQ ID NO: 1334922 - RNA, 14 nt, Human
uaugaucaaauguu

SEQ ID NO: 1334923 - RNA, 13 nt, Human
uaugaucaaaugu

SEQ ID NO: 1334924 - RNA, 12 nt, Human
uaugaucaaaug

SEQ ID NO: 1334925 - RNA, 22 nt, Human
uaugauauuuucugugccugaa

SEQ ID NO: 1334926 - RNA, 23 nt, Human
uaugauacuucgacacuguucuu

SEQ ID NO: 1334927 - RNA, 15 nt, Human
uaugauauuuucugu

SEQ ID NO: 1334928 - RNA, 22 nt, Human
uaugaucaaauguuuaaucaua

SEQ ID NO: 1334929 - RNA, 20 nt, Human
uaugaucaaauguuuaauca

SEQ ID NO: 1334930 - RNA, 18 nt, Human
uaugcauggugccccagg

SEQ ID NO: 1334931 - RNA, 20 nt, Human
uaugcauggugccccaggac

SEQ ID NO: 1334932 - RNA, 21 nt, Human
uaugcauggugccccaggacc

SEQ ID NO: 1334933 - RNA, 22 nt, Human
uaugcauggugccccaggacca

SEQ ID NO: 1334934 - RNA, 23 nt, Human
uaugcauggugccccaggaccag

SEQ ID NO: 1334935 - RNA, 16 nt, Human
uaugcaugguuucagc

SEQ ID NO: 1334936 - RNA, 17 nt, Human
uaugcaugguuucagca

SEQ ID NO: 1334937 - RNA, 18 nt, Human
uaugcaugguuucagcac

SEQ ID NO: 1334938 - RNA, 19 nt, Human
uaugcaugguuucagcacu

SEQ ID NO: 1334939 - RNA, 20 nt, Human
uaugcaugguuucagcacua

SEQ ID NO: 1334940 - RNA, 22 nt, Human
uaugcauguugucuaagaaauu

SEQ ID NO: 1334941 - RNA, 16 nt, Human
uaugcauuauaucaaa

SEQ ID NO: 1334942 - RNA, 16 nt, Human
acagcggaggugugga

SEQ ID NO: 1334943 - RNA, 21 nt, Human
acagcgcccaaaggacgcacu

SEQ ID NO: 1334944 - RNA, 15 nt, Human
acagcggaggugugg

SEQ ID NO: 1334945 - RNA, 18 nt, Human
uauggugccuaguauuga

SEQ ID NO: 1334946 - RNA, 19 nt, Human
uauggugccuaguauugac

SEQ ID NO: 1334947 - RNA, 17 nt, Human
uauggugccuaguauug

SEQ ID NO: 1334948 - RNA, 22 nt, Human
uauggugcaauguguguauaug

SEQ ID NO: 1334949 - RNA, 20 nt, Human
uauggugcaauguguguaua

SEQ ID NO: 1334950 - RNA, 21 nt, Human
uaugguauuuauuuuuucuuu

SEQ ID NO: 1334951 - RNA, 15 nt, Human
uaucuauauuuuaca

SEQ ID NO: 1334952 - RNA, 22 nt, Human
acagauuugagcucagcccugg

SEQ ID NO: 1334953 - RNA, 14 nt, Human
acagauuuggaaag

SEQ ID NO: 1334954 - RNA, 15 nt, Human
acagauuuggaaaga

SEQ ID NO: 1334955 - RNA, 21 nt, Human
acagauuuggaaagacuggac

SEQ ID NO: 1334956 - RNA, 15 nt, Human
acagcaauuccucag

SEQ ID NO: 1334957 - RNA, 17 nt, Human
acagcaauuccucaggc

SEQ ID NO: 1334958 - RNA, 19 nt, Human
acagcaauuccucaggcua

SEQ ID NO: 1334959 - RNA, 14 nt, Human
acagcaauuucuaa

SEQ ID NO: 1334960 - RNA, 12 nt, Human
acagcacagcca

SEQ ID NO: 1334961 - RNA, 13 nt, Human
acagcaccaaauc

SEQ ID NO: 1334962 - RNA, 23 nt, Human
acagcccuccaucuaaacugccc

SEQ ID NO: 1334963 - RNA, 14 nt, Human
acagccccuccucc

SEQ ID NO: 1334964 - RNA, 16 nt, Human
acagccccuccuccau

SEQ ID NO: 1334965 - RNA, 19 nt, Human
acagcacgggggccaagga

SEQ ID NO: 1334966 - RNA, 17 nt, Human
acagcagccccugcaca

SEQ ID NO: 1334967 - RNA, 14 nt, Human
acagcagcaucucu

SEQ ID NO: 1334968 - RNA, 13 nt, Human
acagcagcaucuc

SEQ ID NO: 1334969 - RNA, 13 nt, Human
acagcagacucag

SEQ ID NO: 1334970 - RNA, 18 nt, Human
acagcagacucagcucug

SEQ ID NO: 1334971 - RNA, 19 nt, Human
acagcagacucagcucuga

SEQ ID NO: 1334972 - RNA, 23 nt, Human
acagcagacucagcucugacauu

SEQ ID NO: 1334973 - RNA, 14 nt, Human
uaugaaaaagaaga

SEQ ID NO: 1334974 - RNA, 15 nt, Human
uaugaaaaagaagaa

SEQ ID NO: 1334975 - RNA, 14 nt, Human
uaugaaaagcuaga

SEQ ID NO: 1334976 - RNA, 19 nt, Human
uaugaaaagcuagaauuga

SEQ ID NO: 1334977 - RNA, 19 nt, Human
acagcccuucuuuccacag

SEQ ID NO: 1334978 - RNA, 22 nt, Human
acagcccugucagcaugaauuu

SEQ ID NO: 1334979 - RNA, 21 nt, Human
acagcccugucagcaugaauu

SEQ ID NO: 1334980 - RNA, 22 nt, Human
acagcccuuaugcgguuaauuu

SEQ ID NO: 1334981 - RNA, 23 nt, Human
acagcccuuaugcgguuaauuuu

SEQ ID NO: 1334982 - RNA, 12 nt, Human
acagcccuguca

SEQ ID NO: 1334983 - RNA, 13 nt, Human
acagcccugucag

SEQ ID NO: 1334984 - RNA, 14 nt, Human
acagcccugucagc

SEQ ID NO: 1334985 - RNA, 17 nt, Human
acagcccugucagcaug

SEQ ID NO: 1334986 - RNA, 18 nt, Human
acagcccugucagcauga

SEQ ID NO: 1334987 - RNA, 19 nt, Human
acagcccugucagcaugaa

SEQ ID NO: 1334988 - RNA, 23 nt, Human
uaugaagcuuuuaugugaaacau

SEQ ID NO: 1334989 - RNA, 21 nt, Human
uaugaaggcuguacacugcac

SEQ ID NO: 1334990 - RNA, 22 nt, Human
uaugaagcuuuuaugugaaaca

SEQ ID NO: 1334991 - RNA, 20 nt, Human
uaugaagcuuuuaugugaaa

SEQ ID NO: 1334992 - RNA, 14 nt, Human
acagcuguaugauu

SEQ ID NO: 1334993 - RNA, 19 nt, Human
acagcuguaugauucccag

SEQ ID NO: 1334994 - RNA, 20 nt, Human
acagcuguaugauucccagc

SEQ ID NO: 1334995 - RNA, 23 nt, Human
acagcuguaugauucccagccag

SEQ ID NO: 1334996 - RNA, 17 nt, Human
acagcuguauugucuga

SEQ ID NO: 1334997 - RNA, 19 nt, Human
acagcuguauugucugaac

SEQ ID NO: 1334998 - RNA, 20 nt, Human
acagcuguauugucugaacu

SEQ ID NO: 1334999 - RNA, 12 nt, Human
acagcugugccu

SEQ ID NO: 1335000 - RNA, 13 nt, Human
acagcugugccuc

SEQ ID NO: 1335001 - RNA, 15 nt, Human
acagcugugccucgc

SEQ ID NO: 1335002 - RNA, 17 nt, Human
acagcugugccucgcuc

SEQ ID NO: 1335003 - RNA, 16 nt, Human
acagcugugccucgcu

SEQ ID NO: 1335004 - RNA, 23 nt, Human
acagcuguucaguugcacuucua

SEQ ID NO: 1335005 - RNA, 14 nt, Human
acagcuuagauuuc

SEQ ID NO: 1335006 - RNA, 16 nt, Human
acagcuuagauuucau

SEQ ID NO: 1335007 - RNA, 18 nt, Human
acagcuuagauuucauag

SEQ ID NO: 1335008 - RNA, 21 nt, Human
acagcuaauucuacucacagu

SEQ ID NO: 1335009 - RNA, 14 nt, Human
acagcuacucuccc

SEQ ID NO: 1335010 - RNA, 22 nt, Human
acagcuacucuccccacgaggg

SEQ ID NO: 1335011 - RNA, 23 nt, Human
acagcuacucuccccacgagggc

SEQ ID NO: 1335012 - RNA, 18 nt, Human
acagcucagaaguuucuu

SEQ ID NO: 1335013 - RNA, 11 nt, Human
acagcuggugu

SEQ ID NO: 1335014 - RNA, 12 nt, Human
acagcuggugua

SEQ ID NO: 1335015 - RNA, 15 nt, Human
acagcugguguagcu

SEQ ID NO: 1335016 - RNA, 16 nt, Human
acagcugguguagcua

SEQ ID NO: 1335017 - RNA, 19 nt, Human
acagcugguguagcuacag

SEQ ID NO: 1335018 - RNA, 20 nt, Human
acagcugguguagcuacaga

SEQ ID NO: 1335019 - RNA, 21 nt, Human
acagcugguguagcuacagag

SEQ ID NO: 1335020 - RNA, 22 nt, Human
acagcugguguagcuacagaga

SEQ ID NO: 1335021 - RNA, 23 nt, Human
acagcugguguagcuacagagaa

SEQ ID NO: 1335022 - RNA, 22 nt, Human
acagcuguauagcugcuuccag

SEQ ID NO: 1335023 - RNA, 17 nt, Human
acagcuuagauuucaua

SEQ ID NO: 1335024 - RNA, 20 nt, Human
acagcuucucauccugcagg

SEQ ID NO: 1335025 - RNA, 21 nt, Human
acagcuucucauccugcaggc

SEQ ID NO: 1335026 - RNA, 15 nt, Human
acagcuugaccugag

SEQ ID NO: 1335027 - RNA, 17 nt, Human
acagcuugaccugaggc

SEQ ID NO: 1335028 - RNA, 19 nt, Human
acagcuugaccugaggcug

SEQ ID NO: 1335029 - RNA, 21 nt, Human
acagcuugaccugaggcugug

SEQ ID NO: 1335030 - RNA, 22 nt, Human
acagcuugaccugaggcugugg

SEQ ID NO: 1335031 - RNA, 17 nt, Human
acagcuuguaggggagg

SEQ ID NO: 1335032 - RNA, 22 nt, Human
acaggaaccacaagacugcaca

SEQ ID NO: 1335033 - RNA, 19 nt, Human
acaggaaacuccugugacc

SEQ ID NO: 1335034 - RNA, 22 nt, Human
acaggaaacuccugugaccaca

SEQ ID NO: 1335035 - RNA, 20 nt, Human
acaggaaacuccugugacca

SEQ ID NO: 1335036 - RNA, 23 nt, Human
acagcuugaccugaggcuguggu

SEQ ID NO: 1335037 - RNA, 16 nt, Human
acaggacucugccucc

SEQ ID NO: 1335038 - RNA, 15 nt, Human
acaggacucugccuc

SEQ ID NO: 1335039 - RNA, 13 nt, Human
acaggagcuaccu

SEQ ID NO: 1335040 - RNA, 23 nt, Human
acaggagcuaccuguguggacag

SEQ ID NO: 1335041 - RNA, 21 nt, Human
acaggcagccagugcccugag

SEQ ID NO: 1335042 - RNA, 14 nt, Human
acaggagcuaccug

SEQ ID NO: 1335043 - RNA, 15 nt, Human
acaggcagccagugc

SEQ ID NO: 1335044 - RNA, 19 nt, Human
acaggcagccagugcccug

SEQ ID NO: 1335045 - RNA, 22 nt, Human
acaggcagccagugcccugagc

SEQ ID NO: 1335046 - RNA, 12 nt, Human
acaggcccccuu

SEQ ID NO: 1335047 - RNA, 21 nt, Human
acaggcccccuugaguggggu

SEQ ID NO: 1335048 - RNA, 13 nt, Human
acaggcccuuccu

SEQ ID NO: 1335049 - RNA, 21 nt, Human
acaggcccucccuguucccca

SEQ ID NO: 1335050 - RNA, 22 nt, Human
acaggcccucccuguuccccag

SEQ ID NO: 1335051 - RNA, 23 nt, Human
acaggcccucccuguuccccaga

SEQ ID NO: 1335052 - RNA, 15 nt, Human
acaggcccuuccucu

SEQ ID NO: 1335053 - RNA, 22 nt, Human
acaggcccuuccucuccacugc

SEQ ID NO: 1335054 - RNA, 19 nt, Human
acaggccucacacacaaug

SEQ ID NO: 1335055 - RNA, 16 nt, Human
acaggccgcccugcgg

SEQ ID NO: 1335056 - RNA, 13 nt, Human
acaggccucaggg

SEQ ID NO: 1335057 - RNA, 14 nt, Human
acaggccucagggc

SEQ ID NO: 1335058 - RNA, 18 nt, Human
acaggccucagggcuccu

SEQ ID NO: 1335059 - RNA, 15 nt, Human
acaggccucagggcu

SEQ ID NO: 1335060 - RNA, 19 nt, Human
acaggccuguguagcugug

SEQ ID NO: 1335061 - RNA, 20 nt, Human
acaggccuguguagcuguga

SEQ ID NO: 1335062 - RNA, 23 nt, Human
acaggccuguguagcugugaccu

SEQ ID NO: 1335063 - RNA, 13 nt, Human
uauguccaggugu

SEQ ID NO: 1335064 - RNA, 14 nt, Human
uaugucucuucuga

SEQ ID NO: 1335065 - RNA, 19 nt, Human
uaugucucuucugagcuau

SEQ ID NO: 1335066 - RNA, 13 nt, Human
uaugucugguucu

SEQ ID NO: 1335067 - RNA, 17 nt, Human
uaugucugguucucaau

SEQ ID NO: 1335068 - RNA, 18 nt, Human
uaugucugguucucaauu

SEQ ID NO: 1335069 - RNA, 21 nt, Human
uaugucugguucucaauucca

SEQ ID NO: 1335070 - RNA, 22 nt, Human
uaugucugguucucaauuccaa

SEQ ID NO: 1335071 - RNA, 18 nt, Human
uaauuuuuauauuugaaa

SEQ ID NO: 1335072 - RNA, 16 nt, Human
uaauuuauaaaaaggu

SEQ ID NO: 1335073 - RNA, 19 nt, Human
uaauuuuuauauuugaaau

SEQ ID NO: 1335074 - RNA, 21 nt, Human
uaauuuuuauauuugaaauau

SEQ ID NO: 1335075 - RNA, 19 nt, Human
uaauuuaacuuucuggguu

SEQ ID NO: 1335076 - RNA, 11 nt, Human
uaauuuaacuu

SEQ ID NO: 1335077 - RNA, 14 nt, Human
uaauuuagaaaacu

SEQ ID NO: 1335078 - RNA, 15 nt, Human
uaauuuagaaaacuu

SEQ ID NO: 1335079 - RNA, 16 nt, Human
uaauuuagaaaacuuu

SEQ ID NO: 1335080 - RNA, 17 nt, Human
uaauuuagaaaacuuua

SEQ ID NO: 1335081 - RNA, 21 nt, Human
uaauuuagaaaacuuuaaagc

SEQ ID NO: 1335082 - RNA, 14 nt, Human
uaauuuagaaauca

SEQ ID NO: 1335083 - RNA, 15 nt, Human
uaauuuagaaaucau

SEQ ID NO: 1335084 - RNA, 21 nt, Human
uaauuuagacuucaagcaugg

SEQ ID NO: 1335085 - RNA, 17 nt, Human
uaauuuagacuuggauu

SEQ ID NO: 1335086 - RNA, 21 nt, Human
uaauuuagacuuggauucuuu

SEQ ID NO: 1335087 - RNA, 16 nt, Human
uaauuuaguaaaccaa

SEQ ID NO: 1335088 - RNA, 16 nt, Human
uaauuuaguuucauau

SEQ ID NO: 1335089 - RNA, 17 nt, Human
uaauuuaguuucauaua

SEQ ID NO: 1335090 - RNA, 13 nt, Human
uaauuuauaaaaa

SEQ ID NO: 1335091 - RNA, 22 nt, Human
uaauuccguagguuauuuucag

SEQ ID NO: 1335092 - RNA, 14 nt, Human
uaauuauuauuuau

SEQ ID NO: 1335093 - RNA, 17 nt, Human
uaauuauuauuuauaua

SEQ ID NO: 1335094 - RNA, 22 nt, Human
uaauuauuauuuauauauguau

SEQ ID NO: 1335095 - RNA, 14 nt, Human
uaauuauuauuugu

SEQ ID NO: 1335096 - RNA, 17 nt, Human
uaauuauuauuuguguu

SEQ ID NO: 1335097 - RNA, 19 nt, Human
uaauuccucaacguauugu

SEQ ID NO: 1335098 - RNA, 11 nt, Human
uaauuuaaaca

SEQ ID NO: 1335099 - RNA, 17 nt, Human
uaauuuaaacaccuccu

SEQ ID NO: 1335100 - RNA, 19 nt, Human
uaauuuaaacaccuccuca

SEQ ID NO: 1335101 - RNA, 22 nt, Human
aaugcacuuucuauccucugua

SEQ ID NO: 1335102 - RNA, 16 nt, Human
uaauuauguagcucuu

SEQ ID NO: 1335103 - RNA, 14 nt, Human
uaauuauguagcuc

SEQ ID NO: 1335104 - RNA, 15 nt, Human
uaauuauguagcucu

SEQ ID NO: 1335105 - RNA, 12 nt, Human
uaauuauuauuc

SEQ ID NO: 1335106 - RNA, 14 nt, Human
uaauuauuauucuu

SEQ ID NO: 1335107 - RNA, 12 nt, Human
uaauuauuauuu

SEQ ID NO: 1335108 - RNA, 13 nt, Human
uaauuauuauuua

SEQ ID NO: 1335109 - RNA, 11 nt, Human
aaugcacuuuc

SEQ ID NO: 1335110 - RNA, 13 nt, Human
aaugcacuuucua

SEQ ID NO: 1335111 - RNA, 15 nt, Human
aaugcacuuucuauc

SEQ ID NO: 1335112 - RNA, 15 nt, Human
aaugauuuuucuuua

SEQ ID NO: 1335113 - RNA, 17 nt, Human
aaugauuuuucuuuaca

SEQ ID NO: 1335114 - RNA, 18 nt, Human
aaugauuuuucuuuacaa

SEQ ID NO: 1335115 - RNA, 11 nt, Human
aaugauuucag

SEQ ID NO: 1335116 - RNA, 20 nt, Human
aaugauuuccucuguaaucu

SEQ ID NO: 1335117 - RNA, 23 nt, Human
aaugauuuccucuguaaucuauu

SEQ ID NO: 1335118 - RNA, 16 nt, Human
aaugauuucauucaau

SEQ ID NO: 1335119 - RNA, 17 nt, Human
aaugcaaaaacucuuug

SEQ ID NO: 1335120 - RNA, 17 nt, Human
aaugcacaagaauggau

SEQ ID NO: 1335121 - RNA, 15 nt, Human
aaugcaccuaaagaa

SEQ ID NO: 1335122 - RNA, 16 nt, Human
aaugcaccuaaagaaa

SEQ ID NO: 1335123 - RNA, 22 nt, Human
aaugagaaaucuaaaaaacgaa

SEQ ID NO: 1335124 - RNA, 12 nt, Human
aaugagaaaucu

SEQ ID NO: 1335125 - RNA, 22 nt, Human
aaugagagacacacugaagaag

SEQ ID NO: 1335126 - RNA, 14 nt, Human
aaugagaaccaaca

SEQ ID NO: 1335127 - RNA, 12 nt, Human
aaugagcauguu

SEQ ID NO: 1335128 - RNA, 14 nt, Human
aaugagcauguuua

SEQ ID NO: 1335129 - RNA, 22 nt, Human
aaugagcauguuuagacuuuaa

SEQ ID NO: 1335130 - RNA, 16 nt, Human
aaugagcauguuuaga

SEQ ID NO: 1335131 - RNA, 17 nt, Human
aaugagagguuccuaag

SEQ ID NO: 1335132 - RNA, 15 nt, Human
aaugagauugaauuu

SEQ ID NO: 1335133 - RNA, 16 nt, Human
aaugagauugaauuuc

SEQ ID NO: 1335134 - RNA, 14 nt, Human
aaucuguaaacugu

SEQ ID NO: 1335135 - RNA, 15 nt, Human
aaucuguaaacugug

SEQ ID NO: 1335136 - RNA, 16 nt, Human
aaucuguaaacugugu

SEQ ID NO: 1335137 - RNA, 21 nt, Human
aaucuguaaacuguguauucc

SEQ ID NO: 1335138 - RNA, 23 nt, Human
aaucuguaaacuguguauuccaa

SEQ ID NO: 1335139 - RNA, 16 nt, Human
aaugaggccauggacu

SEQ ID NO: 1335140 - RNA, 22 nt, Human
aaugaggccauggacucugucc

SEQ ID NO: 1335141 - RNA, 24 nt, Human
aaugaggcuuggggcuggagagga

SEQ ID NO: 1335142 - RNA, 15 nt, Human
aaugaggucagcaug

SEQ ID NO: 1335143 - RNA, 19 nt, Human
aaugaggucagcaugucua

SEQ ID NO: 1335144 - RNA, 12 nt, Human
aaugauuauuuu

SEQ ID NO: 1335145 - RNA, 13 nt, Human
aaugauucagugu

SEQ ID NO: 1335146 - RNA, 14 nt, Human
aaugauucaguguu

SEQ ID NO: 1335147 - RNA, 12 nt, Human
aaugaguaacau

SEQ ID NO: 1335148 - RNA, 19 nt, Human
aaugaguaacauuugcugu

SEQ ID NO: 1335149 - RNA, 17 nt, Human
aaugaguaacauuugcu

SEQ ID NO: 1335150 - RNA, 24 nt, Human
aaugauuucagcucacugcaaccu

SEQ ID NO: 1335151 - RNA, 13 nt, Human
aaugauuucaugc

SEQ ID NO: 1335152 - RNA, 22 nt, Human
aaugauuucaugcuaucucugu

SEQ ID NO: 1335153 - RNA, 15 nt, Human
aaugauuguaguaau

SEQ ID NO: 1335154 - RNA, 21 nt, Human
aaugauucaguguuaaaugug

SEQ ID NO: 1335155 - RNA, 22 nt, Human
aaugauucaguguuaaauguga

SEQ ID NO: 1335156 - RNA, 23 nt, Human
aaugauucaguguuaaaugugau

SEQ ID NO: 1335157 - RNA, 14 nt, Human
uacacccagcaaua

SEQ ID NO: 1335158 - RNA, 15 nt, Human
uacacccuuuuccag

SEQ ID NO: 1335159 - RNA, 16 nt, Human
uacacccuuuuccagc

SEQ ID NO: 1335160 - RNA, 12 nt, Human
uacacccagcaa

SEQ ID NO: 1335161 - RNA, 11 nt, Human
uacacccagca

SEQ ID NO: 1335162 - RNA, 14 nt, Human
uacacccaaagagg

SEQ ID NO: 1335163 - RNA, 19 nt, Human
aauguaaucaauguuucuu

SEQ ID NO: 1335164 - RNA, 12 nt, Human
aauguaauuauu

SEQ ID NO: 1335165 - RNA, 22 nt, Human
aauguaauuauuuauguauggu

SEQ ID NO: 1335166 - RNA, 17 nt, Human
aauguaauuauuuaugu

SEQ ID NO: 1335167 - RNA, 15 nt, Human
uacaccgggccugga

SEQ ID NO: 1335168 - RNA, 17 nt, Human
uacaccgggccuggaga

SEQ ID NO: 1335169 - RNA, 17 nt, Human
uacagagaagccuucaa

SEQ ID NO: 1335170 - RNA, 18 nt, Human
uacagagaagccuucaag

SEQ ID NO: 1335171 - RNA, 19 nt, Human
uacagagaagccuucaagc

SEQ ID NO: 1335172 - RNA, 20 nt, Human
uacagagaagccuucaagcu

SEQ ID NO: 1335173 - RNA, 21 nt, Human
uacagagaagccuucaagcuc

SEQ ID NO: 1335174 - RNA, 17 nt, Human
uacagagacagaaagca

SEQ ID NO: 1335175 - RNA, 22 nt, Human
uacagagaagccuucaagcucu

SEQ ID NO: 1335176 - RNA, 23 nt, Human
uacagagaagccuucaagcucug

SEQ ID NO: 1335177 - RNA, 24 nt, Human
uacagagaagccuucaagcucuga

SEQ ID NO: 1335178 - RNA, 13 nt, Human
uacagagaaguca

SEQ ID NO: 1335179 - RNA, 20 nt, Human
uacagagaagucacagggca

SEQ ID NO: 1335180 - RNA, 22 nt, Human
uacagagaagucacagggcagu

SEQ ID NO: 1335181 - RNA, 21 nt, Human
uacagagaagucacagggcag

SEQ ID NO: 1335182 - RNA, 22 nt, Human
aauggaggggcagagccaggaa

SEQ ID NO: 1335183 - RNA, 21 nt, Human
aauggaggggcagagccagga

SEQ ID NO: 1335184 - RNA, 20 nt, Human
aauggaggggcagagccagg

SEQ ID NO: 1335185 - RNA, 19 nt, Human
aauggaggggcagagccag

SEQ ID NO: 1335186 - RNA, 17 nt, Human
aauggaggccauugugu

SEQ ID NO: 1335187 - RNA, 13 nt, Human
aauggaucacaag

SEQ ID NO: 1335188 - RNA, 16 nt, Human
aauggaucacaagaug

SEQ ID NO: 1335189 - RNA, 18 nt, Human
aauggaucacaagaugga

SEQ ID NO: 1335190 - RNA, 17 nt, Human
aauggaucacaagaugg

SEQ ID NO: 1335191 - RNA, 14 nt, Human
aauguaaacuguuu

SEQ ID NO: 1335192 - RNA, 16 nt, Human
aauguaaacuguuucu

SEQ ID NO: 1335193 - RNA, 17 nt, Human
aauguaaacuguuucuu

SEQ ID NO: 1335194 - RNA, 21 nt, Human
aauguaaacuguuucuuuaaa

SEQ ID NO: 1335195 - RNA, 15 nt, Human
aauguaaagacaaaa

SEQ ID NO: 1335196 - RNA, 14 nt, Human
aauguaaagccaug

SEQ ID NO: 1335197 - RNA, 15 nt, Human
aauguaaagccaugc

SEQ ID NO: 1335198 - RNA, 20 nt, Human
aauguaaaggagucaaaacu

SEQ ID NO: 1335199 - RNA, 21 nt, Human
aauguaaaggagucaaaacua

SEQ ID NO: 1335200 - RNA, 23 nt, Human
aauguaaaggagucaaaacuaca

SEQ ID NO: 1335201 - RNA, 12 nt, Human
aauguaaauaaa

SEQ ID NO: 1335202 - RNA, 19 nt, Human
aauguaaagcuugucugau

SEQ ID NO: 1335203 - RNA, 16 nt, Human
aauguaaauauuuuaa

SEQ ID NO: 1335204 - RNA, 17 nt, Human
aauguaaauauuuuaaa

SEQ ID NO: 1335205 - RNA, 19 nt, Human
aauguaaauauuuuaaaga

SEQ ID NO: 1335206 - RNA, 20 nt, Human
aauguaaauauuuuaaagaa

SEQ ID NO: 1335207 - RNA, 21 nt, Human
aauguaaauauuuuaaagaau

SEQ ID NO: 1335208 - RNA, 22 nt, Human
aauguaaauauuuuaaagaauu

SEQ ID NO: 1335209 - RNA, 22 nt, Human
aauguaaggcuguguaagauuu

SEQ ID NO: 1335210 - RNA, 13 nt, Human
aauguaaggcugu

SEQ ID NO: 1335211 - RNA, 15 nt, Human
aauguaaggcugugu

SEQ ID NO: 1335212 - RNA, 17 nt, Human
aauguaaggcuguguaa

SEQ ID NO: 1335213 - RNA, 18 nt, Human
aauguaaggcuguguaag

SEQ ID NO: 1335214 - RNA, 16 nt, Human
aauguaauagggaaaa

SEQ ID NO: 1335215 - RNA, 22 nt, Human
aaugcuguauuuuaaaagaaug

SEQ ID NO: 1335216 - RNA, 14 nt, Human
aaugcuucuaagua

SEQ ID NO: 1335217 - RNA, 18 nt, Human
aaugcuucuaaguaaaua

SEQ ID NO: 1335218 - RNA, 19 nt, Human
aaugcuucuaaguaaauac

SEQ ID NO: 1335219 - RNA, 20 nt, Human
aaugcuucuaaguaaauaca

SEQ ID NO: 1335220 - RNA, 21 nt, Human
aaugcuucuaaguaaauacaa

SEQ ID NO: 1335221 - RNA, 23 nt, Human
aaugcuucuaaguaaauacaauu

SEQ ID NO: 1335222 - RNA, 22 nt, Human
aaugcuucuaaguaaauacaau

SEQ ID NO: 1335223 - RNA, 21 nt, Human
aaugcuguauuuuaaaagaau

SEQ ID NO: 1335224 - RNA, 18 nt, Human
aaugcugggacucagccu

SEQ ID NO: 1335225 - RNA, 22 nt, Human
aaugcauuauaggaucauuugu

SEQ ID NO: 1335226 - RNA, 21 nt, Human
uaauuuuuuucaccuagauuu

SEQ ID NO: 1335227 - RNA, 21 nt, Human
uaauuuuugauacuaagcauu

SEQ ID NO: 1335228 - RNA, 21 nt, Human
uacaaaaaaaaaaaaaaauua

SEQ ID NO: 1335229 - RNA, 22 nt, Human
uaauuuuuuuuuuccuuuuaaa

SEQ ID NO: 1335230 - RNA, 15 nt, Human
uaauuuuuguauuuu

SEQ ID NO: 1335231 - RNA, 20 nt, Human
uaauuuuugauacuaagcau

SEQ ID NO: 1335232 - RNA, 14 nt, Human
uaauuuuuguaauu

SEQ ID NO: 1335233 - RNA, 16 nt, Human
uaauuuuuccuauauu

SEQ ID NO: 1335234 - RNA, 23 nt, Human
uaauuuuugauacuaagcauuga

SEQ ID NO: 1335235 - RNA, 22 nt, Human
uaauuuuuauuaauuuuaguuu

SEQ ID NO: 1335236 - RNA, 16 nt, Human
uaauuuuuauuucuuc

SEQ ID NO: 1335237 - RNA, 17 nt, Human
uaauuuuuauuucuucc

SEQ ID NO: 1335238 - RNA, 18 nt, Human
uaauuuuuauuucuuccu

SEQ ID NO: 1335239 - RNA, 17 nt, Human
uaauuuuucacuucaaa

SEQ ID NO: 1335240 - RNA, 13 nt, Human
uaauuuuuccaac

SEQ ID NO: 1335241 - RNA, 14 nt, Human
uaauuuuuccaacu

SEQ ID NO: 1335242 - RNA, 23 nt, Human
uaauuuuuauuuuugcugagacu

SEQ ID NO: 1335243 - RNA, 18 nt, Human
uacaauuaaaaaaaaaga

SEQ ID NO: 1335244 - RNA, 22 nt, Human
uacaauuaaaaaaaaagaucug

SEQ ID NO: 1335245 - RNA, 19 nt, Human
uacaauuaaagcuguuauu

SEQ ID NO: 1335246 - RNA, 16 nt, Human
uacaauucauuguguu

SEQ ID NO: 1335247 - RNA, 21 nt, Human
uacaauucauuguguuaccug

SEQ ID NO: 1335248 - RNA, 17 nt, Human
uacccuaaccaaguucc

SEQ ID NO: 1335249 - RNA, 16 nt, Human
uacccuaaccaaguuc

SEQ ID NO: 1335250 - RNA, 14 nt, Human
uacccuaaccaagu

SEQ ID NO: 1335251 - RNA, 17 nt, Human
uacccguucacauuuuu

SEQ ID NO: 1335252 - RNA, 15 nt, Human
uacccccugugccuu

SEQ ID NO: 1335253 - RNA, 23 nt, Human
uaccugaagcuaucguaaaauua

SEQ ID NO: 1335254 - RNA, 13 nt, Human
uaccugaaaacac

SEQ ID NO: 1335255 - RNA, 20 nt, Human
uaccugaaaacacugugcac

SEQ ID NO: 1335256 - RNA, 21 nt, Human
uaccugaaaacacugugcaca

SEQ ID NO: 1335257 - RNA, 16 nt, Human
uaccugaaugcucugu

SEQ ID NO: 1335258 - RNA, 17 nt, Human
uaccugacacucccuug

SEQ ID NO: 1335259 - RNA, 14 nt, Human
uaccugaaugcucu

SEQ ID NO: 1335260 - RNA, 13 nt, Human
aauuacauuugua

SEQ ID NO: 1335261 - RNA, 14 nt, Human
aauuacauuuguau

SEQ ID NO: 1335262 - RNA, 19 nt, Human
aauuacauuacugaaaacu

SEQ ID NO: 1335263 - RNA, 22 nt, Human
aauuacauuacugaaaacuuca

SEQ ID NO: 1335264 - RNA, 20 nt, Human
uaccugacacucccuugggc

SEQ ID NO: 1335265 - RNA, 15 nt, Human
uaccugagggucugu

SEQ ID NO: 1335266 - RNA, 11 nt, Human
uaccugagggu

SEQ ID NO: 1335267 - RNA, 12 nt, Human
uaccugauuuuu

SEQ ID NO: 1335268 - RNA, 18 nt, Human
uaccugauuuuuuuuccu

SEQ ID NO: 1335269 - RNA, 12 nt, Human
uaccugugccug

SEQ ID NO: 1335270 - RNA, 12 nt, Human
uaccuguggaua

SEQ ID NO: 1335271 - RNA, 16 nt, Human
uaccuguguggacagg

SEQ ID NO: 1335272 - RNA, 17 nt, Human
uaccuguguuucuugcc

SEQ ID NO: 1335273 - RNA, 21 nt, Human
uaccuguguuucuugccucau

SEQ ID NO: 1335274 - RNA, 20 nt, Human
uaccuguguuucuugccuca

SEQ ID NO: 1335275 - RNA, 13 nt, Human
uaccuguugagca

SEQ ID NO: 1335276 - RNA, 14 nt, Human
uaccuguugagcau

SEQ ID NO: 1335277 - RNA, 21 nt, Human
uaccuguugagcaucacagaa

SEQ ID NO: 1335278 - RNA, 22 nt, Human
aauuaugugacauuuuacauua

SEQ ID NO: 1335279 - RNA, 22 nt, Human
aauuaugugccagauuuaugca

SEQ ID NO: 1335280 - RNA, 20 nt, Human
aauuaugugacauuuuacau

SEQ ID NO: 1335281 - RNA, 17 nt, Human
aauuaugugacauuuua

SEQ ID NO: 1335282 - RNA, 15 nt, Human
aauuaugugacauuu

SEQ ID NO: 1335283 - RNA, 15 nt, Human
aauuagacugugauu

SEQ ID NO: 1335284 - RNA, 19 nt, Human
aauuagacugugauucaga

SEQ ID NO: 1335285 - RNA, 20 nt, Human
aauuagacugugauucagaa

SEQ ID NO: 1335286 - RNA, 21 nt, Human
aauuagacugugauucagaaa

SEQ ID NO: 1335287 - RNA, 23 nt, Human
aauuagacugugauucagaaaau

SEQ ID NO: 1335288 - RNA, 13 nt, Human
aauuacuuaguau

SEQ ID NO: 1335289 - RNA, 22 nt, Human
aauuacuuuggggcuaauuuaa

SEQ ID NO: 1335290 - RNA, 17 nt, Human
aauuacuuaguauugca

SEQ ID NO: 1335291 - RNA, 15 nt, Human
aauuaccaaccuguu

SEQ ID NO: 1335292 - RNA, 21 nt, Human
aauuaccacaccaucucccau

SEQ ID NO: 1335293 - RNA, 21 nt, Human
aauuaccaugcuucacaaugu

SEQ ID NO: 1335294 - RNA, 23 nt, Human
aauuacuuuggggcuaauuuaac

SEQ ID NO: 1335295 - RNA, 16 nt, Human
aauuagacacuuugga

SEQ ID NO: 1335296 - RNA, 17 nt, Human
aauuagacacuuuggaa

SEQ ID NO: 1335297 - RNA, 16 nt, Human
aauuauuguuuuucuu

SEQ ID NO: 1335298 - RNA, 22 nt, Human
aauuauuuaaaccgcuaaaaga

SEQ ID NO: 1335299 - RNA, 11 nt, Human
aauuauuauuu

SEQ ID NO: 1335300 - RNA, 13 nt, Human
aauuauuauuuau

SEQ ID NO: 1335301 - RNA, 16 nt, Human
aauuauuauuuauaua

SEQ ID NO: 1335302 - RNA, 18 nt, Human
aauuauuauuuauauaug

SEQ ID NO: 1335303 - RNA, 21 nt, Human
aauuauuauuuauauauguau

SEQ ID NO: 1335304 - RNA, 12 nt, Human
aauuauuguaca

SEQ ID NO: 1335305 - RNA, 21 nt, Human
aauuauuguacauuuauaguu

SEQ ID NO: 1335306 - RNA, 16 nt, Human
aauuauuaaugaaaau

SEQ ID NO: 1335307 - RNA, 17 nt, Human
aauuauuaaugaaaaua

SEQ ID NO: 1335308 - RNA, 22 nt, Human
aauuauuaaugaaaauaagaau

SEQ ID NO: 1335309 - RNA, 23 nt, Human
aauuauuacaguguuuauccuuu

SEQ ID NO: 1335310 - RNA, 14 nt, Human
aauuauuacagugu

SEQ ID NO: 1335311 - RNA, 18 nt, Human
aauuauuacaguguuuau

SEQ ID NO: 1335312 - RNA, 13 nt, Human
aauuauuauucuu

SEQ ID NO: 1335313 - RNA, 21 nt, Human
aauuauuauucuucauaacaa

SEQ ID NO: 1335314 - RNA, 22 nt, Human
aauucagacaucugagguuuua

SEQ ID NO: 1335315 - RNA, 14 nt, Human
aauucagcauuuga

SEQ ID NO: 1335316 - RNA, 15 nt, Human
aauucagguuuuucc

SEQ ID NO: 1335317 - RNA, 17 nt, Human
aauucaauuuggauuua

SEQ ID NO: 1335318 - RNA, 13 nt, Human
aauucacaaacuu

SEQ ID NO: 1335319 - RNA, 16 nt, Human
aauucagacaucugag

SEQ ID NO: 1335320 - RNA, 21 nt, Human
aauucagacaucugagguuuu

SEQ ID NO: 1335321 - RNA, 19 nt, Human
aauucagguuuuuccuuuu

SEQ ID NO: 1335322 - RNA, 13 nt, Human
aauucaguuucau

SEQ ID NO: 1335323 - RNA, 14 nt, Human
aauucaguuucaua

SEQ ID NO: 1335324 - RNA, 15 nt, Human
aauucaguuucauaa

SEQ ID NO: 1335325 - RNA, 16 nt, Human
aauucaguuucauaaa

SEQ ID NO: 1335326 - RNA, 17 nt, Human
aauucauaaucacucua

SEQ ID NO: 1335327 - RNA, 22 nt, Human
aauuauuucaugauuagaaauu

SEQ ID NO: 1335328 - RNA, 12 nt, Human
aauuauuugcau

SEQ ID NO: 1335329 - RNA, 21 nt, Human
aauucaacuuaacuaucaucu

SEQ ID NO: 1335330 - RNA, 16 nt, Human
aauucaaggaauuucu

SEQ ID NO: 1335331 - RNA, 17 nt, Human
aauucaaggaauuucuu

SEQ ID NO: 1335332 - RNA, 23 nt, Human
aauucaaggaauuucuuaacuuc

SEQ ID NO: 1335333 - RNA, 15 nt, Human
aauucaauucaaagc

SEQ ID NO: 1335334 - RNA, 13 nt, Human
aauucaauucaaa

SEQ ID NO: 1335335 - RNA, 22 nt, Human
aauguuaugacuauguaaacua

SEQ ID NO: 1335336 - RNA, 19 nt, Human
aauguuaugacuauguaaa

SEQ ID NO: 1335337 - RNA, 16 nt, Human
aauguuaucuucucaa

SEQ ID NO: 1335338 - RNA, 17 nt, Human
aauguuaucuucucaag

SEQ ID NO: 1335339 - RNA, 22 nt, Human
aauguuaucuucucaaguucua

SEQ ID NO: 1335340 - RNA, 23 nt, Human
aauguuaucuucucaaguucuaa

SEQ ID NO: 1335341 - RNA, 14 nt, Human
aauguuauuucccu

SEQ ID NO: 1335342 - RNA, 18 nt, Human
aauguucacaauauauuu

SEQ ID NO: 1335343 - RNA, 19 nt, Human
aauguuauuuuuuaauuau

SEQ ID NO: 1335344 - RNA, 20 nt, Human
aauguuauuuuuuaauuauu

SEQ ID NO: 1335345 - RNA, 13 nt, Human
aauguucaucaau

SEQ ID NO: 1335346 - RNA, 15 nt, Human
aauguuacauuauua

SEQ ID NO: 1335347 - RNA, 16 nt, Human
aauguuacauuauuau

SEQ ID NO: 1335348 - RNA, 17 nt, Human
aauguuagccucaauuu

SEQ ID NO: 1335349 - RNA, 14 nt, Human
uacagggggucugg

SEQ ID NO: 1335350 - RNA, 16 nt, Human
uacagggggucuggcu

SEQ ID NO: 1335351 - RNA, 17 nt, Human
uacagggggucuggcug

SEQ ID NO: 1335352 - RNA, 22 nt, Human
uacagggggucuggcugguguu

SEQ ID NO: 1335353 - RNA, 18 nt, Human
uacagggggucuggcugg

SEQ ID NO: 1335354 - RNA, 19 nt, Human
uacagggggucuggcuggu

SEQ ID NO: 1335355 - RNA, 21 nt, Human
uacagggggucuggcuggugu

SEQ ID NO: 1335356 - RNA, 22 nt, Human
aauguggcaaggaaaaacaggu

SEQ ID NO: 1335357 - RNA, 21 nt, Human
aauguggccccugaacaagaa

SEQ ID NO: 1335358 - RNA, 21 nt, Human
aauguucuaaguuucuaagau

SEQ ID NO: 1335359 - RNA, 22 nt, Human
aauguucuaaguuucuaagauu

SEQ ID NO: 1335360 - RNA, 23 nt, Human
aauguucuaaguuucuaagauuc

SEQ ID NO: 1335361 - RNA, 13 nt, Human
aauguucuaaguu

SEQ ID NO: 1335362 - RNA, 14 nt, Human
aauguucuaaguuu

SEQ ID NO: 1335363 - RNA, 16 nt, Human
aauguucuaaguuucu

SEQ ID NO: 1335364 - RNA, 17 nt, Human
aauguucuaaguuucua

SEQ ID NO: 1335365 - RNA, 19 nt, Human
aauguucuaaguuucuaag

SEQ ID NO: 1335366 - RNA, 20 nt, Human
aauguucuaaguuucuaaga

SEQ ID NO: 1335367 - RNA, 17 nt, Human
aauguucucagauuucu

SEQ ID NO: 1335368 - RNA, 20 nt, Human
aauguuggacaccuuuaggu

SEQ ID NO: 1335369 - RNA, 21 nt, Human
aauguuggacaccuuuagguu

SEQ ID NO: 1335370 - RNA, 13 nt, Human
aauguugggacug

SEQ ID NO: 1335371 - RNA, 21 nt, Human
aauguugggacugcuaaauaa

SEQ ID NO: 1335372 - RNA, 23 nt, Human
aauguuggucauuuuauguuaag

SEQ ID NO: 1335373 - RNA, 20 nt, Human
aauguucaucaaugaaugaa

SEQ ID NO: 1335374 - RNA, 16 nt, Human
aauguucaucaaugaa

SEQ ID NO: 1335375 - RNA, 21 nt, Human
aauguuauuuuuuaauuauua

SEQ ID NO: 1335376 - RNA, 12 nt, Human
aauguucaucau

SEQ ID NO: 1335377 - RNA, 22 nt, Human
aauguugggacugcuaaauaaa

SEQ ID NO: 1335378 - RNA, 15 nt, Human
aauguuguuauuuaa

SEQ ID NO: 1335379 - RNA, 13 nt, Human
uacauuuccuaaa

SEQ ID NO: 1335380 - RNA, 14 nt, Human
uacauuccaacucg

SEQ ID NO: 1335381 - RNA, 13 nt, Human
aauguuuaaaaca

SEQ ID NO: 1335382 - RNA, 13 nt, Human
uacauucauuuag

SEQ ID NO: 1335383 - RNA, 15 nt, Human
uacauucauuuagcu

SEQ ID NO: 1335384 - RNA, 14 nt, Human
uaccagauaacuuu

SEQ ID NO: 1335385 - RNA, 15 nt, Human
uaccagauaacuuuu

SEQ ID NO: 1335386 - RNA, 23 nt, Human
uaccagauaacuuuuuuuuuucu

SEQ ID NO: 1335387 - RNA, 16 nt, Human
uacauuugaacuugau

SEQ ID NO: 1335388 - RNA, 19 nt, Human
uaccagggacugaggggag

SEQ ID NO: 1335389 - RNA, 12 nt, Human
uaccagaugcag

SEQ ID NO: 1335390 - RNA, 13 nt, Human
uaccagcgaggag

SEQ ID NO: 1335391 - RNA, 15 nt, Human
uaccagcgaggaggc

SEQ ID NO: 1335392 - RNA, 20 nt, Human
uaccagcgaggaggcuccag

SEQ ID NO: 1335393 - RNA, 17 nt, Human
uaccaggcaccaaaaga

SEQ ID NO: 1335394 - RNA, 18 nt, Human
uaccaggcaccaaaagaa

SEQ ID NO: 1335395 - RNA, 21 nt, Human
uaccaggcaccaaaagaagua

SEQ ID NO: 1335396 - RNA, 12 nt, Human
uaccaguauuua

SEQ ID NO: 1335397 - RNA, 18 nt, Human
uaccaguauuuaacuucu

SEQ ID NO: 1335398 - RNA, 15 nt, Human
uaccaguauuuagaa

SEQ ID NO: 1335399 - RNA, 18 nt, Human
uaccaguauuuagaagcc

SEQ ID NO: 1335400 - RNA, 19 nt, Human
uaccaguauuuagaagcca

SEQ ID NO: 1335401 - RNA, 20 nt, Human
uaccaguauuuagaagccaa

SEQ ID NO: 1335402 - RNA, 14 nt, Human
uaccagucucacau

SEQ ID NO: 1335403 - RNA, 15 nt, Human
uacccccugcaaagc

SEQ ID NO: 1335404 - RNA, 19 nt, Human
uacccccugcaaagcccag

SEQ ID NO: 1335405 - RNA, 23 nt, Human
uacccccugcaaagcccagcuug

SEQ ID NO: 1335406 - RNA, 14 nt, Human
uaccauuaaaccau

SEQ ID NO: 1335407 - RNA, 22 nt, Human
uaccauuaaaccaucucccugg

SEQ ID NO: 1335408 - RNA, 15 nt, Human
uaccauuaaaccauc

SEQ ID NO: 1335409 - RNA, 16 nt, Human
uaccauuaaaccaucu

SEQ ID NO: 1335410 - RNA, 20 nt, Human
uaccauuaaaccaucucccu

SEQ ID NO: 1335411 - RNA, 18 nt, Human
uaccaguuaauuuuucca

SEQ ID NO: 1335412 - RNA, 19 nt, Human
uaccaguuaauuuuuccaa

SEQ ID NO: 1335413 - RNA, 12 nt, Human
uaccaguugccu

SEQ ID NO: 1335414 - RNA, 18 nt, Human
uaccaugcuucacaaugu

SEQ ID NO: 1335415 - RNA, 18 nt, Human
uaccauguaauggcaguu

SEQ ID NO: 1335416 - RNA, 15 nt, Human
uaccauguaauggca

SEQ ID NO: 1335417 - RNA, 14 nt, Human
uaccaugucuuucu

SEQ ID NO: 1335418 - RNA, 13 nt, Human
uaagacaaauaug

SEQ ID NO: 1335419 - RNA, 23 nt, Human
uaagacaaaaagcuacuuauugu

SEQ ID NO: 1335420 - RNA, 17 nt, Human
uaagaccuggcagcucu

SEQ ID NO: 1335421 - RNA, 18 nt, Human
uaagaccuggcagcucug

SEQ ID NO: 1335422 - RNA, 20 nt, Human
uaagacggauuuauuuuucc

SEQ ID NO: 1335423 - RNA, 16 nt, Human
uaagaauucagacauc

SEQ ID NO: 1335424 - RNA, 15 nt, Human
uaagaauucagacau

SEQ ID NO: 1335425 - RNA, 16 nt, Human
uaagaauugaguaaug

SEQ ID NO: 1335426 - RNA, 18 nt, Human
uaagaauugaguaauggu

SEQ ID NO: 1335427 - RNA, 19 nt, Human
uaagaauugaguaauggug

SEQ ID NO: 1335428 - RNA, 20 nt, Human
uaagaauugaguaauggugu

SEQ ID NO: 1335429 - RNA, 21 nt, Human
uaagaauugaguaauggugua

SEQ ID NO: 1335430 - RNA, 22 nt, Human
uaagaauugaguaaugguguag

SEQ ID NO: 1335431 - RNA, 18 nt, Human
uaagaagugaaaaucuac

SEQ ID NO: 1335432 - RNA, 18 nt, Human
uaagaaggcaaaaaugua

SEQ ID NO: 1335433 - RNA, 12 nt, Human
uaagaauuauuu

SEQ ID NO: 1335434 - RNA, 17 nt, Human
uaagaauuauuuugaug

SEQ ID NO: 1335435 - RNA, 13 nt, Human
uaagaagugaaaa

SEQ ID NO: 1335436 - RNA, 13 nt, Human
uaagaaggcaaaa

SEQ ID NO: 1335437 - RNA, 17 nt, Human
uaagaaggcaaaaaugu

SEQ ID NO: 1335438 - RNA, 16 nt, Human
uaacuuuaauguuuuu

SEQ ID NO: 1335439 - RNA, 21 nt, Human
uaacuucccugaaaaaucuaa

SEQ ID NO: 1335440 - RNA, 12 nt, Human
uaacuucuguuu

SEQ ID NO: 1335441 - RNA, 16 nt, Human
uaacuucuguuuuacc

SEQ ID NO: 1335442 - RNA, 17 nt, Human
uaacuucuuauggaauu

SEQ ID NO: 1335443 - RNA, 18 nt, Human
uaacuucuuauggaauug

SEQ ID NO: 1335444 - RNA, 19 nt, Human
uaacuucuuauggaauuga

SEQ ID NO: 1335445 - RNA, 17 nt, Human
uaacuuggccgcuguau

SEQ ID NO: 1335446 - RNA, 12 nt, Human
uaacuuggcuca

SEQ ID NO: 1335447 - RNA, 17 nt, Human
uaacguauaaaagccug

SEQ ID NO: 1335448 - RNA, 13 nt, Human
uaacguauaaaag

SEQ ID NO: 1335449 - RNA, 15 nt, Human
uaacgcgucuuccug

SEQ ID NO: 1335450 - RNA, 16 nt, Human
uaacgcgucuuccuga

SEQ ID NO: 1335451 - RNA, 17 nt, Human
uaacgcgucuuccugag

SEQ ID NO: 1335452 - RNA, 14 nt, Human
uaacggaccaaagc

SEQ ID NO: 1335453 - RNA, 19 nt, Human
uaacgccugagcccaggga

SEQ ID NO: 1335454 - RNA, 20 nt, Human
uaacuaaaacaaagccacuu

SEQ ID NO: 1335455 - RNA, 17 nt, Human
uaacuaaaacaaagcca

SEQ ID NO: 1335456 - RNA, 17 nt, Human
uaacguuuaagccaaaa

SEQ ID NO: 1335457 - RNA, 20 nt, Human
uaacguuuaagccaaaacaa

SEQ ID NO: 1335458 - RNA, 22 nt, Human
uaacggucuguucuguuucaag

SEQ ID NO: 1335459 - RNA, 23 nt, Human
uaacggucuguucuguuucaagg

SEQ ID NO: 1335460 - RNA, 16 nt, Human
uaacguugagccccug

SEQ ID NO: 1335461 - RNA, 20 nt, Human
uaacuuccacagggucccac

SEQ ID NO: 1335462 - RNA, 23 nt, Human
uaacuuccacagggucccacagc

SEQ ID NO: 1335463 - RNA, 20 nt, Human
uaacuucccugaaaaaucua

SEQ ID NO: 1335464 - RNA, 16 nt, Human
uaacuauguugauaaa

SEQ ID NO: 1335465 - RNA, 15 nt, Human
uaacuuaauugcuau

SEQ ID NO: 1335466 - RNA, 14 nt, Human
uaacuuacaaagau

SEQ ID NO: 1335467 - RNA, 12 nt, Human
uaacuaggagcu

SEQ ID NO: 1335468 - RNA, 23 nt, Human
uaacuauaguccagcuuuguucu

SEQ ID NO: 1335469 - RNA, 19 nt, Human
uaacaugaauauuuagugu

SEQ ID NO: 1335470 - RNA, 15 nt, Human
uaacaguaucucaaa

SEQ ID NO: 1335471 - RNA, 15 nt, Human
aauauauuuucuguu

SEQ ID NO: 1335472 - RNA, 21 nt, Human
aauauauuuucuguuuucuuu

SEQ ID NO: 1335473 - RNA, 19 nt, Human
aauauauuuuguuuacaaa

SEQ ID NO: 1335474 - RNA, 20 nt, Human
uaacagggaaggcaggcagg

SEQ ID NO: 1335475 - RNA, 23 nt, Human
uaacagggaaggcaggcagggcu

SEQ ID NO: 1335476 - RNA, 22 nt, Human
uaacagggaaggcaggcagggc

SEQ ID NO: 1335477 - RNA, 17 nt, Human
uaacgcaaguucccagu

SEQ ID NO: 1335478 - RNA, 12 nt, Human
uaacgccugagc

SEQ ID NO: 1335479 - RNA, 13 nt, Human
uaacgccugagcc

SEQ ID NO: 1335480 - RNA, 14 nt, Human
uaacgccugagccc

SEQ ID NO: 1335481 - RNA, 18 nt, Human
uaacgccugagcccaggg

SEQ ID NO: 1335482 - RNA, 19 nt, Human
uaacaugugaaaagaauag

SEQ ID NO: 1335483 - RNA, 22 nt, Human
uaacauguguuaaguauuuuca

SEQ ID NO: 1335484 - RNA, 15 nt, Human
uaacauguaggaagu

SEQ ID NO: 1335485 - RNA, 22 nt, Human
uaacauguccugccuauuaucu

SEQ ID NO: 1335486 - RNA, 21 nt, Human
uaacaugaauauuuaguguuc

SEQ ID NO: 1335487 - RNA, 20 nt, Human
uaacaugaauauuuaguguu

SEQ ID NO: 1335488 - RNA, 21 nt, Human
aauauauuuuaagacgaaaca

SEQ ID NO: 1335489 - RNA, 19 nt, Human
aauauauuuaagauaauua

SEQ ID NO: 1335490 - RNA, 20 nt, Human
aauauauuuaagauaauuau

SEQ ID NO: 1335491 - RNA, 22 nt, Human
aauauauuauuacuuguaaaua

SEQ ID NO: 1335492 - RNA, 14 nt, Human
aauauauuuaaaaa

SEQ ID NO: 1335493 - RNA, 16 nt, Human
aauauauuuaaaaaua

SEQ ID NO: 1335494 - RNA, 15 nt, Human
aauauauuuaagaua

SEQ ID NO: 1335495 - RNA, 21 nt, Human
aauauauucagccuggcuuca

SEQ ID NO: 1335496 - RNA, 21 nt, Human
aauaguuaagacaugauuucc

SEQ ID NO: 1335497 - RNA, 22 nt, Human
aauaguuaagacaugauuuccu

SEQ ID NO: 1335498 - RNA, 23 nt, Human
aauaguuaagacaugauuuccuu

SEQ ID NO: 1335499 - RNA, 14 nt, Human
aauagcguucuugu

SEQ ID NO: 1335500 - RNA, 15 nt, Human
aauagcguucuugua

SEQ ID NO: 1335501 - RNA, 16 nt, Human
aauagcguucuuguaa

SEQ ID NO: 1335502 - RNA, 18 nt, Human
aauagcguucuuguaauu

SEQ ID NO: 1335503 - RNA, 19 nt, Human
aauagcguucuuguaauuu

SEQ ID NO: 1335504 - RNA, 21 nt, Human
aauagcuaaauaccucaauca

SEQ ID NO: 1335505 - RNA, 17 nt, Human
aauagucggugaagaaa

SEQ ID NO: 1335506 - RNA, 23 nt, Human
aauaccacaggaaccacaagacu

SEQ ID NO: 1335507 - RNA, 14 nt, Human
aauacauuuaaaac

SEQ ID NO: 1335508 - RNA, 17 nt, Human
aauacauuuaaaacauu

SEQ ID NO: 1335509 - RNA, 20 nt, Human
aauacauuuaaaacauuaaa

SEQ ID NO: 1335510 - RNA, 21 nt, Human
aauacauuuaaaacauuaaaa

SEQ ID NO: 1335511 - RNA, 22 nt, Human
aauacauuuaaaacauuaaaau

SEQ ID NO: 1335512 - RNA, 23 nt, Human
aauacauuuaaaacauuaaaaua

SEQ ID NO: 1335513 - RNA, 17 nt, Human
aauaccacucuguaauu

SEQ ID NO: 1335514 - RNA, 18 nt, Human
aauaccacucuguaauug

SEQ ID NO: 1335515 - RNA, 19 nt, Human
aauaccacucuguaauugc

SEQ ID NO: 1335516 - RNA, 15 nt, Human
aauacagacuggaug

SEQ ID NO: 1335517 - RNA, 12 nt, Human
aauacagauaua

SEQ ID NO: 1335518 - RNA, 13 nt, Human
aauacagauauau

SEQ ID NO: 1335519 - RNA, 14 nt, Human
aauacagauauauu

SEQ ID NO: 1335520 - RNA, 15 nt, Human
aauacagauauauuu

SEQ ID NO: 1335521 - RNA, 19 nt, Human
aauacagauauauuuucuu

SEQ ID NO: 1335522 - RNA, 16 nt, Human
aauacagaucaucuug

SEQ ID NO: 1335523 - RNA, 18 nt, Human
aauacagcaacaauuuau

SEQ ID NO: 1335524 - RNA, 15 nt, Human
aauacagaucaucuu

SEQ ID NO: 1335525 - RNA, 13 nt, Human
aauacaggaaaca

SEQ ID NO: 1335526 - RNA, 15 nt, Human
aauacaggaaacagu

SEQ ID NO: 1335527 - RNA, 16 nt, Human
aauacaggaaacaguu

SEQ ID NO: 1335528 - RNA, 18 nt, Human
aauacaggaaacaguugc

SEQ ID NO: 1335529 - RNA, 23 nt, Human
aauacaggaaacaguugcaugua

SEQ ID NO: 1335530 - RNA, 16 nt, Human
aauacagggcauuuug

SEQ ID NO: 1335531 - RNA, 17 nt, Human
aauacaugacauuuauu

SEQ ID NO: 1335532 - RNA, 23 nt, Human
aauacaugacauuuauuuuucau

SEQ ID NO: 1335533 - RNA, 21 nt, Human
aauacaugcuaagagaaguag

SEQ ID NO: 1335534 - RNA, 22 nt, Human
aauacaugcuaagagaaguaga

SEQ ID NO: 1335535 - RNA, 23 nt, Human
aauacaugcuaagagaaguagaa

SEQ ID NO: 1335536 - RNA, 19 nt, Human
aauacauuauauuucuauu

SEQ ID NO: 1335537 - RNA, 18 nt, Human
aauaccugaaugcucugu

SEQ ID NO: 1335538 - RNA, 17 nt, Human
aauaccugaaugcucug

SEQ ID NO: 1335539 - RNA, 15 nt, Human
aauaccucuaauagu

SEQ ID NO: 1335540 - RNA, 21 nt, Human
aauacccaugucuacacagau

SEQ ID NO: 1335541 - RNA, 20 nt, Human
aauaccacucuguaauugca

SEQ ID NO: 1335542 - RNA, 21 nt, Human
aauaccacucuguaauugcaa

SEQ ID NO: 1335543 - RNA, 12 nt, Human
aauaccugcuca

SEQ ID NO: 1335544 - RNA, 16 nt, Human
aauagacuuaaaucuc

SEQ ID NO: 1335545 - RNA, 14 nt, Human
aauagagccugagg

SEQ ID NO: 1335546 - RNA, 16 nt, Human
aauagagccugaggga

SEQ ID NO: 1335547 - RNA, 13 nt, Human
aauagcaaaagaa

SEQ ID NO: 1335548 - RNA, 16 nt, Human
aauagcaaaagaagaa

SEQ ID NO: 1335549 - RNA, 19 nt, Human
aauagcaaaagaagaaguu

SEQ ID NO: 1335550 - RNA, 20 nt, Human
aauagcaaaagaagaaguuu

SEQ ID NO: 1335551 - RNA, 14 nt, Human
aauagcaaagaauu

SEQ ID NO: 1335552 - RNA, 15 nt, Human
aauagcaaagaauug

SEQ ID NO: 1335553 - RNA, 18 nt, Human
aauagcaaagaauugacu

SEQ ID NO: 1335554 - RNA, 23 nt, Human
aauagcagaaaaaccaacaucua

SEQ ID NO: 1335555 - RNA, 14 nt, Human
aauagcagccuuuc

SEQ ID NO: 1335556 - RNA, 12 nt, Human
aauagcauguca

SEQ ID NO: 1335557 - RNA, 15 nt, Human
aauagcaugucacua

SEQ ID NO: 1335558 - RNA, 13 nt, Human
uaacaaugcugua

SEQ ID NO: 1335559 - RNA, 13 nt, Human
uaacaauacaaau

SEQ ID NO: 1335560 - RNA, 14 nt, Human
uaacaauacaaaug

SEQ ID NO: 1335561 - RNA, 16 nt, Human
uaacaauacaaaugga

SEQ ID NO: 1335562 - RNA, 17 nt, Human
uaacaauacaaauggau

SEQ ID NO: 1335563 - RNA, 18 nt, Human
uaacaauacaaauggauu

SEQ ID NO: 1335564 - RNA, 19 nt, Human
uaacaauacaaauggauuu

SEQ ID NO: 1335565 - RNA, 20 nt, Human
uaacaauacaaauggauuuu

SEQ ID NO: 1335566 - RNA, 14 nt, Human
uaacaaucagcucc

SEQ ID NO: 1335567 - RNA, 20 nt, Human
uaaauguuaugacuauguaa

SEQ ID NO: 1335568 - RNA, 22 nt, Human
uaaauuaucaggcaaauuugca

SEQ ID NO: 1335569 - RNA, 13 nt, Human
uaaauuauguaaa

SEQ ID NO: 1335570 - RNA, 16 nt, Human
uaaauuauguaaauua

SEQ ID NO: 1335571 - RNA, 15 nt, Human
uaacaaaauguaugu

SEQ ID NO: 1335572 - RNA, 16 nt, Human
uaacaaaauguauguc

SEQ ID NO: 1335573 - RNA, 19 nt, Human
uaacaaaauguaugucugg

SEQ ID NO: 1335574 - RNA, 18 nt, Human
uaaauuauuguuuuucuu

SEQ ID NO: 1335575 - RNA, 13 nt, Human
uaacaaacaaauu

SEQ ID NO: 1335576 - RNA, 20 nt, Human
uaacaaaauguaugucuggu

SEQ ID NO: 1335577 - RNA, 21 nt, Human
uaaauguuaugacuauguaaa

SEQ ID NO: 1335578 - RNA, 19 nt, Human
uaaauguuaugacuaugua

SEQ ID NO: 1335579 - RNA, 13 nt, Human
uaaaugugguaaa

SEQ ID NO: 1335580 - RNA, 15 nt, Human
uaaaugaacaagaga

SEQ ID NO: 1335581 - RNA, 16 nt, Human
uaaaugaacaagagaa

SEQ ID NO: 1335582 - RNA, 17 nt, Human
uaaaugaacaagagaag

SEQ ID NO: 1335583 - RNA, 23 nt, Human
uaaaugaacaagagaagcauucu

SEQ ID NO: 1335584 - RNA, 12 nt, Human
uaaaugaagaaa

SEQ ID NO: 1335585 - RNA, 12 nt, Human
uaaaugaauguu

SEQ ID NO: 1335586 - RNA, 19 nt, Human
uaaaucuuuuauaggauuu

SEQ ID NO: 1335587 - RNA, 23 nt, Human
uaaaucuuuuauaggauuuauuu

SEQ ID NO: 1335588 - RNA, 13 nt, Human
uaaaugaacaaga

SEQ ID NO: 1335589 - RNA, 13 nt, Human
aagugccuuucag

SEQ ID NO: 1335590 - RNA, 14 nt, Human
aagugccuuucagg

SEQ ID NO: 1335591 - RNA, 19 nt, Human
aagugccuuucaggaucua

SEQ ID NO: 1335592 - RNA, 20 nt, Human
aagugccuuucaggaucuau

SEQ ID NO: 1335593 - RNA, 21 nt, Human
aagugccuuucaggaucuauu

SEQ ID NO: 1335594 - RNA, 22 nt, Human
aagugcguccacgagcuguuua

SEQ ID NO: 1335595 - RNA, 13 nt, Human
aaguguauuugga

SEQ ID NO: 1335596 - RNA, 15 nt, Human
aaguguauuuggaaa

SEQ ID NO: 1335597 - RNA, 21 nt, Human
aaguguauuuggaaauaaagu

SEQ ID NO: 1335598 - RNA, 11 nt, Human
aaucuguaaaa

SEQ ID NO: 1335599 - RNA, 13 nt, Human
aaucuauuuuucc

SEQ ID NO: 1335600 - RNA, 11 nt, Human
aaucuguaaac

SEQ ID NO: 1335601 - RNA, 12 nt, Human
aaucuguaaacu

SEQ ID NO: 1335602 - RNA, 19 nt, Human
aaucuauuuucucauugcu

SEQ ID NO: 1335603 - RNA, 14 nt, Human
aaucuauuuuguaa

SEQ ID NO: 1335604 - RNA, 17 nt, Human
aaucuauuuuguaacuu

SEQ ID NO: 1335605 - RNA, 21 nt, Human
aaucuauggucgggagacagc

SEQ ID NO: 1335606 - RNA, 14 nt, Human
aauccucccagaaa

SEQ ID NO: 1335607 - RNA, 18 nt, Human
aauccucucucuguguua

SEQ ID NO: 1335608 - RNA, 18 nt, Human
aauccccaacaugcacug

SEQ ID NO: 1335609 - RNA, 13 nt, Human
aauccccuucucc

SEQ ID NO: 1335610 - RNA, 14 nt, Human
aauccccuucuccc

SEQ ID NO: 1335611 - RNA, 15 nt, Human
aauccccuucucccc

SEQ ID NO: 1335612 - RNA, 16 nt, Human
aauccccuucuccccu

SEQ ID NO: 1335613 - RNA, 17 nt, Human
aauccccuucuccccug

SEQ ID NO: 1335614 - RNA, 20 nt, Human
aauccccuucuccccugcac

SEQ ID NO: 1335615 - RNA, 23 nt, Human
aauccccuucuccccugcacugu

SEQ ID NO: 1335616 - RNA, 19 nt, Human
aaucccucaccuucugagu

SEQ ID NO: 1335617 - RNA, 13 nt, Human
aaucccugcuuuu

SEQ ID NO: 1335618 - RNA, 14 nt, Human
aaucccugcuuuuu

SEQ ID NO: 1335619 - RNA, 22 nt, Human
aaucccugcuuuuuguguuuuu

SEQ ID NO: 1335620 - RNA, 13 nt, Human
uaauaaaaauaaa

SEQ ID NO: 1335621 - RNA, 14 nt, Human
aaucaguuuuccuc

SEQ ID NO: 1335622 - RNA, 20 nt, Human
aaucauaagauauuuuucau

SEQ ID NO: 1335623 - RNA, 19 nt, Human
aaucaguguuugauugccc

SEQ ID NO: 1335624 - RNA, 17 nt, Human
aaucaguucauuagaaa

SEQ ID NO: 1335625 - RNA, 18 nt, Human
aaucaguucauuagaaau

SEQ ID NO: 1335626 - RNA, 19 nt, Human
aaucaguucauuagaaaua

SEQ ID NO: 1335627 - RNA, 20 nt, Human
aaucaguucauuagaaauau

SEQ ID NO: 1335628 - RNA, 23 nt, Human
aaucaguucauuagaaauauuuu

SEQ ID NO: 1335629 - RNA, 12 nt, Human
aaucccaggaug

SEQ ID NO: 1335630 - RNA, 19 nt, Human
aaucccagcccccugacca

SEQ ID NO: 1335631 - RNA, 23 nt, Human
aaucauaagauauuuuucaugau

SEQ ID NO: 1335632 - RNA, 17 nt, Human
uaaguguguguuuuuca

SEQ ID NO: 1335633 - RNA, 13 nt, Human
uaaguauuucaaa

SEQ ID NO: 1335634 - RNA, 16 nt, Human
uaaguuaauaaauaag

SEQ ID NO: 1335635 - RNA, 14 nt, Human
uaaguuaauuuaaa

SEQ ID NO: 1335636 - RNA, 17 nt, Human
uaaguuaguuccacuga

SEQ ID NO: 1335637 - RNA, 19 nt, Human
uaaguuaguuccacugaga

SEQ ID NO: 1335638 - RNA, 21 nt, Human
uaaguacagagaagccaucac

SEQ ID NO: 1335639 - RNA, 12 nt, Human
uaaguauuuagg

SEQ ID NO: 1335640 - RNA, 20 nt, Human
uaaguauuuagguuuuuguu

SEQ ID NO: 1335641 - RNA, 20 nt, Human
uaaguuaguuccacugagac

SEQ ID NO: 1335642 - RNA, 14 nt, Human
uaaguuauaagacu

SEQ ID NO: 1335643 - RNA, 18 nt, Human
uaaguuauagugaauacu

SEQ ID NO: 1335644 - RNA, 17 nt, Human
uaaguuuauuucuuaaa

SEQ ID NO: 1335645 - RNA, 12 nt, Human
uaaguuucuaag

SEQ ID NO: 1335646 - RNA, 13 nt, Human
uaaguuucuaaga

SEQ ID NO: 1335647 - RNA, 14 nt, Human
uaaguuucuaagau

SEQ ID NO: 1335648 - RNA, 15 nt, Human
uaaguuucuaagauu

SEQ ID NO: 1335649 - RNA, 16 nt, Human
uaaguuucuaagauuc

SEQ ID NO: 1335650 - RNA, 17 nt, Human
uaaguuucuaagauucu

SEQ ID NO: 1335651 - RNA, 18 nt, Human
uaaguuucuaagauucua

SEQ ID NO: 1335652 - RNA, 19 nt, Human
uaaguuucuaagauucuaa

SEQ ID NO: 1335653 - RNA, 20 nt, Human
uaaguuucuaagauucuaaa

SEQ ID NO: 1335654 - RNA, 21 nt, Human
uaaguuucuaagauucuaaag

SEQ ID NO: 1335655 - RNA, 23 nt, Human
uaaguuucuaagauucuaaaggu

SEQ ID NO: 1335656 - RNA, 13 nt, Human
uaauaaaaagauu

SEQ ID NO: 1335657 - RNA, 16 nt, Human
uaauaaaaagauugaa

SEQ ID NO: 1335658 - RNA, 15 nt, Human
uaauaaaaagcuuuu

SEQ ID NO: 1335659 - RNA, 18 nt, Human
uaaguacacaauaagcaa

SEQ ID NO: 1335660 - RNA, 11 nt, Human
uaaguacagag

SEQ ID NO: 1335661 - RNA, 12 nt, Human
uaaguacagaga

SEQ ID NO: 1335662 - RNA, 13 nt, Human
uaaguacagagaa

SEQ ID NO: 1335663 - RNA, 14 nt, Human
uaaguacagagaag

SEQ ID NO: 1335664 - RNA, 16 nt, Human
uaaguacagagaagcc

SEQ ID NO: 1335665 - RNA, 17 nt, Human
uaaguacagagaagcca

SEQ ID NO: 1335666 - RNA, 18 nt, Human
uaaguacagagaagccau

SEQ ID NO: 1335667 - RNA, 22 nt, Human
uaaguacagagaagccaucacc

SEQ ID NO: 1335668 - RNA, 20 nt, Human
uaaguaaugauaacuggaaa

SEQ ID NO: 1335669 - RNA, 17 nt, Human
uaagguuuuaauuuagu

SEQ ID NO: 1335670 - RNA, 19 nt, Human
uaaggagaaaucuauagaa

SEQ ID NO: 1335671 - RNA, 21 nt, Human
uaagguuaucuacuuuuacuc

SEQ ID NO: 1335672 - RNA, 15 nt, Human
uaagguucuaaggcc

SEQ ID NO: 1335673 - RNA, 17 nt, Human
uaaggauccggaaagaa

SEQ ID NO: 1335674 - RNA, 18 nt, Human
uaaggauccggaaagaag

SEQ ID NO: 1335675 - RNA, 18 nt, Human
uaagguuuuaauuuagua

SEQ ID NO: 1335676 - RNA, 15 nt, Human
uaaggaccugaaauu

SEQ ID NO: 1335677 - RNA, 21 nt, Human
uaaggaccugaaauuccaaag

SEQ ID NO: 1335678 - RNA, 22 nt, Human
uaaggaccugaaauuccaaagu

SEQ ID NO: 1335679 - RNA, 22 nt, Human
uaaggaauuuuauuuuuuucug

SEQ ID NO: 1335680 - RNA, 13 nt, Human
uaagcugaaaaua

SEQ ID NO: 1335681 - RNA, 14 nt, Human
uaagcugaaaauau

SEQ ID NO: 1335682 - RNA, 19 nt, Human
uaagcucacguccugagaa

SEQ ID NO: 1335683 - RNA, 22 nt, Human
uaagcucccagggccugucuca

SEQ ID NO: 1335684 - RNA, 10 nt, Human
uaagcucuga

SEQ ID NO: 1335685 - RNA, 16 nt, Human
uaagcucugagcuguc

SEQ ID NO: 1335686 - RNA, 12 nt, Human
uaagcucugagc

SEQ ID NO: 1335687 - RNA, 19 nt, Human
uaaggaaaucaacuugcuu

SEQ ID NO: 1335688 - RNA, 20 nt, Human
uaaggaaaucaacuugcuua

SEQ ID NO: 1335689 - RNA, 14 nt, Human
uaaggaaccaacaa

SEQ ID NO: 1335690 - RNA, 17 nt, Human
uaaggaaccaacaaucu

SEQ ID NO: 1335691 - RNA, 21 nt, Human
uaagcauaagcuuaugcuuaa

SEQ ID NO: 1335692 - RNA, 21 nt, Human
uaagcagguggaucuauuuca

SEQ ID NO: 1335693 - RNA, 18 nt, Human
uaagcagugucuguguuu

SEQ ID NO: 1335694 - RNA, 22 nt, Human
uaagcagguggaucuauuucau

SEQ ID NO: 1335695 - RNA, 19 nt, Human
uaagauuauagauucuaaa

SEQ ID NO: 1335696 - RNA, 20 nt, Human
uaagauuauagauucuaaag

SEQ ID NO: 1335697 - RNA, 21 nt, Human
uaagauuauagauucuaaaga

SEQ ID NO: 1335698 - RNA, 22 nt, Human
uaagauuauagauucuaaagau

SEQ ID NO: 1335699 - RNA, 23 nt, Human
uaagauuauagauucuaaagauu

SEQ ID NO: 1335700 - RNA, 23 nt, Human
uaagcauaaaagaugaaagagca

SEQ ID NO: 1335701 - RNA, 14 nt, Human
uaagcuauuugaug

SEQ ID NO: 1335702 - RNA, 15 nt, Human
uaagcuauuugaugu

SEQ ID NO: 1335703 - RNA, 18 nt, Human
uaagcuauuugauguaau

SEQ ID NO: 1335704 - RNA, 19 nt, Human
uaagcuauuugauguaaua

SEQ ID NO: 1335705 - RNA, 21 nt, Human
uaagcuauuugauguaauacu

SEQ ID NO: 1335706 - RNA, 22 nt, Human
uaagcuauuugauguaauacuu

SEQ ID NO: 1335707 - RNA, 23 nt, Human
uaagcuauuugauguaauacuuc

SEQ ID NO: 1335708 - RNA, 14 nt, Human
uaagcuauuuuucu

SEQ ID NO: 1335709 - RNA, 16 nt, Human
uaagcuauuuuucuaa

SEQ ID NO: 1335710 - RNA, 17 nt, Human
uaagcuauuuuucuaac

SEQ ID NO: 1335711 - RNA, 21 nt, Human
uaagcuauuuuucuaacuaca

SEQ ID NO: 1335712 - RNA, 22 nt, Human
uaagcucacguccugagaaagc

SEQ ID NO: 1335713 - RNA, 14 nt, Human
uaagcaaaauguga

SEQ ID NO: 1335714 - RNA, 21 nt, Human
uaagcaaaaugugauauguac

SEQ ID NO: 1335715 - RNA, 15 nt, Human
uaagcaaaaugugau

SEQ ID NO: 1335716 - RNA, 24 nt, Human
aaucagucucagaaugucauuuug

SEQ ID NO: 1335717 - RNA, 17 nt, Human
aaucagucucagaaugu

SEQ ID NO: 1335718 - RNA, 19 nt, Human
uaagauuacaaaucagaag

SEQ ID NO: 1335719 - RNA, 22 nt, Human
uaagauuacaaaucagaaguca

SEQ ID NO: 1335720 - RNA, 15 nt, Human
uaagauuauagauuc

SEQ ID NO: 1335721 - RNA, 16 nt, Human
uaagauuauagauucu

SEQ ID NO: 1335722 - RNA, 17 nt, Human
uaagauuauagauucua

SEQ ID NO: 1335723 - RNA, 18 nt, Human
uaagauuauagauucuaa

SEQ ID NO: 1335724 - RNA, 15 nt, Human
aauauuuauuuuaau

SEQ ID NO: 1335725 - RNA, 20 nt, Human
aauauuuuccuccugagugc

SEQ ID NO: 1335726 - RNA, 13 nt, Human
aauauuuugaauc

SEQ ID NO: 1335727 - RNA, 14 nt, Human
aauauuuugaauca

SEQ ID NO: 1335728 - RNA, 15 nt, Human
aauauuuugaaucaa

SEQ ID NO: 1335729 - RNA, 16 nt, Human
aauauuuugaaucaau

SEQ ID NO: 1335730 - RNA, 18 nt, Human
aauauuuugaaucaauaa

SEQ ID NO: 1335731 - RNA, 22 nt, Human
aauauuuugaaucaauaauaua

SEQ ID NO: 1335732 - RNA, 20 nt, Human
aauauuuugaaucaauaaua

SEQ ID NO: 1335733 - RNA, 17 nt, Human
aaucacuaaaaaugauc

SEQ ID NO: 1335734 - RNA, 15 nt, Human
aauauuuauagguca

SEQ ID NO: 1335735 - RNA, 17 nt, Human
uaagacuuacucuaaga

SEQ ID NO: 1335736 - RNA, 18 nt, Human
uaagacuuacucuaagau

SEQ ID NO: 1335737 - RNA, 15 nt, Human
uaagacucaaauguu

SEQ ID NO: 1335738 - RNA, 18 nt, Human
uaagacucaaauguucua

SEQ ID NO: 1335739 - RNA, 19 nt, Human
uaagacucaaauguucuaa

SEQ ID NO: 1335740 - RNA, 21 nt, Human
uaagacucaaauguucuaagu

SEQ ID NO: 1335741 - RNA, 22 nt, Human
uaagacucaaauguucuaaguu

SEQ ID NO: 1335742 - RNA, 16 nt, Human
uaagacucucacacuc

SEQ ID NO: 1335743 - RNA, 16 nt, Human
aaucaggguuaguauu

SEQ ID NO: 1335744 - RNA, 19 nt, Human
aaucagggaggucauuuug

SEQ ID NO: 1335745 - RNA, 16 nt, Human
aaucagguggcuuuug

SEQ ID NO: 1335746 - RNA, 15 nt, Human
aaucaggcuuuuguu

SEQ ID NO: 1335747 - RNA, 16 nt, Human
aaucagcuauuuugug

SEQ ID NO: 1335748 - RNA, 17 nt, Human
aaucagcuauuuuguga

SEQ ID NO: 1335749 - RNA, 18 nt, Human
aaucaggaauauuuucca

SEQ ID NO: 1335750 - RNA, 20 nt, Human
aaucaggaauauuuuccaaa

SEQ ID NO: 1335751 - RNA, 18 nt, Human
aaucagggaggucauuuu

SEQ ID NO: 1335752 - RNA, 22 nt, Human
aaucaguaagagguguuauuug

SEQ ID NO: 1335753 - RNA, 14 nt, Human
aaucaguaagaggu

SEQ ID NO: 1335754 - RNA, 15 nt, Human
aaucagcuauuuugu

SEQ ID NO: 1335755 - RNA, 20 nt, Human
aaucagcuccuuccuggaga

SEQ ID NO: 1335756 - RNA, 16 nt, Human
aaucagccuaguugau

SEQ ID NO: 1335757 - RNA, 17 nt, Human
aaucagccuacaggccu

SEQ ID NO: 1335758 - RNA, 18 nt, Human
aaucagcauucucacucc

SEQ ID NO: 1335759 - RNA, 19 nt, Human
aaucagcauucucacuccu

SEQ ID NO: 1335760 - RNA, 14 nt, Human
aauauuuucuuuuc

SEQ ID NO: 1335761 - RNA, 18 nt, Human
aaucacucuaauuaauug

SEQ ID NO: 1335762 - RNA, 21 nt, Human
aaucacucuaauuaauuguaa

SEQ ID NO: 1335763 - RNA, 20 nt, Human
aaucacucuaauuaauugua

SEQ ID NO: 1335764 - RNA, 14 nt, Human
aagguacuucaaau

SEQ ID NO: 1335765 - RNA, 18 nt, Human
aagguacuuucauauuuu

SEQ ID NO: 1335766 - RNA, 19 nt, Human
aagguacuuucauauuuua

SEQ ID NO: 1335767 - RNA, 22 nt, Human
aagguacuuucauauuuuaaac

SEQ ID NO: 1335768 - RNA, 18 nt, Human
aagggucgaaagcucuag

SEQ ID NO: 1335769 - RNA, 19 nt, Human
aagggucgaaagcucuaga

SEQ ID NO: 1335770 - RNA, 21 nt, Human
aagggucgaaagcucuagaau

SEQ ID NO: 1335771 - RNA, 22 nt, Human
aagggucgaaagcucuagaauc

SEQ ID NO: 1335772 - RNA, 17 nt, Human
aaggggccagaggcucg

SEQ ID NO: 1335773 - RNA, 23 nt, Human
aaggggccucaccgagugggggc

SEQ ID NO: 1335774 - RNA, 13 nt, Human
aaggggccugagc

SEQ ID NO: 1335775 - RNA, 15 nt, Human
aaggggccugagcag

SEQ ID NO: 1335776 - RNA, 14 nt, Human
aaggggccugagca

SEQ ID NO: 1335777 - RNA, 13 nt, Human
aaggggcuucagg

SEQ ID NO: 1335778 - RNA, 14 nt, Human
aaggcucuuuugua

SEQ ID NO: 1335779 - RNA, 23 nt, Human
aaggcucugagcaaauguggcuc

SEQ ID NO: 1335780 - RNA, 23 nt, Human
aaggcucuguuccacauauauuu

SEQ ID NO: 1335781 - RNA, 22 nt, Human
aaggcucugagagucuagauuc

SEQ ID NO: 1335782 - RNA, 11 nt, Human
aaggcucuaga

SEQ ID NO: 1335783 - RNA, 12 nt, Human
aaggcucuagau

SEQ ID NO: 1335784 - RNA, 13 nt, Human
aaggcucuagauc

SEQ ID NO: 1335785 - RNA, 16 nt, Human
aaggcucuaugagucu

SEQ ID NO: 1335786 - RNA, 20 nt, Human
aaggcucuaugagucuagau

SEQ ID NO: 1335787 - RNA, 21 nt, Human
aaggcucuaugagucuagaug

SEQ ID NO: 1335788 - RNA, 12 nt, Human
aaggcucugaga

SEQ ID NO: 1335789 - RNA, 13 nt, Human
aaggcucugagag

SEQ ID NO: 1335790 - RNA, 14 nt, Human
aaggcucugagagu

SEQ ID NO: 1335791 - RNA, 16 nt, Human
aaggcucugagagucu

SEQ ID NO: 1335792 - RNA, 17 nt, Human
aaggcucugagagucua

SEQ ID NO: 1335793 - RNA, 20 nt, Human
aaggcucugagagucuagau

SEQ ID NO: 1335794 - RNA, 21 nt, Human
aaggcucugagagucuagauu

SEQ ID NO: 1335795 - RNA, 16 nt, Human
aaguaaggaauuuuau

SEQ ID NO: 1335796 - RNA, 13 nt, Human
aaguaagcaaaga

SEQ ID NO: 1335797 - RNA, 18 nt, Human
aagguauuuaauagguuu

SEQ ID NO: 1335798 - RNA, 17 nt, Human
guuucuauuuuuugaaa

SEQ ID NO: 1335799 - RNA, 18 nt, Human
guuucucuuagaaaagcu

SEQ ID NO: 1335800 - RNA, 12 nt, Human
guuucugacucu

SEQ ID NO: 1335801 - RNA, 17 nt, Human
guuucugacucugagcu

SEQ ID NO: 1335802 - RNA, 13 nt, Human
guuucugacucug

SEQ ID NO: 1335803 - RNA, 22 nt, Human
guuucugaggcuuuaugauaau

SEQ ID NO: 1335804 - RNA, 19 nt, Human
guuuaaucauauaaauaga

SEQ ID NO: 1335805 - RNA, 17 nt, Human
guuuaaucauauaaaua

SEQ ID NO: 1335806 - RNA, 22 nt, Human
guugggcagggugacccugaag

SEQ ID NO: 1335807 - RNA, 19 nt, Human
guuuacaugcuuauuccau

SEQ ID NO: 1335808 - RNA, 14 nt, Human
guuuacaugcuuau

SEQ ID NO: 1335809 - RNA, 22 nt, Human
guuuauuuaacuuuuaguaaag

SEQ ID NO: 1335810 - RNA, 15 nt, Human
guuuaaugaaugcuu

SEQ ID NO: 1335811 - RNA, 20 nt, Human
guuuaaugaagaucuaaaua

SEQ ID NO: 1335812 - RNA, 18 nt, Human
guuuaaugaaugcuuaaa

SEQ ID NO: 1335813 - RNA, 11 nt, Human
guuuacagaau

SEQ ID NO: 1335814 - RNA, 14 nt, Human
guuuauuucuuaaa

SEQ ID NO: 1335815 - RNA, 19 nt, Human
guuuauuuucaagaauaau

SEQ ID NO: 1335816 - RNA, 15 nt, Human
aaggaaagaaaacau

SEQ ID NO: 1335817 - RNA, 14 nt, Human
aagcuccaucucca

SEQ ID NO: 1335818 - RNA, 13 nt, Human
aagcuccaagccc

SEQ ID NO: 1335819 - RNA, 20 nt, Human
aagcuccaucuccacuccag

SEQ ID NO: 1335820 - RNA, 13 nt, Human
aaggaaccaacaa

SEQ ID NO: 1335821 - RNA, 17 nt, Human
aaggaaccaacaaucuu

SEQ ID NO: 1335822 - RNA, 16 nt, Human
aaggaaccaacaaucu

SEQ ID NO: 1335823 - RNA, 21 nt, Human
aaggaauaaauugcuccuuga

SEQ ID NO: 1335824 - RNA, 22 nt, Human
aaggaagcauuguaaaauaauu

SEQ ID NO: 1335825 - RNA, 18 nt, Human
aaggaagcauuguaaaau

SEQ ID NO: 1335826 - RNA, 23 nt, Human
aaggaagcauuguaaaauaauuc

SEQ ID NO: 1335827 - RNA, 20 nt, Human
aaggagaggcaacauccaaa

SEQ ID NO: 1335828 - RNA, 18 nt, Human
aaggagaugucuuggaac

SEQ ID NO: 1335829 - RNA, 10 nt, Human
aaggagccug

SEQ ID NO: 1335830 - RNA, 12 nt, Human
aaggagccugug

SEQ ID NO: 1335831 - RNA, 13 nt, Human
aaggagccuguga

SEQ ID NO: 1335832 - RNA, 22 nt, Human
aaggagccugugaacccaggac

SEQ ID NO: 1335833 - RNA, 21 nt, Human
aaggagccugugaacccagga

SEQ ID NO: 1335834 - RNA, 11 nt, Human
aaggagcugcc

SEQ ID NO: 1335835 - RNA, 12 nt, Human
aaggagcugccu

SEQ ID NO: 1335836 - RNA, 13 nt, Human
aaggagcugccug

SEQ ID NO: 1335837 - RNA, 16 nt, Human
aaggagcugccuggac

SEQ ID NO: 1335838 - RNA, 17 nt, Human
aaggagcugccuggacc

SEQ ID NO: 1335839 - RNA, 19 nt, Human
aaggagcugccuggacccg

SEQ ID NO: 1335840 - RNA, 18 nt, Human
aaggagcugccuggaccc

SEQ ID NO: 1335841 - RNA, 17 nt, Human
aaggaggggcuguaaaa

SEQ ID NO: 1335842 - RNA, 17 nt, Human
aaggagucaaaacuaca

SEQ ID NO: 1335843 - RNA, 19 nt, Human
aaggcauuauaaaaagaau

SEQ ID NO: 1335844 - RNA, 17 nt, Human
aaggcauggcggccccc

SEQ ID NO: 1335845 - RNA, 22 nt, Human
aaggcaucgucaugcacaguau

SEQ ID NO: 1335846 - RNA, 17 nt, Human
aaggcaucugacaugca

SEQ ID NO: 1335847 - RNA, 17 nt, Human
aaggaguuuauguucca

SEQ ID NO: 1335848 - RNA, 15 nt, Human
aaggauagaugcugg

SEQ ID NO: 1335849 - RNA, 19 nt, Human
aaggauagaugcuggccca

SEQ ID NO: 1335850 - RNA, 11 nt, Human
aaggauaaagu

SEQ ID NO: 1335851 - RNA, 12 nt, Human
aaggaguuuaug

SEQ ID NO: 1335852 - RNA, 13 nt, Human
aaggaguuuaugu

SEQ ID NO: 1335853 - RNA, 14 nt, Human
aaggaguuuauguu

SEQ ID NO: 1335854 - RNA, 17 nt, Human
aaggagucacugagacc

SEQ ID NO: 1335855 - RNA, 20 nt, Human
aaggagucagacauuuuaag

SEQ ID NO: 1335856 - RNA, 18 nt, Human
aaggagucacugagacca

SEQ ID NO: 1335857 - RNA, 19 nt, Human
aaggaguguagcaacuaca

SEQ ID NO: 1335858 - RNA, 13 nt, Human
aaggccagcacuc

SEQ ID NO: 1335859 - RNA, 14 nt, Human
aaggccauaaaaca

SEQ ID NO: 1335860 - RNA, 17 nt, Human
aaggccauaaaacaggu

SEQ ID NO: 1335861 - RNA, 18 nt, Human
aaggccauaaaacaggua

SEQ ID NO: 1335862 - RNA, 24 nt, Human
aaggccauaaaacagguaauauaa

SEQ ID NO: 1335863 - RNA, 22 nt, Human
aaggccaucugggcuccuccag

SEQ ID NO: 1335864 - RNA, 21 nt, Human
aaggcccgagcagcugagcag

SEQ ID NO: 1335865 - RNA, 17 nt, Human
aaggcccgagcagcuga

SEQ ID NO: 1335866 - RNA, 18 nt, Human
aaggcccgagcagcugag

SEQ ID NO: 1335867 - RNA, 19 nt, Human
aaggcccgagcagcugagc

SEQ ID NO: 1335868 - RNA, 20 nt, Human
aaggcccgagcagcugagca

SEQ ID NO: 1335869 - RNA, 12 nt, Human
guugccuuuuau

SEQ ID NO: 1335870 - RNA, 22 nt, Human
aaggccuaauucuaugccuguc

SEQ ID NO: 1335871 - RNA, 15 nt, Human
aaggccuaggauucu

SEQ ID NO: 1335872 - RNA, 16 nt, Human
aaggccuaggauucua

SEQ ID NO: 1335873 - RNA, 18 nt, Human
aaggccuaggauucuaaa

SEQ ID NO: 1335874 - RNA, 17 nt, Human
guugcguuccuuucuuu

SEQ ID NO: 1335875 - RNA, 22 nt, Human
guuggaaugaauuaaauaaacc

SEQ ID NO: 1335876 - RNA, 15 nt, Human
guuggaauggauuuu

SEQ ID NO: 1335877 - RNA, 22 nt, Human
guuggaauggauuuuucuuuaa

SEQ ID NO: 1335878 - RNA, 23 nt, Human
guugggagagggcgcaggccgug

SEQ ID NO: 1335879 - RNA, 17 nt, Human
guuggaauggauuuuuc

SEQ ID NO: 1335880 - RNA, 22 nt, Human
guugggaucagggguaggaaug

SEQ ID NO: 1335881 - RNA, 14 nt, Human
guugggcagccaga

SEQ ID NO: 1335882 - RNA, 19 nt, Human
guugggcagccagaccagc

SEQ ID NO: 1335883 - RNA, 12 nt, Human
uaaaagaaugau

SEQ ID NO: 1335884 - RNA, 15 nt, Human
uaaaacuuuccucgc

SEQ ID NO: 1335885 - RNA, 17 nt, Human
uaaaacuuuccucgccu

SEQ ID NO: 1335886 - RNA, 14 nt, Human
uaaaacuuugaagu

SEQ ID NO: 1335887 - RNA, 13 nt, Human
uaaaacuuuccuc

SEQ ID NO: 1335888 - RNA, 15 nt, Human
uaaaacuuugaaguu

SEQ ID NO: 1335889 - RNA, 11 nt, Human
uaaaacuaaga

SEQ ID NO: 1335890 - RNA, 18 nt, Human
uaaaacgcaguugcaaac

SEQ ID NO: 1335891 - RNA, 22 nt, Human
uaaaaccuuccaugucaagauu

SEQ ID NO: 1335892 - RNA, 17 nt, Human
uaaaacccguugauuac

SEQ ID NO: 1335893 - RNA, 18 nt, Human
uaaaacccguugauuacu

SEQ ID NO: 1335894 - RNA, 17 nt, Human
uaaaaccugcuuuucaa

SEQ ID NO: 1335895 - RNA, 13 nt, Human
uaaaaccuggaga

SEQ ID NO: 1335896 - RNA, 16 nt, Human
uaaaaauaaacauguu

SEQ ID NO: 1335897 - RNA, 19 nt, Human
uaaaaauaaaaaagauccc

SEQ ID NO: 1335898 - RNA, 21 nt, Human
uaaaaauaaaaaagaucccaa

SEQ ID NO: 1335899 - RNA, 14 nt, Human
uaaaaauaaggucu

SEQ ID NO: 1335900 - RNA, 15 nt, Human
uaaaaauaagucaac

SEQ ID NO: 1335901 - RNA, 21 nt, Human
uaaaaauaaaaaacacuggga

SEQ ID NO: 1335902 - RNA, 20 nt, Human
uaaaaaguuuuaguuuugau

SEQ ID NO: 1335903 - RNA, 16 nt, Human
uaaaaauaaaaaagau

SEQ ID NO: 1335904 - RNA, 17 nt, Human
uaaaaauaaaaaagauc

SEQ ID NO: 1335905 - RNA, 19 nt, Human
uaaaaauaagucaacagua

SEQ ID NO: 1335906 - RNA, 16 nt, Human
uaaaaauaagucaaca

SEQ ID NO: 1335907 - RNA, 19 nt, Human
uaaaaauaaaaaacacugg

SEQ ID NO: 1335908 - RNA, 18 nt, Human
uaaaaauaaaaaacacug

SEQ ID NO: 1335909 - RNA, 16 nt, Human
guuuuugagauauuaa

SEQ ID NO: 1335910 - RNA, 17 nt, Human
uaaaaagugcuuuugug

SEQ ID NO: 1335911 - RNA, 13 nt, Human
guuuuugagauau

SEQ ID NO: 1335912 - RNA, 14 nt, Human
guuuuugagauauu

SEQ ID NO: 1335913 - RNA, 20 nt, Human
uaaaagacagugaaagaaaa

SEQ ID NO: 1335914 - RNA, 12 nt, Human
uaaaagacucau

SEQ ID NO: 1335915 - RNA, 13 nt, Human
uaaaagacucauc

SEQ ID NO: 1335916 - RNA, 14 nt, Human
uaaaagacucaucc

SEQ ID NO: 1335917 - RNA, 16 nt, Human
uaaaagacucauccgu

SEQ ID NO: 1335918 - RNA, 16 nt, Human
uaaaaguguccauuga

SEQ ID NO: 1335919 - RNA, 18 nt, Human
uaaaaguguccauugaaa

SEQ ID NO: 1335920 - RNA, 23 nt, Human
uaaaagugggcuugauucugcag

SEQ ID NO: 1335921 - RNA, 21 nt, Human
uaaaaguuuuuuauuaugcau

SEQ ID NO: 1335922 - RNA, 22 nt, Human
uaaaaguuuuuuauuaugcauu

SEQ ID NO: 1335923 - RNA, 18 nt, Human
uaaaauaauuauauaacu

SEQ ID NO: 1335924 - RNA, 19 nt, Human
uaaaauaauuauauaacug

SEQ ID NO: 1335925 - RNA, 20 nt, Human
uaaaauaauuauauaacugu

SEQ ID NO: 1335926 - RNA, 21 nt, Human
uaaaauaauuauauaacugua

SEQ ID NO: 1335927 - RNA, 22 nt, Human
uaaaauaauuuuaucucuuucu

SEQ ID NO: 1335928 - RNA, 13 nt, Human
uaaaauaauuuug

SEQ ID NO: 1335929 - RNA, 14 nt, Human
uaaaauaauuuugu

SEQ ID NO: 1335930 - RNA, 20 nt, Human
uaaaauaauuuuuauauuug

SEQ ID NO: 1335931 - RNA, 15 nt, Human
uaaaauaauuuugua

SEQ ID NO: 1335932 - RNA, 16 nt, Human
uaaaauaauuuuguaa

SEQ ID NO: 1335933 - RNA, 21 nt, Human
uaaaauaauuuuguaauguau

SEQ ID NO: 1335934 - RNA, 16 nt, Human
uaaaauaauucugagu

SEQ ID NO: 1335935 - RNA, 14 nt, Human
uaaaauacuuuuac

SEQ ID NO: 1335936 - RNA, 19 nt, Human
uaaaauacuuuuacucugc

SEQ ID NO: 1335937 - RNA, 21 nt, Human
uaaaauacuuuuacucugccu

SEQ ID NO: 1335938 - RNA, 20 nt, Human
uaaaauacuuuuacucugcc

SEQ ID NO: 1335939 - RNA, 14 nt, Human
uaaaauaucuacau

SEQ ID NO: 1335940 - RNA, 19 nt, Human
uaaaauaugaagacauaaa

SEQ ID NO: 1335941 - RNA, 21 nt, Human
aagugaucaaacuacauauug

SEQ ID NO: 1335942 - RNA, 20 nt, Human
aagugauucucaugccucag

SEQ ID NO: 1335943 - RNA, 17 nt, Human
aagugagggcucacuca

SEQ ID NO: 1335944 - RNA, 19 nt, Human
aagugagggcucacucagc

SEQ ID NO: 1335945 - RNA, 21 nt, Human
aagugagggcucacucagcca

SEQ ID NO: 1335946 - RNA, 17 nt, Human
aagugagucucucuggg

SEQ ID NO: 1335947 - RNA, 13 nt, Human
uaaaauauuccug

SEQ ID NO: 1335948 - RNA, 22 nt, Human
uaaaauauuccugcauuuguga

SEQ ID NO: 1335949 - RNA, 20 nt, Human
uaaaauaugaagacauaaac

SEQ ID NO: 1335950 - RNA, 21 nt, Human
aagugauucucaugccucagc

SEQ ID NO: 1335951 - RNA, 12 nt, Human
aagugcccucca

SEQ ID NO: 1335952 - RNA, 18 nt, Human
aagugcccuccaggcuuu

SEQ ID NO: 1335953 - RNA, 13 nt, Human
aagugcccucucc

SEQ ID NO: 1335954 - RNA, 15 nt, Human
aagugcccucuccca

SEQ ID NO: 1335955 - RNA, 23 nt, Human
aagugcccucucccacccucuuc

SEQ ID NO: 1335956 - RNA, 19 nt, Human
aagugcccucucccacccu

SEQ ID NO: 1335957 - RNA, 13 nt, Human
aaguauuagaaua

SEQ ID NO: 1335958 - RNA, 10 nt, Human
aaguauuuag

SEQ ID NO: 1335959 - RNA, 11 nt, Human
aaguauuuagg

SEQ ID NO: 1335960 - RNA, 16 nt, Human
aaguauuuagguuuuu

SEQ ID NO: 1335961 - RNA, 20 nt, Human
aaguacccguucacauuuuu

SEQ ID NO: 1335962 - RNA, 12 nt, Human
aaguaccagacu

SEQ ID NO: 1335963 - RNA, 13 nt, Human
aaguaccagacua

SEQ ID NO: 1335964 - RNA, 18 nt, Human
aaguacccguucacauuu

SEQ ID NO: 1335965 - RNA, 11 nt, Human
aaguacagaga

SEQ ID NO: 1335966 - RNA, 12 nt, Human
aaguacagagaa

SEQ ID NO: 1335967 - RNA, 13 nt, Human
aaguacagagaag

SEQ ID NO: 1335968 - RNA, 14 nt, Human
aaguacagagaagc

SEQ ID NO: 1335969 - RNA, 15 nt, Human
aaguacagagaagcc

SEQ ID NO: 1335970 - RNA, 16 nt, Human
aaguacagagaagcca

SEQ ID NO: 1335971 - RNA, 22 nt, Human
aaguacagagaagccaucaccu

SEQ ID NO: 1335972 - RNA, 17 nt, Human
aaguacagagaagccau

SEQ ID NO: 1335973 - RNA, 17 nt, Human
aaguaaugacagaacau

SEQ ID NO: 1335974 - RNA, 18 nt, Human
aaguaaugacagaacaug

SEQ ID NO: 1335975 - RNA, 14 nt, Human
aaguaaugauaacu

SEQ ID NO: 1335976 - RNA, 19 nt, Human
aaguaaugauaacuggaaa

SEQ ID NO: 1335977 - RNA, 17 nt, Human
guuuugcuacauaauua

SEQ ID NO: 1335978 - RNA, 18 nt, Human
guuuuggacaguuuacca

SEQ ID NO: 1335979 - RNA, 17 nt, Human
guuuuggacaguuuacc

SEQ ID NO: 1335980 - RNA, 20 nt, Human
guuuuggcugaaauucuccu

SEQ ID NO: 1335981 - RNA, 22 nt, Human
guuuuggcugaaauucuccugg

SEQ ID NO: 1335982 - RNA, 23 nt, Human
guuuuggcugaaauucuccugga

SEQ ID NO: 1335983 - RNA, 20 nt, Human
guuucugaguuccugcaugc

SEQ ID NO: 1335984 - RNA, 17 nt, Human
guuucugaguuuuacca

SEQ ID NO: 1335985 - RNA, 16 nt, Human
guuucugaguuuuacc

SEQ ID NO: 1335986 - RNA, 13 nt, Human
guuucugcccugc

SEQ ID NO: 1335987 - RNA, 16 nt, Human
aagucuuucacauuua

SEQ ID NO: 1335988 - RNA, 16 nt, Human
aagucuuucucuuucc

SEQ ID NO: 1335989 - RNA, 17 nt, Human
aagucuuucucuuuccc

SEQ ID NO: 1335990 - RNA, 18 nt, Human
aagucuuucucuuucccu

SEQ ID NO: 1335991 - RNA, 20 nt, Human
aagucuuucucuuucccugg

SEQ ID NO: 1335992 - RNA, 22 nt, Human
aagucuuucucuuucccugguc

SEQ ID NO: 1335993 - RNA, 23 nt, Human
aagucuuucucuuucccuggucc

SEQ ID NO: 1335994 - RNA, 14 nt, Human
aagucuuuuguucg

SEQ ID NO: 1335995 - RNA, 21 nt, Human
aagucaugcguuuaaucacau

SEQ ID NO: 1335996 - RNA, 20 nt, Human
aaguauuuguuaauuuagaa

SEQ ID NO: 1335997 - RNA, 19 nt, Human
aaguauuuguuaauuuaga

SEQ ID NO: 1335998 - RNA, 21 nt, Human
aaguauuuguuaauuuagaaa

SEQ ID NO: 1335999 - RNA, 17 nt, Human
aaguauuuucauaagua

SEQ ID NO: 1336000 - RNA, 22 nt, Human
aaguauuuucauaaguauuuca

SEQ ID NO: 1336001 - RNA, 13 nt, Human
aaguauuucaaau

SEQ ID NO: 1336002 - RNA, 21 nt, Human
aaguauuucaaauuggagcuu

SEQ ID NO: 1336003 - RNA, 22 nt, Human
aaguauuucaaauuggagcuuc

SEQ ID NO: 1336004 - RNA, 13 nt, Human
aaguauuugggaa

SEQ ID NO: 1336005 - RNA, 15 nt, Human
aaguauuuuccuguu

SEQ ID NO: 1336006 - RNA, 15 nt, Human
guuuuucauaaagca

SEQ ID NO: 1336007 - RNA, 18 nt, Human
guuuuucauuaaauaaau

SEQ ID NO: 1336008 - RNA, 22 nt, Human
guuuuuccuuccaaugucugga

SEQ ID NO: 1336009 - RNA, 18 nt, Human
guuuuuccuuuuuuugua

SEQ ID NO: 1336010 - RNA, 16 nt, Human
guuuuucggacaguuu

SEQ ID NO: 1336011 - RNA, 13 nt, Human
guuuuucuaaagg

SEQ ID NO: 1336012 - RNA, 18 nt, Human
aagucuuuuguucgcaug

SEQ ID NO: 1336013 - RNA, 13 nt, Human
aagugaaaaacau

SEQ ID NO: 1336014 - RNA, 15 nt, Human
aagugaaaaacauga

SEQ ID NO: 1336015 - RNA, 12 nt, Human
aagugaaaacuu

SEQ ID NO: 1336016 - RNA, 12 nt, Human
aagugaaaauau

SEQ ID NO: 1336017 - RNA, 14 nt, Human
aagugaaaauauag

SEQ ID NO: 1336018 - RNA, 14 nt, Human
aagugaaaaugguc

SEQ ID NO: 1336019 - RNA, 11 nt, Human
aagugaaauaa

SEQ ID NO: 1336020 - RNA, 16 nt, Human
aagugaaauaaugugu

SEQ ID NO: 1336021 - RNA, 14 nt, Human
aagugaaauaaugu

SEQ ID NO: 1336022 - RNA, 13 nt, Human
aagugaagacaga

SEQ ID NO: 1336023 - RNA, 13 nt, Human
aagugaagacugg

SEQ ID NO: 1336024 - RNA, 16 nt, Human
aagugaagacuggaag

SEQ ID NO: 1336025 - RNA, 16 nt, Human
aagugagaccuuccuu

SEQ ID NO: 1336026 - RNA, 23 nt, Human
aagcaucccucacccauccuaga

SEQ ID NO: 1336027 - RNA, 14 nt, Human
aagcaucccucacc

SEQ ID NO: 1336028 - RNA, 13 nt, Human
aagcaucccucac

SEQ ID NO: 1336029 - RNA, 13 nt, Human
aagcaucuaaguu

SEQ ID NO: 1336030 - RNA, 13 nt, Human
aagcaucuggcuc

SEQ ID NO: 1336031 - RNA, 17 nt, Human
aagcaucuggcucuaau

SEQ ID NO: 1336032 - RNA, 19 nt, Human
aagcaucuggcucuaauuc

SEQ ID NO: 1336033 - RNA, 18 nt, Human
aagcaucuaaguuauaag

SEQ ID NO: 1336034 - RNA, 12 nt, Human
aagcauucacaa

SEQ ID NO: 1336035 - RNA, 13 nt, Human
aagcauucacaac

SEQ ID NO: 1336036 - RNA, 21 nt, Human
aagcauucagaagaaaaagaa

SEQ ID NO: 1336037 - RNA, 15 nt, Human
aagcauucagaagaa

SEQ ID NO: 1336038 - RNA, 15 nt, Human
aagcauucucauugg

SEQ ID NO: 1336039 - RNA, 17 nt, Human
aagcauucucauuggaa

SEQ ID NO: 1336040 - RNA, 18 nt, Human
aagcauucucauuggaaa

SEQ ID NO: 1336041 - RNA, 22 nt, Human
aagcauucucauuggaaauuua

SEQ ID NO: 1336042 - RNA, 23 nt, Human
aagcauucucauuggaaauuuag

SEQ ID NO: 1336043 - RNA, 16 nt, Human
aagcauuuagauguau

SEQ ID NO: 1336044 - RNA, 13 nt, Human
aagcauucugucu

SEQ ID NO: 1336045 - RNA, 16 nt, Human
aagcauugaauggcua

SEQ ID NO: 1336046 - RNA, 18 nt, Human
aagcauuguaaaauaauu

SEQ ID NO: 1336047 - RNA, 13 nt, Human
aagcauugaaugg

SEQ ID NO: 1336048 - RNA, 14 nt, Human
aagcauuguaaaau

SEQ ID NO: 1336049 - RNA, 15 nt, Human
aagcauuguaaaaua

SEQ ID NO: 1336050 - RNA, 17 nt, Human
aagcauuguaaaauaau

SEQ ID NO: 1336051 - RNA, 16 nt, Human
aagcauuuagaaaacu

SEQ ID NO: 1336052 - RNA, 14 nt, Human
aagcauuuuguaau

SEQ ID NO: 1336053 - RNA, 17 nt, Human
aagcauuuuguaauaau

SEQ ID NO: 1336054 - RNA, 18 nt, Human
aagccaaaacaauguuua

SEQ ID NO: 1336055 - RNA, 12 nt, Human
aagccaaaacaa

SEQ ID NO: 1336056 - RNA, 22 nt, Human
aagcauaaaagaugaaagagca

SEQ ID NO: 1336057 - RNA, 23 nt, Human
aagcauaaaagaugaaagagcag

SEQ ID NO: 1336058 - RNA, 21 nt, Human
aagcaucauuauuuauguauu

SEQ ID NO: 1336059 - RNA, 23 nt, Human
aagcaucauuauuuauguauugu

SEQ ID NO: 1336060 - RNA, 22 nt, Human
aagcaucauuauuuauguauug

SEQ ID NO: 1336061 - RNA, 18 nt, Human
aagcaguauuuuucuuga

SEQ ID NO: 1336062 - RNA, 17 nt, Human
aagcagucgugccugug

SEQ ID NO: 1336063 - RNA, 18 nt, Human
aagcagucgugccugugu

SEQ ID NO: 1336064 - RNA, 19 nt, Human
aagcagucgugccuguguc

SEQ ID NO: 1336065 - RNA, 16 nt, Human
aagcagguuucaagga

SEQ ID NO: 1336066 - RNA, 17 nt, Human
aagcagguuucaaggaa

SEQ ID NO: 1336067 - RNA, 19 nt, Human
aagcagguuucaaggaagu

SEQ ID NO: 1336068 - RNA, 17 nt, Human
aagcaguauuuuucuug

SEQ ID NO: 1336069 - RNA, 17 nt, Human
gugugugaaugaacacu

SEQ ID NO: 1336070 - RNA, 14 nt, Human
gugugugcccucug

SEQ ID NO: 1336071 - RNA, 17 nt, Human
gugugugcccucugggc

SEQ ID NO: 1336072 - RNA, 19 nt, Human
gugugugcccucugggcuc

SEQ ID NO: 1336073 - RNA, 21 nt, Human
gugugugcccucugggcucug

SEQ ID NO: 1336074 - RNA, 23 nt, Human
gugugugcccucugggcucugag

SEQ ID NO: 1336075 - RNA, 19 nt, Human
aagcagguugauaaaucau

SEQ ID NO: 1336076 - RNA, 15 nt, Human
aagcagguugauaaa

SEQ ID NO: 1336077 - RNA, 14 nt, Human
aagcagguugauaa

SEQ ID NO: 1336078 - RNA, 14 nt, Human
aagcagguucuugu

SEQ ID NO: 1336079 - RNA, 15 nt, Human
aagcagguucuuguu

SEQ ID NO: 1336080 - RNA, 23 nt, Human
aagcccauucauuccauucugga

SEQ ID NO: 1336081 - RNA, 16 nt, Human
aagccccacccaggcc

SEQ ID NO: 1336082 - RNA, 17 nt, Human
aagccccacccaggcca

SEQ ID NO: 1336083 - RNA, 18 nt, Human
aagccccacccaggccag

SEQ ID NO: 1336084 - RNA, 22 nt, Human
aagccccacccaggccaggcau

SEQ ID NO: 1336085 - RNA, 21 nt, Human
aagcccauucauuccauucug

SEQ ID NO: 1336086 - RNA, 16 nt, Human
aagcccauucauucca

SEQ ID NO: 1336087 - RNA, 18 nt, Human
aagcccauccugaccagc

SEQ ID NO: 1336088 - RNA, 20 nt, Human
aagcccauccugaccagcug

SEQ ID NO: 1336089 - RNA, 17 nt, Human
aagcccagugcacugaa

SEQ ID NO: 1336090 - RNA, 22 nt, Human
aagcccauaugcuaccaccagc

SEQ ID NO: 1336091 - RNA, 22 nt, Human
aagcccagugcacugaaaguca

SEQ ID NO: 1336092 - RNA, 14 nt, Human
aagcccauccugac

SEQ ID NO: 1336093 - RNA, 15 nt, Human
aagcccauccugacc

SEQ ID NO: 1336094 - RNA, 16 nt, Human
aagcccauccugacca

SEQ ID NO: 1336095 - RNA, 23 nt, Human
aagcccuuccaugucgccucugc

SEQ ID NO: 1336096 - RNA, 15 nt, Human
aagcccuuccauguc

SEQ ID NO: 1336097 - RNA, 20 nt, Human
aagcccuuccaugucgccuc

SEQ ID NO: 1336098 - RNA, 13 nt, Human
aagccguccuggc

SEQ ID NO: 1336099 - RNA, 17 nt, Human
guuaagacaugauuucc

SEQ ID NO: 1336100 - RNA, 19 nt, Human
guuaagacaugauuuccuu

SEQ ID NO: 1336101 - RNA, 22 nt, Human
guuaagacaugauuuccuugaa

SEQ ID NO: 1336102 - RNA, 13 nt, Human
guuaagaccuggc

SEQ ID NO: 1336103 - RNA, 14 nt, Human
guuaagaccuggca

SEQ ID NO: 1336104 - RNA, 16 nt, Human
guuaagaccuggcagc

SEQ ID NO: 1336105 - RNA, 15 nt, Human
guuaagacuugacag

SEQ ID NO: 1336106 - RNA, 16 nt, Human
guuaagacuugacagu

SEQ ID NO: 1336107 - RNA, 17 nt, Human
guuaagacuugacagug

SEQ ID NO: 1336108 - RNA, 15 nt, Human
aagcccggcuccugg

SEQ ID NO: 1336109 - RNA, 22 nt, Human
aagcccggcuccuggucaccua

SEQ ID NO: 1336110 - RNA, 18 nt, Human
aagcccggcuccugguca

SEQ ID NO: 1336111 - RNA, 13 nt, Human
aagcccucccagg

SEQ ID NO: 1336112 - RNA, 20 nt, Human
aagcccucccagguguuaac

SEQ ID NO: 1336113 - RNA, 14 nt, Human
aagcccccaccgug

SEQ ID NO: 1336114 - RNA, 20 nt, Human
aagcccccaccgugggcagg

SEQ ID NO: 1336115 - RNA, 12 nt, Human
aagcccccagag

SEQ ID NO: 1336116 - RNA, 13 nt, Human
aagcccccagagc

SEQ ID NO: 1336117 - RNA, 14 nt, Human
aagcccccagagcc

SEQ ID NO: 1336118 - RNA, 15 nt, Human
aagcccccagagccc

SEQ ID NO: 1336119 - RNA, 16 nt, Human
aagcccccagagccca

SEQ ID NO: 1336120 - RNA, 17 nt, Human
aagcccccagagcccag

SEQ ID NO: 1336121 - RNA, 18 nt, Human
aagcccccagagcccagg

SEQ ID NO: 1336122 - RNA, 16 nt, Human
aagcccccagcuaaga

SEQ ID NO: 1336123 - RNA, 21 nt, Human
aagcccccagcuaagaaccug

SEQ ID NO: 1336124 - RNA, 23 nt, Human
aagcccccagcuaagaaccugga

SEQ ID NO: 1336125 - RNA, 19 nt, Human
aagcccccagagcccaggc

SEQ ID NO: 1336126 - RNA, 14 nt, Human
aagccccugggccc

SEQ ID NO: 1336127 - RNA, 18 nt, Human
aagccccugccccuccuc

SEQ ID NO: 1336128 - RNA, 20 nt, Human
guuagggaaaacauuccauc

SEQ ID NO: 1336129 - RNA, 15 nt, Human
guuagggaaaacauu

SEQ ID NO: 1336130 - RNA, 13 nt, Human
guuaggagguccu

SEQ ID NO: 1336131 - RNA, 20 nt, Human
guuagcuccuguggccccac

SEQ ID NO: 1336132 - RNA, 19 nt, Human
guuaagacuugacagugga

SEQ ID NO: 1336133 - RNA, 14 nt, Human
guuacuucucuaau

SEQ ID NO: 1336134 - RNA, 14 nt, Human
guuacuucugaggu

SEQ ID NO: 1336135 - RNA, 19 nt, Human
guuagaaaugcagaauccu

SEQ ID NO: 1336136 - RNA, 23 nt, Human
guuagggaaaacauuccauccuu

SEQ ID NO: 1336137 - RNA, 19 nt, Human
guuagggacugaccagcag

SEQ ID NO: 1336138 - RNA, 17 nt, Human
guuauuaucugggcuua

SEQ ID NO: 1336139 - RNA, 22 nt, Human
guuauuaucugggcuuauaucu

SEQ ID NO: 1336140 - RNA, 20 nt, Human
guuagggacugaccagcagc

SEQ ID NO: 1336141 - RNA, 18 nt, Human
guuauuaugauuagcuuu

SEQ ID NO: 1336142 - RNA, 16 nt, Human
guuauuuuuuaauuau

SEQ ID NO: 1336143 - RNA, 13 nt, Human
guuauuuugcaac

SEQ ID NO: 1336144 - RNA, 17 nt, Human
guuauuuuguuuuuccu

SEQ ID NO: 1336145 - RNA, 19 nt, Human
guuauuuuuacauucugaa

SEQ ID NO: 1336146 - RNA, 20 nt, Human
guuauuuuuacauucugaau

SEQ ID NO: 1336147 - RNA, 21 nt, Human
guuauuuuuuaauuauuauuu

SEQ ID NO: 1336148 - RNA, 14 nt, Human
guucaacuuauuaa

SEQ ID NO: 1336149 - RNA, 19 nt, Human
guucaacuuuuccuuugaa

SEQ ID NO: 1336150 - RNA, 16 nt, Human
guucaagaaauaaguu

SEQ ID NO: 1336151 - RNA, 12 nt, Human
guucaaagccag

SEQ ID NO: 1336152 - RNA, 13 nt, Human
guucaaagccagc

SEQ ID NO: 1336153 - RNA, 14 nt, Human
guucaaagcugccu

SEQ ID NO: 1336154 - RNA, 13 nt, Human
guucaacaaagaa

SEQ ID NO: 1336155 - RNA, 22 nt, Human
guucaacaaagaaacaaagaug

SEQ ID NO: 1336156 - RNA, 23 nt, Human
guucaacaaagaaacaaagaugu

SEQ ID NO: 1336157 - RNA, 13 nt, Human
aagcuccagguag

SEQ ID NO: 1336158 - RNA, 14 nt, Human
aagcuccagguaga

SEQ ID NO: 1336159 - RNA, 15 nt, Human
aagcucagcugcauu

SEQ ID NO: 1336160 - RNA, 20 nt, Human
aagcucacagaccuuugaac

SEQ ID NO: 1336161 - RNA, 21 nt, Human
aagcucaaagguuuggaagga

SEQ ID NO: 1336162 - RNA, 18 nt, Human
aagcuauuuaaagcaucu

SEQ ID NO: 1336163 - RNA, 13 nt, Human
aagcuauuuaaag

SEQ ID NO: 1336164 - RNA, 14 nt, Human
aagcuauuugaugu

SEQ ID NO: 1336165 - RNA, 16 nt, Human
aagcuauuugauguaa

SEQ ID NO: 1336166 - RNA, 18 nt, Human
aagcuauuugauguaaua

SEQ ID NO: 1336167 - RNA, 23 nt, Human
aagcuauuugauguaauacuucu

SEQ ID NO: 1336168 - RNA, 13 nt, Human
aagcuauuuuucu

SEQ ID NO: 1336169 - RNA, 14 nt, Human
aagcuauuuuucua

SEQ ID NO: 1336170 - RNA, 16 nt, Human
aagcuauuuuucuaac

SEQ ID NO: 1336171 - RNA, 21 nt, Human
aagcuauuuuucuaacuacaa

SEQ ID NO: 1336172 - RNA, 20 nt, Human
aagcucaaagguuuggaagg

SEQ ID NO: 1336173 - RNA, 22 nt, Human
aagcucaaagguuuggaaggag

SEQ ID NO: 1336174 - RNA, 16 nt, Human
aagcuagcaaauagua

SEQ ID NO: 1336175 - RNA, 14 nt, Human
aagcuaggaaugaa

SEQ ID NO: 1336176 - RNA, 16 nt, Human
aagccugagggaaagg

SEQ ID NO: 1336177 - RNA, 21 nt, Human
aagccugagggaaaggccagc

SEQ ID NO: 1336178 - RNA, 22 nt, Human
aagccugagggaaaggccagca

SEQ ID NO: 1336179 - RNA, 24 nt, Human
aagccugagggaaaggccagcacu

SEQ ID NO: 1336180 - RNA, 22 nt, Human
aagccugaguacuccacacugc

SEQ ID NO: 1336181 - RNA, 15 nt, Human
aagccugaugcugac

SEQ ID NO: 1336182 - RNA, 21 nt, Human
aagccugcacaauaaaaaugu

SEQ ID NO: 1336183 - RNA, 22 nt, Human
aagccugcacaauaaaaauguu

SEQ ID NO: 1336184 - RNA, 22 nt, Human
guucagcuaagcuaggaaugaa

SEQ ID NO: 1336185 - RNA, 22 nt, Human
guucagcgcugucaggauugcg

SEQ ID NO: 1336186 - RNA, 19 nt, Human
guucagcuaagcuaggaau

SEQ ID NO: 1336187 - RNA, 17 nt, Human
guucaagcgauucucuu

SEQ ID NO: 1336188 - RNA, 18 nt, Human
guucaagcgauucucuug

SEQ ID NO: 1336189 - RNA, 14 nt, Human
aagccuaagaaucu

SEQ ID NO: 1336190 - RNA, 17 nt, Human
aagccuaagggauccug

SEQ ID NO: 1336191 - RNA, 22 nt, Human
aagccuaagggauccugccugc

SEQ ID NO: 1336192 - RNA, 22 nt, Human
aagccuagugaaggcuucucuc

SEQ ID NO: 1336193 - RNA, 15 nt, Human
aagccucaaaacaaa

SEQ ID NO: 1336194 - RNA, 16 nt, Human
aagccucaaaacaaag

SEQ ID NO: 1336195 - RNA, 18 nt, Human
aagccucaaaacaaaggc

SEQ ID NO: 1336196 - RNA, 21 nt, Human
aagccucaagguuuuagguuc

SEQ ID NO: 1336197 - RNA, 23 nt, Human
aagccucaagguuuuagguucua

SEQ ID NO: 1336198 - RNA, 19 nt, Human
aagccucagauuccuuccc

SEQ ID NO: 1336199 - RNA, 20 nt, Human
aagccucagauuccuuccca

SEQ ID NO: 1336200 - RNA, 19 nt, Human
aagaggaauuacgugcucu

SEQ ID NO: 1336201 - RNA, 14 nt, Human
aagagccacugcca

SEQ ID NO: 1336202 - RNA, 23 nt, Human
aagaggaaugaaguacucauaca

SEQ ID NO: 1336203 - RNA, 23 nt, Human
aagaggagcccccacccuguucc

SEQ ID NO: 1336204 - RNA, 17 nt, Human
aagaggaggggaagagg

SEQ ID NO: 1336205 - RNA, 20 nt, Human
aagaggaggggaagaggccu

SEQ ID NO: 1336206 - RNA, 21 nt, Human
aagaggaggggaagaggccug

SEQ ID NO: 1336207 - RNA, 22 nt, Human
aagaggaggggaagaggccugu

SEQ ID NO: 1336208 - RNA, 21 nt, Human
guggccuaaccugccgagagu

SEQ ID NO: 1336209 - RNA, 18 nt, Human
guggccgaaccagaacca

SEQ ID NO: 1336210 - RNA, 22 nt, Human
guggccuaaccugccgagaguc

SEQ ID NO: 1336211 - RNA, 18 nt, Human
guggcccuuccuggacag

SEQ ID NO: 1336212 - RNA, 23 nt, Human
guggcccuuucggauccagggag

SEQ ID NO: 1336213 - RNA, 15 nt, Human
aagaggcaccaggaa

SEQ ID NO: 1336214 - RNA, 20 nt, Human
guggcccuuaugacugccaa

SEQ ID NO: 1336215 - RNA, 23 nt, Human
guggcccuuaugacugccaagac

SEQ ID NO: 1336216 - RNA, 13 nt, Human
guggcccuuccug

SEQ ID NO: 1336217 - RNA, 14 nt, Human
guggcccuuccugg

SEQ ID NO: 1336218 - RNA, 15 nt, Human
guggcccuuccugga

SEQ ID NO: 1336219 - RNA, 16 nt, Human
guggcccuuccuggac

SEQ ID NO: 1336220 - RNA, 17 nt, Human
guggcccuuccuggaca

SEQ ID NO: 1336221 - RNA, 21 nt, Human
guggcccuuccuggacagcug

SEQ ID NO: 1336222 - RNA, 17 nt, Human
guggccucuugagcagu

SEQ ID NO: 1336223 - RNA, 20 nt, Human
guggccucuugagcaguggc

SEQ ID NO: 1336224 - RNA, 21 nt, Human
guggccucuugagcaguggcu

SEQ ID NO: 1336225 - RNA, 14 nt, Human
guggccuggucccu

SEQ ID NO: 1336226 - RNA, 15 nt, Human
guggccuggucccug

SEQ ID NO: 1336227 - RNA, 17 nt, Human
gugggaagggcuacacc

SEQ ID NO: 1336228 - RNA, 17 nt, Human
guggggccgccgccucu

SEQ ID NO: 1336229 - RNA, 12 nt, Human
guggggcuuggg

SEQ ID NO: 1336230 - RNA, 12 nt, Human
guggggccuggg

SEQ ID NO: 1336231 - RNA, 14 nt, Human
guggggccugggag

SEQ ID NO: 1336232 - RNA, 20 nt, Human
guggccuuguucugucacca

SEQ ID NO: 1336233 - RNA, 17 nt, Human
guggccuuugcgcuccu

SEQ ID NO: 1336234 - RNA, 20 nt, Human
guggccuuugcgcuccuggc

SEQ ID NO: 1336235 - RNA, 19 nt, Human
guggccuuugcgcuccugg

SEQ ID NO: 1336236 - RNA, 20 nt, Human
gugggaagcccauccugacc

SEQ ID NO: 1336237 - RNA, 21 nt, Human
gugggaagcccauccugacca

SEQ ID NO: 1336238 - RNA, 16 nt, Human
aagacugcacaucaaa

SEQ ID NO: 1336239 - RNA, 17 nt, Human
aagacugcauuauauuu

SEQ ID NO: 1336240 - RNA, 21 nt, Human
aagacuagaaaauuagacugu

SEQ ID NO: 1336241 - RNA, 22 nt, Human
aagacgcacuuuggcuuauaau

SEQ ID NO: 1336242 - RNA, 17 nt, Human
aagacgccuuucuccuc

SEQ ID NO: 1336243 - RNA, 20 nt, Human
aagacgugaugccaggacca

SEQ ID NO: 1336244 - RNA, 15 nt, Human
aagacguuuuauaag

SEQ ID NO: 1336245 - RNA, 17 nt, Human
aagacguuuuauaagca

SEQ ID NO: 1336246 - RNA, 18 nt, Human
aagacguuuuauaagcau

SEQ ID NO: 1336247 - RNA, 19 nt, Human
aagacuucucuuugccuca

SEQ ID NO: 1336248 - RNA, 20 nt, Human
aagacuucucuuugccucaa

SEQ ID NO: 1336249 - RNA, 13 nt, Human
aagacuugacagu

SEQ ID NO: 1336250 - RNA, 23 nt, Human
aagacuugguugguaggguggga

SEQ ID NO: 1336251 - RNA, 14 nt, Human
aagacuugacagug

SEQ ID NO: 1336252 - RNA, 16 nt, Human
aagacuuguuucugau

SEQ ID NO: 1336253 - RNA, 22 nt, Human
aagagcagcaccuccucagccu

SEQ ID NO: 1336254 - RNA, 22 nt, Human
aagagcaggacuccaggcccaa

SEQ ID NO: 1336255 - RNA, 17 nt, Human
aagagcaggacuccagg

SEQ ID NO: 1336256 - RNA, 15 nt, Human
aagagcaucaugccu

SEQ ID NO: 1336257 - RNA, 17 nt, Human
aagagcaucaugccucu

SEQ ID NO: 1336258 - RNA, 18 nt, Human
aagagcaucaugccucug

SEQ ID NO: 1336259 - RNA, 19 nt, Human
aagagcaucaugccucuga

SEQ ID NO: 1336260 - RNA, 20 nt, Human
aagagcaucaugccucugag

SEQ ID NO: 1336261 - RNA, 21 nt, Human
aagagcaucaugccucugagg

SEQ ID NO: 1336262 - RNA, 22 nt, Human
aagagcaucaugccucugaggc

SEQ ID NO: 1336263 - RNA, 24 nt, Human
aagagcaucaugccucugaggcca

SEQ ID NO: 1336264 - RNA, 23 nt, Human
aagagcaucaugccucugaggcc

SEQ ID NO: 1336265 - RNA, 18 nt, Human
aagaccuuuuucugcacu

SEQ ID NO: 1336266 - RNA, 20 nt, Human
aagaccuuuuucugcacuau

SEQ ID NO: 1336267 - RNA, 16 nt, Human
aagaccuuuuucugca

SEQ ID NO: 1336268 - RNA, 15 nt, Human
aagaccuuuuucugc

SEQ ID NO: 1336269 - RNA, 19 nt, Human
aacuugcaaaaucaguuuu

SEQ ID NO: 1336270 - RNA, 18 nt, Human
aacuugcaaaaucaguuu

SEQ ID NO: 1336271 - RNA, 17 nt, Human
aacuugcaaaaucaguu

SEQ ID NO: 1336272 - RNA, 14 nt, Human
aacuugcaaaauca

SEQ ID NO: 1336273 - RNA, 17 nt, Human
aacuugauccauuucua

SEQ ID NO: 1336274 - RNA, 19 nt, Human
aacuugauccauuucuaau

SEQ ID NO: 1336275 - RNA, 14 nt, Human
aacuugcaucacuu

SEQ ID NO: 1336276 - RNA, 13 nt, Human
aacuugccugccu

SEQ ID NO: 1336277 - RNA, 16 nt, Human
aacuugccugccuuuc

SEQ ID NO: 1336278 - RNA, 20 nt, Human
aacuugcugcaguaugaaaa

SEQ ID NO: 1336279 - RNA, 22 nt, Human
aacuugcugcaguaugaaaaua

SEQ ID NO: 1336280 - RNA, 21 nt, Human
guguauuuggaaauaaaguca

SEQ ID NO: 1336281 - RNA, 20 nt, Human
gugucagacccuggaggccc

SEQ ID NO: 1336282 - RNA, 19 nt, Human
gugucaacucuuuguuauu

SEQ ID NO: 1336283 - RNA, 22 nt, Human
gugucacucaaggcggugcuug

SEQ ID NO: 1336284 - RNA, 19 nt, Human
aagauguagaggagaaacu

SEQ ID NO: 1336285 - RNA, 17 nt, Human
guguauuuacgcuuuga

SEQ ID NO: 1336286 - RNA, 21 nt, Human
guguauuuacgcuuugauuca

SEQ ID NO: 1336287 - RNA, 10 nt, Human
guguauuugc

SEQ ID NO: 1336288 - RNA, 19 nt, Human
guguauuugcuaauuuuua

SEQ ID NO: 1336289 - RNA, 14 nt, Human
guguauuugcuuuu

SEQ ID NO: 1336290 - RNA, 19 nt, Human
guguauuuggaaauaaagu

SEQ ID NO: 1336291 - RNA, 13 nt, Human
aagauguagagga

SEQ ID NO: 1336292 - RNA, 19 nt, Human
aagaugggcaucuuuugua

SEQ ID NO: 1336293 - RNA, 20 nt, Human
aagaugggcaucuuuuguau

SEQ ID NO: 1336294 - RNA, 22 nt, Human
aagaugggcaucuuuuguauua

SEQ ID NO: 1336295 - RNA, 18 nt, Human
aagauggggaccagcagc

SEQ ID NO: 1336296 - RNA, 20 nt, Human
aagauggggaccagcagccc

SEQ ID NO: 1336297 - RNA, 11 nt, Human
guguccacccc

SEQ ID NO: 1336298 - RNA, 12 nt, Human
guguccaccccc

SEQ ID NO: 1336299 - RNA, 14 nt, Human
gugugaaugaacac

SEQ ID NO: 1336300 - RNA, 21 nt, Human
gugugaccacugcagaagaca

SEQ ID NO: 1336301 - RNA, 15 nt, Human
gugugaaugaacacu

SEQ ID NO: 1336302 - RNA, 22 nt, Human
gugucaggcacugggcaugagg

SEQ ID NO: 1336303 - RNA, 19 nt, Human
gugucaggcacugggcaug

SEQ ID NO: 1336304 - RNA, 20 nt, Human
gugucauccucacagugaac

SEQ ID NO: 1336305 - RNA, 16 nt, Human
gugucauuucucaucc

SEQ ID NO: 1336306 - RNA, 17 nt, Human
guguccaaaaccgccag

SEQ ID NO: 1336307 - RNA, 18 nt, Human
guguccaaaaccgccagc

SEQ ID NO: 1336308 - RNA, 20 nt, Human
guguccaaaaccgccagcuc

SEQ ID NO: 1336309 - RNA, 22 nt, Human
guguccaaaaccgccagcucug

SEQ ID NO: 1336310 - RNA, 23 nt, Human
guguccaaaaccgccagcucugu

SEQ ID NO: 1336311 - RNA, 24 nt, Human
guguccaaaaccgccagcucuguu

SEQ ID NO: 1336312 - RNA, 14 nt, Human
gugugguacagaga

SEQ ID NO: 1336313 - RNA, 15 nt, Human
gugugguacagagaa

SEQ ID NO: 1336314 - RNA, 16 nt, Human
gugugguacagagaag

SEQ ID NO: 1336315 - RNA, 17 nt, Human
gugugguacagagaagc

SEQ ID NO: 1336316 - RNA, 18 nt, Human
gugugguacagagaagcc

SEQ ID NO: 1336317 - RNA, 19 nt, Human
gugugguacagagaagcca

SEQ ID NO: 1336318 - RNA, 20 nt, Human
gugugguacagagaagccag

SEQ ID NO: 1336319 - RNA, 18 nt, Human
guguguccaaaacugccu

SEQ ID NO: 1336320 - RNA, 20 nt, Human
gugugugaaaaugugugugu

SEQ ID NO: 1336321 - RNA, 15 nt, Human
guguguauuugcuaa

SEQ ID NO: 1336322 - RNA, 19 nt, Human
guguguccaaaacugccuc

SEQ ID NO: 1336323 - RNA, 22 nt, Human
aagaugcuuuuaacagagucug

SEQ ID NO: 1336324 - RNA, 12 nt, Human
aagaugcuuuua

SEQ ID NO: 1336325 - RNA, 20 nt, Human
aagauggaauuuaucaaacc

SEQ ID NO: 1336326 - RNA, 15 nt, Human
aagauggaguuucua

SEQ ID NO: 1336327 - RNA, 20 nt, Human
aagauggcugugccucugcc

SEQ ID NO: 1336328 - RNA, 21 nt, Human
aagauggcugugccucugccu

SEQ ID NO: 1336329 - RNA, 23 nt, Human
aagauggcugugccucugccugu

SEQ ID NO: 1336330 - RNA, 14 nt, Human
aagauggaguuucu

SEQ ID NO: 1336331 - RNA, 16 nt, Human
aagaugaaagagcagu

SEQ ID NO: 1336332 - RNA, 23 nt, Human
aagaugaaggagaggcaacaucc

SEQ ID NO: 1336333 - RNA, 22 nt, Human
aagaugaacccgaggcugagaa

SEQ ID NO: 1336334 - RNA, 23 nt, Human
aagaugaacccgaggcugagaau

SEQ ID NO: 1336335 - RNA, 11 nt, Human
aagaugaauga

SEQ ID NO: 1336336 - RNA, 23 nt, Human
aagaucugcagggggugugucug

SEQ ID NO: 1336337 - RNA, 17 nt, Human
aagaucuguccucagcc

SEQ ID NO: 1336338 - RNA, 18 nt, Human
aagaucuguccucagccu

SEQ ID NO: 1336339 - RNA, 15 nt, Human
aagaguagaauugca

SEQ ID NO: 1336340 - RNA, 22 nt, Human
aagaggcugccccucucaccaa

SEQ ID NO: 1336341 - RNA, 23 nt, Human
aagaggcugccccucucaccaaa

SEQ ID NO: 1336342 - RNA, 16 nt, Human
aagaggcugcccuccu

SEQ ID NO: 1336343 - RNA, 17 nt, Human
aagaggcugccccucuc

SEQ ID NO: 1336344 - RNA, 21 nt, Human
aagaggcugccccucucacca

SEQ ID NO: 1336345 - RNA, 18 nt, Human
aagaggcugaggccugga

SEQ ID NO: 1336346 - RNA, 20 nt, Human
aagaggcugaggccuggacu

SEQ ID NO: 1336347 - RNA, 22 nt, Human
aagaggcugaggcuggcacagg

SEQ ID NO: 1336348 - RNA, 15 nt, Human
aagaggcugaggccu

SEQ ID NO: 1336349 - RNA, 16 nt, Human
aaauucugugccuugu

SEQ ID NO: 1336350 - RNA, 22 nt, Human
aaauucugugccuuguuuuuug

SEQ ID NO: 1336351 - RNA, 20 nt, Human
aaauuguaagcaugcacaaa

SEQ ID NO: 1336352 - RNA, 18 nt, Human
aaauucugucucuggauu

SEQ ID NO: 1336353 - RNA, 19 nt, Human
aaauuguaagcaugcacaa

SEQ ID NO: 1336354 - RNA, 16 nt, Human
aaauucugucucugga

SEQ ID NO: 1336355 - RNA, 15 nt, Human
aaauucugcucagau

SEQ ID NO: 1336356 - RNA, 13 nt, Human
aaauuauuugcau

SEQ ID NO: 1336357 - RNA, 14 nt, Human
aaauuguacagccg

SEQ ID NO: 1336358 - RNA, 15 nt, Human
aaauuguacagccgg

SEQ ID NO: 1336359 - RNA, 23 nt, Human
aaauugugcaguacuuugugcau

SEQ ID NO: 1336360 - RNA, 22 nt, Human
aaauuuauuucaauauuagcaa

SEQ ID NO: 1336361 - RNA, 17 nt, Human
guauuuuucuuuaacca

SEQ ID NO: 1336362 - RNA, 13 nt, Human
guauuuuucuuga

SEQ ID NO: 1336363 - RNA, 14 nt, Human
gucaaaacacuugu

SEQ ID NO: 1336364 - RNA, 13 nt, Human
gucaaaacagauu

SEQ ID NO: 1336365 - RNA, 15 nt, Human
gucaaaacagauugu

SEQ ID NO: 1336366 - RNA, 20 nt, Human
gucaaaacagauuguuugca

SEQ ID NO: 1336367 - RNA, 18 nt, Human
gucaaaauagugccacua

SEQ ID NO: 1336368 - RNA, 17 nt, Human
gucaacacuaacaugau

SEQ ID NO: 1336369 - RNA, 21 nt, Human
gucaacaaguaugaauaaaga

SEQ ID NO: 1336370 - RNA, 17 nt, Human
gucaaacuuggauacuu

SEQ ID NO: 1336371 - RNA, 14 nt, Human
gucaaacgugaaaa

SEQ ID NO: 1336372 - RNA, 12 nt, Human
gucaaacaaaua

SEQ ID NO: 1336373 - RNA, 15 nt, Human
gucaaacgugaaaau

SEQ ID NO: 1336374 - RNA, 17 nt, Human
gucaaacgugaaaaugc

SEQ ID NO: 1336375 - RNA, 13 nt, Human
gucaaacuuggau

SEQ ID NO: 1336376 - RNA, 21 nt, Human
gucaaacuuggauacuuggau

SEQ ID NO: 1336377 - RNA, 18 nt, Human
guauguacuucaugcugu

SEQ ID NO: 1336378 - RNA, 13 nt, Human
guauguauuauuu

SEQ ID NO: 1336379 - RNA, 15 nt, Human
guaugguugacacua

SEQ ID NO: 1336380 - RNA, 16 nt, Human
guaugguuuuguggau

SEQ ID NO: 1336381 - RNA, 15 nt, Human
aaauguauuacagug

SEQ ID NO: 1336382 - RNA, 13 nt, Human
guaugucuccagu

SEQ ID NO: 1336383 - RNA, 13 nt, Human
aaauguaugcaug

SEQ ID NO: 1336384 - RNA, 14 nt, Human
aaauguaugcaugu

SEQ ID NO: 1336385 - RNA, 15 nt, Human
aaauguaugcauguu

SEQ ID NO: 1336386 - RNA, 16 nt, Human
aaauguaugcauguug

SEQ ID NO: 1336387 - RNA, 19 nt, Human
aaauguaugcauguugucu

SEQ ID NO: 1336388 - RNA, 20 nt, Human
aaauguaugcauguugucua

SEQ ID NO: 1336389 - RNA, 15 nt, Human
aaauguauuuuaugu

SEQ ID NO: 1336390 - RNA, 16 nt, Human
aaauguauuuuauguu

SEQ ID NO: 1336391 - RNA, 18 nt, Human
aaauguauuuuauguuau

SEQ ID NO: 1336392 - RNA, 21 nt, Human
aaauguauuuuauguuauaua

SEQ ID NO: 1336393 - RNA, 19 nt, Human
aaauguauuuuauguuaua

SEQ ID NO: 1336394 - RNA, 16 nt, Human
aaaugucaugcugccu

SEQ ID NO: 1336395 - RNA, 22 nt, Human
aaauguccuugugaugugcacg

SEQ ID NO: 1336396 - RNA, 15 nt, Human
aaauguccuugugau

SEQ ID NO: 1336397 - RNA, 13 nt, Human
aaaugucacuuuu

SEQ ID NO: 1336398 - RNA, 14 nt, Human
aaaugucacuuuuu

SEQ ID NO: 1336399 - RNA, 15 nt, Human
aaaugucacuuuuug

SEQ ID NO: 1336400 - RNA, 16 nt, Human
aaaugucacuuuuuga

SEQ ID NO: 1336401 - RNA, 22 nt, Human
aaaugucacuuuuugaggcaaa

SEQ ID NO: 1336402 - RNA, 20 nt, Human
aaaugucacuuuuugaggca

SEQ ID NO: 1336403 - RNA, 15 nt, Human
aaaugucaugcugcc

SEQ ID NO: 1336404 - RNA, 18 nt, Human
aaaugucaugcugccuua

SEQ ID NO: 1336405 - RNA, 14 nt, Human
aaaugucuuuaaug

SEQ ID NO: 1336406 - RNA, 18 nt, Human
aaaugucuuuaaugcaau

SEQ ID NO: 1336407 - RNA, 19 nt, Human
aaaugucuuuaaugcaaua

SEQ ID NO: 1336408 - RNA, 16 nt, Human
aaaugugaguguuuuu

SEQ ID NO: 1336409 - RNA, 13 nt, Human
aaaugugaugaau

SEQ ID NO: 1336410 - RNA, 12 nt, Human
aaaugugugugu

SEQ ID NO: 1336411 - RNA, 12 nt, Human
aaauguguuguu

SEQ ID NO: 1336412 - RNA, 15 nt, Human
aaauguguauuuuaa

SEQ ID NO: 1336413 - RNA, 21 nt, Human
aaaugugaugaauacuguauu

SEQ ID NO: 1336414 - RNA, 15 nt, Human
aaaugugauguucua

SEQ ID NO: 1336415 - RNA, 18 nt, Human
aaaugugauguucuaagg

SEQ ID NO: 1336416 - RNA, 19 nt, Human
aaaugugauguucuaaggc

SEQ ID NO: 1336417 - RNA, 20 nt, Human
aaaugugauguucuaaggcu

SEQ ID NO: 1336418 - RNA, 22 nt, Human
aaaugugauguucuaaggcucu

SEQ ID NO: 1336419 - RNA, 22 nt, Human
aaaugugggauuaugggucaca

SEQ ID NO: 1336420 - RNA, 20 nt, Human
aaaugugggauuauggguca

SEQ ID NO: 1336421 - RNA, 13 nt, Human
aaauguuaaaaug

SEQ ID NO: 1336422 - RNA, 14 nt, Human
aaauguuaaaaugu

SEQ ID NO: 1336423 - RNA, 14 nt, Human
aaauuaagaaagga

SEQ ID NO: 1336424 - RNA, 14 nt, Human
aaauuaagaaggca

SEQ ID NO: 1336425 - RNA, 15 nt, Human
aaauuaagaaggcaa

SEQ ID NO: 1336426 - RNA, 13 nt, Human
aaauuaagacuuu

SEQ ID NO: 1336427 - RNA, 21 nt, Human
aaauuaguuagccaauauuuu

SEQ ID NO: 1336428 - RNA, 13 nt, Human
aaauuaguuauau

SEQ ID NO: 1336429 - RNA, 13 nt, Human
aaauuauagaagu

SEQ ID NO: 1336430 - RNA, 14 nt, Human
aaauuauuaaugaa

SEQ ID NO: 1336431 - RNA, 18 nt, Human
aaauuauuaauuuaugca

SEQ ID NO: 1336432 - RNA, 12 nt, Human
aaauuauuguuu

SEQ ID NO: 1336433 - RNA, 20 nt, Human
aaauuauuguuuuucuuuuu

SEQ ID NO: 1336434 - RNA, 12 nt, Human
aaauuauuuaaa

SEQ ID NO: 1336435 - RNA, 13 nt, Human
aaauuauuuaaac

SEQ ID NO: 1336436 - RNA, 13 nt, Human
guauauuguguuu

SEQ ID NO: 1336437 - RNA, 19 nt, Human
guauauuguguuuguguau

SEQ ID NO: 1336438 - RNA, 20 nt, Human
guauauuguguuuguguauu

SEQ ID NO: 1336439 - RNA, 15 nt, Human
guauaaaauaauuuu

SEQ ID NO: 1336440 - RNA, 21 nt, Human
guauaaaauaauuuuuauauu

SEQ ID NO: 1336441 - RNA, 15 nt, Human
guauaaguggugugu

SEQ ID NO: 1336442 - RNA, 21 nt, Human
guauaaaacuuuccucgccug

SEQ ID NO: 1336443 - RNA, 23 nt, Human
guauaaaaauaaaaaagauccca

SEQ ID NO: 1336444 - RNA, 22 nt, Human
guaucaaaaugcucuuauuuca

SEQ ID NO: 1336445 - RNA, 13 nt, Human
guaucaaauacau

SEQ ID NO: 1336446 - RNA, 14 nt, Human
guaucaaauacauu

SEQ ID NO: 1336447 - RNA, 14 nt, Human
guaucaaaaugcuc

SEQ ID NO: 1336448 - RNA, 13 nt, Human
guaucaaaaugcu

SEQ ID NO: 1336449 - RNA, 14 nt, Human
guauauuuuccuau

SEQ ID NO: 1336450 - RNA, 15 nt, Human
guauauuuuccuaua

SEQ ID NO: 1336451 - RNA, 16 nt, Human
guauauuuuauaucaa

SEQ ID NO: 1336452 - RNA, 19 nt, Human
guaucaaauacauuuaaaa

SEQ ID NO: 1336453 - RNA, 12 nt, Human
guaucauagaaa

SEQ ID NO: 1336454 - RNA, 15 nt, Human
guaucauagaaaugu

SEQ ID NO: 1336455 - RNA, 13 nt, Human
guaucaucagugu

SEQ ID NO: 1336456 - RNA, 17 nt, Human
guaucaugcccugugca

SEQ ID NO: 1336457 - RNA, 18 nt, Human
guaucaugcccugugcaa

SEQ ID NO: 1336458 - RNA, 14 nt, Human
guauccacuuugca

SEQ ID NO: 1336459 - RNA, 19 nt, Human
guauccacuuugcacagcu

SEQ ID NO: 1336460 - RNA, 20 nt, Human
guauccagguucccucccag

SEQ ID NO: 1336461 - RNA, 12 nt, Human
guaugcauguug

SEQ ID NO: 1336462 - RNA, 15 nt, Human
guaugcgugugugug

SEQ ID NO: 1336463 - RNA, 16 nt, Human
guaugcauguugucua

SEQ ID NO: 1336464 - RNA, 19 nt, Human
guauaaaagggacugagaa

SEQ ID NO: 1336465 - RNA, 15 nt, Human
guauaaaacuuuccu

SEQ ID NO: 1336466 - RNA, 16 nt, Human
guauaaaacuuuccuc

SEQ ID NO: 1336467 - RNA, 18 nt, Human
guauaaaacuuuccucgc

SEQ ID NO: 1336468 - RNA, 19 nt, Human
guauaaaacuuuccucgcc

SEQ ID NO: 1336469 - RNA, 12 nt, Human
guaguugucuuu

SEQ ID NO: 1336470 - RNA, 16 nt, Human
guaguugucuuuccug

SEQ ID NO: 1336471 - RNA, 20 nt, Human
guaguuuuuauauguuguaa

SEQ ID NO: 1336472 - RNA, 13 nt, Human
guaguuuuuucau

SEQ ID NO: 1336473 - RNA, 14 nt, Human
guaguuuuuucauc

SEQ ID NO: 1336474 - RNA, 15 nt, Human
guaguuuuuucaucu

SEQ ID NO: 1336475 - RNA, 17 nt, Human
guaguuuuuucaucuuc

SEQ ID NO: 1336476 - RNA, 16 nt, Human
guauaaaaauaaaaaa

SEQ ID NO: 1336477 - RNA, 19 nt, Human
guauaaaaauaaaaaagau

SEQ ID NO: 1336478 - RNA, 17 nt, Human
guaguugccuuaaaaua

SEQ ID NO: 1336479 - RNA, 18 nt, Human
aaauguaaggcuguguaa

SEQ ID NO: 1336480 - RNA, 14 nt, Human
guaguugaauauug

SEQ ID NO: 1336481 - RNA, 20 nt, Human
guaguguuggagaagaacug

SEQ ID NO: 1336482 - RNA, 15 nt, Human
aaaugguucagaauu

SEQ ID NO: 1336483 - RNA, 19 nt, Human
aaauguaaacuguuucuuu

SEQ ID NO: 1336484 - RNA, 20 nt, Human
aaauguaaacuguuucuuua

SEQ ID NO: 1336485 - RNA, 22 nt, Human
aaauguaaagauauuuuuaucu

SEQ ID NO: 1336486 - RNA, 13 nt, Human
aaauguaaagcca

SEQ ID NO: 1336487 - RNA, 17 nt, Human
aaauguaacuuuuguaa

SEQ ID NO: 1336488 - RNA, 18 nt, Human
aaauguaacuuuuguaag

SEQ ID NO: 1336489 - RNA, 20 nt, Human
aaauguaagauuauagauuc

SEQ ID NO: 1336490 - RNA, 21 nt, Human
aaauguaagauuauagauucu

SEQ ID NO: 1336491 - RNA, 22 nt, Human
aaauguaagauuauagauucua

SEQ ID NO: 1336492 - RNA, 13 nt, Human
aaauguaaggcug

SEQ ID NO: 1336493 - RNA, 17 nt, Human
aaauguaaggcugugua

SEQ ID NO: 1336494 - RNA, 20 nt, Human
aaauguaaggcuguguaaga

SEQ ID NO: 1336495 - RNA, 20 nt, Human
aaauggucucuaacauuucc

SEQ ID NO: 1336496 - RNA, 22 nt, Human
aaaugguccaauuaguuuccuu

SEQ ID NO: 1336497 - RNA, 14 nt, Human
aaaugguucagaau

SEQ ID NO: 1336498 - RNA, 23 nt, Human
aaaugguucagaauuaaacuuuu

SEQ ID NO: 1336499 - RNA, 18 nt, Human
aaaugguacuguacagcu

SEQ ID NO: 1336500 - RNA, 19 nt, Human
aaaugguaggcauuuccua

SEQ ID NO: 1336501 - RNA, 16 nt, Human
aaaugguaucuuuugg

SEQ ID NO: 1336502 - RNA, 21 nt, Human
aaaugguccaauuaguuuccu

SEQ ID NO: 1336503 - RNA, 14 nt, Human
aaaugguccaggag

SEQ ID NO: 1336504 - RNA, 22 nt, Human
guaaauuggcauggaaauuuaa

SEQ ID NO: 1336505 - RNA, 14 nt, Human
guaacaauacaaau

SEQ ID NO: 1336506 - RNA, 17 nt, Human
guaacaauacaaaugga

SEQ ID NO: 1336507 - RNA, 21 nt, Human
guaacaauuguguagccuuuu

SEQ ID NO: 1336508 - RNA, 18 nt, Human
guaacaauacaaauggau

SEQ ID NO: 1336509 - RNA, 15 nt, Human
guaacacuaauauau

SEQ ID NO: 1336510 - RNA, 16 nt, Human
guaacacuaauauauu

SEQ ID NO: 1336511 - RNA, 17 nt, Human
guaacacuaauauauuu

SEQ ID NO: 1336512 - RNA, 19 nt, Human
guaacacuaauauauuuaa

SEQ ID NO: 1336513 - RNA, 22 nt, Human
guaacacuaauauauuuaaaaa

SEQ ID NO: 1336514 - RNA, 20 nt, Human
guaacacuaauauauuuaaa

SEQ ID NO: 1336515 - RNA, 12 nt, Human
aaauuugccaag

SEQ ID NO: 1336516 - RNA, 15 nt, Human
aaauuugauugauuu

SEQ ID NO: 1336517 - RNA, 17 nt, Human
aaauuugauugauuuga

SEQ ID NO: 1336518 - RNA, 17 nt, Human
aaauuugcauuaaauua

SEQ ID NO: 1336519 - RNA, 11 nt, Human
aaauuuguacu

SEQ ID NO: 1336520 - RNA, 12 nt, Human
aaauuuguacua

SEQ ID NO: 1336521 - RNA, 13 nt, Human
aaauuuguacuau

SEQ ID NO: 1336522 - RNA, 17 nt, Human
aaauuuguacuauuuaa

SEQ ID NO: 1336523 - RNA, 19 nt, Human
aaauuuguacuauuuaacu

SEQ ID NO: 1336524 - RNA, 20 nt, Human
aaauuuguacuauuuaacug

SEQ ID NO: 1336525 - RNA, 19 nt, Human
aaauuuguuauuuugcaac

SEQ ID NO: 1336526 - RNA, 18 nt, Human
aaauuuguucuuguauuu

SEQ ID NO: 1336527 - RNA, 13 nt, Human
aaauuuguugcau

SEQ ID NO: 1336528 - RNA, 14 nt, Human
aaauuuguugcaua

SEQ ID NO: 1336529 - RNA, 15 nt, Human
aaauuuguucuugua

SEQ ID NO: 1336530 - RNA, 14 nt, Human
gucagucacagcca

SEQ ID NO: 1336531 - RNA, 16 nt, Human
gucagucacagccacc

SEQ ID NO: 1336532 - RNA, 18 nt, Human
gucauaacuaaauaaagc

SEQ ID NO: 1336533 - RNA, 14 nt, Human
aaauuugauugauu

SEQ ID NO: 1336534 - RNA, 13 nt, Human
gucagucacagcc

SEQ ID NO: 1336535 - RNA, 22 nt, Human
gucaguaccuucaaacuagggc

SEQ ID NO: 1336536 - RNA, 17 nt, Human
gucagaauagaaauuag

SEQ ID NO: 1336537 - RNA, 13 nt, Human
gucagaauagaaa

SEQ ID NO: 1336538 - RNA, 19 nt, Human
gucacacaguguuggaggu

SEQ ID NO: 1336539 - RNA, 20 nt, Human
gucacacaguguuggagguu

SEQ ID NO: 1336540 - RNA, 12 nt, Human
gucacagccacc

SEQ ID NO: 1336541 - RNA, 13 nt, Human
gucaacaguaaac

SEQ ID NO: 1336542 - RNA, 14 nt, Human
gucaacaguaaacc

SEQ ID NO: 1336543 - RNA, 15 nt, Human
gucagacccuggagg

SEQ ID NO: 1336544 - RNA, 14 nt, Human
gucagacccuggag

SEQ ID NO: 1336545 - RNA, 18 nt, Human
gucaggauugcgagagau

SEQ ID NO: 1336546 - RNA, 19 nt, Human
gucaggauugcgagagaug

SEQ ID NO: 1336547 - RNA, 21 nt, Human
gucaggauugcgagagaugug

SEQ ID NO: 1336548 - RNA, 22 nt, Human
gucaggauugcgagagaugugu

SEQ ID NO: 1336549 - RNA, 23 nt, Human
gucaggauugcgagagaugugug

SEQ ID NO: 1336550 - RNA, 16 nt, Human
gucaggcacugggcau

SEQ ID NO: 1336551 - RNA, 18 nt, Human
gucaggcacugggcauga

SEQ ID NO: 1336552 - RNA, 13 nt, Human
gucaggcagggug

SEQ ID NO: 1336553 - RNA, 21 nt, Human
gucaggcccuuauuuucaaga

SEQ ID NO: 1336554 - RNA, 22 nt, Human
gucaggcccuuauuuucaagaa

SEQ ID NO: 1336555 - RNA, 20 nt, Human
aaauuuuuucucuaggaaau

SEQ ID NO: 1336556 - RNA, 23 nt, Human
aaauuuuaucugccucucuugua

SEQ ID NO: 1336557 - RNA, 12 nt, Human
aaauuuuauaug

SEQ ID NO: 1336558 - RNA, 23 nt, Human
aaauuuuagcgugcucacugacc

SEQ ID NO: 1336559 - RNA, 22 nt, Human
aaauuuuccuguccucuuucag

SEQ ID NO: 1336560 - RNA, 23 nt, Human
aaauuuuccuguccucuuucagc

SEQ ID NO: 1336561 - RNA, 20 nt, Human
aaauuuuuguaguagcguuu

SEQ ID NO: 1336562 - RNA, 11 nt, Human
aaauuuuuugu

SEQ ID NO: 1336563 - RNA, 14 nt, Human
aaauuuuuuguuga

SEQ ID NO: 1336564 - RNA, 18 nt, Human
aaauuuuuuguugacauu

SEQ ID NO: 1336565 - RNA, 15 nt, Human
aaauuuuuuguugac

SEQ ID NO: 1336566 - RNA, 22 nt, Human
aacaagaccucagugccuuccu

SEQ ID NO: 1336567 - RNA, 23 nt, Human
aacaagaccucagugccuuccug

SEQ ID NO: 1336568 - RNA, 15 nt, Human
aacaagagaagcauu

SEQ ID NO: 1336569 - RNA, 16 nt, Human
aacaagagaagcauuc

SEQ ID NO: 1336570 - RNA, 17 nt, Human
aacaagaugaaauucca

SEQ ID NO: 1336571 - RNA, 17 nt, Human
aacaagagaagcauucu

SEQ ID NO: 1336572 - RNA, 21 nt, Human
aacaagagaagcauucucauu

SEQ ID NO: 1336573 - RNA, 19 nt, Human
aacaagagcacuacauuca

SEQ ID NO: 1336574 - RNA, 17 nt, Human
aacaaugcuguauuuua

SEQ ID NO: 1336575 - RNA, 22 nt, Human
aacaaugcuguauuuuaaaaga

SEQ ID NO: 1336576 - RNA, 19 nt, Human
aacaauaaaaguguccauu

SEQ ID NO: 1336577 - RNA, 15 nt, Human
aacacaacuauauug

SEQ ID NO: 1336578 - RNA, 16 nt, Human
aacacaacuauauugu

SEQ ID NO: 1336579 - RNA, 12 nt, Human
aacaauucuaaa

SEQ ID NO: 1336580 - RNA, 14 nt, Human
aacaauucuaaaau

SEQ ID NO: 1336581 - RNA, 22 nt, Human
aacaauucuaaaaugauuguag

SEQ ID NO: 1336582 - RNA, 19 nt, Human
aacaauucuaaaaugauug

SEQ ID NO: 1336583 - RNA, 16 nt, Human
aacaauugaaguaaac

SEQ ID NO: 1336584 - RNA, 17 nt, Human
aacaauugaaguaaacu

SEQ ID NO: 1336585 - RNA, 23 nt, Human
aacaauugaaguaaacuuuuugu

SEQ ID NO: 1336586 - RNA, 12 nt, Human
aacaauaaaaga

SEQ ID NO: 1336587 - RNA, 15 nt, Human
aacaaugcuguauuu

SEQ ID NO: 1336588 - RNA, 15 nt, Human
guccaguguuucuuu

SEQ ID NO: 1336589 - RNA, 24 nt, Human
guccagugggaggugagaccaccu

SEQ ID NO: 1336590 - RNA, 23 nt, Human
guccaagaauccacauuucuaaa

SEQ ID NO: 1336591 - RNA, 16 nt, Human
guccaagauuccggau

SEQ ID NO: 1336592 - RNA, 20 nt, Human
guccaagauuccggauccua

SEQ ID NO: 1336593 - RNA, 22 nt, Human
guccaagauuccggauccuaag

SEQ ID NO: 1336594 - RNA, 14 nt, Human
guccauaucacaca

SEQ ID NO: 1336595 - RNA, 17 nt, Human
guccauaucacacacau

SEQ ID NO: 1336596 - RNA, 15 nt, Human
guccauaucacacac

SEQ ID NO: 1336597 - RNA, 16 nt, Human
guccauaucacacaca

SEQ ID NO: 1336598 - RNA, 14 nt, Human
gucccacccccacc

SEQ ID NO: 1336599 - RNA, 15 nt, Human
gucccacccccaccc

SEQ ID NO: 1336600 - RNA, 19 nt, Human
gucccacccccacccccag

SEQ ID NO: 1336601 - RNA, 21 nt, Human
gucccacccccacccccagcu

SEQ ID NO: 1336602 - RNA, 22 nt, Human
gucccacccccacccccagcuc

SEQ ID NO: 1336603 - RNA, 23 nt, Human
gucccacccccacccccagcuca

SEQ ID NO: 1336604 - RNA, 16 nt, Human
guccccauacuccuau

SEQ ID NO: 1336605 - RNA, 17 nt, Human
guccccauacuccuaug

SEQ ID NO: 1336606 - RNA, 20 nt, Human
gucccccacucuaaagcaaa

SEQ ID NO: 1336607 - RNA, 11 nt, Human
guccccccacc

SEQ ID NO: 1336608 - RNA, 12 nt, Human
guccccccaccc

SEQ ID NO: 1336609 - RNA, 17 nt, Human
aacacaacuauauuguu

SEQ ID NO: 1336610 - RNA, 17 nt, Human
aacacacuaccgaaugu

SEQ ID NO: 1336611 - RNA, 19 nt, Human
aacacacuaccgaaugugu

SEQ ID NO: 1336612 - RNA, 23 nt, Human
aacacacuaccgaaugugucuuu

SEQ ID NO: 1336613 - RNA, 19 nt, Human
aacacagaaaccuuuuuaa

SEQ ID NO: 1336614 - RNA, 20 nt, Human
gucauuuugguacuuuggug

SEQ ID NO: 1336615 - RNA, 18 nt, Human
gucauuuugguacuuugg

SEQ ID NO: 1336616 - RNA, 17 nt, Human
gucauuuuuacaaugua

SEQ ID NO: 1336617 - RNA, 22 nt, Human
gucauuuuuacaauguaauuau

SEQ ID NO: 1336618 - RNA, 23 nt, Human
gucauuuuuuuucuuugaauaaa

SEQ ID NO: 1336619 - RNA, 20 nt, Human
gucauuuuuacaauguaauu

SEQ ID NO: 1336620 - RNA, 15 nt, Human
guccaaaaccgccag

SEQ ID NO: 1336621 - RNA, 17 nt, Human
guccaaaaccgccagcu

SEQ ID NO: 1336622 - RNA, 18 nt, Human
guccaaaaccgccagcuc

SEQ ID NO: 1336623 - RNA, 20 nt, Human
guccaaaaccgccagcucug

SEQ ID NO: 1336624 - RNA, 22 nt, Human
guccaagaauccacauuucuaa

SEQ ID NO: 1336625 - RNA, 22 nt, Human
guccccccacccucauucuacu

SEQ ID NO: 1336626 - RNA, 13 nt, Human
guccccccacccu

SEQ ID NO: 1336627 - RNA, 13 nt, Human
gucccuugccccc

SEQ ID NO: 1336628 - RNA, 15 nt, Human
gucccuugccccccu

SEQ ID NO: 1336629 - RNA, 18 nt, Human
gucccuugccccccuggc

SEQ ID NO: 1336630 - RNA, 19 nt, Human
gucccuugccccccuggcc

SEQ ID NO: 1336631 - RNA, 20 nt, Human
gucccuugccccccuggccu

SEQ ID NO: 1336632 - RNA, 13 nt, Human
gucccuugccuca

SEQ ID NO: 1336633 - RNA, 14 nt, Human
gucccuugccucaa

SEQ ID NO: 1336634 - RNA, 19 nt, Human
gucccuugccucaaugcca

SEQ ID NO: 1336635 - RNA, 21 nt, Human
gucccuugccccccuggccuc

SEQ ID NO: 1336636 - RNA, 20 nt, Human
gucccuuguauccccugcag

SEQ ID NO: 1336637 - RNA, 19 nt, Human
gucccuuguauccccugca

SEQ ID NO: 1336638 - RNA, 18 nt, Human
aacagaagggagggcaga

SEQ ID NO: 1336639 - RNA, 22 nt, Human
aacagaagggagggcagagcug

SEQ ID NO: 1336640 - RNA, 21 nt, Human
aacagaaugucucuuccuggu

SEQ ID NO: 1336641 - RNA, 21 nt, Human
aacagaagggagggcagagcu

SEQ ID NO: 1336642 - RNA, 14 nt, Human
aacagaucaguaaa

SEQ ID NO: 1336643 - RNA, 13 nt, Human
aacagaucuggaa

SEQ ID NO: 1336644 - RNA, 22 nt, Human
aacagaucuggaaccucagccu

SEQ ID NO: 1336645 - RNA, 21 nt, Human
aacagaucuggaaccucagcc

SEQ ID NO: 1336646 - RNA, 22 nt, Human
aacagugauuaccagggacuga

SEQ ID NO: 1336647 - RNA, 17 nt, Human
aacagguauauacuuug

SEQ ID NO: 1336648 - RNA, 18 nt, Human
aacagguaauauaaaaag

SEQ ID NO: 1336649 - RNA, 15 nt, Human
aacagguauauacuu

SEQ ID NO: 1336650 - RNA, 17 nt, Human
aacagugcaacacuggu

SEQ ID NO: 1336651 - RNA, 13 nt, Human
aacagggaaggca

SEQ ID NO: 1336652 - RNA, 15 nt, Human
aacagggaaggcagg

SEQ ID NO: 1336653 - RNA, 20 nt, Human
aacagggaaggcaggcaggg

SEQ ID NO: 1336654 - RNA, 23 nt, Human
aacagggaaggcaggcagggcuc

SEQ ID NO: 1336655 - RNA, 22 nt, Human
aacagggaaggcaggcagggcu

SEQ ID NO: 1336656 - RNA, 20 nt, Human
aacagggccacauagaugcu

SEQ ID NO: 1336657 - RNA, 16 nt, Human
aacagggccacauaga

SEQ ID NO: 1336658 - RNA, 14 nt, Human
aacagggcugccuu

SEQ ID NO: 1336659 - RNA, 21 nt, Human
aacagggcugccuucuggccu

SEQ ID NO: 1336660 - RNA, 15 nt, Human
aacagguaauauaaa

SEQ ID NO: 1336661 - RNA, 16 nt, Human
gucugucugucugucc

SEQ ID NO: 1336662 - RNA, 14 nt, Human
gucugucugucugu

SEQ ID NO: 1336663 - RNA, 16 nt, Human
gucuguacugauucaa

SEQ ID NO: 1336664 - RNA, 16 nt, Human
gucuguagguugcaca

SEQ ID NO: 1336665 - RNA, 17 nt, Human
gucuguagguugcacac

SEQ ID NO: 1336666 - RNA, 18 nt, Human
gucuguagguugcacacu

SEQ ID NO: 1336667 - RNA, 19 nt, Human
gucuguagguugcacacuu

SEQ ID NO: 1336668 - RNA, 22 nt, Human
gucuguagugucacucaaggcg

SEQ ID NO: 1336669 - RNA, 20 nt, Human
gucuguagguugcacacuuu

SEQ ID NO: 1336670 - RNA, 12 nt, Human
gucuggcagccu

SEQ ID NO: 1336671 - RNA, 22 nt, Human
gucuggcagccucccauccagg

SEQ ID NO: 1336672 - RNA, 15 nt, Human
gucuggcccaccagg

SEQ ID NO: 1336673 - RNA, 17 nt, Human
gucuggccccccugguc

SEQ ID NO: 1336674 - RNA, 19 nt, Human
gucuggcaguuuauauuua

SEQ ID NO: 1336675 - RNA, 17 nt, Human
gucuggcacagccuggc

SEQ ID NO: 1336676 - RNA, 19 nt, Human
gucuggcacagccuggcug

SEQ ID NO: 1336677 - RNA, 21 nt, Human
aaccugaugaaaauaaagaau

SEQ ID NO: 1336678 - RNA, 22 nt, Human
aaccugaugaaaauaaagaaug

SEQ ID NO: 1336679 - RNA, 23 nt, Human
aaccugaugaaaauaaagaaugg

SEQ ID NO: 1336680 - RNA, 22 nt, Human
gucuggcaaugccacagcccug

SEQ ID NO: 1336681 - RNA, 23 nt, Human
gucuggcaaugccacagcccugu

SEQ ID NO: 1336682 - RNA, 20 nt, Human
aaccugagccccaaaaggua

SEQ ID NO: 1336683 - RNA, 21 nt, Human
aaccugagauuuauuaaagaa

SEQ ID NO: 1336684 - RNA, 22 nt, Human
aaccugagauuuauuaaagaaa

SEQ ID NO: 1336685 - RNA, 20 nt, Human
aaccugagucguacagaaag

SEQ ID NO: 1336686 - RNA, 17 nt, Human
aaccugaugaaaauaaa

SEQ ID NO: 1336687 - RNA, 19 nt, Human
aaccugaugaaaauaaaga

SEQ ID NO: 1336688 - RNA, 20 nt, Human
aaccugaugaaaauaaagaa

SEQ ID NO: 1336689 - RNA, 16 nt, Human
gucuuucacauuuaaa

SEQ ID NO: 1336690 - RNA, 18 nt, Human
gucuuuggagaaaugcuu

SEQ ID NO: 1336691 - RNA, 22 nt, Human
gucuuuggagaaaugcuuagaa

SEQ ID NO: 1336692 - RNA, 15 nt, Human
gucuuugguucagcu

SEQ ID NO: 1336693 - RNA, 15 nt, Human
gucuuugguucuaag

SEQ ID NO: 1336694 - RNA, 17 nt, Human
gucuuugguucuaagga

SEQ ID NO: 1336695 - RNA, 16 nt, Human
gucuuuagauagcccu

SEQ ID NO: 1336696 - RNA, 21 nt, Human
gucuuuagauagcccuguccu

SEQ ID NO: 1336697 - RNA, 22 nt, Human
gucuuuagauagcccuguccug

SEQ ID NO: 1336698 - RNA, 24 nt, Human
gucuuuagauagcccuguccuggu

SEQ ID NO: 1336699 - RNA, 15 nt, Human
gucuuucacagcucc

SEQ ID NO: 1336700 - RNA, 16 nt, Human
gucuuucacagcuccu

SEQ ID NO: 1336701 - RNA, 14 nt, Human
gucuucuaaacuuc

SEQ ID NO: 1336702 - RNA, 23 nt, Human
gucuucuaaacuuccccaucuuc

SEQ ID NO: 1336703 - RNA, 16 nt, Human
gucuuuuuagaugccc

SEQ ID NO: 1336704 - RNA, 15 nt, Human
gucuuuuguucgcau

SEQ ID NO: 1336705 - RNA, 12 nt, Human
gucuuuugcuuu

SEQ ID NO: 1336706 - RNA, 13 nt, Human
gucuuuugcuuuu

SEQ ID NO: 1336707 - RNA, 14 nt, Human
gucuuuugcuuuug

SEQ ID NO: 1336708 - RNA, 22 nt, Human
gucuuuugcuuuugcccauuuu

SEQ ID NO: 1336709 - RNA, 16 nt, Human
gucuuuugcuuuuggc

SEQ ID NO: 1336710 - RNA, 12 nt, Human
gucuuuuggagg

SEQ ID NO: 1336711 - RNA, 14 nt, Human
gucuuuuggaggac

SEQ ID NO: 1336712 - RNA, 16 nt, Human
gucuuuugguuaugaa

SEQ ID NO: 1336713 - RNA, 21 nt, Human
aacuagaguuuagcuggaaaa

SEQ ID NO: 1336714 - RNA, 20 nt, Human
aacuagaggugagaaauuua

SEQ ID NO: 1336715 - RNA, 21 nt, Human
aacuagaggugagaaauuuaa

SEQ ID NO: 1336716 - RNA, 23 nt, Human
aacuagacucccaagcuggacua

SEQ ID NO: 1336717 - RNA, 20 nt, Human
aacuagacucccaagcugga

SEQ ID NO: 1336718 - RNA, 17 nt, Human
aacuacuguguuaugca

SEQ ID NO: 1336719 - RNA, 14 nt, Human
aacuacuguguuau

SEQ ID NO: 1336720 - RNA, 16 nt, Human
aacuaugauuuggaaa

SEQ ID NO: 1336721 - RNA, 21 nt, Human
aacuaugauuuggaaaauaaa

SEQ ID NO: 1336722 - RNA, 16 nt, Human
aacuaugauuauuaac

SEQ ID NO: 1336723 - RNA, 17 nt, Human
aacuaugcauggugccc

SEQ ID NO: 1336724 - RNA, 22 nt, Human
aacuaugcauggugccccagga

SEQ ID NO: 1336725 - RNA, 23 nt, Human
aacuaugcauggugccccaggac

SEQ ID NO: 1336726 - RNA, 22 nt, Human
aacuagaggugagaaauuuaaa

SEQ ID NO: 1336727 - RNA, 18 nt, Human
aacuaucuuggugaauuu

SEQ ID NO: 1336728 - RNA, 11 nt, Human
aacuaucuugg

SEQ ID NO: 1336729 - RNA, 18 nt, Human
aaccuugaaaacuuuaug

SEQ ID NO: 1336730 - RNA, 17 nt, Human
aaccuugaaaaaaaaca

SEQ ID NO: 1336731 - RNA, 20 nt, Human
aaccuugaaaaaaaacagug

SEQ ID NO: 1336732 - RNA, 13 nt, Human
aaccuugccuggu

SEQ ID NO: 1336733 - RNA, 16 nt, Human
aaccuugccugguaca

SEQ ID NO: 1336734 - RNA, 19 nt, Human
aaccuugccugguacagua

SEQ ID NO: 1336735 - RNA, 17 nt, Human
aacuaccaccugacauu

SEQ ID NO: 1336736 - RNA, 18 nt, Human
aaccuugccugguacagu

SEQ ID NO: 1336737 - RNA, 21 nt, Human
aaccuuggguuagaccuacag

SEQ ID NO: 1336738 - RNA, 15 nt, Human
aacuaccugagcuaa

SEQ ID NO: 1336739 - RNA, 17 nt, Human
aacuacuaauagaauaa

SEQ ID NO: 1336740 - RNA, 20 nt, Human
aacuacuaccuguaaugaca

SEQ ID NO: 1336741 - RNA, 21 nt, Human
aacucguauagcaugcaucug

SEQ ID NO: 1336742 - RNA, 17 nt, Human
gugaacccaggacaagc

SEQ ID NO: 1336743 - RNA, 13 nt, Human
gugaacccaggac

SEQ ID NO: 1336744 - RNA, 15 nt, Human
gugaacccaggacaa

SEQ ID NO: 1336745 - RNA, 15 nt, Human
aacucguauagcaug

SEQ ID NO: 1336746 - RNA, 19 nt, Human
aacucguauagcaugcauc

SEQ ID NO: 1336747 - RNA, 21 nt, Human
aacuccugugaccacaacaug

SEQ ID NO: 1336748 - RNA, 13 nt, Human
aacuccugugacc

SEQ ID NO: 1336749 - RNA, 16 nt, Human
aacucgaaucugugug

SEQ ID NO: 1336750 - RNA, 15 nt, Human
aacucgaaucugugu

SEQ ID NO: 1336751 - RNA, 17 nt, Human
aacucaucugucaccaa

SEQ ID NO: 1336752 - RNA, 23 nt, Human
aacucauuagacuggaacuugaa

SEQ ID NO: 1336753 - RNA, 15 nt, Human
aacucauuagacugg

SEQ ID NO: 1336754 - RNA, 22 nt, Human
aacucauugcucuguuaauaau

SEQ ID NO: 1336755 - RNA, 20 nt, Human
aaccaagugaucaaacuaca

SEQ ID NO: 1336756 - RNA, 18 nt, Human
aaccaagcugaguuuccu

SEQ ID NO: 1336757 - RNA, 19 nt, Human
aaccaagcugaguuuccua

SEQ ID NO: 1336758 - RNA, 20 nt, Human
aaccaagcugaguuuccuau

SEQ ID NO: 1336759 - RNA, 13 nt, Human
gucucgaacuccu

SEQ ID NO: 1336760 - RNA, 18 nt, Human
gucucgaacuccugaccu

SEQ ID NO: 1336761 - RNA, 19 nt, Human
gucucgaacuccugaccuu

SEQ ID NO: 1336762 - RNA, 13 nt, Human
gucucgagcgccc

SEQ ID NO: 1336763 - RNA, 18 nt, Human
aaccaagccguggcuucc

SEQ ID NO: 1336764 - RNA, 17 nt, Human
aacaguuccuuucaaag

SEQ ID NO: 1336765 - RNA, 19 nt, Human
gucucccuccucugcccgg

SEQ ID NO: 1336766 - RNA, 21 nt, Human
aacaguugcauguaguaacac

SEQ ID NO: 1336767 - RNA, 22 nt, Human
aacaguugcauguaguaacacu

SEQ ID NO: 1336768 - RNA, 14 nt, Human
aacaguugguaacu

SEQ ID NO: 1336769 - RNA, 22 nt, Human
aacaguugcacagcaucucagc

SEQ ID NO: 1336770 - RNA, 14 nt, Human
aacaguugcaugua

SEQ ID NO: 1336771 - RNA, 18 nt, Human
aacaguugcauguaguaa

SEQ ID NO: 1336772 - RNA, 20 nt, Human
aacaguugcauguaguaaca

SEQ ID NO: 1336773 - RNA, 20 nt, Human
aacaguugcacagcaucuca

SEQ ID NO: 1336774 - RNA, 18 nt, Human
aacaguugcacagcaucu

SEQ ID NO: 1336775 - RNA, 17 nt, Human
aacaguugcacagcauc

SEQ ID NO: 1336776 - RNA, 15 nt, Human
aacaguugcacagca

SEQ ID NO: 1336777 - RNA, 14 nt, Human
aacaguugcacagc

SEQ ID NO: 1336778 - RNA, 17 nt, Human
aacaguugguaacuuuu

SEQ ID NO: 1336779 - RNA, 20 nt, Human
gucucccuggaucagaacag

SEQ ID NO: 1336780 - RNA, 13 nt, Human
aaccauugugcau

SEQ ID NO: 1336781 - RNA, 16 nt, Human
aaccauugugcauucu

SEQ ID NO: 1336782 - RNA, 12 nt, Human
aaccauuuccuc

SEQ ID NO: 1336783 - RNA, 15 nt, Human
aaccauuuccucaga

SEQ ID NO: 1336784 - RNA, 16 nt, Human
aaccauuuccucagac

SEQ ID NO: 1336785 - RNA, 19 nt, Human
aaccauuugaaaccccugu

SEQ ID NO: 1336786 - RNA, 13 nt, Human
aacccaauaguug

SEQ ID NO: 1336787 - RNA, 19 nt, Human
aacccaagguaccauccua

SEQ ID NO: 1336788 - RNA, 14 nt, Human
aacccaauccaaau

SEQ ID NO: 1336789 - RNA, 19 nt, Human
aacccacaggcccacagua

SEQ ID NO: 1336790 - RNA, 20 nt, Human
aaccauguguuauguuuucg

SEQ ID NO: 1336791 - RNA, 19 nt, Human
aaccauuauaaccuuaauu

SEQ ID NO: 1336792 - RNA, 17 nt, Human
aaccauuaaccagaucu

SEQ ID NO: 1336793 - RNA, 14 nt, Human
aaccucauccucuc

SEQ ID NO: 1336794 - RNA, 16 nt, Human
aaccucaucuucuuca

SEQ ID NO: 1336795 - RNA, 18 nt, Human
aaccucaguaauuuagaa

SEQ ID NO: 1336796 - RNA, 14 nt, Human
aaccucaguaauuu

SEQ ID NO: 1336797 - RNA, 20 nt, Human
aaccucauccuccuucuuca

SEQ ID NO: 1336798 - RNA, 13 nt, Human
aaccuccaccucc

SEQ ID NO: 1336799 - RNA, 16 nt, Human
aacccgggaggcagag

SEQ ID NO: 1336800 - RNA, 22 nt, Human
aacccgaggcugagaaucagac

SEQ ID NO: 1336801 - RNA, 23 nt, Human
aacccgagucauucguucugugg

SEQ ID NO: 1336802 - RNA, 20 nt, Human
aaccucagccuggccagaca

SEQ ID NO: 1336803 - RNA, 17 nt, Human
aaccccuguaggccuca

SEQ ID NO: 1336804 - RNA, 18 nt, Human
aaccccuuucccacccca

SEQ ID NO: 1336805 - RNA, 12 nt, Human
aaccucuaaauu

SEQ ID NO: 1336806 - RNA, 24 nt, Human
aaccucuaaauucuuucauuuuag

SEQ ID NO: 1336807 - RNA, 16 nt, Human
aaccucgggccugcug

SEQ ID NO: 1336808 - RNA, 14 nt, Human
aaccucgcuggacu

SEQ ID NO: 1336809 - RNA, 19 nt, Human
aaccucgcuggacucucag

SEQ ID NO: 1336810 - RNA, 18 nt, Human
aaccugagccccaaaagg

SEQ ID NO: 1336811 - RNA, 19 nt, Human
aaccugaccccugcucagu

SEQ ID NO: 1336812 - RNA, 14 nt, Human
aaccugagauuuau

SEQ ID NO: 1336813 - RNA, 15 nt, Human
aaccugagauuuauu

SEQ ID NO: 1336814 - RNA, 20 nt, Human
aaccugagauuuauuaaaga

SEQ ID NO: 1336815 - RNA, 11 nt, Human
aaccugacccc

SEQ ID NO: 1336816 - RNA, 16 nt, Human
aaccugaccccugcuc

SEQ ID NO: 1336817 - RNA, 17 nt, Human
aaccugaccccugcuca

SEQ ID NO: 1336818 - RNA, 14 nt, Human
aacccagauaaagg

SEQ ID NO: 1336819 - RNA, 15 nt, Human
aacccagacucagac

SEQ ID NO: 1336820 - RNA, 16 nt, Human
aacccagacucagaca

SEQ ID NO: 1336821 - RNA, 18 nt, Human
aacccagacucagacauu

SEQ ID NO: 1336822 - RNA, 19 nt, Human
aacccacuuuaaaauaucu

SEQ ID NO: 1336823 - RNA, 23 nt, Human
aacccacuuuaaaauaucuacau

SEQ ID NO: 1336824 - RNA, 22 nt, Human
aacccagaccuguuagcagaca

SEQ ID NO: 1336825 - RNA, 23 nt, Human
aacccagaccuguuagcagacag

SEQ ID NO: 1336826 - RNA, 12 nt, Human
aacccagacuca

SEQ ID NO: 1336827 - RNA, 14 nt, Human
aacccagacucaga

SEQ ID NO: 1336828 - RNA, 16 nt, Human
aacccagcccaccccc

SEQ ID NO: 1336829 - RNA, 20 nt, Human
aacccagcucccuucuuccc

SEQ ID NO: 1336830 - RNA, 21 nt, Human
aaccccuacaugaaacagaaa

SEQ ID NO: 1336831 - RNA, 20 nt, Human
aaccccuccccuccaucccu

SEQ ID NO: 1336832 - RNA, 21 nt, Human
aaccccuccccuccaucccug

SEQ ID NO: 1336833 - RNA, 23 nt, Human
aaccccuccccuccaucccuggc

SEQ ID NO: 1336834 - RNA, 15 nt, Human
aaccccccuguacac

SEQ ID NO: 1336835 - RNA, 20 nt, Human
aaccccggggugcccacagg

SEQ ID NO: 1336836 - RNA, 12 nt, Human
aacugaaaucau

SEQ ID NO: 1336837 - RNA, 13 nt, Human
aacugaaaucaua

SEQ ID NO: 1336838 - RNA, 17 nt, Human
aacugaaaauuauuuaa

SEQ ID NO: 1336839 - RNA, 15 nt, Human
aacucuucacucuuc

SEQ ID NO: 1336840 - RNA, 12 nt, Human
aacugaaaaugu

SEQ ID NO: 1336841 - RNA, 12 nt, Human
aacugaaaauua

SEQ ID NO: 1336842 - RNA, 13 nt, Human
aacugaaaauuau

SEQ ID NO: 1336843 - RNA, 19 nt, Human
aacucuucaaggucugcuu

SEQ ID NO: 1336844 - RNA, 16 nt, Human
aacucuucaaggucug

SEQ ID NO: 1336845 - RNA, 22 nt, Human
aacucuuauaaauuucuauuuu

SEQ ID NO: 1336846 - RNA, 15 nt, Human
aacucuuauaaauuu

SEQ ID NO: 1336847 - RNA, 22 nt, Human
aacucuguuacacuuuuuggaa

SEQ ID NO: 1336848 - RNA, 23 nt, Human
aacucuguuacacuuuuuggaag

SEQ ID NO: 1336849 - RNA, 19 nt, Human
aacucuguugcaagugcaa

SEQ ID NO: 1336850 - RNA, 22 nt, Human
aacucuguugcaagugcaauaa

SEQ ID NO: 1336851 - RNA, 16 nt, Human
gugagucguuuccccu

SEQ ID NO: 1336852 - RNA, 18 nt, Human
gugagucucucugggccu

SEQ ID NO: 1336853 - RNA, 22 nt, Human
gugagucucucugggccuuagg

SEQ ID NO: 1336854 - RNA, 20 nt, Human
aacucugacaacagacuucu

SEQ ID NO: 1336855 - RNA, 17 nt, Human
gugagucuuugguucua

SEQ ID NO: 1336856 - RNA, 19 nt, Human
gugagucuuugguucuaag

SEQ ID NO: 1336857 - RNA, 22 nt, Human
aacucugacaacagacuucuga

SEQ ID NO: 1336858 - RNA, 23 nt, Human
aacucugacaacagacuucugaa

SEQ ID NO: 1336859 - RNA, 21 nt, Human
gugagaugcuagaacucccuu

SEQ ID NO: 1336860 - RNA, 14 nt, Human
gugaggccagggca

SEQ ID NO: 1336861 - RNA, 15 nt, Human
gugaggccagggcag

SEQ ID NO: 1336862 - RNA, 17 nt, Human
gugaggccagggcagag

SEQ ID NO: 1336863 - RNA, 17 nt, Human
gugagggggggcucccu

SEQ ID NO: 1336864 - RNA, 18 nt, Human
gugaggguaaguauuuuc

SEQ ID NO: 1336865 - RNA, 15 nt, Human
gugagggucccaugu

SEQ ID NO: 1336866 - RNA, 16 nt, Human
gugagggucccaugug

SEQ ID NO: 1336867 - RNA, 16 nt, Human
aacuggggcuccucca

SEQ ID NO: 1336868 - RNA, 16 nt, Human
aacugggggaaaagau

SEQ ID NO: 1336869 - RNA, 18 nt, Human
aacugggaaccccuuucc

SEQ ID NO: 1336870 - RNA, 20 nt, Human
aacugggaaccccuuuccca

SEQ ID NO: 1336871 - RNA, 21 nt, Human
aacugggaaccccuuucccac

SEQ ID NO: 1336872 - RNA, 22 nt, Human
aacugggaaccccuuucccacc

SEQ ID NO: 1336873 - RNA, 17 nt, Human
aacugggacaggggaga

SEQ ID NO: 1336874 - RNA, 22 nt, Human
aacuggcccuauuuagaugaua

SEQ ID NO: 1336875 - RNA, 18 nt, Human
aacuggcccuauuuagau

SEQ ID NO: 1336876 - RNA, 22 nt, Human
aacuggcaggcaggcucccagg

SEQ ID NO: 1336877 - RNA, 14 nt, Human
aacuggcaggcagg

SEQ ID NO: 1336878 - RNA, 16 nt, Human
aacuggccaagcugag

SEQ ID NO: 1336879 - RNA, 17 nt, Human
aacuggccaagcugagg

SEQ ID NO: 1336880 - RNA, 19 nt, Human
aacuggccaagcugaggug

SEQ ID NO: 1336881 - RNA, 21 nt, Human
aacuggccaagcugaggugcc

SEQ ID NO: 1336882 - RNA, 18 nt, Human
aacuggccauggccugca

SEQ ID NO: 1336883 - RNA, 19 nt, Human
aacugcuaaucuacuuucu

SEQ ID NO: 1336884 - RNA, 22 nt, Human
aacugccuagaaacaacacugu

SEQ ID NO: 1336885 - RNA, 13 nt, Human
aacugcaggcccu

SEQ ID NO: 1336886 - RNA, 13 nt, Human
aacugccuagaaa

SEQ ID NO: 1336887 - RNA, 14 nt, Human
aacugccuagaaac

SEQ ID NO: 1336888 - RNA, 17 nt, Human
aacugccuagaaacaac

SEQ ID NO: 1336889 - RNA, 20 nt, Human
aacugccucgaaacacagaa

SEQ ID NO: 1336890 - RNA, 17 nt, Human
aacugcucccaccuccu

SEQ ID NO: 1336891 - RNA, 13 nt, Human
aacugcuccuccu

SEQ ID NO: 1336892 - RNA, 20 nt, Human
aacugcaccaguugcugcuu

SEQ ID NO: 1336893 - RNA, 20 nt, Human
aacugcaauacaaguuucau

SEQ ID NO: 1336894 - RNA, 12 nt, Human
aacugcugccac

SEQ ID NO: 1336895 - RNA, 14 nt, Human
aacugcugccacug

SEQ ID NO: 1336896 - RNA, 13 nt, Human
aacugcugccacu

SEQ ID NO: 1336897 - RNA, 14 nt, Human
aacugcuuucuguu

SEQ ID NO: 1336898 - RNA, 15 nt, Human
aacugcuuucuguuc

SEQ ID NO: 1336899 - RNA, 17 nt, Human
aacugcuuucuguucca

SEQ ID NO: 1336900 - RNA, 18 nt, Human
aacugcuuucuguuccaa

SEQ ID NO: 1336901 - RNA, 20 nt, Human
aacugcuuucuguuccaaau

SEQ ID NO: 1336902 - RNA, 15 nt, Human
aacuggaaaacagaa

SEQ ID NO: 1336903 - RNA, 17 nt, Human
aacuggaaaacagaaca

SEQ ID NO: 1336904 - RNA, 19 nt, Human
aacuggaaaacagaacacu

SEQ ID NO: 1336905 - RNA, 20 nt, Human
aacuggaaaacagaacacuu

SEQ ID NO: 1336906 - RNA, 21 nt, Human
aacuggaaaacagaacacuua

SEQ ID NO: 1336907 - RNA, 13 nt, Human
aacuggaaagaag

SEQ ID NO: 1336908 - RNA, 12 nt, Human
aacuggaaagaa

SEQ ID NO: 1336909 - RNA, 16 nt, Human
aacuggaaucagcuca

SEQ ID NO: 1336910 - RNA, 19 nt, Human
aacuggaaucagcucagga

SEQ ID NO: 1336911 - RNA, 18 nt, Human
aacuuccagauccuggaa

SEQ ID NO: 1336912 - RNA, 19 nt, Human
aacuuccagguguuacugu

SEQ ID NO: 1336913 - RNA, 22 nt, Human
aacuuccagguguuacuguaau

SEQ ID NO: 1336914 - RNA, 17 nt, Human
aacuuccccaucuucua

SEQ ID NO: 1336915 - RNA, 18 nt, Human
aacuuccccaucuucuaa

SEQ ID NO: 1336916 - RNA, 16 nt, Human
aacuucauuucagagu

SEQ ID NO: 1336917 - RNA, 19 nt, Human
aacuucaguuucacagaaa

SEQ ID NO: 1336918 - RNA, 20 nt, Human
aacuucauauaugaggacuu

SEQ ID NO: 1336919 - RNA, 18 nt, Human
aacuggguaaugaaacaa

SEQ ID NO: 1336920 - RNA, 13 nt, Human
aacuguaaauaaa

SEQ ID NO: 1336921 - RNA, 14 nt, Human
aacuguaaagaugu

SEQ ID NO: 1336922 - RNA, 13 nt, Human
aacuguaauacaa

SEQ ID NO: 1336923 - RNA, 10 nt, Human
aacuguacag

SEQ ID NO: 1336924 - RNA, 11 nt, Human
aacuguacagu

SEQ ID NO: 1336925 - RNA, 16 nt, Human
aacuguacagugucuu

SEQ ID NO: 1336926 - RNA, 17 nt, Human
aacuguacagugucuuu

SEQ ID NO: 1336927 - RNA, 18 nt, Human
aacuguacagugucuuuu

SEQ ID NO: 1336928 - RNA, 12 nt, Human
aacuucuugcuu

SEQ ID NO: 1336929 - RNA, 18 nt, Human
aacuucuugcuucuuucu

SEQ ID NO: 1336930 - RNA, 13 nt, Human
aacuucuguuuua

SEQ ID NO: 1336931 - RNA, 15 nt, Human
aacuucuuauggaau

SEQ ID NO: 1336932 - RNA, 16 nt, Human
aacuucuuauggaauu

SEQ ID NO: 1336933 - RNA, 17 nt, Human
aacuucuuauggaauug

SEQ ID NO: 1336934 - RNA, 19 nt, Human
aacuucuuauggaauugau

SEQ ID NO: 1336935 - RNA, 24 nt, Human
aacuucuuauggaauugauuugca

SEQ ID NO: 1336936 - RNA, 19 nt, Human
aacuucuugcuucuuucua

SEQ ID NO: 1336937 - RNA, 14 nt, Human
gugaugaauacugu

SEQ ID NO: 1336938 - RNA, 14 nt, Human
gugaugagggcagc

SEQ ID NO: 1336939 - RNA, 16 nt, Human
gugaugagggcagcag

SEQ ID NO: 1336940 - RNA, 17 nt, Human
gugaugagggcagcagc

SEQ ID NO: 1336941 - RNA, 18 nt, Human
gugaugagggcagcagcc

SEQ ID NO: 1336942 - RNA, 19 nt, Human
gugaugagggcagcagcca

SEQ ID NO: 1336943 - RNA, 20 nt, Human
gugaugagggcagcagccag

SEQ ID NO: 1336944 - RNA, 21 nt, Human
gugaugagggcagcagccagc

SEQ ID NO: 1336945 - RNA, 22 nt, Human
gugaugagggcagcagccagcc

SEQ ID NO: 1336946 - RNA, 23 nt, Human
gugaugagggcagcagccagccc

SEQ ID NO: 1336947 - RNA, 16 nt, Human
gugauggagugcuguu

SEQ ID NO: 1336948 - RNA, 23 nt, Human
gugauggagugcuguuuuguuau

SEQ ID NO: 1336949 - RNA, 18 nt, Human
gugauggagugcuguuuu

SEQ ID NO: 1336950 - RNA, 14 nt, Human
gugcauucuccagc

SEQ ID NO: 1336951 - RNA, 21 nt, Human
gugccaauuucaaguuccaag

SEQ ID NO: 1336952 - RNA, 12 nt, Human
gugccucugccu

SEQ ID NO: 1336953 - RNA, 15 nt, Human
gugccugucccaccc

SEQ ID NO: 1336954 - RNA, 20 nt, Human
gugccugucccacccccacc

SEQ ID NO: 1336955 - RNA, 13 nt, Human
gugccugugucca

SEQ ID NO: 1336956 - RNA, 22 nt, Human
gugccuguguccaugcgcucag

SEQ ID NO: 1336957 - RNA, 15 nt, Human
gugccacuuaaugua

SEQ ID NO: 1336958 - RNA, 18 nt, Human
gugccacuuaauguaugu

SEQ ID NO: 1336959 - RNA, 14 nt, Human
gugccagaagcuac

SEQ ID NO: 1336960 - RNA, 16 nt, Human
gugccagagaacccag

SEQ ID NO: 1336961 - RNA, 23 nt, Human
gugccuccagaggggcucagguc

SEQ ID NO: 1336962 - RNA, 13 nt, Human
gugccuccucccu

SEQ ID NO: 1336963 - RNA, 14 nt, Human
gugccuccucccuc

SEQ ID NO: 1336964 - RNA, 16 nt, Human
gugccuccucccuccc

SEQ ID NO: 1336965 - RNA, 21 nt, Human
gugccuccucccucccucucc

SEQ ID NO: 1336966 - RNA, 22 nt, Human
gugccuccucccucccucuccg

SEQ ID NO: 1336967 - RNA, 15 nt, Human
gugccucgcucccca

SEQ ID NO: 1336968 - RNA, 19 nt, Human
gugccucgcuccccacucu

SEQ ID NO: 1336969 - RNA, 20 nt, Human
gugccucgcuccccacucug

SEQ ID NO: 1336970 - RNA, 21 nt, Human
gugccucgcuccccacucugc

SEQ ID NO: 1336971 - RNA, 20 nt, Human
gugcacaaauauuuauuuuc

SEQ ID NO: 1336972 - RNA, 20 nt, Human
gugcacaccccacucccaca

SEQ ID NO: 1336973 - RNA, 20 nt, Human
gugcaauguguguauaugga

SEQ ID NO: 1336974 - RNA, 23 nt, Human
gugcaauguguauaaacaagaaa

SEQ ID NO: 1336975 - RNA, 18 nt, Human
gugcaauuucaagguucu

SEQ ID NO: 1336976 - RNA, 19 nt, Human
gugcaauuucaagguucua

SEQ ID NO: 1336977 - RNA, 20 nt, Human
gugcaauuucaagguucuaa

SEQ ID NO: 1336978 - RNA, 18 nt, Human
gugcacaaaacccagacc

SEQ ID NO: 1336979 - RNA, 15 nt, Human
gugcacaaauauuua

SEQ ID NO: 1336980 - RNA, 14 nt, Human
gugcacagccccua

SEQ ID NO: 1336981 - RNA, 11 nt, Human
gugcacagccc

SEQ ID NO: 1336982 - RNA, 19 nt, Human
gugcacagcacaaauuagu

SEQ ID NO: 1336983 - RNA, 12 nt, Human
gugcacaggagg

SEQ ID NO: 1336984 - RNA, 13 nt, Human
gugcacaggaggg

SEQ ID NO: 1336985 - RNA, 14 nt, Human
gugcacaggagggg

SEQ ID NO: 1336986 - RNA, 22 nt, Human
gugcacauauccaggcaccagg

SEQ ID NO: 1336987 - RNA, 18 nt, Human
gugcacaucugugucuug

SEQ ID NO: 1336988 - RNA, 14 nt, Human
gugaugguuccccu

SEQ ID NO: 1336989 - RNA, 16 nt, Human
gugaugguuccccugu

SEQ ID NO: 1336990 - RNA, 22 nt, Human
gugaugguuccccuguucacuc

SEQ ID NO: 1336991 - RNA, 23 nt, Human
gugcaaccucuuggccugaucag

SEQ ID NO: 1336992 - RNA, 15 nt, Human
gugcaaggaccuaaa

SEQ ID NO: 1336993 - RNA, 19 nt, Human
gugcaaggaccuaaaacau

SEQ ID NO: 1336994 - RNA, 12 nt, Human
gugcaaggcagc

SEQ ID NO: 1336995 - RNA, 15 nt, Human
gugcaaggcagccgu

SEQ ID NO: 1336996 - RNA, 14 nt, Human
gugcaaggcagccg

SEQ ID NO: 1336997 - RNA, 13 nt, Human
gugcaauguaaau

SEQ ID NO: 1336998 - RNA, 17 nt, Human
gugcaauguaaauauuu

SEQ ID NO: 1336999 - RNA, 22 nt, Human
gugcaauguaaauauuuuaaag

SEQ ID NO: 1337000 - RNA, 20 nt, Human
gugcaauguaaauauuuuaa

SEQ ID NO: 1337001 - RNA, 15 nt, Human
gugcaauguguauaa

SEQ ID NO: 1337002 - RNA, 17 nt, Human
gugcaauguguauaaac

SEQ ID NO: 1337003 - RNA, 19 nt, Human
gugcaauguguauaaacaa

SEQ ID NO: 1337004 - RNA, 15 nt, Human
accaucucuccaacu

SEQ ID NO: 1337005 - RNA, 15 nt, Human
accauccaccaggcc

SEQ ID NO: 1337006 - RNA, 23 nt, Human
accaucagaaacacccucacacu

SEQ ID NO: 1337007 - RNA, 20 nt, Human
accaucagaaacacccucac

SEQ ID NO: 1337008 - RNA, 13 nt, Human
accaucacugagu

SEQ ID NO: 1337009 - RNA, 22 nt, Human
accaucaccagaauuaauuuua

SEQ ID NO: 1337010 - RNA, 17 nt, Human
accaucaaguugugcca

SEQ ID NO: 1337011 - RNA, 21 nt, Human
accauacuaauuauacccccu

SEQ ID NO: 1337012 - RNA, 12 nt, Human
accauacugaaa

SEQ ID NO: 1337013 - RNA, 17 nt, Human
accauaggucaccuuua

SEQ ID NO: 1337014 - RNA, 22 nt, Human
accauagcacaggcuaauuuuu

SEQ ID NO: 1337015 - RNA, 13 nt, Human
accauacuaauua

SEQ ID NO: 1337016 - RNA, 16 nt, Human
accauacuaauuauac

SEQ ID NO: 1337017 - RNA, 15 nt, Human
acccacccagaauga

SEQ ID NO: 1337018 - RNA, 15 nt, Human
acccaccccugcaca

SEQ ID NO: 1337019 - RNA, 12 nt, Human
acccaccccugc

SEQ ID NO: 1337020 - RNA, 12 nt, Human
acccacccagaa

SEQ ID NO: 1337021 - RNA, 16 nt, Human
acccaccaguugaauu

SEQ ID NO: 1337022 - RNA, 19 nt, Human
acccaccaacccucagggc

SEQ ID NO: 1337023 - RNA, 18 nt, Human
acccaccaacccucaggg

SEQ ID NO: 1337024 - RNA, 19 nt, Human
accaugaagagauuuuuca

SEQ ID NO: 1337025 - RNA, 23 nt, Human
acccacacucagauccuccucau

SEQ ID NO: 1337026 - RNA, 20 nt, Human
accaugaagagauuuuucau

SEQ ID NO: 1337027 - RNA, 18 nt, Human
acccacaggcccacagua

SEQ ID NO: 1337028 - RNA, 23 nt, Human
acccacaugccauuuguacugac

SEQ ID NO: 1337029 - RNA, 14 nt, Human
acccacaugcucca

SEQ ID NO: 1337030 - RNA, 17 nt, Human
acccaccaacccucagg

SEQ ID NO: 1337031 - RNA, 14 nt, Human
acccaccgggccac

SEQ ID NO: 1337032 - RNA, 16 nt, Human
acccaccgggccacuc

SEQ ID NO: 1337033 - RNA, 18 nt, Human
acccaccgggccacuccu

SEQ ID NO: 1337034 - RNA, 19 nt, Human
acccaccgggccacuccuu

SEQ ID NO: 1337035 - RNA, 22 nt, Human
acccaccgggccacuccuuccu

SEQ ID NO: 1337036 - RNA, 23 nt, Human
acccaguuucuaaacuggagacu

SEQ ID NO: 1337037 - RNA, 22 nt, Human
acccaguuucuaaacuggagac

SEQ ID NO: 1337038 - RNA, 23 nt, Human
acccauauccuuacccuccuugg

SEQ ID NO: 1337039 - RNA, 16 nt, Human
acccauauuguaaaac

SEQ ID NO: 1337040 - RNA, 20 nt, Human
acccauauuguaaaacaggu

SEQ ID NO: 1337041 - RNA, 15 nt, Human
acccaucaacaaaaa

SEQ ID NO: 1337042 - RNA, 17 nt, Human
acauuuccuaaauauau

SEQ ID NO: 1337043 - RNA, 16 nt, Human
acauuuccuaaauaua

SEQ ID NO: 1337044 - RNA, 14 nt, Human
acaugugaaaagaa

SEQ ID NO: 1337045 - RNA, 17 nt, Human
acaugugaaaagaauag

SEQ ID NO: 1337046 - RNA, 18 nt, Human
acaugugaaaagaauaga

SEQ ID NO: 1337047 - RNA, 18 nt, Human
acauuuccuuacagaacu

SEQ ID NO: 1337048 - RNA, 13 nt, Human
acauuucuaaaau

SEQ ID NO: 1337049 - RNA, 20 nt, Human
acauuucuauagccaaaaau

SEQ ID NO: 1337050 - RNA, 12 nt, Human
acauuucucaau

SEQ ID NO: 1337051 - RNA, 23 nt, Human
acauuucucuaagagaacaaugu

SEQ ID NO: 1337052 - RNA, 21 nt, Human
accaacuuuucuauuaaaagu

SEQ ID NO: 1337053 - RNA, 22 nt, Human
accaacuuuucuauuaaaagug

SEQ ID NO: 1337054 - RNA, 19 nt, Human
accaaggcugauuaaacca

SEQ ID NO: 1337055 - RNA, 21 nt, Human
accaagauacuuaagugcugc

SEQ ID NO: 1337056 - RNA, 15 nt, Human
accaagauacuuaag

SEQ ID NO: 1337057 - RNA, 20 nt, Human
accaagauacuuaagugcug

SEQ ID NO: 1337058 - RNA, 20 nt, Human
accaaggcugauuaaaccaa

SEQ ID NO: 1337059 - RNA, 22 nt, Human
accaccccgccugcccucaugg

SEQ ID NO: 1337060 - RNA, 13 nt, Human
accacccucacug

SEQ ID NO: 1337061 - RNA, 12 nt, Human
accaccugccca

SEQ ID NO: 1337062 - RNA, 21 nt, Human
accacccugagccggccccag

SEQ ID NO: 1337063 - RNA, 20 nt, Human
accacccucacuggcucucc

SEQ ID NO: 1337064 - RNA, 19 nt, Human
accacccucacuggcucuc

SEQ ID NO: 1337065 - RNA, 12 nt, Human
accacccugagc

SEQ ID NO: 1337066 - RNA, 13 nt, Human
accacccugagcc

SEQ ID NO: 1337067 - RNA, 14 nt, Human
accacccugagccg

SEQ ID NO: 1337068 - RNA, 20 nt, Human
accaccuuuguuucuccccc

SEQ ID NO: 1337069 - RNA, 22 nt, Human
accaccuuuguuucucccccau

SEQ ID NO: 1337070 - RNA, 13 nt, Human
accacgacuggcc

SEQ ID NO: 1337071 - RNA, 16 nt, Human
accacgacuggccagg

SEQ ID NO: 1337072 - RNA, 24 nt, Human
accacgacuggccagggccacgcu

SEQ ID NO: 1337073 - RNA, 19 nt, Human
accacgacuggccagggcc

SEQ ID NO: 1337074 - RNA, 19 nt, Human
accagcagacagagccagg

SEQ ID NO: 1337075 - RNA, 20 nt, Human
accagcagacagagccagga

SEQ ID NO: 1337076 - RNA, 22 nt, Human
accagcagacagagccaggaga

SEQ ID NO: 1337077 - RNA, 15 nt, Human
acaguggggaaugaa

SEQ ID NO: 1337078 - RNA, 13 nt, Human
acagugcaucuca

SEQ ID NO: 1337079 - RNA, 19 nt, Human
acaguggggaaugaagaua

SEQ ID NO: 1337080 - RNA, 21 nt, Human
acagugauuaccagggacuga

SEQ ID NO: 1337081 - RNA, 14 nt, Human
acagugcagugcgc

SEQ ID NO: 1337082 - RNA, 21 nt, Human
acagggccuuuggcaggugca

SEQ ID NO: 1337083 - RNA, 16 nt, Human
acagggcggggguggc

SEQ ID NO: 1337084 - RNA, 15 nt, Human
acagcugccucuucc

SEQ ID NO: 1337085 - RNA, 16 nt, Human
acagggcugccuucug

SEQ ID NO: 1337086 - RNA, 16 nt, Human
acaggucuucaucgaa

SEQ ID NO: 1337087 - RNA, 18 nt, Human
acaggugcuaauuuguuu

SEQ ID NO: 1337088 - RNA, 18 nt, Human
acagugagccugaauuuu

SEQ ID NO: 1337089 - RNA, 21 nt, Human
acagugagccugaauuuuguu

SEQ ID NO: 1337090 - RNA, 14 nt, Human
acagcugccucuuc

SEQ ID NO: 1337091 - RNA, 12 nt, Human
acagcugccugc

SEQ ID NO: 1337092 - RNA, 16 nt, Human
acagcugccugcagua

SEQ ID NO: 1337093 - RNA, 20 nt, Human
acauaauucaggaagcagcu

SEQ ID NO: 1337094 - RNA, 18 nt, Human
acauaauucacucugagu

SEQ ID NO: 1337095 - RNA, 20 nt, Human
acauaauucacucugagugu

SEQ ID NO: 1337096 - RNA, 21 nt, Human
acauaauuuaguuucauauaa

SEQ ID NO: 1337097 - RNA, 12 nt, Human
acaucagcccuu

SEQ ID NO: 1337098 - RNA, 15 nt, Human
acaucagguuuuucc

SEQ ID NO: 1337099 - RNA, 16 nt, Human
acaucagguuuuuccc

SEQ ID NO: 1337100 - RNA, 15 nt, Human
acauaagccauuauu

SEQ ID NO: 1337101 - RNA, 18 nt, Human
acauaagccauuauucac

SEQ ID NO: 1337102 - RNA, 12 nt, Human
acauaagcuauu

SEQ ID NO: 1337103 - RNA, 13 nt, Human
acauaagcuauuu

SEQ ID NO: 1337104 - RNA, 17 nt, Human
acauaagcuauuuuucu

SEQ ID NO: 1337105 - RNA, 18 nt, Human
acauaagcuauuuuucua

SEQ ID NO: 1337106 - RNA, 20 nt, Human
acauaagcuauuuuucuaac

SEQ ID NO: 1337107 - RNA, 19 nt, Human
acauaagcuauuuuucuaa

SEQ ID NO: 1337108 - RNA, 17 nt, Human
acauaauuauccaggaa

SEQ ID NO: 1337109 - RNA, 23 nt, Human
acauaauuauccaggaagggaau

SEQ ID NO: 1337110 - RNA, 16 nt, Human
acauaauucacucuga

SEQ ID NO: 1337111 - RNA, 17 nt, Human
acauaauucacucugag

SEQ ID NO: 1337112 - RNA, 16 nt, Human
acauccucuuccauau

SEQ ID NO: 1337113 - RNA, 21 nt, Human
acaugauuuccuugaaugugg

SEQ ID NO: 1337114 - RNA, 15 nt, Human
acauccuacaagaca

SEQ ID NO: 1337115 - RNA, 21 nt, Human
acauccuccacguucugcuca

SEQ ID NO: 1337116 - RNA, 13 nt, Human
acauccuccuccc

SEQ ID NO: 1337117 - RNA, 15 nt, Human
acauccuccucccac

SEQ ID NO: 1337118 - RNA, 15 nt, Human
acaucauuacuauaa

SEQ ID NO: 1337119 - RNA, 18 nt, Human
acaucauuacuauaagaa

SEQ ID NO: 1337120 - RNA, 21 nt, Human
acaucauuacuauaagaacuu

SEQ ID NO: 1337121 - RNA, 15 nt, Human
acaucauucauuuuu

SEQ ID NO: 1337122 - RNA, 23 nt, Human
acaugauuuccuugaauguggcu

SEQ ID NO: 1337123 - RNA, 14 nt, Human
acaugccacaagga

SEQ ID NO: 1337124 - RNA, 21 nt, Human
acaugccauuuguacugaccc

SEQ ID NO: 1337125 - RNA, 17 nt, Human
acaugccauuuguacug

SEQ ID NO: 1337126 - RNA, 18 nt, Human
acaugccauuuguacuga

SEQ ID NO: 1337127 - RNA, 18 nt, Human
aauuuccugggagcuuuu

SEQ ID NO: 1337128 - RNA, 21 nt, Human
aauuuccugggagcuuuugua

SEQ ID NO: 1337129 - RNA, 19 nt, Human
aauuucaccuguaaaccug

SEQ ID NO: 1337130 - RNA, 20 nt, Human
aauuucaccuguaaaccuga

SEQ ID NO: 1337131 - RNA, 18 nt, Human
aauuucaagguucuaacc

SEQ ID NO: 1337132 - RNA, 13 nt, Human
aauuucagacucc

SEQ ID NO: 1337133 - RNA, 23 nt, Human
aauuucagacucccauuccugaa

SEQ ID NO: 1337134 - RNA, 23 nt, Human
aauuucacugucuuuaauucugu

SEQ ID NO: 1337135 - RNA, 21 nt, Human
aauuucaggaggaauacugaa

SEQ ID NO: 1337136 - RNA, 13 nt, Human
aauuuauuuucuu

SEQ ID NO: 1337137 - RNA, 12 nt, Human
aauuucaaaaug

SEQ ID NO: 1337138 - RNA, 16 nt, Human
aauuucaaaaugcuuu

SEQ ID NO: 1337139 - RNA, 14 nt, Human
aauuucaagguucu

SEQ ID NO: 1337140 - RNA, 15 nt, Human
aauuucaagguucua

SEQ ID NO: 1337141 - RNA, 16 nt, Human
aauuucaagguucuaa

SEQ ID NO: 1337142 - RNA, 17 nt, Human
aauuucaagguucuaac

SEQ ID NO: 1337143 - RNA, 16 nt, Human
aauuucaccuguaaac

SEQ ID NO: 1337144 - RNA, 21 nt, Human
aauuucggauuuuuuccaaaa

SEQ ID NO: 1337145 - RNA, 17 nt, Human
aauuucggauuuuuucc

SEQ ID NO: 1337146 - RNA, 18 nt, Human
aauuucggauuuuuucca

SEQ ID NO: 1337147 - RNA, 20 nt, Human
aauuucggauuuuuuccaaa

SEQ ID NO: 1337148 - RNA, 13 nt, Human
aauuuauuauuaa

SEQ ID NO: 1337149 - RNA, 23 nt, Human
aauuuauuugaaugauuuuucuu

SEQ ID NO: 1337150 - RNA, 11 nt, Human
aauugucccuu

SEQ ID NO: 1337151 - RNA, 16 nt, Human
aauugucccuuaaaca

SEQ ID NO: 1337152 - RNA, 18 nt, Human
aauugucccuuaaacaaa

SEQ ID NO: 1337153 - RNA, 12 nt, Human
aauugucugaaa

SEQ ID NO: 1337154 - RNA, 21 nt, Human
aauuguguagccuuuuuguau

SEQ ID NO: 1337155 - RNA, 17 nt, Human
aauuguguagccuuuuu

SEQ ID NO: 1337156 - RNA, 21 nt, Human
aauugugauuagacagaacac

SEQ ID NO: 1337157 - RNA, 16 nt, Human
aauugugguuuauaua

SEQ ID NO: 1337158 - RNA, 17 nt, Human
aauugugguuuauauau

SEQ ID NO: 1337159 - RNA, 15 nt, Human
aauuguguagccuuu

SEQ ID NO: 1337160 - RNA, 16 nt, Human
aauuguguagccuuuu

SEQ ID NO: 1337161 - RNA, 21 nt, Human
aauugugcaguacuuugugca

SEQ ID NO: 1337162 - RNA, 18 nt, Human
aauugugauuagacagaa

SEQ ID NO: 1337163 - RNA, 20 nt, Human
aauugugauuagacagaaca

SEQ ID NO: 1337164 - RNA, 21 nt, Human
aauuguggggaugaugaaaua

SEQ ID NO: 1337165 - RNA, 15 nt, Human
aauuggguucacagc

SEQ ID NO: 1337166 - RNA, 21 nt, Human
aauuguaaaguaaaagcuaua

SEQ ID NO: 1337167 - RNA, 14 nt, Human
aauuguaacuguuc

SEQ ID NO: 1337168 - RNA, 16 nt, Human
aauuguaacuguucuu

SEQ ID NO: 1337169 - RNA, 14 nt, Human
aauuguauauugua

SEQ ID NO: 1337170 - RNA, 16 nt, Human
aauuguauuuuaguaa

SEQ ID NO: 1337171 - RNA, 21 nt, Human
acaaggaugaauuaaguuuuu

SEQ ID NO: 1337172 - RNA, 22 nt, Human
acaagaaaugaaagcagggacu

SEQ ID NO: 1337173 - RNA, 16 nt, Human
acaagaaaugaaagca

SEQ ID NO: 1337174 - RNA, 15 nt, Human
acaagaaaugaaagc

SEQ ID NO: 1337175 - RNA, 18 nt, Human
acaaccuucuguggcuca

SEQ ID NO: 1337176 - RNA, 15 nt, Human
acaaccucaacugcc

SEQ ID NO: 1337177 - RNA, 18 nt, Human
acaaagaaacaaagaugu

SEQ ID NO: 1337178 - RNA, 16 nt, Human
acaaccucaacugccu

SEQ ID NO: 1337179 - RNA, 16 nt, Human
acaaagaaauuaugug

SEQ ID NO: 1337180 - RNA, 14 nt, Human
acaaagaaauuaug

SEQ ID NO: 1337181 - RNA, 12 nt, Human
acaaagaaauua

SEQ ID NO: 1337182 - RNA, 13 nt, Human
acaaacuuuuaua

SEQ ID NO: 1337183 - RNA, 19 nt, Human
acaaacuuugcaucucagu

SEQ ID NO: 1337184 - RNA, 17 nt, Human
acaaagaaacaaagaug

SEQ ID NO: 1337185 - RNA, 20 nt, Human
acaaagaaacaaagauguua

SEQ ID NO: 1337186 - RNA, 13 nt, Human
acaaaauggaaua

SEQ ID NO: 1337187 - RNA, 14 nt, Human
acaaaauggaauac

SEQ ID NO: 1337188 - RNA, 15 nt, Human
acaaaauggaauacu

SEQ ID NO: 1337189 - RNA, 13 nt, Human
acaaacuuugcau

SEQ ID NO: 1337190 - RNA, 15 nt, Human
acaaacuuugcaucu

SEQ ID NO: 1337191 - RNA, 18 nt, Human
aauuuucaucuaggauuu

SEQ ID NO: 1337192 - RNA, 14 nt, Human
aauuuucacugugu

SEQ ID NO: 1337193 - RNA, 17 nt, Human
aauuuugugaagcaaaa

SEQ ID NO: 1337194 - RNA, 18 nt, Human
aauuuugugaagcaaaau

SEQ ID NO: 1337195 - RNA, 12 nt, Human
aauuuuggauuu

SEQ ID NO: 1337196 - RNA, 16 nt, Human
aauuuugaugaacaaa

SEQ ID NO: 1337197 - RNA, 16 nt, Human
acagaagcuccaggua

SEQ ID NO: 1337198 - RNA, 17 nt, Human
acagaacuucagaaaga

SEQ ID NO: 1337199 - RNA, 18 nt, Human
acagaacuucagaaagac

SEQ ID NO: 1337200 - RNA, 19 nt, Human
acagaacuucagaaagacu

SEQ ID NO: 1337201 - RNA, 20 nt, Human
acagaacuucagaaagacuu

SEQ ID NO: 1337202 - RNA, 21 nt, Human
acagaacuucagaaagacuug

SEQ ID NO: 1337203 - RNA, 12 nt, Human
acagaagaaaca

SEQ ID NO: 1337204 - RNA, 16 nt, Human
acagaagggagggcag

SEQ ID NO: 1337205 - RNA, 17 nt, Human
acagaagggagggcaga

SEQ ID NO: 1337206 - RNA, 19 nt, Human
acagaagggagggcagagc

SEQ ID NO: 1337207 - RNA, 21 nt, Human
acagaagggagggcagagcug

SEQ ID NO: 1337208 - RNA, 22 nt, Human
acagaagggagggcagagcugg

SEQ ID NO: 1337209 - RNA, 23 nt, Human
acagaagggagggcagagcuggu

SEQ ID NO: 1337210 - RNA, 13 nt, Human
acagaggcagccc

SEQ ID NO: 1337211 - RNA, 16 nt, Human
acagaggacacagaga

SEQ ID NO: 1337212 - RNA, 20 nt, Human
acacugggagaaaugaaaaa

SEQ ID NO: 1337213 - RNA, 19 nt, Human
acacugggacuugcaaaaa

SEQ ID NO: 1337214 - RNA, 18 nt, Human
acacugggacuugcaaaa

SEQ ID NO: 1337215 - RNA, 13 nt, Human
acacugggacuug

SEQ ID NO: 1337216 - RNA, 23 nt, Human
acacuguguaaauacccauaugu

SEQ ID NO: 1337217 - RNA, 17 nt, Human
acacuggggacuuggcc

SEQ ID NO: 1337218 - RNA, 22 nt, Human
acacuggggacuuggccucucu

SEQ ID NO: 1337219 - RNA, 18 nt, Human
acacuggggacuuggccu

SEQ ID NO: 1337220 - RNA, 18 nt, Human
acacuguguacugcaguu

SEQ ID NO: 1337221 - RNA, 16 nt, Human
acagaacaugcuguua

SEQ ID NO: 1337222 - RNA, 21 nt, Human
acagaacaugcuguuauuuag

SEQ ID NO: 1337223 - RNA, 17 nt, Human
acagaaccccuacauga

SEQ ID NO: 1337224 - RNA, 16 nt, Human
acagaacauagacaga

SEQ ID NO: 1337225 - RNA, 18 nt, Human
acagaacucuuucaaaac

SEQ ID NO: 1337226 - RNA, 20 nt, Human
acagaacucuuucaaaaccu

SEQ ID NO: 1337227 - RNA, 14 nt, Human
acagaacuucagaa

SEQ ID NO: 1337228 - RNA, 18 nt, Human
acaauuuaugaauugaau

SEQ ID NO: 1337229 - RNA, 22 nt, Human
acaauuccucuacuaacaauca

SEQ ID NO: 1337230 - RNA, 23 nt, Human
acaauuccucuacuaacaaucag

SEQ ID NO: 1337231 - RNA, 12 nt, Human
acaauucuaaaa

SEQ ID NO: 1337232 - RNA, 14 nt, Human
acaauucuaaaaug

SEQ ID NO: 1337233 - RNA, 17 nt, Human
acaauucuaaaaugauu

SEQ ID NO: 1337234 - RNA, 23 nt, Human
acaauucuaaaaugauuguagua

SEQ ID NO: 1337235 - RNA, 24 nt, Human
acaauucuaaaaugauuguaguaa

SEQ ID NO: 1337236 - RNA, 21 nt, Human
acaauuaggcagacucuuuau

SEQ ID NO: 1337237 - RNA, 16 nt, Human
acaauuuuuuaucaug

SEQ ID NO: 1337238 - RNA, 22 nt, Human
acaauuuuuuaucaugcauguc

SEQ ID NO: 1337239 - RNA, 17 nt, Human
acaauuuuuuuuauuag

SEQ ID NO: 1337240 - RNA, 24 nt, Human
acaauuuuuuuuauuaguauuguu

SEQ ID NO: 1337241 - RNA, 18 nt, Human
acaauuuuuuuuauuagu

SEQ ID NO: 1337242 - RNA, 12 nt, Human
acacggccacau

SEQ ID NO: 1337243 - RNA, 14 nt, Human
acacggccacauca

SEQ ID NO: 1337244 - RNA, 13 nt, Human
acacgggccuguc

SEQ ID NO: 1337245 - RNA, 20 nt, Human
acacggccacaucaaagagg

SEQ ID NO: 1337246 - RNA, 15 nt, Human
acacgggccugucca

SEQ ID NO: 1337247 - RNA, 23 nt, Human
acacggucggggcaucuggccug

SEQ ID NO: 1337248 - RNA, 19 nt, Human
acuaguauuucuaugaaau

SEQ ID NO: 1337249 - RNA, 19 nt, Human
acuauucuugauguaaaau

SEQ ID NO: 1337250 - RNA, 18 nt, Human
acuaguauuucuaugaaa

SEQ ID NO: 1337251 - RNA, 16 nt, Human
acuagggaucccucau

SEQ ID NO: 1337252 - RNA, 18 nt, Human
acuagggaucccucaucu

SEQ ID NO: 1337253 - RNA, 15 nt, Human
acuauugcauuuaua

SEQ ID NO: 1337254 - RNA, 23 nt, Human
acuauucuugauguaaaaucuug

SEQ ID NO: 1337255 - RNA, 20 nt, Human
acuauucuugauguaaaauc

SEQ ID NO: 1337256 - RNA, 22 nt, Human
acuauucuugauguaaaaucuu

SEQ ID NO: 1337257 - RNA, 14 nt, Human
acuauuguuacauu

SEQ ID NO: 1337258 - RNA, 14 nt, Human
acuagggagccaug

SEQ ID NO: 1337259 - RNA, 15 nt, Human
acuagggagccaugu

SEQ ID NO: 1337260 - RNA, 18 nt, Human
acuagggagccauguuuc

SEQ ID NO: 1337261 - RNA, 19 nt, Human
acuagggagccauguuuca

SEQ ID NO: 1337262 - RNA, 22 nt, Human
acuagggagccauguuucacaa

SEQ ID NO: 1337263 - RNA, 19 nt, Human
acuagggagccauuugaga

SEQ ID NO: 1337264 - RNA, 23 nt, Human
acuaggcccccacuugccucuuc

SEQ ID NO: 1337265 - RNA, 23 nt, Human
acuaggccuugcggcuccucagg

SEQ ID NO: 1337266 - RNA, 22 nt, Human
acuaggccuugcggcuccucag

SEQ ID NO: 1337267 - RNA, 14 nt, Human
acuaggcugagcaa

SEQ ID NO: 1337268 - RNA, 23 nt, Human
acuaggcugagcaaucugacccu

SEQ ID NO: 1337269 - RNA, 19 nt, Human
acuaaugccuuacucuucu

SEQ ID NO: 1337270 - RNA, 18 nt, Human
acuaaugaaaacagaaug

SEQ ID NO: 1337271 - RNA, 17 nt, Human
acgcacggcagccacag

SEQ ID NO: 1337272 - RNA, 17 nt, Human
acgcaccugccucagga

SEQ ID NO: 1337273 - RNA, 15 nt, Human
acgcacggcagccac

SEQ ID NO: 1337274 - RNA, 23 nt, Human
acgcacugagcaacgcuauucca

SEQ ID NO: 1337275 - RNA, 16 nt, Human
acggaaggguaaacaa

SEQ ID NO: 1337276 - RNA, 22 nt, Human
acggaaggguaaacaauauagu

SEQ ID NO: 1337277 - RNA, 19 nt, Human
acggacgaaccuugaaaac

SEQ ID NO: 1337278 - RNA, 17 nt, Human
acggacagagaccaaga

SEQ ID NO: 1337279 - RNA, 21 nt, Human
acggacaguuccagaagugug

SEQ ID NO: 1337280 - RNA, 18 nt, Human
acgcuggcaacacagagg

SEQ ID NO: 1337281 - RNA, 22 nt, Human
acuaaccuuccaaaaauuacuu

SEQ ID NO: 1337282 - RNA, 17 nt, Human
acguggcucagccagca

SEQ ID NO: 1337283 - RNA, 19 nt, Human
acguggcucagccagcacu

SEQ ID NO: 1337284 - RNA, 20 nt, Human
acguggccaagagaaacuuc

SEQ ID NO: 1337285 - RNA, 22 nt, Human
acuaacuaaaacaaagccacuu

SEQ ID NO: 1337286 - RNA, 20 nt, Human
acuaacuagacaccaaaguu

SEQ ID NO: 1337287 - RNA, 22 nt, Human
acuaacuagacaccaaaguucu

SEQ ID NO: 1337288 - RNA, 15 nt, Human
acuaacuaaaacaaa

SEQ ID NO: 1337289 - RNA, 14 nt, Human
acuaacuaaaacaa

SEQ ID NO: 1337290 - RNA, 18 nt, Human
acuaacguugagccccug

SEQ ID NO: 1337291 - RNA, 15 nt, Human
acuaaccuugccugg

SEQ ID NO: 1337292 - RNA, 17 nt, Human
acuaaccuugccuggua

SEQ ID NO: 1337293 - RNA, 21 nt, Human
acuaaccuugccugguacagu

SEQ ID NO: 1337294 - RNA, 22 nt, Human
acuaaccuugccugguacagua

SEQ ID NO: 1337295 - RNA, 15 nt, Human
acuaacuaugcaugg

SEQ ID NO: 1337296 - RNA, 23 nt, Human
acuaacuaugcauggugccccag

SEQ ID NO: 1337297 - RNA, 20 nt, Human
acuaacuccuaggaaaauac

SEQ ID NO: 1337298 - RNA, 17 nt, Human
acuaauauauuuaaaaa

SEQ ID NO: 1337299 - RNA, 18 nt, Human
acuaauauauuuaaaaau

SEQ ID NO: 1337300 - RNA, 20 nt, Human
acuaauauauuuaaaaauaa

SEQ ID NO: 1337301 - RNA, 19 nt, Human
acuaauauauuuaaaaaua

SEQ ID NO: 1337302 - RNA, 13 nt, Human
acuaauauuucug

SEQ ID NO: 1337303 - RNA, 14 nt, Human
acuaauauuucugu

SEQ ID NO: 1337304 - RNA, 15 nt, Human
acuaauauuucugua

SEQ ID NO: 1337305 - RNA, 17 nt, Human
acuaauauuucuguaau

SEQ ID NO: 1337306 - RNA, 17 nt, Human
acgucuggguggcccuu

SEQ ID NO: 1337307 - RNA, 23 nt, Human
acggaccaaagggagucugccag

SEQ ID NO: 1337308 - RNA, 18 nt, Human
acggagccacuccucuga

SEQ ID NO: 1337309 - RNA, 19 nt, Human
acggagccacuccucugac

SEQ ID NO: 1337310 - RNA, 20 nt, Human
acggagccacuccucugacu

SEQ ID NO: 1337311 - RNA, 16 nt, Human
acguggccucuugagc

SEQ ID NO: 1337312 - RNA, 14 nt, Human
acguggcucagcca

SEQ ID NO: 1337313 - RNA, 15 nt, Human
accugugagcccagc

SEQ ID NO: 1337314 - RNA, 17 nt, Human
accugugagcccagcug

SEQ ID NO: 1337315 - RNA, 18 nt, Human
accugugagcccagcugg

SEQ ID NO: 1337316 - RNA, 16 nt, Human
accuguguggacagga

SEQ ID NO: 1337317 - RNA, 19 nt, Human
accuguguggacaggacua

SEQ ID NO: 1337318 - RNA, 17 nt, Human
accucugccucagaaaa

SEQ ID NO: 1337319 - RNA, 18 nt, Human
accucugccucagaaaac

SEQ ID NO: 1337320 - RNA, 20 nt, Human
accugucugucugucugucc

SEQ ID NO: 1337321 - RNA, 18 nt, Human
accugucugucugucugu

SEQ ID NO: 1337322 - RNA, 14 nt, Human
accugucugucugu

SEQ ID NO: 1337323 - RNA, 23 nt, Human
accugcccugcccugccaccugu

SEQ ID NO: 1337324 - RNA, 18 nt, Human
accugcccuaccugcccc

SEQ ID NO: 1337325 - RNA, 22 nt, Human
accugcccugcccugccaccug

SEQ ID NO: 1337326 - RNA, 21 nt, Human
accugcccugcccugccaccu

SEQ ID NO: 1337327 - RNA, 20 nt, Human
accugcccugcccugccacc

SEQ ID NO: 1337328 - RNA, 18 nt, Human
accugcccugcccugcca

SEQ ID NO: 1337329 - RNA, 17 nt, Human
accugcccugcccugcc

SEQ ID NO: 1337330 - RNA, 16 nt, Human
accugcccugcccugc

SEQ ID NO: 1337331 - RNA, 13 nt, Human
accugcccugccc

SEQ ID NO: 1337332 - RNA, 12 nt, Human
accugcccugcc

SEQ ID NO: 1337333 - RNA, 23 nt, Human
accugccccuccucucugcccua

SEQ ID NO: 1337334 - RNA, 19 nt, Human
accugcccuaccugcccca

SEQ ID NO: 1337335 - RNA, 13 nt, Human
accugcccaaccu

SEQ ID NO: 1337336 - RNA, 20 nt, Human
accucugccucagaaaacaa

SEQ ID NO: 1337337 - RNA, 23 nt, Human
accggcggaccccagccauccag

SEQ ID NO: 1337338 - RNA, 16 nt, Human
accggccugccaggag

SEQ ID NO: 1337339 - RNA, 14 nt, Human
accggcucucaccu

SEQ ID NO: 1337340 - RNA, 21 nt, Human
accggcucucaccuggcccug

SEQ ID NO: 1337341 - RNA, 13 nt, Human
accggccugccag

SEQ ID NO: 1337342 - RNA, 15 nt, Human
accggccugccagga

SEQ ID NO: 1337343 - RNA, 17 nt, Human
accggccugccaggagg

SEQ ID NO: 1337344 - RNA, 16 nt, Human
accggcucucaccugg

SEQ ID NO: 1337345 - RNA, 14 nt, Human
accgguggggcugg

SEQ ID NO: 1337346 - RNA, 17 nt, Human
acccuguggucuuccuc

SEQ ID NO: 1337347 - RNA, 13 nt, Human
acccuguuccugc

SEQ ID NO: 1337348 - RNA, 14 nt, Human
acccuguuccugcu

SEQ ID NO: 1337349 - RNA, 15 nt, Human
acccuguuccugcug

SEQ ID NO: 1337350 - RNA, 16 nt, Human
acccuguuccugcugc

SEQ ID NO: 1337351 - RNA, 17 nt, Human
acccuguuccugcugcu

SEQ ID NO: 1337352 - RNA, 21 nt, Human
acccuguuccugcugcugucu

SEQ ID NO: 1337353 - RNA, 18 nt, Human
acccuguuccugcugcug

SEQ ID NO: 1337354 - RNA, 23 nt, Human
acccuuaaacaguugcacagcau

SEQ ID NO: 1337355 - RNA, 21 nt, Human
acccuuaaacaguugcacagc

SEQ ID NO: 1337356 - RNA, 13 nt, Human
acccuuacaguag

SEQ ID NO: 1337357 - RNA, 19 nt, Human
acccuuacaguaggagccc

SEQ ID NO: 1337358 - RNA, 20 nt, Human
accccaaccugcucuccucu

SEQ ID NO: 1337359 - RNA, 19 nt, Human
accccaaccugcucuccuc

SEQ ID NO: 1337360 - RNA, 20 nt, Human
accccaauuucggauuuuuu

SEQ ID NO: 1337361 - RNA, 21 nt, Human
accccaauuucggauuuuuuc

SEQ ID NO: 1337362 - RNA, 13 nt, Human
accccaauccucc

SEQ ID NO: 1337363 - RNA, 23 nt, Human
accucagguaaucgaccugccuc

SEQ ID NO: 1337364 - RNA, 15 nt, Human
accucaggugaucca

SEQ ID NO: 1337365 - RNA, 17 nt, Human
accucaguuuuaucauu

SEQ ID NO: 1337366 - RNA, 18 nt, Human
accucaguuuuaucauuu

SEQ ID NO: 1337367 - RNA, 15 nt, Human
accucaucuucuuca

SEQ ID NO: 1337368 - RNA, 22 nt, Human
accucagguaaucgaccugccu

SEQ ID NO: 1337369 - RNA, 20 nt, Human
acuucaaauccuugaagauu

SEQ ID NO: 1337370 - RNA, 19 nt, Human
acuucaagcauggcuauuu

SEQ ID NO: 1337371 - RNA, 23 nt, Human
acuucaagcauggcuauuuuaua

SEQ ID NO: 1337372 - RNA, 18 nt, Human
acuucagcgguuuauaua

SEQ ID NO: 1337373 - RNA, 19 nt, Human
acuucagcgguuuauauaa

SEQ ID NO: 1337374 - RNA, 13 nt, Human
acuucagcucugu

SEQ ID NO: 1337375 - RNA, 22 nt, Human
acuuggcucgaaucucugugcc

SEQ ID NO: 1337376 - RNA, 23 nt, Human
acuuggcucgaaucucugugccu

SEQ ID NO: 1337377 - RNA, 16 nt, Human
acuuggcugcaggaau

SEQ ID NO: 1337378 - RNA, 13 nt, Human
acuuggcuggugu

SEQ ID NO: 1337379 - RNA, 14 nt, Human
acuuggcuggugug

SEQ ID NO: 1337380 - RNA, 19 nt, Human
acuuggcuggugugguaca

SEQ ID NO: 1337381 - RNA, 22 nt, Human
acuuggcuggugugguacagag

SEQ ID NO: 1337382 - RNA, 23 nt, Human
acuuggcuggugugguacagaga

SEQ ID NO: 1337383 - RNA, 12 nt, Human
acuucugccugg

SEQ ID NO: 1337384 - RNA, 13 nt, Human
acuucugccugga

SEQ ID NO: 1337385 - RNA, 16 nt, Human
acuucugccuggagac

SEQ ID NO: 1337386 - RNA, 15 nt, Human
acuucuguuuuacca

SEQ ID NO: 1337387 - RNA, 22 nt, Human
acuuaaaauauuccugcauuug

SEQ ID NO: 1337388 - RNA, 19 nt, Human
acuuaaacuugcaucacuu

SEQ ID NO: 1337389 - RNA, 16 nt, Human
acuuaaagcuuucaga

SEQ ID NO: 1337390 - RNA, 22 nt, Human
acuuaaagcuuucagaauaugu

SEQ ID NO: 1337391 - RNA, 14 nt, Human
acuuaaaaaugguu

SEQ ID NO: 1337392 - RNA, 13 nt, Human
acuuaaaaauggu

SEQ ID NO: 1337393 - RNA, 21 nt, Human
acuuaaaaaugguuuaaaugg

SEQ ID NO: 1337394 - RNA, 21 nt, Human
acuggaccacugggcaaugau

SEQ ID NO: 1337395 - RNA, 21 nt, Human
acuggaaucagcucaggacug

SEQ ID NO: 1337396 - RNA, 16 nt, Human
acuggaauccuuucag

SEQ ID NO: 1337397 - RNA, 17 nt, Human
acuggaauccuuucagc

SEQ ID NO: 1337398 - RNA, 12 nt, Human
acuggacagcuu

SEQ ID NO: 1337399 - RNA, 13 nt, Human
acuggacagcuug

SEQ ID NO: 1337400 - RNA, 14 nt, Human
acuggacagcuugu

SEQ ID NO: 1337401 - RNA, 15 nt, Human
acuggacagcuugug

SEQ ID NO: 1337402 - RNA, 16 nt, Human
acuggaccacugggca

SEQ ID NO: 1337403 - RNA, 20 nt, Human
acuggaccacugggcaauga

SEQ ID NO: 1337404 - RNA, 22 nt, Human
acuugggaggcugagaugggag

SEQ ID NO: 1337405 - RNA, 13 nt, Human
acuugggaauaua

SEQ ID NO: 1337406 - RNA, 20 nt, Human
acuugggagaccuguaauca

SEQ ID NO: 1337407 - RNA, 17 nt, Human
acuuuaugcuaagugaa

SEQ ID NO: 1337408 - RNA, 12 nt, Human
acuuuaugcuaa

SEQ ID NO: 1337409 - RNA, 13 nt, Human
acuuuauguaguu

SEQ ID NO: 1337410 - RNA, 22 nt, Human
acuuucaggccacauggcuaaa

SEQ ID NO: 1337411 - RNA, 11 nt, Human
acuuucagcug

SEQ ID NO: 1337412 - RNA, 13 nt, Human
acuuucagcuguc

SEQ ID NO: 1337413 - RNA, 15 nt, Human
acuuucagcugucuu

SEQ ID NO: 1337414 - RNA, 22 nt, Human
acuuucagcugucuuuuggagg

SEQ ID NO: 1337415 - RNA, 14 nt, Human
acuuuccauuacaa

SEQ ID NO: 1337416 - RNA, 20 nt, Human
acuuucaaucuucaauccuu

SEQ ID NO: 1337417 - RNA, 11 nt, Human
acuuucaaucu

SEQ ID NO: 1337418 - RNA, 19 nt, Human
acugauucacaucucauuu

SEQ ID NO: 1337419 - RNA, 20 nt, Human
acugauucacaucucauuuu

SEQ ID NO: 1337420 - RNA, 14 nt, Human
acugauucaauuug

SEQ ID NO: 1337421 - RNA, 12 nt, Human
acugauuucaga

SEQ ID NO: 1337422 - RNA, 15 nt, Human
acugauuucagagug

SEQ ID NO: 1337423 - RNA, 22 nt, Human
acugcaaaaagaaaaucuuuau

SEQ ID NO: 1337424 - RNA, 18 nt, Human
acugcaaaucaggcuuuu

SEQ ID NO: 1337425 - RNA, 20 nt, Human
acugcaaaucaggcuuuugu

SEQ ID NO: 1337426 - RNA, 21 nt, Human
acugcaaaucaggcuuuuguu

SEQ ID NO: 1337427 - RNA, 22 nt, Human
acugaauaccacucuguaauug

SEQ ID NO: 1337428 - RNA, 21 nt, Human
acugaauaccacucuguaauu

SEQ ID NO: 1337429 - RNA, 13 nt, Human
acugaccagccuc

SEQ ID NO: 1337430 - RNA, 14 nt, Human
acugaccagcagcu

SEQ ID NO: 1337431 - RNA, 15 nt, Human
acugaccagcagcuu

SEQ ID NO: 1337432 - RNA, 15 nt, Human
acugaccagccucca

SEQ ID NO: 1337433 - RNA, 20 nt, Human
acugaccagccuccaugcug

SEQ ID NO: 1337434 - RNA, 12 nt, Human
acugaccagaac

SEQ ID NO: 1337435 - RNA, 14 nt, Human
acugaccagaacua

SEQ ID NO: 1337436 - RNA, 23 nt, Human
acugaccagccuccaugcugccu

SEQ ID NO: 1337437 - RNA, 11 nt, Human
acugaugcugc

SEQ ID NO: 1337438 - RNA, 12 nt, Human
acugaugcugcc

SEQ ID NO: 1337439 - RNA, 14 nt, Human
acugaugcugcccc

SEQ ID NO: 1337440 - RNA, 15 nt, Human
acugaugcugccccu

SEQ ID NO: 1337441 - RNA, 19 nt, Human
acugaugcugccccucauc

SEQ ID NO: 1337442 - RNA, 20 nt, Human
acugaugcugccccucaucu

SEQ ID NO: 1337443 - RNA, 15 nt, Human
acugaugcuuagaug

SEQ ID NO: 1337444 - RNA, 19 nt, Human
acucuguucauuccuccag

SEQ ID NO: 1337445 - RNA, 18 nt, Human
acucuguucauuccucca

SEQ ID NO: 1337446 - RNA, 16 nt, Human
acucuguucauuccuc

SEQ ID NO: 1337447 - RNA, 15 nt, Human
acucuguucauuccu

SEQ ID NO: 1337448 - RNA, 19 nt, Human
acucuagaguccaagguuu

SEQ ID NO: 1337449 - RNA, 13 nt, Human
acucuagauucca

SEQ ID NO: 1337450 - RNA, 14 nt, Human
acucuagauuccau

SEQ ID NO: 1337451 - RNA, 14 nt, Human
acucuuaagaagac

SEQ ID NO: 1337452 - RNA, 15 nt, Human
acucuuaagaagacu

SEQ ID NO: 1337453 - RNA, 20 nt, Human
acucuguucauuccuccagg

SEQ ID NO: 1337454 - RNA, 20 nt, Human
acucuuaagaagacugcauu

SEQ ID NO: 1337455 - RNA, 22 nt, Human
acugaauaaauuguacagccgg

SEQ ID NO: 1337456 - RNA, 23 nt, Human
acugaauaaauuguacagccggc

SEQ ID NO: 1337457 - RNA, 13 nt, Human
acugaauaccacu

SEQ ID NO: 1337458 - RNA, 14 nt, Human
acugaauaccacuc

SEQ ID NO: 1337459 - RNA, 17 nt, Human
acugaauaccacucugu

SEQ ID NO: 1337460 - RNA, 18 nt, Human
acugaauaccacucugua

SEQ ID NO: 1337461 - RNA, 19 nt, Human
acugaauaccacucuguaa

SEQ ID NO: 1337462 - RNA, 20 nt, Human
acugaauaccacucuguaau

SEQ ID NO: 1337463 - RNA, 14 nt, Human
acucuagaguccaa

SEQ ID NO: 1337464 - RNA, 20 nt, Human
acucuagaguccaagguuua

SEQ ID NO: 1337465 - RNA, 21 nt, Human
acucuagaugaaguuuuacau

SEQ ID NO: 1337466 - RNA, 22 nt, Human
acucuagaugaaguuuuacauu

SEQ ID NO: 1337467 - RNA, 20 nt, Human
acucuacuuagcaugucccu

SEQ ID NO: 1337468 - RNA, 19 nt, Human
acucuacuuaauccaaugg

SEQ ID NO: 1337469 - RNA, 21 nt, Human
acucuacuuagcaugucccua

SEQ ID NO: 1337470 - RNA, 21 nt, Human
acucuacuuaauccaaugggu

SEQ ID NO: 1337471 - RNA, 17 nt, Human
acucugucucaguccau

SEQ ID NO: 1337472 - RNA, 15 nt, Human
acucugucucagucc

SEQ ID NO: 1337473 - RNA, 12 nt, Human
acuauuuucaga

SEQ ID NO: 1337474 - RNA, 22 nt, Human
acuauuuucagaugugaaccau

SEQ ID NO: 1337475 - RNA, 18 nt, Human
acuauuugaugagucuua

SEQ ID NO: 1337476 - RNA, 13 nt, Human
acucuaaagcaaa

SEQ ID NO: 1337477 - RNA, 14 nt, Human
acucuaaagcaaau

SEQ ID NO: 1337478 - RNA, 18 nt, Human
acucuaaagcaaauuuau

SEQ ID NO: 1337479 - RNA, 14 nt, Human
acucuaaagucugu

SEQ ID NO: 1337480 - RNA, 13 nt, Human
acucuaagaaaga

SEQ ID NO: 1337481 - RNA, 14 nt, Human
acucuaagaaagaa

SEQ ID NO: 1337482 - RNA, 15 nt, Human
acucuaagaaagaac

SEQ ID NO: 1337483 - RNA, 12 nt, Human
acucuaagaucu

SEQ ID NO: 1337484 - RNA, 13 nt, Human
acucuaagaucuu

SEQ ID NO: 1337485 - RNA, 17 nt, Human
acucuaagaucuuagau

SEQ ID NO: 1337486 - RNA, 20 nt, Human
acucuaagaucuuagauucu

SEQ ID NO: 1337487 - RNA, 21 nt, Human
acucuaagaucuuagauucuc

SEQ ID NO: 1337488 - RNA, 13 nt, Human
acugccauaugau

SEQ ID NO: 1337489 - RNA, 19 nt, Human
acugccauaugauuuacau

SEQ ID NO: 1337490 - RNA, 16 nt, Human
acugccauauuaaauu

SEQ ID NO: 1337491 - RNA, 21 nt, Human
acugccauauuaaauuuuuug

SEQ ID NO: 1337492 - RNA, 18 nt, Human
acugccagucccccugcc

SEQ ID NO: 1337493 - RNA, 13 nt, Human
acugccaggcucu

SEQ ID NO: 1337494 - RNA, 14 nt, Human
acugccaggcucuc

SEQ ID NO: 1337495 - RNA, 17 nt, Human
acugccaggcucucuuu

SEQ ID NO: 1337496 - RNA, 18 nt, Human
acugccaggcucucuuug

SEQ ID NO: 1337497 - RNA, 19 nt, Human
acugccagucccccugccc

SEQ ID NO: 1337498 - RNA, 18 nt, Human
acuggaaggggaagggac

SEQ ID NO: 1337499 - RNA, 13 nt, Human
aagagaaggagca

SEQ ID NO: 1337500 - RNA, 13 nt, Human
aagagaaguagaa

SEQ ID NO: 1337501 - RNA, 21 nt, Human
aagagaaguuguaaaguaugu

SEQ ID NO: 1337502 - RNA, 23 nt, Human
aagagaaugcccuucuccuuauu

SEQ ID NO: 1337503 - RNA, 15 nt, Human
aagacuuuuaugaua

SEQ ID NO: 1337504 - RNA, 15 nt, Human
aagagaacuuccaga

SEQ ID NO: 1337505 - RNA, 20 nt, Human
aagagaacccacgaacauuc

SEQ ID NO: 1337506 - RNA, 22 nt, Human
aagagaaugcccuucuccuuau

SEQ ID NO: 1337507 - RNA, 19 nt, Human
aagagacaaacaccuccca

SEQ ID NO: 1337508 - RNA, 21 nt, Human
aagagacaaacaccucccagg

SEQ ID NO: 1337509 - RNA, 15 nt, Human
aagagacagcccagg

SEQ ID NO: 1337510 - RNA, 16 nt, Human
aagagacagcccagga

SEQ ID NO: 1337511 - RNA, 18 nt, Human
aagagagccugcaggauc

SEQ ID NO: 1337512 - RNA, 19 nt, Human
aacuguuguagaagacaaa

SEQ ID NO: 1337513 - RNA, 18 nt, Human
aacuguuguagaagacaa

SEQ ID NO: 1337514 - RNA, 19 nt, Human
aacuguuggaauggauuuu

SEQ ID NO: 1337515 - RNA, 19 nt, Human
aacuuaccugggcauucuu

SEQ ID NO: 1337516 - RNA, 21 nt, Human
aacuuaccaggcaccaaaaga

SEQ ID NO: 1337517 - RNA, 16 nt, Human
aacuuagauuuuacau

SEQ ID NO: 1337518 - RNA, 19 nt, Human
aacuuagauuuuacaugaa

SEQ ID NO: 1337519 - RNA, 22 nt, Human
aagacagcuucucauccugcag

SEQ ID NO: 1337520 - RNA, 15 nt, Human
aagacagcagaacug

SEQ ID NO: 1337521 - RNA, 23 nt, Human
aagacagugaaagaaaauaacaa

SEQ ID NO: 1337522 - RNA, 14 nt, Human
aagacaguggcccc

SEQ ID NO: 1337523 - RNA, 12 nt, Human
aagacaugucug

SEQ ID NO: 1337524 - RNA, 13 nt, Human
aagacaugucugu

SEQ ID NO: 1337525 - RNA, 16 nt, Human
aagacauucaggacug

SEQ ID NO: 1337526 - RNA, 16 nt, Human
aagacaugucuguucu

SEQ ID NO: 1337527 - RNA, 17 nt, Human
aagacaugucuguucua

SEQ ID NO: 1337528 - RNA, 19 nt, Human
aagacaugucuguucuaca

SEQ ID NO: 1337529 - RNA, 18 nt, Human
aagacauucuuauauuuc

SEQ ID NO: 1337530 - RNA, 22 nt, Human
aagacauucuuauauuucauau

SEQ ID NO: 1337531 - RNA, 16 nt, Human
aagauacugaaauaaa

SEQ ID NO: 1337532 - RNA, 20 nt, Human
aagauacugaaauaaacguc

SEQ ID NO: 1337533 - RNA, 14 nt, Human
aagauacuuaagug

SEQ ID NO: 1337534 - RNA, 17 nt, Human
aagauacuuaagugcug

SEQ ID NO: 1337535 - RNA, 17 nt, Human
aagauucaaucccagga

SEQ ID NO: 1337536 - RNA, 15 nt, Human
aagauuauagauucu

SEQ ID NO: 1337537 - RNA, 16 nt, Human
aagauuauagauucua

SEQ ID NO: 1337538 - RNA, 17 nt, Human
aagauuauagauucuaa

SEQ ID NO: 1337539 - RNA, 20 nt, Human
aagauuauagauucuaaaga

SEQ ID NO: 1337540 - RNA, 14 nt, Human
aagauuauagauuc

SEQ ID NO: 1337541 - RNA, 20 nt, Human
aagauucaaugccccugaau

SEQ ID NO: 1337542 - RNA, 21 nt, Human
aagauucaaugccccugaauu

SEQ ID NO: 1337543 - RNA, 15 nt, Human
aagauucagcuagug

SEQ ID NO: 1337544 - RNA, 14 nt, Human
aagauucagcuagu

SEQ ID NO: 1337545 - RNA, 13 nt, Human
aagauucagcuag

SEQ ID NO: 1337546 - RNA, 21 nt, Human
aagauuauagauucuaaagau

SEQ ID NO: 1337547 - RNA, 19 nt, Human
aagauucucuauguaucaa

SEQ ID NO: 1337548 - RNA, 20 nt, Human
aagauucucuauguaucaaa

SEQ ID NO: 1337549 - RNA, 16 nt, Human
aagauucuuucccaau

SEQ ID NO: 1337550 - RNA, 13 nt, Human
aagauucuuuccc

SEQ ID NO: 1337551 - RNA, 19 nt, Human
aagauugagcucucugccc

SEQ ID NO: 1337552 - RNA, 12 nt, Human
aagauugcugaa

SEQ ID NO: 1337553 - RNA, 15 nt, Human
aagauugcugaaauu

SEQ ID NO: 1337554 - RNA, 12 nt, Human
aagcagaaagug

SEQ ID NO: 1337555 - RNA, 13 nt, Human
aagcagaaagugc

SEQ ID NO: 1337556 - RNA, 15 nt, Human
aagcagaaagugccu

SEQ ID NO: 1337557 - RNA, 17 nt, Human
aagcagaaagugccuuu

SEQ ID NO: 1337558 - RNA, 18 nt, Human
aagcagaaagugccuuuc

SEQ ID NO: 1337559 - RNA, 19 nt, Human
aagcagaaagugccuuuca

SEQ ID NO: 1337560 - RNA, 20 nt, Human
aagcagaaagugccuuucag

SEQ ID NO: 1337561 - RNA, 23 nt, Human
aagcagaaagugccuuucaggau

SEQ ID NO: 1337562 - RNA, 15 nt, Human
aagcagaaauccaag

SEQ ID NO: 1337563 - RNA, 16 nt, Human
aagcagaaauccaagc

SEQ ID NO: 1337564 - RNA, 19 nt, Human
aagcagguggaucuauuuc

SEQ ID NO: 1337565 - RNA, 20 nt, Human
aagcagguggaucuauuuca

SEQ ID NO: 1337566 - RNA, 22 nt, Human
aagcagguggaucuauuucaug

SEQ ID NO: 1337567 - RNA, 14 nt, Human
aagcagguggaucu

SEQ ID NO: 1337568 - RNA, 15 nt, Human
aagcagggacuugaa

SEQ ID NO: 1337569 - RNA, 12 nt, Human
aaggucugcuuu

SEQ ID NO: 1337570 - RNA, 13 nt, Human
aaggucuuugguu

SEQ ID NO: 1337571 - RNA, 19 nt, Human
aaggucuuugguucagcua

SEQ ID NO: 1337572 - RNA, 17 nt, Human
aaggugaaacauuuucu

SEQ ID NO: 1337573 - RNA, 19 nt, Human
aaggugaaacauuuucucc

SEQ ID NO: 1337574 - RNA, 22 nt, Human
aaggugaaacauuuucucccug

SEQ ID NO: 1337575 - RNA, 15 nt, Human
aaggugaauagccau

SEQ ID NO: 1337576 - RNA, 19 nt, Human
aaggugacaucggaaaaau

SEQ ID NO: 1337577 - RNA, 20 nt, Human
aaggugacaucggaaaaaua

SEQ ID NO: 1337578 - RNA, 13 nt, Human
aagguggggugga

SEQ ID NO: 1337579 - RNA, 15 nt, Human
aaggugguguuucug

SEQ ID NO: 1337580 - RNA, 20 nt, Human
aagguguagccacaccagga

SEQ ID NO: 1337581 - RNA, 15 nt, Human
aagguguccuacaga

SEQ ID NO: 1337582 - RNA, 16 nt, Human
aagguguccuacagaa

SEQ ID NO: 1337583 - RNA, 18 nt, Human
aagguguccuacagaaaa

SEQ ID NO: 1337584 - RNA, 20 nt, Human
aagguguccuacagaaaaac

SEQ ID NO: 1337585 - RNA, 12 nt, Human
aaguagaggagg

SEQ ID NO: 1337586 - RNA, 19 nt, Human
aaguagaugauaaaggcca

SEQ ID NO: 1337587 - RNA, 15 nt, Human
aaguagaugcauuug

SEQ ID NO: 1337588 - RNA, 15 nt, Human
aaggugugagacugg

SEQ ID NO: 1337589 - RNA, 18 nt, Human
aagguuagagaauaaauu

SEQ ID NO: 1337590 - RNA, 15 nt, Human
aagguuaucagugcu

SEQ ID NO: 1337591 - RNA, 18 nt, Human
aagguuaucagugcuucc

SEQ ID NO: 1337592 - RNA, 17 nt, Human
aagguucccguugcauu

SEQ ID NO: 1337593 - RNA, 23 nt, Human
aagguuccgcuuggagcagaggg

SEQ ID NO: 1337594 - RNA, 11 nt, Human
aagguucuaag

SEQ ID NO: 1337595 - RNA, 13 nt, Human
aagguucuaaggc

SEQ ID NO: 1337596 - RNA, 14 nt, Human
aagguucuaaggcc

SEQ ID NO: 1337597 - RNA, 12 nt, Human
aagguucuaggu

SEQ ID NO: 1337598 - RNA, 13 nt, Human
aagguucuagguu

SEQ ID NO: 1337599 - RNA, 21 nt, Human
aagguucucagguguugccaa

SEQ ID NO: 1337600 - RNA, 17 nt, Human
aagggacugagaaauuu

SEQ ID NO: 1337601 - RNA, 15 nt, Human
aagggacugagaaau

SEQ ID NO: 1337602 - RNA, 21 nt, Human
aagggacugagagaugcagaa

SEQ ID NO: 1337603 - RNA, 12 nt, Human
aagggagguggg

SEQ ID NO: 1337604 - RNA, 17 nt, Human
aagggaggugggccgug

SEQ ID NO: 1337605 - RNA, 15 nt, Human
aagggagucugccag

SEQ ID NO: 1337606 - RNA, 16 nt, Human
aagggagucugccagg

SEQ ID NO: 1337607 - RNA, 13 nt, Human
aagggauccugcc

SEQ ID NO: 1337608 - RNA, 16 nt, Human
aagggauccugccugc

SEQ ID NO: 1337609 - RNA, 20 nt, Human
aagggcagcuuugcucauau

SEQ ID NO: 1337610 - RNA, 19 nt, Human
aagggcagcuuugcucaua

SEQ ID NO: 1337611 - RNA, 18 nt, Human
aagggcaaauuggagaaa

SEQ ID NO: 1337612 - RNA, 22 nt, Human
aagggcaacagaucaguaaaga

SEQ ID NO: 1337613 - RNA, 20 nt, Human
aagggcaacagaucaguaaa

SEQ ID NO: 1337614 - RNA, 16 nt, Human
aagggauggacaucuu

SEQ ID NO: 1337615 - RNA, 17 nt, Human
aagggauggacaucuug

SEQ ID NO: 1337616 - RNA, 17 nt, Human
aagcuggagugcagugg

SEQ ID NO: 1337617 - RNA, 21 nt, Human
aagcugcugagaaucuagccu

SEQ ID NO: 1337618 - RNA, 15 nt, Human
aagcugcccugccca

SEQ ID NO: 1337619 - RNA, 14 nt, Human
aaggaauuucuuaa

SEQ ID NO: 1337620 - RNA, 18 nt, Human
aagcugcaucuagaggcu

SEQ ID NO: 1337621 - RNA, 23 nt, Human
aaggcagccgugggccccacccu

SEQ ID NO: 1337622 - RNA, 19 nt, Human
aaggcagaggccugggcug

SEQ ID NO: 1337623 - RNA, 14 nt, Human
aaggcagcaaggcc

SEQ ID NO: 1337624 - RNA, 19 nt, Human
aaggcagcaaggcccgagc

SEQ ID NO: 1337625 - RNA, 16 nt, Human
aaggcagcaaggcccg

SEQ ID NO: 1337626 - RNA, 19 nt, Human
aaggcagccgugggcccca

SEQ ID NO: 1337627 - RNA, 16 nt, Human
aaggcacuugaggggg

SEQ ID NO: 1337628 - RNA, 14 nt, Human
aaggcagaggccug

SEQ ID NO: 1337629 - RNA, 15 nt, Human
aaggcagaggccugg

SEQ ID NO: 1337630 - RNA, 16 nt, Human
aaggcagaggccuggg

SEQ ID NO: 1337631 - RNA, 17 nt, Human
aaggcagaggccugggc

SEQ ID NO: 1337632 - RNA, 18 nt, Human
aaggcagaggccugggcu

SEQ ID NO: 1337633 - RNA, 14 nt, Human
aaggcaaaauugca

SEQ ID NO: 1337634 - RNA, 15 nt, Human
aaggcaaaauugcaa

SEQ ID NO: 1337635 - RNA, 19 nt, Human
aaggcaaaauugcaaaucu

SEQ ID NO: 1337636 - RNA, 18 nt, Human
aaggacuaauagaaaagu

SEQ ID NO: 1337637 - RNA, 15 nt, Human
aaggcaaacccauca

SEQ ID NO: 1337638 - RNA, 20 nt, Human
aaggcaaacccaucaacaaa

SEQ ID NO: 1337639 - RNA, 20 nt, Human
aaggcaaagcacgaaauguu

SEQ ID NO: 1337640 - RNA, 15 nt, Human
aaggcacucuagauu

SEQ ID NO: 1337641 - RNA, 16 nt, Human
aaggcacucuagauuc

SEQ ID NO: 1337642 - RNA, 19 nt, Human
aaggcacucuagauuccau

SEQ ID NO: 1337643 - RNA, 12 nt, Human
aaggaauuuuau

SEQ ID NO: 1337644 - RNA, 16 nt, Human
aaggaauuucuuaacu

SEQ ID NO: 1337645 - RNA, 17 nt, Human
aaggaauuucuuaacuu

SEQ ID NO: 1337646 - RNA, 19 nt, Human
aaggaauuucuuaacuucu

SEQ ID NO: 1337647 - RNA, 20 nt, Human
aaggaauuucuuaacuucuu

SEQ ID NO: 1337648 - RNA, 22 nt, Human
aaggacccggaggggccuggca

SEQ ID NO: 1337649 - RNA, 23 nt, Human
aaggaauuucuuaacuucuugcu

SEQ ID NO: 1337650 - RNA, 14 nt, Human
aaggacccugugag

SEQ ID NO: 1337651 - RNA, 12 nt, Human
aaggaccuaaaa

SEQ ID NO: 1337652 - RNA, 18 nt, Human
aaggaccugaaauuccaa

SEQ ID NO: 1337653 - RNA, 19 nt, Human
aaggaccugaaauuccaaa

SEQ ID NO: 1337654 - RNA, 13 nt, Human
aaggacuaggguc

SEQ ID NO: 1337655 - RNA, 14 nt, Human
aaggacgcacugag

SEQ ID NO: 1337656 - RNA, 15 nt, Human
aaggacuaauagaaa

SEQ ID NO: 1337657 - RNA, 15 nt, Human
aaggacuaggguccu

SEQ ID NO: 1337658 - RNA, 19 nt, Human
aaggacuaauagaaaagua

SEQ ID NO: 1337659 - RNA, 12 nt, Human
aaggcaaaauug

SEQ ID NO: 1337660 - RNA, 23 nt, Human
aagccagcaccggaccagccugg

SEQ ID NO: 1337661 - RNA, 17 nt, Human
aagccagcaccggacca

SEQ ID NO: 1337662 - RNA, 22 nt, Human
aagccagcaccggaccagccug

SEQ ID NO: 1337663 - RNA, 23 nt, Human
aagccagauuuuuuaaaauuuau

SEQ ID NO: 1337664 - RNA, 18 nt, Human
aagcagguucccaagcuc

SEQ ID NO: 1337665 - RNA, 19 nt, Human
aagcagguucccaagcuca

SEQ ID NO: 1337666 - RNA, 14 nt, Human
aauaauguuucaaa

SEQ ID NO: 1337667 - RNA, 19 nt, Human
aauaauguuucaaacauau

SEQ ID NO: 1337668 - RNA, 12 nt, Human
aauaauguuuca

SEQ ID NO: 1337669 - RNA, 15 nt, Human
aauaauauauuuucu

SEQ ID NO: 1337670 - RNA, 17 nt, Human
aauaauauauuuucugu

SEQ ID NO: 1337671 - RNA, 19 nt, Human
aauaauauauuuucuguuu

SEQ ID NO: 1337672 - RNA, 17 nt, Human
aauaauacauuauauuu

SEQ ID NO: 1337673 - RNA, 18 nt, Human
aauaauaccuaagccuuc

SEQ ID NO: 1337674 - RNA, 16 nt, Human
aauaauacugcugaga

SEQ ID NO: 1337675 - RNA, 17 nt, Human
aauaauauauuuuaaau

SEQ ID NO: 1337676 - RNA, 12 nt, Human
aauaaaauuuuu

SEQ ID NO: 1337677 - RNA, 17 nt, Human
aauaaaauuuguugcau

SEQ ID NO: 1337678 - RNA, 16 nt, Human
aauaaaauuuguugca

SEQ ID NO: 1337679 - RNA, 13 nt, Human
aauaaacaaauaa

SEQ ID NO: 1337680 - RNA, 18 nt, Human
aaguugauggugaugaaa

SEQ ID NO: 1337681 - RNA, 14 nt, Human
aaguugauuagaaa

SEQ ID NO: 1337682 - RNA, 14 nt, Human
aaguugcagcuguu

SEQ ID NO: 1337683 - RNA, 15 nt, Human
aaguugcagcuguuu

SEQ ID NO: 1337684 - RNA, 17 nt, Human
aaguugcagcuguuuug

SEQ ID NO: 1337685 - RNA, 21 nt, Human
aaguugcagcuguuuuguuga

SEQ ID NO: 1337686 - RNA, 19 nt, Human
aaguugcagcuguuuuguu

SEQ ID NO: 1337687 - RNA, 11 nt, Human
aauaaaauuug

SEQ ID NO: 1337688 - RNA, 12 nt, Human
aauaaaauuugu

SEQ ID NO: 1337689 - RNA, 13 nt, Human
aauaaaauuuguu

SEQ ID NO: 1337690 - RNA, 14 nt, Human
aauaaaauuuguug

SEQ ID NO: 1337691 - RNA, 22 nt, Human
aauaaaggacuguaaucuuauu

SEQ ID NO: 1337692 - RNA, 16 nt, Human
aauaaaggaugugauu

SEQ ID NO: 1337693 - RNA, 18 nt, Human
aauaaaggaugugauugu

SEQ ID NO: 1337694 - RNA, 18 nt, Human
aauaaaggacuguaaucu

SEQ ID NO: 1337695 - RNA, 11 nt, Human
aauaaaggacu

SEQ ID NO: 1337696 - RNA, 14 nt, Human
aauaaagcugcuga

SEQ ID NO: 1337697 - RNA, 19 nt, Human
aauaaagcuguguggcagu

SEQ ID NO: 1337698 - RNA, 11 nt, Human
aauaaagcugu

SEQ ID NO: 1337699 - RNA, 15 nt, Human
aauaaacgucuuaaa

SEQ ID NO: 1337700 - RNA, 16 nt, Human
aauaaacgucuuaaau

SEQ ID NO: 1337701 - RNA, 22 nt, Human
aaguugauaugccuuuucccaa

SEQ ID NO: 1337702 - RNA, 19 nt, Human
aaguucuguacucaaaugu

SEQ ID NO: 1337703 - RNA, 15 nt, Human
aaguggggacagagc

SEQ ID NO: 1337704 - RNA, 22 nt, Human
aagugggcuugauucugcagua

SEQ ID NO: 1337705 - RNA, 11 nt, Human
aagugggacag

SEQ ID NO: 1337706 - RNA, 12 nt, Human
aagugggcuuga

SEQ ID NO: 1337707 - RNA, 16 nt, Human
aagugggcuugauucu

SEQ ID NO: 1337708 - RNA, 20 nt, Human
aaguggggcagcagcagugg

SEQ ID NO: 1337709 - RNA, 23 nt, Human
aaguggggcgggcuucauagaga

SEQ ID NO: 1337710 - RNA, 15 nt, Human
aaguggguaccccca

SEQ ID NO: 1337711 - RNA, 19 nt, Human
aaguggguacccccaggac

SEQ ID NO: 1337712 - RNA, 14 nt, Human
aagugcugagauua

SEQ ID NO: 1337713 - RNA, 14 nt, Human
aagugcugcacuca

SEQ ID NO: 1337714 - RNA, 15 nt, Human
aagugcugcacucaa

SEQ ID NO: 1337715 - RNA, 19 nt, Human
aagugcugcacucaaauga

SEQ ID NO: 1337716 - RNA, 15 nt, Human
aagugcuaagguucu

SEQ ID NO: 1337717 - RNA, 16 nt, Human
aagugcuaagguucua

SEQ ID NO: 1337718 - RNA, 17 nt, Human
aagugcuaagguucuaa

SEQ ID NO: 1337719 - RNA, 18 nt, Human
aagugcuaagguucuaag

SEQ ID NO: 1337720 - RNA, 19 nt, Human
aagugcuaagguucuaagg

SEQ ID NO: 1337721 - RNA, 20 nt, Human
aagugcuaagguucuaaggc

SEQ ID NO: 1337722 - RNA, 21 nt, Human
aagugcuaagguucuaaggcc

SEQ ID NO: 1337723 - RNA, 13 nt, Human
aagugcugagauu

SEQ ID NO: 1337724 - RNA, 18 nt, Human
aaguaguuaucauguuag

SEQ ID NO: 1337725 - RNA, 19 nt, Human
aaguaguuaucauguuagu

SEQ ID NO: 1337726 - RNA, 17 nt, Human
aaguaguuaucauguua

SEQ ID NO: 1337727 - RNA, 15 nt, Human
aaguaguuaucaugu

SEQ ID NO: 1337728 - RNA, 13 nt, Human
aaguaguuaucau

SEQ ID NO: 1337729 - RNA, 13 nt, Human
aaguaggaaguaa

SEQ ID NO: 1337730 - RNA, 15 nt, Human
aaguauacauaaguu

SEQ ID NO: 1337731 - RNA, 19 nt, Human
aauacgugggcauucaaau

SEQ ID NO: 1337732 - RNA, 20 nt, Human
aauacgugggcauucaaaug

SEQ ID NO: 1337733 - RNA, 15 nt, Human
aauacuaaggaacca

SEQ ID NO: 1337734 - RNA, 14 nt, Human
aauacuaccuugaa

SEQ ID NO: 1337735 - RNA, 15 nt, Human
aauacuaccuugaaa

SEQ ID NO: 1337736 - RNA, 16 nt, Human
aauacuaccuugaaaa

SEQ ID NO: 1337737 - RNA, 19 nt, Human
aauaccuuagugcaguuau

SEQ ID NO: 1337738 - RNA, 13 nt, Human
aauacuaaugaaa

SEQ ID NO: 1337739 - RNA, 14 nt, Human
aauacuucucauuu

SEQ ID NO: 1337740 - RNA, 16 nt, Human
aauacuucucauuuuu

SEQ ID NO: 1337741 - RNA, 22 nt, Human
aauacuucucauuuuuuaaaaa

SEQ ID NO: 1337742 - RNA, 13 nt, Human
aauacuucuugug

SEQ ID NO: 1337743 - RNA, 14 nt, Human
aauacuucuugugu

SEQ ID NO: 1337744 - RNA, 17 nt, Human
aauacuucuugugugua

SEQ ID NO: 1337745 - RNA, 19 nt, Human
aauacuucuuguguguaug

SEQ ID NO: 1337746 - RNA, 21 nt, Human
aauacuucuuguguguaugca

SEQ ID NO: 1337747 - RNA, 13 nt, Human
aauagaaaauggu

SEQ ID NO: 1337748 - RNA, 14 nt, Human
aauagaaaaugguc

SEQ ID NO: 1337749 - RNA, 15 nt, Human
aauagaaaauggucc

SEQ ID NO: 1337750 - RNA, 22 nt, Human
aauagaaauaaaggaugugauu

SEQ ID NO: 1337751 - RNA, 17 nt, Human
aauagaacaaggcugag

SEQ ID NO: 1337752 - RNA, 13 nt, Human
aauagaacacagu

SEQ ID NO: 1337753 - RNA, 22 nt, Human
aauagaagcuaagguuuagaua

SEQ ID NO: 1337754 - RNA, 14 nt, Human
aauaguuuggauau

SEQ ID NO: 1337755 - RNA, 20 nt, Human
aauaguuuuauuaauaaaca

SEQ ID NO: 1337756 - RNA, 21 nt, Human
aauaguuuuauuaauaaacau

SEQ ID NO: 1337757 - RNA, 22 nt, Human
aauaguuuuauuaauaaacauu

SEQ ID NO: 1337758 - RNA, 14 nt, Human
aauauaaaauauga

SEQ ID NO: 1337759 - RNA, 23 nt, Human
aauauaaaauaugaagacauaaa

SEQ ID NO: 1337760 - RNA, 21 nt, Human
aauaugcuuauauuguucacu

SEQ ID NO: 1337761 - RNA, 23 nt, Human
aauaugcuuaaaauaagcaggug

SEQ ID NO: 1337762 - RNA, 16 nt, Human
aauaugcuuaaaauaa

SEQ ID NO: 1337763 - RNA, 19 nt, Human
aauaugcuuaaaauaagca

SEQ ID NO: 1337764 - RNA, 22 nt, Human
aauaugcuuaaaauaagcaggu

SEQ ID NO: 1337765 - RNA, 16 nt, Human
aauaugcuaauucuca

SEQ ID NO: 1337766 - RNA, 19 nt, Human
aauauacuuuuacaaguaa

SEQ ID NO: 1337767 - RNA, 18 nt, Human
aauauacuuuuacaagua

SEQ ID NO: 1337768 - RNA, 21 nt, Human
aauauagaucaguuauaagua

SEQ ID NO: 1337769 - RNA, 11 nt, Human
aauauaaagac

SEQ ID NO: 1337770 - RNA, 12 nt, Human
aauauaaagacg

SEQ ID NO: 1337771 - RNA, 23 nt, Human
aauauaaagacguuuuauaagca

SEQ ID NO: 1337772 - RNA, 18 nt, Human
aauauaaagacguuuuau

SEQ ID NO: 1337773 - RNA, 15 nt, Human
aauauaaaguuuuau

SEQ ID NO: 1337774 - RNA, 20 nt, Human
aauauaaaguuuuauauauu

SEQ ID NO: 1337775 - RNA, 21 nt, Human
aauauaaaguuuuauauauua

SEQ ID NO: 1337776 - RNA, 22 nt, Human
aauauaaaguuuuauauauuau

SEQ ID NO: 1337777 - RNA, 11 nt, Human
aauauaaaugc

SEQ ID NO: 1337778 - RNA, 12 nt, Human
aauauaaaugca

SEQ ID NO: 1337779 - RNA, 13 nt, Human
aauauaaaugcaa

SEQ ID NO: 1337780 - RNA, 14 nt, Human
aauauaaaugcaaa

SEQ ID NO: 1337781 - RNA, 15 nt, Human
aauauaaaugcaaau

SEQ ID NO: 1337782 - RNA, 16 nt, Human
aauauaaaugcaaaua

SEQ ID NO: 1337783 - RNA, 17 nt, Human
aauauaaaugcaaauaa

SEQ ID NO: 1337784 - RNA, 18 nt, Human
aauauaaaugcaaauaac

SEQ ID NO: 1337785 - RNA, 19 nt, Human
aauauaaaugcaaauaaca

SEQ ID NO: 1337786 - RNA, 20 nt, Human
aauauaaaugcaaauaacaa

SEQ ID NO: 1337787 - RNA, 22 nt, Human
aauauaaaugcaaauaacaaau

SEQ ID NO: 1337788 - RNA, 12 nt, Human
aaucaaaugaau

SEQ ID NO: 1337789 - RNA, 20 nt, Human
aaucaaauuuguaggguuuc

SEQ ID NO: 1337790 - RNA, 19 nt, Human
aaucaaauuuguaggguuu

SEQ ID NO: 1337791 - RNA, 13 nt, Human
aaucauuuuaugu

SEQ ID NO: 1337792 - RNA, 15 nt, Human
aaucauuuguuuaaa

SEQ ID NO: 1337793 - RNA, 13 nt, Human
aaucauuuugcaa

SEQ ID NO: 1337794 - RNA, 17 nt, Human
aaucauuuguuuaaaaa

SEQ ID NO: 1337795 - RNA, 15 nt, Human
aaucauuuuaauuau

SEQ ID NO: 1337796 - RNA, 16 nt, Human
aaucauuuuaauuauu

SEQ ID NO: 1337797 - RNA, 17 nt, Human
aaucauuuuaauuauua

SEQ ID NO: 1337798 - RNA, 19 nt, Human
aaucauuuuaauuauuauu

SEQ ID NO: 1337799 - RNA, 20 nt, Human
aaucauuuuaauuauuauuc

SEQ ID NO: 1337800 - RNA, 22 nt, Human
aaucauuuuaauuauuauucuu

SEQ ID NO: 1337801 - RNA, 20 nt, Human
aauccaaauggcgucuggaa

SEQ ID NO: 1337802 - RNA, 13 nt, Human
aauccaaauggcg

SEQ ID NO: 1337803 - RNA, 22 nt, Human
aauccaagauauuuuaaaaucu

SEQ ID NO: 1337804 - RNA, 15 nt, Human
aauccacauuucuaa

SEQ ID NO: 1337805 - RNA, 16 nt, Human
aauccacauuucuaaa

SEQ ID NO: 1337806 - RNA, 16 nt, Human
aauccauacauuugug

SEQ ID NO: 1337807 - RNA, 17 nt, Human
aauccauacauuugugu

SEQ ID NO: 1337808 - RNA, 23 nt, Human
aaucucgcucugucgcccaggcu

SEQ ID NO: 1337809 - RNA, 18 nt, Human
aaucucccauuuuggaau

SEQ ID NO: 1337810 - RNA, 18 nt, Human
aaucucggcucacugcau

SEQ ID NO: 1337811 - RNA, 19 nt, Human
aauccaugaaagaacuuaa

SEQ ID NO: 1337812 - RNA, 16 nt, Human
aaucucccauuuugga

SEQ ID NO: 1337813 - RNA, 22 nt, Human
aaucucccauuuuggaauuugc

SEQ ID NO: 1337814 - RNA, 15 nt, Human
aaucuggacuccucu

SEQ ID NO: 1337815 - RNA, 16 nt, Human
aaucuggacuccucug

SEQ ID NO: 1337816 - RNA, 15 nt, Human
aaucucuacaaaccc

SEQ ID NO: 1337817 - RNA, 17 nt, Human
aaucuggacuccucugu

SEQ ID NO: 1337818 - RNA, 18 nt, Human
aaucuggacuccucuguc

SEQ ID NO: 1337819 - RNA, 20 nt, Human
aaucuggacuccucugucca

SEQ ID NO: 1337820 - RNA, 14 nt, Human
aaugauaacuggaa

SEQ ID NO: 1337821 - RNA, 17 nt, Human
aaugaacaagagaagca

SEQ ID NO: 1337822 - RNA, 18 nt, Human
aaugaacaagagaagcau

SEQ ID NO: 1337823 - RNA, 22 nt, Human
aaugaacaagagaagcauucuc

SEQ ID NO: 1337824 - RNA, 14 nt, Human
aaugaaauuaacug

SEQ ID NO: 1337825 - RNA, 12 nt, Human
aaugaacaaaug

SEQ ID NO: 1337826 - RNA, 12 nt, Human
aaugaacaagag

SEQ ID NO: 1337827 - RNA, 13 nt, Human
aaugaacaagaga

SEQ ID NO: 1337828 - RNA, 14 nt, Human
aaugaacaagagaa

SEQ ID NO: 1337829 - RNA, 16 nt, Human
aaugaacaagagaagc

SEQ ID NO: 1337830 - RNA, 15 nt, Human
aaugauaacuggaaa

SEQ ID NO: 1337831 - RNA, 16 nt, Human
aaugauaacuggaaac

SEQ ID NO: 1337832 - RNA, 21 nt, Human
aaugauagacaauugagguaa

SEQ ID NO: 1337833 - RNA, 12 nt, Human
aaugaacagaac

SEQ ID NO: 1337834 - RNA, 17 nt, Human
aaugauaacuggaaacu

SEQ ID NO: 1337835 - RNA, 21 nt, Human
aaugaacacucuuuugcuuua

SEQ ID NO: 1337836 - RNA, 15 nt, Human
aaugaacacucuuuu

SEQ ID NO: 1337837 - RNA, 18 nt, Human
aaugaacacucuuuugcu

SEQ ID NO: 1337838 - RNA, 15 nt, Human
aaugauaugcuugua

SEQ ID NO: 1337839 - RNA, 17 nt, Human
aaugauaugcuuguaac

SEQ ID NO: 1337840 - RNA, 23 nt, Human
aaugauguauguugaagccuuug

SEQ ID NO: 1337841 - RNA, 19 nt, Human
aaugauaugcuuguaacua

SEQ ID NO: 1337842 - RNA, 18 nt, Human
aaugauaugcuuguaacu

SEQ ID NO: 1337843 - RNA, 19 nt, Human
aaugauauuguuauauaca

SEQ ID NO: 1337844 - RNA, 14 nt, Human
aaugaacagaacau

SEQ ID NO: 1337845 - RNA, 23 nt, Human
aauggucacguuuggugcuucuc

SEQ ID NO: 1337846 - RNA, 22 nt, Human
aauggucacguuuggugcuucu

SEQ ID NO: 1337847 - RNA, 20 nt, Human
aaugguccaauuaguuuccu

SEQ ID NO: 1337848 - RNA, 14 nt, Human
aaugguccaggaga

SEQ ID NO: 1337849 - RNA, 19 nt, Human
aaugguccaggagaaggcc

SEQ ID NO: 1337850 - RNA, 15 nt, Human
aauggguuacuugau

SEQ ID NO: 1337851 - RNA, 16 nt, Human
aauggguuuuucccug

SEQ ID NO: 1337852 - RNA, 12 nt, Human
aaugguaucuuu

SEQ ID NO: 1337853 - RNA, 22 nt, Human
aauggggccagauccagccugg

SEQ ID NO: 1337854 - RNA, 16 nt, Human
aaugcucuuauuucau

SEQ ID NO: 1337855 - RNA, 14 nt, Human
aaugcucuuauuuc

SEQ ID NO: 1337856 - RNA, 21 nt, Human
aaugggagcugaggccacacu

SEQ ID NO: 1337857 - RNA, 14 nt, Human
aaugggcacuuaaa

SEQ ID NO: 1337858 - RNA, 19 nt, Human
aaugggcacuuaaagcuuu

SEQ ID NO: 1337859 - RNA, 17 nt, Human
aauggggccagauccag

SEQ ID NO: 1337860 - RNA, 21 nt, Human
aaugcgcaggcuggcccugcc

SEQ ID NO: 1337861 - RNA, 15 nt, Human
aaugcgcaggcuggc

SEQ ID NO: 1337862 - RNA, 14 nt, Human
aaugcgcaggcugg

SEQ ID NO: 1337863 - RNA, 22 nt, Human
aaugccugacuagggagccaug

SEQ ID NO: 1337864 - RNA, 17 nt, Human
aaugcgcaggcuggccc

SEQ ID NO: 1337865 - RNA, 18 nt, Human
aaugcgcaggcuggcccu

SEQ ID NO: 1337866 - RNA, 19 nt, Human
aaugcgcaggcuggcccug

SEQ ID NO: 1337867 - RNA, 20 nt, Human
aaugcgcaggcuggcccugc

SEQ ID NO: 1337868 - RNA, 13 nt, Human
aaugcccuucacu

SEQ ID NO: 1337869 - RNA, 17 nt, Human
aaugcccuucacuguca

SEQ ID NO: 1337870 - RNA, 14 nt, Human
aaugcccuucacug

SEQ ID NO: 1337871 - RNA, 15 nt, Human
aaauaaacgucuuaa

SEQ ID NO: 1337872 - RNA, 16 nt, Human
aaauaaacgucuuaaa

SEQ ID NO: 1337873 - RNA, 21 nt, Human
aaauaaaacccguugauuacu

SEQ ID NO: 1337874 - RNA, 18 nt, Human
aaauaaaauuuguugcau

SEQ ID NO: 1337875 - RNA, 19 nt, Human
aaauaaaauuuguugcaua

SEQ ID NO: 1337876 - RNA, 18 nt, Human
aaauaaacaaauaacaau

SEQ ID NO: 1337877 - RNA, 14 nt, Human
aaagugccuuucag

SEQ ID NO: 1337878 - RNA, 15 nt, Human
aaagugccuuucagg

SEQ ID NO: 1337879 - RNA, 16 nt, Human
aaagugccuuucagga

SEQ ID NO: 1337880 - RNA, 17 nt, Human
aaagugccuuucaggau

SEQ ID NO: 1337881 - RNA, 19 nt, Human
aaagugccuuucaggaucu

SEQ ID NO: 1337882 - RNA, 20 nt, Human
aaagugccuuucaggaucua

SEQ ID NO: 1337883 - RNA, 23 nt, Human
aaagugccuuucaggaucuauuu

SEQ ID NO: 1337884 - RNA, 16 nt, Human
aaagugcuaagguucu

SEQ ID NO: 1337885 - RNA, 22 nt, Human
aaagugccuuucaggaucuauu

SEQ ID NO: 1337886 - RNA, 13 nt, Human
aaagugcuaaggu

SEQ ID NO: 1337887 - RNA, 14 nt, Human
aaauaaaaccagcu

SEQ ID NO: 1337888 - RNA, 18 nt, Human
aaagucagauucuugcau

SEQ ID NO: 1337889 - RNA, 15 nt, Human
aaagucauaauugca

SEQ ID NO: 1337890 - RNA, 15 nt, Human
aaagucaggaaucau

SEQ ID NO: 1337891 - RNA, 17 nt, Human
aaagucaauguuuucag

SEQ ID NO: 1337892 - RNA, 18 nt, Human
aaagucaauguuuucagu

SEQ ID NO: 1337893 - RNA, 15 nt, Human
aaaggcuguuaaaua

SEQ ID NO: 1337894 - RNA, 18 nt, Human
aaaggcuguuaaauacag

SEQ ID NO: 1337895 - RNA, 17 nt, Human
aaagucauaauugcauu

SEQ ID NO: 1337896 - RNA, 19 nt, Human
aaagugccauuaacaaaug

SEQ ID NO: 1337897 - RNA, 15 nt, Human
aaagugccaguauuu

SEQ ID NO: 1337898 - RNA, 19 nt, Human
aaagugccaguauuuuaaa

SEQ ID NO: 1337899 - RNA, 20 nt, Human
aaagugccugacacacuaac

SEQ ID NO: 1337900 - RNA, 17 nt, Human
aaauaaacgucuuaaau

SEQ ID NO: 1337901 - RNA, 21 nt, Human
aaauaaauguaucauagaaau

SEQ ID NO: 1337902 - RNA, 16 nt, Human
aaauaaauguaucaua

SEQ ID NO: 1337903 - RNA, 17 nt, Human
aaagcccauucauucca

SEQ ID NO: 1337904 - RNA, 16 nt, Human
aaagcccauucauucc

SEQ ID NO: 1337905 - RNA, 22 nt, Human
aaagcccauaugcuaccaccag

SEQ ID NO: 1337906 - RNA, 22 nt, Human
aaagccaaggagucacugagac

SEQ ID NO: 1337907 - RNA, 15 nt, Human
aaaggcaguuaccau

SEQ ID NO: 1337908 - RNA, 23 nt, Human
aaaggcaguuaccauuaaaccau

SEQ ID NO: 1337909 - RNA, 13 nt, Human
aaaggcaguuuuc

SEQ ID NO: 1337910 - RNA, 14 nt, Human
aaaggcaguuuucu

SEQ ID NO: 1337911 - RNA, 16 nt, Human
aaaggcaguuuucuaa

SEQ ID NO: 1337912 - RNA, 23 nt, Human
aaaggcaguuugcaaaaaauguu

SEQ ID NO: 1337913 - RNA, 14 nt, Human
aaagcccccagagc

SEQ ID NO: 1337914 - RNA, 21 nt, Human
aaagcccccagagcccaggcu

SEQ ID NO: 1337915 - RNA, 22 nt, Human
aaagcccccagagcccaggcuc

SEQ ID NO: 1337916 - RNA, 19 nt, Human
aaaggcuagguacacagcu

SEQ ID NO: 1337917 - RNA, 20 nt, Human
aaaggcuaugauugucuuug

SEQ ID NO: 1337918 - RNA, 21 nt, Human
aaagcauuuuguaauaauaaa

SEQ ID NO: 1337919 - RNA, 15 nt, Human
aaagccaaacauaua

SEQ ID NO: 1337920 - RNA, 13 nt, Human
aaagcauuuugua

SEQ ID NO: 1337921 - RNA, 14 nt, Human
aaagcauuuuguaa

SEQ ID NO: 1337922 - RNA, 15 nt, Human
aaagcauuuuguaau

SEQ ID NO: 1337923 - RNA, 23 nt, Human
aaagcauuuaaccccccuguaca

SEQ ID NO: 1337924 - RNA, 19 nt, Human
aaagaacggaagaagagau

SEQ ID NO: 1337925 - RNA, 23 nt, Human
aaagaacguggucagaguagaac

SEQ ID NO: 1337926 - RNA, 15 nt, Human
aaagaacggaagaag

SEQ ID NO: 1337927 - RNA, 20 nt, Human
aaagaacgcugauuuaaaga

SEQ ID NO: 1337928 - RNA, 23 nt, Human
aaagaaccaacaaccucaacugc

SEQ ID NO: 1337929 - RNA, 13 nt, Human
aaagaaccacuug

SEQ ID NO: 1337930 - RNA, 15 nt, Human
aaagaacgcugauuu

SEQ ID NO: 1337931 - RNA, 18 nt, Human
aaagaacgcugauuuaaa

SEQ ID NO: 1337932 - RNA, 13 nt, Human
aaagaaacauuug

SEQ ID NO: 1337933 - RNA, 12 nt, Human
aaagaaacuuuc

SEQ ID NO: 1337934 - RNA, 15 nt, Human
aaagaagacaaacuu

SEQ ID NO: 1337935 - RNA, 20 nt, Human
aaagaagaaggugggaggau

SEQ ID NO: 1337936 - RNA, 12 nt, Human
aaagaggcugag

SEQ ID NO: 1337937 - RNA, 19 nt, Human
aaagaggcugaggccugga

SEQ ID NO: 1337938 - RNA, 20 nt, Human
aaagaggcugaggccuggac

SEQ ID NO: 1337939 - RNA, 21 nt, Human
aaagaggcugaggccuggacu

SEQ ID NO: 1337940 - RNA, 19 nt, Human
aaagaggcugaggcuggca

SEQ ID NO: 1337941 - RNA, 14 nt, Human
aaagaggcugcccc

SEQ ID NO: 1337942 - RNA, 18 nt, Human
aaagaggcugccccucuc

SEQ ID NO: 1337943 - RNA, 20 nt, Human
aaagaggcugccccucucac

SEQ ID NO: 1337944 - RNA, 19 nt, Human
aaagaaaauuuuuguagua

SEQ ID NO: 1337945 - RNA, 12 nt, Human
aaagaaaauuuu

SEQ ID NO: 1337946 - RNA, 18 nt, Human
aaagaaaaugauacagca

SEQ ID NO: 1337947 - RNA, 13 nt, Human
aaagaaaauuaca

SEQ ID NO: 1337948 - RNA, 22 nt, Human
aaacugauccaguauaagacua

SEQ ID NO: 1337949 - RNA, 22 nt, Human
aaacugaagcagccucucccca

SEQ ID NO: 1337950 - RNA, 13 nt, Human
aaacugagugacu

SEQ ID NO: 1337951 - RNA, 20 nt, Human
aaacucuuuggucguuuuuu

SEQ ID NO: 1337952 - RNA, 21 nt, Human
aaacucuuuggucguuuuuuu

SEQ ID NO: 1337953 - RNA, 13 nt, Human
aaacucuuuuccc

SEQ ID NO: 1337954 - RNA, 18 nt, Human
aaacugaagcagccucuc

SEQ ID NO: 1337955 - RNA, 21 nt, Human
aaacugaagcagccucucccc

SEQ ID NO: 1337956 - RNA, 19 nt, Human
aaacccuugccaugugcua

SEQ ID NO: 1337957 - RNA, 19 nt, Human
aaaccgccagcucuguucu

SEQ ID NO: 1337958 - RNA, 14 nt, Human
aaaccgcuaaaaga

SEQ ID NO: 1337959 - RNA, 15 nt, Human
aaaccgcuaaaagaa

SEQ ID NO: 1337960 - RNA, 16 nt, Human
aaaccgcuaaaagaaa

SEQ ID NO: 1337961 - RNA, 18 nt, Human
aaaccgcuaaaagaaacu

SEQ ID NO: 1337962 - RNA, 23 nt, Human
aaaccgcuaaaagaaacuuucuu

SEQ ID NO: 1337963 - RNA, 21 nt, Human
aaaccgcuaaaagaaacuuuc

SEQ ID NO: 1337964 - RNA, 20 nt, Human
aaaccccaccccaaaauuag

SEQ ID NO: 1337965 - RNA, 20 nt, Human
aaaccccaccuuuauuccuu

SEQ ID NO: 1337966 - RNA, 22 nt, Human
aaacccauauuguaaaacaggu

SEQ ID NO: 1337967 - RNA, 21 nt, Human
aaacccugucucuacuaaaaa

SEQ ID NO: 1337968 - RNA, 15 nt, Human
aaaccccccagauau

SEQ ID NO: 1337969 - RNA, 17 nt, Human
aaacccaguugccaucu

SEQ ID NO: 1337970 - RNA, 18 nt, Human
aaagaggugaccccaggg

SEQ ID NO: 1337971 - RNA, 19 nt, Human
aaagaggugaccccagggc

SEQ ID NO: 1337972 - RNA, 21 nt, Human
aaagaggugaccccagggcac

SEQ ID NO: 1337973 - RNA, 22 nt, Human
aaagaggcugccccucucacca

SEQ ID NO: 1337974 - RNA, 23 nt, Human
aaagaggcugccccucucaccaa

SEQ ID NO: 1337975 - RNA, 18 nt, Human
aaagaggucgcuugggaa

SEQ ID NO: 1337976 - RNA, 21 nt, Human
aaagauaaauuauaucaauuu

SEQ ID NO: 1337977 - RNA, 20 nt, Human
aaagaggugaccccagggca

SEQ ID NO: 1337978 - RNA, 21 nt, Human
aaagauacagaacucuuucaa

SEQ ID NO: 1337979 - RNA, 12 nt, Human
aaacaggaucag

SEQ ID NO: 1337980 - RNA, 16 nt, Human
aaacaggcacugcccu

SEQ ID NO: 1337981 - RNA, 17 nt, Human
aaacagggccacauaga

SEQ ID NO: 1337982 - RNA, 17 nt, Human
aaacaggcacugcccug

SEQ ID NO: 1337983 - RNA, 15 nt, Human
aaacaggcacuuggc

SEQ ID NO: 1337984 - RNA, 23 nt, Human
aaacaggcacuuggcagccuugu

SEQ ID NO: 1337985 - RNA, 12 nt, Human
aaaauugaaugc

SEQ ID NO: 1337986 - RNA, 14 nt, Human
aaaauugaaugcaa

SEQ ID NO: 1337987 - RNA, 14 nt, Human
aaaauucugugccu

SEQ ID NO: 1337988 - RNA, 23 nt, Human
aaaauucugugccuuguuuuuug

SEQ ID NO: 1337989 - RNA, 14 nt, Human
aaaauugaaaugua

SEQ ID NO: 1337990 - RNA, 16 nt, Human
aaaauugaaauguaag

SEQ ID NO: 1337991 - RNA, 17 nt, Human
aaaauugaaauguaagg

SEQ ID NO: 1337992 - RNA, 18 nt, Human
aaaauugaaauguaaggc

SEQ ID NO: 1337993 - RNA, 21 nt, Human
aaaauugaaauguaaggcugu

SEQ ID NO: 1337994 - RNA, 21 nt, Human
aaaauugaaugcaaaccauag

SEQ ID NO: 1337995 - RNA, 13 nt, Human
aaaauucauuuuu

SEQ ID NO: 1337996 - RNA, 13 nt, Human
aaaauuccacuca

SEQ ID NO: 1337997 - RNA, 14 nt, Human
aaaauuccacucaa

SEQ ID NO: 1337998 - RNA, 15 nt, Human
aaaauaaaaaacacu

SEQ ID NO: 1337999 - RNA, 21 nt, Human
aaaauaaaaaagaucccaaau

SEQ ID NO: 1338000 - RNA, 12 nt, Human
aaaaguuuguuu

SEQ ID NO: 1338001 - RNA, 20 nt, Human
aaaaguuuuuuauuaugcau

SEQ ID NO: 1338002 - RNA, 21 nt, Human
aaaauccacuuuaucuugaau

SEQ ID NO: 1338003 - RNA, 20 nt, Human
aaaauaaaaagaucacuuuc

SEQ ID NO: 1338004 - RNA, 16 nt, Human
aaaauaaaaaagaucc

SEQ ID NO: 1338005 - RNA, 13 nt, Human
aaaaucaaauggu

SEQ ID NO: 1338006 - RNA, 13 nt, Human
aaaauuaucuaua

SEQ ID NO: 1338007 - RNA, 24 nt, Human
aaaauuauagcucuaauguuugca

SEQ ID NO: 1338008 - RNA, 19 nt, Human
aaaauuauagcucuaaugu

SEQ ID NO: 1338009 - RNA, 15 nt, Human
aaaauuauagcucua

SEQ ID NO: 1338010 - RNA, 16 nt, Human
aaaauuauagaaguuu

SEQ ID NO: 1338011 - RNA, 13 nt, Human
aaaauuauuuaaa

SEQ ID NO: 1338012 - RNA, 13 nt, Human
aaaauuauuugca

SEQ ID NO: 1338013 - RNA, 14 nt, Human
aaaauuauuugcau

SEQ ID NO: 1338014 - RNA, 14 nt, Human
aaaauuacaacuaa

SEQ ID NO: 1338015 - RNA, 23 nt, Human
aaaauuacuuaguauugcaaagu

SEQ ID NO: 1338016 - RNA, 21 nt, Human
aaaauuacuuaguauugcaaa

SEQ ID NO: 1338017 - RNA, 14 nt, Human
aaaauuacuguuua

SEQ ID NO: 1338018 - RNA, 19 nt, Human
aaaauuaggauuucaugau

SEQ ID NO: 1338019 - RNA, 19 nt, Human
aaaauuagccaguaauccu

SEQ ID NO: 1338020 - RNA, 17 nt, Human
aaaauuagccaguaauc

SEQ ID NO: 1338021 - RNA, 21 nt, Human
aaaauuagccaguaauccugu

SEQ ID NO: 1338022 - RNA, 22 nt, Human
aaaauuacuuaguauugcaaag

SEQ ID NO: 1338023 - RNA, 23 nt, Human
aaaauuagacugugauucagaaa

SEQ ID NO: 1338024 - RNA, 12 nt, Human
aaaauuaagaaa

SEQ ID NO: 1338025 - RNA, 22 nt, Human
aaaauuaacaugaauauuuagu

SEQ ID NO: 1338026 - RNA, 20 nt, Human
aaaauuaaaccggaccaucu

SEQ ID NO: 1338027 - RNA, 19 nt, Human
aaaauccauacauuugugu

SEQ ID NO: 1338028 - RNA, 20 nt, Human
aaaauuaagaaaggauaaag

SEQ ID NO: 1338029 - RNA, 13 nt, Human
aaaauuaagaaag

SEQ ID NO: 1338030 - RNA, 17 nt, Human
aaaauuaaaucaaccuu

SEQ ID NO: 1338031 - RNA, 23 nt, Human
aaaauuaaucugggccagaauuu

SEQ ID NO: 1338032 - RNA, 20 nt, Human
aacaggaucaguuaacuauu

SEQ ID NO: 1338033 - RNA, 17 nt, Human
aacaucccuuuuucaau

SEQ ID NO: 1338034 - RNA, 15 nt, Human
aacauccuacaagac

SEQ ID NO: 1338035 - RNA, 22 nt, Human
aacauccuacaagacacaguga

SEQ ID NO: 1338036 - RNA, 18 nt, Human
aacaucuacaaaacauua

SEQ ID NO: 1338037 - RNA, 20 nt, Human
aacaucuacaaaacauuaaa

SEQ ID NO: 1338038 - RNA, 20 nt, Human
aacaggaaacuccugugacc

SEQ ID NO: 1338039 - RNA, 19 nt, Human
aacagcguuccuagagaag

SEQ ID NO: 1338040 - RNA, 23 nt, Human
aacagcguuccuagagaagacag

SEQ ID NO: 1338041 - RNA, 20 nt, Human
aacagcaaaugcaaaaacuc

SEQ ID NO: 1338042 - RNA, 13 nt, Human
aacagcgcccaaa

SEQ ID NO: 1338043 - RNA, 15 nt, Human
aacagauuguuugca

SEQ ID NO: 1338044 - RNA, 16 nt, Human
aacagauuguuugcaa

SEQ ID NO: 1338045 - RNA, 13 nt, Human
aacagauuuggaa

SEQ ID NO: 1338046 - RNA, 14 nt, Human
aacagauuuggaaa

SEQ ID NO: 1338047 - RNA, 15 nt, Human
aacagauuuggaaag

SEQ ID NO: 1338048 - RNA, 17 nt, Human
aacacuaauucauaauc

SEQ ID NO: 1338049 - RNA, 18 nt, Human
aacacuagacaagccaga

SEQ ID NO: 1338050 - RNA, 19 nt, Human
aacacuagacaagccagaa

SEQ ID NO: 1338051 - RNA, 23 nt, Human
aacccuuaaacaguugcacagca

SEQ ID NO: 1338052 - RNA, 18 nt, Human
aacccuuaaacaguugca

SEQ ID NO: 1338053 - RNA, 18 nt, Human
aaccauaacaacuucaua

SEQ ID NO: 1338054 - RNA, 22 nt, Human
aaccauacaaaaauuccuuuuc

SEQ ID NO: 1338055 - RNA, 13 nt, Human
aaccauacugaaa

SEQ ID NO: 1338056 - RNA, 22 nt, Human
aaccauagcacaggcuaauuuu

SEQ ID NO: 1338057 - RNA, 16 nt, Human
aaccagguccaaugag

SEQ ID NO: 1338058 - RNA, 17 nt, Human
aaccagguccaaugagc

SEQ ID NO: 1338059 - RNA, 21 nt, Human
aaccagguccaaugagcuuuc

SEQ ID NO: 1338060 - RNA, 22 nt, Human
aaccagguccaaugagcuuucu

SEQ ID NO: 1338061 - RNA, 21 nt, Human
aacaucugagaaaagcuuuga

SEQ ID NO: 1338062 - RNA, 16 nt, Human
aacaucugaguccugg

SEQ ID NO: 1338063 - RNA, 19 nt, Human
aacaugcuguuauuuaggu

SEQ ID NO: 1338064 - RNA, 23 nt, Human
aacaugcuguuauuuagguauuu

SEQ ID NO: 1338065 - RNA, 22 nt, Human
aacccuuaaacaguugcacagc

SEQ ID NO: 1338066 - RNA, 14 nt, Human
aaccgccagcucug

SEQ ID NO: 1338067 - RNA, 15 nt, Human
aaccgccagcucugu

SEQ ID NO: 1338068 - RNA, 17 nt, Human
aaccgccagcucuguuc

SEQ ID NO: 1338069 - RNA, 22 nt, Human
aaccgccagcucuguucuuccu

SEQ ID NO: 1338070 - RNA, 16 nt, Human
aaccgcuaaaagaaac

SEQ ID NO: 1338071 - RNA, 22 nt, Human
aacucaucuagguaaauuacag

SEQ ID NO: 1338072 - RNA, 21 nt, Human
aacugaagcagccucucccca

SEQ ID NO: 1338073 - RNA, 15 nt, Human
aacucauauuuucau

SEQ ID NO: 1338074 - RNA, 16 nt, Human
aacucauauuuucaug

SEQ ID NO: 1338075 - RNA, 18 nt, Human
aacucauauuuucaugcu

SEQ ID NO: 1338076 - RNA, 12 nt, Human
aacugaaugaga

SEQ ID NO: 1338077 - RNA, 24 nt, Human
aacugaauaccacucuguaauugc

SEQ ID NO: 1338078 - RNA, 15 nt, Human
aacugaauaccacuc

SEQ ID NO: 1338079 - RNA, 17 nt, Human
aacugaauaccacucug

SEQ ID NO: 1338080 - RNA, 18 nt, Human
aacugaauaccacucugu

SEQ ID NO: 1338081 - RNA, 21 nt, Human
aacugaauaccacucuguaau

SEQ ID NO: 1338082 - RNA, 19 nt, Human
aacugaagggggcggccua

SEQ ID NO: 1338083 - RNA, 13 nt, Human
aacugaauaccac

SEQ ID NO: 1338084 - RNA, 14 nt, Human
aacugaauaccacu

SEQ ID NO: 1338085 - RNA, 12 nt, Human
aacugaggaauu

SEQ ID NO: 1338086 - RNA, 13 nt, Human
aacugaggaauuu

SEQ ID NO: 1338087 - RNA, 18 nt, Human
aacugaggaauuucaccu

SEQ ID NO: 1338088 - RNA, 16 nt, Human
aacugaggaauuuucu

SEQ ID NO: 1338089 - RNA, 18 nt, Human
aacugaggaauuuucuuu

SEQ ID NO: 1338090 - RNA, 16 nt, Human
aacgcuaucugggaag

SEQ ID NO: 1338091 - RNA, 16 nt, Human
aacgcuccaaagucau

SEQ ID NO: 1338092 - RNA, 20 nt, Human
aacgcuccaaagucauaauu

SEQ ID NO: 1338093 - RNA, 19 nt, Human
aacgccugagcccagggag

SEQ ID NO: 1338094 - RNA, 13 nt, Human
aacgccugagccc

SEQ ID NO: 1338095 - RNA, 17 nt, Human
aacgccugagcccaggg

SEQ ID NO: 1338096 - RNA, 18 nt, Human
aacgccugagcccaggga

SEQ ID NO: 1338097 - RNA, 15 nt, Human
aacguauaaaagccu

SEQ ID NO: 1338098 - RNA, 13 nt, Human
aacggugcucagg

SEQ ID NO: 1338099 - RNA, 16 nt, Human
aacucaaaauauuugu

SEQ ID NO: 1338100 - RNA, 22 nt, Human
aacucaaacugaggaauuucac

SEQ ID NO: 1338101 - RNA, 18 nt, Human
aacucaaauggggccaga

SEQ ID NO: 1338102 - RNA, 21 nt, Human
aacucaaauggggccagaucc

SEQ ID NO: 1338103 - RNA, 22 nt, Human
aacucaaauggggccagaucca

SEQ ID NO: 1338104 - RNA, 23 nt, Human
aacucaaauggggccagauccag

SEQ ID NO: 1338105 - RNA, 21 nt, Human
aacucaaaugugaguguuuuu

SEQ ID NO: 1338106 - RNA, 16 nt, Human
aacgaaaaugaaagcu

SEQ ID NO: 1338107 - RNA, 16 nt, Human
aacgagacuuuccauu

SEQ ID NO: 1338108 - RNA, 21 nt, Human
aacgagacuuuccauuacaag

SEQ ID NO: 1338109 - RNA, 11 nt, Human
aacgccugagc

SEQ ID NO: 1338110 - RNA, 12 nt, Human
aacgccugagcc

SEQ ID NO: 1338111 - RNA, 21 nt, Human
aaauguuuuuuuuuaaagacu

SEQ ID NO: 1338112 - RNA, 18 nt, Human
aaauguuuuuuuuuaaag

SEQ ID NO: 1338113 - RNA, 13 nt, Human
aaauguucuaagu

SEQ ID NO: 1338114 - RNA, 14 nt, Human
aaauguucuaaguu

SEQ ID NO: 1338115 - RNA, 17 nt, Human
aaauguucuaaguuucu

SEQ ID NO: 1338116 - RNA, 19 nt, Human
aaauguucuaaguuucuaa

SEQ ID NO: 1338117 - RNA, 21 nt, Human
aaauguucuaaguuucuaaga

SEQ ID NO: 1338118 - RNA, 15 nt, Human
aaauguucuguuugc

SEQ ID NO: 1338119 - RNA, 11 nt, Human
aaauguucuuu

SEQ ID NO: 1338120 - RNA, 23 nt, Human
aaauguugaaauaugauguuaaa

SEQ ID NO: 1338121 - RNA, 20 nt, Human
aaauguucaucaaugaauga

SEQ ID NO: 1338122 - RNA, 18 nt, Human
aaauugaugggauuuggu

SEQ ID NO: 1338123 - RNA, 23 nt, Human
aaauugagcuggaccucaccaag

SEQ ID NO: 1338124 - RNA, 15 nt, Human
aacaaacaauaccug

SEQ ID NO: 1338125 - RNA, 18 nt, Human
aacaaacauuugcugaau

SEQ ID NO: 1338126 - RNA, 22 nt, Human
aaauguuuuuuuuuaaagacuu

SEQ ID NO: 1338127 - RNA, 12 nt, Human
aaauuaaaaaag

SEQ ID NO: 1338128 - RNA, 14 nt, Human
aaauuaaaaaagau

SEQ ID NO: 1338129 - RNA, 15 nt, Human
aaauuaaaaaagaua

SEQ ID NO: 1338130 - RNA, 20 nt, Human
aaauuaaaaaagauaaacac

SEQ ID NO: 1338131 - RNA, 16 nt, Human
aaauuaaaaaagauaa

SEQ ID NO: 1338132 - RNA, 20 nt, Human
aaauuaacuggguaaugaaa

SEQ ID NO: 1338133 - RNA, 21 nt, Human
aaauuaacuggguaaugaaac

SEQ ID NO: 1338134 - RNA, 21 nt, Human
aacacccucacacugggacuu

SEQ ID NO: 1338135 - RNA, 17 nt, Human
aacacccucacacuggg

SEQ ID NO: 1338136 - RNA, 16 nt, Human
aacacccuauauuuug

SEQ ID NO: 1338137 - RNA, 16 nt, Human
aacacccauuuuuccu

SEQ ID NO: 1338138 - RNA, 21 nt, Human
aacacccauuuuuccuuuugc

SEQ ID NO: 1338139 - RNA, 16 nt, Human
aacacaucacagauga

SEQ ID NO: 1338140 - RNA, 13 nt, Human
aacaccucccagg

SEQ ID NO: 1338141 - RNA, 23 nt, Human
aacaccucccaggagacaguuca

SEQ ID NO: 1338142 - RNA, 16 nt, Human
aacaccuccucaugua

SEQ ID NO: 1338143 - RNA, 17 nt, Human
aacacccauuuuuccuu

SEQ ID NO: 1338144 - RNA, 18 nt, Human
aacacuaacuaugcaugg

SEQ ID NO: 1338145 - RNA, 13 nt, Human
aacacuaauauau

SEQ ID NO: 1338146 - RNA, 14 nt, Human
aacacuaauauauu

SEQ ID NO: 1338147 - RNA, 20 nt, Human
aacacuaauauauuuaaaaa

SEQ ID NO: 1338148 - RNA, 22 nt, Human
aacacuaauauauuuaaaaaua

SEQ ID NO: 1338149 - RNA, 23 nt, Human
aacacuaauauauuuaaaaauaa

SEQ ID NO: 1338150 - RNA, 14 nt, Human
aacacuaauucaua

SEQ ID NO: 1338151 - RNA, 15 nt, Human
aacacuaauucauaa

SEQ ID NO: 1338152 - RNA, 16 nt, Human
aacacuaauucauaau

SEQ ID NO: 1338153 - RNA, 19 nt, Human
aacaaaugccaaauuaaaa

SEQ ID NO: 1338154 - RNA, 14 nt, Human
aacaaaugaagaca

SEQ ID NO: 1338155 - RNA, 17 nt, Human
aacaaaugccaaauuaa

SEQ ID NO: 1338156 - RNA, 23 nt, Human
aacaaaugccaaauuaaaaaaga

SEQ ID NO: 1338157 - RNA, 12 nt, Human
aacaaaugaaga

SEQ ID NO: 1338158 - RNA, 20 nt, Human
aacaaacucguuuuuuacaa

SEQ ID NO: 1338159 - RNA, 16 nt, Human
aacaaacucguuuuuu

SEQ ID NO: 1338160 - RNA, 16 nt, Human
aacaaagguugagaug

SEQ ID NO: 1338161 - RNA, 16 nt, Human
aacaaauagucuauca

SEQ ID NO: 1338162 - RNA, 22 nt, Human
aaaucugcuggaguuucaugua

SEQ ID NO: 1338163 - RNA, 19 nt, Human
aaaucugccacaaaaacag

SEQ ID NO: 1338164 - RNA, 20 nt, Human
aaaucugcuggaguuucaug

SEQ ID NO: 1338165 - RNA, 18 nt, Human
aaaucugacccagugccc

SEQ ID NO: 1338166 - RNA, 11 nt, Human
aaaucugccac

SEQ ID NO: 1338167 - RNA, 19 nt, Human
aaaucugugccugagaaca

SEQ ID NO: 1338168 - RNA, 13 nt, Human
aaaucugcuugua

SEQ ID NO: 1338169 - RNA, 15 nt, Human
aaaugcuagguucua

SEQ ID NO: 1338170 - RNA, 16 nt, Human
aaaugcuagguucuac

SEQ ID NO: 1338171 - RNA, 18 nt, Human
aaaugcuagguucuaccu

SEQ ID NO: 1338172 - RNA, 16 nt, Human
aaaucucccauuuugg

SEQ ID NO: 1338173 - RNA, 21 nt, Human
aaaucucccauuuuggaauuu

SEQ ID NO: 1338174 - RNA, 18 nt, Human
aaaucucccauuuuggaa

SEQ ID NO: 1338175 - RNA, 20 nt, Human
aaaucucccauuuuggaauu

SEQ ID NO: 1338176 - RNA, 13 nt, Human
aaaucucuccacu

SEQ ID NO: 1338177 - RNA, 17 nt, Human
aaaucucuccacuuuca

SEQ ID NO: 1338178 - RNA, 19 nt, Human
aaaucucuccacuuucagc

SEQ ID NO: 1338179 - RNA, 20 nt, Human
aaaucucuccacuuucagcu

SEQ ID NO: 1338180 - RNA, 21 nt, Human
aaaucucuccacuuucagcug

SEQ ID NO: 1338181 - RNA, 23 nt, Human
aaaucucuccacuuucagcuguc

SEQ ID NO: 1338182 - RNA, 14 nt, Human
aaaucugacccagu

SEQ ID NO: 1338183 - RNA, 20 nt, Human
aaaucugacccagugccccc

SEQ ID NO: 1338184 - RNA, 23 nt, Human
aaaugcucuuauuucaucauuca

SEQ ID NO: 1338185 - RNA, 19 nt, Human
aaaugcucuuauuucauca

SEQ ID NO: 1338186 - RNA, 18 nt, Human
agaggaauuacgugcucu

SEQ ID NO: 1338187 - RNA, 23 nt, Human
agaggagggagcaucagugcccu

SEQ ID NO: 1338188 - RNA, 11 nt, Human
agagggcugga

SEQ ID NO: 1338189 - RNA, 12 nt, Human
agagggcuggag

SEQ ID NO: 1338190 - RNA, 17 nt, Human
agagggcuggaggccca

SEQ ID NO: 1338191 - RNA, 18 nt, Human
agagggcuggaggcccag

SEQ ID NO: 1338192 - RNA, 19 nt, Human
agagggcuggaggcccagg

SEQ ID NO: 1338193 - RNA, 14 nt, Human
agagggggcuggug

SEQ ID NO: 1338194 - RNA, 19 nt, Human
agagggggcuggugggugc

SEQ ID NO: 1338195 - RNA, 16 nt, Human
agagggggcugguggg

SEQ ID NO: 1338196 - RNA, 10 nt, Human
agagggcugc

SEQ ID NO: 1338197 - RNA, 14 nt, Human
agagggcgcaggcc

SEQ ID NO: 1338198 - RNA, 16 nt, Human
agagggcgcaggccgu

SEQ ID NO: 1338199 - RNA, 20 nt, Human
agagggcucgaggggugggc

SEQ ID NO: 1338200 - RNA, 13 nt, Human
agaggaaugaagu

SEQ ID NO: 1338201 - RNA, 23 nt, Human
agaggaaggggccagaggcucgu

SEQ ID NO: 1338202 - RNA, 18 nt, Human
agaggaaggggccagagg

SEQ ID NO: 1338203 - RNA, 20 nt, Human
agaggaaggggccagaggcu

SEQ ID NO: 1338204 - RNA, 15 nt, Human
agacgcugcugucac

SEQ ID NO: 1338205 - RNA, 14 nt, Human
agacgccuggcugc

SEQ ID NO: 1338206 - RNA, 15 nt, Human
agacgccuggcugcu

SEQ ID NO: 1338207 - RNA, 18 nt, Human
agacgccuuucuccucca

SEQ ID NO: 1338208 - RNA, 14 nt, Human
agacucuuuaugcu

SEQ ID NO: 1338209 - RNA, 14 nt, Human
agacugacgccagg

SEQ ID NO: 1338210 - RNA, 18 nt, Human
agacucugucucagucca

SEQ ID NO: 1338211 - RNA, 17 nt, Human
agacucuugccuguuuc

SEQ ID NO: 1338212 - RNA, 18 nt, Human
agacucuugccuguuucc

SEQ ID NO: 1338213 - RNA, 22 nt, Human
agacucuugccuguuucccagg

SEQ ID NO: 1338214 - RNA, 16 nt, Human
agacugcuguggccag

SEQ ID NO: 1338215 - RNA, 17 nt, Human
agacugcuguggccagg

SEQ ID NO: 1338216 - RNA, 18 nt, Human
agacugcuguggccagga

SEQ ID NO: 1338217 - RNA, 19 nt, Human
agacugcuguggccaggag

SEQ ID NO: 1338218 - RNA, 20 nt, Human
agacugcuguggccaggagg

SEQ ID NO: 1338219 - RNA, 21 nt, Human
agacugcuguggccaggaggu

SEQ ID NO: 1338220 - RNA, 19 nt, Human
agacugcuuccaauuuucu

SEQ ID NO: 1338221 - RNA, 18 nt, Human
agacuggaacacuagaca

SEQ ID NO: 1338222 - RNA, 13 nt, Human
agacuggaacuug

SEQ ID NO: 1338223 - RNA, 17 nt, Human
agacuggaacuugaacu

SEQ ID NO: 1338224 - RNA, 18 nt, Human
agacuggaacuugaacug

SEQ ID NO: 1338225 - RNA, 15 nt, Human
agacuggaacacuag

SEQ ID NO: 1338226 - RNA, 21 nt, Human
agacuggaagcuaauuugcau

SEQ ID NO: 1338227 - RNA, 23 nt, Human
agacuggaacuugaacugauuca

SEQ ID NO: 1338228 - RNA, 11 nt, Human
agacuggacag

SEQ ID NO: 1338229 - RNA, 13 nt, Human
agacuggacagcu

SEQ ID NO: 1338230 - RNA, 14 nt, Human
agacuggacagcuu

SEQ ID NO: 1338231 - RNA, 15 nt, Human
agacuggacagcuug

SEQ ID NO: 1338232 - RNA, 16 nt, Human
agacuggacagcuugu

SEQ ID NO: 1338233 - RNA, 17 nt, Human
agacuggacagcuugug

SEQ ID NO: 1338234 - RNA, 14 nt, Human
agagagagagggcc

SEQ ID NO: 1338235 - RNA, 23 nt, Human
agagagagggccugcuggagagc

SEQ ID NO: 1338236 - RNA, 14 nt, Human
agagaggccuuuug

SEQ ID NO: 1338237 - RNA, 20 nt, Human
agagaggccuuuuggaaugu

SEQ ID NO: 1338238 - RNA, 20 nt, Human
agagccuccuuucuggcuuu

SEQ ID NO: 1338239 - RNA, 11 nt, Human
agagccugagg

SEQ ID NO: 1338240 - RNA, 22 nt, Human
agagccaugucuucucccugga

SEQ ID NO: 1338241 - RNA, 19 nt, Human
agagccaugucuucucccu

SEQ ID NO: 1338242 - RNA, 22 nt, Human
agagccggggugggguggcugc

SEQ ID NO: 1338243 - RNA, 23 nt, Human
agagccggggugggguggcugca

SEQ ID NO: 1338244 - RNA, 18 nt, Human
agagccggguguccccaa

SEQ ID NO: 1338245 - RNA, 17 nt, Human
agaagagaucaggaaga

SEQ ID NO: 1338246 - RNA, 22 nt, Human
agaaggugggaggaugugaauu

SEQ ID NO: 1338247 - RNA, 14 nt, Human
agaaggugggagga

SEQ ID NO: 1338248 - RNA, 18 nt, Human
agaagucacauuccugaa

SEQ ID NO: 1338249 - RNA, 20 nt, Human
agaagucacauuccugaaca

SEQ ID NO: 1338250 - RNA, 21 nt, Human
agaagucacauuccugaacag

SEQ ID NO: 1338251 - RNA, 17 nt, Human
agaaguagaaaucauag

SEQ ID NO: 1338252 - RNA, 15 nt, Human
agaaguauaaagaau

SEQ ID NO: 1338253 - RNA, 16 nt, Human
agaaguauaaagaauu

SEQ ID NO: 1338254 - RNA, 19 nt, Human
agaaguauaaagaauugug

SEQ ID NO: 1338255 - RNA, 13 nt, Human
agaaguauacaua

SEQ ID NO: 1338256 - RNA, 22 nt, Human
agaaguaaaagcaaaaaagaaa

SEQ ID NO: 1338257 - RNA, 15 nt, Human
agaaguaaaagcaaa

SEQ ID NO: 1338258 - RNA, 14 nt, Human
agaaguaccagacu

SEQ ID NO: 1338259 - RNA, 16 nt, Human
agaaguaccagacuag

SEQ ID NO: 1338260 - RNA, 18 nt, Human
agaagguuucagaaagaa

SEQ ID NO: 1338261 - RNA, 16 nt, Human
agaagguugcucuaga

SEQ ID NO: 1338262 - RNA, 20 nt, Human
agaagguugcucuagauuga

SEQ ID NO: 1338263 - RNA, 18 nt, Human
agaagacugcauuauauu

SEQ ID NO: 1338264 - RNA, 17 nt, Human
agaagaccugagaaugu

SEQ ID NO: 1338265 - RNA, 21 nt, Human
acuuuccucuuagucgagcca

SEQ ID NO: 1338266 - RNA, 13 nt, Human
acuuucccuaccc

SEQ ID NO: 1338267 - RNA, 15 nt, Human
acuuuccauuacaag

SEQ ID NO: 1338268 - RNA, 17 nt, Human
acuuuccauuacaagua

SEQ ID NO: 1338269 - RNA, 21 nt, Human
acuuuccauuacaaguauuuu

SEQ ID NO: 1338270 - RNA, 17 nt, Human
acuuuccccaccagaug

SEQ ID NO: 1338271 - RNA, 19 nt, Human
acuuuccccaccagaugcu

SEQ ID NO: 1338272 - RNA, 20 nt, Human
acuuuccccaccagaugcug

SEQ ID NO: 1338273 - RNA, 21 nt, Human
acuuuccccaccagaugcuga

SEQ ID NO: 1338274 - RNA, 21 nt, Human
acuuucccuacccucuagaga

SEQ ID NO: 1338275 - RNA, 23 nt, Human
acuuuccccaccagaugcugaaa

SEQ ID NO: 1338276 - RNA, 19 nt, Human
acuuuccuccugaggcuuu

SEQ ID NO: 1338277 - RNA, 15 nt, Human
agaagacaauugaca

SEQ ID NO: 1338278 - RNA, 18 nt, Human
agaagacaggcuggaaga

SEQ ID NO: 1338279 - RNA, 13 nt, Human
agaagacaggcug

SEQ ID NO: 1338280 - RNA, 22 nt, Human
agaagucacauuccugaacagg

SEQ ID NO: 1338281 - RNA, 15 nt, Human
agaagucaucuugcu

SEQ ID NO: 1338282 - RNA, 16 nt, Human
agaagucaucuugcua

SEQ ID NO: 1338283 - RNA, 22 nt, Human
agaagucaucuugcuaccagua

SEQ ID NO: 1338284 - RNA, 21 nt, Human
agaagugaaaaucuacacucc

SEQ ID NO: 1338285 - RNA, 15 nt, Human
agaagugaagaaugc

SEQ ID NO: 1338286 - RNA, 16 nt, Human
agaagugaaugcuggg

SEQ ID NO: 1338287 - RNA, 17 nt, Human
agaagugaaugcuggga

SEQ ID NO: 1338288 - RNA, 19 nt, Human
agaagugaaugcugggacu

SEQ ID NO: 1338289 - RNA, 21 nt, Human
agaagugaaugcugggacuca

SEQ ID NO: 1338290 - RNA, 17 nt, Human
agaaugagagacacacu

SEQ ID NO: 1338291 - RNA, 22 nt, Human
agaaugagagacacacugaaga

SEQ ID NO: 1338292 - RNA, 14 nt, Human
agaaugagacaucc

SEQ ID NO: 1338293 - RNA, 18 nt, Human
agaauggcuuuggucucu

SEQ ID NO: 1338294 - RNA, 23 nt, Human
agaauggcuuuggucucuugcuu

SEQ ID NO: 1338295 - RNA, 13 nt, Human
agaaugauuucau

SEQ ID NO: 1338296 - RNA, 14 nt, Human
agaaugauuucaug

SEQ ID NO: 1338297 - RNA, 13 nt, Human
agaaugcuguaca

SEQ ID NO: 1338298 - RNA, 14 nt, Human
agaaugcuguacau

SEQ ID NO: 1338299 - RNA, 15 nt, Human
agaaugcuguacauc

SEQ ID NO: 1338300 - RNA, 20 nt, Human
agaaugcuguacaucuauuu

SEQ ID NO: 1338301 - RNA, 20 nt, Human
agaaugcuuaaucagauaga

SEQ ID NO: 1338302 - RNA, 14 nt, Human
agaaugcuuaauca

SEQ ID NO: 1338303 - RNA, 19 nt, Human
agaauggaucacaagaugg

SEQ ID NO: 1338304 - RNA, 16 nt, Human
agaauggcagaaaagu

SEQ ID NO: 1338305 - RNA, 20 nt, Human
agaauggaucacaagaugga

SEQ ID NO: 1338306 - RNA, 22 nt, Human
agacagccaacuauggccugug

SEQ ID NO: 1338307 - RNA, 14 nt, Human
agaccacugccaua

SEQ ID NO: 1338308 - RNA, 15 nt, Human
agacagaggcccuca

SEQ ID NO: 1338309 - RNA, 16 nt, Human
agacagaggcccucaa

SEQ ID NO: 1338310 - RNA, 18 nt, Human
agacagaggcccucaagu

SEQ ID NO: 1338311 - RNA, 19 nt, Human
agacccaaaaggcagaagc

SEQ ID NO: 1338312 - RNA, 15 nt, Human
agaccagcagacaga

SEQ ID NO: 1338313 - RNA, 16 nt, Human
agaccagcagacagag

SEQ ID NO: 1338314 - RNA, 21 nt, Human
agaccagcagacagagccagg

SEQ ID NO: 1338315 - RNA, 20 nt, Human
agaccagcagacagagccag

SEQ ID NO: 1338316 - RNA, 17 nt, Human
agacccagcccucaucc

SEQ ID NO: 1338317 - RNA, 18 nt, Human
agacccagcccucauccc

SEQ ID NO: 1338318 - RNA, 19 nt, Human
agacccagcccucaucccg

SEQ ID NO: 1338319 - RNA, 14 nt, Human
agacccagcggaca

SEQ ID NO: 1338320 - RNA, 23 nt, Human
agacgcacuuuggcuuauaauuc

SEQ ID NO: 1338321 - RNA, 13 nt, Human
agacgccugagga

SEQ ID NO: 1338322 - RNA, 15 nt, Human
agacgccugaggaac

SEQ ID NO: 1338323 - RNA, 13 nt, Human
agacgccuggcug

SEQ ID NO: 1338324 - RNA, 19 nt, Human
agacaaacaccucccagga

SEQ ID NO: 1338325 - RNA, 15 nt, Human
agacaaacuuugcau

SEQ ID NO: 1338326 - RNA, 18 nt, Human
agacaaagguuuuccucu

SEQ ID NO: 1338327 - RNA, 21 nt, Human
agacaaacuuugcaucucagu

SEQ ID NO: 1338328 - RNA, 19 nt, Human
agacaaauagaaaaugguc

SEQ ID NO: 1338329 - RNA, 21 nt, Human
agauguagccccucuccugga

SEQ ID NO: 1338330 - RNA, 13 nt, Human
agauucucaaagg

SEQ ID NO: 1338331 - RNA, 19 nt, Human
agauucucauaacuugaga

SEQ ID NO: 1338332 - RNA, 17 nt, Human
agauucucccuugcucu

SEQ ID NO: 1338333 - RNA, 14 nt, Human
agauucucuaugua

SEQ ID NO: 1338334 - RNA, 21 nt, Human
agauucucuggcuguaaggcu

SEQ ID NO: 1338335 - RNA, 20 nt, Human
agauucucauaacuugagac

SEQ ID NO: 1338336 - RNA, 23 nt, Human
agauucucuggcuguaaggcucu

SEQ ID NO: 1338337 - RNA, 16 nt, Human
agauucucugugucua

SEQ ID NO: 1338338 - RNA, 17 nt, Human
agauucucugugucuaa

SEQ ID NO: 1338339 - RNA, 12 nt, Human
agauucuugcau

SEQ ID NO: 1338340 - RNA, 19 nt, Human
agauucugccuuugccagg

SEQ ID NO: 1338341 - RNA, 19 nt, Human
agauucucugugucuaaga

SEQ ID NO: 1338342 - RNA, 20 nt, Human
agauucucugugucuaagau

SEQ ID NO: 1338343 - RNA, 22 nt, Human
agauucucugugucuaagauuc

SEQ ID NO: 1338344 - RNA, 23 nt, Human
agauucucugugucuaagauucu

SEQ ID NO: 1338345 - RNA, 14 nt, Human
agauucugauuuua

SEQ ID NO: 1338346 - RNA, 13 nt, Human
agauucugccuuu

SEQ ID NO: 1338347 - RNA, 19 nt, Human
agauguagaggagaaacug

SEQ ID NO: 1338348 - RNA, 17 nt, Human
agauguaaaagguauua

SEQ ID NO: 1338349 - RNA, 19 nt, Human
agaugaaguuuuacauugu

SEQ ID NO: 1338350 - RNA, 14 nt, Human
agaugauaaagaga

SEQ ID NO: 1338351 - RNA, 16 nt, Human
agaugauaaagagaca

SEQ ID NO: 1338352 - RNA, 18 nt, Human
agaugauaaagagacagu

SEQ ID NO: 1338353 - RNA, 16 nt, Human
agaugauacauccaaa

SEQ ID NO: 1338354 - RNA, 20 nt, Human
agaugauacauccaaagcag

SEQ ID NO: 1338355 - RNA, 11 nt, Human
agaugguggau

SEQ ID NO: 1338356 - RNA, 14 nt, Human
agaugguggcagua

SEQ ID NO: 1338357 - RNA, 13 nt, Human
agaucuggaaccu

SEQ ID NO: 1338358 - RNA, 14 nt, Human
agaucuggaaccuc

SEQ ID NO: 1338359 - RNA, 15 nt, Human
agaucuggaaccuca

SEQ ID NO: 1338360 - RNA, 17 nt, Human
agaucuggaaccucagc

SEQ ID NO: 1338361 - RNA, 19 nt, Human
agaucuggaaccucagccu

SEQ ID NO: 1338362 - RNA, 20 nt, Human
agaucuggaaccucagccug

SEQ ID NO: 1338363 - RNA, 13 nt, Human
agaucuggcaugu

SEQ ID NO: 1338364 - RNA, 14 nt, Human
agaucuguccucag

SEQ ID NO: 1338365 - RNA, 18 nt, Human
agaugaaauuccauuugu

SEQ ID NO: 1338366 - RNA, 17 nt, Human
agaugaaauuccauuug

SEQ ID NO: 1338367 - RNA, 18 nt, Human
agaucuguccucagccuu

SEQ ID NO: 1338368 - RNA, 15 nt, Human
agaucuguccucagc

SEQ ID NO: 1338369 - RNA, 17 nt, Human
agaucuguccucagccu

SEQ ID NO: 1338370 - RNA, 16 nt, Human
agaugaaggagaggca

SEQ ID NO: 1338371 - RNA, 19 nt, Human
agaucuguccucagccuug

SEQ ID NO: 1338372 - RNA, 15 nt, Human
agaugaaguuuuaca

SEQ ID NO: 1338373 - RNA, 20 nt, Human
agagugauagucuuuugcuu

SEQ ID NO: 1338374 - RNA, 22 nt, Human
agagugauagucuuuugcuuuu

SEQ ID NO: 1338375 - RNA, 21 nt, Human
agagugcuguccgguggagau

SEQ ID NO: 1338376 - RNA, 24 nt, Human
agcaaaauuuuuucucuaggaaau

SEQ ID NO: 1338377 - RNA, 21 nt, Human
agcaaaauaauuuuaaacaaa

SEQ ID NO: 1338378 - RNA, 13 nt, Human
agauugaccugga

SEQ ID NO: 1338379 - RNA, 14 nt, Human
agcaaaagaagaag

SEQ ID NO: 1338380 - RNA, 17 nt, Human
agcaaaagaauggcaga

SEQ ID NO: 1338381 - RNA, 21 nt, Human
agcaaaagaauggcagaaaag

SEQ ID NO: 1338382 - RNA, 13 nt, Human
agcaaaccuguaa

SEQ ID NO: 1338383 - RNA, 15 nt, Human
agcaaagcccccaga

SEQ ID NO: 1338384 - RNA, 16 nt, Human
agcaaagcccccagag

SEQ ID NO: 1338385 - RNA, 17 nt, Human
agcaaagcccccagagc

SEQ ID NO: 1338386 - RNA, 21 nt, Human
agcaaagcccccagagcccag

SEQ ID NO: 1338387 - RNA, 22 nt, Human
agcaaagcccccagagcccagg

SEQ ID NO: 1338388 - RNA, 20 nt, Human
agauugaaccugaauauugc

SEQ ID NO: 1338389 - RNA, 23 nt, Human
agauugaccuggauggggcaggc

SEQ ID NO: 1338390 - RNA, 12 nt, Human
agcaaagccugu

SEQ ID NO: 1338391 - RNA, 21 nt, Human
agcaaagccuguucauggcag

SEQ ID NO: 1338392 - RNA, 22 nt, Human
agcaaagccuguucauggcaga

SEQ ID NO: 1338393 - RNA, 20 nt, Human
agcaaaucgaaugaaauuaa

SEQ ID NO: 1338394 - RNA, 22 nt, Human
agcaaaucgaaugaaauuaacu

SEQ ID NO: 1338395 - RNA, 13 nt, Human
agcaaaugcaaaa

SEQ ID NO: 1338396 - RNA, 14 nt, Human
agcaaaugcaaaaa

SEQ ID NO: 1338397 - RNA, 22 nt, Human
agcaaaugcaaaaacucuuuga

SEQ ID NO: 1338398 - RNA, 15 nt, Human
agcaaauggccucau

SEQ ID NO: 1338399 - RNA, 20 nt, Human
agcaaauggccucaugucaa

SEQ ID NO: 1338400 - RNA, 17 nt, Human
agcaaaugucuuccugg

SEQ ID NO: 1338401 - RNA, 20 nt, Human
agcaaaugucuuccuggauu

SEQ ID NO: 1338402 - RNA, 16 nt, Human
agcaaauguggcuccu

SEQ ID NO: 1338403 - RNA, 19 nt, Human
agcaaaugucaugcugccu

SEQ ID NO: 1338404 - RNA, 20 nt, Human
agcaaaugucaugcugccuu

SEQ ID NO: 1338405 - RNA, 21 nt, Human
agcaaaugucaugcugccuua

SEQ ID NO: 1338406 - RNA, 21 nt, Human
agcaauuacaacggagucaaa

SEQ ID NO: 1338407 - RNA, 18 nt, Human
agcacaaagacccuggcu

SEQ ID NO: 1338408 - RNA, 19 nt, Human
agcacaaagacccuggcuu

SEQ ID NO: 1338409 - RNA, 19 nt, Human
agcacaaauuaguuauaua

SEQ ID NO: 1338410 - RNA, 21 nt, Human
agcacaaguguaaugaauacc

SEQ ID NO: 1338411 - RNA, 17 nt, Human
agcacaaguuauuuaaa

SEQ ID NO: 1338412 - RNA, 18 nt, Human
agcacaaguuauuuaaau

SEQ ID NO: 1338413 - RNA, 19 nt, Human
agcacaaguuauuuaaauc

SEQ ID NO: 1338414 - RNA, 13 nt, Human
agcacaaauuagu

SEQ ID NO: 1338415 - RNA, 21 nt, Human
agcacaaguuauuuaaaucug

SEQ ID NO: 1338416 - RNA, 17 nt, Human
agcacaauaaauggcug

SEQ ID NO: 1338417 - RNA, 18 nt, Human
agcacaauaaauggcugu

SEQ ID NO: 1338418 - RNA, 15 nt, Human
agcaauccucccacu

SEQ ID NO: 1338419 - RNA, 16 nt, Human
agcaaucugacccuau

SEQ ID NO: 1338420 - RNA, 14 nt, Human
agcacacagggcag

SEQ ID NO: 1338421 - RNA, 15 nt, Human
agcacggcucugucc

SEQ ID NO: 1338422 - RNA, 20 nt, Human
agcacggcucuguccccagc

SEQ ID NO: 1338423 - RNA, 20 nt, Human
agcacuguuuucuaguguau

SEQ ID NO: 1338424 - RNA, 21 nt, Human
agcacggcucuguccccagcc

SEQ ID NO: 1338425 - RNA, 22 nt, Human
agcacuguuuucuaguguauca

SEQ ID NO: 1338426 - RNA, 15 nt, Human
agcacuuauuuaaug

SEQ ID NO: 1338427 - RNA, 22 nt, Human
agcacuugcaaccgucuguuau

SEQ ID NO: 1338428 - RNA, 15 nt, Human
agcacuucuuuuucu

SEQ ID NO: 1338429 - RNA, 17 nt, Human
agcagccucgccccugg

SEQ ID NO: 1338430 - RNA, 20 nt, Human
agcagccucgccccuggcag

SEQ ID NO: 1338431 - RNA, 21 nt, Human
agcagccucgccccuggcaga

SEQ ID NO: 1338432 - RNA, 22 nt, Human
agcagccucgccccuggcagag

SEQ ID NO: 1338433 - RNA, 15 nt, Human
agcagccucucccca

SEQ ID NO: 1338434 - RNA, 18 nt, Human
agcagccucuccccaggu

SEQ ID NO: 1338435 - RNA, 20 nt, Human
agcagccucuccccaggucc

SEQ ID NO: 1338436 - RNA, 21 nt, Human
agcagccucuccccaggucca

SEQ ID NO: 1338437 - RNA, 23 nt, Human
agcagccucgccccuggcagaga

SEQ ID NO: 1338438 - RNA, 13 nt, Human
agcagccugagca

SEQ ID NO: 1338439 - RNA, 19 nt, Human
agcagccugagcaacucuu

SEQ ID NO: 1338440 - RNA, 12 nt, Human
agcagcuuccag

SEQ ID NO: 1338441 - RNA, 14 nt, Human
agcagcuuccagau

SEQ ID NO: 1338442 - RNA, 16 nt, Human
agcagcuuccagauug

SEQ ID NO: 1338443 - RNA, 23 nt, Human
agcccuccaucuaaacugccccc

SEQ ID NO: 1338444 - RNA, 12 nt, Human
agcccucccugc

SEQ ID NO: 1338445 - RNA, 13 nt, Human
agcccucccugcc

SEQ ID NO: 1338446 - RNA, 14 nt, Human
agccccacccaggc

SEQ ID NO: 1338447 - RNA, 22 nt, Human
agccccacaccagggccagccu

SEQ ID NO: 1338448 - RNA, 23 nt, Human
agccccacaccagggccagccuc

SEQ ID NO: 1338449 - RNA, 23 nt, Human
agcaggaaaugaaaaugucuugu

SEQ ID NO: 1338450 - RNA, 21 nt, Human
agcagcuuuagaaucccagcc

SEQ ID NO: 1338451 - RNA, 15 nt, Human
agcaggaaaugaaaa

SEQ ID NO: 1338452 - RNA, 21 nt, Human
agcaggaaaugaaaaugucuu

SEQ ID NO: 1338453 - RNA, 19 nt, Human
agcccacgacacugcagcc

SEQ ID NO: 1338454 - RNA, 20 nt, Human
agcccacgacacugcagccc

SEQ ID NO: 1338455 - RNA, 18 nt, Human
agcccacgcucacccccu

SEQ ID NO: 1338456 - RNA, 16 nt, Human
agcccacuccaucugg

SEQ ID NO: 1338457 - RNA, 21 nt, Human
agcccacuccaucugguagaa

SEQ ID NO: 1338458 - RNA, 16 nt, Human
agcccaaugaaaugaa

SEQ ID NO: 1338459 - RNA, 21 nt, Human
agcccaccauuuggcaucccu

SEQ ID NO: 1338460 - RNA, 22 nt, Human
agcccaccauuuggcaucccug

SEQ ID NO: 1338461 - RNA, 21 nt, Human
agccaaaccucaccaacuccu

SEQ ID NO: 1338462 - RNA, 11 nt, Human
agccaaagagu

SEQ ID NO: 1338463 - RNA, 15 nt, Human
agccaagcucugcag

SEQ ID NO: 1338464 - RNA, 19 nt, Human
agccaaggagucacugaga

SEQ ID NO: 1338465 - RNA, 21 nt, Human
agccaaggagucacugagacc

SEQ ID NO: 1338466 - RNA, 16 nt, Human
agccaagcucugcagu

SEQ ID NO: 1338467 - RNA, 20 nt, Human
agccaaggagucacugagac

SEQ ID NO: 1338468 - RNA, 21 nt, Human
agcuuuuaugugaaacauguu

SEQ ID NO: 1338469 - RNA, 15 nt, Human
agcuuuuaugugaaa

SEQ ID NO: 1338470 - RNA, 22 nt, Human
aggaaauucuuucccagucugu

SEQ ID NO: 1338471 - RNA, 13 nt, Human
aggaacaaacagg

SEQ ID NO: 1338472 - RNA, 14 nt, Human
aggaacaaacaggg

SEQ ID NO: 1338473 - RNA, 21 nt, Human
aggaaccaacaaucuuccugu

SEQ ID NO: 1338474 - RNA, 13 nt, Human
aggaaccaacaau

SEQ ID NO: 1338475 - RNA, 16 nt, Human
aggaaccgaggcaggg

SEQ ID NO: 1338476 - RNA, 19 nt, Human
aggaacccuuacaguagga

SEQ ID NO: 1338477 - RNA, 23 nt, Human
aggaaguugacuuauaguacaug

SEQ ID NO: 1338478 - RNA, 22 nt, Human
aggaaguugacuuauaguacau

SEQ ID NO: 1338479 - RNA, 18 nt, Human
aggaaguugacuuauagu

SEQ ID NO: 1338480 - RNA, 19 nt, Human
aggaauaaauugcuccuug

SEQ ID NO: 1338481 - RNA, 20 nt, Human
aggaauaaauugcuccuuga

SEQ ID NO: 1338482 - RNA, 17 nt, Human
aggaauacugaacaucu

SEQ ID NO: 1338483 - RNA, 22 nt, Human
aggaaggcugagaggagagaga

SEQ ID NO: 1338484 - RNA, 19 nt, Human
aggaaggcuuguugugcuu

SEQ ID NO: 1338485 - RNA, 22 nt, Human
aggaaggcuuguugugcuuuua

SEQ ID NO: 1338486 - RNA, 21 nt, Human
aggaaggcuuguugugcuuuu

SEQ ID NO: 1338487 - RNA, 16 nt, Human
aggaaggggccagagg

SEQ ID NO: 1338488 - RNA, 18 nt, Human
aggaaggggccagaggcu

SEQ ID NO: 1338489 - RNA, 20 nt, Human
aggaaggggccagaggcucg

SEQ ID NO: 1338490 - RNA, 20 nt, Human
aggaagggguuggauugcaa

SEQ ID NO: 1338491 - RNA, 14 nt, Human
aggaaguaggaagu

SEQ ID NO: 1338492 - RNA, 15 nt, Human
aggaaguaggaagua

SEQ ID NO: 1338493 - RNA, 18 nt, Human
aggaagucaaagcaagga

SEQ ID NO: 1338494 - RNA, 16 nt, Human
aggaagucucaucugg

SEQ ID NO: 1338495 - RNA, 19 nt, Human
aggaagucucaucugggga

SEQ ID NO: 1338496 - RNA, 20 nt, Human
aggaagucucaucuggggag

SEQ ID NO: 1338497 - RNA, 18 nt, Human
agcuucacuguaaaauaa

SEQ ID NO: 1338498 - RNA, 18 nt, Human
agcuucacaguacccaaa

SEQ ID NO: 1338499 - RNA, 19 nt, Human
agcuucauggcagaaggca

SEQ ID NO: 1338500 - RNA, 16 nt, Human
agcuuuuaaacccuau

SEQ ID NO: 1338501 - RNA, 16 nt, Human
agcuuuuaaaagauuu

SEQ ID NO: 1338502 - RNA, 19 nt, Human
agcuucugagacgucauga

SEQ ID NO: 1338503 - RNA, 15 nt, Human
agcuucugcccccug

SEQ ID NO: 1338504 - RNA, 19 nt, Human
agcuucugcccccugcaga

SEQ ID NO: 1338505 - RNA, 17 nt, Human
agcuucugcccccugca

SEQ ID NO: 1338506 - RNA, 12 nt, Human
agcuucugagac

SEQ ID NO: 1338507 - RNA, 13 nt, Human
agcuucugagacg

SEQ ID NO: 1338508 - RNA, 22 nt, Human
agcuguaaacuuccaauuucua

SEQ ID NO: 1338509 - RNA, 21 nt, Human
aggacccggaggggccuggca

SEQ ID NO: 1338510 - RNA, 22 nt, Human
aggacccggaggggccuggcag

SEQ ID NO: 1338511 - RNA, 16 nt, Human
aggaccagucccagag

SEQ ID NO: 1338512 - RNA, 15 nt, Human
aggacccugaagggg

SEQ ID NO: 1338513 - RNA, 19 nt, Human
aggacccugaaggggccau

SEQ ID NO: 1338514 - RNA, 18 nt, Human
aggaccugaaauuccaaa

SEQ ID NO: 1338515 - RNA, 20 nt, Human
aggaccugaaauuccaaagu

SEQ ID NO: 1338516 - RNA, 16 nt, Human
aggaccugagaccuga

SEQ ID NO: 1338517 - RNA, 12 nt, Human
aggaccugagcc

SEQ ID NO: 1338518 - RNA, 13 nt, Human
aggaccugagccu

SEQ ID NO: 1338519 - RNA, 14 nt, Human
aggaccugagccug

SEQ ID NO: 1338520 - RNA, 15 nt, Human
aggaccugagccugc

SEQ ID NO: 1338521 - RNA, 16 nt, Human
aggaccugagccugcc

SEQ ID NO: 1338522 - RNA, 17 nt, Human
aggaccugagccugccg

SEQ ID NO: 1338523 - RNA, 18 nt, Human
aggaccugagccugccga

SEQ ID NO: 1338524 - RNA, 18 nt, Human
aggacccggaggggccug

SEQ ID NO: 1338525 - RNA, 20 nt, Human
aggacccggaggggccuggc

SEQ ID NO: 1338526 - RNA, 19 nt, Human
aggaccagucaaccugggc

SEQ ID NO: 1338527 - RNA, 20 nt, Human
aggaccagucaaccugggca

SEQ ID NO: 1338528 - RNA, 17 nt, Human
aggaccagucccagagc

SEQ ID NO: 1338529 - RNA, 21 nt, Human
aggaccugagccugccgagca

SEQ ID NO: 1338530 - RNA, 19 nt, Human
aggaccugagccugccgag

SEQ ID NO: 1338531 - RNA, 13 nt, Human
aggaccuggcugc

SEQ ID NO: 1338532 - RNA, 16 nt, Human
aggaccuggcugccau

SEQ ID NO: 1338533 - RNA, 17 nt, Human
aggaccuggcugccaua

SEQ ID NO: 1338534 - RNA, 20 nt, Human
aggagacuguuuggaaauug

SEQ ID NO: 1338535 - RNA, 14 nt, Human
aggagagacacugg

SEQ ID NO: 1338536 - RNA, 14 nt, Human
aggagagaguugaa

SEQ ID NO: 1338537 - RNA, 24 nt, Human
aggaccagcucaggacagaugcca

SEQ ID NO: 1338538 - RNA, 20 nt, Human
aggaaucaucaggaacguuu

SEQ ID NO: 1338539 - RNA, 18 nt, Human
aggaauagcaugucacua

SEQ ID NO: 1338540 - RNA, 15 nt, Human
aggaauauuuuccaa

SEQ ID NO: 1338541 - RNA, 16 nt, Human
aggaauauuuuccaaa

SEQ ID NO: 1338542 - RNA, 20 nt, Human
aggaauauuuuccaaagagu

SEQ ID NO: 1338543 - RNA, 23 nt, Human
agcguuuuuuaaauguauacuau

SEQ ID NO: 1338544 - RNA, 20 nt, Human
agcguuuuuuaaauguauac

SEQ ID NO: 1338545 - RNA, 19 nt, Human
agcguuuuuuaaauguaua

SEQ ID NO: 1338546 - RNA, 18 nt, Human
agcguuuuuuaaauguau

SEQ ID NO: 1338547 - RNA, 12 nt, Human
agcuaaaauaaa

SEQ ID NO: 1338548 - RNA, 19 nt, Human
agcuaaaauaaagaaauag

SEQ ID NO: 1338549 - RNA, 17 nt, Human
agcuaaacggauuccaa

SEQ ID NO: 1338550 - RNA, 17 nt, Human
agcguuuuuuaaaugua

SEQ ID NO: 1338551 - RNA, 14 nt, Human
agcguuuuuuaaau

SEQ ID NO: 1338552 - RNA, 11 nt, Human
agcguuuuuua

SEQ ID NO: 1338553 - RNA, 11 nt, Human
agcguucuugu

SEQ ID NO: 1338554 - RNA, 12 nt, Human
agcguucuugua

SEQ ID NO: 1338555 - RNA, 18 nt, Human
agcguucuuguaauuuua

SEQ ID NO: 1338556 - RNA, 16 nt, Human
agcuaaucagcauucu

SEQ ID NO: 1338557 - RNA, 16 nt, Human
agcuaauaacugaucu

SEQ ID NO: 1338558 - RNA, 21 nt, Human
agcuaaucagcauucucacuc

SEQ ID NO: 1338559 - RNA, 18 nt, Human
agcuaauaaaaagcuuuu

SEQ ID NO: 1338560 - RNA, 19 nt, Human
agcuaauaaaaagcuuuug

SEQ ID NO: 1338561 - RNA, 21 nt, Human
agcuaauaaaaagcuuuuguc

SEQ ID NO: 1338562 - RNA, 23 nt, Human
agcuaauaaaaagcuuuugucua

SEQ ID NO: 1338563 - RNA, 18 nt, Human
agcuaauaacaugugaaa

SEQ ID NO: 1338564 - RNA, 12 nt, Human
agcuacaaaugc

SEQ ID NO: 1338565 - RNA, 20 nt, Human
agcuaauuugcauuaaauuc

SEQ ID NO: 1338566 - RNA, 22 nt, Human
agcuaauuugcauuaaauucac

SEQ ID NO: 1338567 - RNA, 15 nt, Human
agcuauuuuucuaac

SEQ ID NO: 1338568 - RNA, 20 nt, Human
agcuauuuuucuaacuacaa

SEQ ID NO: 1338569 - RNA, 17 nt, Human
agcuauuuuucuaacua

SEQ ID NO: 1338570 - RNA, 13 nt, Human
agcuaauuugcau

SEQ ID NO: 1338571 - RNA, 14 nt, Human
agcuaauuugcauu

SEQ ID NO: 1338572 - RNA, 21 nt, Human
agcuaauucuacucacagugc

SEQ ID NO: 1338573 - RNA, 13 nt, Human
agcucaaugagca

SEQ ID NO: 1338574 - RNA, 14 nt, Human
agcucaaugagcau

SEQ ID NO: 1338575 - RNA, 15 nt, Human
agcucaaugagcaug

SEQ ID NO: 1338576 - RNA, 17 nt, Human
agcucaaugagcauguu

SEQ ID NO: 1338577 - RNA, 14 nt, Human
agcucaauggacug

SEQ ID NO: 1338578 - RNA, 23 nt, Human
agcucaaugagcauguuuagacu

SEQ ID NO: 1338579 - RNA, 14 nt, Human
agcucacaaggcag

SEQ ID NO: 1338580 - RNA, 14 nt, Human
agcucaaagguuug

SEQ ID NO: 1338581 - RNA, 20 nt, Human
agcucaaagguuuggaagga

SEQ ID NO: 1338582 - RNA, 23 nt, Human
agcucaaagguuuggaaggagca

SEQ ID NO: 1338583 - RNA, 21 nt, Human
agcucaaagguuuggaaggag

SEQ ID NO: 1338584 - RNA, 14 nt, Human
agcucaacucucuu

SEQ ID NO: 1338585 - RNA, 22 nt, Human
agcucaacucucuuauugccuc

SEQ ID NO: 1338586 - RNA, 23 nt, Human
agcucaacucucuuauugccuca

SEQ ID NO: 1338587 - RNA, 12 nt, Human
agcucaaugagc

SEQ ID NO: 1338588 - RNA, 19 nt, Human
agcucacugcaaccuccac

SEQ ID NO: 1338589 - RNA, 13 nt, Human
agcucacuucugg

SEQ ID NO: 1338590 - RNA, 23 nt, Human
agcucacuucugggcuucaucug

SEQ ID NO: 1338591 - RNA, 18 nt, Human
agcucagaaaauaucccu

SEQ ID NO: 1338592 - RNA, 19 nt, Human
agcucagaaaauaucccuc

SEQ ID NO: 1338593 - RNA, 21 nt, Human
agcucacguccugagaaagcu

SEQ ID NO: 1338594 - RNA, 20 nt, Human
agcucacguccugagaaagc

SEQ ID NO: 1338595 - RNA, 19 nt, Human
agcucacuccccaaccccc

SEQ ID NO: 1338596 - RNA, 21 nt, Human
agcucagaaaauaucccuccu

SEQ ID NO: 1338597 - RNA, 19 nt, Human
agcucagaggcgcacugug

SEQ ID NO: 1338598 - RNA, 22 nt, Human
agcucagaggcgcacugugacc

SEQ ID NO: 1338599 - RNA, 13 nt, Human
agcucagcacugc

SEQ ID NO: 1338600 - RNA, 16 nt, Human
agcucacaaggcagca

SEQ ID NO: 1338601 - RNA, 15 nt, Human
agcucacaaggcagc

SEQ ID NO: 1338602 - RNA, 18 nt, Human
agccuggcuucaaauugu

SEQ ID NO: 1338603 - RNA, 17 nt, Human
agccuggcuucaaauug

SEQ ID NO: 1338604 - RNA, 15 nt, Human
agcccucccugcccc

SEQ ID NO: 1338605 - RNA, 16 nt, Human
agcccucccugccccu

SEQ ID NO: 1338606 - RNA, 17 nt, Human
agcccucccugccccuc

SEQ ID NO: 1338607 - RNA, 19 nt, Human
agcccucccugccccuccc

SEQ ID NO: 1338608 - RNA, 22 nt, Human
agcccucccugccccucccuuc

SEQ ID NO: 1338609 - RNA, 23 nt, Human
agcccucccugccccucccuuca

SEQ ID NO: 1338610 - RNA, 17 nt, Human
agccuggggcugaggcu

SEQ ID NO: 1338611 - RNA, 22 nt, Human
agccuggggcucuaacgccuga

SEQ ID NO: 1338612 - RNA, 23 nt, Human
agccuggggcucuaacgccugag

SEQ ID NO: 1338613 - RNA, 14 nt, Human
agccuggggcucua

SEQ ID NO: 1338614 - RNA, 15 nt, Human
agccuggggcucuaa

SEQ ID NO: 1338615 - RNA, 16 nt, Human
agccuggggcucuaac

SEQ ID NO: 1338616 - RNA, 21 nt, Human
agccuggggcucuaacgccug

SEQ ID NO: 1338617 - RNA, 18 nt, Human
agccugggcgcugguccu

SEQ ID NO: 1338618 - RNA, 23 nt, Human
agccugggccuauggagagcccu

SEQ ID NO: 1338619 - RNA, 13 nt, Human
agccuggggcucu

SEQ ID NO: 1338620 - RNA, 17 nt, Human
agccugggaaagccccu

SEQ ID NO: 1338621 - RNA, 12 nt, Human
agccugggccua

SEQ ID NO: 1338622 - RNA, 19 nt, Human
agccugggccuauggagag

SEQ ID NO: 1338623 - RNA, 20 nt, Human
agccugggccuauggagagc

SEQ ID NO: 1338624 - RNA, 21 nt, Human
agccugggccuauggagagcc

SEQ ID NO: 1338625 - RNA, 22 nt, Human
agccugggccuauggagagccc

SEQ ID NO: 1338626 - RNA, 24 nt, Human
agccugggccuauggagagcccug

SEQ ID NO: 1338627 - RNA, 19 nt, Human
agccugggaaagccccugc

SEQ ID NO: 1338628 - RNA, 19 nt, Human
agcgacuccguuggccacu

SEQ ID NO: 1338629 - RNA, 20 nt, Human
agcgacuccguuggccacuc

SEQ ID NO: 1338630 - RNA, 21 nt, Human
agcgacuccguuggccacucc

SEQ ID NO: 1338631 - RNA, 19 nt, Human
agcgagcgcccagcuccug

SEQ ID NO: 1338632 - RNA, 20 nt, Human
agcgaggagaugcuccuugg

SEQ ID NO: 1338633 - RNA, 15 nt, Human
agcgaggaggcucca

SEQ ID NO: 1338634 - RNA, 19 nt, Human
agcgaggaggcuccagagg

SEQ ID NO: 1338635 - RNA, 15 nt, Human
agcgagggcgugucu

SEQ ID NO: 1338636 - RNA, 19 nt, Human
agcgaguggagucugccac

SEQ ID NO: 1338637 - RNA, 22 nt, Human
agcgaguggagucugccaccca

SEQ ID NO: 1338638 - RNA, 21 nt, Human
agcgaguggagucugccaccc

SEQ ID NO: 1338639 - RNA, 19 nt, Human
agcgauucccucucccagg

SEQ ID NO: 1338640 - RNA, 20 nt, Human
agcgauucccucucccaggc

SEQ ID NO: 1338641 - RNA, 21 nt, Human
agcgauucccucucccaggcc

SEQ ID NO: 1338642 - RNA, 22 nt, Human
agcgauucccucucccaggccc

SEQ ID NO: 1338643 - RNA, 15 nt, Human
agccuuuggaaacag

SEQ ID NO: 1338644 - RNA, 14 nt, Human
agccuggggcuggc

SEQ ID NO: 1338645 - RNA, 14 nt, Human
agccuuuguucccc

SEQ ID NO: 1338646 - RNA, 20 nt, Human
agccuuuguuccccacugga

SEQ ID NO: 1338647 - RNA, 21 nt, Human
agccuuuguuccccacuggag

SEQ ID NO: 1338648 - RNA, 22 nt, Human
agccuuuguuccccacuggagc

SEQ ID NO: 1338649 - RNA, 24 nt, Human
agccuuuguuccccacuggagcag

SEQ ID NO: 1338650 - RNA, 23 nt, Human
agccuuuguuccccacuggagca

SEQ ID NO: 1338651 - RNA, 18 nt, Human
agccuuuucccucuuugg

SEQ ID NO: 1338652 - RNA, 23 nt, Human
agccuuuucccucuuuggcuccc

SEQ ID NO: 1338653 - RNA, 14 nt, Human
agcgaccgcccccu

SEQ ID NO: 1338654 - RNA, 15 nt, Human
agcgaccgcccccuc

SEQ ID NO: 1338655 - RNA, 16 nt, Human
agcgaccgcccccucc

SEQ ID NO: 1338656 - RNA, 17 nt, Human
agcgaccgcccccuccu

SEQ ID NO: 1338657 - RNA, 22 nt, Human
agcgaccuuccucauccacccc

SEQ ID NO: 1338658 - RNA, 16 nt, Human
agcgacuccguuggcc

SEQ ID NO: 1338659 - RNA, 17 nt, Human
agcgacuccguuggcca

SEQ ID NO: 1338660 - RNA, 21 nt, Human
agcugaggccacacucagcac

SEQ ID NO: 1338661 - RNA, 20 nt, Human
agcugguuuaauguuuuggc

SEQ ID NO: 1338662 - RNA, 23 nt, Human
agcugaagguuguggccuuugcg

SEQ ID NO: 1338663 - RNA, 15 nt, Human
agcugaauguuuuuc

SEQ ID NO: 1338664 - RNA, 16 nt, Human
agcugaauguuuuucu

SEQ ID NO: 1338665 - RNA, 17 nt, Human
agcugaauguuuuucua

SEQ ID NO: 1338666 - RNA, 18 nt, Human
agcugaauguuuuucuaa

SEQ ID NO: 1338667 - RNA, 20 nt, Human
agcugaauguuuuucuaaag

SEQ ID NO: 1338668 - RNA, 12 nt, Human
agcugagcgcca

SEQ ID NO: 1338669 - RNA, 14 nt, Human
agcugagcgccagg

SEQ ID NO: 1338670 - RNA, 15 nt, Human
agcugagcgccagga

SEQ ID NO: 1338671 - RNA, 17 nt, Human
agcugagcgccaggaug

SEQ ID NO: 1338672 - RNA, 17 nt, Human
agcugagcucacaaggc

SEQ ID NO: 1338673 - RNA, 18 nt, Human
agcugagcucacaaggca

SEQ ID NO: 1338674 - RNA, 19 nt, Human
agcugagcucacaaggcag

SEQ ID NO: 1338675 - RNA, 22 nt, Human
agcugagcucacaaggcagcaa

SEQ ID NO: 1338676 - RNA, 20 nt, Human
agcugagcucacaaggcagc

SEQ ID NO: 1338677 - RNA, 21 nt, Human
agcugagcucacaaggcagca

SEQ ID NO: 1338678 - RNA, 15 nt, Human
agcugaggcagcagu

SEQ ID NO: 1338679 - RNA, 16 nt, Human
agcugaggcagcagug

SEQ ID NO: 1338680 - RNA, 17 nt, Human
agcugaggcagcagugu

SEQ ID NO: 1338681 - RNA, 13 nt, Human
agcugaggccaca

SEQ ID NO: 1338682 - RNA, 17 nt, Human
agcugaggccacacuca

SEQ ID NO: 1338683 - RNA, 16 nt, Human
agcuccuuaaggcucu

SEQ ID NO: 1338684 - RNA, 17 nt, Human
agcuccuuaaggcucuu

SEQ ID NO: 1338685 - RNA, 18 nt, Human
agcuccuuaaggcucuuu

SEQ ID NO: 1338686 - RNA, 12 nt, Human
agcuccuguggc

SEQ ID NO: 1338687 - RNA, 13 nt, Human
agcuccuguggcc

SEQ ID NO: 1338688 - RNA, 15 nt, Human
agcuccuguggcccc

SEQ ID NO: 1338689 - RNA, 16 nt, Human
agcuccuguggcccca

SEQ ID NO: 1338690 - RNA, 19 nt, Human
agcuccuguggccccaccc

SEQ ID NO: 1338691 - RNA, 22 nt, Human
agcuccuguggccccacccugg

SEQ ID NO: 1338692 - RNA, 14 nt, Human
agcuccccucccca

SEQ ID NO: 1338693 - RNA, 18 nt, Human
agcuccccuccccaacug

SEQ ID NO: 1338694 - RNA, 15 nt, Human
agcuccccuccccaa

SEQ ID NO: 1338695 - RNA, 17 nt, Human
agcucagcacugccugc

SEQ ID NO: 1338696 - RNA, 20 nt, Human
agcucagcacugccugcucc

SEQ ID NO: 1338697 - RNA, 23 nt, Human
agcucagcacugccugcucccau

SEQ ID NO: 1338698 - RNA, 21 nt, Human
agcucagcacugccugcuccc

SEQ ID NO: 1338699 - RNA, 21 nt, Human
aggccggcuugccacaccccc

SEQ ID NO: 1338700 - RNA, 20 nt, Human
aggccggcuugccacacccc

SEQ ID NO: 1338701 - RNA, 19 nt, Human
aggccggcuugccacaccc

SEQ ID NO: 1338702 - RNA, 19 nt, Human
aggcggggcuugccuucug

SEQ ID NO: 1338703 - RNA, 14 nt, Human
aggcggggcuugcc

SEQ ID NO: 1338704 - RNA, 15 nt, Human
aggcggggcuugccu

SEQ ID NO: 1338705 - RNA, 16 nt, Human
aggcggggcuugccuu

SEQ ID NO: 1338706 - RNA, 18 nt, Human
aggcggggcuugccuucu

SEQ ID NO: 1338707 - RNA, 16 nt, Human
aggcggugggccuggu

SEQ ID NO: 1338708 - RNA, 14 nt, Human
aggcuaagcugccg

SEQ ID NO: 1338709 - RNA, 14 nt, Human
agggaccggcggac

SEQ ID NO: 1338710 - RNA, 13 nt, Human
agggacugagaga

SEQ ID NO: 1338711 - RNA, 20 nt, Human
agggacugagagaugcagaa

SEQ ID NO: 1338712 - RNA, 15 nt, Human
agggacugaggggag

SEQ ID NO: 1338713 - RNA, 23 nt, Human
agggacugccagucccccugccc

SEQ ID NO: 1338714 - RNA, 18 nt, Human
agggaccacacccuguac

SEQ ID NO: 1338715 - RNA, 13 nt, Human
agggacccagcua

SEQ ID NO: 1338716 - RNA, 23 nt, Human
aggcuggucucgaacuccugacc

SEQ ID NO: 1338717 - RNA, 23 nt, Human
aggcugguccuauggccucaugu

SEQ ID NO: 1338718 - RNA, 17 nt, Human
aggcuggucuaaaacuc

SEQ ID NO: 1338719 - RNA, 18 nt, Human
aggcugaggcuggcacag

SEQ ID NO: 1338720 - RNA, 17 nt, Human
aggcugguccuauggcc

SEQ ID NO: 1338721 - RNA, 22 nt, Human
aggcuggucucaaacuccugac

SEQ ID NO: 1338722 - RNA, 14 nt, Human
aggcugaggcuggc

SEQ ID NO: 1338723 - RNA, 15 nt, Human
aggcugaggcuggca

SEQ ID NO: 1338724 - RNA, 16 nt, Human
aggcugaggcuggcac

SEQ ID NO: 1338725 - RNA, 17 nt, Human
aggcugaggcuggcaca

SEQ ID NO: 1338726 - RNA, 13 nt, Human
aggcugaggccug

SEQ ID NO: 1338727 - RNA, 14 nt, Human
aggcugaggccugg

SEQ ID NO: 1338728 - RNA, 15 nt, Human
aggcugaggccugga

SEQ ID NO: 1338729 - RNA, 16 nt, Human
aggcugaggccuggac

SEQ ID NO: 1338730 - RNA, 17 nt, Human
aggcugaggccuggacu

SEQ ID NO: 1338731 - RNA, 16 nt, Human
aggcugaccacagcac

SEQ ID NO: 1338732 - RNA, 17 nt, Human
aggcugaccacagcaca

SEQ ID NO: 1338733 - RNA, 18 nt, Human
aggcugaccacagcacag

SEQ ID NO: 1338734 - RNA, 21 nt, Human
aggcugaccacagcacagcca

SEQ ID NO: 1338735 - RNA, 13 nt, Human
aggcugaccacag

SEQ ID NO: 1338736 - RNA, 14 nt, Human
aggcugaccacagc

SEQ ID NO: 1338737 - RNA, 12 nt, Human
aggcuaauuuuu

SEQ ID NO: 1338738 - RNA, 23 nt, Human
aggcuaauuuuuuuguauuuuag

SEQ ID NO: 1338739 - RNA, 22 nt, Human
aggcuaauuuuuuuguauuuua

SEQ ID NO: 1338740 - RNA, 12 nt, Human
aggcuacagaga

SEQ ID NO: 1338741 - RNA, 13 nt, Human
aggcuacagagaa

SEQ ID NO: 1338742 - RNA, 14 nt, Human
aggcuacagagaag

SEQ ID NO: 1338743 - RNA, 15 nt, Human
aggcuacagagaagc

SEQ ID NO: 1338744 - RNA, 16 nt, Human
aggcuacagagaagcc

SEQ ID NO: 1338745 - RNA, 17 nt, Human
aggcuacagagaagccu

SEQ ID NO: 1338746 - RNA, 18 nt, Human
aggcuacagagaagccuu

SEQ ID NO: 1338747 - RNA, 19 nt, Human
aggcuacagagaagccuuc

SEQ ID NO: 1338748 - RNA, 20 nt, Human
aggcuacagagaagccuuca

SEQ ID NO: 1338749 - RNA, 22 nt, Human
aggcuacagagaagccuucaag

SEQ ID NO: 1338750 - RNA, 15 nt, Human
aggcagagaagaaag

SEQ ID NO: 1338751 - RNA, 14 nt, Human
aggcagagaagaaa

SEQ ID NO: 1338752 - RNA, 13 nt, Human
aggcagagaagaa

SEQ ID NO: 1338753 - RNA, 14 nt, Human
aggcagaggcccag

SEQ ID NO: 1338754 - RNA, 17 nt, Human
aggcagaggcccaggcu

SEQ ID NO: 1338755 - RNA, 19 nt, Human
aggcagaggcccaggcugc

SEQ ID NO: 1338756 - RNA, 20 nt, Human
aggcagaggcccaggcugcc

SEQ ID NO: 1338757 - RNA, 21 nt, Human
aggcagaggcccaggcugccg

SEQ ID NO: 1338758 - RNA, 22 nt, Human
aggcagaggcccaggcugccgu

SEQ ID NO: 1338759 - RNA, 14 nt, Human
aggcagaggccugg

SEQ ID NO: 1338760 - RNA, 18 nt, Human
aggcagaggccugggcug

SEQ ID NO: 1338761 - RNA, 14 nt, Human
aggcacucuagauu

SEQ ID NO: 1338762 - RNA, 15 nt, Human
aggcacucuagauuc

SEQ ID NO: 1338763 - RNA, 17 nt, Human
aggcacucuagauucca

SEQ ID NO: 1338764 - RNA, 17 nt, Human
aggcacugaagugcuua

SEQ ID NO: 1338765 - RNA, 23 nt, Human
aggcacugagauaccagcgagga

SEQ ID NO: 1338766 - RNA, 20 nt, Human
aggagagggcgcuccucucu

SEQ ID NO: 1338767 - RNA, 21 nt, Human
aggagaggcaacauccaaaau

SEQ ID NO: 1338768 - RNA, 20 nt, Human
aggagaggcaacauccaaaa

SEQ ID NO: 1338769 - RNA, 21 nt, Human
aggcaccugguggccaugcuc

SEQ ID NO: 1338770 - RNA, 20 nt, Human
aggcaccugguggccaugcu

SEQ ID NO: 1338771 - RNA, 12 nt, Human
aggcauggugga

SEQ ID NO: 1338772 - RNA, 17 nt, Human
aggcagaggccugggcu

SEQ ID NO: 1338773 - RNA, 15 nt, Human
aggcagcaaggcccg

SEQ ID NO: 1338774 - RNA, 16 nt, Human
aggcagcaaggcccga

SEQ ID NO: 1338775 - RNA, 17 nt, Human
aggcagcaaggcccgag

SEQ ID NO: 1338776 - RNA, 18 nt, Human
aggcagcaaggcccgagc

SEQ ID NO: 1338777 - RNA, 23 nt, Human
aggcagcaaggcccgagcagcug

SEQ ID NO: 1338778 - RNA, 19 nt, Human
aggcagcagugugaggcca

SEQ ID NO: 1338779 - RNA, 20 nt, Human
aggcagcagugugaggccag

SEQ ID NO: 1338780 - RNA, 22 nt, Human
aggcagcagugugaggccaggg

SEQ ID NO: 1338781 - RNA, 23 nt, Human
aggcagcagugugaggccagggc

SEQ ID NO: 1338782 - RNA, 21 nt, Human
aggccaugggcacugugggua

SEQ ID NO: 1338783 - RNA, 23 nt, Human
aggccaugggcacuguggguaga

SEQ ID NO: 1338784 - RNA, 13 nt, Human
aggcccuggauca

SEQ ID NO: 1338785 - RNA, 18 nt, Human
aggcccuggaucagcgug

SEQ ID NO: 1338786 - RNA, 21 nt, Human
aggcccuggaucagcguggcc

SEQ ID NO: 1338787 - RNA, 23 nt, Human
aggcccuggaucagcguggccuu

SEQ ID NO: 1338788 - RNA, 14 nt, Human
aggcccuggccucc

SEQ ID NO: 1338789 - RNA, 15 nt, Human
aggcccuggccuccc

SEQ ID NO: 1338790 - RNA, 21 nt, Human
aggcccuggccuccccugcca

SEQ ID NO: 1338791 - RNA, 22 nt, Human
aggcccuggccuccccugccac

SEQ ID NO: 1338792 - RNA, 23 nt, Human
aggcccuggccuccccugccacc

SEQ ID NO: 1338793 - RNA, 22 nt, Human
aggcccuuccucuccacugccu

SEQ ID NO: 1338794 - RNA, 16 nt, Human
aggcccuuauuuucaa

SEQ ID NO: 1338795 - RNA, 13 nt, Human
aggcccugugccc

SEQ ID NO: 1338796 - RNA, 16 nt, Human
aggccagcugugguuu

SEQ ID NO: 1338797 - RNA, 20 nt, Human
aggccagcugugguuuucuu

SEQ ID NO: 1338798 - RNA, 21 nt, Human
aggccagcugugguuuucuuu

SEQ ID NO: 1338799 - RNA, 23 nt, Human
aggccagcugugguuuucuuuug

SEQ ID NO: 1338800 - RNA, 15 nt, Human
aggccaggacucugc

SEQ ID NO: 1338801 - RNA, 17 nt, Human
aggccaggacucugcag

SEQ ID NO: 1338802 - RNA, 18 nt, Human
aggccaggacucugcagc

SEQ ID NO: 1338803 - RNA, 19 nt, Human
aggccaggacucugcagcc

SEQ ID NO: 1338804 - RNA, 20 nt, Human
aggccaggacucugcagccu

SEQ ID NO: 1338805 - RNA, 21 nt, Human
aggccaggacucugcagccuc

SEQ ID NO: 1338806 - RNA, 23 nt, Human
aggccaggacucugcagccucag

SEQ ID NO: 1338807 - RNA, 11 nt, Human
aggccaggcau

SEQ ID NO: 1338808 - RNA, 22 nt, Human
aggccaggacucugcagccuca

SEQ ID NO: 1338809 - RNA, 18 nt, Human
aggccaguaguucucaaa

SEQ ID NO: 1338810 - RNA, 19 nt, Human
aggccaguaguucucaaag

SEQ ID NO: 1338811 - RNA, 16 nt, Human
aggccauaaaacaggu

SEQ ID NO: 1338812 - RNA, 21 nt, Human
aggccaucugggcuccuccag

SEQ ID NO: 1338813 - RNA, 22 nt, Human
aggccaucugggcuccuccagg

SEQ ID NO: 1338814 - RNA, 13 nt, Human
aggccauggacuc

SEQ ID NO: 1338815 - RNA, 17 nt, Human
aggccauggacucuguc

SEQ ID NO: 1338816 - RNA, 18 nt, Human
aggccauggacucugucc

SEQ ID NO: 1338817 - RNA, 19 nt, Human
aggccauggacucuguccu

SEQ ID NO: 1338818 - RNA, 20 nt, Human
aggccauggacucuguccug

SEQ ID NO: 1338819 - RNA, 21 nt, Human
aggccauggacucuguccuga

SEQ ID NO: 1338820 - RNA, 22 nt, Human
aggccauggacucuguccugaa

SEQ ID NO: 1338821 - RNA, 11 nt, Human
agguacuguau

SEQ ID NO: 1338822 - RNA, 12 nt, Human
agguacuauuau

SEQ ID NO: 1338823 - RNA, 18 nt, Human
agguccgguguucuaaga

SEQ ID NO: 1338824 - RNA, 19 nt, Human
agguccgguguucuaagau

SEQ ID NO: 1338825 - RNA, 15 nt, Human
agguaagaaguuuua

SEQ ID NO: 1338826 - RNA, 18 nt, Human
agguaacuaacugcauac

SEQ ID NO: 1338827 - RNA, 19 nt, Human
agguaacuaacugcauaca

SEQ ID NO: 1338828 - RNA, 19 nt, Human
agguacgaugacaguguuc

SEQ ID NO: 1338829 - RNA, 21 nt, Human
agguccucaguguccucaggg

SEQ ID NO: 1338830 - RNA, 15 nt, Human
agguccucagagaau

SEQ ID NO: 1338831 - RNA, 13 nt, Human
agguccucuguca

SEQ ID NO: 1338832 - RNA, 14 nt, Human
agguccucugucag

SEQ ID NO: 1338833 - RNA, 19 nt, Human
agguccucugucagucaca

SEQ ID NO: 1338834 - RNA, 23 nt, Human
agguccucugucagucacagcca

SEQ ID NO: 1338835 - RNA, 12 nt, Human
agguccugagca

SEQ ID NO: 1338836 - RNA, 13 nt, Human
agguccugagcac

SEQ ID NO: 1338837 - RNA, 15 nt, Human
agguccugagcacug

SEQ ID NO: 1338838 - RNA, 16 nt, Human
agguccugagcacugc

SEQ ID NO: 1338839 - RNA, 17 nt, Human
agguccugagcacugcc

SEQ ID NO: 1338840 - RNA, 18 nt, Human
agguccugagcacugcca

SEQ ID NO: 1338841 - RNA, 22 nt, Human
aggucgguagguucagccaagg

SEQ ID NO: 1338842 - RNA, 19 nt, Human
agguccugagcacugccag

SEQ ID NO: 1338843 - RNA, 12 nt, Human
aggucucagccc

SEQ ID NO: 1338844 - RNA, 14 nt, Human
aggucucagccccu

SEQ ID NO: 1338845 - RNA, 13 nt, Human
aggucucagcccc

SEQ ID NO: 1338846 - RNA, 13 nt, Human
aggucucccugga

SEQ ID NO: 1338847 - RNA, 21 nt, Human
aggguuugugacagggcgggg

SEQ ID NO: 1338848 - RNA, 16 nt, Human
aggguuuuaacuuugu

SEQ ID NO: 1338849 - RNA, 15 nt, Human
aggguuuuaacuuug

SEQ ID NO: 1338850 - RNA, 16 nt, Human
agggucggugccuuca

SEQ ID NO: 1338851 - RNA, 14 nt, Human
agggccugaugggg

SEQ ID NO: 1338852 - RNA, 19 nt, Human
agggccugaugggguggaa

SEQ ID NO: 1338853 - RNA, 17 nt, Human
agggcaaauuggagaaa

SEQ ID NO: 1338854 - RNA, 15 nt, Human
agggcaaagccaggu

SEQ ID NO: 1338855 - RNA, 18 nt, Human
agggcaaagccagguccc

SEQ ID NO: 1338856 - RNA, 20 nt, Human
agggcaaagccaggucccuc

SEQ ID NO: 1338857 - RNA, 18 nt, Human
agggcaacagaucaguaa

SEQ ID NO: 1338858 - RNA, 21 nt, Human
agggccugaugggguggaagg

SEQ ID NO: 1338859 - RNA, 13 nt, Human
agggauguggguu

SEQ ID NO: 1338860 - RNA, 21 nt, Human
agggauguggguuccacagac

SEQ ID NO: 1338861 - RNA, 22 nt, Human
agggauguggguuccacagacg

SEQ ID NO: 1338862 - RNA, 17 nt, Human
agggauuaaccucugca

SEQ ID NO: 1338863 - RNA, 18 nt, Human
agggauuaaccucugcac

SEQ ID NO: 1338864 - RNA, 15 nt, Human
agggaucccucaucu

SEQ ID NO: 1338865 - RNA, 16 nt, Human
agggaucccucaucug

SEQ ID NO: 1338866 - RNA, 19 nt, Human
agggaucccucaucugucc

SEQ ID NO: 1338867 - RNA, 22 nt, Human
agggaucccucaucugucccuc

SEQ ID NO: 1338868 - RNA, 11 nt, Human
agggcaaagcc

SEQ ID NO: 1338869 - RNA, 13 nt, Human
agggcaaagccag

SEQ ID NO: 1338870 - RNA, 14 nt, Human
agggcaaagccagg

SEQ ID NO: 1338871 - RNA, 21 nt, Human
agggcaaagccaggucccucu

SEQ ID NO: 1338872 - RNA, 19 nt, Human
agggauuaaccucugcacu

SEQ ID NO: 1338873 - RNA, 20 nt, Human
agggacuguaaacacagaca

SEQ ID NO: 1338874 - RNA, 16 nt, Human
agggacugucgcugcu

SEQ ID NO: 1338875 - RNA, 22 nt, Human
agggacugucgcugcuucgugg

SEQ ID NO: 1338876 - RNA, 12 nt, Human
aggggccuggca

SEQ ID NO: 1338877 - RNA, 18 nt, Human
aggggccuggagauccuc

SEQ ID NO: 1338878 - RNA, 21 nt, Human
aggggccuggagauccuccug

SEQ ID NO: 1338879 - RNA, 13 nt, Human
aggggccuggcag

SEQ ID NO: 1338880 - RNA, 15 nt, Human
aggggccuggcagcc

SEQ ID NO: 1338881 - RNA, 22 nt, Human
aggggccuggagauccuccugc

SEQ ID NO: 1338882 - RNA, 14 nt, Human
aggggccugcccag

SEQ ID NO: 1338883 - RNA, 15 nt, Human
aggguaugaagagug

SEQ ID NO: 1338884 - RNA, 21 nt, Human
aggguauggacuaucugucug

SEQ ID NO: 1338885 - RNA, 16 nt, Human
aggguaugaagagugu

SEQ ID NO: 1338886 - RNA, 19 nt, Human
agggucagacgccugagga

SEQ ID NO: 1338887 - RNA, 21 nt, Human
agggucagacgccugaggaac

SEQ ID NO: 1338888 - RNA, 17 nt, Human
aggguccuuuugacacu

SEQ ID NO: 1338889 - RNA, 22 nt, Human
aggguccuuuugacacugcucu

SEQ ID NO: 1338890 - RNA, 14 nt, Human
agggucgaaagcuc

SEQ ID NO: 1338891 - RNA, 15 nt, Human
agggucgaaagcucu

SEQ ID NO: 1338892 - RNA, 16 nt, Human
agggucgaaagcucua

SEQ ID NO: 1338893 - RNA, 18 nt, Human
agggucgaaagcucuaga

SEQ ID NO: 1338894 - RNA, 22 nt, Human
agggucgaaagcucuagaaucu

SEQ ID NO: 1338895 - RNA, 15 nt, Human
agggucggugccuuc

SEQ ID NO: 1338896 - RNA, 13 nt, Human
aggggccccucuc

SEQ ID NO: 1338897 - RNA, 14 nt, Human
aggggccccucuca

SEQ ID NO: 1338898 - RNA, 19 nt, Human
aggggccccucucagcccu

SEQ ID NO: 1338899 - RNA, 12 nt, Human
aggggccugagc

SEQ ID NO: 1338900 - RNA, 13 nt, Human
aggggccugagca

SEQ ID NO: 1338901 - RNA, 14 nt, Human
aggggccugagcag

SEQ ID NO: 1338902 - RNA, 15 nt, Human
aggggccugccaccu

SEQ ID NO: 1338903 - RNA, 17 nt, Human
aggggccugccaccugg

SEQ ID NO: 1338904 - RNA, 19 nt, Human
aggggccugccaccuggac

SEQ ID NO: 1338905 - RNA, 20 nt, Human
aggggccugccaccuggacc

SEQ ID NO: 1338906 - RNA, 21 nt, Human
aggggccugccaccuggaccc

SEQ ID NO: 1338907 - RNA, 22 nt, Human
aggggccugccaccuggacccc

SEQ ID NO: 1338908 - RNA, 13 nt, Human
aggggccugccca

SEQ ID NO: 1338909 - RNA, 13 nt, Human
aggggccuggaga

SEQ ID NO: 1338910 - RNA, 14 nt, Human
aggggccuggagau

SEQ ID NO: 1338911 - RNA, 13 nt, Human
agggccugcugga

SEQ ID NO: 1338912 - RNA, 13 nt, Human
agggcgcaggccg

SEQ ID NO: 1338913 - RNA, 14 nt, Human
agggcgcaggccgu

SEQ ID NO: 1338914 - RNA, 22 nt, Human
augcacaaauucugucucugga

SEQ ID NO: 1338915 - RNA, 15 nt, Human
augcacaaauucugu

SEQ ID NO: 1338916 - RNA, 23 nt, Human
augcacaaauucugucucuggau

SEQ ID NO: 1338917 - RNA, 18 nt, Human
augauguauacugccacu

SEQ ID NO: 1338918 - RNA, 21 nt, Human
augcacaauguagauaagugu

SEQ ID NO: 1338919 - RNA, 16 nt, Human
augcacaagaauggau

SEQ ID NO: 1338920 - RNA, 16 nt, Human
augauggguguuuuua

SEQ ID NO: 1338921 - RNA, 15 nt, Human
augauggaugccaau

SEQ ID NO: 1338922 - RNA, 19 nt, Human
augauggaugccaauauua

SEQ ID NO: 1338923 - RNA, 19 nt, Human
augauggcaauuuuguaac

SEQ ID NO: 1338924 - RNA, 12 nt, Human
augaugaaugag

SEQ ID NO: 1338925 - RNA, 15 nt, Human
augaugaaugagaau

SEQ ID NO: 1338926 - RNA, 19 nt, Human
augaugacuuaguacaaag

SEQ ID NO: 1338927 - RNA, 20 nt, Human
augaugaucaauuauaguuu

SEQ ID NO: 1338928 - RNA, 18 nt, Human
augccuuguuucauauuu

SEQ ID NO: 1338929 - RNA, 24 nt, Human
augccuugguuuuuacugcucuga

SEQ ID NO: 1338930 - RNA, 19 nt, Human
augccugucuuaauuuucu

SEQ ID NO: 1338931 - RNA, 16 nt, Human
augccuuacucuucuu

SEQ ID NO: 1338932 - RNA, 18 nt, Human
augccuuacucuucuuga

SEQ ID NO: 1338933 - RNA, 21 nt, Human
augcauuauaggaucauuugu

SEQ ID NO: 1338934 - RNA, 18 nt, Human
augcauuauaucaaaucu

SEQ ID NO: 1338935 - RNA, 22 nt, Human
augcauuauaggaucauuuguu

SEQ ID NO: 1338936 - RNA, 14 nt, Human
augcauucuucucu

SEQ ID NO: 1338937 - RNA, 19 nt, Human
augcauucuucucuguugu

SEQ ID NO: 1338938 - RNA, 17 nt, Human
augcauucuucucuguu

SEQ ID NO: 1338939 - RNA, 17 nt, Human
auggcuuugugauucaa

SEQ ID NO: 1338940 - RNA, 17 nt, Human
auggauaggcacaggaa

SEQ ID NO: 1338941 - RNA, 15 nt, Human
auggagucuugcucu

SEQ ID NO: 1338942 - RNA, 18 nt, Human
auggauaggcacaggaaa

SEQ ID NO: 1338943 - RNA, 22 nt, Human
auggauccacuggcuggacaaa

SEQ ID NO: 1338944 - RNA, 15 nt, Human
auggaucacaagaug

SEQ ID NO: 1338945 - RNA, 16 nt, Human
auggaucacaagaugg

SEQ ID NO: 1338946 - RNA, 22 nt, Human
auggauauaguuuuacuuuuaa

SEQ ID NO: 1338947 - RNA, 15 nt, Human
auggcugugccucug

SEQ ID NO: 1338948 - RNA, 16 nt, Human
auggcugugccucugc

SEQ ID NO: 1338949 - RNA, 17 nt, Human
auggcugugccucugcc

SEQ ID NO: 1338950 - RNA, 18 nt, Human
auggcugugccucugccu

SEQ ID NO: 1338951 - RNA, 16 nt, Human
auggauccuggaggau

SEQ ID NO: 1338952 - RNA, 19 nt, Human
auggaggggcagagccagg

SEQ ID NO: 1338953 - RNA, 12 nt, Human
auggagguucua

SEQ ID NO: 1338954 - RNA, 13 nt, Human
auggagguucuaa

SEQ ID NO: 1338955 - RNA, 15 nt, Human
auggagguucuaagg

SEQ ID NO: 1338956 - RNA, 16 nt, Human
auggagguucuaaggc

SEQ ID NO: 1338957 - RNA, 17 nt, Human
auggagguucuaaggcc

SEQ ID NO: 1338958 - RNA, 15 nt, Human
auggaggggcagagc

SEQ ID NO: 1338959 - RNA, 14 nt, Human
auggaggggcagag

SEQ ID NO: 1338960 - RNA, 16 nt, Human
auggagggaauaauac

SEQ ID NO: 1338961 - RNA, 21 nt, Human
augcuuuaggauguacaguua

SEQ ID NO: 1338962 - RNA, 18 nt, Human
augcuuuaggauguacag

SEQ ID NO: 1338963 - RNA, 13 nt, Human
augcugauggagc

SEQ ID NO: 1338964 - RNA, 21 nt, Human
augcugagauuacagguguga

SEQ ID NO: 1338965 - RNA, 14 nt, Human
augcugaggccugg

SEQ ID NO: 1338966 - RNA, 15 nt, Human
augcugaggccuggg

SEQ ID NO: 1338967 - RNA, 17 nt, Human
augcugaggccugggcc

SEQ ID NO: 1338968 - RNA, 18 nt, Human
augcugaggccugggccg

SEQ ID NO: 1338969 - RNA, 22 nt, Human
augcugaggccugggccgcugc

SEQ ID NO: 1338970 - RNA, 19 nt, Human
augcugacuguacuccucc

SEQ ID NO: 1338971 - RNA, 22 nt, Human
augcugacauucaccugcccca

SEQ ID NO: 1338972 - RNA, 20 nt, Human
augcugacuguacuccuccc

SEQ ID NO: 1338973 - RNA, 21 nt, Human
augcugacuguacuccuccca

SEQ ID NO: 1338974 - RNA, 23 nt, Human
augcugaauauacagcaggugcu

SEQ ID NO: 1338975 - RNA, 19 nt, Human
augcugacauucaccugcc

SEQ ID NO: 1338976 - RNA, 20 nt, Human
augcugacauucaccugccc

SEQ ID NO: 1338977 - RNA, 12 nt, Human
augcugccucca

SEQ ID NO: 1338978 - RNA, 15 nt, Human
augcugccuccagaa

SEQ ID NO: 1338979 - RNA, 23 nt, Human
augcugccuuauucagggaagga

SEQ ID NO: 1338980 - RNA, 17 nt, Human
auguguaagacaaaaag

SEQ ID NO: 1338981 - RNA, 19 nt, Human
auguguaagacaaaaagcu

SEQ ID NO: 1338982 - RNA, 21 nt, Human
auguguaaacaauuuuauaua

SEQ ID NO: 1338983 - RNA, 16 nt, Human
augugguuuuagauuu

SEQ ID NO: 1338984 - RNA, 20 nt, Human
auguguaugcacaguaaaaa

SEQ ID NO: 1338985 - RNA, 15 nt, Human
auguuccauuaaacg

SEQ ID NO: 1338986 - RNA, 14 nt, Human
auguuccauuaaac

SEQ ID NO: 1338987 - RNA, 19 nt, Human
auguguaugcacaguaaaa

SEQ ID NO: 1338988 - RNA, 15 nt, Human
auguguaugcacagu

SEQ ID NO: 1338989 - RNA, 15 nt, Human
auguguauaaacaag

SEQ ID NO: 1338990 - RNA, 16 nt, Human
auguguaguucaugua

SEQ ID NO: 1338991 - RNA, 18 nt, Human
auguguaguucauguaaa

SEQ ID NO: 1338992 - RNA, 20 nt, Human
auguguaguucauguaaaua

SEQ ID NO: 1338993 - RNA, 19 nt, Human
auguguaguucauguaaau

SEQ ID NO: 1338994 - RNA, 13 nt, Human
auguguauaaaaa

SEQ ID NO: 1338995 - RNA, 23 nt, Human
auguguauaaaaauaaaaaagau

SEQ ID NO: 1338996 - RNA, 12 nt, Human
auguguauaaac

SEQ ID NO: 1338997 - RNA, 13 nt, Human
auguguauaaaca

SEQ ID NO: 1338998 - RNA, 14 nt, Human
auguguauaaacaa

SEQ ID NO: 1338999 - RNA, 13 nt, Human
auguucugucccu

SEQ ID NO: 1339000 - RNA, 14 nt, Human
auguucugucccuu

SEQ ID NO: 1339001 - RNA, 20 nt, Human
auguucugucccuugccccc

SEQ ID NO: 1339002 - RNA, 23 nt, Human
auguucugucccuugccccccug

SEQ ID NO: 1339003 - RNA, 13 nt, Human
auguucuguuugc

SEQ ID NO: 1339004 - RNA, 16 nt, Human
auguucuguuugcugu

SEQ ID NO: 1339005 - RNA, 17 nt, Human
auguucuguuugcugug

SEQ ID NO: 1339006 - RNA, 13 nt, Human
auguuuccagcau

SEQ ID NO: 1339007 - RNA, 15 nt, Human
auguuuccagcauuc

SEQ ID NO: 1339008 - RNA, 16 nt, Human
auguuuccagcauucc

SEQ ID NO: 1339009 - RNA, 18 nt, Human
auguuuccagcauuccca

SEQ ID NO: 1339010 - RNA, 19 nt, Human
auguuuccagcauucccag

SEQ ID NO: 1339011 - RNA, 20 nt, Human
auguuuccagcauucccagg

SEQ ID NO: 1339012 - RNA, 21 nt, Human
auguuuccagcauucccaggu

SEQ ID NO: 1339013 - RNA, 14 nt, Human
auguuuccucuagu

SEQ ID NO: 1339014 - RNA, 20 nt, Human
auguuuccucuaguucuuug

SEQ ID NO: 1339015 - RNA, 12 nt, Human
auguuucuggau

SEQ ID NO: 1339016 - RNA, 15 nt, Human
auguuucuucuaggu

SEQ ID NO: 1339017 - RNA, 18 nt, Human
augugaaaucauucauuu

SEQ ID NO: 1339018 - RNA, 17 nt, Human
augugaaaucauucauu

SEQ ID NO: 1339019 - RNA, 20 nt, Human
augugaaauuuacaucauuu

SEQ ID NO: 1339020 - RNA, 22 nt, Human
augugaaaaugguccaggagaa

SEQ ID NO: 1339021 - RNA, 23 nt, Human
augugaaauuuacaucauuucuu

SEQ ID NO: 1339022 - RNA, 15 nt, Human
augugaaacauguuu

SEQ ID NO: 1339023 - RNA, 21 nt, Human
augugaaaaugguccaggaga

SEQ ID NO: 1339024 - RNA, 14 nt, Human
augugaaacauguu

SEQ ID NO: 1339025 - RNA, 16 nt, Human
augucaauuucugugu

SEQ ID NO: 1339026 - RNA, 19 nt, Human
augucaauuucuguguugc

SEQ ID NO: 1339027 - RNA, 14 nt, Human
auguaaauuuguac

SEQ ID NO: 1339028 - RNA, 15 nt, Human
auguaaauuuguacu

SEQ ID NO: 1339029 - RNA, 17 nt, Human
auguaaauuuguacuau

SEQ ID NO: 1339030 - RNA, 21 nt, Human
auguaaauuuguacuauuuaa

SEQ ID NO: 1339031 - RNA, 19 nt, Human
auguaaauuuguacuauuu

SEQ ID NO: 1339032 - RNA, 14 nt, Human
auguaacuagaauu

SEQ ID NO: 1339033 - RNA, 15 nt, Human
auguaacugccuaga

SEQ ID NO: 1339034 - RNA, 17 nt, Human
auguaacugccuagaaa

SEQ ID NO: 1339035 - RNA, 19 nt, Human
auguaacugccuagaaaca

SEQ ID NO: 1339036 - RNA, 18 nt, Human
auguaacugccuagaaac

SEQ ID NO: 1339037 - RNA, 14 nt, Human
auguaacuuuugua

SEQ ID NO: 1339038 - RNA, 15 nt, Human
auguaauuauuuaug

SEQ ID NO: 1339039 - RNA, 17 nt, Human
auguaauuauuuaugua

SEQ ID NO: 1339040 - RNA, 23 nt, Human
auguaauuauuuauguauggugc

SEQ ID NO: 1339041 - RNA, 21 nt, Human
auguaauuucaggaggaauac

SEQ ID NO: 1339042 - RNA, 12 nt, Human
auguaauuuugu

SEQ ID NO: 1339043 - RNA, 21 nt, Human
augucaaucagccuaguugau

SEQ ID NO: 1339044 - RNA, 17 nt, Human
auguauuuauaaauaua

SEQ ID NO: 1339045 - RNA, 15 nt, Human
auguaauuuugugua

SEQ ID NO: 1339046 - RNA, 16 nt, Human
auguaauuuuguguaa

SEQ ID NO: 1339047 - RNA, 17 nt, Human
auguaauuuuguguaag

SEQ ID NO: 1339048 - RNA, 22 nt, Human
auguaauuuuguguaagaaaua

SEQ ID NO: 1339049 - RNA, 23 nt, Human
auguaauuuuguguaagaaauac

SEQ ID NO: 1339050 - RNA, 20 nt, Human
auguacaaaaaaaaaacccu

SEQ ID NO: 1339051 - RNA, 15 nt, Human
auguauugugcaaug

SEQ ID NO: 1339052 - RNA, 17 nt, Human
auguauugugcaaugug

SEQ ID NO: 1339053 - RNA, 18 nt, Human
auguauugugcaaugugu

SEQ ID NO: 1339054 - RNA, 19 nt, Human
auguauugugcaaugugua

SEQ ID NO: 1339055 - RNA, 20 nt, Human
auguauugugcaauguguau

SEQ ID NO: 1339056 - RNA, 22 nt, Human
auguauugugcaauguguauaa

SEQ ID NO: 1339057 - RNA, 24 nt, Human
auguauugugcaauguguauaaac

SEQ ID NO: 1339058 - RNA, 22 nt, Human
auggguuagggaaaacauucca

SEQ ID NO: 1339059 - RNA, 13 nt, Human
auggguggaaagg

SEQ ID NO: 1339060 - RNA, 16 nt, Human
augguaaaaaauuuau

SEQ ID NO: 1339061 - RNA, 22 nt, Human
auggguuuuucccuguacagua

SEQ ID NO: 1339062 - RNA, 18 nt, Human
augguaaaaaauuuauaa

SEQ ID NO: 1339063 - RNA, 14 nt, Human
augguaacugcuuu

SEQ ID NO: 1339064 - RNA, 15 nt, Human
augguaacugcuuuc

SEQ ID NO: 1339065 - RNA, 20 nt, Human
augguaacugcuuucuguuc

SEQ ID NO: 1339066 - RNA, 23 nt, Human
augguaacugcuuucuguuccaa

SEQ ID NO: 1339067 - RNA, 14 nt, Human
augguaauuguugc

SEQ ID NO: 1339068 - RNA, 16 nt, Human
augguaccagaugcag

SEQ ID NO: 1339069 - RNA, 21 nt, Human
augguacugacuuugcuugcu

SEQ ID NO: 1339070 - RNA, 23 nt, Human
augguacuguacagcuggcucua

SEQ ID NO: 1339071 - RNA, 17 nt, Human
augguaggcauuuccua

SEQ ID NO: 1339072 - RNA, 18 nt, Human
augguaggcauuuccuau

SEQ ID NO: 1339073 - RNA, 13 nt, Human
augguccaggaga

SEQ ID NO: 1339074 - RNA, 16 nt, Human
augguccaggagaagg

SEQ ID NO: 1339075 - RNA, 18 nt, Human
augguccaggagaaggcc

SEQ ID NO: 1339076 - RNA, 19 nt, Human
augguccaggagaaggcca

SEQ ID NO: 1339077 - RNA, 20 nt, Human
augguccaauuaguuuccuu

SEQ ID NO: 1339078 - RNA, 17 nt, Human
auggucccacaucccug

SEQ ID NO: 1339079 - RNA, 19 nt, Human
auggucccacaucccuggg

SEQ ID NO: 1339080 - RNA, 20 nt, Human
auggucccacaucccugggc

SEQ ID NO: 1339081 - RNA, 22 nt, Human
auggucccacaucccugggccu

SEQ ID NO: 1339082 - RNA, 23 nt, Human
auggucccacaucccugggccug

SEQ ID NO: 1339083 - RNA, 19 nt, Human
auccucaguuuuugugaaa

SEQ ID NO: 1339084 - RNA, 13 nt, Human
aucccuacaugua

SEQ ID NO: 1339085 - RNA, 14 nt, Human
aucccuacauguau

SEQ ID NO: 1339086 - RNA, 15 nt, Human
aucccuacauguauu

SEQ ID NO: 1339087 - RNA, 18 nt, Human
aucccuacauguauugca

SEQ ID NO: 1339088 - RNA, 15 nt, Human
aucccggcugcccuu

SEQ ID NO: 1339089 - RNA, 15 nt, Human
auccccacgccacag

SEQ ID NO: 1339090 - RNA, 16 nt, Human
auccccacgccacagc

SEQ ID NO: 1339091 - RNA, 17 nt, Human
auccccacgccacagcc

SEQ ID NO: 1339092 - RNA, 18 nt, Human
auccccacgccacagccc

SEQ ID NO: 1339093 - RNA, 20 nt, Human
auccccacgccacagcccuu

SEQ ID NO: 1339094 - RNA, 21 nt, Human
auccccacgccacagcccuuu

SEQ ID NO: 1339095 - RNA, 13 nt, Human
aucccguguucuc

SEQ ID NO: 1339096 - RNA, 16 nt, Human
aucccguguucuccuu

SEQ ID NO: 1339097 - RNA, 12 nt, Human
aucccuacaugu

SEQ ID NO: 1339098 - RNA, 18 nt, Human
auccccaagccuggcaag

SEQ ID NO: 1339099 - RNA, 17 nt, Human
auccccaaggcacuuga

SEQ ID NO: 1339100 - RNA, 19 nt, Human
auccagagucccugccugg

SEQ ID NO: 1339101 - RNA, 20 nt, Human
auccagagucccugccugga

SEQ ID NO: 1339102 - RNA, 21 nt, Human
auccagagucccugccuggac

SEQ ID NO: 1339103 - RNA, 17 nt, Human
auccaccugccuuggcu

SEQ ID NO: 1339104 - RNA, 13 nt, Human
auccacucgccuu

SEQ ID NO: 1339105 - RNA, 22 nt, Human
auccuucaucuggauuccagag

SEQ ID NO: 1339106 - RNA, 16 nt, Human
auccuucacugcucac

SEQ ID NO: 1339107 - RNA, 16 nt, Human
auccuugagucaaaaa

SEQ ID NO: 1339108 - RNA, 23 nt, Human
auccuugaagguauaucuagguu

SEQ ID NO: 1339109 - RNA, 16 nt, Human
auccuugaagguauau

SEQ ID NO: 1339110 - RNA, 22 nt, Human
auccuugccaauagugucaucc

SEQ ID NO: 1339111 - RNA, 16 nt, Human
auccucacagugaaca

SEQ ID NO: 1339112 - RNA, 12 nt, Human
auccucaaucca

SEQ ID NO: 1339113 - RNA, 15 nt, Human
auccucaauccagcu

SEQ ID NO: 1339114 - RNA, 13 nt, Human
auccuuacaaguu

SEQ ID NO: 1339115 - RNA, 18 nt, Human
auccuuagaucuggcaug

SEQ ID NO: 1339116 - RNA, 14 nt, Human
auccuuagaucugg

SEQ ID NO: 1339117 - RNA, 15 nt, Human
aucgccuuccccacc

SEQ ID NO: 1339118 - RNA, 22 nt, Human
aucgcuccugcagccccagccc

SEQ ID NO: 1339119 - RNA, 12 nt, Human
aucgccuuuccc

SEQ ID NO: 1339120 - RNA, 14 nt, Human
auccuugucuuauu

SEQ ID NO: 1339121 - RNA, 20 nt, Human
auccuuucauauaguuagcu

SEQ ID NO: 1339122 - RNA, 17 nt, Human
auccuuucauauaguua

SEQ ID NO: 1339123 - RNA, 12 nt, Human
aucgccuucccc

SEQ ID NO: 1339124 - RNA, 13 nt, Human
aucgccuucccca

SEQ ID NO: 1339125 - RNA, 14 nt, Human
aucaaauauauuca

SEQ ID NO: 1339126 - RNA, 12 nt, Human
aucaaagaugaa

SEQ ID NO: 1339127 - RNA, 18 nt, Human
aucaaagcaucuugcauu

SEQ ID NO: 1339128 - RNA, 23 nt, Human
aucaaaaugcucuuauuucauca

SEQ ID NO: 1339129 - RNA, 22 nt, Human
aucaaacaccaacauaaaaaug

SEQ ID NO: 1339130 - RNA, 13 nt, Human
aucaaaaugcuuu

SEQ ID NO: 1339131 - RNA, 23 nt, Human
aucaaacaccaacauaaaaauga

SEQ ID NO: 1339132 - RNA, 15 nt, Human
aucaaacauuuucug

SEQ ID NO: 1339133 - RNA, 16 nt, Human
aucaaacauuuucugg

SEQ ID NO: 1339134 - RNA, 21 nt, Human
aucaaaaugcucuuauuucau

SEQ ID NO: 1339135 - RNA, 20 nt, Human
aucaaaaugcucuuauuuca

SEQ ID NO: 1339136 - RNA, 12 nt, Human
aucaaaaugcuu

SEQ ID NO: 1339137 - RNA, 22 nt, Human
aucaaaaugcuuuuuauuucug

SEQ ID NO: 1339138 - RNA, 21 nt, Human
auauuucccaugauuucaugu

SEQ ID NO: 1339139 - RNA, 19 nt, Human
auauuucccaugauuucau

SEQ ID NO: 1339140 - RNA, 19 nt, Human
aucaaaaugcucuuauuuc

SEQ ID NO: 1339141 - RNA, 15 nt, Human
aucaaaaugcucuua

SEQ ID NO: 1339142 - RNA, 23 nt, Human
aucaaaaucucuccacuuucagc

SEQ ID NO: 1339143 - RNA, 13 nt, Human
aucaaaaucucuc

SEQ ID NO: 1339144 - RNA, 15 nt, Human
aucaaaaucucucca

SEQ ID NO: 1339145 - RNA, 16 nt, Human
aucaaaaucucuccac

SEQ ID NO: 1339146 - RNA, 17 nt, Human
aucaaaaucucuccacu

SEQ ID NO: 1339147 - RNA, 16 nt, Human
aucaccgacugaaaau

SEQ ID NO: 1339148 - RNA, 16 nt, Human
aucacccaacgcucca

SEQ ID NO: 1339149 - RNA, 15 nt, Human
aucacccagacauaa

SEQ ID NO: 1339150 - RNA, 23 nt, Human
aucacccagacauaaaggaaaag

SEQ ID NO: 1339151 - RNA, 19 nt, Human
aucaccgugggcucccuga

SEQ ID NO: 1339152 - RNA, 20 nt, Human
aucaccgugggcucccugac

SEQ ID NO: 1339153 - RNA, 22 nt, Human
aucaccgugggcucccugacug

SEQ ID NO: 1339154 - RNA, 23 nt, Human
aucaccacaaacuguaauacaau

SEQ ID NO: 1339155 - RNA, 13 nt, Human
aucaccacaguuu

SEQ ID NO: 1339156 - RNA, 20 nt, Human
aucacaugaauuauuacagu

SEQ ID NO: 1339157 - RNA, 22 nt, Human
aucacaugaauuauuacagugu

SEQ ID NO: 1339158 - RNA, 22 nt, Human
aucaaauauauucagccuggcu

SEQ ID NO: 1339159 - RNA, 13 nt, Human
aucacacacauug

SEQ ID NO: 1339160 - RNA, 20 nt, Human
aucacacacauugcugugaa

SEQ ID NO: 1339161 - RNA, 13 nt, Human
aucacagcccagc

SEQ ID NO: 1339162 - RNA, 15 nt, Human
aucacagcccagccc

SEQ ID NO: 1339163 - RNA, 16 nt, Human
aucacagcccagcccg

SEQ ID NO: 1339164 - RNA, 19 nt, Human
aucaggaagagaaggagca

SEQ ID NO: 1339165 - RNA, 17 nt, Human
aucaggaagagaaggag

SEQ ID NO: 1339166 - RNA, 14 nt, Human
aucaggaagagaag

SEQ ID NO: 1339167 - RNA, 13 nt, Human
aucaggaacguuu

SEQ ID NO: 1339168 - RNA, 23 nt, Human
aucaccucagauggcagcuuuua

SEQ ID NO: 1339169 - RNA, 23 nt, Human
aucaggaacguuuagcugacaaa

SEQ ID NO: 1339170 - RNA, 18 nt, Human
aucaugaagauauuuuuc

SEQ ID NO: 1339171 - RNA, 13 nt, Human
aucagcuuauugu

SEQ ID NO: 1339172 - RNA, 19 nt, Human
aucaccuacucacacaggc

SEQ ID NO: 1339173 - RNA, 16 nt, Human
aucaccuagcugaaug

SEQ ID NO: 1339174 - RNA, 20 nt, Human
aucaccuagcugaauguuuu

SEQ ID NO: 1339175 - RNA, 21 nt, Human
aucaccuagcugaauguuuuu

SEQ ID NO: 1339176 - RNA, 23 nt, Human
aucaccuagcugaauguuuuucu

SEQ ID NO: 1339177 - RNA, 14 nt, Human
aucaccuauuucca

SEQ ID NO: 1339178 - RNA, 15 nt, Human
aucaccuauuuccau

SEQ ID NO: 1339179 - RNA, 22 nt, Human
aucaccuauuuccauucaacaa

SEQ ID NO: 1339180 - RNA, 15 nt, Human
aucaccucagauggc

SEQ ID NO: 1339181 - RNA, 16 nt, Human
aucaccucagauggca

SEQ ID NO: 1339182 - RNA, 19 nt, Human
aucaccucagauggcagcu

SEQ ID NO: 1339183 - RNA, 22 nt, Human
aucaccucagauggcagcuuuu

SEQ ID NO: 1339184 - RNA, 12 nt, Human
aucaugugaaau

SEQ ID NO: 1339185 - RNA, 14 nt, Human
aucaugugaaauca

SEQ ID NO: 1339186 - RNA, 17 nt, Human
aucaugaauuaguuuua

SEQ ID NO: 1339187 - RNA, 21 nt, Human
aucaugaauuaguuuuauaug

SEQ ID NO: 1339188 - RNA, 16 nt, Human
aucuauagaaagcuau

SEQ ID NO: 1339189 - RNA, 16 nt, Human
aucuauaauuuaccua

SEQ ID NO: 1339190 - RNA, 23 nt, Human
aucuauaauuuaccuaagauuac

SEQ ID NO: 1339191 - RNA, 23 nt, Human
aucuauaaggugcucucuuucug

SEQ ID NO: 1339192 - RNA, 11 nt, Human
aucuauaauuu

SEQ ID NO: 1339193 - RNA, 13 nt, Human
aucuauaauuuac

SEQ ID NO: 1339194 - RNA, 22 nt, Human
aucuaguuccccuguuuauuca

SEQ ID NO: 1339195 - RNA, 15 nt, Human
aucuauaaacuauaa

SEQ ID NO: 1339196 - RNA, 20 nt, Human
aucuaguuccccuguuuauu

SEQ ID NO: 1339197 - RNA, 19 nt, Human
aucuaguuccccuguuuau

SEQ ID NO: 1339198 - RNA, 23 nt, Human
aucuaguuccccuguuuauucau

SEQ ID NO: 1339199 - RNA, 17 nt, Human
aucuaguuccccuguuu

SEQ ID NO: 1339200 - RNA, 22 nt, Human
aucuaguuauuuacaggaacuu

SEQ ID NO: 1339201 - RNA, 23 nt, Human
aucuagguuuaugacaguaauug

SEQ ID NO: 1339202 - RNA, 22 nt, Human
aucuagguuuaugacaguaauu

SEQ ID NO: 1339203 - RNA, 21 nt, Human
aucuagguuuaugacaguaau

SEQ ID NO: 1339204 - RNA, 18 nt, Human
aucuagguuuaugacagu

SEQ ID NO: 1339205 - RNA, 15 nt, Human
aucuagguuuaugac

SEQ ID NO: 1339206 - RNA, 14 nt, Human
aucuagguuuauga

SEQ ID NO: 1339207 - RNA, 17 nt, Human
aucuauagaaagcuaua

SEQ ID NO: 1339208 - RNA, 16 nt, Human
aucuauagaacugaau

SEQ ID NO: 1339209 - RNA, 21 nt, Human
aucuauaggaagauugaaccu

SEQ ID NO: 1339210 - RNA, 15 nt, Human
aucuauauuuaacaa

SEQ ID NO: 1339211 - RNA, 14 nt, Human
aucuauauuuuaca

SEQ ID NO: 1339212 - RNA, 19 nt, Human
aucuauuucauguuuuuga

SEQ ID NO: 1339213 - RNA, 20 nt, Human
aucuccgucaacucauauuu

SEQ ID NO: 1339214 - RNA, 15 nt, Human
aucuccguggcuuug

SEQ ID NO: 1339215 - RNA, 14 nt, Human
aucuauuuuggauu

SEQ ID NO: 1339216 - RNA, 22 nt, Human
aucuauuuuggauuguauauug

SEQ ID NO: 1339217 - RNA, 12 nt, Human
aucuccugaaaa

SEQ ID NO: 1339218 - RNA, 16 nt, Human
aucuccugccuuccuc

SEQ ID NO: 1339219 - RNA, 17 nt, Human
aucuccugccuuccucc

SEQ ID NO: 1339220 - RNA, 20 nt, Human
aucuccugccuuccuccugg

SEQ ID NO: 1339221 - RNA, 17 nt, Human
aucucuccacuuucagc

SEQ ID NO: 1339222 - RNA, 18 nt, Human
aucucuccacuuucagcu

SEQ ID NO: 1339223 - RNA, 19 nt, Human
aucucuccacuuucagcug

SEQ ID NO: 1339224 - RNA, 21 nt, Human
aucucuccacuuucagcuguc

SEQ ID NO: 1339225 - RNA, 20 nt, Human
aucucuccacuuucagcugu

SEQ ID NO: 1339226 - RNA, 15 nt, Human
aucuggauuccagag

SEQ ID NO: 1339227 - RNA, 16 nt, Human
aucuggcaacaucuuu

SEQ ID NO: 1339228 - RNA, 17 nt, Human
aucuggcaacaucuuua

SEQ ID NO: 1339229 - RNA, 18 nt, Human
aucuggggagcaggcagc

SEQ ID NO: 1339230 - RNA, 19 nt, Human
aucuggggagcaggcagcc

SEQ ID NO: 1339231 - RNA, 21 nt, Human
aucuggggagcaggcagccag

SEQ ID NO: 1339232 - RNA, 16 nt, Human
aucuggagagaacagg

SEQ ID NO: 1339233 - RNA, 14 nt, Human
aucuggagagaaca

SEQ ID NO: 1339234 - RNA, 16 nt, Human
aucucugcuuuggaaa

SEQ ID NO: 1339235 - RNA, 19 nt, Human
aucucugaagccacaaaua

SEQ ID NO: 1339236 - RNA, 18 nt, Human
aucucugaagccacaaau

SEQ ID NO: 1339237 - RNA, 13 nt, Human
aucuuauuuagga

SEQ ID NO: 1339238 - RNA, 13 nt, Human
aucuuauucauuu

SEQ ID NO: 1339239 - RNA, 18 nt, Human
aucuuauucauuuucucu

SEQ ID NO: 1339240 - RNA, 14 nt, Human
aucuucaauccuug

SEQ ID NO: 1339241 - RNA, 20 nt, Human
aucuuauucauuuucucuaa

SEQ ID NO: 1339242 - RNA, 18 nt, Human
aucugggggccucuucug

SEQ ID NO: 1339243 - RNA, 23 nt, Human
aucuggggagcaggcagccagca

SEQ ID NO: 1339244 - RNA, 22 nt, Human
aucuggggagcaggcagccagc

SEQ ID NO: 1339245 - RNA, 15 nt, Human
aucugggucucuaau

SEQ ID NO: 1339246 - RNA, 18 nt, Human
aucugggucucuaaucug

SEQ ID NO: 1339247 - RNA, 13 nt, Human
aucuucuaaaugg

SEQ ID NO: 1339248 - RNA, 21 nt, Human
aucuucuaaacccaauccaaa

SEQ ID NO: 1339249 - RNA, 13 nt, Human
augaccaguaaag

SEQ ID NO: 1339250 - RNA, 19 nt, Human
augaccacuuuuuagaaag

SEQ ID NO: 1339251 - RNA, 18 nt, Human
augaccacacuccagcug

SEQ ID NO: 1339252 - RNA, 15 nt, Human
augaccacacuccag

SEQ ID NO: 1339253 - RNA, 15 nt, Human
augaaguuguaggua

SEQ ID NO: 1339254 - RNA, 20 nt, Human
augaaguccaagcauuuaga

SEQ ID NO: 1339255 - RNA, 23 nt, Human
augaaguccaagcauuuagaugu

SEQ ID NO: 1339256 - RNA, 14 nt, Human
augaaaaugucuug

SEQ ID NO: 1339257 - RNA, 12 nt, Human
augaaguauuuu

SEQ ID NO: 1339258 - RNA, 21 nt, Human
augaaguacucauacauguua

SEQ ID NO: 1339259 - RNA, 15 nt, Human
augaaaaugucuugu

SEQ ID NO: 1339260 - RNA, 17 nt, Human
augaaaacagaaugucu

SEQ ID NO: 1339261 - RNA, 14 nt, Human
augaaaauguccau

SEQ ID NO: 1339262 - RNA, 13 nt, Human
augaaaaugucuu

SEQ ID NO: 1339263 - RNA, 13 nt, Human
augacugcacaug

SEQ ID NO: 1339264 - RNA, 13 nt, Human
augacugaauggg

SEQ ID NO: 1339265 - RNA, 15 nt, Human
augacugccaagacu

SEQ ID NO: 1339266 - RNA, 16 nt, Human
augacugccaagacug

SEQ ID NO: 1339267 - RNA, 21 nt, Human
augacugccaagacugcugug

SEQ ID NO: 1339268 - RNA, 12 nt, Human
augacugcuugc

SEQ ID NO: 1339269 - RNA, 13 nt, Human
augacugcuugcc

SEQ ID NO: 1339270 - RNA, 22 nt, Human
augacugcuugcccuaagcaga

SEQ ID NO: 1339271 - RNA, 17 nt, Human
augacugcuugcccuaa

SEQ ID NO: 1339272 - RNA, 21 nt, Human
augacugcuugcccuaagcag

SEQ ID NO: 1339273 - RNA, 19 nt, Human
augacuguuuuucggacag

SEQ ID NO: 1339274 - RNA, 20 nt, Human
augagggguuccuccccucc

SEQ ID NO: 1339275 - RNA, 22 nt, Human
augacuguuuuucggacaguuu

SEQ ID NO: 1339276 - RNA, 21 nt, Human
augacuguuuuucggacaguu

SEQ ID NO: 1339277 - RNA, 13 nt, Human
augagggcagcag

SEQ ID NO: 1339278 - RNA, 14 nt, Human
augagggcagcagc

SEQ ID NO: 1339279 - RNA, 15 nt, Human
augagggcagcagcc

SEQ ID NO: 1339280 - RNA, 16 nt, Human
augagggcagcagcca

SEQ ID NO: 1339281 - RNA, 17 nt, Human
augagggcagcagccag

SEQ ID NO: 1339282 - RNA, 18 nt, Human
augagggcagcagccagc

SEQ ID NO: 1339283 - RNA, 19 nt, Human
augagggcagcagccagcc

SEQ ID NO: 1339284 - RNA, 20 nt, Human
augagggcagcagccagccc

SEQ ID NO: 1339285 - RNA, 23 nt, Human
augagggcagcagccagcccugc

SEQ ID NO: 1339286 - RNA, 22 nt, Human
augagggcagcagccagcccug

SEQ ID NO: 1339287 - RNA, 17 nt, Human
augagggguuccucccc

SEQ ID NO: 1339288 - RNA, 22 nt, Human
augagggguuccuccccuccag

SEQ ID NO: 1339289 - RNA, 15 nt, Human
augaaaacagaaugu

SEQ ID NO: 1339290 - RNA, 19 nt, Human
augaaaacagaaugucucu

SEQ ID NO: 1339291 - RNA, 17 nt, Human
agugacccugcucucac

SEQ ID NO: 1339292 - RNA, 16 nt, Human
agugacccuggcuccu

SEQ ID NO: 1339293 - RNA, 17 nt, Human
agugaccucagcuuuga

SEQ ID NO: 1339294 - RNA, 14 nt, Human
agugacccugcucu

SEQ ID NO: 1339295 - RNA, 15 nt, Human
agugaauucccucac

SEQ ID NO: 1339296 - RNA, 16 nt, Human
agugaauucccucacu

SEQ ID NO: 1339297 - RNA, 17 nt, Human
agugaauucccucacuc

SEQ ID NO: 1339298 - RNA, 14 nt, Human
agugaauuugccug

SEQ ID NO: 1339299 - RNA, 16 nt, Human
agucuguugauuaaag

SEQ ID NO: 1339300 - RNA, 17 nt, Human
agucuguuuacugcaag

SEQ ID NO: 1339301 - RNA, 19 nt, Human
agugaaugcugggacucag

SEQ ID NO: 1339302 - RNA, 19 nt, Human
agugaauuaguuuuaaaau

SEQ ID NO: 1339303 - RNA, 20 nt, Human
agugaauuaguuuuaaaaug

SEQ ID NO: 1339304 - RNA, 14 nt, Human
agugaauucccuca

SEQ ID NO: 1339305 - RNA, 23 nt, Human
agugaauucccucacucgucucc

SEQ ID NO: 1339306 - RNA, 16 nt, Human
agucugagagaggcca

SEQ ID NO: 1339307 - RNA, 16 nt, Human
agucugaauuuuuaaa

SEQ ID NO: 1339308 - RNA, 23 nt, Human
agucugagagaggccauucuuuc

SEQ ID NO: 1339309 - RNA, 14 nt, Human
agucugagguccug

SEQ ID NO: 1339310 - RNA, 15 nt, Human
agucugagguccuga

SEQ ID NO: 1339311 - RNA, 16 nt, Human
agucugagguccugag

SEQ ID NO: 1339312 - RNA, 17 nt, Human
agucugagguccugagc

SEQ ID NO: 1339313 - RNA, 18 nt, Human
agucugagguccugagca

SEQ ID NO: 1339314 - RNA, 19 nt, Human
agucugagguccugagcac

SEQ ID NO: 1339315 - RNA, 22 nt, Human
agucugagguccugagcacugc

SEQ ID NO: 1339316 - RNA, 20 nt, Human
agucugagguccugagcacu

SEQ ID NO: 1339317 - RNA, 20 nt, Human
agucugugccacguguuugu

SEQ ID NO: 1339318 - RNA, 14 nt, Human
agucuguggaucag

SEQ ID NO: 1339319 - RNA, 17 nt, Human
agucuguggaucagaga

SEQ ID NO: 1339320 - RNA, 18 nt, Human
agugaccucagcuuugau

SEQ ID NO: 1339321 - RNA, 15 nt, Human
agugacccuggcucc

SEQ ID NO: 1339322 - RNA, 17 nt, Human
agugacuaaaccauugu

SEQ ID NO: 1339323 - RNA, 16 nt, Human
agugacuaaaccauug

SEQ ID NO: 1339324 - RNA, 22 nt, Human
agugacuaaaccauugugcauu

SEQ ID NO: 1339325 - RNA, 15 nt, Human
agugacuaauggcau

SEQ ID NO: 1339326 - RNA, 21 nt, Human
agucauuuuuacaauguaauu

SEQ ID NO: 1339327 - RNA, 14 nt, Human
aguccaagaaucca

SEQ ID NO: 1339328 - RNA, 14 nt, Human
aguccugaaggaca

SEQ ID NO: 1339329 - RNA, 20 nt, Human
aguccugaucagagccgugg

SEQ ID NO: 1339330 - RNA, 19 nt, Human
agucaugcguuuaaucaca

SEQ ID NO: 1339331 - RNA, 20 nt, Human
agucauguaagcugaaaaua

SEQ ID NO: 1339332 - RNA, 12 nt, Human
agucaugugacc

SEQ ID NO: 1339333 - RNA, 14 nt, Human
agucauguuuaucu

SEQ ID NO: 1339334 - RNA, 19 nt, Human
agucauguuuaucugcuua

SEQ ID NO: 1339335 - RNA, 14 nt, Human
agucauuuuuacaa

SEQ ID NO: 1339336 - RNA, 22 nt, Human
agucauuuuuacaauguaauua

SEQ ID NO: 1339337 - RNA, 17 nt, Human
aguauuuuguuucagug

SEQ ID NO: 1339338 - RNA, 14 nt, Human
aguauuuuguuuca

SEQ ID NO: 1339339 - RNA, 21 nt, Human
aguauuuuuauauuuaaaugu

SEQ ID NO: 1339340 - RNA, 19 nt, Human
aguauuuuuauauuuaaau

SEQ ID NO: 1339341 - RNA, 16 nt, Human
aguauuuuuucaguau

SEQ ID NO: 1339342 - RNA, 21 nt, Human
aguauuuuuucaguauuauau

SEQ ID NO: 1339343 - RNA, 13 nt, Human
aguauuuuuugua

SEQ ID NO: 1339344 - RNA, 19 nt, Human
aguauuuuuuguauaauug

SEQ ID NO: 1339345 - RNA, 20 nt, Human
aguauuuuuuguauaauugg

SEQ ID NO: 1339346 - RNA, 19 nt, Human
aguaucggcacuguacaaa

SEQ ID NO: 1339347 - RNA, 16 nt, Human
aguaucggcacuguac

SEQ ID NO: 1339348 - RNA, 15 nt, Human
aguaucggcacugua

SEQ ID NO: 1339349 - RNA, 23 nt, Human
aguacuugggagaccuguaauca

SEQ ID NO: 1339350 - RNA, 13 nt, Human
aguacuuguaguu

SEQ ID NO: 1339351 - RNA, 17 nt, Human
aguacuuguaguuccac

SEQ ID NO: 1339352 - RNA, 14 nt, Human
aguacuuguaguuc

SEQ ID NO: 1339353 - RNA, 14 nt, Human
aguauccacuuugc

SEQ ID NO: 1339354 - RNA, 15 nt, Human
agucaaaaauuaaac

SEQ ID NO: 1339355 - RNA, 19 nt, Human
agucaaaacacuuguaauu

SEQ ID NO: 1339356 - RNA, 22 nt, Human
aguauuuuuuguauaauuggau

SEQ ID NO: 1339357 - RNA, 12 nt, Human
agucaaaaagaa

SEQ ID NO: 1339358 - RNA, 14 nt, Human
agucaaaaagaacc

SEQ ID NO: 1339359 - RNA, 17 nt, Human
agucaaaacuacaaauc

SEQ ID NO: 1339360 - RNA, 24 nt, Human
agucaaucaagucuguuuacugca

SEQ ID NO: 1339361 - RNA, 12 nt, Human
agucaaucaagu

SEQ ID NO: 1339362 - RNA, 18 nt, Human
agucaaucaagucuguuu

SEQ ID NO: 1339363 - RNA, 15 nt, Human
agucaaugacaugaa

SEQ ID NO: 1339364 - RNA, 18 nt, Human
agucaaugacaugaauuu

SEQ ID NO: 1339365 - RNA, 23 nt, Human
agucaauguuuucaguucucuug

SEQ ID NO: 1339366 - RNA, 17 nt, Human
agucaauuacucuauaa

SEQ ID NO: 1339367 - RNA, 21 nt, Human
agucaauuacucuauaauaca

SEQ ID NO: 1339368 - RNA, 11 nt, Human
agucacacagu

SEQ ID NO: 1339369 - RNA, 20 nt, Human
aguaaaucacgcuuuuugaa

SEQ ID NO: 1339370 - RNA, 19 nt, Human
aguaaaucacgcuuuuuga

SEQ ID NO: 1339371 - RNA, 20 nt, Human
aguaaaugugauucaccucu

SEQ ID NO: 1339372 - RNA, 20 nt, Human
aguaacaauacaaauggauu

SEQ ID NO: 1339373 - RNA, 15 nt, Human
aguaaaucuuuuaca

SEQ ID NO: 1339374 - RNA, 14 nt, Human
aguaagagguguua

SEQ ID NO: 1339375 - RNA, 15 nt, Human
aguaaauuauagcuc

SEQ ID NO: 1339376 - RNA, 12 nt, Human
aguaacaaaaau

SEQ ID NO: 1339377 - RNA, 15 nt, Human
aguaacaaaaauaaa

SEQ ID NO: 1339378 - RNA, 13 nt, Human
aguaacaaaaaua

SEQ ID NO: 1339379 - RNA, 19 nt, Human
aguaacaauacaaauggau

SEQ ID NO: 1339380 - RNA, 12 nt, Human
aguaacacuaau

SEQ ID NO: 1339381 - RNA, 13 nt, Human
aguaacacuaaua

SEQ ID NO: 1339382 - RNA, 16 nt, Human
aguaacacuaauauau

SEQ ID NO: 1339383 - RNA, 23 nt, Human
aguaacacuaauauauuuaaaaa

SEQ ID NO: 1339384 - RNA, 17 nt, Human
aguaacacuaauauauu

SEQ ID NO: 1339385 - RNA, 17 nt, Human
aguaacauuugcuguuu

SEQ ID NO: 1339386 - RNA, 15 nt, Human
aguaacauuugcugu

SEQ ID NO: 1339387 - RNA, 23 nt, Human
aguacuaacuccuaggaaaauac

SEQ ID NO: 1339388 - RNA, 13 nt, Human
aguacucauacau

SEQ ID NO: 1339389 - RNA, 20 nt, Human
aguacugggauuacaggcgu

SEQ ID NO: 1339390 - RNA, 16 nt, Human
aguacugggauuacag

SEQ ID NO: 1339391 - RNA, 23 nt, Human
aguacuuagcuaguuuuauucuu

SEQ ID NO: 1339392 - RNA, 20 nt, Human
agugcuaauuuugaaaaacu

SEQ ID NO: 1339393 - RNA, 18 nt, Human
agugcuaauuuugaaaaa

SEQ ID NO: 1339394 - RNA, 11 nt, Human
agugcucugau

SEQ ID NO: 1339395 - RNA, 16 nt, Human
agugcucugaucccuc

SEQ ID NO: 1339396 - RNA, 17 nt, Human
agugcucugaucccucu

SEQ ID NO: 1339397 - RNA, 21 nt, Human
agugcucugaucccucuacag

SEQ ID NO: 1339398 - RNA, 14 nt, Human
agugcucuuuucuc

SEQ ID NO: 1339399 - RNA, 17 nt, Human
agugcucuuuucuccuc

SEQ ID NO: 1339400 - RNA, 14 nt, Human
agugcugaacagug

SEQ ID NO: 1339401 - RNA, 15 nt, Human
agugcugaacagugg

SEQ ID NO: 1339402 - RNA, 16 nt, Human
agugcugaacagugga

SEQ ID NO: 1339403 - RNA, 15 nt, Human
agugcuaauuuugaa

SEQ ID NO: 1339404 - RNA, 17 nt, Human
agugaucugcccgccuc

SEQ ID NO: 1339405 - RNA, 17 nt, Human
agugaugcuaaaaccug

SEQ ID NO: 1339406 - RNA, 16 nt, Human
agugauccuuacaagu

SEQ ID NO: 1339407 - RNA, 20 nt, Human
agugauggguuaguggaugg

SEQ ID NO: 1339408 - RNA, 21 nt, Human
agugauucucaugccucagcc

SEQ ID NO: 1339409 - RNA, 19 nt, Human
agugucaaugcagccccca

SEQ ID NO: 1339410 - RNA, 22 nt, Human
agugggaggguaccagcagaaa

SEQ ID NO: 1339411 - RNA, 24 nt, Human
agugggcaaaagcuuacaaauacu

SEQ ID NO: 1339412 - RNA, 14 nt, Human
agugggcaaaagcu

SEQ ID NO: 1339413 - RNA, 20 nt, Human
agugucauuucucauccaca

SEQ ID NO: 1339414 - RNA, 22 nt, Human
aguguccuuggcaggcugauuu

SEQ ID NO: 1339415 - RNA, 18 nt, Human
agugucauuucucaucca

SEQ ID NO: 1339416 - RNA, 16 nt, Human
agugucacucaaggcg

SEQ ID NO: 1339417 - RNA, 14 nt, Human
agugucaggaggaa

SEQ ID NO: 1339418 - RNA, 14 nt, Human
agugucaggcacug

SEQ ID NO: 1339419 - RNA, 15 nt, Human
agugucaggcacugg

SEQ ID NO: 1339420 - RNA, 19 nt, Human
agugggacagggcauggcc

SEQ ID NO: 1339421 - RNA, 21 nt, Human
agugggacagggcauggccag

SEQ ID NO: 1339422 - RNA, 19 nt, Human
agugggaaaaauguaggag

SEQ ID NO: 1339423 - RNA, 12 nt, Human
agugggaagccc

SEQ ID NO: 1339424 - RNA, 17 nt, Human
agugggaagcccauccu

SEQ ID NO: 1339425 - RNA, 21 nt, Human
agugggaagcccauccugacc

SEQ ID NO: 1339426 - RNA, 22 nt, Human
agugggaagcccauccugacca

SEQ ID NO: 1339427 - RNA, 14 nt, Human
agugggaaaaaugu

SEQ ID NO: 1339428 - RNA, 17 nt, Human
agugggaaaaauguagg

SEQ ID NO: 1339429 - RNA, 18 nt, Human
agugggaaaaauguagga

SEQ ID NO: 1339430 - RNA, 16 nt, Human
agugucuguguuuuga

SEQ ID NO: 1339431 - RNA, 21 nt, Human
aguugacuuauaguacaugau

SEQ ID NO: 1339432 - RNA, 18 nt, Human
aguugacuuauaguacau

SEQ ID NO: 1339433 - RNA, 17 nt, Human
aguugacuuauaguaca

SEQ ID NO: 1339434 - RNA, 14 nt, Human
aguugagacaagaa

SEQ ID NO: 1339435 - RNA, 18 nt, Human
aguugagauaguuuucau

SEQ ID NO: 1339436 - RNA, 17 nt, Human
aguugagacaagaaaau

SEQ ID NO: 1339437 - RNA, 15 nt, Human
aguugacuuauagua

SEQ ID NO: 1339438 - RNA, 23 nt, Human
aguugaauuuuuuuuaacauucc

SEQ ID NO: 1339439 - RNA, 22 nt, Human
aguugaauuuuuuuuaacauuc

SEQ ID NO: 1339440 - RNA, 13 nt, Human
aguugaauuuuuu

SEQ ID NO: 1339441 - RNA, 18 nt, Human
aguugaauuuuuuuuaac

SEQ ID NO: 1339442 - RNA, 21 nt, Human
aguugaauuuuuuuuaacauu

SEQ ID NO: 1339443 - RNA, 17 nt, Human
aguugauaaagauuuuu

SEQ ID NO: 1339444 - RNA, 21 nt, Human
aguugauaaagauuuuuuaau

SEQ ID NO: 1339445 - RNA, 23 nt, Human
aguugauaaagauuuuuuaauaa

SEQ ID NO: 1339446 - RNA, 16 nt, Human
aguugaggacuucuug

SEQ ID NO: 1339447 - RNA, 15 nt, Human
aguugaggacuucuu

SEQ ID NO: 1339448 - RNA, 11 nt, Human
aguugaggcca

SEQ ID NO: 1339449 - RNA, 13 nt, Human
aguugaggccacu

SEQ ID NO: 1339450 - RNA, 19 nt, Human
aguugucccgauuguaacu

SEQ ID NO: 1339451 - RNA, 20 nt, Human
aguugucccgauuguaacuc

SEQ ID NO: 1339452 - RNA, 11 nt, Human
aguugucucug

SEQ ID NO: 1339453 - RNA, 12 nt, Human
aguugucucuga

SEQ ID NO: 1339454 - RNA, 13 nt, Human
aguugucucugau

SEQ ID NO: 1339455 - RNA, 16 nt, Human
aguugucucugaugca

SEQ ID NO: 1339456 - RNA, 22 nt, Human
aguugucucugaugcagcuuau

SEQ ID NO: 1339457 - RNA, 17 nt, Human
aguugucucugaugcag

SEQ ID NO: 1339458 - RNA, 22 nt, Human
aguugugaguuuaccuuguaua

SEQ ID NO: 1339459 - RNA, 14 nt, Human
aguugugcuugagc

SEQ ID NO: 1339460 - RNA, 21 nt, Human
aguucagcgcugucaggauug

SEQ ID NO: 1339461 - RNA, 21 nt, Human
aguucagcauccgcaggugcu

SEQ ID NO: 1339462 - RNA, 20 nt, Human
aguucagaguccuuaaaaug

SEQ ID NO: 1339463 - RNA, 20 nt, Human
auaguacaugauaaaugaua

SEQ ID NO: 1339464 - RNA, 17 nt, Human
auaguaccaaucauuuu

SEQ ID NO: 1339465 - RNA, 23 nt, Human
auaguagaacgcuaucugggaag

SEQ ID NO: 1339466 - RNA, 21 nt, Human
auauaauaaauguacauuaau

SEQ ID NO: 1339467 - RNA, 14 nt, Human
auauaaucauuauu

SEQ ID NO: 1339468 - RNA, 17 nt, Human
auauaaucaucaaguaa

SEQ ID NO: 1339469 - RNA, 24 nt, Human
auagguuuggacaaaauggaauac

SEQ ID NO: 1339470 - RNA, 15 nt, Human
auagccucugucugg

SEQ ID NO: 1339471 - RNA, 16 nt, Human
auagccucugucuggc

SEQ ID NO: 1339472 - RNA, 23 nt, Human
auagccucugucuggcaaugcca

SEQ ID NO: 1339473 - RNA, 23 nt, Human
auagcccuguccuggugguauuu

SEQ ID NO: 1339474 - RNA, 18 nt, Human
auagcccuguccuggugg

SEQ ID NO: 1339475 - RNA, 13 nt, Human
auaguaaaaauaa

SEQ ID NO: 1339476 - RNA, 14 nt, Human
auaguaaaaauaaa

SEQ ID NO: 1339477 - RNA, 19 nt, Human
auaguaaaucacgcuuuuu

SEQ ID NO: 1339478 - RNA, 13 nt, Human
auaguaaaucacg

SEQ ID NO: 1339479 - RNA, 19 nt, Human
auaguaacuucuuauggaa

SEQ ID NO: 1339480 - RNA, 21 nt, Human
auaguaacuucuuauggaauu

SEQ ID NO: 1339481 - RNA, 15 nt, Human
auauacagcucagaa

SEQ ID NO: 1339482 - RNA, 12 nt, Human
auagaaagcuau

SEQ ID NO: 1339483 - RNA, 22 nt, Human
auagaaauaaaggaugugauug

SEQ ID NO: 1339484 - RNA, 19 nt, Human
auagaaaugccaagcacuu

SEQ ID NO: 1339485 - RNA, 12 nt, Human
auagaaaugcca

SEQ ID NO: 1339486 - RNA, 16 nt, Human
auagaaaugccaagca

SEQ ID NO: 1339487 - RNA, 17 nt, Human
auagaaaugccaagcac

SEQ ID NO: 1339488 - RNA, 17 nt, Human
auagcacaggcuaauuu

SEQ ID NO: 1339489 - RNA, 21 nt, Human
auagcagaaaaaccaacaucu

SEQ ID NO: 1339490 - RNA, 16 nt, Human
auagcagacaguguuu

SEQ ID NO: 1339491 - RNA, 18 nt, Human
auagcagcuuauucacaa

SEQ ID NO: 1339492 - RNA, 13 nt, Human
auagcaugcaucu

SEQ ID NO: 1339493 - RNA, 15 nt, Human
auagcagcuuauuca

SEQ ID NO: 1339494 - RNA, 14 nt, Human
auagcacaggcuaa

SEQ ID NO: 1339495 - RNA, 13 nt, Human
auagcagccuuuc

SEQ ID NO: 1339496 - RNA, 19 nt, Human
auagcagccuuucucucuu

SEQ ID NO: 1339497 - RNA, 15 nt, Human
auagcauuguaaaag

SEQ ID NO: 1339498 - RNA, 14 nt, Human
auagcccuguccug

SEQ ID NO: 1339499 - RNA, 15 nt, Human
auagcccuguccugg

SEQ ID NO: 1339500 - RNA, 16 nt, Human
auagcccuguccuggu

SEQ ID NO: 1339501 - RNA, 16 nt, Human
auacuugucuguuuua

SEQ ID NO: 1339502 - RNA, 13 nt, Human
auacuugucuguu

SEQ ID NO: 1339503 - RNA, 17 nt, Human
auacuuguaauuaugga

SEQ ID NO: 1339504 - RNA, 15 nt, Human
auacuuguaauuaug

SEQ ID NO: 1339505 - RNA, 16 nt, Human
auacuuguaauuaugg

SEQ ID NO: 1339506 - RNA, 21 nt, Human
auacuuguaauuauggaguca

SEQ ID NO: 1339507 - RNA, 15 nt, Human
auacuuucccuaccc

SEQ ID NO: 1339508 - RNA, 21 nt, Human
auacuuucccuacccucuaga

SEQ ID NO: 1339509 - RNA, 22 nt, Human
auacuuucccuacccucuagag

SEQ ID NO: 1339510 - RNA, 23 nt, Human
auacuuucccuacccucuagaga

SEQ ID NO: 1339511 - RNA, 24 nt, Human
auacuuucccuacccucuagagaa

SEQ ID NO: 1339512 - RNA, 22 nt, Human
auacuuugaaaggagaugucuu

SEQ ID NO: 1339513 - RNA, 23 nt, Human
auacuuugaaaggagaugucuug

SEQ ID NO: 1339514 - RNA, 12 nt, Human
auacuuugaaug

SEQ ID NO: 1339515 - RNA, 13 nt, Human
auacuuugaaugu

SEQ ID NO: 1339516 - RNA, 15 nt, Human
auacuuugaaugugu

SEQ ID NO: 1339517 - RNA, 17 nt, Human
auacuuugaauguguuu

SEQ ID NO: 1339518 - RNA, 19 nt, Human
auacuuugaauguguuuca

SEQ ID NO: 1339519 - RNA, 20 nt, Human
auacuuugaauguguuucac

SEQ ID NO: 1339520 - RNA, 22 nt, Human
auacuuugaauguguuucacag

SEQ ID NO: 1339521 - RNA, 23 nt, Human
auacuuugaauguguuucacagu

SEQ ID NO: 1339522 - RNA, 22 nt, Human
auacuuugcagcacagcugaga

SEQ ID NO: 1339523 - RNA, 16 nt, Human
auacuuuuacaaguaa

SEQ ID NO: 1339524 - RNA, 22 nt, Human
auagaaaaguauguucuaaccu

SEQ ID NO: 1339525 - RNA, 23 nt, Human
auacuugaagggccagagccagg

SEQ ID NO: 1339526 - RNA, 12 nt, Human
auacuuggauuu

SEQ ID NO: 1339527 - RNA, 13 nt, Human
auacuuggauuua

SEQ ID NO: 1339528 - RNA, 16 nt, Human
auacuuggauuuaguu

SEQ ID NO: 1339529 - RNA, 17 nt, Human
auacuuggauuuaguuu

SEQ ID NO: 1339530 - RNA, 22 nt, Human
auacuuggauuuaguuucagua

SEQ ID NO: 1339531 - RNA, 13 nt, Human
auacuuguaauua

SEQ ID NO: 1339532 - RNA, 14 nt, Human
auacuuguaauuau

SEQ ID NO: 1339533 - RNA, 18 nt, Human
auauauuuuuuucugaaa

SEQ ID NO: 1339534 - RNA, 22 nt, Human
auauuauuuuauguugcauaga

SEQ ID NO: 1339535 - RNA, 15 nt, Human
auauuauuuuauguu

SEQ ID NO: 1339536 - RNA, 14 nt, Human
auauuauguuaaaa

SEQ ID NO: 1339537 - RNA, 16 nt, Human
auauuauguuaaaacu

SEQ ID NO: 1339538 - RNA, 20 nt, Human
auauucaauaaagcugcuga

SEQ ID NO: 1339539 - RNA, 15 nt, Human
auauucaauaaagcu

SEQ ID NO: 1339540 - RNA, 13 nt, Human
auauucaauaaag

SEQ ID NO: 1339541 - RNA, 22 nt, Human
auauuucccaugauuucaugua

SEQ ID NO: 1339542 - RNA, 18 nt, Human
auauuucccaugauuuca

SEQ ID NO: 1339543 - RNA, 11 nt, Human
auauuucauca

SEQ ID NO: 1339544 - RNA, 13 nt, Human
auauuauguuaaa

SEQ ID NO: 1339545 - RNA, 13 nt, Human
auauggccacagu

SEQ ID NO: 1339546 - RNA, 16 nt, Human
auaugcuuaaaauaag

SEQ ID NO: 1339547 - RNA, 18 nt, Human
auaugcuuaaaauaagca

SEQ ID NO: 1339548 - RNA, 14 nt, Human
auaugcuuacugau

SEQ ID NO: 1339549 - RNA, 19 nt, Human
auaugcuuaaaauaagcag

SEQ ID NO: 1339550 - RNA, 13 nt, Human
auaugcacuuaua

SEQ ID NO: 1339551 - RNA, 14 nt, Human
auaugcacuuauaa

SEQ ID NO: 1339552 - RNA, 21 nt, Human
auaucauaauggggguaaagu

SEQ ID NO: 1339553 - RNA, 13 nt, Human
auacagaaaaguu

SEQ ID NO: 1339554 - RNA, 17 nt, Human
auacccccugcaaagcc

SEQ ID NO: 1339555 - RNA, 19 nt, Human
auacccccugcaaagccca

SEQ ID NO: 1339556 - RNA, 23 nt, Human
auacacuuuuucucuuuccauga

SEQ ID NO: 1339557 - RNA, 13 nt, Human
auaccccccucug

SEQ ID NO: 1339558 - RNA, 22 nt, Human
auacacuuauuggaacucugcu

SEQ ID NO: 1339559 - RNA, 18 nt, Human
auaauguuucaaacauau

SEQ ID NO: 1339560 - RNA, 23 nt, Human
auaauguuucaaacauauauaac

SEQ ID NO: 1339561 - RNA, 19 nt, Human
auaauguuguuauuuaaag

SEQ ID NO: 1339562 - RNA, 20 nt, Human
auacccccugcaaagcccag

SEQ ID NO: 1339563 - RNA, 21 nt, Human
auacccccugcaaagcccagc

SEQ ID NO: 1339564 - RNA, 13 nt, Human
auaauggucagag

SEQ ID NO: 1339565 - RNA, 18 nt, Human
auaagguaaaaugccaug

SEQ ID NO: 1339566 - RNA, 20 nt, Human
auaaggugcucucuuucugu

SEQ ID NO: 1339567 - RNA, 17 nt, Human
auaaggugcucucuuuc

SEQ ID NO: 1339568 - RNA, 19 nt, Human
auaagggcaaauuggagaa

SEQ ID NO: 1339569 - RNA, 23 nt, Human
auaagggucccccacucuaaagc

SEQ ID NO: 1339570 - RNA, 16 nt, Human
auaagguaaaaugcca

SEQ ID NO: 1339571 - RNA, 13 nt, Human
auaauguuucaaa

SEQ ID NO: 1339572 - RNA, 14 nt, Human
auaauguuguuauu

SEQ ID NO: 1339573 - RNA, 15 nt, Human
auaauguaaauaaag

SEQ ID NO: 1339574 - RNA, 22 nt, Human
auaagccagacaucaacagaua

SEQ ID NO: 1339575 - RNA, 21 nt, Human
auaagccagacaucaacagau

SEQ ID NO: 1339576 - RNA, 23 nt, Human
auaagggaaguaguuaucauguu

SEQ ID NO: 1339577 - RNA, 22 nt, Human
auaagggaaguaguuaucaugu

SEQ ID NO: 1339578 - RNA, 12 nt, Human
auaagggaagua

SEQ ID NO: 1339579 - RNA, 11 nt, Human
auaaggcuuca

SEQ ID NO: 1339580 - RNA, 19 nt, Human
auaaaaaggacaucagcaa

SEQ ID NO: 1339581 - RNA, 13 nt, Human
auaaaacauuaau

SEQ ID NO: 1339582 - RNA, 14 nt, Human
auaaaaaggacauc

SEQ ID NO: 1339583 - RNA, 11 nt, Human
auaaaaaggac

SEQ ID NO: 1339584 - RNA, 17 nt, Human
auaaaaagcuuccauga

SEQ ID NO: 1339585 - RNA, 21 nt, Human
auaaaaagcuuccaugauucu

SEQ ID NO: 1339586 - RNA, 14 nt, Human
aguuugauuauuca

SEQ ID NO: 1339587 - RNA, 17 nt, Human
aguuugauuauucagug

SEQ ID NO: 1339588 - RNA, 18 nt, Human
aguuugauuauucagugu

SEQ ID NO: 1339589 - RNA, 23 nt, Human
aguuugauuauucagugucacug

SEQ ID NO: 1339590 - RNA, 17 nt, Human
aguuugcaaaaaauguu

SEQ ID NO: 1339591 - RNA, 20 nt, Human
aguuuggauauguaaaacau

SEQ ID NO: 1339592 - RNA, 16 nt, Human
aguuuggauauguaaa

SEQ ID NO: 1339593 - RNA, 17 nt, Human
aguuuggauauguaaaa

SEQ ID NO: 1339594 - RNA, 22 nt, Human
aguuuggauauguaaaacauuu

SEQ ID NO: 1339595 - RNA, 15 nt, Human
aguuugcuuugcccu

SEQ ID NO: 1339596 - RNA, 22 nt, Human
aguuuggagagagcagacuggc

SEQ ID NO: 1339597 - RNA, 12 nt, Human
aguuuggaggaa

SEQ ID NO: 1339598 - RNA, 14 nt, Human
aguuuggauaugua

SEQ ID NO: 1339599 - RNA, 15 nt, Human
aguuguuagauuaag

SEQ ID NO: 1339600 - RNA, 13 nt, Human
aguuucuugcuug

SEQ ID NO: 1339601 - RNA, 12 nt, Human
aguuugaaauaa

SEQ ID NO: 1339602 - RNA, 13 nt, Human
aguuugaaauaag

SEQ ID NO: 1339603 - RNA, 18 nt, Human
aguuugaaauaagcuauu

SEQ ID NO: 1339604 - RNA, 19 nt, Human
aguuugaaugcugcaaguu

SEQ ID NO: 1339605 - RNA, 11 nt, Human
auaaagcaauu

SEQ ID NO: 1339606 - RNA, 18 nt, Human
auaaagauuuuuuaauaa

SEQ ID NO: 1339607 - RNA, 13 nt, Human
auaaagauuuuuu

SEQ ID NO: 1339608 - RNA, 16 nt, Human
auaaagauuuuuuaau

SEQ ID NO: 1339609 - RNA, 17 nt, Human
auaaagauuuuuuaaua

SEQ ID NO: 1339610 - RNA, 21 nt, Human
auaaagauuuuuuaauaauuu

SEQ ID NO: 1339611 - RNA, 18 nt, Human
auaaauuucuauuuuuau

SEQ ID NO: 1339612 - RNA, 12 nt, Human
auaaauuugacu

SEQ ID NO: 1339613 - RNA, 18 nt, Human
auaaauuugacuuuucug

SEQ ID NO: 1339614 - RNA, 20 nt, Human
auaaauuugacuuuucugua

SEQ ID NO: 1339615 - RNA, 21 nt, Human
auaaauuugacuuuucuguaa

SEQ ID NO: 1339616 - RNA, 14 nt, Human
auaacaaugaaagu

SEQ ID NO: 1339617 - RNA, 15 nt, Human
auaacaaugcuguau

SEQ ID NO: 1339618 - RNA, 17 nt, Human
auaacaaugcuguauuu

SEQ ID NO: 1339619 - RNA, 19 nt, Human
auaacaaugcuguauuuua

SEQ ID NO: 1339620 - RNA, 20 nt, Human
auaacaaugcuguauuuuaa

SEQ ID NO: 1339621 - RNA, 21 nt, Human
auaacaaugcuguauuuuaaa

SEQ ID NO: 1339622 - RNA, 16 nt, Human
auaacaaugugcucuc

SEQ ID NO: 1339623 - RNA, 14 nt, Human
auaacaauuccucu

SEQ ID NO: 1339624 - RNA, 15 nt, Human
auaacaauuccucua

SEQ ID NO: 1339625 - RNA, 20 nt, Human
caaggaaaaaauaacaauga

SEQ ID NO: 1339626 - RNA, 18 nt, Human
caaggaaaaaauaacaau

SEQ ID NO: 1339627 - RNA, 14 nt, Human
caaggagccaaaca

SEQ ID NO: 1339628 - RNA, 14 nt, Human
caagcugcuguggc

SEQ ID NO: 1339629 - RNA, 21 nt, Human
caagcgauucucuugccucaa

SEQ ID NO: 1339630 - RNA, 15 nt, Human
caagcgauucucuug

SEQ ID NO: 1339631 - RNA, 14 nt, Human
caagcugcaucuag

SEQ ID NO: 1339632 - RNA, 14 nt, Human
caagccuugauugg

SEQ ID NO: 1339633 - RNA, 16 nt, Human
caagaggagcccccac

SEQ ID NO: 1339634 - RNA, 14 nt, Human
caagagucuaaaga

SEQ ID NO: 1339635 - RNA, 15 nt, Human
caagagucuaaagau

SEQ ID NO: 1339636 - RNA, 19 nt, Human
caagagugaauucccucac

SEQ ID NO: 1339637 - RNA, 20 nt, Human
caagagugaauucccucacu

SEQ ID NO: 1339638 - RNA, 14 nt, Human
caagauaaacauua

SEQ ID NO: 1339639 - RNA, 15 nt, Human
caagauaaacauuau

SEQ ID NO: 1339640 - RNA, 17 nt, Human
caauaaauagacacgca

SEQ ID NO: 1339641 - RNA, 16 nt, Human
caauaaauagaccauu

SEQ ID NO: 1339642 - RNA, 17 nt, Human
caauaaaucugacccag

SEQ ID NO: 1339643 - RNA, 18 nt, Human
caauaaaucugacccagu

SEQ ID NO: 1339644 - RNA, 20 nt, Human
caauaaaucugacccagugc

SEQ ID NO: 1339645 - RNA, 15 nt, Human
caauaaauggcugua

SEQ ID NO: 1339646 - RNA, 13 nt, Human
caauaaauagaca

SEQ ID NO: 1339647 - RNA, 14 nt, Human
caauaaagugaccc

SEQ ID NO: 1339648 - RNA, 21 nt, Human
caauaaagugacccugcucuc

SEQ ID NO: 1339649 - RNA, 15 nt, Human
caaggcuuucucuac

SEQ ID NO: 1339650 - RNA, 15 nt, Human
caagggaaaagucuc

SEQ ID NO: 1339651 - RNA, 16 nt, Human
caagggaaaagucucu

SEQ ID NO: 1339652 - RNA, 15 nt, Human
caagggaaccugugu

SEQ ID NO: 1339653 - RNA, 16 nt, Human
caagggaaccuguguc

SEQ ID NO: 1339654 - RNA, 15 nt, Human
caagggucaggccuu

SEQ ID NO: 1339655 - RNA, 18 nt, Human
caagggucaggccuuuga

SEQ ID NO: 1339656 - RNA, 16 nt, Human
caagggucaggccuuu

SEQ ID NO: 1339657 - RNA, 12 nt, Human
caauaagcaaaa

SEQ ID NO: 1339658 - RNA, 16 nt, Human
caauaacuccucccag

SEQ ID NO: 1339659 - RNA, 17 nt, Human
caauaacuccucccagg

SEQ ID NO: 1339660 - RNA, 18 nt, Human
caauaacuccucccaggg

SEQ ID NO: 1339661 - RNA, 19 nt, Human
caauaacuccucccagggu

SEQ ID NO: 1339662 - RNA, 23 nt, Human
caauaacguuuaagccaaaacaa

SEQ ID NO: 1339663 - RNA, 15 nt, Human
caauaacguuuaagc

SEQ ID NO: 1339664 - RNA, 18 nt, Human
caauaauaauaccucccu

SEQ ID NO: 1339665 - RNA, 17 nt, Human
caauaccugaaugcucu

SEQ ID NO: 1339666 - RNA, 19 nt, Human
caauaccugaaugcucugu

SEQ ID NO: 1339667 - RNA, 19 nt, Human
caauagucaaauuguguga

SEQ ID NO: 1339668 - RNA, 17 nt, Human
caauagcacauauggaa

SEQ ID NO: 1339669 - RNA, 14 nt, Human
caauagugucaucc

SEQ ID NO: 1339670 - RNA, 16 nt, Human
caauagcacauaugga

SEQ ID NO: 1339671 - RNA, 19 nt, Human
caauagcagacaguguuuu

SEQ ID NO: 1339672 - RNA, 13 nt, Human
cacaauaagcaaa

SEQ ID NO: 1339673 - RNA, 20 nt, Human
cacaauaacuccucccaggg

SEQ ID NO: 1339674 - RNA, 16 nt, Human
cacaauaaauggcugu

SEQ ID NO: 1339675 - RNA, 16 nt, Human
cacaauaacuccuccc

SEQ ID NO: 1339676 - RNA, 17 nt, Human
cacaauaacuccuccca

SEQ ID NO: 1339677 - RNA, 15 nt, Human
cacaauaauuuucua

SEQ ID NO: 1339678 - RNA, 14 nt, Human
cacaauagaauuau

SEQ ID NO: 1339679 - RNA, 15 nt, Human
cacaauagaauuaua

SEQ ID NO: 1339680 - RNA, 22 nt, Human
cacaaugcagugccuuucuucu

SEQ ID NO: 1339681 - RNA, 23 nt, Human
cacaaugagauugaauuucacug

SEQ ID NO: 1339682 - RNA, 23 nt, Human
cacacaaaagggaacccagcucu

SEQ ID NO: 1339683 - RNA, 17 nt, Human
cacaaguguaaugaaua

SEQ ID NO: 1339684 - RNA, 15 nt, Human
cacaaguguaaugaa

SEQ ID NO: 1339685 - RNA, 16 nt, Human
cacaaguuauuuaaau

SEQ ID NO: 1339686 - RNA, 18 nt, Human
cacaauaaaaauguuuaa

SEQ ID NO: 1339687 - RNA, 21 nt, Human
cacaagaaaugaaagcaggga

SEQ ID NO: 1339688 - RNA, 20 nt, Human
cacaagaaaugaaagcaggg

SEQ ID NO: 1339689 - RNA, 12 nt, Human
cacacacguuau

SEQ ID NO: 1339690 - RNA, 13 nt, Human
cacacaccuguag

SEQ ID NO: 1339691 - RNA, 18 nt, Human
cacacaaauaacaagaau

SEQ ID NO: 1339692 - RNA, 21 nt, Human
cacacaaauuaucuuaaaacu

SEQ ID NO: 1339693 - RNA, 23 nt, Human
caauuaaaaaaaaagaucuguuu

SEQ ID NO: 1339694 - RNA, 17 nt, Human
caauuacugguccaaaa

SEQ ID NO: 1339695 - RNA, 16 nt, Human
caauuagcuuauguua

SEQ ID NO: 1339696 - RNA, 21 nt, Human
caauuagcaauugacugucac

SEQ ID NO: 1339697 - RNA, 23 nt, Human
caauuaggcagacucuuuaugcu

SEQ ID NO: 1339698 - RNA, 11 nt, Human
caauuccccuc

SEQ ID NO: 1339699 - RNA, 12 nt, Human
caauuccccucu

SEQ ID NO: 1339700 - RNA, 13 nt, Human
caauuccccucug

SEQ ID NO: 1339701 - RNA, 14 nt, Human
caauuccccucugc

SEQ ID NO: 1339702 - RNA, 17 nt, Human
caauuccccucugcugc

SEQ ID NO: 1339703 - RNA, 22 nt, Human
cacaaaauauauuuuguuuaca

SEQ ID NO: 1339704 - RNA, 18 nt, Human
cacaaagcccuuccaugu

SEQ ID NO: 1339705 - RNA, 20 nt, Human
caauuuuuuaagugaaaaua

SEQ ID NO: 1339706 - RNA, 21 nt, Human
caauuuuuuaagugaaaauau

SEQ ID NO: 1339707 - RNA, 21 nt, Human
caauuuuuuaucaugcauguc

SEQ ID NO: 1339708 - RNA, 17 nt, Human
caauuuuuuuuauuagu

SEQ ID NO: 1339709 - RNA, 20 nt, Human
caauuuuuuuuauuaguauu

SEQ ID NO: 1339710 - RNA, 23 nt, Human
caauuuuuuuuauuaguauuguu

SEQ ID NO: 1339711 - RNA, 22 nt, Human
cacaaaauaaccaauccuggac

SEQ ID NO: 1339712 - RNA, 22 nt, Human
caaugugacuuaaugccacuaa

SEQ ID NO: 1339713 - RNA, 13 nt, Human
caaugugcucucg

SEQ ID NO: 1339714 - RNA, 23 nt, Human
caauguggcaaggaaaaacaggu

SEQ ID NO: 1339715 - RNA, 21 nt, Human
caauaucuuuuuuuuaauaaa

SEQ ID NO: 1339716 - RNA, 23 nt, Human
caauaucugaagcccucccaggu

SEQ ID NO: 1339717 - RNA, 13 nt, Human
caauaucugaagc

SEQ ID NO: 1339718 - RNA, 15 nt, Human
caauguguauaaaca

SEQ ID NO: 1339719 - RNA, 16 nt, Human
caauguguauaaacaa

SEQ ID NO: 1339720 - RNA, 17 nt, Human
caauguguauaaacaag

SEQ ID NO: 1339721 - RNA, 18 nt, Human
caauguguauaaacaaga

SEQ ID NO: 1339722 - RNA, 20 nt, Human
caauguguauaaacaagaaa

SEQ ID NO: 1339723 - RNA, 21 nt, Human
caauguguauaaacaagaaaa

SEQ ID NO: 1339724 - RNA, 23 nt, Human
caauguguauaaacaagaaaaau

SEQ ID NO: 1339725 - RNA, 12 nt, Human
caauguguguau

SEQ ID NO: 1339726 - RNA, 14 nt, Human
caauguguguauau

SEQ ID NO: 1339727 - RNA, 15 nt, Human
caauguguguauaug

SEQ ID NO: 1339728 - RNA, 16 nt, Human
caauguguguauaugg

SEQ ID NO: 1339729 - RNA, 17 nt, Human
caauguguguauaugga

SEQ ID NO: 1339730 - RNA, 18 nt, Human
caauguguguauauggac

SEQ ID NO: 1339731 - RNA, 20 nt, Human
caauguguugauacauuccc

SEQ ID NO: 1339732 - RNA, 21 nt, Human
caauguuaaacuuauaaccca

SEQ ID NO: 1339733 - RNA, 22 nt, Human
caauguuucaagaggagccccc

SEQ ID NO: 1339734 - RNA, 17 nt, Human
caauguuucuucuaggu

SEQ ID NO: 1339735 - RNA, 14 nt, Human
cacagcugccucuu

SEQ ID NO: 1339736 - RNA, 21 nt, Human
cacagcugccggucgcccuuu

SEQ ID NO: 1339737 - RNA, 14 nt, Human
cacagcugagaggc

SEQ ID NO: 1339738 - RNA, 14 nt, Human
cacagcccugucag

SEQ ID NO: 1339739 - RNA, 16 nt, Human
cacagcccugucagca

SEQ ID NO: 1339740 - RNA, 18 nt, Human
cacagcccugucagcaug

SEQ ID NO: 1339741 - RNA, 19 nt, Human
cacagcccugucagcauga

SEQ ID NO: 1339742 - RNA, 23 nt, Human
cacagcccugucagcaugaauuu

SEQ ID NO: 1339743 - RNA, 22 nt, Human
cacagcccugucagcaugaauu

SEQ ID NO: 1339744 - RNA, 23 nt, Human
cacagcccuuaugcgguuaauuu

SEQ ID NO: 1339745 - RNA, 14 nt, Human
cacagcccuuuugu

SEQ ID NO: 1339746 - RNA, 13 nt, Human
cacagcccuguca

SEQ ID NO: 1339747 - RNA, 13 nt, Human
cacagccaccccu

SEQ ID NO: 1339748 - RNA, 16 nt, Human
cacagauuugagcuca

SEQ ID NO: 1339749 - RNA, 17 nt, Human
cacagauuugagcucag

SEQ ID NO: 1339750 - RNA, 18 nt, Human
cacagauuugagcucagc

SEQ ID NO: 1339751 - RNA, 22 nt, Human
cacagauuugagcucagcccug

SEQ ID NO: 1339752 - RNA, 21 nt, Human
cacagcaguucugcagaggac

SEQ ID NO: 1339753 - RNA, 13 nt, Human
cacacugaagaag

SEQ ID NO: 1339754 - RNA, 14 nt, Human
cacacugaagaagc

SEQ ID NO: 1339755 - RNA, 14 nt, Human
cacacuccagcugg

SEQ ID NO: 1339756 - RNA, 20 nt, Human
cacacucaugcauuguccuc

SEQ ID NO: 1339757 - RNA, 15 nt, Human
cacagaggacacaga

SEQ ID NO: 1339758 - RNA, 19 nt, Human
cacagaggacacagagaag

SEQ ID NO: 1339759 - RNA, 21 nt, Human
cacagaggcagcccgcacacc

SEQ ID NO: 1339760 - RNA, 16 nt, Human
cacagagggcgugugc

SEQ ID NO: 1339761 - RNA, 23 nt, Human
cacagagguagucucacugcuug

SEQ ID NO: 1339762 - RNA, 22 nt, Human
cacagauaacugaaaauuauuu

SEQ ID NO: 1339763 - RNA, 19 nt, Human
cacagauaacugaaaauua

SEQ ID NO: 1339764 - RNA, 16 nt, Human
caacagcuggacccug

SEQ ID NO: 1339765 - RNA, 19 nt, Human
caacagcuggacccugacc

SEQ ID NO: 1339766 - RNA, 20 nt, Human
caacagcuggacccugacca

SEQ ID NO: 1339767 - RNA, 12 nt, Human
caacagcgccca

SEQ ID NO: 1339768 - RNA, 15 nt, Human
caacagcgcccaaag

SEQ ID NO: 1339769 - RNA, 15 nt, Human
caacagcguuccuag

SEQ ID NO: 1339770 - RNA, 23 nt, Human
caacagcguuccuagagaagaca

SEQ ID NO: 1339771 - RNA, 23 nt, Human
caacauagugggacccugucucu

SEQ ID NO: 1339772 - RNA, 17 nt, Human
caaccugcucuccucuu

SEQ ID NO: 1339773 - RNA, 18 nt, Human
caaccugcucuccucuug

SEQ ID NO: 1339774 - RNA, 21 nt, Human
caaccugcucuccucuugcca

SEQ ID NO: 1339775 - RNA, 23 nt, Human
caaccugcucuccucuugccacu

SEQ ID NO: 1339776 - RNA, 15 nt, Human
caacaggccucaggg

SEQ ID NO: 1339777 - RNA, 16 nt, Human
caacaggccucagggc

SEQ ID NO: 1339778 - RNA, 19 nt, Human
caacaggccucagggcucc

SEQ ID NO: 1339779 - RNA, 20 nt, Human
caacaggccucagggcuccu

SEQ ID NO: 1339780 - RNA, 21 nt, Human
caacauaguauucaugacuau

SEQ ID NO: 1339781 - RNA, 16 nt, Human
caaccuggucacagga

SEQ ID NO: 1339782 - RNA, 16 nt, Human
caaccuucuguggcuc

SEQ ID NO: 1339783 - RNA, 17 nt, Human
caaccuucuguggcuca

SEQ ID NO: 1339784 - RNA, 19 nt, Human
caaccuucuguggcucaca

SEQ ID NO: 1339785 - RNA, 20 nt, Human
caaccuucuguggcucacag

SEQ ID NO: 1339786 - RNA, 15 nt, Human
caaauuuuaucugcc

SEQ ID NO: 1339787 - RNA, 14 nt, Human
caaauuugauugau

SEQ ID NO: 1339788 - RNA, 17 nt, Human
caaauuugauugauuug

SEQ ID NO: 1339789 - RNA, 19 nt, Human
caaauuuguaggguuucua

SEQ ID NO: 1339790 - RNA, 19 nt, Human
caaauguuaaaauguguug

SEQ ID NO: 1339791 - RNA, 18 nt, Human
caaauuacuuugugaaua

SEQ ID NO: 1339792 - RNA, 21 nt, Human
caaauuacuuugugaauagaa

SEQ ID NO: 1339793 - RNA, 14 nt, Human
caaauuaguuauau

SEQ ID NO: 1339794 - RNA, 15 nt, Human
caaauuaguuauaua

SEQ ID NO: 1339795 - RNA, 20 nt, Human
caacagagacugaauagaua

SEQ ID NO: 1339796 - RNA, 14 nt, Human
caacagaucaguaa

SEQ ID NO: 1339797 - RNA, 13 nt, Human
caacagaucugga

SEQ ID NO: 1339798 - RNA, 14 nt, Human
caacagaucuggaa

SEQ ID NO: 1339799 - RNA, 17 nt, Human
caacagaucuggaaccu

SEQ ID NO: 1339800 - RNA, 23 nt, Human
caacagaucuggaaccucagccu

SEQ ID NO: 1339801 - RNA, 15 nt, Human
caacagcaaacaggu

SEQ ID NO: 1339802 - RNA, 17 nt, Human
caacagcaaacaggugc

SEQ ID NO: 1339803 - RNA, 17 nt, Human
caaaucaaucuguaaaa

SEQ ID NO: 1339804 - RNA, 18 nt, Human
caaaucaaaaucucucca

SEQ ID NO: 1339805 - RNA, 20 nt, Human
caaauauuuauuuucuuucu

SEQ ID NO: 1339806 - RNA, 23 nt, Human
caaauauauucagccuggcuuca

SEQ ID NO: 1339807 - RNA, 20 nt, Human
caaaucaaucuguaaaacua

SEQ ID NO: 1339808 - RNA, 16 nt, Human
caaaucaauuacuggu

SEQ ID NO: 1339809 - RNA, 14 nt, Human
caaaucacauauuu

SEQ ID NO: 1339810 - RNA, 15 nt, Human
caaaucacauauuuu

SEQ ID NO: 1339811 - RNA, 18 nt, Human
caaaucacauauuuuaaa

SEQ ID NO: 1339812 - RNA, 14 nt, Human
caaaucaccacaaa

SEQ ID NO: 1339813 - RNA, 19 nt, Human
caaaucacauauuuuaaaa

SEQ ID NO: 1339814 - RNA, 22 nt, Human
caaauggauuuugggagugacu

SEQ ID NO: 1339815 - RNA, 18 nt, Human
caaauggcgucuggaagu

SEQ ID NO: 1339816 - RNA, 20 nt, Human
caaauguucaucaaugaaug

SEQ ID NO: 1339817 - RNA, 22 nt, Human
caaauggcgucuggaaguccaa

SEQ ID NO: 1339818 - RNA, 18 nt, Human
caaauguucaucaaugaa

SEQ ID NO: 1339819 - RNA, 14 nt, Human
caaauguucaucaa

SEQ ID NO: 1339820 - RNA, 19 nt, Human
caaauggcgucuggaaguc

SEQ ID NO: 1339821 - RNA, 21 nt, Human
caaauggcgucuggaagucca

SEQ ID NO: 1339822 - RNA, 20 nt, Human
caaauguuaaaauguguugu

SEQ ID NO: 1339823 - RNA, 18 nt, Human
caaagugcugggauuaca

SEQ ID NO: 1339824 - RNA, 19 nt, Human
caaaguguggucucuggaa

SEQ ID NO: 1339825 - RNA, 15 nt, Human
caaaguguuuucucu

SEQ ID NO: 1339826 - RNA, 18 nt, Human
caaaguguuuucucugaa

SEQ ID NO: 1339827 - RNA, 20 nt, Human
caaaguucccuacuuccugu

SEQ ID NO: 1339828 - RNA, 21 nt, Human
caaaguucccuacuuccugug

SEQ ID NO: 1339829 - RNA, 21 nt, Human
caaagagagauuuuuuuuuaa

SEQ ID NO: 1339830 - RNA, 14 nt, Human
caaagaaccaaaga

SEQ ID NO: 1339831 - RNA, 17 nt, Human
caaagaaccaaagaaga

SEQ ID NO: 1339832 - RNA, 18 nt, Human
caaagaaccuucucuaug

SEQ ID NO: 1339833 - RNA, 19 nt, Human
caaagaaccaaagaagaaa

SEQ ID NO: 1339834 - RNA, 22 nt, Human
caaagaaggcauuugcaggguc

SEQ ID NO: 1339835 - RNA, 21 nt, Human
caaagaaggcauuugcagggu

SEQ ID NO: 1339836 - RNA, 18 nt, Human
caaagagaaugcccuucu

SEQ ID NO: 1339837 - RNA, 23 nt, Human
caaagagaaugcccuucuccuua

SEQ ID NO: 1339838 - RNA, 13 nt, Human
caagaagcagugg

SEQ ID NO: 1339839 - RNA, 14 nt, Human
caagaagcaguggc

SEQ ID NO: 1339840 - RNA, 18 nt, Human
caagaagcaguggccuua

SEQ ID NO: 1339841 - RNA, 19 nt, Human
caagaaaugaaagcaggga

SEQ ID NO: 1339842 - RNA, 17 nt, Human
caagaaaugaaagcagg

SEQ ID NO: 1339843 - RNA, 13 nt, Human
caacuuguccuag

SEQ ID NO: 1339844 - RNA, 19 nt, Human
caacuuguccuagcacaga

SEQ ID NO: 1339845 - RNA, 20 nt, Human
caacuuguccuagcacagau

SEQ ID NO: 1339846 - RNA, 12 nt, Human
caacuugggaac

SEQ ID NO: 1339847 - RNA, 16 nt, Human
caacuuguaaaugugg

SEQ ID NO: 1339848 - RNA, 18 nt, Human
caacgugcucuuuguuuu

SEQ ID NO: 1339849 - RNA, 14 nt, Human
caacuugcuuauca

SEQ ID NO: 1339850 - RNA, 16 nt, Human
caacuuggcugcagga

SEQ ID NO: 1339851 - RNA, 20 nt, Human
caacgugcucuuuguuuugu

SEQ ID NO: 1339852 - RNA, 23 nt, Human
caacguggcuuuuuuuuuuuccc

SEQ ID NO: 1339853 - RNA, 22 nt, Human
caagagcuacguauuuaauagc

SEQ ID NO: 1339854 - RNA, 19 nt, Human
caagagcuacauaauuuag

SEQ ID NO: 1339855 - RNA, 17 nt, Human
caagagcuuaacagugu

SEQ ID NO: 1339856 - RNA, 14 nt, Human
caagaggagaucca

SEQ ID NO: 1339857 - RNA, 14 nt, Human
caagaggagccccc

SEQ ID NO: 1339858 - RNA, 21 nt, Human
caagaggagcccccacccugu

SEQ ID NO: 1339859 - RNA, 19 nt, Human
caagaggccguggcugcug

SEQ ID NO: 1339860 - RNA, 16 nt, Human
caagagcaucaugccu

SEQ ID NO: 1339861 - RNA, 18 nt, Human
caagagcaucaugccucu

SEQ ID NO: 1339862 - RNA, 19 nt, Human
caagagcaucaugccucug

SEQ ID NO: 1339863 - RNA, 20 nt, Human
caagagcaucaugccucuga

SEQ ID NO: 1339864 - RNA, 21 nt, Human
caagagcaucaugccucugag

SEQ ID NO: 1339865 - RNA, 22 nt, Human
caagagcaucaugccucugagg

SEQ ID NO: 1339866 - RNA, 23 nt, Human
caagagcaucaugccucugaggc

SEQ ID NO: 1339867 - RNA, 13 nt, Human
caagagccacagu

SEQ ID NO: 1339868 - RNA, 17 nt, Human
caagaagcauuuuguaa

SEQ ID NO: 1339869 - RNA, 23 nt, Human
caagaagcauuuuguaaguugaa

SEQ ID NO: 1339870 - RNA, 13 nt, Human
caagagaagcauu

SEQ ID NO: 1339871 - RNA, 14 nt, Human
caagagaagcauuc

SEQ ID NO: 1339872 - RNA, 16 nt, Human
caagagaagcauucuc

SEQ ID NO: 1339873 - RNA, 22 nt, Human
caagagaagcauucucauugga

SEQ ID NO: 1339874 - RNA, 18 nt, Human
caagagaagcauucucau

SEQ ID NO: 1339875 - RNA, 12 nt, Human
caagagacugag

SEQ ID NO: 1339876 - RNA, 15 nt, Human
caagagacugaguca

SEQ ID NO: 1339877 - RNA, 13 nt, Human
caagagacugagu

SEQ ID NO: 1339878 - RNA, 13 nt, Human
caagagauaacug

SEQ ID NO: 1339879 - RNA, 23 nt, Human
caagggaauuucuucaacucccu

SEQ ID NO: 1339880 - RNA, 16 nt, Human
caaaaucaauuaaaau

SEQ ID NO: 1339881 - RNA, 17 nt, Human
caaaauauuuguacaua

SEQ ID NO: 1339882 - RNA, 16 nt, Human
caaaauauuuguacau

SEQ ID NO: 1339883 - RNA, 13 nt, Human
caaaauagggacu

SEQ ID NO: 1339884 - RNA, 17 nt, Human
caaaauaggguauauuu

SEQ ID NO: 1339885 - RNA, 18 nt, Human
caaaauaggguauauuuu

SEQ ID NO: 1339886 - RNA, 21 nt, Human
caaaauaggguauauuuuccu

SEQ ID NO: 1339887 - RNA, 16 nt, Human
caaaauagugccacua

SEQ ID NO: 1339888 - RNA, 20 nt, Human
caaaauauauuuuguuuaca

SEQ ID NO: 1339889 - RNA, 22 nt, Human
caaaauauauuuuguuuacaaa

SEQ ID NO: 1339890 - RNA, 20 nt, Human
caaaauccuugcuuaugaca

SEQ ID NO: 1339891 - RNA, 19 nt, Human
caaaaucucccauuuugga

SEQ ID NO: 1339892 - RNA, 16 nt, Human
caaaaucucuccacuu

SEQ ID NO: 1339893 - RNA, 21 nt, Human
caaaaucucuccacuuucagc

SEQ ID NO: 1339894 - RNA, 22 nt, Human
caaaaucucuccacuuucagcu

SEQ ID NO: 1339895 - RNA, 12 nt, Human
caaaaucaguuu

SEQ ID NO: 1339896 - RNA, 16 nt, Human
caaaaucaguuuuccu

SEQ ID NO: 1339897 - RNA, 15 nt, Human
caaaaucagguaacu

SEQ ID NO: 1339898 - RNA, 16 nt, Human
caaaauccuugcuuau

SEQ ID NO: 1339899 - RNA, 20 nt, Human
caaaauacuugucuguuuua

SEQ ID NO: 1339900 - RNA, 21 nt, Human
caaaauacuugucuguuuuaa

SEQ ID NO: 1339901 - RNA, 11 nt, Human
caaaacucuac

SEQ ID NO: 1339902 - RNA, 19 nt, Human
caaaacucuacuuaaucca

SEQ ID NO: 1339903 - RNA, 18 nt, Human
caaaaguuucauccuuuu

SEQ ID NO: 1339904 - RNA, 18 nt, Human
caaaaguuuguuugcuua

SEQ ID NO: 1339905 - RNA, 15 nt, Human
caaaacugcauuuca

SEQ ID NO: 1339906 - RNA, 22 nt, Human
caaaacugccucaggaggcagg

SEQ ID NO: 1339907 - RNA, 19 nt, Human
caaaaguuacauguuugca

SEQ ID NO: 1339908 - RNA, 14 nt, Human
caaaaguuccaaga

SEQ ID NO: 1339909 - RNA, 18 nt, Human
caaaaguuccaagagucu

SEQ ID NO: 1339910 - RNA, 23 nt, Human
caaaaguuccaagagucuaaaga

SEQ ID NO: 1339911 - RNA, 17 nt, Human
caaacugacucuuaaga

SEQ ID NO: 1339912 - RNA, 21 nt, Human
caaacugacucuuaagaagac

SEQ ID NO: 1339913 - RNA, 14 nt, Human
caaacucuuugguc

SEQ ID NO: 1339914 - RNA, 16 nt, Human
caaacugacucuuaag

SEQ ID NO: 1339915 - RNA, 23 nt, Human
caaacugaagcagccucucccca

SEQ ID NO: 1339916 - RNA, 18 nt, Human
caaacuccugaccucagg

SEQ ID NO: 1339917 - RNA, 19 nt, Human
caaacucuuuggucguuuu

SEQ ID NO: 1339918 - RNA, 17 nt, Human
caaacugaagcagccuc

SEQ ID NO: 1339919 - RNA, 19 nt, Human
caaacuccugaccucaggc

SEQ ID NO: 1339920 - RNA, 19 nt, Human
caaaccugaccccugcuca

SEQ ID NO: 1339921 - RNA, 20 nt, Human
caaaccugaccccugcucag

SEQ ID NO: 1339922 - RNA, 21 nt, Human
caaaaugagcccuguccugcc

SEQ ID NO: 1339923 - RNA, 22 nt, Human
caaaaucuugaucaguuaagaa

SEQ ID NO: 1339924 - RNA, 23 nt, Human
caaaaucucuccacuuucagcug

SEQ ID NO: 1339925 - RNA, 16 nt, Human
caaaaucuugaucagu

SEQ ID NO: 1339926 - RNA, 18 nt, Human
caaaaucuugaucaguua

SEQ ID NO: 1339927 - RNA, 16 nt, Human
caaacaaaaagguucu

SEQ ID NO: 1339928 - RNA, 14 nt, Human
caaacaccucccag

SEQ ID NO: 1339929 - RNA, 15 nt, Human
caaacaccucccagg

SEQ ID NO: 1339930 - RNA, 12 nt, Human
caaacaccuucc

SEQ ID NO: 1339931 - RNA, 21 nt, Human
caaacaccuuccagcuccugu

SEQ ID NO: 1339932 - RNA, 14 nt, Human
caaacaccuuccag

SEQ ID NO: 1339933 - RNA, 22 nt, Human
caaacaauaccugaaugcucug

SEQ ID NO: 1339934 - RNA, 15 nt, Human
caaacaauaccugaa

SEQ ID NO: 1339935 - RNA, 13 nt, Human
caaacaauaccug

SEQ ID NO: 1339936 - RNA, 20 nt, Human
caaacaaaaagguucucagg

SEQ ID NO: 1339937 - RNA, 21 nt, Human
caaacaaaaagguucucaggu

SEQ ID NO: 1339938 - RNA, 17 nt, Human
caaacugaggaauuuca

SEQ ID NO: 1339939 - RNA, 22 nt, Human
cacagcugccucuucccucuuc

SEQ ID NO: 1339940 - RNA, 15 nt, Human
cacagcugccucuuc

SEQ ID NO: 1339941 - RNA, 12 nt, Human
cacagcugcuca

SEQ ID NO: 1339942 - RNA, 22 nt, Human
cacagcugcucaauaaaguaca

SEQ ID NO: 1339943 - RNA, 18 nt, Human
cacagcuugaccugaggc

SEQ ID NO: 1339944 - RNA, 19 nt, Human
cacagcuugaccugaggcu

SEQ ID NO: 1339945 - RNA, 20 nt, Human
cacagcuugaccugaggcug

SEQ ID NO: 1339946 - RNA, 21 nt, Human
cacagcuugaccugaggcugu

SEQ ID NO: 1339947 - RNA, 22 nt, Human
cacagcuugaccugaggcugug

SEQ ID NO: 1339948 - RNA, 13 nt, Human
cacaggaaaccag

SEQ ID NO: 1339949 - RNA, 19 nt, Human
cacaggaaccacaagacug

SEQ ID NO: 1339950 - RNA, 12 nt, Human
cacagcuuuugc

SEQ ID NO: 1339951 - RNA, 13 nt, Human
cacagcuuuugca

SEQ ID NO: 1339952 - RNA, 16 nt, Human
cacaggcccuuccucu

SEQ ID NO: 1339953 - RNA, 17 nt, Human
cacaggcccuuccucuc

SEQ ID NO: 1339954 - RNA, 18 nt, Human
cacaggcccuuccucucc

SEQ ID NO: 1339955 - RNA, 19 nt, Human
cacaggcccuuccucucca

SEQ ID NO: 1339956 - RNA, 16 nt, Human
cacaguguuggagguu

SEQ ID NO: 1339957 - RNA, 21 nt, Human
cacaggcccuuccucuccacu

SEQ ID NO: 1339958 - RNA, 22 nt, Human
cacaggcccuuccucuccacug

SEQ ID NO: 1339959 - RNA, 18 nt, Human
cacagugcaucucagccc

SEQ ID NO: 1339960 - RNA, 19 nt, Human
cacagugcaucucagccca

SEQ ID NO: 1339961 - RNA, 14 nt, Human
cacagcuuuugcaa

SEQ ID NO: 1339962 - RNA, 16 nt, Human
cacagugcucuuuucu

SEQ ID NO: 1339963 - RNA, 18 nt, Human
cacagugcucuuuucucc

SEQ ID NO: 1339964 - RNA, 22 nt, Human
cacaguggaaagacagcuucuc

SEQ ID NO: 1339965 - RNA, 12 nt, Human
uuuuuuguuauu

SEQ ID NO: 1339966 - RNA, 21 nt, Human
ugugugaaagguacuucaaau

SEQ ID NO: 1339967 - RNA, 22 nt, Human
ugugugaaagguacuucaaauc

SEQ ID NO: 1339968 - RNA, 18 nt, Human
uguguaugcgugugugug

SEQ ID NO: 1339969 - RNA, 19 nt, Human
uguguaugcacaugaacuu

SEQ ID NO: 1339970 - RNA, 22 nt, Human
uguguagcugugaccugcugag

SEQ ID NO: 1339971 - RNA, 23 nt, Human
uguguaugcacaugaacuuagau

SEQ ID NO: 1339972 - RNA, 15 nt, Human
ugugugcuuauguau

SEQ ID NO: 1339973 - RNA, 22 nt, Human
ugugugcaacaggguauggacu

SEQ ID NO: 1339974 - RNA, 21 nt, Human
ugugugcguguuuggguuuuu

SEQ ID NO: 1339975 - RNA, 21 nt, Human
uguguggagagggaaugugaa

SEQ ID NO: 1339976 - RNA, 20 nt, Human
uguguggcuuucagagccuc

SEQ ID NO: 1339977 - RNA, 20 nt, Human
ugugugcuuuuuuugugugu

SEQ ID NO: 1339978 - RNA, 14 nt, Human
uguguggacaggac

SEQ ID NO: 1339979 - RNA, 22 nt, Human
uguguggagagggaaugugaaa

SEQ ID NO: 1339980 - RNA, 14 nt, Human
uguguggauucuuu

SEQ ID NO: 1339981 - RNA, 18 nt, Human
uguguuuuucauaaagca

SEQ ID NO: 1339982 - RNA, 14 nt, Human
uguguuuuucuauu

SEQ ID NO: 1339983 - RNA, 15 nt, Human
uguguuuuucauaaa

SEQ ID NO: 1339984 - RNA, 17 nt, Human
uguguuucuugccucau

SEQ ID NO: 1339985 - RNA, 16 nt, Human
uguguuuugaaagaau

SEQ ID NO: 1339986 - RNA, 19 nt, Human
uguguuuugcuaaaggaaa

SEQ ID NO: 1339987 - RNA, 15 nt, Human
uguguuuuuaacaug

SEQ ID NO: 1339988 - RNA, 13 nt, Human
uguguuuugcaag

SEQ ID NO: 1339989 - RNA, 19 nt, Human
uguguuuugcaagccagau

SEQ ID NO: 1339990 - RNA, 13 nt, Human
uguguuugaagca

SEQ ID NO: 1339991 - RNA, 21 nt, Human
uguguuucacaguuugaaaua

SEQ ID NO: 1339992 - RNA, 18 nt, Human
uguguuucacaguuugaa

SEQ ID NO: 1339993 - RNA, 19 nt, Human
uguguuucacaguuugaaa

SEQ ID NO: 1339994 - RNA, 23 nt, Human
uguguuucacaguuugaaauaag

SEQ ID NO: 1339995 - RNA, 12 nt, Human
uguguuuccaca

SEQ ID NO: 1339996 - RNA, 19 nt, Human
ugugugugcuuauguauga

SEQ ID NO: 1339997 - RNA, 20 nt, Human
ugugugugcuuauguaugag

SEQ ID NO: 1339998 - RNA, 14 nt, Human
ugugugugcccucu

SEQ ID NO: 1339999 - RNA, 22 nt, Human
ugugugugcccucugggcucug

SEQ ID NO: 1340000 - RNA, 17 nt, Human
uguguggcuuucagagc

SEQ ID NO: 1340001 - RNA, 17 nt, Human
ugugugugaaaaugugu

SEQ ID NO: 1340002 - RNA, 16 nt, Human
ugugugugaaugaaca

SEQ ID NO: 1340003 - RNA, 20 nt, Human
ugugugugaaugaacacucu

SEQ ID NO: 1340004 - RNA, 16 nt, Human
ugugugucuuaauuau

SEQ ID NO: 1340005 - RNA, 17 nt, Human
uguucauaaauaaaguu

SEQ ID NO: 1340006 - RNA, 14 nt, Human
uguucauagcccag

SEQ ID NO: 1340007 - RNA, 15 nt, Human
uguucauagcccagu

SEQ ID NO: 1340008 - RNA, 15 nt, Human
uguucagcacugucc

SEQ ID NO: 1340009 - RNA, 17 nt, Human
uguucagcacugucccu

SEQ ID NO: 1340010 - RNA, 18 nt, Human
uguucagcacugucccuu

SEQ ID NO: 1340011 - RNA, 14 nt, Human
uguuagugcaaauu

SEQ ID NO: 1340012 - RNA, 16 nt, Human
uguuaguaauaccucu

SEQ ID NO: 1340013 - RNA, 15 nt, Human
uguuagucauuugcu

SEQ ID NO: 1340014 - RNA, 16 nt, Human
uguucacuuuuccucc

SEQ ID NO: 1340015 - RNA, 19 nt, Human
uguucacuuuuccucccuc

SEQ ID NO: 1340016 - RNA, 17 nt, Human
uguucacuuuugacaaa

SEQ ID NO: 1340017 - RNA, 18 nt, Human
uguucagaagguugcucu

SEQ ID NO: 1340018 - RNA, 22 nt, Human
uguucagaagguugcucuagau

SEQ ID NO: 1340019 - RNA, 13 nt, Human
uguucagcacugu

SEQ ID NO: 1340020 - RNA, 14 nt, Human
uguucagcacuguc

SEQ ID NO: 1340021 - RNA, 15 nt, Human
uguuaguaauaccuc

SEQ ID NO: 1340022 - RNA, 14 nt, Human
uguuaguaauaccu

SEQ ID NO: 1340023 - RNA, 21 nt, Human
uguuacccaguaacucaucug

SEQ ID NO: 1340024 - RNA, 16 nt, Human
uguuaccuacuuugac

SEQ ID NO: 1340025 - RNA, 15 nt, Human
uguuaccugaaaaca

SEQ ID NO: 1340026 - RNA, 16 nt, Human
uguuaccugaaaacac

SEQ ID NO: 1340027 - RNA, 22 nt, Human
uguuaccugaaaacacugugca

SEQ ID NO: 1340028 - RNA, 14 nt, Human
uguuaccuguagau

SEQ ID NO: 1340029 - RNA, 15 nt, Human
uguguuuuucuauua

SEQ ID NO: 1340030 - RNA, 16 nt, Human
uguguuuuucuauuaa

SEQ ID NO: 1340031 - RNA, 17 nt, Human
uguguuuuucuauuaaa

SEQ ID NO: 1340032 - RNA, 19 nt, Human
uguguuuuucuauuaaaag

SEQ ID NO: 1340033 - RNA, 21 nt, Human
uguguuuuucuauuaaaagac

SEQ ID NO: 1340034 - RNA, 22 nt, Human
uguguuuuucuauuaaaagacu

SEQ ID NO: 1340035 - RNA, 19 nt, Human
uguuaaaaaaauaagaaga

SEQ ID NO: 1340036 - RNA, 20 nt, Human
uguuaaaaaaauaagaagaa

SEQ ID NO: 1340037 - RNA, 22 nt, Human
uguuaaaaaaauaagaagaaug

SEQ ID NO: 1340038 - RNA, 23 nt, Human
uguuaaaaaaauaagaagaaugc

SEQ ID NO: 1340039 - RNA, 14 nt, Human
uguuaaaaauguca

SEQ ID NO: 1340040 - RNA, 23 nt, Human
uguuaccugaaaacacugugcac

SEQ ID NO: 1340041 - RNA, 16 nt, Human
uguuacguagccuaag

SEQ ID NO: 1340042 - RNA, 20 nt, Human
uguuacuaaaaaaaagauga

SEQ ID NO: 1340043 - RNA, 17 nt, Human
uguuagccccauaauuu

SEQ ID NO: 1340044 - RNA, 19 nt, Human
uguuagccucaauuucuga

SEQ ID NO: 1340045 - RNA, 19 nt, Human
uguuagccuuuuuucccca

SEQ ID NO: 1340046 - RNA, 20 nt, Human
uguuagccuuuuuuccccag

SEQ ID NO: 1340047 - RNA, 21 nt, Human
uguuagccuuuuuuccccaga

SEQ ID NO: 1340048 - RNA, 12 nt, Human
uguuacuguaau

SEQ ID NO: 1340049 - RNA, 14 nt, Human
uguuacuguaauuc

SEQ ID NO: 1340050 - RNA, 15 nt, Human
uguuacuguaauucc

SEQ ID NO: 1340051 - RNA, 14 nt, Human
uguuagcagacagg

SEQ ID NO: 1340052 - RNA, 21 nt, Human
uguuagcaugcuggugagcca

SEQ ID NO: 1340053 - RNA, 20 nt, Human
uguugacaugggacauuugc

SEQ ID NO: 1340054 - RNA, 17 nt, Human
uguugacaguucauaug

SEQ ID NO: 1340055 - RNA, 13 nt, Human
uguugaauacuuu

SEQ ID NO: 1340056 - RNA, 18 nt, Human
uguugaauacuuuuuaca

SEQ ID NO: 1340057 - RNA, 12 nt, Human
uguugacauuag

SEQ ID NO: 1340058 - RNA, 14 nt, Human
uguugacauuaguc

SEQ ID NO: 1340059 - RNA, 14 nt, Human
uguugacauucuga

SEQ ID NO: 1340060 - RNA, 15 nt, Human
uguugacauucugaa

SEQ ID NO: 1340061 - RNA, 16 nt, Human
uguugacauucugaau

SEQ ID NO: 1340062 - RNA, 17 nt, Human
uguugacauucugaaug

SEQ ID NO: 1340063 - RNA, 23 nt, Human
uguugacauucugaaugcuucua

SEQ ID NO: 1340064 - RNA, 18 nt, Human
uguugacauucugaaugc

SEQ ID NO: 1340065 - RNA, 22 nt, Human
uguugagaaucccaaauuugau

SEQ ID NO: 1340066 - RNA, 23 nt, Human
uguugagaaucccaaauuugauu

SEQ ID NO: 1340067 - RNA, 21 nt, Human
uguugauacuguugcacgugu

SEQ ID NO: 1340068 - RNA, 20 nt, Human
uguucuuuuaaaugauugaa

SEQ ID NO: 1340069 - RNA, 22 nt, Human
uguucuuuggaaaguacacucu

SEQ ID NO: 1340070 - RNA, 13 nt, Human
uguucuuuuuaga

SEQ ID NO: 1340071 - RNA, 18 nt, Human
uguugaaaaaguuuguuu

SEQ ID NO: 1340072 - RNA, 18 nt, Human
uguucuuuggaaaguaca

SEQ ID NO: 1340073 - RNA, 20 nt, Human
uguucuuuggaaauacacag

SEQ ID NO: 1340074 - RNA, 15 nt, Human
uguucugcuuuccuc

SEQ ID NO: 1340075 - RNA, 13 nt, Human
uguucaugaaaga

SEQ ID NO: 1340076 - RNA, 14 nt, Human
uguucaugaaagau

SEQ ID NO: 1340077 - RNA, 23 nt, Human
uguucauauuaagaaugaucuga

SEQ ID NO: 1340078 - RNA, 18 nt, Human
uguucauauuaagaauga

SEQ ID NO: 1340079 - RNA, 17 nt, Human
uguucauauuaagaaug

SEQ ID NO: 1340080 - RNA, 23 nt, Human
uguucauagcccaguagaccuug

SEQ ID NO: 1340081 - RNA, 19 nt, Human
uguucauagcccaguagac

SEQ ID NO: 1340082 - RNA, 20 nt, Human
uguucauagcccaguagacc

SEQ ID NO: 1340083 - RNA, 20 nt, Human
uguucaugaaagauucaaug

SEQ ID NO: 1340084 - RNA, 21 nt, Human
uguucuccuuuuccucucucc

SEQ ID NO: 1340085 - RNA, 23 nt, Human
uguucuccugcugcucccucaga

SEQ ID NO: 1340086 - RNA, 12 nt, Human
uguuuaagagac

SEQ ID NO: 1340087 - RNA, 13 nt, Human
uguuuaaaguuca

SEQ ID NO: 1340088 - RNA, 14 nt, Human
uguugggagagggc

SEQ ID NO: 1340089 - RNA, 14 nt, Human
uguuuaaaccuuuu

SEQ ID NO: 1340090 - RNA, 12 nt, Human
uguuuaaaguuc

SEQ ID NO: 1340091 - RNA, 23 nt, Human
uguuuaaaguucaacauguuauu

SEQ ID NO: 1340092 - RNA, 13 nt, Human
uguuuacaugcuu

SEQ ID NO: 1340093 - RNA, 16 nt, Human
uguuuacaugcuuauu

SEQ ID NO: 1340094 - RNA, 21 nt, Human
uguuuacaugcuuauuccaug

SEQ ID NO: 1340095 - RNA, 22 nt, Human
uguuuacaugcuuauuccauga

SEQ ID NO: 1340096 - RNA, 20 nt, Human
uguuggcguaggcuacagag

SEQ ID NO: 1340097 - RNA, 21 nt, Human
uguuggcguaggcuacagaga

SEQ ID NO: 1340098 - RNA, 22 nt, Human
uguuggcguaggcuacagagaa

SEQ ID NO: 1340099 - RNA, 23 nt, Human
uguuggcguaggcuacagagaag

SEQ ID NO: 1340100 - RNA, 23 nt, Human
uguuggcguggggccuuugucag

SEQ ID NO: 1340101 - RNA, 24 nt, Human
uguuggcguaggcuacagagaagc

SEQ ID NO: 1340102 - RNA, 18 nt, Human
uguuggcaggcuggccag

SEQ ID NO: 1340103 - RNA, 21 nt, Human
uguuggcaggcuggccagucc

SEQ ID NO: 1340104 - RNA, 17 nt, Human
uguuggcauagcucugg

SEQ ID NO: 1340105 - RNA, 23 nt, Human
uguuggccaggcuggucuaaaac

SEQ ID NO: 1340106 - RNA, 18 nt, Human
uguuggcguaggcuacag

SEQ ID NO: 1340107 - RNA, 14 nt, Human
uguuggcuagccuc

SEQ ID NO: 1340108 - RNA, 19 nt, Human
uguugggaaacuuggcucg

SEQ ID NO: 1340109 - RNA, 14 nt, Human
uguugggacugcua

SEQ ID NO: 1340110 - RNA, 19 nt, Human
uguugggacugcuaaauaa

SEQ ID NO: 1340111 - RNA, 14 nt, Human
uguuggagaagaac

SEQ ID NO: 1340112 - RNA, 12 nt, Human
uguuggaaugaa

SEQ ID NO: 1340113 - RNA, 16 nt, Human
uguuggagaagaacug

SEQ ID NO: 1340114 - RNA, 17 nt, Human
uguuggagaagaacuga

SEQ ID NO: 1340115 - RNA, 23 nt, Human
uguugauacuguugcacgugugu

SEQ ID NO: 1340116 - RNA, 15 nt, Human
uguugauuaaagaug

SEQ ID NO: 1340117 - RNA, 16 nt, Human
uguugauuaaagauga

SEQ ID NO: 1340118 - RNA, 19 nt, Human
uguuggagaagaacugaaa

SEQ ID NO: 1340119 - RNA, 20 nt, Human
uguuggagaagaacugaaau

SEQ ID NO: 1340120 - RNA, 21 nt, Human
uguuggacaagcuucugagac

SEQ ID NO: 1340121 - RNA, 22 nt, Human
uguuggacaagcuucugagacg

SEQ ID NO: 1340122 - RNA, 21 nt, Human
uguuggacaccuuuagguucu

SEQ ID NO: 1340123 - RNA, 14 nt, Human
uguuggcagccucu

SEQ ID NO: 1340124 - RNA, 12 nt, Human
uguuggcaggcu

SEQ ID NO: 1340125 - RNA, 11 nt, Human
uguuucuguaa

SEQ ID NO: 1340126 - RNA, 16 nt, Human
uguuucuguaagaaac

SEQ ID NO: 1340127 - RNA, 15 nt, Human
uguuugugcuguggu

SEQ ID NO: 1340128 - RNA, 12 nt, Human
uguuuguguauu

SEQ ID NO: 1340129 - RNA, 14 nt, Human
uguuuguguauuua

SEQ ID NO: 1340130 - RNA, 11 nt, Human
uguuuguuggu

SEQ ID NO: 1340131 - RNA, 15 nt, Human
uguuuguuguagauu

SEQ ID NO: 1340132 - RNA, 14 nt, Human
uguuuccucuguuc

SEQ ID NO: 1340133 - RNA, 20 nt, Human
uguuucccuuucacuggcau

SEQ ID NO: 1340134 - RNA, 22 nt, Human
uguuuccccacaaaacaaagca

SEQ ID NO: 1340135 - RNA, 16 nt, Human
uguuuccuagcugugu

SEQ ID NO: 1340136 - RNA, 14 nt, Human
uguuuccucuaguu

SEQ ID NO: 1340137 - RNA, 12 nt, Human
uguuucugacuc

SEQ ID NO: 1340138 - RNA, 19 nt, Human
uguuucugacucugagcua

SEQ ID NO: 1340139 - RNA, 17 nt, Human
uguuucuggauuucaua

SEQ ID NO: 1340140 - RNA, 20 nt, Human
uguuuccagcauucccaggu

SEQ ID NO: 1340141 - RNA, 22 nt, Human
uguuucccaggcccacugugcc

SEQ ID NO: 1340142 - RNA, 18 nt, Human
uguuuccagcauucccag

SEQ ID NO: 1340143 - RNA, 20 nt, Human
uguuuacauuuuauggugcc

SEQ ID NO: 1340144 - RNA, 13 nt, Human
uguuuacuaggga

SEQ ID NO: 1340145 - RNA, 19 nt, Human
uguuuacuagggaucccuc

SEQ ID NO: 1340146 - RNA, 15 nt, Human
uguuuacugcaaggu

SEQ ID NO: 1340147 - RNA, 13 nt, Human
uuaaaaaaaaaga

SEQ ID NO: 1340148 - RNA, 22 nt, Human
uuaaaaaaaaaccugagcccca

SEQ ID NO: 1340149 - RNA, 23 nt, Human
uguuuuugcgugggagugugugc

SEQ ID NO: 1340150 - RNA, 10 nt, Human
uguuuuuggg

SEQ ID NO: 1340151 - RNA, 16 nt, Human
uguuuuuggucuuuua

SEQ ID NO: 1340152 - RNA, 18 nt, Human
uguuuuuacaaauguuaa

SEQ ID NO: 1340153 - RNA, 20 nt, Human
uguuuuuaaugcuuugauau

SEQ ID NO: 1340154 - RNA, 16 nt, Human
uguuuuugcacauguu

SEQ ID NO: 1340155 - RNA, 16 nt, Human
uguuuuaauaacuuau

SEQ ID NO: 1340156 - RNA, 13 nt, Human
uguuuuaauugua

SEQ ID NO: 1340157 - RNA, 22 nt, Human
uguuuuaauuuaaacaccuccu

SEQ ID NO: 1340158 - RNA, 23 nt, Human
uguuuuaauuuaaacaccuccuc

SEQ ID NO: 1340159 - RNA, 14 nt, Human
uguuuuuaaacugu

SEQ ID NO: 1340160 - RNA, 15 nt, Human
uguuuuuaaacugua

SEQ ID NO: 1340161 - RNA, 16 nt, Human
uguuuuuaaacuguac

SEQ ID NO: 1340162 - RNA, 18 nt, Human
uguuuuuaaacuguacag

SEQ ID NO: 1340163 - RNA, 19 nt, Human
uguuuuuaaacuguacagu

SEQ ID NO: 1340164 - RNA, 19 nt, Human
uguuuuuaacaugucaauc

SEQ ID NO: 1340165 - RNA, 23 nt, Human
uguuuuuaaacuguacagugucu

SEQ ID NO: 1340166 - RNA, 14 nt, Human
uuaaagccuccuca

SEQ ID NO: 1340167 - RNA, 13 nt, Human
uuaaagccuccuc

SEQ ID NO: 1340168 - RNA, 20 nt, Human
uuaaagcagguucuuguugg

SEQ ID NO: 1340169 - RNA, 21 nt, Human
uuaaagaaaaaaauguauuuu

SEQ ID NO: 1340170 - RNA, 17 nt, Human
uuaaagaaaaaaauuga

SEQ ID NO: 1340171 - RNA, 20 nt, Human
uuaaagaaaaaaauugaaau

SEQ ID NO: 1340172 - RNA, 22 nt, Human
uuaaagaaaaaaauugaaaugu

SEQ ID NO: 1340173 - RNA, 21 nt, Human
uuaaaugacacucauauaauu

SEQ ID NO: 1340174 - RNA, 16 nt, Human
uuaaaucucauugcuu

SEQ ID NO: 1340175 - RNA, 18 nt, Human
uuaaaucuguuuuucuaa

SEQ ID NO: 1340176 - RNA, 14 nt, Human
uuaaaugaacaaga

SEQ ID NO: 1340177 - RNA, 17 nt, Human
uuaaaugaacaagagaa

SEQ ID NO: 1340178 - RNA, 18 nt, Human
uuaaaugaacaagagaag

SEQ ID NO: 1340179 - RNA, 22 nt, Human
uuaaaugacacucauauaauua

SEQ ID NO: 1340180 - RNA, 20 nt, Human
uuaaaugaacaagagaagca

SEQ ID NO: 1340181 - RNA, 22 nt, Human
uuaaaugaacaagagaagcauu

SEQ ID NO: 1340182 - RNA, 18 nt, Human
uuaaaaaaaaagaucugu

SEQ ID NO: 1340183 - RNA, 18 nt, Human
uuaaaaccugcuuuucaa

SEQ ID NO: 1340184 - RNA, 21 nt, Human
uuaaaaccugcuuuucaaugu

SEQ ID NO: 1340185 - RNA, 12 nt, Human
uuaaaacuccug

SEQ ID NO: 1340186 - RNA, 15 nt, Human
uuaaaacuuguaauu

SEQ ID NO: 1340187 - RNA, 15 nt, Human
uuaaaacuuugaagu

SEQ ID NO: 1340188 - RNA, 17 nt, Human
uuaaaauacaagacugc

SEQ ID NO: 1340189 - RNA, 15 nt, Human
uuaaaauaauuauau

SEQ ID NO: 1340190 - RNA, 11 nt, Human
uuaaaauacaa

SEQ ID NO: 1340191 - RNA, 13 nt, Human
uuaaaauacaaga

SEQ ID NO: 1340192 - RNA, 15 nt, Human
uuaaaauacaagacu

SEQ ID NO: 1340193 - RNA, 14 nt, Human
uuaaacuaaaugug

SEQ ID NO: 1340194 - RNA, 22 nt, Human
uuaaacuaggagaaccaaaucu

SEQ ID NO: 1340195 - RNA, 17 nt, Human
uuaaacuugcaucacuu

SEQ ID NO: 1340196 - RNA, 17 nt, Human
uuaaacuuuuaauucau

SEQ ID NO: 1340197 - RNA, 18 nt, Human
uuaaacuuuuaauucauu

SEQ ID NO: 1340198 - RNA, 18 nt, Human
uuaaagaaaaaaauguau

SEQ ID NO: 1340199 - RNA, 19 nt, Human
uuaaagaaaaaaauguauu

SEQ ID NO: 1340200 - RNA, 20 nt, Human
uuaaagaaaaaaauguauuu

SEQ ID NO: 1340201 - RNA, 14 nt, Human
uuaauagcagccuu

SEQ ID NO: 1340202 - RNA, 15 nt, Human
uuaauagcagccuuu

SEQ ID NO: 1340203 - RNA, 22 nt, Human
uuaauagcagccuuucucucuu

SEQ ID NO: 1340204 - RNA, 15 nt, Human
uuaauagcaaagaau

SEQ ID NO: 1340205 - RNA, 16 nt, Human
uuaauagcaaagaauu

SEQ ID NO: 1340206 - RNA, 18 nt, Human
uuaauagcaaagaauuga

SEQ ID NO: 1340207 - RNA, 20 nt, Human
uuaauagcaaagaauugacu

SEQ ID NO: 1340208 - RNA, 16 nt, Human
uuaauaauguuucaaa

SEQ ID NO: 1340209 - RNA, 15 nt, Human
uuaauaccacagcuu

SEQ ID NO: 1340210 - RNA, 15 nt, Human
uuaauacuaccuuga

SEQ ID NO: 1340211 - RNA, 17 nt, Human
uuaauacuaccuugaaa

SEQ ID NO: 1340212 - RNA, 22 nt, Human
uuaauacucaaaugaguaacau

SEQ ID NO: 1340213 - RNA, 21 nt, Human
uuaauacucaaaugaguaaca

SEQ ID NO: 1340214 - RNA, 22 nt, Human
uuaagcaucuggcucuaauuca

SEQ ID NO: 1340215 - RNA, 16 nt, Human
uuaagccaaaacaaug

SEQ ID NO: 1340216 - RNA, 21 nt, Human
uuaagccacuuaaaauguuca

SEQ ID NO: 1340217 - RNA, 20 nt, Human
uuaagcccagugcacugaaa

SEQ ID NO: 1340218 - RNA, 12 nt, Human
uuaagaguaaaa

SEQ ID NO: 1340219 - RNA, 14 nt, Human
uuaacuuuguuuua

SEQ ID NO: 1340220 - RNA, 13 nt, Human
uuaagaguccaag

SEQ ID NO: 1340221 - RNA, 14 nt, Human
uuaagaguccaaga

SEQ ID NO: 1340222 - RNA, 19 nt, Human
uuaagaguccaagaaucca

SEQ ID NO: 1340223 - RNA, 14 nt, Human
uuaacuuuaauguu

SEQ ID NO: 1340224 - RNA, 11 nt, Human
uuaacuuuguu

SEQ ID NO: 1340225 - RNA, 16 nt, Human
uuaagauaauuauaau

SEQ ID NO: 1340226 - RNA, 14 nt, Human
uuaagauaauuaua

SEQ ID NO: 1340227 - RNA, 18 nt, Human
uuaagaucacagugaacu

SEQ ID NO: 1340228 - RNA, 20 nt, Human
uuaaauguuaugacuaugua

SEQ ID NO: 1340229 - RNA, 16 nt, Human
uuaaauguuaugacua

SEQ ID NO: 1340230 - RNA, 13 nt, Human
uuaaauguuauua

SEQ ID NO: 1340231 - RNA, 19 nt, Human
uuaaauguauacuauagua

SEQ ID NO: 1340232 - RNA, 14 nt, Human
uuaaauguauacua

SEQ ID NO: 1340233 - RNA, 12 nt, Human
uuaaauguauac

SEQ ID NO: 1340234 - RNA, 20 nt, Human
uuaaaugcaaccauuugaaa

SEQ ID NO: 1340235 - RNA, 23 nt, Human
uuacaacggagucaaaaauuaaa

SEQ ID NO: 1340236 - RNA, 19 nt, Human
uuacaacggagucaaaaau

SEQ ID NO: 1340237 - RNA, 22 nt, Human
uuacaacugccucgaaacacag

SEQ ID NO: 1340238 - RNA, 23 nt, Human
uuacaacugccucgaaacacaga

SEQ ID NO: 1340239 - RNA, 17 nt, Human
uuacacauuaagcaaau

SEQ ID NO: 1340240 - RNA, 16 nt, Human
uuacaacggagucaaa

SEQ ID NO: 1340241 - RNA, 19 nt, Human
uuacaaauguuaaaaugug

SEQ ID NO: 1340242 - RNA, 16 nt, Human
uuaauuaccaaccugu

SEQ ID NO: 1340243 - RNA, 19 nt, Human
uuaauuagccagugaaaaa

SEQ ID NO: 1340244 - RNA, 18 nt, Human
uuacaaauguuaaaaugu

SEQ ID NO: 1340245 - RNA, 21 nt, Human
uuacaaauguuaaaauguguu

SEQ ID NO: 1340246 - RNA, 20 nt, Human
uuaaugaaugcuuaaagaau

SEQ ID NO: 1340247 - RNA, 21 nt, Human
uuaaugaaugcuuaaagaauu

SEQ ID NO: 1340248 - RNA, 17 nt, Human
uuaaugaaugcuuaaag

SEQ ID NO: 1340249 - RNA, 15 nt, Human
uuaaugaaugcuuaa

SEQ ID NO: 1340250 - RNA, 13 nt, Human
uuaaugaaugcuu

SEQ ID NO: 1340251 - RNA, 16 nt, Human
uuaauagcagccuuuc

SEQ ID NO: 1340252 - RNA, 20 nt, Human
uuaauaaucucacauauaca

SEQ ID NO: 1340253 - RNA, 14 nt, Human
uuacauuuccuaaa

SEQ ID NO: 1340254 - RNA, 17 nt, Human
uuacauuuacaaacuga

SEQ ID NO: 1340255 - RNA, 18 nt, Human
uuacauuuacaaacugaa

SEQ ID NO: 1340256 - RNA, 19 nt, Human
uuacauuuacaaacugaag

SEQ ID NO: 1340257 - RNA, 20 nt, Human
uuacauuuacaaacugaaga

SEQ ID NO: 1340258 - RNA, 20 nt, Human
uuacagagacagaaagcaga

SEQ ID NO: 1340259 - RNA, 23 nt, Human
uuacagaauugcuuguuugcuuc

SEQ ID NO: 1340260 - RNA, 19 nt, Human
uuacagacgcugcugucac

SEQ ID NO: 1340261 - RNA, 13 nt, Human
uuacauucugaau

SEQ ID NO: 1340262 - RNA, 16 nt, Human
uuacacuuuuuggaag

SEQ ID NO: 1340263 - RNA, 17 nt, Human
uuacacgcuuuugugau

SEQ ID NO: 1340264 - RNA, 14 nt, Human
uuacacgcuuuugu

SEQ ID NO: 1340265 - RNA, 22 nt, Human
uuacacuacacacuguguacug

SEQ ID NO: 1340266 - RNA, 14 nt, Human
uuacacucuuugua

SEQ ID NO: 1340267 - RNA, 15 nt, Human
uuacacucuuuguaa

SEQ ID NO: 1340268 - RNA, 19 nt, Human
uguggaacauaaaaaggac

SEQ ID NO: 1340269 - RNA, 15 nt, Human
uguggaacugcugcc

SEQ ID NO: 1340270 - RNA, 17 nt, Human
uguggaacugcugccac

SEQ ID NO: 1340271 - RNA, 21 nt, Human
uguggaacauaaaaaggacau

SEQ ID NO: 1340272 - RNA, 22 nt, Human
uguggaacugcugccacugagg

SEQ ID NO: 1340273 - RNA, 18 nt, Human
uguggaacugcugccacu

SEQ ID NO: 1340274 - RNA, 14 nt, Human
uguggacaggacua

SEQ ID NO: 1340275 - RNA, 15 nt, Human
uguggccuaaccugc

SEQ ID NO: 1340276 - RNA, 22 nt, Human
uguggaccauggaguggcagcc

SEQ ID NO: 1340277 - RNA, 21 nt, Human
uguggaccauggaguggcagc

SEQ ID NO: 1340278 - RNA, 17 nt, Human
uguggccuaagaggcug

SEQ ID NO: 1340279 - RNA, 23 nt, Human
uguggccuaagaggcugcccucc

SEQ ID NO: 1340280 - RNA, 17 nt, Human
uguggccuuugcgcucc

SEQ ID NO: 1340281 - RNA, 18 nt, Human
uguggcgccgucuccagg

SEQ ID NO: 1340282 - RNA, 23 nt, Human
uguggccucagcucccacaagcc

SEQ ID NO: 1340283 - RNA, 19 nt, Human
uguggccuaagaggcugcc

SEQ ID NO: 1340284 - RNA, 23 nt, Human
ugugggagaccggccugccagga

SEQ ID NO: 1340285 - RNA, 17 nt, Human
ugugggagaccggccug

SEQ ID NO: 1340286 - RNA, 12 nt, Human
ugugggagccuc

SEQ ID NO: 1340287 - RNA, 10 nt, Human
uguggcucac

SEQ ID NO: 1340288 - RNA, 19 nt, Human
uguggcgccgucuccaggg

SEQ ID NO: 1340289 - RNA, 23 nt, Human
uguggcgccgucuccaggggcug

SEQ ID NO: 1340290 - RNA, 14 nt, Human
uguguagcuuugcu

SEQ ID NO: 1340291 - RNA, 17 nt, Human
uguguagcuuugcucuu

SEQ ID NO: 1340292 - RNA, 15 nt, Human
uguguacauaacuga

SEQ ID NO: 1340293 - RNA, 17 nt, Human
uguguacauaacugaaa

SEQ ID NO: 1340294 - RNA, 12 nt, Human
uguguagccuuu

SEQ ID NO: 1340295 - RNA, 13 nt, Human
uguguagccuuuu

SEQ ID NO: 1340296 - RNA, 14 nt, Human
uguguagccuuuuu

SEQ ID NO: 1340297 - RNA, 20 nt, Human
uguguagccuuuuuguauaa

SEQ ID NO: 1340298 - RNA, 16 nt, Human
uguguagcugugaccu

SEQ ID NO: 1340299 - RNA, 19 nt, Human
uguguagcugugaccugcu

SEQ ID NO: 1340300 - RNA, 22 nt, Human
ugugggcgugagaccugccccu

SEQ ID NO: 1340301 - RNA, 20 nt, Human
ugugggccugggcuccugga

SEQ ID NO: 1340302 - RNA, 21 nt, Human
uguguaauuagugccacuuaa

SEQ ID NO: 1340303 - RNA, 20 nt, Human
ugugggcgugagaccugccc

SEQ ID NO: 1340304 - RNA, 21 nt, Human
ugugggcgugagaccugcccc

SEQ ID NO: 1340305 - RNA, 11 nt, Human
ugugggccugg

SEQ ID NO: 1340306 - RNA, 13 nt, Human
ugugggccugggc

SEQ ID NO: 1340307 - RNA, 14 nt, Human
ugugggccugggcu

SEQ ID NO: 1340308 - RNA, 15 nt, Human
ugugggccugggcuc

SEQ ID NO: 1340309 - RNA, 17 nt, Human
ugugggccugggcuccu

SEQ ID NO: 1340310 - RNA, 19 nt, Human
ugugggccugggcuccugg

SEQ ID NO: 1340311 - RNA, 14 nt, Human
ugugggagccucgc

SEQ ID NO: 1340312 - RNA, 19 nt, Human
ugugggauguucagcacug

SEQ ID NO: 1340313 - RNA, 22 nt, Human
ugugggauguucagcacugucc

SEQ ID NO: 1340314 - RNA, 13 nt, Human
ugugggauuaugg

SEQ ID NO: 1340315 - RNA, 16 nt, Human
ugugggauuauggguc

SEQ ID NO: 1340316 - RNA, 18 nt, Human
ugugggauuaugggucac

SEQ ID NO: 1340317 - RNA, 23 nt, Human
ugugggauuaugggucacaggaa

SEQ ID NO: 1340318 - RNA, 16 nt, Human
uguggaacauaaaaag

SEQ ID NO: 1340319 - RNA, 14 nt, Human
ugugcuuugagaag

SEQ ID NO: 1340320 - RNA, 19 nt, Human
ugugcuugagccaggaggc

SEQ ID NO: 1340321 - RNA, 16 nt, Human
ugugcucaggagcccu

SEQ ID NO: 1340322 - RNA, 15 nt, Human
ugugcucaggagccc

SEQ ID NO: 1340323 - RNA, 17 nt, Human
ugugcucaggagcccug

SEQ ID NO: 1340324 - RNA, 20 nt, Human
ugugcucaggagcccuggga

SEQ ID NO: 1340325 - RNA, 14 nt, Human
ugugcuuguuaacu

SEQ ID NO: 1340326 - RNA, 19 nt, Human
ugugcuaguaauuggaaag

SEQ ID NO: 1340327 - RNA, 13 nt, Human
ugugcuauacugc

SEQ ID NO: 1340328 - RNA, 18 nt, Human
ugugcuauacugcauacu

SEQ ID NO: 1340329 - RNA, 20 nt, Human
ugugcuauacugcauacuuu

SEQ ID NO: 1340330 - RNA, 21 nt, Human
ugugcuauacugcauacuuuu

SEQ ID NO: 1340331 - RNA, 18 nt, Human
ugugcuauggugcucugu

SEQ ID NO: 1340332 - RNA, 12 nt, Human
ugugcucagccc

SEQ ID NO: 1340333 - RNA, 15 nt, Human
ugugcucagcccuga

SEQ ID NO: 1340334 - RNA, 13 nt, Human
ugugcacugccca

SEQ ID NO: 1340335 - RNA, 21 nt, Human
ugugcacugcccauggacagg

SEQ ID NO: 1340336 - RNA, 20 nt, Human
ugugcacuggcaccaagugc

SEQ ID NO: 1340337 - RNA, 17 nt, Human
ugugcacuuauuuauga

SEQ ID NO: 1340338 - RNA, 21 nt, Human
ugugcacaucugugucuuguu

SEQ ID NO: 1340339 - RNA, 16 nt, Human
ugugcauuauuuucca

SEQ ID NO: 1340340 - RNA, 15 nt, Human
ugugcauucuggauu

SEQ ID NO: 1340341 - RNA, 23 nt, Human
ugugccuucgucuuucccauggg

SEQ ID NO: 1340342 - RNA, 17 nt, Human
ugugccuugucacgcca

SEQ ID NO: 1340343 - RNA, 19 nt, Human
ugugccuugucacgccaga

SEQ ID NO: 1340344 - RNA, 20 nt, Human
ugugccuugucacgccagac

SEQ ID NO: 1340345 - RNA, 21 nt, Human
ugugccuucucucucccuuuu

SEQ ID NO: 1340346 - RNA, 13 nt, Human
ugugccuuguuuu

SEQ ID NO: 1340347 - RNA, 18 nt, Human
ugugccuuguuuuuuguu

SEQ ID NO: 1340348 - RNA, 15 nt, Human
ugugccuuguuuuuu

SEQ ID NO: 1340349 - RNA, 16 nt, Human
ugugauauaagugugu

SEQ ID NO: 1340350 - RNA, 17 nt, Human
ugugaguguuuuuaucu

SEQ ID NO: 1340351 - RNA, 16 nt, Human
ugugaguucucccugu

SEQ ID NO: 1340352 - RNA, 21 nt, Human
ugugaguuuaccuuguauacu

SEQ ID NO: 1340353 - RNA, 19 nt, Human
ugugaguuuaccuuguaua

SEQ ID NO: 1340354 - RNA, 13 nt, Human
ugugauauauaag

SEQ ID NO: 1340355 - RNA, 14 nt, Human
ugugauauauaagu

SEQ ID NO: 1340356 - RNA, 15 nt, Human
ugugauauauaagug

SEQ ID NO: 1340357 - RNA, 16 nt, Human
ugugauauauaagugu

SEQ ID NO: 1340358 - RNA, 21 nt, Human
ugugauaugcacaauguagau

SEQ ID NO: 1340359 - RNA, 22 nt, Human
ugugaguguuuuuaucuuuuua

SEQ ID NO: 1340360 - RNA, 14 nt, Human
ugugauauucuaag

SEQ ID NO: 1340361 - RNA, 15 nt, Human
ugugauauucuaaga

SEQ ID NO: 1340362 - RNA, 19 nt, Human
ugugauauucuaagacuua

SEQ ID NO: 1340363 - RNA, 15 nt, Human
ugugaucagaccaua

SEQ ID NO: 1340364 - RNA, 17 nt, Human
ugugcacaucugugucu

SEQ ID NO: 1340365 - RNA, 20 nt, Human
ugugcacaucugugucuugu

SEQ ID NO: 1340366 - RNA, 14 nt, Human
ugugaggccagggc

SEQ ID NO: 1340367 - RNA, 15 nt, Human
ugugaggccagggca

SEQ ID NO: 1340368 - RNA, 16 nt, Human
ugugaggccagggcag

SEQ ID NO: 1340369 - RNA, 17 nt, Human
ugugaggccagggcaga

SEQ ID NO: 1340370 - RNA, 22 nt, Human
ugugaggccagggcagagugag

SEQ ID NO: 1340371 - RNA, 14 nt, Human
ugugaggcuguccu

SEQ ID NO: 1340372 - RNA, 18 nt, Human
ugugagucuuugguucua

SEQ ID NO: 1340373 - RNA, 20 nt, Human
ugugagucuuugguucuaag

SEQ ID NO: 1340374 - RNA, 21 nt, Human
ugugagucuuugguucuaagg

SEQ ID NO: 1340375 - RNA, 22 nt, Human
ugugagucuuugguucuaagga

SEQ ID NO: 1340376 - RNA, 18 nt, Human
ugugacauuuuacauuaa

SEQ ID NO: 1340377 - RNA, 17 nt, Human
ugugacauuuuacauua

SEQ ID NO: 1340378 - RNA, 15 nt, Human
ugugacauuuuacau

SEQ ID NO: 1340379 - RNA, 18 nt, Human
ugugaccaaaaguuacau

SEQ ID NO: 1340380 - RNA, 17 nt, Human
ugugaccaaaaguuaca

SEQ ID NO: 1340381 - RNA, 15 nt, Human
ugugaccaaugucuu

SEQ ID NO: 1340382 - RNA, 16 nt, Human
ugugaccaaugucuug

SEQ ID NO: 1340383 - RNA, 13 nt, Human
ugugaggccaggg

SEQ ID NO: 1340384 - RNA, 17 nt, Human
ugugaaggugauuuaag

SEQ ID NO: 1340385 - RNA, 23 nt, Human
ugugaaggugauuuaagggccca

SEQ ID NO: 1340386 - RNA, 16 nt, Human
ugugaauuaagcccaa

SEQ ID NO: 1340387 - RNA, 19 nt, Human
ugugaauuaggcuguaacu

SEQ ID NO: 1340388 - RNA, 22 nt, Human
ugugaauuaggcuguaacuacu

SEQ ID NO: 1340389 - RNA, 23 nt, Human
ugugaauuaggcuguaacuacuu

SEQ ID NO: 1340390 - RNA, 24 nt, Human
ugugaauuaggcuguaacuacuuu

SEQ ID NO: 1340391 - RNA, 17 nt, Human
ugugacauuuauauauu

SEQ ID NO: 1340392 - RNA, 18 nt, Human
ugugacauuuauauauug

SEQ ID NO: 1340393 - RNA, 16 nt, Human
ugugaaaaugugugug

SEQ ID NO: 1340394 - RNA, 18 nt, Human
ugugaaaaugguccagga

SEQ ID NO: 1340395 - RNA, 22 nt, Human
ugugaaaaugguccaggagaag

SEQ ID NO: 1340396 - RNA, 17 nt, Human
ugugaaaaugugugugu

SEQ ID NO: 1340397 - RNA, 13 nt, Human
ugugaagccuucc

SEQ ID NO: 1340398 - RNA, 12 nt, Human
ugugaagccuuc

SEQ ID NO: 1340399 - RNA, 13 nt, Human
ugugaaggacccu

SEQ ID NO: 1340400 - RNA, 14 nt, Human
ugugaaggacccuu

SEQ ID NO: 1340401 - RNA, 13 nt, Human
ugucuuuuggagg

SEQ ID NO: 1340402 - RNA, 14 nt, Human
ugucuguccuuuau

SEQ ID NO: 1340403 - RNA, 17 nt, Human
ugucuggcacagccugg

SEQ ID NO: 1340404 - RNA, 23 nt, Human
ugucugguucucaauuccaacag

SEQ ID NO: 1340405 - RNA, 20 nt, Human
ugucuggcaaggacuuugua

SEQ ID NO: 1340406 - RNA, 15 nt, Human
ugucuggcaaugcca

SEQ ID NO: 1340407 - RNA, 16 nt, Human
ugucuggcaaugccac

SEQ ID NO: 1340408 - RNA, 19 nt, Human
ugucuggcaaugccacagc

SEQ ID NO: 1340409 - RNA, 22 nt, Human
ugucuggcaaugccacagcccu

SEQ ID NO: 1340410 - RNA, 15 nt, Human
ugucuggaagauggg

SEQ ID NO: 1340411 - RNA, 17 nt, Human
ugucuggaagaugggga

SEQ ID NO: 1340412 - RNA, 11 nt, Human
ugucuggagac

SEQ ID NO: 1340413 - RNA, 12 nt, Human
ugucuggagacc

SEQ ID NO: 1340414 - RNA, 13 nt, Human
ugucuggagacca

SEQ ID NO: 1340415 - RNA, 17 nt, Human
ugucuggagaccaccag

SEQ ID NO: 1340416 - RNA, 18 nt, Human
ugucuggagaccaccagg

SEQ ID NO: 1340417 - RNA, 20 nt, Human
ugucuggagaccaccagggc

SEQ ID NO: 1340418 - RNA, 21 nt, Human
ugucuggagaccaccagggca

SEQ ID NO: 1340419 - RNA, 14 nt, Human
ugucuggcaaggac

SEQ ID NO: 1340420 - RNA, 16 nt, Human
ugucugaagucacugc

SEQ ID NO: 1340421 - RNA, 16 nt, Human
ugucugaacuugcauu

SEQ ID NO: 1340422 - RNA, 17 nt, Human
ugucugaagucacugca

SEQ ID NO: 1340423 - RNA, 18 nt, Human
ugucugaagucacugcac

SEQ ID NO: 1340424 - RNA, 19 nt, Human
ugucugaagucacugcaca

SEQ ID NO: 1340425 - RNA, 20 nt, Human
ugucugaagucacugcacag

SEQ ID NO: 1340426 - RNA, 17 nt, Human
uguccucagccuugcca

SEQ ID NO: 1340427 - RNA, 20 nt, Human
uguccucagccuugccagag

SEQ ID NO: 1340428 - RNA, 21 nt, Human
uguccucagccuugccagaga

SEQ ID NO: 1340429 - RNA, 22 nt, Human
uguccucagccuugccagagau

SEQ ID NO: 1340430 - RNA, 18 nt, Human
uguccuagcacagauggc

SEQ ID NO: 1340431 - RNA, 23 nt, Human
uguccuccaacaccaagcacagc

SEQ ID NO: 1340432 - RNA, 23 nt, Human
uguccucccgagcuccucuucca

SEQ ID NO: 1340433 - RNA, 16 nt, Human
uguccucuucccucuc

SEQ ID NO: 1340434 - RNA, 13 nt, Human
uguccucuucccu

SEQ ID NO: 1340435 - RNA, 14 nt, Human
uguccucuuucagc

SEQ ID NO: 1340436 - RNA, 15 nt, Human
uguccucuuucagcu

SEQ ID NO: 1340437 - RNA, 16 nt, Human
uguccucuuucagcuc

SEQ ID NO: 1340438 - RNA, 17 nt, Human
uguccucuuucagcucc

SEQ ID NO: 1340439 - RNA, 18 nt, Human
uguccucuuucagcuccu

SEQ ID NO: 1340440 - RNA, 19 nt, Human
uguccucuuucagcuccug

SEQ ID NO: 1340441 - RNA, 21 nt, Human
uguccucuuucagcuccugac

SEQ ID NO: 1340442 - RNA, 12 nt, Human
uguccugaaggc

SEQ ID NO: 1340443 - RNA, 18 nt, Human
uguccugaaggccugagg

SEQ ID NO: 1340444 - RNA, 15 nt, Human
uguccugaaggccug

SEQ ID NO: 1340445 - RNA, 13 nt, Human
ugucugaacuugc

SEQ ID NO: 1340446 - RNA, 18 nt, Human
ugucugaacuugcauugu

SEQ ID NO: 1340447 - RNA, 18 nt, Human
uguagccccucuccugga

SEQ ID NO: 1340448 - RNA, 19 nt, Human
uguagcccuuuccaagcuu

SEQ ID NO: 1340449 - RNA, 23 nt, Human
uguagccucaaucgagugagaca

SEQ ID NO: 1340450 - RNA, 16 nt, Human
uguagccacaccagga

SEQ ID NO: 1340451 - RNA, 17 nt, Human
uguagccacaccaggau

SEQ ID NO: 1340452 - RNA, 18 nt, Human
uguagccacaccaggaua

SEQ ID NO: 1340453 - RNA, 15 nt, Human
uguagccagccgggg

SEQ ID NO: 1340454 - RNA, 12 nt, Human
uguagccagccg

SEQ ID NO: 1340455 - RNA, 14 nt, Human
uguagccagccggg

SEQ ID NO: 1340456 - RNA, 16 nt, Human
uguagccccagugaca

SEQ ID NO: 1340457 - RNA, 21 nt, Human
uguagccccagugacagcuag

SEQ ID NO: 1340458 - RNA, 12 nt, Human
uguagccuuuuu

SEQ ID NO: 1340459 - RNA, 13 nt, Human
uguagccuuuuug

SEQ ID NO: 1340460 - RNA, 16 nt, Human
uguagcgucuuucuuu

SEQ ID NO: 1340461 - RNA, 15 nt, Human
uguagcgucuuucuu

SEQ ID NO: 1340462 - RNA, 13 nt, Human
uguagcuacagag

SEQ ID NO: 1340463 - RNA, 14 nt, Human
uguagcuacagaga

SEQ ID NO: 1340464 - RNA, 15 nt, Human
uguagcuacagagaa

SEQ ID NO: 1340465 - RNA, 16 nt, Human
uguagcuacagagaaa

SEQ ID NO: 1340466 - RNA, 17 nt, Human
uguagcuacagagaaac

SEQ ID NO: 1340467 - RNA, 18 nt, Human
uguagcuacagagaaacc

SEQ ID NO: 1340468 - RNA, 19 nt, Human
uguagcuacagagaaacca

SEQ ID NO: 1340469 - RNA, 21 nt, Human
uguagcuacagagaaaccagc

SEQ ID NO: 1340470 - RNA, 22 nt, Human
uguagcuacagagaaaccagcu

SEQ ID NO: 1340471 - RNA, 23 nt, Human
uguagcuacagagaaaccagcuu

SEQ ID NO: 1340472 - RNA, 11 nt, Human
uguagcuccuc

SEQ ID NO: 1340473 - RNA, 17 nt, Human
uguagcuccuccccugg

SEQ ID NO: 1340474 - RNA, 18 nt, Human
uguagcuccuccccugga

SEQ ID NO: 1340475 - RNA, 17 nt, Human
uguagcucuaaaaucug

SEQ ID NO: 1340476 - RNA, 20 nt, Human
uguagcucuuugucagggag

SEQ ID NO: 1340477 - RNA, 15 nt, Human
uguagcugaggaggc

SEQ ID NO: 1340478 - RNA, 11 nt, Human
uguagcuguga

SEQ ID NO: 1340479 - RNA, 13 nt, Human
uguagcugugacc

SEQ ID NO: 1340480 - RNA, 14 nt, Human
uguagcugugaccu

SEQ ID NO: 1340481 - RNA, 15 nt, Human
uguagcugugaccug

SEQ ID NO: 1340482 - RNA, 16 nt, Human
uguagcugugaccugc

SEQ ID NO: 1340483 - RNA, 17 nt, Human
uguagcugugaccugcu

SEQ ID NO: 1340484 - RNA, 18 nt, Human
uguagcugugaccugcug

SEQ ID NO: 1340485 - RNA, 19 nt, Human
uguagcugugaccugcuga

SEQ ID NO: 1340486 - RNA, 20 nt, Human
uguagcugugaccugcugag

SEQ ID NO: 1340487 - RNA, 21 nt, Human
uguagcugugaccugcugagc

SEQ ID NO: 1340488 - RNA, 13 nt, Human
uguaguucaugua

SEQ ID NO: 1340489 - RNA, 14 nt, Human
uguaguucauguaa

SEQ ID NO: 1340490 - RNA, 20 nt, Human
uguaguucauguaaauaaua

SEQ ID NO: 1340491 - RNA, 22 nt, Human
uguaguuccacuuauagccucu

SEQ ID NO: 1340492 - RNA, 14 nt, Human
uguagcauccugga

SEQ ID NO: 1340493 - RNA, 16 nt, Human
uguagcauccuggaau

SEQ ID NO: 1340494 - RNA, 18 nt, Human
uguagauugauuguauug

SEQ ID NO: 1340495 - RNA, 22 nt, Human
uguagauugauuguauuguuga

SEQ ID NO: 1340496 - RNA, 17 nt, Human
uguagcauccuggaaua

SEQ ID NO: 1340497 - RNA, 18 nt, Human
uguagcauccuggaauau

SEQ ID NO: 1340498 - RNA, 13 nt, Human
uguagccacacca

SEQ ID NO: 1340499 - RNA, 16 nt, Human
uguacuguucuguguc

SEQ ID NO: 1340500 - RNA, 19 nt, Human
uguacuguucugugucuuu

SEQ ID NO: 1340501 - RNA, 16 nt, Human
uguagauucagguaau

SEQ ID NO: 1340502 - RNA, 14 nt, Human
uguagauugauugu

SEQ ID NO: 1340503 - RNA, 21 nt, Human
uguacggauuuucaguuacuu

SEQ ID NO: 1340504 - RNA, 18 nt, Human
uguacggauuuucaguua

SEQ ID NO: 1340505 - RNA, 12 nt, Human
uguacugccugc

SEQ ID NO: 1340506 - RNA, 13 nt, Human
uguacugccugcu

SEQ ID NO: 1340507 - RNA, 15 nt, Human
uguacugccugcuug

SEQ ID NO: 1340508 - RNA, 14 nt, Human
uguacugccugcuu

SEQ ID NO: 1340509 - RNA, 15 nt, Human
uguacuguucugugu

SEQ ID NO: 1340510 - RNA, 22 nt, Human
uguaccuuuugaggagccccag

SEQ ID NO: 1340511 - RNA, 22 nt, Human
uguaccgcgucuacccugggau

SEQ ID NO: 1340512 - RNA, 21 nt, Human
uguaccuuuugaggagcccca

SEQ ID NO: 1340513 - RNA, 21 nt, Human
uguaaucuugaauuguaacug

SEQ ID NO: 1340514 - RNA, 20 nt, Human
uguaaugucuugagcucuau

SEQ ID NO: 1340515 - RNA, 15 nt, Human
uguaaugucuugagc

SEQ ID NO: 1340516 - RNA, 19 nt, Human
uguaaugucuugagcucua

SEQ ID NO: 1340517 - RNA, 14 nt, Human
uguaauguuaauau

SEQ ID NO: 1340518 - RNA, 15 nt, Human
uguaauguuaauauu

SEQ ID NO: 1340519 - RNA, 18 nt, Human
uguaauguuaauauugau

SEQ ID NO: 1340520 - RNA, 17 nt, Human
uguaauguuaauauuga

SEQ ID NO: 1340521 - RNA, 20 nt, Human
uguaaucuuauuuaggaagu

SEQ ID NO: 1340522 - RNA, 15 nt, Human
uguaaucuugaauug

SEQ ID NO: 1340523 - RNA, 14 nt, Human
uguaaucacagcua

SEQ ID NO: 1340524 - RNA, 20 nt, Human
uguaaucaauguuucuucua

SEQ ID NO: 1340525 - RNA, 16 nt, Human
uguaauccgaaucucu

SEQ ID NO: 1340526 - RNA, 20 nt, Human
uguaauagggaaaauucuaa

SEQ ID NO: 1340527 - RNA, 17 nt, Human
uguaauauuucuucaaa

SEQ ID NO: 1340528 - RNA, 14 nt, Human
uguaaucaauguuu

SEQ ID NO: 1340529 - RNA, 17 nt, Human
uggucacaggaaguaga

SEQ ID NO: 1340530 - RNA, 15 nt, Human
uggucacagcggagg

SEQ ID NO: 1340531 - RNA, 21 nt, Human
uggucacagcggaggugugga

SEQ ID NO: 1340532 - RNA, 14 nt, Human
uggucacacacuga

SEQ ID NO: 1340533 - RNA, 15 nt, Human
uggucacacacugau

SEQ ID NO: 1340534 - RNA, 16 nt, Human
uggucacacacugaug

SEQ ID NO: 1340535 - RNA, 13 nt, Human
uggucacagcugu

SEQ ID NO: 1340536 - RNA, 14 nt, Human
uggucacagcugua

SEQ ID NO: 1340537 - RNA, 13 nt, Human
uguaauaaacuuu

SEQ ID NO: 1340538 - RNA, 15 nt, Human
uguaauaaacuuuaa

SEQ ID NO: 1340539 - RNA, 17 nt, Human
uguaauaaacuuuaaua

SEQ ID NO: 1340540 - RNA, 18 nt, Human
uguaauagauguuugaua

SEQ ID NO: 1340541 - RNA, 22 nt, Human
uguaccguaggcuuuguauuca

SEQ ID NO: 1340542 - RNA, 18 nt, Human
uguaccgcgucuacccug

SEQ ID NO: 1340543 - RNA, 19 nt, Human
uguaccgcgucuacccugg

SEQ ID NO: 1340544 - RNA, 20 nt, Human
uguaccgcgucuacccuggg

SEQ ID NO: 1340545 - RNA, 21 nt, Human
uguaccgcgucuacccuggga

SEQ ID NO: 1340546 - RNA, 16 nt, Human
uguaccgcaaugugac

SEQ ID NO: 1340547 - RNA, 21 nt, Human
uguacaguuaucuaaguuaau

SEQ ID NO: 1340548 - RNA, 22 nt, Human
uguacaguuaucuaaguuaauu

SEQ ID NO: 1340549 - RNA, 14 nt, Human
uguacagugucuuu

SEQ ID NO: 1340550 - RNA, 15 nt, Human
uguacagugucuuuu

SEQ ID NO: 1340551 - RNA, 22 nt, Human
uguacagugucuuuuuuuguau

SEQ ID NO: 1340552 - RNA, 23 nt, Human
uguacagugucuuuuuuuguaua

SEQ ID NO: 1340553 - RNA, 12 nt, Human
uguacaguguua

SEQ ID NO: 1340554 - RNA, 13 nt, Human
uguacaguguuac

SEQ ID NO: 1340555 - RNA, 14 nt, Human
uguacaguguuacc

SEQ ID NO: 1340556 - RNA, 17 nt, Human
uguacaguuaucuaagu

SEQ ID NO: 1340557 - RNA, 18 nt, Human
uguacaguuaucuaaguu

SEQ ID NO: 1340558 - RNA, 14 nt, Human
uguaauuaaaagca

SEQ ID NO: 1340559 - RNA, 16 nt, Human
uguaauuaaaagcaaa

SEQ ID NO: 1340560 - RNA, 20 nt, Human
uguaauuaaaagcaaaucau

SEQ ID NO: 1340561 - RNA, 16 nt, Human
uguacaaggacagccc

SEQ ID NO: 1340562 - RNA, 20 nt, Human
uguacaaggacagccccucc

SEQ ID NO: 1340563 - RNA, 23 nt, Human
uguacaaggacagccccuccucc

SEQ ID NO: 1340564 - RNA, 19 nt, Human
uguaauuaaaagcaaauca

SEQ ID NO: 1340565 - RNA, 15 nt, Human
uguacacaacucacu

SEQ ID NO: 1340566 - RNA, 21 nt, Human
uguacacaacucacuccuuuu

SEQ ID NO: 1340567 - RNA, 12 nt, Human
uguacacaguca

SEQ ID NO: 1340568 - RNA, 22 nt, Human
ugucacccagguuggagugcag

SEQ ID NO: 1340569 - RNA, 15 nt, Human
ugucaccagaucuga

SEQ ID NO: 1340570 - RNA, 23 nt, Human
ugucaccaauguacccaccgggc

SEQ ID NO: 1340571 - RNA, 18 nt, Human
ugucaccacccugcucau

SEQ ID NO: 1340572 - RNA, 22 nt, Human
ugucaccacccugcucauccac

SEQ ID NO: 1340573 - RNA, 14 nt, Human
uguauuuuguauug

SEQ ID NO: 1340574 - RNA, 20 nt, Human
uguauuuauuuaguauuuau

SEQ ID NO: 1340575 - RNA, 22 nt, Human
uguauuuauugguuuugcagaa

SEQ ID NO: 1340576 - RNA, 23 nt, Human
uguauuguugaaaaaguuuguuu

SEQ ID NO: 1340577 - RNA, 22 nt, Human
uguauuguugaaaaaguuuguu

SEQ ID NO: 1340578 - RNA, 23 nt, Human
uguauuuccccaacauguaauaa

SEQ ID NO: 1340579 - RNA, 16 nt, Human
uguauuuuagcagaga

SEQ ID NO: 1340580 - RNA, 12 nt, Human
uguauuuuaugu

SEQ ID NO: 1340581 - RNA, 13 nt, Human
uguauuuuauguu

SEQ ID NO: 1340582 - RNA, 14 nt, Human
uguauuuuauguua

SEQ ID NO: 1340583 - RNA, 17 nt, Human
uguauuuuauguuauau

SEQ ID NO: 1340584 - RNA, 22 nt, Human
uguauaaaagggacugagaaau

SEQ ID NO: 1340585 - RNA, 20 nt, Human
uguaugaucaaauguuuaau

SEQ ID NO: 1340586 - RNA, 19 nt, Human
uguaugaucaaauguuuaa

SEQ ID NO: 1340587 - RNA, 18 nt, Human
uguaugaucaaauguuua

SEQ ID NO: 1340588 - RNA, 16 nt, Human
uguaugaucaaauguu

SEQ ID NO: 1340589 - RNA, 15 nt, Human
uguaugaucaaaugu

SEQ ID NO: 1340590 - RNA, 14 nt, Human
uguaugaucaaaug

SEQ ID NO: 1340591 - RNA, 13 nt, Human
uguaugaucaaau

SEQ ID NO: 1340592 - RNA, 13 nt, Human
uguauaaaagugu

SEQ ID NO: 1340593 - RNA, 12 nt, Human
uguaugaucaaa

SEQ ID NO: 1340594 - RNA, 15 nt, Human
uguaugauucccagc

SEQ ID NO: 1340595 - RNA, 23 nt, Human
uguaugaucaaauguuuaaucau

SEQ ID NO: 1340596 - RNA, 12 nt, Human
uguaugauuacu

SEQ ID NO: 1340597 - RNA, 13 nt, Human
uguaugauuacug

SEQ ID NO: 1340598 - RNA, 13 nt, Human
uguaguucuaaga

SEQ ID NO: 1340599 - RNA, 15 nt, Human
uguaguucuaagacu

SEQ ID NO: 1340600 - RNA, 20 nt, Human
uguaguucugcuccagacag

SEQ ID NO: 1340601 - RNA, 19 nt, Human
uguaguuuuuauauguugu

SEQ ID NO: 1340602 - RNA, 20 nt, Human
uguaguuuuuauauguugua

SEQ ID NO: 1340603 - RNA, 14 nt, Human
uguauaaaaauaaa

SEQ ID NO: 1340604 - RNA, 22 nt, Human
uguauaaaaauaaaaaagaucc

SEQ ID NO: 1340605 - RNA, 15 nt, Human
uguauugugcaaugu

SEQ ID NO: 1340606 - RNA, 21 nt, Human
uguauuguauauuacaaugau

SEQ ID NO: 1340607 - RNA, 18 nt, Human
uguauugugcaaugugua

SEQ ID NO: 1340608 - RNA, 19 nt, Human
uguauugugcaauguguau

SEQ ID NO: 1340609 - RNA, 20 nt, Human
uguauugugcaauguguaua

SEQ ID NO: 1340610 - RNA, 18 nt, Human
uguauuguugaaaaaguu

SEQ ID NO: 1340611 - RNA, 20 nt, Human
uguauuguugaaaaaguuug

SEQ ID NO: 1340612 - RNA, 16 nt, Human
uguaugauucccagcc

SEQ ID NO: 1340613 - RNA, 22 nt, Human
uguaugauuacuggccuuuuuc

SEQ ID NO: 1340614 - RNA, 13 nt, Human
uguauucucugag

SEQ ID NO: 1340615 - RNA, 14 nt, Human
uguauucucugagc

SEQ ID NO: 1340616 - RNA, 19 nt, Human
uguauucucugagcugugc

SEQ ID NO: 1340617 - RNA, 20 nt, Human
uguauucucugagcugugca

SEQ ID NO: 1340618 - RNA, 21 nt, Human
uguauucucugagcugugcag

SEQ ID NO: 1340619 - RNA, 23 nt, Human
ugucccacccccacccccagcuc

SEQ ID NO: 1340620 - RNA, 18 nt, Human
uguccaugcgcucagggc

SEQ ID NO: 1340621 - RNA, 17 nt, Human
ugucccacccccacccc

SEQ ID NO: 1340622 - RNA, 18 nt, Human
ugucccacccccaccccc

SEQ ID NO: 1340623 - RNA, 22 nt, Human
ugucccacccccacccccagcu

SEQ ID NO: 1340624 - RNA, 12 nt, Human
uguccccagcag

SEQ ID NO: 1340625 - RNA, 14 nt, Human
uguccccccacucc

SEQ ID NO: 1340626 - RNA, 15 nt, Human
uguccccccacuccc

SEQ ID NO: 1340627 - RNA, 19 nt, Human
uguccccccacucccucac

SEQ ID NO: 1340628 - RNA, 18 nt, Human
ugucccccucuguccagg

SEQ ID NO: 1340629 - RNA, 21 nt, Human
uguccucagccccgcguggaa

SEQ ID NO: 1340630 - RNA, 21 nt, Human
ugucccccuuuagaucucuga

SEQ ID NO: 1340631 - RNA, 22 nt, Human
ugucccccuuuagaucucugaa

SEQ ID NO: 1340632 - RNA, 14 nt, Human
uguccuagcacaga

SEQ ID NO: 1340633 - RNA, 15 nt, Human
uguccuagcacagau

SEQ ID NO: 1340634 - RNA, 12 nt, Human
uguccucagccu

SEQ ID NO: 1340635 - RNA, 13 nt, Human
uguccucagccuu

SEQ ID NO: 1340636 - RNA, 16 nt, Human
uguccucagccuugcc

SEQ ID NO: 1340637 - RNA, 23 nt, Human
ugucauuguuauauaaucauuau

SEQ ID NO: 1340638 - RNA, 15 nt, Human
ugucauuucagaagu

SEQ ID NO: 1340639 - RNA, 16 nt, Human
ugucauuucagaaguu

SEQ ID NO: 1340640 - RNA, 14 nt, Human
ugucauuucauuuc

SEQ ID NO: 1340641 - RNA, 16 nt, Human
ugucauuucauuuccu

SEQ ID NO: 1340642 - RNA, 17 nt, Human
ugucauuucauuuccua

SEQ ID NO: 1340643 - RNA, 16 nt, Human
ugucccaacuuguaaa

SEQ ID NO: 1340644 - RNA, 20 nt, Human
uguccaugcgcucagggcca

SEQ ID NO: 1340645 - RNA, 18 nt, Human
uguccaucagaugacaag

SEQ ID NO: 1340646 - RNA, 17 nt, Human
uguccaucagaugacaa

SEQ ID NO: 1340647 - RNA, 16 nt, Human
uguccaucagaugaca

SEQ ID NO: 1340648 - RNA, 14 nt, Human
uguccaucagauga

SEQ ID NO: 1340649 - RNA, 14 nt, Human
ugucacgccagacu

SEQ ID NO: 1340650 - RNA, 13 nt, Human
ugucaucugugca

SEQ ID NO: 1340651 - RNA, 14 nt, Human
ugucaccugugcuu

SEQ ID NO: 1340652 - RNA, 13 nt, Human
ugucaugcugccu

SEQ ID NO: 1340653 - RNA, 14 nt, Human
ugucaugcugccuu

SEQ ID NO: 1340654 - RNA, 15 nt, Human
ugucaugcugccuua

SEQ ID NO: 1340655 - RNA, 16 nt, Human
ugucaugcugggauuu

SEQ ID NO: 1340656 - RNA, 20 nt, Human
ugucaugcugggauuuccaa

SEQ ID NO: 1340657 - RNA, 15 nt, Human
ugucauguguauaaa

SEQ ID NO: 1340658 - RNA, 11 nt, Human
ugucaugugua

SEQ ID NO: 1340659 - RNA, 13 nt, Human
ugucauguguaua

SEQ ID NO: 1340660 - RNA, 14 nt, Human
ugucauguguauaa

SEQ ID NO: 1340661 - RNA, 20 nt, Human
ugucauuuaguucagcaucc

SEQ ID NO: 1340662 - RNA, 21 nt, Human
uggggaaaggggucggcugac

SEQ ID NO: 1340663 - RNA, 22 nt, Human
uggggaaaggggucggcugacc

SEQ ID NO: 1340664 - RNA, 23 nt, Human
uggggaaaggggucggcugacca

SEQ ID NO: 1340665 - RNA, 13 nt, Human
uggggaagacagu

SEQ ID NO: 1340666 - RNA, 14 nt, Human
uggggaagacagug

SEQ ID NO: 1340667 - RNA, 17 nt, Human
uggggaagacaguggcc

SEQ ID NO: 1340668 - RNA, 13 nt, Human
ugggggcugcagu

SEQ ID NO: 1340669 - RNA, 17 nt, Human
ugggggcugaggagcag

SEQ ID NO: 1340670 - RNA, 12 nt, Human
ugggcagcaauu

SEQ ID NO: 1340671 - RNA, 17 nt, Human
ugggcagauuuucagca

SEQ ID NO: 1340672 - RNA, 20 nt, Human
ugggcgugagaccugccccu

SEQ ID NO: 1340673 - RNA, 23 nt, Human
ugggcagaggaccaggcuguagg

SEQ ID NO: 1340674 - RNA, 15 nt, Human
ugggcagauuuucag

SEQ ID NO: 1340675 - RNA, 13 nt, Human
ugggcuuauaucu

SEQ ID NO: 1340676 - RNA, 20 nt, Human
ugggcuuauaucuggccucu

SEQ ID NO: 1340677 - RNA, 21 nt, Human
ugggcuuauaucuggccucug

SEQ ID NO: 1340678 - RNA, 22 nt, Human
ugggcuuauaucuggccucugc

SEQ ID NO: 1340679 - RNA, 14 nt, Human
ugggcugguaucuc

SEQ ID NO: 1340680 - RNA, 18 nt, Human
ugggcugguaucucagaa

SEQ ID NO: 1340681 - RNA, 20 nt, Human
ugggcugguaucucagaaag

SEQ ID NO: 1340682 - RNA, 21 nt, Human
ugggcugguaucucagaaagu

SEQ ID NO: 1340683 - RNA, 23 nt, Human
ugggcugguaucucagaaagugc

SEQ ID NO: 1340684 - RNA, 14 nt, Human
ugggcuucagcugc

SEQ ID NO: 1340685 - RNA, 18 nt, Human
ugggcuucagcugccagu

SEQ ID NO: 1340686 - RNA, 17 nt, Human
ugggcuucagcugccag

SEQ ID NO: 1340687 - RNA, 18 nt, Human
ugggcuuguggggccugg

SEQ ID NO: 1340688 - RNA, 19 nt, Human
ugggcuuguggggccuggg

SEQ ID NO: 1340689 - RNA, 20 nt, Human
ugggcuuguggggccuggga

SEQ ID NO: 1340690 - RNA, 22 nt, Human
ugggcuuguggggccugggagg

SEQ ID NO: 1340691 - RNA, 16 nt, Human
uggggaaacagcaucu

SEQ ID NO: 1340692 - RNA, 18 nt, Human
uggggaaacagcaucucc

SEQ ID NO: 1340693 - RNA, 16 nt, Human
uggggaaacuggccau

SEQ ID NO: 1340694 - RNA, 18 nt, Human
uggggaaacuggccaugg

SEQ ID NO: 1340695 - RNA, 21 nt, Human
uggguuagggaaaacauucca

SEQ ID NO: 1340696 - RNA, 19 nt, Human
uggguuagggaaaacauuc

SEQ ID NO: 1340697 - RNA, 18 nt, Human
uggguuagggaaaacauu

SEQ ID NO: 1340698 - RNA, 16 nt, Human
uggguuagggaaaaca

SEQ ID NO: 1340699 - RNA, 14 nt, Human
uggguuaaguauua

SEQ ID NO: 1340700 - RNA, 15 nt, Human
uggguuagaccuaca

SEQ ID NO: 1340701 - RNA, 22 nt, Human
uggguguuaucaccuagcugaa

SEQ ID NO: 1340702 - RNA, 14 nt, Human
uggguguuaauuuu

SEQ ID NO: 1340703 - RNA, 14 nt, Human
uggguuaguggaug

SEQ ID NO: 1340704 - RNA, 14 nt, Human
uggguucugccugc

SEQ ID NO: 1340705 - RNA, 15 nt, Human
ugggggugagggucc

SEQ ID NO: 1340706 - RNA, 14 nt, Human
ugggggugccagga

SEQ ID NO: 1340707 - RNA, 23 nt, Human
uggguaaaauacuuuuacucugc

SEQ ID NO: 1340708 - RNA, 15 nt, Human
uggguaaaauacuuu

SEQ ID NO: 1340709 - RNA, 16 nt, Human
uggguaaaauacuuuu

SEQ ID NO: 1340710 - RNA, 13 nt, Human
ugggugguacccu

SEQ ID NO: 1340711 - RNA, 14 nt, Human
ugggugguacccuc

SEQ ID NO: 1340712 - RNA, 18 nt, Human
ugggugguacccucugga

SEQ ID NO: 1340713 - RNA, 22 nt, Human
ugggugguacccucuggagggg

SEQ ID NO: 1340714 - RNA, 23 nt, Human
ugguaugaacuugaggacacaug

SEQ ID NO: 1340715 - RNA, 22 nt, Human
ugguaugaacuugaggacacau

SEQ ID NO: 1340716 - RNA, 21 nt, Human
ugguaugaacuugaggacaca

SEQ ID NO: 1340717 - RNA, 19 nt, Human
ugguaugaacuugaggaca

SEQ ID NO: 1340718 - RNA, 22 nt, Human
ugguauauccaaaagcuuuuua

SEQ ID NO: 1340719 - RNA, 13 nt, Human
ugguaucucagaa

SEQ ID NO: 1340720 - RNA, 22 nt, Human
ugguaucucagaaagugccuga

SEQ ID NO: 1340721 - RNA, 16 nt, Human
ugguaucucagaaagu

SEQ ID NO: 1340722 - RNA, 16 nt, Human
uggguucugccugcca

SEQ ID NO: 1340723 - RNA, 19 nt, Human
uggguucugccugccagcu

SEQ ID NO: 1340724 - RNA, 17 nt, Human
uggguuugguguauggu

SEQ ID NO: 1340725 - RNA, 15 nt, Human
ugguaguuuuuucau

SEQ ID NO: 1340726 - RNA, 16 nt, Human
ugguaguuuuuucauc

SEQ ID NO: 1340727 - RNA, 17 nt, Human
ugguaguuuuuucaucu

SEQ ID NO: 1340728 - RNA, 18 nt, Human
ugguaguuuuuucaucuu

SEQ ID NO: 1340729 - RNA, 16 nt, Human
ugguauauccaaaagc

SEQ ID NO: 1340730 - RNA, 19 nt, Human
ugguauauccaaaagcuuu

SEQ ID NO: 1340731 - RNA, 22 nt, Human
uggccccacccucguggacacc

SEQ ID NO: 1340732 - RNA, 13 nt, Human
uggccccacccug

SEQ ID NO: 1340733 - RNA, 15 nt, Human
uggccccacccuggg

SEQ ID NO: 1340734 - RNA, 16 nt, Human
uggccccacccugggc

SEQ ID NO: 1340735 - RNA, 18 nt, Human
uggccccacccugggccc

SEQ ID NO: 1340736 - RNA, 14 nt, Human
uggcccagggccca

SEQ ID NO: 1340737 - RNA, 15 nt, Human
uggcccagggcccag

SEQ ID NO: 1340738 - RNA, 16 nt, Human
uggcccagggcccaga

SEQ ID NO: 1340739 - RNA, 22 nt, Human
uggccccacccugggcccuggg

SEQ ID NO: 1340740 - RNA, 12 nt, Human
uggccccagcac

SEQ ID NO: 1340741 - RNA, 13 nt, Human
uggcucuccuggc

SEQ ID NO: 1340742 - RNA, 17 nt, Human
uggcucuccuggcccug

SEQ ID NO: 1340743 - RNA, 14 nt, Human
uggcucuccuggcc

SEQ ID NO: 1340744 - RNA, 19 nt, Human
uggcucugagcgccuccau

SEQ ID NO: 1340745 - RNA, 20 nt, Human
uggcucugaggugccugucc

SEQ ID NO: 1340746 - RNA, 21 nt, Human
uggcucugaggugccuguccc

SEQ ID NO: 1340747 - RNA, 14 nt, Human
uggcuggacaaacu

SEQ ID NO: 1340748 - RNA, 13 nt, Human
uggcuggacccag

SEQ ID NO: 1340749 - RNA, 14 nt, Human
uggcuggacccagc

SEQ ID NO: 1340750 - RNA, 15 nt, Human
uggcuggacccagcc

SEQ ID NO: 1340751 - RNA, 16 nt, Human
uggcuggacccagcca

SEQ ID NO: 1340752 - RNA, 21 nt, Human
uggcuggacccagccaggccc

SEQ ID NO: 1340753 - RNA, 22 nt, Human
uggcuggacccagccaggccca

SEQ ID NO: 1340754 - RNA, 23 nt, Human
uggcuggacccagccaggcccag

SEQ ID NO: 1340755 - RNA, 14 nt, Human
uggcuggucaacuu

SEQ ID NO: 1340756 - RNA, 13 nt, Human
uggcugguccagg

SEQ ID NO: 1340757 - RNA, 15 nt, Human
uggcugguccagggc

SEQ ID NO: 1340758 - RNA, 16 nt, Human
uggcugguccagggcu

SEQ ID NO: 1340759 - RNA, 19 nt, Human
uggcuggaagauccugcgg

SEQ ID NO: 1340760 - RNA, 20 nt, Human
uggcuggaagauccugcggg

SEQ ID NO: 1340761 - RNA, 21 nt, Human
uggcuggaagauccugcgggu

SEQ ID NO: 1340762 - RNA, 22 nt, Human
uggcucugaggugccuguccca

SEQ ID NO: 1340763 - RNA, 12 nt, Human
uggcucugccag

SEQ ID NO: 1340764 - RNA, 13 nt, Human
uggcucugccagu

SEQ ID NO: 1340765 - RNA, 17 nt, Human
uggcucugccaguccug

SEQ ID NO: 1340766 - RNA, 19 nt, Human
uggcucugccaguccuguc

SEQ ID NO: 1340767 - RNA, 16 nt, Human
uggcuuccuggcaaua

SEQ ID NO: 1340768 - RNA, 18 nt, Human
uggcugguguuaacagaa

SEQ ID NO: 1340769 - RNA, 22 nt, Human
uggcuggucaacuugagcaugu

SEQ ID NO: 1340770 - RNA, 11 nt, Human
uggcuggugug

SEQ ID NO: 1340771 - RNA, 13 nt, Human
uggcugguguggu

SEQ ID NO: 1340772 - RNA, 17 nt, Human
uggcuggugugguacag

SEQ ID NO: 1340773 - RNA, 19 nt, Human
uggcuggugugguacagag

SEQ ID NO: 1340774 - RNA, 20 nt, Human
uggcuggugugguacagaga

SEQ ID NO: 1340775 - RNA, 21 nt, Human
uggcuggugugguacagagaa

SEQ ID NO: 1340776 - RNA, 22 nt, Human
uggcuggugugguacagagaag

SEQ ID NO: 1340777 - RNA, 23 nt, Human
uggcuggugugguacagagaagc

SEQ ID NO: 1340778 - RNA, 12 nt, Human
uggcugguguua

SEQ ID NO: 1340779 - RNA, 15 nt, Human
uggcugguguuaaca

SEQ ID NO: 1340780 - RNA, 16 nt, Human
uggcugguguuaacag

SEQ ID NO: 1340781 - RNA, 19 nt, Human
uggcugguguuaacagaag

SEQ ID NO: 1340782 - RNA, 13 nt, Human
uggcuucuggcca

SEQ ID NO: 1340783 - RNA, 15 nt, Human
uggcuucuggccagg

SEQ ID NO: 1340784 - RNA, 16 nt, Human
uggcuucuggccagga

SEQ ID NO: 1340785 - RNA, 17 nt, Human
uggcuucuggccaggaa

SEQ ID NO: 1340786 - RNA, 18 nt, Human
uggcuucuggccaggaag

SEQ ID NO: 1340787 - RNA, 19 nt, Human
uggcuucuggccaggaagc

SEQ ID NO: 1340788 - RNA, 21 nt, Human
uggcuucuggccaggaagcuu

SEQ ID NO: 1340789 - RNA, 15 nt, Human
uggcuugagaaauau

SEQ ID NO: 1340790 - RNA, 21 nt, Human
uggcuugaguuuaaauuguaa

SEQ ID NO: 1340791 - RNA, 17 nt, Human
uggcuuuaggagcagug

SEQ ID NO: 1340792 - RNA, 20 nt, Human
uggcuuuaggagcaguggga

SEQ ID NO: 1340793 - RNA, 15 nt, Human
uggcuuucagagccu

SEQ ID NO: 1340794 - RNA, 17 nt, Human
uggcuuucagagccucc

SEQ ID NO: 1340795 - RNA, 11 nt, Human
uggcuuucagg

SEQ ID NO: 1340796 - RNA, 14 nt, Human
uggcuuucagggag

SEQ ID NO: 1340797 - RNA, 21 nt, Human
uggcuuucauuuucucucagg

SEQ ID NO: 1340798 - RNA, 16 nt, Human
uggcuuugaugauaaa

SEQ ID NO: 1340799 - RNA, 13 nt, Human
uggcuuuggaagc

SEQ ID NO: 1340800 - RNA, 21 nt, Human
uggcuuuggucucuugcuugu

SEQ ID NO: 1340801 - RNA, 23 nt, Human
ugggagauucaagggacccauga

SEQ ID NO: 1340802 - RNA, 18 nt, Human
ugggagcaaacugcaugc

SEQ ID NO: 1340803 - RNA, 20 nt, Human
ugggagcugaggccacacuc

SEQ ID NO: 1340804 - RNA, 22 nt, Human
ugggagcugaggccacacucag

SEQ ID NO: 1340805 - RNA, 16 nt, Human
ugggacguggcucagc

SEQ ID NO: 1340806 - RNA, 20 nt, Human
ugggacguggcucagccagc

SEQ ID NO: 1340807 - RNA, 14 nt, Human
ugggagaggcagcc

SEQ ID NO: 1340808 - RNA, 15 nt, Human
ugggagaggcagccc

SEQ ID NO: 1340809 - RNA, 18 nt, Human
ugggagaggcagcccagg

SEQ ID NO: 1340810 - RNA, 22 nt, Human
ugggagaggcagcccaggaagu

SEQ ID NO: 1340811 - RNA, 12 nt, Human
ugggagagggcg

SEQ ID NO: 1340812 - RNA, 13 nt, Human
ugggagagggcgc

SEQ ID NO: 1340813 - RNA, 14 nt, Human
ugggagagggcgca

SEQ ID NO: 1340814 - RNA, 15 nt, Human
ugggagagggcgcag

SEQ ID NO: 1340815 - RNA, 20 nt, Human
ugggagagggcgcaggccgu

SEQ ID NO: 1340816 - RNA, 15 nt, Human
ugggaccgcuacacc

SEQ ID NO: 1340817 - RNA, 20 nt, Human
ugggaccgcuacaccacucu

SEQ ID NO: 1340818 - RNA, 21 nt, Human
ugggaccgcuacaccacucug

SEQ ID NO: 1340819 - RNA, 16 nt, Human
ugggaccuagggaggc

SEQ ID NO: 1340820 - RNA, 22 nt, Human
ugggaccgcuacaccacucugg

SEQ ID NO: 1340821 - RNA, 23 nt, Human
ugggaccucaguuuuaucauuuu

SEQ ID NO: 1340822 - RNA, 23 nt, Human
ugggacgggaugguucuggcugu

SEQ ID NO: 1340823 - RNA, 14 nt, Human
ugggacggugccca

SEQ ID NO: 1340824 - RNA, 23 nt, Human
ugggacggugcccaagccagagg

SEQ ID NO: 1340825 - RNA, 15 nt, Human
ugggacguggcucag

SEQ ID NO: 1340826 - RNA, 14 nt, Human
uggcuuuggucucu

SEQ ID NO: 1340827 - RNA, 20 nt, Human
uggcuuuugcgguucaggaa

SEQ ID NO: 1340828 - RNA, 15 nt, Human
ugggacaacugcucc

SEQ ID NO: 1340829 - RNA, 21 nt, Human
ugggacaccccgacuuuuguu

SEQ ID NO: 1340830 - RNA, 22 nt, Human
ugggacaauuagauaaaugucc

SEQ ID NO: 1340831 - RNA, 12 nt, Human
ugggacaauuag

SEQ ID NO: 1340832 - RNA, 20 nt, Human
ugggauuaugggucacagga

SEQ ID NO: 1340833 - RNA, 20 nt, Human
ugggauucaggaaaaggccu

SEQ ID NO: 1340834 - RNA, 21 nt, Human
ugggauucaggaaaaggccug

SEQ ID NO: 1340835 - RNA, 22 nt, Human
ugggauucaggaaaaggccugg

SEQ ID NO: 1340836 - RNA, 18 nt, Human
ugggcagagcuggcucug

SEQ ID NO: 1340837 - RNA, 20 nt, Human
ugggcagagcuggcucugag

SEQ ID NO: 1340838 - RNA, 17 nt, Human
ugggauuacagguguga

SEQ ID NO: 1340839 - RNA, 15 nt, Human
ugggauuauggguca

SEQ ID NO: 1340840 - RNA, 18 nt, Human
ugggauuaugggucacag

SEQ ID NO: 1340841 - RNA, 19 nt, Human
ugggauuaugggucacagg

SEQ ID NO: 1340842 - RNA, 21 nt, Human
ugggauuaugggucacaggaa

SEQ ID NO: 1340843 - RNA, 19 nt, Human
ugggagcaaacugcaugcc

SEQ ID NO: 1340844 - RNA, 16 nt, Human
ugggagcugccaagag

SEQ ID NO: 1340845 - RNA, 23 nt, Human
ugggagucacacaguguuggagg

SEQ ID NO: 1340846 - RNA, 15 nt, Human
ugggagucacacagu

SEQ ID NO: 1340847 - RNA, 19 nt, Human
uggaaccagacucuugccu

SEQ ID NO: 1340848 - RNA, 18 nt, Human
uggaacucgugucuggca

SEQ ID NO: 1340849 - RNA, 13 nt, Human
uggaaccagacuc

SEQ ID NO: 1340850 - RNA, 17 nt, Human
uggaacuacauuacugu

SEQ ID NO: 1340851 - RNA, 23 nt, Human
uggaacuacauuaguacacagca

SEQ ID NO: 1340852 - RNA, 18 nt, Human
uggaacuagguuuuaaua

SEQ ID NO: 1340853 - RNA, 20 nt, Human
uggaacuagguuuuaauaau

SEQ ID NO: 1340854 - RNA, 16 nt, Human
uggaauaucuccguca

SEQ ID NO: 1340855 - RNA, 14 nt, Human
uggaauauaauugu

SEQ ID NO: 1340856 - RNA, 22 nt, Human
uggaauaauccuaaacauauga

SEQ ID NO: 1340857 - RNA, 15 nt, Human
uggaauaaguucaaa

SEQ ID NO: 1340858 - RNA, 12 nt, Human
uggacagcccca

SEQ ID NO: 1340859 - RNA, 14 nt, Human
uggacagccccacc

SEQ ID NO: 1340860 - RNA, 20 nt, Human
uggacauccuccucccaccc

SEQ ID NO: 1340861 - RNA, 23 nt, Human
uggacauccuccucccacccggc

SEQ ID NO: 1340862 - RNA, 18 nt, Human
uggacaugaagauucuuu

SEQ ID NO: 1340863 - RNA, 21 nt, Human
uggacaugaagauucuuuccc

SEQ ID NO: 1340864 - RNA, 22 nt, Human
uggacaugaagauucuuuccca

SEQ ID NO: 1340865 - RNA, 18 nt, Human
uggacucaccucccccau

SEQ ID NO: 1340866 - RNA, 20 nt, Human
uggacucaccucccccaucu

SEQ ID NO: 1340867 - RNA, 22 nt, Human
uggacuaucugucugguggccc

SEQ ID NO: 1340868 - RNA, 23 nt, Human
uggacuaucugucugguggcccc

SEQ ID NO: 1340869 - RNA, 22 nt, Human
uggacuauggagugcaccaaag

SEQ ID NO: 1340870 - RNA, 14 nt, Human
uggacuaucugucu

SEQ ID NO: 1340871 - RNA, 15 nt, Human
uggacuaucugucug

SEQ ID NO: 1340872 - RNA, 17 nt, Human
uggacuaucugucuggu

SEQ ID NO: 1340873 - RNA, 20 nt, Human
uggacuaucugucugguggc

SEQ ID NO: 1340874 - RNA, 15 nt, Human
uggaauggauuuuuc

SEQ ID NO: 1340875 - RNA, 22 nt, Human
uggaauauaauuguuuuaucug

SEQ ID NO: 1340876 - RNA, 17 nt, Human
uggaaugaauuaaauaa

SEQ ID NO: 1340877 - RNA, 18 nt, Human
uggaaugaauuaaauaaa

SEQ ID NO: 1340878 - RNA, 17 nt, Human
uggaaugcccuucacug

SEQ ID NO: 1340879 - RNA, 17 nt, Human
uggaaacaagucaguca

SEQ ID NO: 1340880 - RNA, 17 nt, Human
uggaaacagcucgacuu

SEQ ID NO: 1340881 - RNA, 13 nt, Human
uggaaacaagaug

SEQ ID NO: 1340882 - RNA, 19 nt, Human
uggaaaacagaacacuuau

SEQ ID NO: 1340883 - RNA, 15 nt, Human
uggaaaauucauuuu

SEQ ID NO: 1340884 - RNA, 17 nt, Human
uggaaaacaaggaaguc

SEQ ID NO: 1340885 - RNA, 16 nt, Human
uggaaaacagaacacu

SEQ ID NO: 1340886 - RNA, 17 nt, Human
uggaaaacagaacacuu

SEQ ID NO: 1340887 - RNA, 18 nt, Human
uggaaaacagaacacuua

SEQ ID NO: 1340888 - RNA, 20 nt, Human
uggaaaacagaacacuuaug

SEQ ID NO: 1340889 - RNA, 23 nt, Human
uggaaacuucagcgguuuauaua

SEQ ID NO: 1340890 - RNA, 22 nt, Human
uggaaacagcucgacuuuaaaa

SEQ ID NO: 1340891 - RNA, 14 nt, Human
uggaaacuuuucuu

SEQ ID NO: 1340892 - RNA, 19 nt, Human
uggaaagacagcuucucau

SEQ ID NO: 1340893 - RNA, 14 nt, Human
uggaaagaguacuc

SEQ ID NO: 1340894 - RNA, 23 nt, Human
uggaaagacagcuucucauccug

SEQ ID NO: 1340895 - RNA, 22 nt, Human
uggaaacuuuucuuaaaaaguu

SEQ ID NO: 1340896 - RNA, 18 nt, Human
uggaaagauaacuaggaa

SEQ ID NO: 1340897 - RNA, 23 nt, Human
uggaaagauaacuaggaaaucca

SEQ ID NO: 1340898 - RNA, 12 nt, Human
uggaaagcaggu

SEQ ID NO: 1340899 - RNA, 14 nt, Human
uggaacauccuugg

SEQ ID NO: 1340900 - RNA, 13 nt, Human
uggaacauuggaa

SEQ ID NO: 1340901 - RNA, 17 nt, Human
uggaacauuggaauguu

SEQ ID NO: 1340902 - RNA, 20 nt, Human
uggaacauuggaauguucuc

SEQ ID NO: 1340903 - RNA, 12 nt, Human
uggaaccagacu

SEQ ID NO: 1340904 - RNA, 23 nt, Human
ugcuuugaaauugaaccuuugug

SEQ ID NO: 1340905 - RNA, 16 nt, Human
ugcuuugaaguagcuc

SEQ ID NO: 1340906 - RNA, 20 nt, Human
ugcuuugaaguagcucuuuu

SEQ ID NO: 1340907 - RNA, 14 nt, Human
ugcuuucuguucca

SEQ ID NO: 1340908 - RNA, 15 nt, Human
ugcuuucuguuccaa

SEQ ID NO: 1340909 - RNA, 16 nt, Human
ugcuuucuguuccaaa

SEQ ID NO: 1340910 - RNA, 17 nt, Human
ugcuuucuguuccaaau

SEQ ID NO: 1340911 - RNA, 22 nt, Human
ugcuuucuguuccaaauucagu

SEQ ID NO: 1340912 - RNA, 18 nt, Human
ugcuuucuuuguuuggcu

SEQ ID NO: 1340913 - RNA, 21 nt, Human
ugcuuugaaacagaaaaauau

SEQ ID NO: 1340914 - RNA, 16 nt, Human
ugcuuugaaacagaaa

SEQ ID NO: 1340915 - RNA, 17 nt, Human
ugcuggaauucuaacaa

SEQ ID NO: 1340916 - RNA, 14 nt, Human
ugcuggacugucau

SEQ ID NO: 1340917 - RNA, 15 nt, Human
ugcuggacugucaua

SEQ ID NO: 1340918 - RNA, 19 nt, Human
ugcuggacugucauagaaa

SEQ ID NO: 1340919 - RNA, 20 nt, Human
ugcuggagaggccccagccg

SEQ ID NO: 1340920 - RNA, 22 nt, Human
ugcuggagaggccccagccgcu

SEQ ID NO: 1340921 - RNA, 13 nt, Human
ugcuuuaauauaa

SEQ ID NO: 1340922 - RNA, 14 nt, Human
ugcuuuaauauaaa

SEQ ID NO: 1340923 - RNA, 18 nt, Human
ugcuuuaauauaaaugca

SEQ ID NO: 1340924 - RNA, 20 nt, Human
ugcuuuaauauaaaugcaaa

SEQ ID NO: 1340925 - RNA, 22 nt, Human
ugcuuuaauauaaaugcaaaua

SEQ ID NO: 1340926 - RNA, 21 nt, Human
ugcuuuaauauaaaugcaaau

SEQ ID NO: 1340927 - RNA, 15 nt, Human
uggcaggugcagccc

SEQ ID NO: 1340928 - RNA, 18 nt, Human
uggcaguccgugggacgg

SEQ ID NO: 1340929 - RNA, 18 nt, Human
uggcaguccuggaagcca

SEQ ID NO: 1340930 - RNA, 16 nt, Human
uggcagucugaauuuu

SEQ ID NO: 1340931 - RNA, 22 nt, Human
uggcagucugaauuuuuaaaac

SEQ ID NO: 1340932 - RNA, 15 nt, Human
uggcaggggacagga

SEQ ID NO: 1340933 - RNA, 18 nt, Human
uggcaggggacaggaguc

SEQ ID NO: 1340934 - RNA, 13 nt, Human
uggcagggggcug

SEQ ID NO: 1340935 - RNA, 15 nt, Human
uggcagggggcugcu

SEQ ID NO: 1340936 - RNA, 16 nt, Human
uggcagggggcugcug

SEQ ID NO: 1340937 - RNA, 17 nt, Human
uggcagggggcugcugc

SEQ ID NO: 1340938 - RNA, 18 nt, Human
uggcagggggcugcugcu

SEQ ID NO: 1340939 - RNA, 19 nt, Human
uggcagggggcugcugcug

SEQ ID NO: 1340940 - RNA, 21 nt, Human
uggcagggggcugcugcuggg

SEQ ID NO: 1340941 - RNA, 23 nt, Human
uggcagggggcugcugcugggcu

SEQ ID NO: 1340942 - RNA, 11 nt, Human
uggcagcuuuu

SEQ ID NO: 1340943 - RNA, 19 nt, Human
uggcaggaguuggaagugu

SEQ ID NO: 1340944 - RNA, 18 nt, Human
uggcagcuuuuaaaagau

SEQ ID NO: 1340945 - RNA, 12 nt, Human
uggcaggaaggc

SEQ ID NO: 1340946 - RNA, 17 nt, Human
uggcaggaaggcuuguu

SEQ ID NO: 1340947 - RNA, 15 nt, Human
uggcaggaaggcuug

SEQ ID NO: 1340948 - RNA, 22 nt, Human
uggcaacagaucuggaaccuca

SEQ ID NO: 1340949 - RNA, 16 nt, Human
uggcaccgaagcccag

SEQ ID NO: 1340950 - RNA, 17 nt, Human
uggcaccgaagcccaga

SEQ ID NO: 1340951 - RNA, 18 nt, Human
uggcaccgaagcccagag

SEQ ID NO: 1340952 - RNA, 24 nt, Human
uggcaccgaagcccagagggucug

SEQ ID NO: 1340953 - RNA, 20 nt, Human
uggcaccuaauccaggcaga

SEQ ID NO: 1340954 - RNA, 13 nt, Human
uggccagcagcac

SEQ ID NO: 1340955 - RNA, 15 nt, Human
uggccagcagcaccu

SEQ ID NO: 1340956 - RNA, 16 nt, Human
uggccagcagcaccug

SEQ ID NO: 1340957 - RNA, 18 nt, Human
uggccagcagcaccugcc

SEQ ID NO: 1340958 - RNA, 21 nt, Human
uggccagcagcaccugcccua

SEQ ID NO: 1340959 - RNA, 20 nt, Human
uggccagcagcaccugcccu

SEQ ID NO: 1340960 - RNA, 17 nt, Human
uggccacuccagacccc

SEQ ID NO: 1340961 - RNA, 20 nt, Human
uggccacuccagaccccugg

SEQ ID NO: 1340962 - RNA, 19 nt, Human
uggcagugggaaaaaugua

SEQ ID NO: 1340963 - RNA, 22 nt, Human
uggcagugggaaaaauguagga

SEQ ID NO: 1340964 - RNA, 23 nt, Human
uggcagugggaaaaauguaggag

SEQ ID NO: 1340965 - RNA, 11 nt, Human
uggccaggagg

SEQ ID NO: 1340966 - RNA, 16 nt, Human
uggccaggaggugcca

SEQ ID NO: 1340967 - RNA, 12 nt, Human
uggccaggaggu

SEQ ID NO: 1340968 - RNA, 13 nt, Human
uggccaggccggg

SEQ ID NO: 1340969 - RNA, 15 nt, Human
uggccaggccgggaa

SEQ ID NO: 1340970 - RNA, 22 nt, Human
uggccaggccgggaaaaagccc

SEQ ID NO: 1340971 - RNA, 11 nt, Human
uggagggaagc

SEQ ID NO: 1340972 - RNA, 22 nt, Human
uggagggacaaguggacucagg

SEQ ID NO: 1340973 - RNA, 17 nt, Human
uggaggaccugagccug

SEQ ID NO: 1340974 - RNA, 18 nt, Human
uggaggaccugagccugc

SEQ ID NO: 1340975 - RNA, 20 nt, Human
uggaggaccugagccugccg

SEQ ID NO: 1340976 - RNA, 19 nt, Human
uggaggaccugagccugcc

SEQ ID NO: 1340977 - RNA, 12 nt, Human
uggaggagccca

SEQ ID NO: 1340978 - RNA, 13 nt, Human
uggaggagcccag

SEQ ID NO: 1340979 - RNA, 14 nt, Human
uggaggagcccagg

SEQ ID NO: 1340980 - RNA, 19 nt, Human
uggaggagcccaggccagg

SEQ ID NO: 1340981 - RNA, 22 nt, Human
uggaggagcccaggccaggacu

SEQ ID NO: 1340982 - RNA, 23 nt, Human
uggaggagcccaggccaggacuc

SEQ ID NO: 1340983 - RNA, 18 nt, Human
uggaggaagagggacaga

SEQ ID NO: 1340984 - RNA, 16 nt, Human
uggaggaccugagccu

SEQ ID NO: 1340985 - RNA, 15 nt, Human
uggacuccucugucc

SEQ ID NO: 1340986 - RNA, 15 nt, Human
uggacuccugcacac

SEQ ID NO: 1340987 - RNA, 16 nt, Human
uggacucgccuguaau

SEQ ID NO: 1340988 - RNA, 14 nt, Human
uggacucuaaaguc

SEQ ID NO: 1340989 - RNA, 15 nt, Human
uggacucucagucuc

SEQ ID NO: 1340990 - RNA, 20 nt, Human
uggacucucagucucugagc

SEQ ID NO: 1340991 - RNA, 22 nt, Human
uggacucucagucucugagcag

SEQ ID NO: 1340992 - RNA, 16 nt, Human
uggauuuaguuucagu

SEQ ID NO: 1340993 - RNA, 15 nt, Human
uggauuuaguuucag

SEQ ID NO: 1340994 - RNA, 15 nt, Human
uggauuuccuaauac

SEQ ID NO: 1340995 - RNA, 21 nt, Human
uggauuuccuaauacugucau

SEQ ID NO: 1340996 - RNA, 15 nt, Human
uggauuucuuugaaa

SEQ ID NO: 1340997 - RNA, 19 nt, Human
uggauuucuuugaaaaaaa

SEQ ID NO: 1340998 - RNA, 21 nt, Human
uggauccacuggcuggacaaa

SEQ ID NO: 1340999 - RNA, 15 nt, Human
uggaucacucaccau

SEQ ID NO: 1341000 - RNA, 17 nt, Human
uggaucacucaccauuc

SEQ ID NO: 1341001 - RNA, 18 nt, Human
uggaucagcguggccuug

SEQ ID NO: 1341002 - RNA, 17 nt, Human
uggaucagcguggccuu

SEQ ID NO: 1341003 - RNA, 16 nt, Human
uggauccuguguggag

SEQ ID NO: 1341004 - RNA, 17 nt, Human
uggauccuguguggaga

SEQ ID NO: 1341005 - RNA, 14 nt, Human
uggaucuauuucau

SEQ ID NO: 1341006 - RNA, 18 nt, Human
uggaucuauuucauguuu

SEQ ID NO: 1341007 - RNA, 20 nt, Human
uggaucuauuucauguuuuu

SEQ ID NO: 1341008 - RNA, 18 nt, Human
uggaucucauuggacccu

SEQ ID NO: 1341009 - RNA, 18 nt, Human
uggauuucuuugaaaaaa

SEQ ID NO: 1341010 - RNA, 13 nt, Human
uggauuugacauu

SEQ ID NO: 1341011 - RNA, 14 nt, Human
uggauuugacauug

SEQ ID NO: 1341012 - RNA, 22 nt, Human
uggauuuuccaggacuguuuca

SEQ ID NO: 1341013 - RNA, 13 nt, Human
uggauuuuuacca

SEQ ID NO: 1341014 - RNA, 14 nt, Human
uggauuuuuaccag

SEQ ID NO: 1341015 - RNA, 22 nt, Human
uggauuuuuaccagucucacau

SEQ ID NO: 1341016 - RNA, 15 nt, Human
uggauuuuucuuuaa

SEQ ID NO: 1341017 - RNA, 18 nt, Human
uggauuuuucuuuaacug

SEQ ID NO: 1341018 - RNA, 13 nt, Human
uggcaacacagag

SEQ ID NO: 1341019 - RNA, 13 nt, Human
uggcaacagaucu

SEQ ID NO: 1341020 - RNA, 15 nt, Human
uggcaacagaucugg

SEQ ID NO: 1341021 - RNA, 16 nt, Human
uggcaacagaucugga

SEQ ID NO: 1341022 - RNA, 17 nt, Human
uggcaacagaucuggaa

SEQ ID NO: 1341023 - RNA, 18 nt, Human
uggcaacagaucuggaac

SEQ ID NO: 1341024 - RNA, 20 nt, Human
uggcaacagaucuggaaccu

SEQ ID NO: 1341025 - RNA, 17 nt, Human
ugccacccucaugcugu

SEQ ID NO: 1341026 - RNA, 16 nt, Human
ugccacccucaugcug

SEQ ID NO: 1341027 - RNA, 14 nt, Human
ugccaccaggccac

SEQ ID NO: 1341028 - RNA, 17 nt, Human
ugccaccaggccaccuc

SEQ ID NO: 1341029 - RNA, 18 nt, Human
ugccaccaggccaccucc

SEQ ID NO: 1341030 - RNA, 19 nt, Human
ugccacuaaccuuccaaaa

SEQ ID NO: 1341031 - RNA, 23 nt, Human
ugccaggagggacaaaggagccu

SEQ ID NO: 1341032 - RNA, 24 nt, Human
ugccaggagggacaaaggagccug

SEQ ID NO: 1341033 - RNA, 21 nt, Human
ugccaggaggacccagggcuc

SEQ ID NO: 1341034 - RNA, 22 nt, Human
ugccaggaggacccagggcucu

SEQ ID NO: 1341035 - RNA, 23 nt, Human
ugccaggaggacccagggcucug

SEQ ID NO: 1341036 - RNA, 13 nt, Human
ugccaggagggac

SEQ ID NO: 1341037 - RNA, 21 nt, Human
ugccaggagggacaaaggagc

SEQ ID NO: 1341038 - RNA, 22 nt, Human
ugccaggagggacaaaggagcc

SEQ ID NO: 1341039 - RNA, 21 nt, Human
ugcauauuuauaaaaauaaaa

SEQ ID NO: 1341040 - RNA, 15 nt, Human
ugcauauguugaaua

SEQ ID NO: 1341041 - RNA, 17 nt, Human
ugcauauguugaauacu

SEQ ID NO: 1341042 - RNA, 15 nt, Human
ugcauauuuguuuau

SEQ ID NO: 1341043 - RNA, 20 nt, Human
ugcauauuuauaaaaauaaa

SEQ ID NO: 1341044 - RNA, 13 nt, Human
ugcauauguugaa

SEQ ID NO: 1341045 - RNA, 18 nt, Human
ugccaaauauaaauaaaa

SEQ ID NO: 1341046 - RNA, 17 nt, Human
ugccaaauauaaauaaa

SEQ ID NO: 1341047 - RNA, 22 nt, Human
ugccaaauauaaauaaaaauaa

SEQ ID NO: 1341048 - RNA, 19 nt, Human
ugccaaauauaaauaaaaa

SEQ ID NO: 1341049 - RNA, 16 nt, Human
ugccaaauauguccug

SEQ ID NO: 1341050 - RNA, 13 nt, Human
ugccaccaggcca

SEQ ID NO: 1341051 - RNA, 16 nt, Human
ugccccaucagugcuc

SEQ ID NO: 1341052 - RNA, 18 nt, Human
ugccccaucagugcuccc

SEQ ID NO: 1341053 - RNA, 20 nt, Human
ugccccaucagugcucccuc

SEQ ID NO: 1341054 - RNA, 21 nt, Human
ugccccaucagugcucccuca

SEQ ID NO: 1341055 - RNA, 15 nt, Human
ugccccagggcuccc

SEQ ID NO: 1341056 - RNA, 14 nt, Human
ugccccaggccuga

SEQ ID NO: 1341057 - RNA, 14 nt, Human
ugccccaggaccag

SEQ ID NO: 1341058 - RNA, 18 nt, Human
ugccccaggaccagcuca

SEQ ID NO: 1341059 - RNA, 19 nt, Human
ugccccaggaccagcucag

SEQ ID NO: 1341060 - RNA, 20 nt, Human
ugccccaggaccagcucagg

SEQ ID NO: 1341061 - RNA, 13 nt, Human
ugccccucccuuc

SEQ ID NO: 1341062 - RNA, 17 nt, Human
ugccccaucccaugcug

SEQ ID NO: 1341063 - RNA, 14 nt, Human
ugcccaguuaaucu

SEQ ID NO: 1341064 - RNA, 20 nt, Human
ugcccaguuaaucuugcuuu

SEQ ID NO: 1341065 - RNA, 23 nt, Human
ugcccaguuaaucuugcuuucuu

SEQ ID NO: 1341066 - RNA, 22 nt, Human
ugcccaguuaaucuugcuuucu

SEQ ID NO: 1341067 - RNA, 20 nt, Human
ugcccaugcugggagcccac

SEQ ID NO: 1341068 - RNA, 24 nt, Human
ugcccauggacaggcuggcuccag

SEQ ID NO: 1341069 - RNA, 16 nt, Human
ugcccaugggagcugg

SEQ ID NO: 1341070 - RNA, 13 nt, Human
ugccccaggacca

SEQ ID NO: 1341071 - RNA, 22 nt, Human
ugcccacccucuggagaaggug

SEQ ID NO: 1341072 - RNA, 22 nt, Human
ugcccaccucagccucccaaag

SEQ ID NO: 1341073 - RNA, 22 nt, Human
ugcacugauauaucaugaguga

SEQ ID NO: 1341074 - RNA, 14 nt, Human
ugcacugaugcugc

SEQ ID NO: 1341075 - RNA, 16 nt, Human
ugcacugaugcugccc

SEQ ID NO: 1341076 - RNA, 17 nt, Human
ugcacugaugcugcccc

SEQ ID NO: 1341077 - RNA, 21 nt, Human
ugcacugaugcugccccucau

SEQ ID NO: 1341078 - RNA, 22 nt, Human
ugcacugaugcugccccucauc

SEQ ID NO: 1341079 - RNA, 13 nt, Human
ugcacugauguug

SEQ ID NO: 1341080 - RNA, 14 nt, Human
ugcacugauguugu

SEQ ID NO: 1341081 - RNA, 15 nt, Human
ugcacugauguugug

SEQ ID NO: 1341082 - RNA, 21 nt, Human
ugcacugauguuguguuuuua

SEQ ID NO: 1341083 - RNA, 19 nt, Human
ugcacugcccauggacagg

SEQ ID NO: 1341084 - RNA, 21 nt, Human
ugcacugcccauggacaggcu

SEQ ID NO: 1341085 - RNA, 12 nt, Human
ugcaccggggcc

SEQ ID NO: 1341086 - RNA, 16 nt, Human
ugcaccggggccuggg

SEQ ID NO: 1341087 - RNA, 22 nt, Human
ugcaccggggccugggcaggag

SEQ ID NO: 1341088 - RNA, 17 nt, Human
ugcacuggccccacccu

SEQ ID NO: 1341089 - RNA, 12 nt, Human
ugcacugggagg

SEQ ID NO: 1341090 - RNA, 17 nt, Human
ugcacugggaggcuccc

SEQ ID NO: 1341091 - RNA, 20 nt, Human
ugcacugggaggcuccccuu

SEQ ID NO: 1341092 - RNA, 16 nt, Human
ugcacuggccccaccc

SEQ ID NO: 1341093 - RNA, 15 nt, Human
ugcacuggccccacc

SEQ ID NO: 1341094 - RNA, 16 nt, Human
ugcacuggggagcccg

SEQ ID NO: 1341095 - RNA, 20 nt, Human
ugcacuggggagcccgucuc

SEQ ID NO: 1341096 - RNA, 21 nt, Human
ugcacugggaggcuccccuuc

SEQ ID NO: 1341097 - RNA, 12 nt, Human
ugcacuguaaaa

SEQ ID NO: 1341098 - RNA, 13 nt, Human
ugcacuguaaaau

SEQ ID NO: 1341099 - RNA, 14 nt, Human
ugcacuguaaaaug

SEQ ID NO: 1341100 - RNA, 17 nt, Human
ugcacuguaaaaugugg

SEQ ID NO: 1341101 - RNA, 15 nt, Human
ugcacuguaaaaugu

SEQ ID NO: 1341102 - RNA, 20 nt, Human
ugcacuuucuauccucugua

SEQ ID NO: 1341103 - RNA, 12 nt, Human
ugcacuuugcuu

SEQ ID NO: 1341104 - RNA, 16 nt, Human
ugcacuuugcuuuaau

SEQ ID NO: 1341105 - RNA, 17 nt, Human
ugcacuuugcuuuaaua

SEQ ID NO: 1341106 - RNA, 20 nt, Human
ugcacuuugcuuuaauauaa

SEQ ID NO: 1341107 - RNA, 22 nt, Human
ugcacuuugcuuuaauauaaau

SEQ ID NO: 1341108 - RNA, 23 nt, Human
ugcagcacagcugagaggcuguc

SEQ ID NO: 1341109 - RNA, 14 nt, Human
ugcagaggccagag

SEQ ID NO: 1341110 - RNA, 15 nt, Human
ugcagaggccagagg

SEQ ID NO: 1341111 - RNA, 17 nt, Human
ugcagaggccagaggcc

SEQ ID NO: 1341112 - RNA, 21 nt, Human
ugcagagcaggaaacaugacu

SEQ ID NO: 1341113 - RNA, 21 nt, Human
ugcacuuugcuuuaauauaaa

SEQ ID NO: 1341114 - RNA, 15 nt, Human
ugcaguucugaagaa

SEQ ID NO: 1341115 - RNA, 16 nt, Human
ugcaguucugaagaag

SEQ ID NO: 1341116 - RNA, 17 nt, Human
ugcaguucugaagaaga

SEQ ID NO: 1341117 - RNA, 18 nt, Human
ugcaguucugaagaagau

SEQ ID NO: 1341118 - RNA, 22 nt, Human
ugcaguggcgugaucucagcuc

SEQ ID NO: 1341119 - RNA, 22 nt, Human
ugcaguggcgcgaucucagcuc

SEQ ID NO: 1341120 - RNA, 22 nt, Human
ugcaguggcaucaucucagcuc

SEQ ID NO: 1341121 - RNA, 19 nt, Human
ugcaguucugaagaagaug

SEQ ID NO: 1341122 - RNA, 22 nt, Human
ugcaguucugaagaagauggua

SEQ ID NO: 1341123 - RNA, 20 nt, Human
ugcaguucuuuggcugaaag

SEQ ID NO: 1341124 - RNA, 21 nt, Human
ugcaguucuuuggcugaaagg

SEQ ID NO: 1341125 - RNA, 23 nt, Human
ugcauauaagggaaguaguuauc

SEQ ID NO: 1341126 - RNA, 22 nt, Human
ugcauauaagggaaguaguuau

SEQ ID NO: 1341127 - RNA, 21 nt, Human
ugcauauaagggaaguaguua

SEQ ID NO: 1341128 - RNA, 14 nt, Human
ugcaggcaggaaca

SEQ ID NO: 1341129 - RNA, 17 nt, Human
ugcaggcccuggccucc

SEQ ID NO: 1341130 - RNA, 19 nt, Human
ugcaggcccuggccucccc

SEQ ID NO: 1341131 - RNA, 20 nt, Human
ugcaggcaggaacaaacagg

SEQ ID NO: 1341132 - RNA, 19 nt, Human
ugcaggcaggaacaaacag

SEQ ID NO: 1341133 - RNA, 12 nt, Human
ugcaggcccugg

SEQ ID NO: 1341134 - RNA, 15 nt, Human
ugcaggcccuggccu

SEQ ID NO: 1341135 - RNA, 16 nt, Human
ugcaggcccuggccuc

SEQ ID NO: 1341136 - RNA, 20 nt, Human
ugcaggcccuggccuccccu

SEQ ID NO: 1341137 - RNA, 15 nt, Human
ugcuaagcauuccaa

SEQ ID NO: 1341138 - RNA, 19 nt, Human
ugcuaagcauuccaacuau

SEQ ID NO: 1341139 - RNA, 16 nt, Human
ugcuaagagaaguaga

SEQ ID NO: 1341140 - RNA, 13 nt, Human
ugcucaaggccag

SEQ ID NO: 1341141 - RNA, 16 nt, Human
ugcucaaggccagcuu

SEQ ID NO: 1341142 - RNA, 21 nt, Human
ugcucaauaaaugauucuuag

SEQ ID NO: 1341143 - RNA, 17 nt, Human
ugcucagagcaguguuu

SEQ ID NO: 1341144 - RNA, 21 nt, Human
ugcucagggggcgccuguggu

SEQ ID NO: 1341145 - RNA, 13 nt, Human
ugcucagguacuu

SEQ ID NO: 1341146 - RNA, 17 nt, Human
ugcucagguacuuguaa

SEQ ID NO: 1341147 - RNA, 17 nt, Human
ugcucaggugcuggggc

SEQ ID NO: 1341148 - RNA, 17 nt, Human
ugcucaguaauuugagg

SEQ ID NO: 1341149 - RNA, 16 nt, Human
ugcucagcccugagga

SEQ ID NO: 1341150 - RNA, 17 nt, Human
ugcucagcccugaggac

SEQ ID NO: 1341151 - RNA, 19 nt, Human
ugcucagcccugaggacag

SEQ ID NO: 1341152 - RNA, 13 nt, Human
ugcucagcccugc

SEQ ID NO: 1341153 - RNA, 17 nt, Human
ugcucagcucugggcca

SEQ ID NO: 1341154 - RNA, 23 nt, Human
ugcucagggacucaucuuucccu

SEQ ID NO: 1341155 - RNA, 14 nt, Human
ugcucgccccagca

SEQ ID NO: 1341156 - RNA, 16 nt, Human
ugcucgccccagcagg

SEQ ID NO: 1341157 - RNA, 13 nt, Human
ugcucgcccugcg

SEQ ID NO: 1341158 - RNA, 14 nt, Human
ugcucgcccugcgg

SEQ ID NO: 1341159 - RNA, 20 nt, Human
ugcucuaugugcuuguaaaa

SEQ ID NO: 1341160 - RNA, 19 nt, Human
ugcucuccauucugcuccu

SEQ ID NO: 1341161 - RNA, 20 nt, Human
ugcucuccauucugcuccuu

SEQ ID NO: 1341162 - RNA, 21 nt, Human
ugcucuccauucugcuccuuc

SEQ ID NO: 1341163 - RNA, 16 nt, Human
ugcucuccucuugcca

SEQ ID NO: 1341164 - RNA, 18 nt, Human
ugcucuccucuugccacu

SEQ ID NO: 1341165 - RNA, 21 nt, Human
ugcucuccucuugccacugcc

SEQ ID NO: 1341166 - RNA, 22 nt, Human
ugcucuccucuugccacugccu

SEQ ID NO: 1341167 - RNA, 20 nt, Human
ugcugaaacgcaucuaguuc

SEQ ID NO: 1341168 - RNA, 17 nt, Human
ugcugaaauuuuauaug

SEQ ID NO: 1341169 - RNA, 23 nt, Human
ugcugaaggaauaaauugcuccu

SEQ ID NO: 1341170 - RNA, 14 nt, Human
ugcugaacagugga

SEQ ID NO: 1341171 - RNA, 18 nt, Human
ugcugacauucaccugcc

SEQ ID NO: 1341172 - RNA, 17 nt, Human
ugcugauggagccuucc

SEQ ID NO: 1341173 - RNA, 13 nt, Human
ugcugcaaaccug

SEQ ID NO: 1341174 - RNA, 14 nt, Human
ugcugcaaaccuga

SEQ ID NO: 1341175 - RNA, 20 nt, Human
ugcugcaaaccugaccccug

SEQ ID NO: 1341176 - RNA, 19 nt, Human
ugcugcaagcacagcccuu

SEQ ID NO: 1341177 - RNA, 14 nt, Human
ugcugcauggcagg

SEQ ID NO: 1341178 - RNA, 16 nt, Human
ugcugcauggcagggg

SEQ ID NO: 1341179 - RNA, 21 nt, Human
ugcugcauggcagggggcugc

SEQ ID NO: 1341180 - RNA, 22 nt, Human
ugcugcauggcagggggcugcu

SEQ ID NO: 1341181 - RNA, 23 nt, Human
ugcugcauggcagggggcugcug

SEQ ID NO: 1341182 - RNA, 19 nt, Human
ugcugcuaauauuuuccuc

SEQ ID NO: 1341183 - RNA, 15 nt, Human
ugcugcuacuuauau

SEQ ID NO: 1341184 - RNA, 13 nt, Human
ugcugcugggcuc

SEQ ID NO: 1341185 - RNA, 14 nt, Human
ugcugcugggcuca

SEQ ID NO: 1341186 - RNA, 17 nt, Human
ugcugcugggcucagug

SEQ ID NO: 1341187 - RNA, 14 nt, Human
ugcugcuggggaag

SEQ ID NO: 1341188 - RNA, 15 nt, Human
ugcugcuggggaaga

SEQ ID NO: 1341189 - RNA, 19 nt, Human
ugcugcuggggaagacagu

SEQ ID NO: 1341190 - RNA, 20 nt, Human
ugcugcuggggaagacagug

SEQ ID NO: 1341191 - RNA, 21 nt, Human
ugcugcuggggaagacagugg

SEQ ID NO: 1341192 - RNA, 22 nt, Human
ugcugcuggggaagacaguggc

SEQ ID NO: 1341193 - RNA, 24 nt, Human
ugcugcuggggaagacaguggccc

SEQ ID NO: 1341194 - RNA, 13 nt, Human
ugcugcugucccu

SEQ ID NO: 1341195 - RNA, 23 nt, Human
ugcugcuggggaagacaguggcc

SEQ ID NO: 1341196 - RNA, 17 nt, Human
ugcugcugucugggugc

SEQ ID NO: 1341197 - RNA, 14 nt, Human
ugcugcugugugcu

SEQ ID NO: 1341198 - RNA, 18 nt, Human
ugcuggaaaauaauacug

SEQ ID NO: 1341199 - RNA, 22 nt, Human
ugcuggaagacgcaagggccug

SEQ ID NO: 1341200 - RNA, 17 nt, Human
ugcuggaauaaguucaa

SEQ ID NO: 1341201 - RNA, 16 nt, Human
ugcuggaauucuaaca

SEQ ID NO: 1341202 - RNA, 15 nt, Human
ugccuucucaacucc

SEQ ID NO: 1341203 - RNA, 17 nt, Human
ugccuucucaacuccaa

SEQ ID NO: 1341204 - RNA, 17 nt, Human
ugccugugaacugaacu

SEQ ID NO: 1341205 - RNA, 18 nt, Human
ugccugugaacugaacuc

SEQ ID NO: 1341206 - RNA, 21 nt, Human
ugccugugaacugaacucuga

SEQ ID NO: 1341207 - RNA, 21 nt, Human
ugccuucgcuucuugccucug

SEQ ID NO: 1341208 - RNA, 22 nt, Human
ugccuucgcuucuugccucugu

SEQ ID NO: 1341209 - RNA, 23 nt, Human
ugccuucgcuucuugccucugug

SEQ ID NO: 1341210 - RNA, 20 nt, Human
ugccuucgucuuucccaugg

SEQ ID NO: 1341211 - RNA, 16 nt, Human
ugccuucuacuuuuaa

SEQ ID NO: 1341212 - RNA, 20 nt, Human
ugcgagugcucauuucagga

SEQ ID NO: 1341213 - RNA, 16 nt, Human
ugccuugaaaaagaca

SEQ ID NO: 1341214 - RNA, 13 nt, Human
ugcgauagagucu

SEQ ID NO: 1341215 - RNA, 14 nt, Human
ugcgauagagucuc

SEQ ID NO: 1341216 - RNA, 16 nt, Human
ugcgauagagucucac

SEQ ID NO: 1341217 - RNA, 12 nt, Human
ugcuaaagacau

SEQ ID NO: 1341218 - RNA, 17 nt, Human
ugcuaaauaaaauuugu

SEQ ID NO: 1341219 - RNA, 21 nt, Human
ugcuaaauaaaauuuguugca

SEQ ID NO: 1341220 - RNA, 22 nt, Human
ugcuaaauaaaauuuguugcau

SEQ ID NO: 1341221 - RNA, 23 nt, Human
ugcuaaauaaaauuuguugcaua

SEQ ID NO: 1341222 - RNA, 16 nt, Human
ugcuaacaucuaaaaa

SEQ ID NO: 1341223 - RNA, 19 nt, Human
ugcuaagagaaaaaaaaga

SEQ ID NO: 1341224 - RNA, 13 nt, Human
ugcuaagagaagu

SEQ ID NO: 1341225 - RNA, 22 nt, Human
ugcuaagagaaguagaaaucau

SEQ ID NO: 1341226 - RNA, 13 nt, Human
ugcuaacaucuaa

SEQ ID NO: 1341227 - RNA, 22 nt, Human
ugcgugacaauaaaacauuaau

SEQ ID NO: 1341228 - RNA, 14 nt, Human
ugcgugacaauaaa

SEQ ID NO: 1341229 - RNA, 15 nt, Human
ugcgugacaauaaaa

SEQ ID NO: 1341230 - RNA, 17 nt, Human
ugcgugacaauaaaaca

SEQ ID NO: 1341231 - RNA, 9 nt, Human
ugccucucu

SEQ ID NO: 1341232 - RNA, 20 nt, Human
ugccucucgcuccucaaccc

SEQ ID NO: 1341233 - RNA, 15 nt, Human
ugccucuucugggag

SEQ ID NO: 1341234 - RNA, 18 nt, Human
ugccucucaucaacugaa

SEQ ID NO: 1341235 - RNA, 21 nt, Human
ugccucucaucaacugaauga

SEQ ID NO: 1341236 - RNA, 13 nt, Human
ugccucucccagg

SEQ ID NO: 1341237 - RNA, 17 nt, Human
ugccucucccaggcagg

SEQ ID NO: 1341238 - RNA, 16 nt, Human
ugccucucccaggcag

SEQ ID NO: 1341239 - RNA, 16 nt, Human
ugccugacacacuaac

SEQ ID NO: 1341240 - RNA, 21 nt, Human
ugccucuuuuuaaaguucaaa

SEQ ID NO: 1341241 - RNA, 16 nt, Human
ugccucuucugggagg

SEQ ID NO: 1341242 - RNA, 19 nt, Human
ugccucuucugggagggca

SEQ ID NO: 1341243 - RNA, 20 nt, Human
ugccucuucugggagggcag

SEQ ID NO: 1341244 - RNA, 21 nt, Human
ugccucuucugggagggcagc

SEQ ID NO: 1341245 - RNA, 13 nt, Human
ugccccuggcugg

SEQ ID NO: 1341246 - RNA, 14 nt, Human
ugccccuuccgcca

SEQ ID NO: 1341247 - RNA, 17 nt, Human
ugccccuuccgccacug

SEQ ID NO: 1341248 - RNA, 18 nt, Human
ugccccuuccgccacugg

SEQ ID NO: 1341249 - RNA, 19 nt, Human
ugccccuuccgccacuggg

SEQ ID NO: 1341250 - RNA, 23 nt, Human
ugccccuuccgccacuggggcuc

SEQ ID NO: 1341251 - RNA, 20 nt, Human
ugccccuuccgccacugggg

SEQ ID NO: 1341252 - RNA, 21 nt, Human
ugccccuuccgccacuggggc

SEQ ID NO: 1341253 - RNA, 23 nt, Human
ugccucgaaacacagaaaccuuu

SEQ ID NO: 1341254 - RNA, 20 nt, Human
ugccccuugacaacuggcag

SEQ ID NO: 1341255 - RNA, 18 nt, Human
ugccuguaaucacagcua

SEQ ID NO: 1341256 - RNA, 14 nt, Human
ugccugugaacuga

SEQ ID NO: 1341257 - RNA, 20 nt, Human
ugccuguagccccagugaca

SEQ ID NO: 1341258 - RNA, 22 nt, Human
ugccuguagccccagugacagc

SEQ ID NO: 1341259 - RNA, 21 nt, Human
ugccuguagccccagugacag

SEQ ID NO: 1341260 - RNA, 18 nt, Human
ugccugacauuuggagug

SEQ ID NO: 1341261 - RNA, 23 nt, Human
ugccugacccuacuucuuuugcu

SEQ ID NO: 1341262 - RNA, 21 nt, Human
ugccugacuagggagccaugu

SEQ ID NO: 1341263 - RNA, 20 nt, Human
ugaagagguuuuaaagcuuc

SEQ ID NO: 1341264 - RNA, 21 nt, Human
ugaagagguuuuaaagcuucc

SEQ ID NO: 1341265 - RNA, 23 nt, Human
ugaagaguaagucaaccugccug

SEQ ID NO: 1341266 - RNA, 23 nt, Human
ugaagaguaaucaaucuacucaa

SEQ ID NO: 1341267 - RNA, 16 nt, Human
ugaagacuaugaaaau

SEQ ID NO: 1341268 - RNA, 17 nt, Human
ugaagacuaugaaaaug

SEQ ID NO: 1341269 - RNA, 15 nt, Human
ugaagacuggaagcu

SEQ ID NO: 1341270 - RNA, 17 nt, Human
ugaagacuggaagcuaa

SEQ ID NO: 1341271 - RNA, 15 nt, Human
ugaagagauuuuuca

SEQ ID NO: 1341272 - RNA, 16 nt, Human
ugaagagauuuuucau

SEQ ID NO: 1341273 - RNA, 17 nt, Human
ugaagagccacugccau

SEQ ID NO: 1341274 - RNA, 21 nt, Human
ugaagcuuuuaugugaaacau

SEQ ID NO: 1341275 - RNA, 23 nt, Human
ugaagaguguuauuuucauucaa

SEQ ID NO: 1341276 - RNA, 12 nt, Human
ugaaggccugag

SEQ ID NO: 1341277 - RNA, 14 nt, Human
ugaaggccugaggu

SEQ ID NO: 1341278 - RNA, 13 nt, Human
ugaaacauguuuc

SEQ ID NO: 1341279 - RNA, 16 nt, Human
ugaaacacuuugcaua

SEQ ID NO: 1341280 - RNA, 12 nt, Human
ugaaacagaaaa

SEQ ID NO: 1341281 - RNA, 15 nt, Human
ugaaacagaaaaaua

SEQ ID NO: 1341282 - RNA, 13 nt, Human
ugaaacagaaaca

SEQ ID NO: 1341283 - RNA, 14 nt, Human
ugaaacagaaacaa

SEQ ID NO: 1341284 - RNA, 16 nt, Human
ugaaacagaaacaaaa

SEQ ID NO: 1341285 - RNA, 23 nt, Human
ugaaacagaaaaauauguaccaa

SEQ ID NO: 1341286 - RNA, 16 nt, Human
ugaacuugaggacaca

SEQ ID NO: 1341287 - RNA, 21 nt, Human
ugaacuugaaauauccugcuu

SEQ ID NO: 1341288 - RNA, 17 nt, Human
ugaacuuagauuuuaca

SEQ ID NO: 1341289 - RNA, 18 nt, Human
ugaacuuagauuuuacau

SEQ ID NO: 1341290 - RNA, 19 nt, Human
ugaacuuagauuuuacaug

SEQ ID NO: 1341291 - RNA, 20 nt, Human
ugaacuuagauuuuacauga

SEQ ID NO: 1341292 - RNA, 21 nt, Human
ugaacuuagauuuuacaugaa

SEQ ID NO: 1341293 - RNA, 20 nt, Human
ugaacuugaggacacauguc

SEQ ID NO: 1341294 - RNA, 19 nt, Human
ugaacuugaggacacaugu

SEQ ID NO: 1341295 - RNA, 18 nt, Human
ugaacuugaggacacaug

SEQ ID NO: 1341296 - RNA, 17 nt, Human
ugaacuugaggacacau

SEQ ID NO: 1341297 - RNA, 22 nt, Human
ugaacuugaggacacaugucca

SEQ ID NO: 1341298 - RNA, 21 nt, Human
ugaacuugaggacacaugucc

SEQ ID NO: 1341299 - RNA, 23 nt, Human
ugaagaccuuuuucugcacuaua

SEQ ID NO: 1341300 - RNA, 22 nt, Human
ugaagaccuuuuucugcacuau

SEQ ID NO: 1341301 - RNA, 21 nt, Human
ugaagaccuuuuucugcacua

SEQ ID NO: 1341302 - RNA, 19 nt, Human
ugaagaccuuuuucugcac

SEQ ID NO: 1341303 - RNA, 14 nt, Human
ugaaggcuguacac

SEQ ID NO: 1341304 - RNA, 13 nt, Human
ugaaggcuucucu

SEQ ID NO: 1341305 - RNA, 15 nt, Human
ugaaggcuucucucu

SEQ ID NO: 1341306 - RNA, 16 nt, Human
ugaaggcuucucucug

SEQ ID NO: 1341307 - RNA, 19 nt, Human
ugaaggcuucucucugugg

SEQ ID NO: 1341308 - RNA, 15 nt, Human
ugaaguuugaaugcu

SEQ ID NO: 1341309 - RNA, 14 nt, Human
ugaaguuuuacauu

SEQ ID NO: 1341310 - RNA, 15 nt, Human
ugaaguuuuacauug

SEQ ID NO: 1341311 - RNA, 16 nt, Human
ugaaguuuuacauugu

SEQ ID NO: 1341312 - RNA, 17 nt, Human
ugaaguuuuacauuguu

SEQ ID NO: 1341313 - RNA, 14 nt, Human
ugaaucacaugaau

SEQ ID NO: 1341314 - RNA, 14 nt, Human
ugaauccucucucu

SEQ ID NO: 1341315 - RNA, 16 nt, Human
ugaauccucucucugu

SEQ ID NO: 1341316 - RNA, 21 nt, Human
ugaauccucucucuguguuac

SEQ ID NO: 1341317 - RNA, 20 nt, Human
ugaaugaauggcuaagcaaa

SEQ ID NO: 1341318 - RNA, 15 nt, Human
ugaaugaauggcuaa

SEQ ID NO: 1341319 - RNA, 16 nt, Human
ugaaugauucaguguu

SEQ ID NO: 1341320 - RNA, 24 nt, Human
ugaaugaagcaaaugucaugcugc

SEQ ID NO: 1341321 - RNA, 15 nt, Human
ugaaugauuuuucuu

SEQ ID NO: 1341322 - RNA, 16 nt, Human
ugaaugauuuuucuuu

SEQ ID NO: 1341323 - RNA, 19 nt, Human
ugaaugauuuuucuuuaca

SEQ ID NO: 1341324 - RNA, 20 nt, Human
ugaaugauuuuucuuuacaa

SEQ ID NO: 1341325 - RNA, 15 nt, Human
ugaaugcaaaccaua

SEQ ID NO: 1341326 - RNA, 19 nt, Human
ugaaugcaaaccauagcac

SEQ ID NO: 1341327 - RNA, 14 nt, Human
ugaaugcauaaaau

SEQ ID NO: 1341328 - RNA, 19 nt, Human
ugaauguuuacacucuuug

SEQ ID NO: 1341329 - RNA, 22 nt, Human
ugaauguuuacacucuuuguaa

SEQ ID NO: 1341330 - RNA, 13 nt, Human
ugaauguuuuucu

SEQ ID NO: 1341331 - RNA, 15 nt, Human
ugaauguuuuucuaa

SEQ ID NO: 1341332 - RNA, 16 nt, Human
ugaauguuuuucuaaa

SEQ ID NO: 1341333 - RNA, 17 nt, Human
ugaauguuuuucuaaag

SEQ ID NO: 1341334 - RNA, 18 nt, Human
ugaauguuuuucuaaagg

SEQ ID NO: 1341335 - RNA, 20 nt, Human
ugaauguuuuucuaaaggag

SEQ ID NO: 1341336 - RNA, 16 nt, Human
ugaaucuuggugucua

SEQ ID NO: 1341337 - RNA, 12 nt, Human
ugaaugaacacu

SEQ ID NO: 1341338 - RNA, 15 nt, Human
ugaaugaacacucuu

SEQ ID NO: 1341339 - RNA, 11 nt, Human
ugaaugaagca

SEQ ID NO: 1341340 - RNA, 22 nt, Human
ugaaugaagcaaaugucaugcu

SEQ ID NO: 1341341 - RNA, 16 nt, Human
ugaauuuaaauagcuu

SEQ ID NO: 1341342 - RNA, 15 nt, Human
ugacaacagacuucu

SEQ ID NO: 1341343 - RNA, 18 nt, Human
ugacaacagacuucugaa

SEQ ID NO: 1341344 - RNA, 19 nt, Human
ugacaacagacuucugaaa

SEQ ID NO: 1341345 - RNA, 23 nt, Human
ugacaacauuucuauagccaaaa

SEQ ID NO: 1341346 - RNA, 16 nt, Human
ugacaacauuucuaua

SEQ ID NO: 1341347 - RNA, 14 nt, Human
ugaauuaaguuuuu

SEQ ID NO: 1341348 - RNA, 17 nt, Human
ugaauuaaauaaacccu

SEQ ID NO: 1341349 - RNA, 18 nt, Human
ugaauuaagcccaauuaa

SEQ ID NO: 1341350 - RNA, 13 nt, Human
ugaauuacauuug

SEQ ID NO: 1341351 - RNA, 16 nt, Human
ugaauuaauaucccua

SEQ ID NO: 1341352 - RNA, 19 nt, Human
ugaauuaauaucccuacau

SEQ ID NO: 1341353 - RNA, 22 nt, Human
ugaauuaauaucccuacaugua

SEQ ID NO: 1341354 - RNA, 23 nt, Human
ugaauuaauaucccuacauguau

SEQ ID NO: 1341355 - RNA, 14 nt, Human
ugaauuacauuugu

SEQ ID NO: 1341356 - RNA, 19 nt, Human
ugaauuguaacuguucuug

SEQ ID NO: 1341357 - RNA, 12 nt, Human
ugacaauaaaac

SEQ ID NO: 1341358 - RNA, 13 nt, Human
ugacaauaaaaca

SEQ ID NO: 1341359 - RNA, 14 nt, Human
ugacaauaaaacau

SEQ ID NO: 1341360 - RNA, 16 nt, Human
ugacaauaaaacauua

SEQ ID NO: 1341361 - RNA, 16 nt, Human
ugacaaccacuggucu

SEQ ID NO: 1341362 - RNA, 19 nt, Human
ugacaaccaugagaccacu

SEQ ID NO: 1341363 - RNA, 17 nt, Human
ugacaaccacuggucug

SEQ ID NO: 1341364 - RNA, 21 nt, Human
ugacaacguuucagcgacucc

SEQ ID NO: 1341365 - RNA, 13 nt, Human
ugacaacuggcag

SEQ ID NO: 1341366 - RNA, 14 nt, Human
ugacaacuggcagg

SEQ ID NO: 1341367 - RNA, 15 nt, Human
ugacaacuggcaggc

SEQ ID NO: 1341368 - RNA, 18 nt, Human
ugacaacuggcaggcagg

SEQ ID NO: 1341369 - RNA, 17 nt, Human
ugacaacuggcaggcag

SEQ ID NO: 1341370 - RNA, 16 nt, Human
ugacaugggacauuug

SEQ ID NO: 1341371 - RNA, 19 nt, Human
ugacauguguuggcagccu

SEQ ID NO: 1341372 - RNA, 19 nt, Human
ugacauguggggccagguc

SEQ ID NO: 1341373 - RNA, 20 nt, Human
ugacauguggggccagguca

SEQ ID NO: 1341374 - RNA, 17 nt, Human
ugacauguggggccagg

SEQ ID NO: 1341375 - RNA, 18 nt, Human
ugacauguggggccaggu

SEQ ID NO: 1341376 - RNA, 15 nt, Human
ugacaugaagcuguu

SEQ ID NO: 1341377 - RNA, 17 nt, Human
ugacaugaauuuuagcu

SEQ ID NO: 1341378 - RNA, 21 nt, Human
ugacaugaauuuuagcuuuug

SEQ ID NO: 1341379 - RNA, 22 nt, Human
ugacaugaauuuuagcuuuugu

SEQ ID NO: 1341380 - RNA, 17 nt, Human
ugacaugcaucaucuca

SEQ ID NO: 1341381 - RNA, 18 nt, Human
ugaccacugcagaagaca

SEQ ID NO: 1341382 - RNA, 17 nt, Human
ugaccacugcagaagac

SEQ ID NO: 1341383 - RNA, 16 nt, Human
ugaccacugcagaaga

SEQ ID NO: 1341384 - RNA, 21 nt, Human
ugaccagccuccaugcugccu

SEQ ID NO: 1341385 - RNA, 22 nt, Human
ugaccagccuccaugcugccuc

SEQ ID NO: 1341386 - RNA, 23 nt, Human
ugaccagccuccaugcugccucc

SEQ ID NO: 1341387 - RNA, 15 nt, Human
ugacauauuuuugcu

SEQ ID NO: 1341388 - RNA, 17 nt, Human
ugacaucaccacaguuu

SEQ ID NO: 1341389 - RNA, 14 nt, Human
ugacaucaaaaaag

SEQ ID NO: 1341390 - RNA, 13 nt, Human
ugacaucacuugu

SEQ ID NO: 1341391 - RNA, 16 nt, Human
ugacaucacuuguaca

SEQ ID NO: 1341392 - RNA, 17 nt, Human
ugacaucacuuguacaa

SEQ ID NO: 1341393 - RNA, 18 nt, Human
ugacaucacuuguacaaa

SEQ ID NO: 1341394 - RNA, 19 nt, Human
ugacaucacuuguacaaaa

SEQ ID NO: 1341395 - RNA, 20 nt, Human
ugacaucacuuguacaaaau

SEQ ID NO: 1341396 - RNA, 21 nt, Human
ugacaucacuuguacaaaaua

SEQ ID NO: 1341397 - RNA, 22 nt, Human
ugacaucacuuguacaaaauaa

SEQ ID NO: 1341398 - RNA, 23 nt, Human
ugacaucacuuguacaaaauaaa

SEQ ID NO: 1341399 - RNA, 18 nt, Human
ugacaucagguuuuuccc

SEQ ID NO: 1341400 - RNA, 21 nt, Human
ugacaucggaaaaauaaucaa

SEQ ID NO: 1341401 - RNA, 19 nt, Human
ugacaucggaaaaauaauc

SEQ ID NO: 1341402 - RNA, 16 nt, Human
ugacuuuggcugcaug

SEQ ID NO: 1341403 - RNA, 15 nt, Human
ugacuuugcuugcuu

SEQ ID NO: 1341404 - RNA, 16 nt, Human
ugacuuugcuugcuuu

SEQ ID NO: 1341405 - RNA, 22 nt, Human
ugacuuuccccaccagaugcug

SEQ ID NO: 1341406 - RNA, 23 nt, Human
ugacuuuccccaccagaugcuga

SEQ ID NO: 1341407 - RNA, 13 nt, Human
ugacuuucuuuuu

SEQ ID NO: 1341408 - RNA, 13 nt, Human
ugacuuugcuugc

SEQ ID NO: 1341409 - RNA, 15 nt, Human
ugacuggcuaaagcu

SEQ ID NO: 1341410 - RNA, 16 nt, Human
ugacugggaccaggca

SEQ ID NO: 1341411 - RNA, 17 nt, Human
ugacuggcuucagcaag

SEQ ID NO: 1341412 - RNA, 12 nt, Human
ugacuuucccca

SEQ ID NO: 1341413 - RNA, 21 nt, Human
ugacuuuccccaccagaugcu

SEQ ID NO: 1341414 - RNA, 14 nt, Human
ugacucuuuccaac

SEQ ID NO: 1341415 - RNA, 16 nt, Human
ugacucuuuccaaccg

SEQ ID NO: 1341416 - RNA, 13 nt, Human
ugacucuuuccaa

SEQ ID NO: 1341417 - RNA, 19 nt, Human
ugacucuuuccaaccggcu

SEQ ID NO: 1341418 - RNA, 14 nt, Human
ugacugcuugcccu

SEQ ID NO: 1341419 - RNA, 16 nt, Human
ugacugcuugcccuaa

SEQ ID NO: 1341420 - RNA, 14 nt, Human
ugacucuuaagaag

SEQ ID NO: 1341421 - RNA, 15 nt, Human
ugacucuuaagaaga

SEQ ID NO: 1341422 - RNA, 16 nt, Human
ugacucuuaagaagac

SEQ ID NO: 1341423 - RNA, 18 nt, Human
ugacuacagucaggaaag

SEQ ID NO: 1341424 - RNA, 15 nt, Human
ugacuaauggcauga

SEQ ID NO: 1341425 - RNA, 16 nt, Human
ugacuacagucaggaa

SEQ ID NO: 1341426 - RNA, 17 nt, Human
ugacuacagucaggaaa

SEQ ID NO: 1341427 - RNA, 12 nt, Human
ugaccaugcuca

SEQ ID NO: 1341428 - RNA, 16 nt, Human
ugaccaugcucaucug

SEQ ID NO: 1341429 - RNA, 18 nt, Human
ugaccaugcucaucugcu

SEQ ID NO: 1341430 - RNA, 19 nt, Human
ugaccaugcucaucugcug

SEQ ID NO: 1341431 - RNA, 17 nt, Human
ugaccagccgugagcau

SEQ ID NO: 1341432 - RNA, 19 nt, Human
ugacuaaaccauugugcau

SEQ ID NO: 1341433 - RNA, 15 nt, Human
ugacuaaaccauugu

SEQ ID NO: 1341434 - RNA, 14 nt, Human
ugacuaaaauauuu

SEQ ID NO: 1341435 - RNA, 12 nt, Human
ugacuaaacuuu

SEQ ID NO: 1341436 - RNA, 18 nt, Human
ugacuaaacuuuuuuucu

SEQ ID NO: 1341437 - RNA, 19 nt, Human
ugacuaaacuuuuuuucug

SEQ ID NO: 1341438 - RNA, 21 nt, Human
ugacuaaacuuuuuuucugua

SEQ ID NO: 1341439 - RNA, 17 nt, Human
ugacuaacaggccaaag

SEQ ID NO: 1341440 - RNA, 21 nt, Human
ugacuaacaggccaaagaguc

SEQ ID NO: 1341441 - RNA, 20 nt, Human
ugacuaacuagacaccaaag

SEQ ID NO: 1341442 - RNA, 23 nt, Human
ugacuaacuagacaccaaaguuc

SEQ ID NO: 1341443 - RNA, 14 nt, Human
ugacuaauggcaug

SEQ ID NO: 1341444 - RNA, 16 nt, Human
ugacuaauggcaugag

SEQ ID NO: 1341445 - RNA, 18 nt, Human
ugagaaaaauauauacua

SEQ ID NO: 1341446 - RNA, 17 nt, Human
ugacuuuuugcauuuaa

SEQ ID NO: 1341447 - RNA, 23 nt, Human
ugacuuuuugcauuuaaaacaga

SEQ ID NO: 1341448 - RNA, 12 nt, Human
ugagaaaacaug

SEQ ID NO: 1341449 - RNA, 19 nt, Human
ugagaaaagcuuugaaccc

SEQ ID NO: 1341450 - RNA, 20 nt, Human
ugagaaacaacaauuucuac

SEQ ID NO: 1341451 - RNA, 17 nt, Human
ugacuuugcuugcuuug

SEQ ID NO: 1341452 - RNA, 13 nt, Human
ugacuuuucugua

SEQ ID NO: 1341453 - RNA, 19 nt, Human
ugacuuuucuguaauucag

SEQ ID NO: 1341454 - RNA, 22 nt, Human
ugacuuuucuguaauucagguu

SEQ ID NO: 1341455 - RNA, 14 nt, Human
ugacuuuugugaaa

SEQ ID NO: 1341456 - RNA, 14 nt, Human
ugacuuuuugcauu

SEQ ID NO: 1341457 - RNA, 12 nt, Human
ugagacauccag

SEQ ID NO: 1341458 - RNA, 10 nt, Human
ugagacaucc

SEQ ID NO: 1341459 - RNA, 13 nt, Human
ugagaaaucuaaa

SEQ ID NO: 1341460 - RNA, 21 nt, Human
ugagaaauauggacacuuaau

SEQ ID NO: 1341461 - RNA, 22 nt, Human
ugagaaauagcuuaugaaaaga

SEQ ID NO: 1341462 - RNA, 21 nt, Human
ugagaaagucagauucuugca

SEQ ID NO: 1341463 - RNA, 20 nt, Human
ugagaaagucagauucuugc

SEQ ID NO: 1341464 - RNA, 21 nt, Human
ugagaaagucuuauuuauuca

SEQ ID NO: 1341465 - RNA, 15 nt, Human
ugagaaauauggaca

SEQ ID NO: 1341466 - RNA, 17 nt, Human
ugagaaauauggacacu

SEQ ID NO: 1341467 - RNA, 19 nt, Human
ugagaaacuuaaauguuau

SEQ ID NO: 1341468 - RNA, 14 nt, Human
ugagaaagccuucu

SEQ ID NO: 1341469 - RNA, 16 nt, Human
ugagaaagccuucuuu

SEQ ID NO: 1341470 - RNA, 19 nt, Human
ugagaaaggguagaauucu

SEQ ID NO: 1341471 - RNA, 18 nt, Human
ugagaaacuuaaauguua

SEQ ID NO: 1341472 - RNA, 13 nt, Human
ugagacauccagc

SEQ ID NO: 1341473 - RNA, 12 nt, Human
ugagaccugccc

SEQ ID NO: 1341474 - RNA, 13 nt, Human
ugagaccugcccc

SEQ ID NO: 1341475 - RNA, 14 nt, Human
ugagaccugccccu

SEQ ID NO: 1341476 - RNA, 15 nt, Human
ugagaccugccccuc

SEQ ID NO: 1341477 - RNA, 22 nt, Human
ugagaccugccccuccucucug

SEQ ID NO: 1341478 - RNA, 19 nt, Human
ugagaccuuccuuuuacuu

SEQ ID NO: 1341479 - RNA, 19 nt, Human
ugagaggcugucuguugua

SEQ ID NO: 1341480 - RNA, 20 nt, Human
ugagcagggccggggaacug

SEQ ID NO: 1341481 - RNA, 14 nt, Human
ugagcagggccggg

SEQ ID NO: 1341482 - RNA, 16 nt, Human
ugagcagggccgggga

SEQ ID NO: 1341483 - RNA, 22 nt, Human
ugagcaggccacacuucaaacu

SEQ ID NO: 1341484 - RNA, 12 nt, Human
ugagcagggccg

SEQ ID NO: 1341485 - RNA, 16 nt, Human
ugagauaguuuucauc

SEQ ID NO: 1341486 - RNA, 17 nt, Human
ugagcagcgagccugcu

SEQ ID NO: 1341487 - RNA, 22 nt, Human
ugagagggcucgaggggugggc

SEQ ID NO: 1341488 - RNA, 22 nt, Human
ugagauaaugugauauuauaca

SEQ ID NO: 1341489 - RNA, 14 nt, Human
ugagauacauacag

SEQ ID NO: 1341490 - RNA, 15 nt, Human
ugagauacauacaga

SEQ ID NO: 1341491 - RNA, 21 nt, Human
ugagauaccagcgaggaggcu

SEQ ID NO: 1341492 - RNA, 20 nt, Human
ugagauaccagcgaggaggc

SEQ ID NO: 1341493 - RNA, 21 nt, Human
ugagauacauacagaauuacu

SEQ ID NO: 1341494 - RNA, 15 nt, Human
ugagauaguuuucau

SEQ ID NO: 1341495 - RNA, 15 nt, Human
ugaggcacuggcgag

SEQ ID NO: 1341496 - RNA, 12 nt, Human
ugaggcaaaaga

SEQ ID NO: 1341497 - RNA, 17 nt, Human
ugaggcacaugucagca

SEQ ID NO: 1341498 - RNA, 20 nt, Human
ugaggcacaugucagcaagu

SEQ ID NO: 1341499 - RNA, 21 nt, Human
ugaggcagcagugugaggcca

SEQ ID NO: 1341500 - RNA, 11 nt, Human
ugaggccugga

SEQ ID NO: 1341501 - RNA, 12 nt, Human
ugaggccuggac

SEQ ID NO: 1341502 - RNA, 14 nt, Human
ugaggccuggacuu

SEQ ID NO: 1341503 - RNA, 17 nt, Human
ugaggccuggacuuucc

SEQ ID NO: 1341504 - RNA, 19 nt, Human
ugaggccuggacuuuccug

SEQ ID NO: 1341505 - RNA, 20 nt, Human
ugaggccuggacuuuccugc

SEQ ID NO: 1341506 - RNA, 23 nt, Human
ugaggccuggacuuuccugcaac

SEQ ID NO: 1341507 - RNA, 23 nt, Human
ugaggcgccccaacccguggagg

SEQ ID NO: 1341508 - RNA, 12 nt, Human
ugaggccugggc

SEQ ID NO: 1341509 - RNA, 13 nt, Human
ugaggccugggcc

SEQ ID NO: 1341510 - RNA, 22 nt, Human
ugaggccugggccgcugccacg

SEQ ID NO: 1341511 - RNA, 20 nt, Human
ugaggcgagaagggcugcuu

SEQ ID NO: 1341512 - RNA, 21 nt, Human
ugaggcgagaagggcugcuuc

SEQ ID NO: 1341513 - RNA, 16 nt, Human
ugaggugccuguccca

SEQ ID NO: 1341514 - RNA, 16 nt, Human
ugaggugcacugggag

SEQ ID NO: 1341515 - RNA, 12 nt, Human
ugaggugcccag

SEQ ID NO: 1341516 - RNA, 13 nt, Human
ugaggugcccagg

SEQ ID NO: 1341517 - RNA, 14 nt, Human
ugaggugcccagga

SEQ ID NO: 1341518 - RNA, 15 nt, Human
ugaggugcccaggag

SEQ ID NO: 1341519 - RNA, 16 nt, Human
ugaggugcccaggaga

SEQ ID NO: 1341520 - RNA, 17 nt, Human
ugaggugcccaggagaa

SEQ ID NO: 1341521 - RNA, 18 nt, Human
ugaggugcccaggagaag

SEQ ID NO: 1341522 - RNA, 14 nt, Human
ugaggugccugucc

SEQ ID NO: 1341523 - RNA, 15 nt, Human
ugaggugccuguccc

SEQ ID NO: 1341524 - RNA, 20 nt, Human
ugagucccaggcugagccuc

SEQ ID NO: 1341525 - RNA, 21 nt, Human
ugagucccaggcugagccuca

SEQ ID NO: 1341526 - RNA, 20 nt, Human
ugaguccccauugaggcuug

SEQ ID NO: 1341527 - RNA, 22 nt, Human
ugaguccccauugaggcuuggu

SEQ ID NO: 1341528 - RNA, 15 nt, Human
ugagguguccaacug

SEQ ID NO: 1341529 - RNA, 12 nt, Human
ugaggcuguccu

SEQ ID NO: 1341530 - RNA, 13 nt, Human
ugaggcuguccug

SEQ ID NO: 1341531 - RNA, 14 nt, Human
ugaggcuguccugu

SEQ ID NO: 1341532 - RNA, 22 nt, Human
ugaggucagcacaucucaacag

SEQ ID NO: 1341533 - RNA, 15 nt, Human
ugaggugcacuggga

SEQ ID NO: 1341534 - RNA, 19 nt, Human
ugaggugcacugggaggcu

SEQ ID NO: 1341535 - RNA, 17 nt, Human
ugaggaucagaguaauc

SEQ ID NO: 1341536 - RNA, 13 nt, Human
ugaggaucagagu

SEQ ID NO: 1341537 - RNA, 19 nt, Human
ugaggaucagaguaaucca

SEQ ID NO: 1341538 - RNA, 20 nt, Human
ugaggauacgacaguacacu

SEQ ID NO: 1341539 - RNA, 22 nt, Human
ugaggauguaaagaucaauaaa

SEQ ID NO: 1341540 - RNA, 14 nt, Human
ugaggcaaaagaag

SEQ ID NO: 1341541 - RNA, 23 nt, Human
ugagcuuaagaauuuugagcagg

SEQ ID NO: 1341542 - RNA, 21 nt, Human
ugagcuuaaaauacaagacug

SEQ ID NO: 1341543 - RNA, 22 nt, Human
ugagcuuaaaauacaagacugc

SEQ ID NO: 1341544 - RNA, 16 nt, Human
ugagcuuaaaauacaa

SEQ ID NO: 1341545 - RNA, 17 nt, Human
ugagcuuaaaauacaag

SEQ ID NO: 1341546 - RNA, 19 nt, Human
ugagcuuaaaauacaagac

SEQ ID NO: 1341547 - RNA, 20 nt, Human
ugagcuuaaaauacaagacu

SEQ ID NO: 1341548 - RNA, 13 nt, Human
ugaggagucugag

SEQ ID NO: 1341549 - RNA, 14 nt, Human
ugaggagucugagg

SEQ ID NO: 1341550 - RNA, 15 nt, Human
ugaggagucugaggu

SEQ ID NO: 1341551 - RNA, 16 nt, Human
ugaggagucugagguc

SEQ ID NO: 1341552 - RNA, 17 nt, Human
ugaggagucugaggucc

SEQ ID NO: 1341553 - RNA, 22 nt, Human
ugaggagucugagguccugagc

SEQ ID NO: 1341554 - RNA, 21 nt, Human
ugaggagucugagguccugag

SEQ ID NO: 1341555 - RNA, 15 nt, Human
ugagcagucaggaaa

SEQ ID NO: 1341556 - RNA, 16 nt, Human
ugagcuauugcuguuc

SEQ ID NO: 1341557 - RNA, 15 nt, Human
ugagcuauuucaucu

SEQ ID NO: 1341558 - RNA, 17 nt, Human
ugagcucacaaggcagc

SEQ ID NO: 1341559 - RNA, 18 nt, Human
ugagcucacaaggcagca

SEQ ID NO: 1341560 - RNA, 19 nt, Human
ugagcucacaaggcagcaa

SEQ ID NO: 1341561 - RNA, 11 nt, Human
ugagcucagcc

SEQ ID NO: 1341562 - RNA, 12 nt, Human
ugagcucagccc

SEQ ID NO: 1341563 - RNA, 20 nt, Human
ugagcucacaaggcagcaag

SEQ ID NO: 1341564 - RNA, 22 nt, Human
ugagcucacaaggcagcaaggc

SEQ ID NO: 1341565 - RNA, 23 nt, Human
ugagcucagaaaauaucccuccu

SEQ ID NO: 1341566 - RNA, 23 nt, Human
ugagcucacaaggcagcaaggcc

SEQ ID NO: 1341567 - RNA, 20 nt, Human
ugagcucagcccuggugggc

SEQ ID NO: 1341568 - RNA, 14 nt, Human
ugagcucagcgugg

SEQ ID NO: 1341569 - RNA, 18 nt, Human
ugagcugaaggugaaaca

SEQ ID NO: 1341570 - RNA, 15 nt, Human
ugagcugaccagccg

SEQ ID NO: 1341571 - RNA, 24 nt, Human
ugagcugaccagccgugagcaugu

SEQ ID NO: 1341572 - RNA, 14 nt, Human
ugagcugagcaggc

SEQ ID NO: 1341573 - RNA, 14 nt, Human
ugagcugaggcagc

SEQ ID NO: 1341574 - RNA, 14 nt, Human
ucuuauaauuuaaa

SEQ ID NO: 1341575 - RNA, 13 nt, Human
ucuuauaauuuaa

SEQ ID NO: 1341576 - RNA, 20 nt, Human
ucuuagcuaucauugcuucc

SEQ ID NO: 1341577 - RNA, 21 nt, Human
ucuuagcuaucauugcuuccu

SEQ ID NO: 1341578 - RNA, 15 nt, Human
ucuuagcucaaugag

SEQ ID NO: 1341579 - RNA, 16 nt, Human
ucuuagcucaaugagc

SEQ ID NO: 1341580 - RNA, 18 nt, Human
ucuuagcucaaugagcau

SEQ ID NO: 1341581 - RNA, 19 nt, Human
ucuuagcucaaugagcaug

SEQ ID NO: 1341582 - RNA, 21 nt, Human
ucuuagcucaaugagcauguu

SEQ ID NO: 1341583 - RNA, 16 nt, Human
ucugugugaaacuuuc

SEQ ID NO: 1341584 - RNA, 21 nt, Human
ucugugugaaacuuucauucc

SEQ ID NO: 1341585 - RNA, 19 nt, Human
ucugugugaaacuuucauu

SEQ ID NO: 1341586 - RNA, 14 nt, Human
ucugugugcacaaa

SEQ ID NO: 1341587 - RNA, 21 nt, Human
ucugugugcacaaauauuuau

SEQ ID NO: 1341588 - RNA, 12 nt, Human
ucuuagauucuc

SEQ ID NO: 1341589 - RNA, 21 nt, Human
ucuuagauucucugugucuaa

SEQ ID NO: 1341590 - RNA, 16 nt, Human
ucuuagcagcuuccag

SEQ ID NO: 1341591 - RNA, 22 nt, Human
ucuuagcucaaugagcauguuu

SEQ ID NO: 1341592 - RNA, 17 nt, Human
ucuuagucuagguccuu

SEQ ID NO: 1341593 - RNA, 16 nt, Human
ucuuauccuccaccgu

SEQ ID NO: 1341594 - RNA, 14 nt, Human
ucuuaugcaauuuc

SEQ ID NO: 1341595 - RNA, 14 nt, Human
ucuucagaggcccu

SEQ ID NO: 1341596 - RNA, 15 nt, Human
ucuucagaggcccuc

SEQ ID NO: 1341597 - RNA, 19 nt, Human
ucuucaguuaagccuuugg

SEQ ID NO: 1341598 - RNA, 20 nt, Human
ucuucaguuaagccuuugga

SEQ ID NO: 1341599 - RNA, 22 nt, Human
ucuucaguuaagccuuuggaaa

SEQ ID NO: 1341600 - RNA, 15 nt, Human
ucuucaguugucucu

SEQ ID NO: 1341601 - RNA, 21 nt, Human
ucuucaguugucucugaugca

SEQ ID NO: 1341602 - RNA, 16 nt, Human
ucuucaguugucucug

SEQ ID NO: 1341603 - RNA, 17 nt, Human
ucuucaguugucucuga

SEQ ID NO: 1341604 - RNA, 16 nt, Human
ucuucauggugacacu

SEQ ID NO: 1341605 - RNA, 16 nt, Human
ucuucauguuucagga

SEQ ID NO: 1341606 - RNA, 17 nt, Human
ucuucauggugacacuc

SEQ ID NO: 1341607 - RNA, 20 nt, Human
ucuucauaacaauuuuagga

SEQ ID NO: 1341608 - RNA, 19 nt, Human
ucuugccaaauauaaauaa

SEQ ID NO: 1341609 - RNA, 23 nt, Human
ucuugcauggcaaggacugcagg

SEQ ID NO: 1341610 - RNA, 12 nt, Human
ucuugcauguaa

SEQ ID NO: 1341611 - RNA, 15 nt, Human
ucuugcauuaugcaa

SEQ ID NO: 1341612 - RNA, 17 nt, Human
ucuugcauuaugcaauu

SEQ ID NO: 1341613 - RNA, 17 nt, Human
ucuugcccgcucaggcu

SEQ ID NO: 1341614 - RNA, 16 nt, Human
ucuugccacugccucu

SEQ ID NO: 1341615 - RNA, 17 nt, Human
ucuugccacugccucuu

SEQ ID NO: 1341616 - RNA, 16 nt, Human
ucuuguaauuuggauc

SEQ ID NO: 1341617 - RNA, 13 nt, Human
ucuuguaauuuua

SEQ ID NO: 1341618 - RNA, 11 nt, Human
ucuuguaauuu

SEQ ID NO: 1341619 - RNA, 19 nt, Human
ucuuguaauuuuacacgcu

SEQ ID NO: 1341620 - RNA, 15 nt, Human
ucuuguaauuuuaca

SEQ ID NO: 1341621 - RNA, 21 nt, Human
ucuuguauaagauccuagauc

SEQ ID NO: 1341622 - RNA, 20 nt, Human
ucuuguauaagauccuagau

SEQ ID NO: 1341623 - RNA, 12 nt, Human
ucuugucuauaa

SEQ ID NO: 1341624 - RNA, 13 nt, Human
ucuugucuauaaa

SEQ ID NO: 1341625 - RNA, 16 nt, Human
ucuugucuauaaagca

SEQ ID NO: 1341626 - RNA, 21 nt, Human
ucuugaaauuaagaaggcaaa

SEQ ID NO: 1341627 - RNA, 22 nt, Human
ucuugaaauuaagaaggcaaaa

SEQ ID NO: 1341628 - RNA, 14 nt, Human
ucuugaaauuaaga

SEQ ID NO: 1341629 - RNA, 20 nt, Human
ucuugaaauuaagaaggcaa

SEQ ID NO: 1341630 - RNA, 16 nt, Human
ucuucuuggucucagu

SEQ ID NO: 1341631 - RNA, 23 nt, Human
ucuucuuggccaugggaggccuu

SEQ ID NO: 1341632 - RNA, 19 nt, Human
ucuucuuggccaugggagg

SEQ ID NO: 1341633 - RNA, 17 nt, Human
ucuucuuucugucuuua

SEQ ID NO: 1341634 - RNA, 21 nt, Human
ucuucuuuuaaaccauuuucu

SEQ ID NO: 1341635 - RNA, 22 nt, Human
ucuucuuuuaaaccauuuucuu

SEQ ID NO: 1341636 - RNA, 15 nt, Human
ucuucuuuugugaag

SEQ ID NO: 1341637 - RNA, 17 nt, Human
ucuucgacuguuguuau

SEQ ID NO: 1341638 - RNA, 15 nt, Human
ucuucgacuguuguu

SEQ ID NO: 1341639 - RNA, 14 nt, Human
ucuucgacuguugu

SEQ ID NO: 1341640 - RNA, 22 nt, Human
ucuucgacuguuguuaucuguu

SEQ ID NO: 1341641 - RNA, 13 nt, Human
ucuuccuuuguaa

SEQ ID NO: 1341642 - RNA, 16 nt, Human
ucuuccuuuguaaaaa

SEQ ID NO: 1341643 - RNA, 10 nt, Human
ucuuccuuuu

SEQ ID NO: 1341644 - RNA, 14 nt, Human
ucuuccuuuuauca

SEQ ID NO: 1341645 - RNA, 23 nt, Human
ucuuccuugaagaacugcaggcc

SEQ ID NO: 1341646 - RNA, 15 nt, Human
ucuuccuuuucacug

SEQ ID NO: 1341647 - RNA, 18 nt, Human
ucuuccuuuucacugcug

SEQ ID NO: 1341648 - RNA, 17 nt, Human
ucuuuccacagaagcuc

SEQ ID NO: 1341649 - RNA, 15 nt, Human
ucuuguguguaugca

SEQ ID NO: 1341650 - RNA, 21 nt, Human
ucuuguguguaugcacaugaa

SEQ ID NO: 1341651 - RNA, 19 nt, Human
ucuuuccacagaagcucca

SEQ ID NO: 1341652 - RNA, 22 nt, Human
ucuuguguguaugcacaugaac

SEQ ID NO: 1341653 - RNA, 13 nt, Human
ucuuuccauuugc

SEQ ID NO: 1341654 - RNA, 19 nt, Human
ucuuuccaaccggcuuugu

SEQ ID NO: 1341655 - RNA, 14 nt, Human
ucuuuccauuugca

SEQ ID NO: 1341656 - RNA, 16 nt, Human
ucuuuccauuugcauu

SEQ ID NO: 1341657 - RNA, 17 nt, Human
ucuuuccauuugcauuu

SEQ ID NO: 1341658 - RNA, 22 nt, Human
ucuuuccauuugcauuuguuua

SEQ ID NO: 1341659 - RNA, 18 nt, Human
ucuuucccauggggaggg

SEQ ID NO: 1341660 - RNA, 16 nt, Human
ucuuugaauaaauguc

SEQ ID NO: 1341661 - RNA, 17 nt, Human
ucuuugaauaaauguca

SEQ ID NO: 1341662 - RNA, 21 nt, Human
ucuuugaauaaaugucacuuu

SEQ ID NO: 1341663 - RNA, 20 nt, Human
ucuuugaauaaaugucacuu

SEQ ID NO: 1341664 - RNA, 15 nt, Human
ucuugucuauaaagc

SEQ ID NO: 1341665 - RNA, 22 nt, Human
ucuugugcacuggcaccaagug

SEQ ID NO: 1341666 - RNA, 14 nt, Human
ucuugugcacuggc

SEQ ID NO: 1341667 - RNA, 22 nt, Human
ucuuugccacccucaugcugug

SEQ ID NO: 1341668 - RNA, 21 nt, Human
ucuuugccacccucaugcugu

SEQ ID NO: 1341669 - RNA, 21 nt, Human
ucuuugacaauugggagcugc

SEQ ID NO: 1341670 - RNA, 12 nt, Human
ucuuugagaggg

SEQ ID NO: 1341671 - RNA, 12 nt, Human
ucuuugccucaa

SEQ ID NO: 1341672 - RNA, 13 nt, Human
ucuuuucauacau

SEQ ID NO: 1341673 - RNA, 23 nt, Human
ucuuuucauacauuuucuaagaa

SEQ ID NO: 1341674 - RNA, 15 nt, Human
ugaaacacuuugcau

SEQ ID NO: 1341675 - RNA, 18 nt, Human
ugaaaaccacauuggaga

SEQ ID NO: 1341676 - RNA, 20 nt, Human
ugaaaauuaggauuucauga

SEQ ID NO: 1341677 - RNA, 13 nt, Human
ugaaaauuauuua

SEQ ID NO: 1341678 - RNA, 17 nt, Human
ugaaaauuauuuaaacc

SEQ ID NO: 1341679 - RNA, 14 nt, Human
ugaaaauuauuuaa

SEQ ID NO: 1341680 - RNA, 21 nt, Human
ucuuuuuacccauuuguucau

SEQ ID NO: 1341681 - RNA, 19 nt, Human
ucuuuuuaccuuucauaca

SEQ ID NO: 1341682 - RNA, 14 nt, Human
ucuuuuuaaaguuc

SEQ ID NO: 1341683 - RNA, 18 nt, Human
ucuuuuuaaaguucaaac

SEQ ID NO: 1341684 - RNA, 20 nt, Human
ucuuuuguucgcauggucac

SEQ ID NO: 1341685 - RNA, 12 nt, Human
ucuuuuguauua

SEQ ID NO: 1341686 - RNA, 14 nt, Human
ucuuuucauacauu

SEQ ID NO: 1341687 - RNA, 19 nt, Human
ucuuuucccacuguuuaag

SEQ ID NO: 1341688 - RNA, 16 nt, Human
ucuuuucccauuuauc

SEQ ID NO: 1341689 - RNA, 19 nt, Human
ucuuuucccauuuaucuaa

SEQ ID NO: 1341690 - RNA, 20 nt, Human
ucuuuucccauuuaucuaaa

SEQ ID NO: 1341691 - RNA, 21 nt, Human
ucuuuucccauuuaucuaaau

SEQ ID NO: 1341692 - RNA, 19 nt, Human
ucuuuucccccauuaauca

SEQ ID NO: 1341693 - RNA, 24 nt, Human
ucuuuucccccuuugugcacauuu

SEQ ID NO: 1341694 - RNA, 16 nt, Human
ugaaaacacugugcac

SEQ ID NO: 1341695 - RNA, 18 nt, Human
ugaaaacacugugcacau

SEQ ID NO: 1341696 - RNA, 14 nt, Human
ugaaaacagaaugu

SEQ ID NO: 1341697 - RNA, 22 nt, Human
ucuggagcccacuguacuugcu

SEQ ID NO: 1341698 - RNA, 16 nt, Human
ucuggagcccacugua

SEQ ID NO: 1341699 - RNA, 12 nt, Human
ucuggagcccac

SEQ ID NO: 1341700 - RNA, 15 nt, Human
ucuggagcauuucuc

SEQ ID NO: 1341701 - RNA, 14 nt, Human
ucuggagccagccg

SEQ ID NO: 1341702 - RNA, 22 nt, Human
ucuggagccagccgagcaggag

SEQ ID NO: 1341703 - RNA, 18 nt, Human
ucuggcugguagagcagg

SEQ ID NO: 1341704 - RNA, 12 nt, Human
ucuggcuggugu

SEQ ID NO: 1341705 - RNA, 13 nt, Human
ucuggcugguguu

SEQ ID NO: 1341706 - RNA, 17 nt, Human
ucuggcugguguuaaca

SEQ ID NO: 1341707 - RNA, 18 nt, Human
ucuggcugguguuaacag

SEQ ID NO: 1341708 - RNA, 20 nt, Human
ucuggcugguguuaacagaa

SEQ ID NO: 1341709 - RNA, 22 nt, Human
ucuggcuguaaggcucuagauc

SEQ ID NO: 1341710 - RNA, 16 nt, Human
ucuggcuguaaggcuc

SEQ ID NO: 1341711 - RNA, 18 nt, Human
ucuggcuguaaggcucua

SEQ ID NO: 1341712 - RNA, 21 nt, Human
ucuggcuguaaggcucuagau

SEQ ID NO: 1341713 - RNA, 15 nt, Human
ucuggcuucuggcca

SEQ ID NO: 1341714 - RNA, 18 nt, Human
ucuggcuucuggccagga

SEQ ID NO: 1341715 - RNA, 19 nt, Human
ucuggcuucuggccaggaa

SEQ ID NO: 1341716 - RNA, 22 nt, Human
ucuguaagaaaccuacugccca

SEQ ID NO: 1341717 - RNA, 14 nt, Human
ucuguaagaaaccu

SEQ ID NO: 1341718 - RNA, 20 nt, Human
ucuguaagaaaccuacugcc

SEQ ID NO: 1341719 - RNA, 16 nt, Human
ucuguaaaucuacaca

SEQ ID NO: 1341720 - RNA, 19 nt, Human
ucuguaaacuguguauucc

SEQ ID NO: 1341721 - RNA, 22 nt, Human
ucuguaaacuguguauuccaag

SEQ ID NO: 1341722 - RNA, 19 nt, Human
ucuguaaagcuaaaauaaa

SEQ ID NO: 1341723 - RNA, 13 nt, Human
ucuguaaagcuaa

SEQ ID NO: 1341724 - RNA, 12 nt, Human
ucuguaaacugu

SEQ ID NO: 1341725 - RNA, 13 nt, Human
ucuguaaacugug

SEQ ID NO: 1341726 - RNA, 14 nt, Human
ucuguaaacugugu

SEQ ID NO: 1341727 - RNA, 15 nt, Human
ucuguaaacugugua

SEQ ID NO: 1341728 - RNA, 16 nt, Human
ucuguaaacuguguau

SEQ ID NO: 1341729 - RNA, 20 nt, Human
ucuggcuucuggccaggaag

SEQ ID NO: 1341730 - RNA, 17 nt, Human
ucuggugaagcucacuu

SEQ ID NO: 1341731 - RNA, 20 nt, Human
ucuguaauucagguuuuucc

SEQ ID NO: 1341732 - RNA, 12 nt, Human
ucuguaauugca

SEQ ID NO: 1341733 - RNA, 13 nt, Human
ucuguaauugcaa

SEQ ID NO: 1341734 - RNA, 14 nt, Human
ucuguaauugcaaa

SEQ ID NO: 1341735 - RNA, 17 nt, Human
ucuguaauuguguguga

SEQ ID NO: 1341736 - RNA, 13 nt, Human
ucuguaauugugu

SEQ ID NO: 1341737 - RNA, 13 nt, Human
ucuguccucagcc

SEQ ID NO: 1341738 - RNA, 14 nt, Human
ucuguccucagccu

SEQ ID NO: 1341739 - RNA, 15 nt, Human
ucuguccucagccuu

SEQ ID NO: 1341740 - RNA, 19 nt, Human
ucuguccucagccuugcca

SEQ ID NO: 1341741 - RNA, 21 nt, Human
ucuguccucagccuugccaga

SEQ ID NO: 1341742 - RNA, 23 nt, Human
ucuguccucagccuugccagaga

SEQ ID NO: 1341743 - RNA, 17 nt, Human
ucugucgcccaugcugg

SEQ ID NO: 1341744 - RNA, 18 nt, Human
ucuguccugaaggccuga

SEQ ID NO: 1341745 - RNA, 15 nt, Human
ucugucuacuugcuc

SEQ ID NO: 1341746 - RNA, 18 nt, Human
ucugucuacuugcucagg

SEQ ID NO: 1341747 - RNA, 23 nt, Human
ucugucuacuugcucagguacuu

SEQ ID NO: 1341748 - RNA, 14 nt, Human
ucugucucagucca

SEQ ID NO: 1341749 - RNA, 13 nt, Human
ucugucucaucca

SEQ ID NO: 1341750 - RNA, 21 nt, Human
ucugucucauccaucaucaug

SEQ ID NO: 1341751 - RNA, 17 nt, Human
ucugucucauccaucau

SEQ ID NO: 1341752 - RNA, 14 nt, Human
ucuggaauuugaaa

SEQ ID NO: 1341753 - RNA, 18 nt, Human
ucuggacagccccacccu

SEQ ID NO: 1341754 - RNA, 19 nt, Human
ucuggacagccccacccug

SEQ ID NO: 1341755 - RNA, 23 nt, Human
ucugcuggaguuucauguacaag

SEQ ID NO: 1341756 - RNA, 19 nt, Human
ucugcuggaguuucaugua

SEQ ID NO: 1341757 - RNA, 15 nt, Human
ucuggaauguaauca

SEQ ID NO: 1341758 - RNA, 16 nt, Human
ucuggaauguaaucaa

SEQ ID NO: 1341759 - RNA, 18 nt, Human
ucuggaauguaaucaaug

SEQ ID NO: 1341760 - RNA, 22 nt, Human
ucuggaauguaaucaauguuuc

SEQ ID NO: 1341761 - RNA, 19 nt, Human
ucugcugccucccucugcu

SEQ ID NO: 1341762 - RNA, 18 nt, Human
ucugcugcugucccuccc

SEQ ID NO: 1341763 - RNA, 13 nt, Human
ucugcuggaguuu

SEQ ID NO: 1341764 - RNA, 15 nt, Human
ucuggacuccucugu

SEQ ID NO: 1341765 - RNA, 16 nt, Human
ucuggacuccucuguc

SEQ ID NO: 1341766 - RNA, 18 nt, Human
ucuggacuccucugucca

SEQ ID NO: 1341767 - RNA, 20 nt, Human
ucuggacagccccacccugg

SEQ ID NO: 1341768 - RNA, 19 nt, Human
ucuggacaggauguguuug

SEQ ID NO: 1341769 - RNA, 14 nt, Human
ucuggaccucuggg

SEQ ID NO: 1341770 - RNA, 15 nt, Human
ucuggaccucugggu

SEQ ID NO: 1341771 - RNA, 22 nt, Human
ucuggacuccucuguccaggca

SEQ ID NO: 1341772 - RNA, 21 nt, Human
ucuggagaaagggcccugggc

SEQ ID NO: 1341773 - RNA, 20 nt, Human
ucugcucuuucucugccagu

SEQ ID NO: 1341774 - RNA, 13 nt, Human
ucugcugaaggaa

SEQ ID NO: 1341775 - RNA, 18 nt, Human
ucugcucuuucucugcca

SEQ ID NO: 1341776 - RNA, 19 nt, Human
ucugcucuuucucugccag

SEQ ID NO: 1341777 - RNA, 14 nt, Human
ucugcucuuucucu

SEQ ID NO: 1341778 - RNA, 15 nt, Human
ucugcucuuucucug

SEQ ID NO: 1341779 - RNA, 16 nt, Human
ucugcucuuucucugc

SEQ ID NO: 1341780 - RNA, 17 nt, Human
ucugcucuuucucugcc

SEQ ID NO: 1341781 - RNA, 11 nt, Human
ucugcucugau

SEQ ID NO: 1341782 - RNA, 14 nt, Human
ucugcucugaugca

SEQ ID NO: 1341783 - RNA, 13 nt, Human
ucugcucugaugc

SEQ ID NO: 1341784 - RNA, 16 nt, Human
ucugcucugcguguca

SEQ ID NO: 1341785 - RNA, 21 nt, Human
ucugcucugcgugucaccugu

SEQ ID NO: 1341786 - RNA, 18 nt, Human
ucugcucugguuguuucu

SEQ ID NO: 1341787 - RNA, 21 nt, Human
ucugcucugguuguuucuguu

SEQ ID NO: 1341788 - RNA, 18 nt, Human
ucugccugccagcugcac

SEQ ID NO: 1341789 - RNA, 21 nt, Human
ucugccugccagcugcacuga

SEQ ID NO: 1341790 - RNA, 22 nt, Human
ucugccugccagcugcacugau

SEQ ID NO: 1341791 - RNA, 12 nt, Human
ucugcuccugga

SEQ ID NO: 1341792 - RNA, 15 nt, Human
ucugcuccuucccca

SEQ ID NO: 1341793 - RNA, 12 nt, Human
ucugcuccuucc

SEQ ID NO: 1341794 - RNA, 22 nt, Human
ucugcccaccucagccucccaa

SEQ ID NO: 1341795 - RNA, 21 nt, Human
ucugcagucucuauaccaaua

SEQ ID NO: 1341796 - RNA, 20 nt, Human
ucugcagucucuauaccaau

SEQ ID NO: 1341797 - RNA, 18 nt, Human
ucugcagucucuauacca

SEQ ID NO: 1341798 - RNA, 14 nt, Human
ucugcagucucuau

SEQ ID NO: 1341799 - RNA, 18 nt, Human
ucugcacuauaugcaaac

SEQ ID NO: 1341800 - RNA, 15 nt, Human
ucugcauauguugaa

SEQ ID NO: 1341801 - RNA, 16 nt, Human
ucugcauauguugaau

SEQ ID NO: 1341802 - RNA, 18 nt, Human
ucugcauauguugaauac

SEQ ID NO: 1341803 - RNA, 19 nt, Human
ucugcauauguugaauacu

SEQ ID NO: 1341804 - RNA, 21 nt, Human
ucugcauauguugaauacuuu

SEQ ID NO: 1341805 - RNA, 12 nt, Human
ucugcccaaccc

SEQ ID NO: 1341806 - RNA, 15 nt, Human
ucugccuccucuuca

SEQ ID NO: 1341807 - RNA, 15 nt, Human
ucugccucucuugua

SEQ ID NO: 1341808 - RNA, 15 nt, Human
ucugccucucuagga

SEQ ID NO: 1341809 - RNA, 21 nt, Human
ucugccuacagaacuucagaa

SEQ ID NO: 1341810 - RNA, 22 nt, Human
ucugccuccccuuaaaggggag

SEQ ID NO: 1341811 - RNA, 14 nt, Human
ucugccucuucugg

SEQ ID NO: 1341812 - RNA, 15 nt, Human
ucugccucuucuggg

SEQ ID NO: 1341813 - RNA, 17 nt, Human
ucugccucuucugggag

SEQ ID NO: 1341814 - RNA, 18 nt, Human
ucugccucuucugggagg

SEQ ID NO: 1341815 - RNA, 19 nt, Human
ucugccucuucugggaggg

SEQ ID NO: 1341816 - RNA, 16 nt, Human
ucugccugccagcugc

SEQ ID NO: 1341817 - RNA, 17 nt, Human
ucugccugccagcugca

SEQ ID NO: 1341818 - RNA, 13 nt, Human
ucucauccugcag

SEQ ID NO: 1341819 - RNA, 15 nt, Human
ucucaucaacugaau

SEQ ID NO: 1341820 - RNA, 17 nt, Human
ucucaucaacugaauga

SEQ ID NO: 1341821 - RNA, 12 nt, Human
ucucauccacau

SEQ ID NO: 1341822 - RNA, 13 nt, Human
ucucauccaucau

SEQ ID NO: 1341823 - RNA, 14 nt, Human
ucucauccaucauc

SEQ ID NO: 1341824 - RNA, 13 nt, Human
ucugagaggcccu

SEQ ID NO: 1341825 - RNA, 14 nt, Human
ucugagaggcccug

SEQ ID NO: 1341826 - RNA, 16 nt, Human
ucugagaggcccugga

SEQ ID NO: 1341827 - RNA, 17 nt, Human
ucugagaggcccuggau

SEQ ID NO: 1341828 - RNA, 18 nt, Human
ucugagaggcccuggauc

SEQ ID NO: 1341829 - RNA, 14 nt, Human
ucugagagucuaga

SEQ ID NO: 1341830 - RNA, 15 nt, Human
ucugagagucuagau

SEQ ID NO: 1341831 - RNA, 16 nt, Human
ucugagagucuagauu

SEQ ID NO: 1341832 - RNA, 17 nt, Human
ucugagagucuagauuc

SEQ ID NO: 1341833 - RNA, 18 nt, Human
ucugagagucuagauucu

SEQ ID NO: 1341834 - RNA, 19 nt, Human
ucugagagucuagauucuc

SEQ ID NO: 1341835 - RNA, 21 nt, Human
ucugagagucuagauucucug

SEQ ID NO: 1341836 - RNA, 22 nt, Human
ucugagagucuagauucucugg

SEQ ID NO: 1341837 - RNA, 21 nt, Human
ucugagcccgguaagagcaaa

SEQ ID NO: 1341838 - RNA, 23 nt, Human
ucugagcccgguaagagcaaaag

SEQ ID NO: 1341839 - RNA, 21 nt, Human
ucugagcgccuccauccaagg

SEQ ID NO: 1341840 - RNA, 14 nt, Human
ucugagcgccucca

SEQ ID NO: 1341841 - RNA, 17 nt, Human
ucugagcuauuucaucu

SEQ ID NO: 1341842 - RNA, 20 nt, Human
ucugagcuauuucaucuauu

SEQ ID NO: 1341843 - RNA, 22 nt, Human
ucugagcuauuucaucuauuuu

SEQ ID NO: 1341844 - RNA, 13 nt, Human
ucugagcuccagc

SEQ ID NO: 1341845 - RNA, 17 nt, Human
ucugauuuguaacccac

SEQ ID NO: 1341846 - RNA, 22 nt, Human
ucugauuuguaacccacugaga

SEQ ID NO: 1341847 - RNA, 13 nt, Human
ucugauuuuagga

SEQ ID NO: 1341848 - RNA, 22 nt, Human
ucugauuuuaggagcuaaggcu

SEQ ID NO: 1341849 - RNA, 24 nt, Human
ucugcaaacaccaacauguuggga

SEQ ID NO: 1341850 - RNA, 14 nt, Human
ucugcaaacugccu

SEQ ID NO: 1341851 - RNA, 15 nt, Human
ucugcaaacugccuu

SEQ ID NO: 1341852 - RNA, 21 nt, Human
ucugcacuacugacauguggg

SEQ ID NO: 1341853 - RNA, 18 nt, Human
ucugcacucccaccugac

SEQ ID NO: 1341854 - RNA, 21 nt, Human
ucugcacucccaccugacaca

SEQ ID NO: 1341855 - RNA, 16 nt, Human
ucugcaguaaaucuuu

SEQ ID NO: 1341856 - RNA, 18 nt, Human
ucugcacuacugacaugu

SEQ ID NO: 1341857 - RNA, 20 nt, Human
ucugcacuacugacaugugg

SEQ ID NO: 1341858 - RNA, 17 nt, Human
ucugcaaggucuuuggu

SEQ ID NO: 1341859 - RNA, 23 nt, Human
ucugcaaguauacuagggagcca

SEQ ID NO: 1341860 - RNA, 22 nt, Human
ucugcaaguauacuagggagcc

SEQ ID NO: 1341861 - RNA, 14 nt, Human
ucugcaauucaaaa

SEQ ID NO: 1341862 - RNA, 16 nt, Human
ucugcaauucaaaagu

SEQ ID NO: 1341863 - RNA, 19 nt, Human
ucugcaauucaaaaguucc

SEQ ID NO: 1341864 - RNA, 21 nt, Human
ucugcaauucaaaaguuccaa

SEQ ID NO: 1341865 - RNA, 17 nt, Human
uccuuaggccucugaga

SEQ ID NO: 1341866 - RNA, 14 nt, Human
uccuuaucaaagga

SEQ ID NO: 1341867 - RNA, 15 nt, Human
uccuuaucaaaggac

SEQ ID NO: 1341868 - RNA, 15 nt, Human
uccuuaccuuuuuau

SEQ ID NO: 1341869 - RNA, 20 nt, Human
uccuuaccuuuuuauuugca

SEQ ID NO: 1341870 - RNA, 16 nt, Human
uccuuacucccaggca

SEQ ID NO: 1341871 - RNA, 14 nt, Human
uccuuacuccugug

SEQ ID NO: 1341872 - RNA, 16 nt, Human
uccuuacuccuguggg

SEQ ID NO: 1341873 - RNA, 17 nt, Human
uccuuacuccuguggga

SEQ ID NO: 1341874 - RNA, 20 nt, Human
uccuuacuccugugggagcc

SEQ ID NO: 1341875 - RNA, 22 nt, Human
uccuuacuccugugggagccuc

SEQ ID NO: 1341876 - RNA, 23 nt, Human
uccuuacuccugugggagccucg

SEQ ID NO: 1341877 - RNA, 17 nt, Human
uccuuacuuuuuauaua

SEQ ID NO: 1341878 - RNA, 18 nt, Human
uccuuacuuuuuauauau

SEQ ID NO: 1341879 - RNA, 20 nt, Human
uccuuacuuuuuauauauau

SEQ ID NO: 1341880 - RNA, 17 nt, Human
uccuuaucaaaggacac

SEQ ID NO: 1341881 - RNA, 17 nt, Human
uccuuaucgaaacucau

SEQ ID NO: 1341882 - RNA, 17 nt, Human
uccuguccagcuccaac

SEQ ID NO: 1341883 - RNA, 16 nt, Human
uccuguccccugcuac

SEQ ID NO: 1341884 - RNA, 17 nt, Human
uccuguccccugcuaca

SEQ ID NO: 1341885 - RNA, 16 nt, Human
uccugaggcuuuggau

SEQ ID NO: 1341886 - RNA, 17 nt, Human
uccugaggcuuuggauu

SEQ ID NO: 1341887 - RNA, 18 nt, Human
uccugaggcuuuggauuu

SEQ ID NO: 1341888 - RNA, 13 nt, Human
uccuguccagcuc

SEQ ID NO: 1341889 - RNA, 14 nt, Human
uccuguccagcucc

SEQ ID NO: 1341890 - RNA, 15 nt, Human
uccuguccagcucca

SEQ ID NO: 1341891 - RNA, 16 nt, Human
uccuguccagcuccaa

SEQ ID NO: 1341892 - RNA, 23 nt, Human
uccuugcugaaacgcaucuaguu

SEQ ID NO: 1341893 - RNA, 22 nt, Human
uccuugcuuaugacaucacuug

SEQ ID NO: 1341894 - RNA, 18 nt, Human
uccuugaagaacugcagg

SEQ ID NO: 1341895 - RNA, 19 nt, Human
uccuugaagaacugcaggc

SEQ ID NO: 1341896 - RNA, 20 nt, Human
uccuugaagaacugcaggcc

SEQ ID NO: 1341897 - RNA, 20 nt, Human
uccuuugaauccucucucug

SEQ ID NO: 1341898 - RNA, 21 nt, Human
uccuuugaauccucucucugu

SEQ ID NO: 1341899 - RNA, 23 nt, Human
uccuuugggcuucagcugccagu

SEQ ID NO: 1341900 - RNA, 12 nt, Human
uccuuuguaaaa

SEQ ID NO: 1341901 - RNA, 14 nt, Human
uccuuugugaaaaa

SEQ ID NO: 1341902 - RNA, 17 nt, Human
uccuuugugcuuaguua

SEQ ID NO: 1341903 - RNA, 13 nt, Human
uccuuuugacacu

SEQ ID NO: 1341904 - RNA, 14 nt, Human
uccuuuugacacug

SEQ ID NO: 1341905 - RNA, 16 nt, Human
uccuuuugacacugcu

SEQ ID NO: 1341906 - RNA, 18 nt, Human
uccuuuugacacugcucu

SEQ ID NO: 1341907 - RNA, 20 nt, Human
uccuuuugacacugcucuaa

SEQ ID NO: 1341908 - RNA, 22 nt, Human
uccuuuugacacugcucuaaca

SEQ ID NO: 1341909 - RNA, 20 nt, Human
ucgauacugcgacuuucugc

SEQ ID NO: 1341910 - RNA, 22 nt, Human
ucgauacugcgacuuucugccu

SEQ ID NO: 1341911 - RNA, 23 nt, Human
ucgauacugcgacuuucugccug

SEQ ID NO: 1341912 - RNA, 14 nt, Human
ucgaugcaaugaac

SEQ ID NO: 1341913 - RNA, 17 nt, Human
ucgcagccacccugagg

SEQ ID NO: 1341914 - RNA, 18 nt, Human
ucgcagccacccugagga

SEQ ID NO: 1341915 - RNA, 19 nt, Human
ucgcagccacccugaggag

SEQ ID NO: 1341916 - RNA, 20 nt, Human
ucgcagccacccugaggagu

SEQ ID NO: 1341917 - RNA, 23 nt, Human
ucgcagccacccugaggagucug

SEQ ID NO: 1341918 - RNA, 21 nt, Human
ucgcagccacccugaggaguc

SEQ ID NO: 1341919 - RNA, 12 nt, Human
ucgauuagacug

SEQ ID NO: 1341920 - RNA, 13 nt, Human
ucgauuagacugg

SEQ ID NO: 1341921 - RNA, 14 nt, Human
ucgauuagacugga

SEQ ID NO: 1341922 - RNA, 18 nt, Human
ucgauuagacuggacagc

SEQ ID NO: 1341923 - RNA, 22 nt, Human
ucgauuagacuggacagcuugu

SEQ ID NO: 1341924 - RNA, 21 nt, Human
ucgauuagacuggacagcuug

SEQ ID NO: 1341925 - RNA, 13 nt, Human
ucgcagccacccu

SEQ ID NO: 1341926 - RNA, 14 nt, Human
ucgcagccacccug

SEQ ID NO: 1341927 - RNA, 16 nt, Human
ucgcagccacccugag

SEQ ID NO: 1341928 - RNA, 19 nt, Human
ucgcauggucacacacuga

SEQ ID NO: 1341929 - RNA, 20 nt, Human
ucgcauggucacacacugau

SEQ ID NO: 1341930 - RNA, 16 nt, Human
ucgccacacaguauuu

SEQ ID NO: 1341931 - RNA, 16 nt, Human
ucgcccauccccuuga

SEQ ID NO: 1341932 - RNA, 21 nt, Human
ucgcuucuugccucugugcug

SEQ ID NO: 1341933 - RNA, 17 nt, Human
ucggccuccauccugag

SEQ ID NO: 1341934 - RNA, 16 nt, Human
ucggccuccauccuga

SEQ ID NO: 1341935 - RNA, 15 nt, Human
ucggccuccauccug

SEQ ID NO: 1341936 - RNA, 19 nt, Human
ucgcuuuauuggcugagau

SEQ ID NO: 1341937 - RNA, 13 nt, Human
ucggaaaaauaau

SEQ ID NO: 1341938 - RNA, 19 nt, Human
ucggaaaaauaaucaaaag

SEQ ID NO: 1341939 - RNA, 12 nt, Human
ucggaggaagcc

SEQ ID NO: 1341940 - RNA, 13 nt, Human
ucggaggaagccc

SEQ ID NO: 1341941 - RNA, 13 nt, Human
ucuauauuuuaca

SEQ ID NO: 1341942 - RNA, 17 nt, Human
ucuagguuuaugacagu

SEQ ID NO: 1341943 - RNA, 23 nt, Human
ucuagguucuaaaaauugugauc

SEQ ID NO: 1341944 - RNA, 17 nt, Human
ucuagguccccauacuc

SEQ ID NO: 1341945 - RNA, 14 nt, Human
ucuagguucuaaaa

SEQ ID NO: 1341946 - RNA, 15 nt, Human
ucuagguaaauuaca

SEQ ID NO: 1341947 - RNA, 21 nt, Human
ucuagguacgaugacaguguu

SEQ ID NO: 1341948 - RNA, 17 nt, Human
ucuagguaggaaaugug

SEQ ID NO: 1341949 - RNA, 15 nt, Human
ucuagguccccauac

SEQ ID NO: 1341950 - RNA, 21 nt, Human
ucuaggcaguucaaagcagga

SEQ ID NO: 1341951 - RNA, 15 nt, Human
ucuaggcacuguagu

SEQ ID NO: 1341952 - RNA, 21 nt, Human
ucuaggcacuguaguucuaag

SEQ ID NO: 1341953 - RNA, 22 nt, Human
ucuaggcacuguaguucuaaga

SEQ ID NO: 1341954 - RNA, 24 nt, Human
ucuaggcacuguaguucuaagacu

SEQ ID NO: 1341955 - RNA, 18 nt, Human
ucuacuaauuccacaccu

SEQ ID NO: 1341956 - RNA, 20 nt, Human
ucuacucacuuuucccacuc

SEQ ID NO: 1341957 - RNA, 21 nt, Human
ucuacucacuuuucccacucc

SEQ ID NO: 1341958 - RNA, 19 nt, Human
ucuacuaaaaauacaaaaa

SEQ ID NO: 1341959 - RNA, 15 nt, Human
ucuacuaaaaauaca

SEQ ID NO: 1341960 - RNA, 14 nt, Human
ucuacuauuuaugu

SEQ ID NO: 1341961 - RNA, 14 nt, Human
ucuaauuuuuaaga

SEQ ID NO: 1341962 - RNA, 19 nt, Human
ucuacuaaugccucuucau

SEQ ID NO: 1341963 - RNA, 15 nt, Human
ucuacuaauuccaca

SEQ ID NO: 1341964 - RNA, 15 nt, Human
ucuaauuuuuaagaa

SEQ ID NO: 1341965 - RNA, 13 nt, Human
ucuaauugccaug

SEQ ID NO: 1341966 - RNA, 15 nt, Human
ucuaauugccaugua

SEQ ID NO: 1341967 - RNA, 14 nt, Human
ucuaauugccaugu

SEQ ID NO: 1341968 - RNA, 12 nt, Human
ucuaauugcuua

SEQ ID NO: 1341969 - RNA, 13 nt, Human
ucuaauugcuuau

SEQ ID NO: 1341970 - RNA, 14 nt, Human
ucuaauugcuuauu

SEQ ID NO: 1341971 - RNA, 18 nt, Human
ucuaauugcuuauuuauu

SEQ ID NO: 1341972 - RNA, 15 nt, Human
ucuaauugcuuauuu

SEQ ID NO: 1341973 - RNA, 13 nt, Human
ucuaauuuauaaa

SEQ ID NO: 1341974 - RNA, 14 nt, Human
ucuaauuuauaaaa

SEQ ID NO: 1341975 - RNA, 14 nt, Human
ucguccccaaguga

SEQ ID NO: 1341976 - RNA, 19 nt, Human
ucguccucguuuguguucu

SEQ ID NO: 1341977 - RNA, 15 nt, Human
ucguccuuacuccug

SEQ ID NO: 1341978 - RNA, 19 nt, Human
ucguccuuacuccuguggg

SEQ ID NO: 1341979 - RNA, 16 nt, Human
ucguccuuacuccugu

SEQ ID NO: 1341980 - RNA, 21 nt, Human
ucgucucggccuucacaaucu

SEQ ID NO: 1341981 - RNA, 23 nt, Human
ucgucucuuuuacccuggccccu

SEQ ID NO: 1341982 - RNA, 18 nt, Human
ucgucuguuuauaaacau

SEQ ID NO: 1341983 - RNA, 15 nt, Human
ucgucuucuuggcca

SEQ ID NO: 1341984 - RNA, 18 nt, Human
ucuaaucaugaaacuccc

SEQ ID NO: 1341985 - RNA, 19 nt, Human
ucuaaucuagauaucgacu

SEQ ID NO: 1341986 - RNA, 20 nt, Human
ucuaaucuagauaucgacuu

SEQ ID NO: 1341987 - RNA, 20 nt, Human
ucuaaucugugcuguuucaa

SEQ ID NO: 1341988 - RNA, 21 nt, Human
ucuaauucuauuaaagugcua

SEQ ID NO: 1341989 - RNA, 17 nt, Human
ucuaauucuuccuuugu

SEQ ID NO: 1341990 - RNA, 18 nt, Human
ucuaauucuuccuuugua

SEQ ID NO: 1341991 - RNA, 21 nt, Human
ucuaauucuuccuuuguaaaa

SEQ ID NO: 1341992 - RNA, 18 nt, Human
ucucagauuucugaggaa

SEQ ID NO: 1341993 - RNA, 17 nt, Human
ucucagauuucugagga

SEQ ID NO: 1341994 - RNA, 21 nt, Human
ucucaguugcagcccugcugc

SEQ ID NO: 1341995 - RNA, 16 nt, Human
ucucaguuuguguguc

SEQ ID NO: 1341996 - RNA, 17 nt, Human
ucucaguuugugugucu

SEQ ID NO: 1341997 - RNA, 18 nt, Human
ucucaguuugugugucuu

SEQ ID NO: 1341998 - RNA, 19 nt, Human
ucucaguuugugugucuua

SEQ ID NO: 1341999 - RNA, 15 nt, Human
ucucaguuuucauaa

SEQ ID NO: 1342000 - RNA, 16 nt, Human
ucucaguuuucauaag

SEQ ID NO: 1342001 - RNA, 14 nt, Human
ucucagauuucuga

SEQ ID NO: 1342002 - RNA, 17 nt, Human
ucucacugagcacuguu

SEQ ID NO: 1342003 - RNA, 14 nt, Human
ucucacugcuugaa

SEQ ID NO: 1342004 - RNA, 18 nt, Human
ucucacugagcacuguuu

SEQ ID NO: 1342005 - RNA, 18 nt, Human
ucucacugcuugaacuag

SEQ ID NO: 1342006 - RNA, 16 nt, Human
ucucacugcuugaacu

SEQ ID NO: 1342007 - RNA, 13 nt, Human
ucuaugaaauauu

SEQ ID NO: 1342008 - RNA, 15 nt, Human
ucucaauuccaacag

SEQ ID NO: 1342009 - RNA, 16 nt, Human
ucucaauuccaacagu

SEQ ID NO: 1342010 - RNA, 22 nt, Human
ucucaauuccaacaguuuaaug

SEQ ID NO: 1342011 - RNA, 17 nt, Human
ucucaauugcuuuguaa

SEQ ID NO: 1342012 - RNA, 12 nt, Human
ucucaauuucua

SEQ ID NO: 1342013 - RNA, 23 nt, Human
ucucaauuccaacaguuuaauga

SEQ ID NO: 1342014 - RNA, 16 nt, Human
ucucacugagcacugu

SEQ ID NO: 1342015 - RNA, 11 nt, Human
ucucacugagc

SEQ ID NO: 1342016 - RNA, 14 nt, Human
ucuauccucuguaa

SEQ ID NO: 1342017 - RNA, 22 nt, Human
ucuaucuuugagcgcccacuag

SEQ ID NO: 1342018 - RNA, 19 nt, Human
ucccuacccuaaccaaguu

SEQ ID NO: 1342019 - RNA, 16 nt, Human
ucccuacccucuagag

SEQ ID NO: 1342020 - RNA, 12 nt, Human
ucccaugcccug

SEQ ID NO: 1342021 - RNA, 22 nt, Human
ucccaugauuucauguacugca

SEQ ID NO: 1342022 - RNA, 19 nt, Human
ucccaugauuucauguacu

SEQ ID NO: 1342023 - RNA, 16 nt, Human
ucccaugauuucaugu

SEQ ID NO: 1342024 - RNA, 19 nt, Human
ucccuaccgagucucuucu

SEQ ID NO: 1342025 - RNA, 21 nt, Human
ucccuaccgagucucuucucc

SEQ ID NO: 1342026 - RNA, 22 nt, Human
ucccuaccgagucucuucucca

SEQ ID NO: 1342027 - RNA, 23 nt, Human
ucccuaccgagucucuucuccac

SEQ ID NO: 1342028 - RNA, 23 nt, Human
ucccaugagcuccuuaaggcucu

SEQ ID NO: 1342029 - RNA, 15 nt, Human
ucccaugaucccugu

SEQ ID NO: 1342030 - RNA, 14 nt, Human
ucccaugauuucau

SEQ ID NO: 1342031 - RNA, 13 nt, Human
ucccaugauuuca

SEQ ID NO: 1342032 - RNA, 16 nt, Human
ucccaugaucccugug

SEQ ID NO: 1342033 - RNA, 19 nt, Human
ucccaugaucccuguguug

SEQ ID NO: 1342034 - RNA, 18 nt, Human
ucccuagcugugaccucu

SEQ ID NO: 1342035 - RNA, 19 nt, Human
ucccuagaaacuuccaaau

SEQ ID NO: 1342036 - RNA, 18 nt, Human
ucccuagaaacuuccaaa

SEQ ID NO: 1342037 - RNA, 19 nt, Human
ucccuccgcccccagguag

SEQ ID NO: 1342038 - RNA, 14 nt, Human
ucccuccgggaccu

SEQ ID NO: 1342039 - RNA, 15 nt, Human
ucccuccgggaccug

SEQ ID NO: 1342040 - RNA, 13 nt, Human
ucccucccuuggg

SEQ ID NO: 1342041 - RNA, 14 nt, Human
ucccucccuugggg

SEQ ID NO: 1342042 - RNA, 14 nt, Human
ucccuccgccccca

SEQ ID NO: 1342043 - RNA, 16 nt, Human
ucccucugcagucucu

SEQ ID NO: 1342044 - RNA, 22 nt, Human
ucccucugcagucucuauacca

SEQ ID NO: 1342045 - RNA, 13 nt, Human
ucccucucuggag

SEQ ID NO: 1342046 - RNA, 15 nt, Human
ucccucucuggagaa

SEQ ID NO: 1342047 - RNA, 14 nt, Human
ucccucucuggaga

SEQ ID NO: 1342048 - RNA, 17 nt, Human
ucccucucaacacccag

SEQ ID NO: 1342049 - RNA, 16 nt, Human
ucccucucaggaucca

SEQ ID NO: 1342050 - RNA, 10 nt, Human
ucccucucau

SEQ ID NO: 1342051 - RNA, 22 nt, Human
ucccucucauuuagccuguccu

SEQ ID NO: 1342052 - RNA, 21 nt, Human
ucccucucauuuagccugucc

SEQ ID NO: 1342053 - RNA, 12 nt, Human
ucccucucccag

SEQ ID NO: 1342054 - RNA, 13 nt, Human
ucccucucccagg

SEQ ID NO: 1342055 - RNA, 14 nt, Human
ucccucucccaggc

SEQ ID NO: 1342056 - RNA, 15 nt, Human
ucccucucccaggcc

SEQ ID NO: 1342057 - RNA, 16 nt, Human
ucccucucccaggccc

SEQ ID NO: 1342058 - RNA, 21 nt, Human
ucccucuuccuucccugcugu

SEQ ID NO: 1342059 - RNA, 21 nt, Human
ucccucuuagucuagguccuu

SEQ ID NO: 1342060 - RNA, 13 nt, Human
ucccugcauggca

SEQ ID NO: 1342061 - RNA, 20 nt, Human
ucccugcauggcauccucca

SEQ ID NO: 1342062 - RNA, 21 nt, Human
ucccugcauggcauccuccag

SEQ ID NO: 1342063 - RNA, 19 nt, Human
ucccugggccuugggcucc

SEQ ID NO: 1342064 - RNA, 12 nt, Human
ucccugggccug

SEQ ID NO: 1342065 - RNA, 13 nt, Human
ucccugggccugc

SEQ ID NO: 1342066 - RNA, 14 nt, Human
ucccugggccugcu

SEQ ID NO: 1342067 - RNA, 15 nt, Human
ucccugggccugcug

SEQ ID NO: 1342068 - RNA, 16 nt, Human
ucccugggccugcugc

SEQ ID NO: 1342069 - RNA, 17 nt, Human
ucccugggccugcugcu

SEQ ID NO: 1342070 - RNA, 18 nt, Human
ucccugggccugcugcug

SEQ ID NO: 1342071 - RNA, 19 nt, Human
ucccugggccugcugcuga

SEQ ID NO: 1342072 - RNA, 20 nt, Human
ucccugggccugcugcugag

SEQ ID NO: 1342073 - RNA, 21 nt, Human
ucccugggccugcugcugaga

SEQ ID NO: 1342074 - RNA, 13 nt, Human
ucccugggccuug

SEQ ID NO: 1342075 - RNA, 14 nt, Human
ucccugggccuugg

SEQ ID NO: 1342076 - RNA, 15 nt, Human
ucccugggccuuggg

SEQ ID NO: 1342077 - RNA, 16 nt, Human
ucccugggccuugggc

SEQ ID NO: 1342078 - RNA, 20 nt, Human
ucccuggggcuagggggagc

SEQ ID NO: 1342079 - RNA, 16 nt, Human
ucccugccccccagcc

SEQ ID NO: 1342080 - RNA, 14 nt, Human
ucccugccccuccc

SEQ ID NO: 1342081 - RNA, 23 nt, Human
ucccugcauggcauccuccagcc

SEQ ID NO: 1342082 - RNA, 22 nt, Human
ucccugcauggcauccuccagc

SEQ ID NO: 1342083 - RNA, 18 nt, Human
ucccugccccucccuuca

SEQ ID NO: 1342084 - RNA, 19 nt, Human
ucccugccccucccuucaa

SEQ ID NO: 1342085 - RNA, 23 nt, Human
ucccugggagggacaugcuuagc

SEQ ID NO: 1342086 - RNA, 17 nt, Human
ucccuucuuuuucuucu

SEQ ID NO: 1342087 - RNA, 17 nt, Human
uccgacucuucugagca

SEQ ID NO: 1342088 - RNA, 16 nt, Human
uccgacucacaccacu

SEQ ID NO: 1342089 - RNA, 12 nt, Human
uccgacugcuuu

SEQ ID NO: 1342090 - RNA, 15 nt, Human
uccgacugcuuugga

SEQ ID NO: 1342091 - RNA, 12 nt, Human
uccggaaagaag

SEQ ID NO: 1342092 - RNA, 13 nt, Human
uccgcccugccac

SEQ ID NO: 1342093 - RNA, 14 nt, Human
uccgcccugccacu

SEQ ID NO: 1342094 - RNA, 15 nt, Human
uccgcccugccacuc

SEQ ID NO: 1342095 - RNA, 16 nt, Human
uccgcccugccacuca

SEQ ID NO: 1342096 - RNA, 16 nt, Human
uccgagaggugggcca

SEQ ID NO: 1342097 - RNA, 21 nt, Human
uccgaggacccaggaaaggca

SEQ ID NO: 1342098 - RNA, 21 nt, Human
uccgcccacaggaagccugca

SEQ ID NO: 1342099 - RNA, 14 nt, Human
uccgcccccaggua

SEQ ID NO: 1342100 - RNA, 16 nt, Human
uccgcccccagguagg

SEQ ID NO: 1342101 - RNA, 15 nt, Human
uccgcccccagguag

SEQ ID NO: 1342102 - RNA, 15 nt, Human
uccuaagcaucuaag

SEQ ID NO: 1342103 - RNA, 16 nt, Human
uccuaagcaucuaagu

SEQ ID NO: 1342104 - RNA, 13 nt, Human
uccuauccuccua

SEQ ID NO: 1342105 - RNA, 17 nt, Human
uccuaagcaucuaaguu

SEQ ID NO: 1342106 - RNA, 17 nt, Human
uccuaucuccagcggcc

SEQ ID NO: 1342107 - RNA, 19 nt, Human
uccuaucuccagcggcccu

SEQ ID NO: 1342108 - RNA, 23 nt, Human
uccuaucuccagcggcccuguca

SEQ ID NO: 1342109 - RNA, 13 nt, Human
uccuaucugggcu

SEQ ID NO: 1342110 - RNA, 16 nt, Human
uccuaucugggcuucc

SEQ ID NO: 1342111 - RNA, 18 nt, Human
uccuaucugggcuuccug

SEQ ID NO: 1342112 - RNA, 19 nt, Human
uccuaucugggcuuccugg

SEQ ID NO: 1342113 - RNA, 20 nt, Human
uccuaucugggcuuccugga

SEQ ID NO: 1342114 - RNA, 16 nt, Human
uccuaugauguauacu

SEQ ID NO: 1342115 - RNA, 12 nt, Human
uccuaugcaugg

SEQ ID NO: 1342116 - RNA, 22 nt, Human
uccuaugauguauacugccacu

SEQ ID NO: 1342117 - RNA, 15 nt, Human
uccuaugauguauac

SEQ ID NO: 1342118 - RNA, 12 nt, Human
uccuaugaugua

SEQ ID NO: 1342119 - RNA, 20 nt, Human
uccuaugcaugguuucagca

SEQ ID NO: 1342120 - RNA, 21 nt, Human
uccuaugcaugguuucagcac

SEQ ID NO: 1342121 - RNA, 22 nt, Human
uccuaugcaugguuucagcacu

SEQ ID NO: 1342122 - RNA, 13 nt, Human
uccuaugcuuuga

SEQ ID NO: 1342123 - RNA, 14 nt, Human
uccuaugcuuugaa

SEQ ID NO: 1342124 - RNA, 20 nt, Human
uccuaugcuuugaaacagaa

SEQ ID NO: 1342125 - RNA, 21 nt, Human
uccuauugugcaauguaaaua

SEQ ID NO: 1342126 - RNA, 17 nt, Human
uccuaagagugcugggc

SEQ ID NO: 1342127 - RNA, 19 nt, Human
uccuaagagugcugggcau

SEQ ID NO: 1342128 - RNA, 21 nt, Human
uccuaagcaacuaggccuuca

SEQ ID NO: 1342129 - RNA, 13 nt, Human
uccuaagcaucua

SEQ ID NO: 1342130 - RNA, 14 nt, Human
uccuaagcaucuaa

SEQ ID NO: 1342131 - RNA, 16 nt, Human
uccggauccuaagcau

SEQ ID NO: 1342132 - RNA, 14 nt, Human
uccuaagccuaaaa

SEQ ID NO: 1342133 - RNA, 20 nt, Human
uccucaaaacuucagacaua

SEQ ID NO: 1342134 - RNA, 12 nt, Human
uccuccucaggc

SEQ ID NO: 1342135 - RNA, 12 nt, Human
uccuccugcaga

SEQ ID NO: 1342136 - RNA, 15 nt, Human
uccuccugcagacca

SEQ ID NO: 1342137 - RNA, 20 nt, Human
uccuccugcagaccacgccc

SEQ ID NO: 1342138 - RNA, 17 nt, Human
uccuccgucaccucaga

SEQ ID NO: 1342139 - RNA, 17 nt, Human
uccucuguccaggcacu

SEQ ID NO: 1342140 - RNA, 21 nt, Human
uccucugucagucacagccac

SEQ ID NO: 1342141 - RNA, 22 nt, Human
uccucugucagucacagccacc

SEQ ID NO: 1342142 - RNA, 23 nt, Human
uccucuggcuuggccacagccag

SEQ ID NO: 1342143 - RNA, 19 nt, Human
uccucugucagucacagcc

SEQ ID NO: 1342144 - RNA, 22 nt, Human
uccucuguccaggcacugcugc

SEQ ID NO: 1342145 - RNA, 15 nt, Human
uccugaggcuccacu

SEQ ID NO: 1342146 - RNA, 22 nt, Human
uccucuggcuuggccacagcca

SEQ ID NO: 1342147 - RNA, 17 nt, Human
uccugaggcuccacuug

SEQ ID NO: 1342148 - RNA, 16 nt, Human
uccugaggcuccacuu

SEQ ID NO: 1342149 - RNA, 13 nt, Human
uccucuggagcca

SEQ ID NO: 1342150 - RNA, 17 nt, Human
uccucuggagccagccg

SEQ ID NO: 1342151 - RNA, 15 nt, Human
uccucuggcuuggcc

SEQ ID NO: 1342152 - RNA, 13 nt, Human
uccucucaauaaa

SEQ ID NO: 1342153 - RNA, 14 nt, Human
uccuccugggcccu

SEQ ID NO: 1342154 - RNA, 15 nt, Human
uccuccugggcccuc

SEQ ID NO: 1342155 - RNA, 16 nt, Human
uccuccugggcccucu

SEQ ID NO: 1342156 - RNA, 14 nt, Human
uccuccuuuuucca

SEQ ID NO: 1342157 - RNA, 13 nt, Human
uccuccuggacuc

SEQ ID NO: 1342158 - RNA, 12 nt, Human
uccuccugcuca

SEQ ID NO: 1342159 - RNA, 11 nt, Human
uccuccuggaa

SEQ ID NO: 1342160 - RNA, 16 nt, Human
uccucgagaucccaac

SEQ ID NO: 1342161 - RNA, 23 nt, Human
uccucgagaucccaacacugcca

SEQ ID NO: 1342162 - RNA, 12 nt, Human
uccauacauuug

SEQ ID NO: 1342163 - RNA, 22 nt, Human
uccauaaugcauucuucucugu

SEQ ID NO: 1342164 - RNA, 23 nt, Human
uccauaaucuggacuccucuguc

SEQ ID NO: 1342165 - RNA, 18 nt, Human
uccauaaugcauucuucu

SEQ ID NO: 1342166 - RNA, 14 nt, Human
uccagggcuaguga

SEQ ID NO: 1342167 - RNA, 12 nt, Human
uccauauaaaua

SEQ ID NO: 1342168 - RNA, 13 nt, Human
uccauauaaauau

SEQ ID NO: 1342169 - RNA, 19 nt, Human
uccauauaaauauuagaaa

SEQ ID NO: 1342170 - RNA, 19 nt, Human
uccauauggauccacuggc

SEQ ID NO: 1342171 - RNA, 21 nt, Human
uccauauggauccacuggcug

SEQ ID NO: 1342172 - RNA, 16 nt, Human
uccauauggauccacu

SEQ ID NO: 1342173 - RNA, 15 nt, Human
uccauaucacacaca

SEQ ID NO: 1342174 - RNA, 13 nt, Human
uccauaucacaca

SEQ ID NO: 1342175 - RNA, 14 nt, Human
ucccaacuuguaaa

SEQ ID NO: 1342176 - RNA, 16 nt, Human
ucccaacacugccagc

SEQ ID NO: 1342177 - RNA, 14 nt, Human
ucccaacacugcca

SEQ ID NO: 1342178 - RNA, 15 nt, Human
ucccaacacugccag

SEQ ID NO: 1342179 - RNA, 14 nt, Human
uccaugugcccagu

SEQ ID NO: 1342180 - RNA, 16 nt, Human
uccaugugcccaguua

SEQ ID NO: 1342181 - RNA, 17 nt, Human
uccaugucgccucugca

SEQ ID NO: 1342182 - RNA, 18 nt, Human
uccaugucgccucugcau

SEQ ID NO: 1342183 - RNA, 19 nt, Human
uccaugucgccucugcauu

SEQ ID NO: 1342184 - RNA, 16 nt, Human
uccaugucgccucugc

SEQ ID NO: 1342185 - RNA, 20 nt, Human
uccaugcguguuucugacuc

SEQ ID NO: 1342186 - RNA, 21 nt, Human
uccaugcguguuucugacucu

SEQ ID NO: 1342187 - RNA, 15 nt, Human
uccaugcgcucaggg

SEQ ID NO: 1342188 - RNA, 16 nt, Human
uccaugcgcucagggc

SEQ ID NO: 1342189 - RNA, 18 nt, Human
uccaugcguguuucugac

SEQ ID NO: 1342190 - RNA, 19 nt, Human
uccaugcguguuucugacu

SEQ ID NO: 1342191 - RNA, 12 nt, Human
uccaugauucua

SEQ ID NO: 1342192 - RNA, 21 nt, Human
uccaugcacccucauacacag

SEQ ID NO: 1342193 - RNA, 20 nt, Human
ucccaagcaccugggauuac

SEQ ID NO: 1342194 - RNA, 16 nt, Human
ucccaagcggugucuc

SEQ ID NO: 1342195 - RNA, 15 nt, Human
ucccaccuccauccc

SEQ ID NO: 1342196 - RNA, 17 nt, Human
ucccaccuccaucccag

SEQ ID NO: 1342197 - RNA, 15 nt, Human
ucccaccuccccuug

SEQ ID NO: 1342198 - RNA, 17 nt, Human
ucccaccuccccuuggg

SEQ ID NO: 1342199 - RNA, 21 nt, Human
ucccaagcaccugggauuaca

SEQ ID NO: 1342200 - RNA, 22 nt, Human
ucccaagagcaucaugccucug

SEQ ID NO: 1342201 - RNA, 13 nt, Human
ucccaagagcuac

SEQ ID NO: 1342202 - RNA, 17 nt, Human
ucccaagcggugucucu

SEQ ID NO: 1342203 - RNA, 18 nt, Human
ucccaccuccccuugggc

SEQ ID NO: 1342204 - RNA, 20 nt, Human
ucccaccuccugacacccuu

SEQ ID NO: 1342205 - RNA, 21 nt, Human
ucccaccuccugacacccuuc

SEQ ID NO: 1342206 - RNA, 17 nt, Human
ucccacucacaacagcu

SEQ ID NO: 1342207 - RNA, 22 nt, Human
ucccacucacaacagcugccug

SEQ ID NO: 1342208 - RNA, 20 nt, Human
ucccaccuuucgggccaugu

SEQ ID NO: 1342209 - RNA, 15 nt, Human
ucccacggccuuucu

SEQ ID NO: 1342210 - RNA, 17 nt, Human
ucccacggccuuucuag

SEQ ID NO: 1342211 - RNA, 21 nt, Human
ucccacuucagccucccaagc

SEQ ID NO: 1342212 - RNA, 13 nt, Human
ucccaggcaaggc

SEQ ID NO: 1342213 - RNA, 14 nt, Human
ucccacuccaagcc

SEQ ID NO: 1342214 - RNA, 13 nt, Human
ucccacuccaagc

SEQ ID NO: 1342215 - RNA, 22 nt, Human
ucccacuccaagcccagcccau

SEQ ID NO: 1342216 - RNA, 17 nt, Human
ucccacuccaagcccag

SEQ ID NO: 1342217 - RNA, 16 nt, Human
ucccacucuccuaggc

SEQ ID NO: 1342218 - RNA, 13 nt, Human
ucccacucuccua

SEQ ID NO: 1342219 - RNA, 18 nt, Human
ucccacuuaaaaauuaaa

SEQ ID NO: 1342220 - RNA, 15 nt, Human
ucccaggcaaggcug

SEQ ID NO: 1342221 - RNA, 16 nt, Human
ucccaggcaaggcugu

SEQ ID NO: 1342222 - RNA, 17 nt, Human
ucccaggcaaggcugug

SEQ ID NO: 1342223 - RNA, 19 nt, Human
ucccaggcaaggcugugga

SEQ ID NO: 1342224 - RNA, 19 nt, Human
ucccaggcugagccucagu

SEQ ID NO: 1342225 - RNA, 20 nt, Human
ucccaggcaaggcuguggac

SEQ ID NO: 1342226 - RNA, 18 nt, Human
ucccaggcacuguacuaa

SEQ ID NO: 1342227 - RNA, 16 nt, Human
ucccagggacaccugg

SEQ ID NO: 1342228 - RNA, 16 nt, Human
ucccagggccugucuc

SEQ ID NO: 1342229 - RNA, 17 nt, Human
uccagagcacugcucca

SEQ ID NO: 1342230 - RNA, 22 nt, Human
uccagagaguggcuccucccgg

SEQ ID NO: 1342231 - RNA, 19 nt, Human
uccagagaguggcuccucc

SEQ ID NO: 1342232 - RNA, 15 nt, Human
uccagagucccugcc

SEQ ID NO: 1342233 - RNA, 17 nt, Human
uccagagggcacucugc

SEQ ID NO: 1342234 - RNA, 15 nt, Human
uccagaugcagggca

SEQ ID NO: 1342235 - RNA, 20 nt, Human
uccagaggcuauuauuuuca

SEQ ID NO: 1342236 - RNA, 12 nt, Human
uccagagggcac

SEQ ID NO: 1342237 - RNA, 17 nt, Human
uccacuuuaucuugaau

SEQ ID NO: 1342238 - RNA, 16 nt, Human
uccacuuauagccucu

SEQ ID NO: 1342239 - RNA, 20 nt, Human
uccacuuauagccucugucu

SEQ ID NO: 1342240 - RNA, 22 nt, Human
uccacuuauagccucugucugg

SEQ ID NO: 1342241 - RNA, 23 nt, Human
uccacuuauagccucugucuggc

SEQ ID NO: 1342242 - RNA, 14 nt, Human
uccacuucugacag

SEQ ID NO: 1342243 - RNA, 15 nt, Human
uccacuucugacagc

SEQ ID NO: 1342244 - RNA, 12 nt, Human
uccacuuucagc

SEQ ID NO: 1342245 - RNA, 13 nt, Human
uccacuuucagcu

SEQ ID NO: 1342246 - RNA, 14 nt, Human
uccacuuucagcug

SEQ ID NO: 1342247 - RNA, 15 nt, Human
uccacuuucagcugu

SEQ ID NO: 1342248 - RNA, 16 nt, Human
uccacuuucagcuguc

SEQ ID NO: 1342249 - RNA, 17 nt, Human
uccacuuucagcugucu

SEQ ID NO: 1342250 - RNA, 18 nt, Human
uccacuuucagcugucuu

SEQ ID NO: 1342251 - RNA, 15 nt, Human
uccacuuuaucuuga

SEQ ID NO: 1342252 - RNA, 21 nt, Human
uccacuuagaaauugcauuuc

SEQ ID NO: 1342253 - RNA, 23 nt, Human
uccacuuagaaauugcauuuccu

SEQ ID NO: 1342254 - RNA, 14 nt, Human
uccacuuacaucca

SEQ ID NO: 1342255 - RNA, 16 nt, Human
uccacaggcuucugag

SEQ ID NO: 1342256 - RNA, 22 nt, Human
uccacccuggccgaguccaagc

SEQ ID NO: 1342257 - RNA, 22 nt, Human
uccagauuuuuuacagcugccu

SEQ ID NO: 1342258 - RNA, 17 nt, Human
uccagauuagagccugu

SEQ ID NO: 1342259 - RNA, 17 nt, Human
uccagauugacgacaag

SEQ ID NO: 1342260 - RNA, 16 nt, Human
uccagaugcagggcag

SEQ ID NO: 1342261 - RNA, 17 nt, Human
uccagaugcagggcagu

SEQ ID NO: 1342262 - RNA, 18 nt, Human
uccagaugcagggcaguc

SEQ ID NO: 1342263 - RNA, 19 nt, Human
uccagaugcagggcaguca

SEQ ID NO: 1342264 - RNA, 15 nt, Human
uccagaugccacaau

SEQ ID NO: 1342265 - RNA, 18 nt, Human
uccagcaauucuccugcc

SEQ ID NO: 1342266 - RNA, 19 nt, Human
uccagcaauucuccugccu

SEQ ID NO: 1342267 - RNA, 20 nt, Human
uccagcaauucuccugccuc

SEQ ID NO: 1342268 - RNA, 21 nt, Human
uccagcaauucuccugccuca

SEQ ID NO: 1342269 - RNA, 15 nt, Human
uccagcuggccggga

SEQ ID NO: 1342270 - RNA, 21 nt, Human
uccagcuggccgggagccuga

SEQ ID NO: 1342271 - RNA, 22 nt, Human
uccagcuggccgggagccugau

SEQ ID NO: 1342272 - RNA, 19 nt, Human
uccagcuggguuggaaaac

SEQ ID NO: 1342273 - RNA, 19 nt, Human
uccagcugggcucugcaau

SEQ ID NO: 1342274 - RNA, 22 nt, Human
uccaggaaaguggccaagaagc

SEQ ID NO: 1342275 - RNA, 20 nt, Human
uccaggacuauauuugggcc

SEQ ID NO: 1342276 - RNA, 23 nt, Human
uccaggacuauauuugggccugc

SEQ ID NO: 1342277 - RNA, 15 nt, Human
uccaggacuguuuca

SEQ ID NO: 1342278 - RNA, 19 nt, Human
uccaggacuguuucaaaca

SEQ ID NO: 1342279 - RNA, 20 nt, Human
uccaggacuguuucaaacau

SEQ ID NO: 1342280 - RNA, 21 nt, Human
uccaggacuguuucaaacaug

SEQ ID NO: 1342281 - RNA, 22 nt, Human
uccaggacuguuucaaacaugc

SEQ ID NO: 1342282 - RNA, 16 nt, Human
uccaggagaaggccaa

SEQ ID NO: 1342283 - RNA, 20 nt, Human
uccaggagaaggccaauucc

SEQ ID NO: 1342284 - RNA, 23 nt, Human
uccaggagaaggccaauuccuau

SEQ ID NO: 1342285 - RNA, 17 nt, Human
uccagggcccccaucuc

SEQ ID NO: 1342286 - RNA, 17 nt, Human
uccaagcaaaugugaau

SEQ ID NO: 1342287 - RNA, 20 nt, Human
uccaagacucuagaguccaa

SEQ ID NO: 1342288 - RNA, 23 nt, Human
uccaagacucuagaguccaaggu

SEQ ID NO: 1342289 - RNA, 15 nt, Human
uccaagagucuaaag

SEQ ID NO: 1342290 - RNA, 16 nt, Human
uccaagagucuaaaga

SEQ ID NO: 1342291 - RNA, 21 nt, Human
uccaagagcuacauaauuuag

SEQ ID NO: 1342292 - RNA, 13 nt, Human
uccaagacucuag

SEQ ID NO: 1342293 - RNA, 14 nt, Human
uccaagacucuaga

SEQ ID NO: 1342294 - RNA, 15 nt, Human
uccaagacucuagag

SEQ ID NO: 1342295 - RNA, 16 nt, Human
uccaagacucuagagu

SEQ ID NO: 1342296 - RNA, 23 nt, Human
ucaugucaaauauuuagauguaa

SEQ ID NO: 1342297 - RNA, 16 nt, Human
ucauguacugcauuau

SEQ ID NO: 1342298 - RNA, 19 nt, Human
ucauguacugcauuauuug

SEQ ID NO: 1342299 - RNA, 17 nt, Human
ucauguacaagaugaag

SEQ ID NO: 1342300 - RNA, 18 nt, Human
ucauguacaagaugaagg

SEQ ID NO: 1342301 - RNA, 23 nt, Human
uccacagcugccucuucccucuu

SEQ ID NO: 1342302 - RNA, 15 nt, Human
uccacagccugcaag

SEQ ID NO: 1342303 - RNA, 18 nt, Human
uccacagccugcaaguca

SEQ ID NO: 1342304 - RNA, 19 nt, Human
uccacagcaaccccaggcu

SEQ ID NO: 1342305 - RNA, 20 nt, Human
uccacagcaaccccaggcug

SEQ ID NO: 1342306 - RNA, 17 nt, Human
uccacacacauaauggc

SEQ ID NO: 1342307 - RNA, 19 nt, Human
uccacacagugcucaaggc

SEQ ID NO: 1342308 - RNA, 17 nt, Human
uccacacaugaaucugc

SEQ ID NO: 1342309 - RNA, 13 nt, Human
uccacacaugaau

SEQ ID NO: 1342310 - RNA, 13 nt, Human
uccacaccugcgg

SEQ ID NO: 1342311 - RNA, 14 nt, Human
uccacaccugcggc

SEQ ID NO: 1342312 - RNA, 18 nt, Human
uccacaccugcggcccaa

SEQ ID NO: 1342313 - RNA, 15 nt, Human
uccacaccugcggcc

SEQ ID NO: 1342314 - RNA, 15 nt, Human
uccacaccuuuuauu

SEQ ID NO: 1342315 - RNA, 21 nt, Human
uccacaccuuuuauugacaca

SEQ ID NO: 1342316 - RNA, 17 nt, Human
uccaagcucacucccca

SEQ ID NO: 1342317 - RNA, 14 nt, Human
uccaagcuaagcac

SEQ ID NO: 1342318 - RNA, 22 nt, Human
uccaagcuaagcacugccacug

SEQ ID NO: 1342319 - RNA, 22 nt, Human
uccaagcagcuuagaguuggcc

SEQ ID NO: 1342320 - RNA, 23 nt, Human
uccaagcagccugagcaacucuu

SEQ ID NO: 1342321 - RNA, 14 nt, Human
uccaagcagcuuag

SEQ ID NO: 1342322 - RNA, 15 nt, Human
uccaagcagcuuaga

SEQ ID NO: 1342323 - RNA, 19 nt, Human
uccaagcagcuuagaguug

SEQ ID NO: 1342324 - RNA, 19 nt, Human
uccaagcccagcccaugga

SEQ ID NO: 1342325 - RNA, 21 nt, Human
uccaagcccagcccauggaga

SEQ ID NO: 1342326 - RNA, 15 nt, Human
uccaagccccaucuu

SEQ ID NO: 1342327 - RNA, 19 nt, Human
uccaagccccaucuucuaa

SEQ ID NO: 1342328 - RNA, 23 nt, Human
uccaagccccaucuucuaaaugg

SEQ ID NO: 1342329 - RNA, 23 nt, Human
ucagauaagguaaaaugccauga

SEQ ID NO: 1342330 - RNA, 22 nt, Human
uaucauucaaguguaaaauauu

SEQ ID NO: 1342331 - RNA, 14 nt, Human
uaucauuccaaagg

SEQ ID NO: 1342332 - RNA, 19 nt, Human
uaucauugcuuccuccucc

SEQ ID NO: 1342333 - RNA, 20 nt, Human
ucagauaagguaaaaugcca

SEQ ID NO: 1342334 - RNA, 17 nt, Human
ucagauagaaugacagu

SEQ ID NO: 1342335 - RNA, 17 nt, Human
ucagauaugauucaaau

SEQ ID NO: 1342336 - RNA, 18 nt, Human
ucagauaugauucaaaug

SEQ ID NO: 1342337 - RNA, 22 nt, Human
ucagauaagguaaaaugccaug

SEQ ID NO: 1342338 - RNA, 13 nt, Human
ucagauccuccuc

SEQ ID NO: 1342339 - RNA, 15 nt, Human
ucagauccuccucau

SEQ ID NO: 1342340 - RNA, 14 nt, Human
ucagauccuccuca

SEQ ID NO: 1342341 - RNA, 14 nt, Human
ucagcacaucucaa

SEQ ID NO: 1342342 - RNA, 16 nt, Human
ucagcacaucucaaca

SEQ ID NO: 1342343 - RNA, 20 nt, Human
ucagcacaucucaacaggcc

SEQ ID NO: 1342344 - RNA, 14 nt, Human
ucagauccaggagc

SEQ ID NO: 1342345 - RNA, 15 nt, Human
ucagauccaggagcu

SEQ ID NO: 1342346 - RNA, 16 nt, Human
ucagauccaggagcuc

SEQ ID NO: 1342347 - RNA, 18 nt, Human
ucagauccaggagcucca

SEQ ID NO: 1342348 - RNA, 14 nt, Human
ucagauccagggac

SEQ ID NO: 1342349 - RNA, 15 nt, Human
ucagauccagggaca

SEQ ID NO: 1342350 - RNA, 16 nt, Human
ucagauccagggacag

SEQ ID NO: 1342351 - RNA, 23 nt, Human
ucagaucaguguaccauuugccu

SEQ ID NO: 1342352 - RNA, 17 nt, Human
ucagcagggacuguaaa

SEQ ID NO: 1342353 - RNA, 18 nt, Human
ucagcagggacuguaaac

SEQ ID NO: 1342354 - RNA, 22 nt, Human
ucagcagggacuguaaacacag

SEQ ID NO: 1342355 - RNA, 13 nt, Human
ucagcaugaauuu

SEQ ID NO: 1342356 - RNA, 19 nt, Human
ucagcucucaguugcagcc

SEQ ID NO: 1342357 - RNA, 14 nt, Human
ucaggacagaugcc

SEQ ID NO: 1342358 - RNA, 15 nt, Human
ucaggacagaugcca

SEQ ID NO: 1342359 - RNA, 20 nt, Human
ucaggaccaaagcuuucaug

SEQ ID NO: 1342360 - RNA, 15 nt, Human
ucaggacccagagga

SEQ ID NO: 1342361 - RNA, 16 nt, Human
ucaggacccagaggaa

SEQ ID NO: 1342362 - RNA, 19 nt, Human
ucaggacccagaggaaggg

SEQ ID NO: 1342363 - RNA, 12 nt, Human
ucaggacuggga

SEQ ID NO: 1342364 - RNA, 13 nt, Human
ucaggacugggag

SEQ ID NO: 1342365 - RNA, 14 nt, Human
ucaggacugggagc

SEQ ID NO: 1342366 - RNA, 15 nt, Human
ucaggacugggagcc

SEQ ID NO: 1342367 - RNA, 21 nt, Human
ucaggacugggagcccccagc

SEQ ID NO: 1342368 - RNA, 22 nt, Human
ucaggacugggagcccccagcc

SEQ ID NO: 1342369 - RNA, 23 nt, Human
ucaggacugggagcccccagccu

SEQ ID NO: 1342370 - RNA, 16 nt, Human
ucaggacuugaaagaa

SEQ ID NO: 1342371 - RNA, 17 nt, Human
ucaggacuugaaagaaa

SEQ ID NO: 1342372 - RNA, 20 nt, Human
ucaggagagaguugaaccua

SEQ ID NO: 1342373 - RNA, 16 nt, Human
ucaggaggaaggcuua

SEQ ID NO: 1342374 - RNA, 23 nt, Human
ucaggaggaaggcuuacacccac

SEQ ID NO: 1342375 - RNA, 17 nt, Human
ucaggaggaauacugaa

SEQ ID NO: 1342376 - RNA, 19 nt, Human
ucaggaggaauacugaaca

SEQ ID NO: 1342377 - RNA, 17 nt, Human
ucaggaggcaggaccuu

SEQ ID NO: 1342378 - RNA, 11 nt, Human
ucagcuccuga

SEQ ID NO: 1342379 - RNA, 12 nt, Human
ucagcuccugac

SEQ ID NO: 1342380 - RNA, 17 nt, Human
ucagcuccugaccaguu

SEQ ID NO: 1342381 - RNA, 18 nt, Human
ucagcuccugaccaguug

SEQ ID NO: 1342382 - RNA, 14 nt, Human
ucagcuccuuccug

SEQ ID NO: 1342383 - RNA, 15 nt, Human
ucagcuccuuccugg

SEQ ID NO: 1342384 - RNA, 16 nt, Human
ucagcuccuuccugga

SEQ ID NO: 1342385 - RNA, 17 nt, Human
ucagcuccuuccuggag

SEQ ID NO: 1342386 - RNA, 17 nt, Human
ucagccugaaccccagg

SEQ ID NO: 1342387 - RNA, 19 nt, Human
ucagccugaaccccagggc

SEQ ID NO: 1342388 - RNA, 23 nt, Human
ucagccuccauccuacccccugu

SEQ ID NO: 1342389 - RNA, 20 nt, Human
ucagccucccaaguagcugg

SEQ ID NO: 1342390 - RNA, 24 nt, Human
ucauggacuucugccagcauaaua

SEQ ID NO: 1342391 - RNA, 23 nt, Human
ucauggaugggggaacucagauc

SEQ ID NO: 1342392 - RNA, 20 nt, Human
ucauggauuuuccaggacug

SEQ ID NO: 1342393 - RNA, 22 nt, Human
ucauggcagaaggcaaacccau

SEQ ID NO: 1342394 - RNA, 18 nt, Human
ucauggcagauguaggag

SEQ ID NO: 1342395 - RNA, 21 nt, Human
ucauggcagauguaggaggga

SEQ ID NO: 1342396 - RNA, 22 nt, Human
ucauggcagauguaggagggac

SEQ ID NO: 1342397 - RNA, 13 nt, Human
ucauggccccucu

SEQ ID NO: 1342398 - RNA, 14 nt, Human
ucauggccccucug

SEQ ID NO: 1342399 - RNA, 18 nt, Human
ucauggccccucugaccu

SEQ ID NO: 1342400 - RNA, 16 nt, Human
ucauggccagcuggag

SEQ ID NO: 1342401 - RNA, 21 nt, Human
ucauggaauuggagcucgugg

SEQ ID NO: 1342402 - RNA, 15 nt, Human
ucaugaaagauucaa

SEQ ID NO: 1342403 - RNA, 13 nt, Human
ucaugaaagauuc

SEQ ID NO: 1342404 - RNA, 11 nt, Human
ucaugaaaauu

SEQ ID NO: 1342405 - RNA, 19 nt, Human
ucauggaauuggagcucgu

SEQ ID NO: 1342406 - RNA, 18 nt, Human
ucaucuggaaccaucaga

SEQ ID NO: 1342407 - RNA, 12 nt, Human
ucaucuggaacc

SEQ ID NO: 1342408 - RNA, 19 nt, Human
ucaucugcugguccguggg

SEQ ID NO: 1342409 - RNA, 14 nt, Human
ucauccaccccauc

SEQ ID NO: 1342410 - RNA, 16 nt, Human
ucauccaccccauccc

SEQ ID NO: 1342411 - RNA, 13 nt, Human
ucaucugcugguc

SEQ ID NO: 1342412 - RNA, 14 nt, Human
ucaucugcuggucc

SEQ ID NO: 1342413 - RNA, 19 nt, Human
ucauccaaguuaaauguag

SEQ ID NO: 1342414 - RNA, 19 nt, Human
ucauccacauacccugacc

SEQ ID NO: 1342415 - RNA, 12 nt, Human
ucauccacccca

SEQ ID NO: 1342416 - RNA, 17 nt, Human
ucaucuggauuccagag

SEQ ID NO: 1342417 - RNA, 13 nt, Human
ucaucuggaacca

SEQ ID NO: 1342418 - RNA, 19 nt, Human
ucaucuggcaacaucuuua

SEQ ID NO: 1342419 - RNA, 23 nt, Human
ucaucuggcaacaucuuuauccg

SEQ ID NO: 1342420 - RNA, 14 nt, Human
ucaucuuucuucca

SEQ ID NO: 1342421 - RNA, 17 nt, Human
ucaucuuucuuccaaac

SEQ ID NO: 1342422 - RNA, 22 nt, Human
ucauauuuuucauagcuaaaaa

SEQ ID NO: 1342423 - RNA, 23 nt, Human
ucauacuugaacguuuucuaauu

SEQ ID NO: 1342424 - RNA, 13 nt, Human
ucauagaaaugua

SEQ ID NO: 1342425 - RNA, 22 nt, Human
ucauagaaauguaacuuuugua

SEQ ID NO: 1342426 - RNA, 23 nt, Human
ucauagaaauguaacuuuuguaa

SEQ ID NO: 1342427 - RNA, 12 nt, Human
ucauacuugaac

SEQ ID NO: 1342428 - RNA, 14 nt, Human
ucauacuugaacgu

SEQ ID NO: 1342429 - RNA, 15 nt, Human
ucauacuugaacguu

SEQ ID NO: 1342430 - RNA, 19 nt, Human
ucauacuugaacguuuucu

SEQ ID NO: 1342431 - RNA, 21 nt, Human
ucauacuugaacguuuucuaa

SEQ ID NO: 1342432 - RNA, 22 nt, Human
ucauacuugaacguuuucuaau

SEQ ID NO: 1342433 - RNA, 19 nt, Human
ucaguucucuugauuuuca

SEQ ID NO: 1342434 - RNA, 13 nt, Human
ucaguucuaggaa

SEQ ID NO: 1342435 - RNA, 15 nt, Human
ucaguucuaggaaaa

SEQ ID NO: 1342436 - RNA, 16 nt, Human
ucaguucuaggaaaau

SEQ ID NO: 1342437 - RNA, 17 nt, Human
ucaucaucauggccagc

SEQ ID NO: 1342438 - RNA, 20 nt, Human
ucaucauucucugucucauc

SEQ ID NO: 1342439 - RNA, 22 nt, Human
ucaucauucucugucucaucca

SEQ ID NO: 1342440 - RNA, 17 nt, Human
ucauccaaguuaaaugu

SEQ ID NO: 1342441 - RNA, 16 nt, Human
ucaucaucauggccag

SEQ ID NO: 1342442 - RNA, 13 nt, Human
ucaucaacugaau

SEQ ID NO: 1342443 - RNA, 15 nt, Human
ucaucaacugaauga

SEQ ID NO: 1342444 - RNA, 22 nt, Human
ucaucaacugaaugaggucagc

SEQ ID NO: 1342445 - RNA, 13 nt, Human
ucaucaagagaau

SEQ ID NO: 1342446 - RNA, 21 nt, Human
ucaucaagagaauuuggggcu

SEQ ID NO: 1342447 - RNA, 19 nt, Human
ucaucaagagaauuugggg

SEQ ID NO: 1342448 - RNA, 20 nt, Human
ucaguuaacuauugcauuua

SEQ ID NO: 1342449 - RNA, 16 nt, Human
ucaguuaacuauugca

SEQ ID NO: 1342450 - RNA, 13 nt, Human
ucaguuaagaaau

SEQ ID NO: 1342451 - RNA, 15 nt, Human
ucaguguuaaaugug

SEQ ID NO: 1342452 - RNA, 17 nt, Human
ucaguguuaaaugugau

SEQ ID NO: 1342453 - RNA, 21 nt, Human
ucaguguuaaaugugaugaau

SEQ ID NO: 1342454 - RNA, 16 nt, Human
ucaguuaagccuuugg

SEQ ID NO: 1342455 - RNA, 17 nt, Human
ucaguuaagccuuugga

SEQ ID NO: 1342456 - RNA, 23 nt, Human
ucagucucuauaccaauaaagug

SEQ ID NO: 1342457 - RNA, 20 nt, Human
ucagucucucuucucuccag

SEQ ID NO: 1342458 - RNA, 22 nt, Human
ucagucucuauaccaauaaagu

SEQ ID NO: 1342459 - RNA, 13 nt, Human
ucagucucugagc

SEQ ID NO: 1342460 - RNA, 15 nt, Human
ucagucucugagcag

SEQ ID NO: 1342461 - RNA, 17 nt, Human
ucagucucugagcagug

SEQ ID NO: 1342462 - RNA, 20 nt, Human
ucagucucugagcagugaau

SEQ ID NO: 1342463 - RNA, 18 nt, Human
ucaguccaugaagaugua

SEQ ID NO: 1342464 - RNA, 18 nt, Human
ucaguccccgugaaggag

SEQ ID NO: 1342465 - RNA, 18 nt, Human
ucaguccccacagauaac

SEQ ID NO: 1342466 - RNA, 12 nt, Human
ucaguccaggau

SEQ ID NO: 1342467 - RNA, 15 nt, Human
ucaggugcuggggcc

SEQ ID NO: 1342468 - RNA, 23 nt, Human
ucaggugcuggggccugguuccc

SEQ ID NO: 1342469 - RNA, 17 nt, Human
uauagaacugaaugaga

SEQ ID NO: 1342470 - RNA, 18 nt, Human
uauagaacugaaugagaa

SEQ ID NO: 1342471 - RNA, 20 nt, Human
uauagaacuggauuuucaga

SEQ ID NO: 1342472 - RNA, 19 nt, Human
uauagaaguauaaagaauu

SEQ ID NO: 1342473 - RNA, 22 nt, Human
uauagaaguauaaagaauugug

SEQ ID NO: 1342474 - RNA, 13 nt, Human
uauagaaguuuag

SEQ ID NO: 1342475 - RNA, 24 nt, Human
uauagaaagcuauauaagacaaga

SEQ ID NO: 1342476 - RNA, 13 nt, Human
uauagaaagcuau

SEQ ID NO: 1342477 - RNA, 13 nt, Human
uauacuuuuacaa

SEQ ID NO: 1342478 - RNA, 22 nt, Human
uauaaauagaauguaaaugucu

SEQ ID NO: 1342479 - RNA, 15 nt, Human
uauacuuuaaauaau

SEQ ID NO: 1342480 - RNA, 18 nt, Human
uauacuuuaaauaauggu

SEQ ID NO: 1342481 - RNA, 12 nt, Human
uauacuuucccu

SEQ ID NO: 1342482 - RNA, 16 nt, Human
uauacuuucccuaccc

SEQ ID NO: 1342483 - RNA, 17 nt, Human
uauacuuucccuacccu

SEQ ID NO: 1342484 - RNA, 20 nt, Human
uauacuuucccuacccucua

SEQ ID NO: 1342485 - RNA, 11 nt, Human
uauacuuuuuu

SEQ ID NO: 1342486 - RNA, 20 nt, Human
uauaaauagaauguaaaugu

SEQ ID NO: 1342487 - RNA, 19 nt, Human
uauaaauagaauguaaaug

SEQ ID NO: 1342488 - RNA, 16 nt, Human
uauaaauagaauguaa

SEQ ID NO: 1342489 - RNA, 14 nt, Human
uauaaauagaaugu

SEQ ID NO: 1342490 - RNA, 18 nt, Human
uauaaauacugcaaauca

SEQ ID NO: 1342491 - RNA, 17 nt, Human
uauaaaguuuuauauau

SEQ ID NO: 1342492 - RNA, 18 nt, Human
uauaaaguuuuauauauu

SEQ ID NO: 1342493 - RNA, 22 nt, Human
uauaaaguuuuauauauuauau

SEQ ID NO: 1342494 - RNA, 21 nt, Human
uauaaaguuuuauauauuaua

SEQ ID NO: 1342495 - RNA, 18 nt, Human
uauaaaguaguccuguga

SEQ ID NO: 1342496 - RNA, 16 nt, Human
uauaaaguaguccugu

SEQ ID NO: 1342497 - RNA, 16 nt, Human
uauaguacaugauaaa

SEQ ID NO: 1342498 - RNA, 14 nt, Human
uauaguacaugaua

SEQ ID NO: 1342499 - RNA, 13 nt, Human
uauaguacaugau

SEQ ID NO: 1342500 - RNA, 12 nt, Human
uauaguacauga

SEQ ID NO: 1342501 - RNA, 13 nt, Human
uauaguccagcuu

SEQ ID NO: 1342502 - RNA, 13 nt, Human
uauagugauguaa

SEQ ID NO: 1342503 - RNA, 18 nt, Human
uauagugauguaaucuug

SEQ ID NO: 1342504 - RNA, 22 nt, Human
uauaguuuuacuuuuaaacugu

SEQ ID NO: 1342505 - RNA, 23 nt, Human
uauaguuuuacuuuuaaacugug

SEQ ID NO: 1342506 - RNA, 12 nt, Human
uauauaaagaaa

SEQ ID NO: 1342507 - RNA, 13 nt, Human
uauaucuggccuc

SEQ ID NO: 1342508 - RNA, 12 nt, Human
uauaucuuguuu

SEQ ID NO: 1342509 - RNA, 17 nt, Human
uauauaacaaugcugua

SEQ ID NO: 1342510 - RNA, 19 nt, Human
uauauaacaaugcuguauu

SEQ ID NO: 1342511 - RNA, 23 nt, Human
uauauaaagaaaaugauacagca

SEQ ID NO: 1342512 - RNA, 14 nt, Human
uauauuuuccuaua

SEQ ID NO: 1342513 - RNA, 14 nt, Human
uauauuuugccugu

SEQ ID NO: 1342514 - RNA, 14 nt, Human
uauauuuucuguuu

SEQ ID NO: 1342515 - RNA, 15 nt, Human
uauauuuucuuucuc

SEQ ID NO: 1342516 - RNA, 17 nt, Human
uauauuuuguuuacaaa

SEQ ID NO: 1342517 - RNA, 21 nt, Human
uauauuuuuuguuaaaugauu

SEQ ID NO: 1342518 - RNA, 16 nt, Human
uauauuuuuuucugaa

SEQ ID NO: 1342519 - RNA, 19 nt, Human
uauauuuuuuucugaaauu

SEQ ID NO: 1342520 - RNA, 20 nt, Human
uauauuuuuuucugaaauuu

SEQ ID NO: 1342521 - RNA, 21 nt, Human
uauauuuuuuuuuaagcucug

SEQ ID NO: 1342522 - RNA, 19 nt, Human
uaucaaaacuuucuuuucu

SEQ ID NO: 1342523 - RNA, 14 nt, Human
uauaugcuucuguu

SEQ ID NO: 1342524 - RNA, 18 nt, Human
uauaugaagaaaaucacu

SEQ ID NO: 1342525 - RNA, 16 nt, Human
uauaugcuucuguuuu

SEQ ID NO: 1342526 - RNA, 19 nt, Human
uauaugaagaaaaucacuu

SEQ ID NO: 1342527 - RNA, 14 nt, Human
uauauggaaauaua

SEQ ID NO: 1342528 - RNA, 18 nt, Human
uauauggaaauauauauu

SEQ ID NO: 1342529 - RNA, 19 nt, Human
uauauggaaauauauauua

SEQ ID NO: 1342530 - RNA, 17 nt, Human
uauauggaaauucugcu

SEQ ID NO: 1342531 - RNA, 22 nt, Human
uauauuugggccugcuccagac

SEQ ID NO: 1342532 - RNA, 22 nt, Human
uauauggaaauauauauuauac

SEQ ID NO: 1342533 - RNA, 18 nt, Human
uauauggacaaaacaaga

SEQ ID NO: 1342534 - RNA, 18 nt, Human
uaucaaacccuagccuug

SEQ ID NO: 1342535 - RNA, 19 nt, Human
uaucaaacccuagccuugc

SEQ ID NO: 1342536 - RNA, 20 nt, Human
uaucaaacccuagccuugcu

SEQ ID NO: 1342537 - RNA, 21 nt, Human
uaucaaacccuagccuugcuu

SEQ ID NO: 1342538 - RNA, 23 nt, Human
uaucaaacccuagccuugcuugu

SEQ ID NO: 1342539 - RNA, 14 nt, Human
uaucaaaagaaaga

SEQ ID NO: 1342540 - RNA, 22 nt, Human
uaucaaaaugcucuuauuucau

SEQ ID NO: 1342541 - RNA, 19 nt, Human
uaucaaacaccaacauaaa

SEQ ID NO: 1342542 - RNA, 14 nt, Human
uaucaaaaugcucu

SEQ ID NO: 1342543 - RNA, 23 nt, Human
uaucaaacaccaacauaaaaaug

SEQ ID NO: 1342544 - RNA, 17 nt, Human
uaucaaacccuagccuu

SEQ ID NO: 1342545 - RNA, 22 nt, Human
uaucaaacccuagccuugcuug

SEQ ID NO: 1342546 - RNA, 15 nt, Human
uaucaguaaauaacu

SEQ ID NO: 1342547 - RNA, 9 nt, Human
uaucaguag

SEQ ID NO: 1342548 - RNA, 20 nt, Human
uaucagucaauauuuuuaga

SEQ ID NO: 1342549 - RNA, 21 nt, Human
uaucagucaauauuuuuagau

SEQ ID NO: 1342550 - RNA, 22 nt, Human
uaucagucauaacuaaauaaag

SEQ ID NO: 1342551 - RNA, 14 nt, Human
uaucauagaaaugu

SEQ ID NO: 1342552 - RNA, 15 nt, Human
uaucauagaaaugua

SEQ ID NO: 1342553 - RNA, 20 nt, Human
uaucauguuaguaauaccuc

SEQ ID NO: 1342554 - RNA, 13 nt, Human
uaucauucaagug

SEQ ID NO: 1342555 - RNA, 14 nt, Human
uaucauucaagugu

SEQ ID NO: 1342556 - RNA, 21 nt, Human
uaucauguuaguaauaccucu

SEQ ID NO: 1342557 - RNA, 19 nt, Human
uaucauguuaguaauaccu

SEQ ID NO: 1342558 - RNA, 16 nt, Human
uaucauguuaguaaua

SEQ ID NO: 1342559 - RNA, 17 nt, Human
uaucaugcauguccugu

SEQ ID NO: 1342560 - RNA, 19 nt, Human
uaucaugcauguccuguaa

SEQ ID NO: 1342561 - RNA, 14 nt, Human
uaucaugcccugug

SEQ ID NO: 1342562 - RNA, 23 nt, Human
uaucauagaaauguaacuuuugu

SEQ ID NO: 1342563 - RNA, 18 nt, Human
uaucauagaaauguaacu

SEQ ID NO: 1342564 - RNA, 21 nt, Human
uaucauauauauacauacaug

SEQ ID NO: 1342565 - RNA, 18 nt, Human
uaucaucagauagcaucu

SEQ ID NO: 1342566 - RNA, 16 nt, Human
uaucaugagugaauaa

SEQ ID NO: 1342567 - RNA, 18 nt, Human
uauaaaccgaacugaugu

SEQ ID NO: 1342568 - RNA, 22 nt, Human
uaguugaauuuuuuuuaacauu

SEQ ID NO: 1342569 - RNA, 21 nt, Human
uauaaacaagaaaaauaaaga

SEQ ID NO: 1342570 - RNA, 13 nt, Human
uauaaacaagaaa

SEQ ID NO: 1342571 - RNA, 15 nt, Human
uauaaacaagaaaaa

SEQ ID NO: 1342572 - RNA, 19 nt, Human
uauaaacaagaaaaauaaa

SEQ ID NO: 1342573 - RNA, 20 nt, Human
uauaaacaagaaaaauaaag

SEQ ID NO: 1342574 - RNA, 22 nt, Human
uauaaacaagaaaaauaaagaa

SEQ ID NO: 1342575 - RNA, 17 nt, Human
uaguauuguccaggucu

SEQ ID NO: 1342576 - RNA, 18 nt, Human
uaguauugacaaaauguu

SEQ ID NO: 1342577 - RNA, 17 nt, Human
uaguauugacaaaaugu

SEQ ID NO: 1342578 - RNA, 14 nt, Human
uaguauugacaaaa

SEQ ID NO: 1342579 - RNA, 13 nt, Human
uaguauugacaaa

SEQ ID NO: 1342580 - RNA, 17 nt, Human
uaguauggccuguguca

SEQ ID NO: 1342581 - RNA, 19 nt, Human
uaguauggccugugucacu

SEQ ID NO: 1342582 - RNA, 16 nt, Human
uaguaggcauuuuuac

SEQ ID NO: 1342583 - RNA, 16 nt, Human
uaguauggccuguguc

SEQ ID NO: 1342584 - RNA, 16 nt, Human
uaguauuucuaugaaa

SEQ ID NO: 1342585 - RNA, 22 nt, Human
uaguauuguuguccuuuucaua

SEQ ID NO: 1342586 - RNA, 16 nt, Human
uaguauugcaaaguca

SEQ ID NO: 1342587 - RNA, 22 nt, Human
uaguauugacaaaauguuauuu

SEQ ID NO: 1342588 - RNA, 21 nt, Human
uaguauugacaaaauguuauu

SEQ ID NO: 1342589 - RNA, 19 nt, Human
uaguauugacaaaauguua

SEQ ID NO: 1342590 - RNA, 13 nt, Human
uaguauuguuguc

SEQ ID NO: 1342591 - RNA, 16 nt, Human
uaguauuguuguccuu

SEQ ID NO: 1342592 - RNA, 17 nt, Human
uaguauuguuguccuuu

SEQ ID NO: 1342593 - RNA, 21 nt, Human
uaguauuguuguccuuuucau

SEQ ID NO: 1342594 - RNA, 17 nt, Human
uaguucuuacugcuuaa

SEQ ID NO: 1342595 - RNA, 17 nt, Human
uaguugaaaauaaagug

SEQ ID NO: 1342596 - RNA, 17 nt, Human
uaguuguuguagagaaa

SEQ ID NO: 1342597 - RNA, 23 nt, Human
uaguugaauuuuuuuuaacauuc

SEQ ID NO: 1342598 - RNA, 12 nt, Human
uaguugaauuuu

SEQ ID NO: 1342599 - RNA, 23 nt, Human
uaguagcguuuuuuaaauguaua

SEQ ID NO: 1342600 - RNA, 21 nt, Human
uaguagcguuuuuuaaaugua

SEQ ID NO: 1342601 - RNA, 19 nt, Human
uaguagcguuuuuuaaaug

SEQ ID NO: 1342602 - RNA, 20 nt, Human
uaguagcagugauugucuua

SEQ ID NO: 1342603 - RNA, 22 nt, Human
uagguuauuaugauuagcuuug

SEQ ID NO: 1342604 - RNA, 13 nt, Human
uagguucuaaagu

SEQ ID NO: 1342605 - RNA, 12 nt, Human
uagguucuaaaa

SEQ ID NO: 1342606 - RNA, 15 nt, Human
uagguucagccaagg

SEQ ID NO: 1342607 - RNA, 15 nt, Human
uagguucuaaaguuc

SEQ ID NO: 1342608 - RNA, 16 nt, Human
uagguucuaaaguucu

SEQ ID NO: 1342609 - RNA, 17 nt, Human
uagguucuaaaguucua

SEQ ID NO: 1342610 - RNA, 18 nt, Human
uagguucuaaaguucuaa

SEQ ID NO: 1342611 - RNA, 20 nt, Human
uagguucuaaaguucuaaga

SEQ ID NO: 1342612 - RNA, 21 nt, Human
uagguucuaaaguucuaagau

SEQ ID NO: 1342613 - RNA, 22 nt, Human
uagguucuaaaguucuaagauu

SEQ ID NO: 1342614 - RNA, 18 nt, Human
uagguucuuugcugcauu

SEQ ID NO: 1342615 - RNA, 12 nt, Human
uagguugcacac

SEQ ID NO: 1342616 - RNA, 13 nt, Human
uagguugcacacu

SEQ ID NO: 1342617 - RNA, 16 nt, Human
uagguugcacacuuug

SEQ ID NO: 1342618 - RNA, 17 nt, Human
uagguugcacacuuugg

SEQ ID NO: 1342619 - RNA, 18 nt, Human
uagguugcacacuuuggu

SEQ ID NO: 1342620 - RNA, 19 nt, Human
uagguugcacacuuuggua

SEQ ID NO: 1342621 - RNA, 20 nt, Human
uagguuauuaugauuagcuu

SEQ ID NO: 1342622 - RNA, 22 nt, Human
uagguuauuuugauguaaagau

SEQ ID NO: 1342623 - RNA, 14 nt, Human
uagguucagccaag

SEQ ID NO: 1342624 - RNA, 20 nt, Human
uagguggguugaaagccaag

SEQ ID NO: 1342625 - RNA, 21 nt, Human
uagguguuuuguucaccauua

SEQ ID NO: 1342626 - RNA, 19 nt, Human
uaggucugaaauuuuucuu

SEQ ID NO: 1342627 - RNA, 14 nt, Human
uagcugggacuaca

SEQ ID NO: 1342628 - RNA, 22 nt, Human
uagcuguccuuuuuccucucca

SEQ ID NO: 1342629 - RNA, 21 nt, Human
uagcugucugcucagacagaa

SEQ ID NO: 1342630 - RNA, 16 nt, Human
uagcugugaccucucc

SEQ ID NO: 1342631 - RNA, 19 nt, Human
uaggcugacaccuaacucu

SEQ ID NO: 1342632 - RNA, 21 nt, Human
uaggcugacaccuaacucuuc

SEQ ID NO: 1342633 - RNA, 23 nt, Human
uaggcugacaccuaacucuucuu

SEQ ID NO: 1342634 - RNA, 20 nt, Human
uaggcuggaguuagggacug

SEQ ID NO: 1342635 - RNA, 19 nt, Human
uaggcuguaacuacuuuau

SEQ ID NO: 1342636 - RNA, 21 nt, Human
uaggcuguaacuacuuuauaa

SEQ ID NO: 1342637 - RNA, 18 nt, Human
uaggcuuaguuugugugu

SEQ ID NO: 1342638 - RNA, 12 nt, Human
uaggucugaaau

SEQ ID NO: 1342639 - RNA, 14 nt, Human
uaggucugaaauuu

SEQ ID NO: 1342640 - RNA, 18 nt, Human
uaggucugaaauuuuucu

SEQ ID NO: 1342641 - RNA, 22 nt, Human
uaggucugaaauuuuucuucuu

SEQ ID NO: 1342642 - RNA, 21 nt, Human
uaggucuuaauacacacaguu

SEQ ID NO: 1342643 - RNA, 19 nt, Human
uaggugcuauuugucaucu

SEQ ID NO: 1342644 - RNA, 13 nt, Human
uagcauccuggaa

SEQ ID NO: 1342645 - RNA, 15 nt, Human
uagcauccuggaaua

SEQ ID NO: 1342646 - RNA, 16 nt, Human
uagcauccuggaauau

SEQ ID NO: 1342647 - RNA, 18 nt, Human
uagcauccuggaauaucu

SEQ ID NO: 1342648 - RNA, 14 nt, Human
uagcagcuuccaga

SEQ ID NO: 1342649 - RNA, 15 nt, Human
uagcagcuuccagau

SEQ ID NO: 1342650 - RNA, 17 nt, Human
uagauuuuaaucaaauu

SEQ ID NO: 1342651 - RNA, 18 nt, Human
uagauuuuaaucaaauuu

SEQ ID NO: 1342652 - RNA, 14 nt, Human
uagauuuuacauga

SEQ ID NO: 1342653 - RNA, 15 nt, Human
uagauuuuacaugaa

SEQ ID NO: 1342654 - RNA, 20 nt, Human
uagauuuuacaugaaguauu

SEQ ID NO: 1342655 - RNA, 16 nt, Human
uagauuuuacaugaag

SEQ ID NO: 1342656 - RNA, 17 nt, Human
uagauuuuacaugaagu

SEQ ID NO: 1342657 - RNA, 18 nt, Human
uagauuuuacaugaagua

SEQ ID NO: 1342658 - RNA, 12 nt, Human
uagcagccuuuc

SEQ ID NO: 1342659 - RNA, 13 nt, Human
uagcagccuuucu

SEQ ID NO: 1342660 - RNA, 16 nt, Human
uagcagccuuucucuc

SEQ ID NO: 1342661 - RNA, 22 nt, Human
uagcagcggaacaaggagucag

SEQ ID NO: 1342662 - RNA, 20 nt, Human
uagauaggaagaaagaagac

SEQ ID NO: 1342663 - RNA, 13 nt, Human
uagauucaaaggu

SEQ ID NO: 1342664 - RNA, 15 nt, Human
uagauucaaagguuc

SEQ ID NO: 1342665 - RNA, 16 nt, Human
uagauucaaagguucu

SEQ ID NO: 1342666 - RNA, 17 nt, Human
uagauucaaagguucua

SEQ ID NO: 1342667 - RNA, 18 nt, Human
uagauucaaagguucuag

SEQ ID NO: 1342668 - RNA, 17 nt, Human
uagauucagguaauaca

SEQ ID NO: 1342669 - RNA, 19 nt, Human
uagauucagguaauacaaa

SEQ ID NO: 1342670 - RNA, 20 nt, Human
uagauuccauugguccaaga

SEQ ID NO: 1342671 - RNA, 21 nt, Human
uagauuccauugguccaagau

SEQ ID NO: 1342672 - RNA, 11 nt, Human
uagauucuaaa

SEQ ID NO: 1342673 - RNA, 12 nt, Human
uagauucuaaag

SEQ ID NO: 1342674 - RNA, 13 nt, Human
uagauucuaaaga

SEQ ID NO: 1342675 - RNA, 14 nt, Human
uagauucuaaagau

SEQ ID NO: 1342676 - RNA, 15 nt, Human
uagauucuaaagauu

SEQ ID NO: 1342677 - RNA, 11 nt, Human
uagauuuaugg

SEQ ID NO: 1342678 - RNA, 16 nt, Human
uagauuucauaguuca

SEQ ID NO: 1342679 - RNA, 18 nt, Human
uagauuucauaguucaga

SEQ ID NO: 1342680 - RNA, 19 nt, Human
uagauuucauaguucagaa

SEQ ID NO: 1342681 - RNA, 20 nt, Human
uagauuucauaguucagaau

SEQ ID NO: 1342682 - RNA, 22 nt, Human
uagauuucauaguucagaauuu

SEQ ID NO: 1342683 - RNA, 23 nt, Human
uagauuucauaguucagaauuua

SEQ ID NO: 1342684 - RNA, 20 nt, Human
uagauuuggcuccucugcuu

SEQ ID NO: 1342685 - RNA, 24 nt, Human
uagauuuggcuccucugcuucuca

SEQ ID NO: 1342686 - RNA, 19 nt, Human
uagauuugugugcaucagg

SEQ ID NO: 1342687 - RNA, 22 nt, Human
uagauuugugugcaucaggcuu

SEQ ID NO: 1342688 - RNA, 20 nt, Human
uagauuugugugcaucaggc

SEQ ID NO: 1342689 - RNA, 16 nt, Human
uagauuuuaaucaaau

SEQ ID NO: 1342690 - RNA, 17 nt, Human
uagauaggccaugggca

SEQ ID NO: 1342691 - RNA, 19 nt, Human
uagauagcccuguccuggu

SEQ ID NO: 1342692 - RNA, 23 nt, Human
uagauagcccuguccugguggua

SEQ ID NO: 1342693 - RNA, 14 nt, Human
uagauaggccaugg

SEQ ID NO: 1342694 - RNA, 15 nt, Human
uagauagcccugucc

SEQ ID NO: 1342695 - RNA, 17 nt, Human
uagauagcccuguccug

SEQ ID NO: 1342696 - RNA, 12 nt, Human
uagaguugcuga

SEQ ID NO: 1342697 - RNA, 23 nt, Human
uagauacccuacgcuguccagaa

SEQ ID NO: 1342698 - RNA, 16 nt, Human
uagccccucuccugga

SEQ ID NO: 1342699 - RNA, 22 nt, Human
uagcccccugguaauagcugua

SEQ ID NO: 1342700 - RNA, 14 nt, Human
uagccccugaaagc

SEQ ID NO: 1342701 - RNA, 22 nt, Human
uagccccugggguggccaccag

SEQ ID NO: 1342702 - RNA, 22 nt, Human
uagccauauuuguaaaaugaca

SEQ ID NO: 1342703 - RNA, 21 nt, Human
uagcccccugguaauagcugu

SEQ ID NO: 1342704 - RNA, 22 nt, Human
uagccaguaauccuguaggaag

SEQ ID NO: 1342705 - RNA, 18 nt, Human
uagccaguaauccuguag

SEQ ID NO: 1342706 - RNA, 17 nt, Human
uagccaguaauccugua

SEQ ID NO: 1342707 - RNA, 16 nt, Human
uagccaguaauccugu

SEQ ID NO: 1342708 - RNA, 15 nt, Human
uagccaguaauccug

SEQ ID NO: 1342709 - RNA, 15 nt, Human
uagccauauuuguaa

SEQ ID NO: 1342710 - RNA, 17 nt, Human
uagccauauuuguaaaa

SEQ ID NO: 1342711 - RNA, 19 nt, Human
uagccauauuuguaaaaug

SEQ ID NO: 1342712 - RNA, 20 nt, Human
uagccauauuuguaaaauga

SEQ ID NO: 1342713 - RNA, 23 nt, Human
uagccauauuuguaaaaugacaa

SEQ ID NO: 1342714 - RNA, 23 nt, Human
uagccagccggggcgaguggcac

SEQ ID NO: 1342715 - RNA, 17 nt, Human
uagcaugcuuguugcaa

SEQ ID NO: 1342716 - RNA, 18 nt, Human
uagcaugcuuguugcaau

SEQ ID NO: 1342717 - RNA, 23 nt, Human
uagcaugcuuguugcaauugccu

SEQ ID NO: 1342718 - RNA, 19 nt, Human
uagcucuuugucagggagu

SEQ ID NO: 1342719 - RNA, 15 nt, Human
uagcugaauguuuuu

SEQ ID NO: 1342720 - RNA, 18 nt, Human
uagcugacaaaauacuug

SEQ ID NO: 1342721 - RNA, 18 nt, Human
uagcugaauguuuuucua

SEQ ID NO: 1342722 - RNA, 19 nt, Human
uagcugaauguuuuucuaa

SEQ ID NO: 1342723 - RNA, 11 nt, Human
uagcugagcuc

SEQ ID NO: 1342724 - RNA, 21 nt, Human
uagcugagcucacaaggcagc

SEQ ID NO: 1342725 - RNA, 14 nt, Human
uagcugaucaguuu

SEQ ID NO: 1342726 - RNA, 12 nt, Human
uagcugagcuca

SEQ ID NO: 1342727 - RNA, 20 nt, Human
uagccuaaggcuccuguuuu

SEQ ID NO: 1342728 - RNA, 21 nt, Human
uagccuaaggcuccuguuuug

SEQ ID NO: 1342729 - RNA, 11 nt, Human
uagccuggacc

SEQ ID NO: 1342730 - RNA, 17 nt, Human
uagccuggaccucugac

SEQ ID NO: 1342731 - RNA, 21 nt, Human
uagccuggaccucugacagca

SEQ ID NO: 1342732 - RNA, 23 nt, Human
uagccuggaccucugacagcagc

SEQ ID NO: 1342733 - RNA, 22 nt, Human
uagccuggaccucugacagcag

SEQ ID NO: 1342734 - RNA, 14 nt, Human
uagccuggcuuggg

SEQ ID NO: 1342735 - RNA, 11 nt, Human
uagccuggcua

SEQ ID NO: 1342736 - RNA, 11 nt, Human
uagccuguccu

SEQ ID NO: 1342737 - RNA, 12 nt, Human
uagccuguccug

SEQ ID NO: 1342738 - RNA, 13 nt, Human
uagccuguccugu

SEQ ID NO: 1342739 - RNA, 14 nt, Human
uagccuguccuguc

SEQ ID NO: 1342740 - RNA, 16 nt, Human
uagccuguccugucau

SEQ ID NO: 1342741 - RNA, 20 nt, Human
uagccuguccugucaucauc

SEQ ID NO: 1342742 - RNA, 13 nt, Human
uagaauaugccuu

SEQ ID NO: 1342743 - RNA, 21 nt, Human
uagaaucaaacauuuugaaag

SEQ ID NO: 1342744 - RNA, 22 nt, Human
uagaaucaaacauuuugaaagu

SEQ ID NO: 1342745 - RNA, 23 nt, Human
uagaauacaguuuugaguagagu

SEQ ID NO: 1342746 - RNA, 23 nt, Human
uagaauaccacaggaaccacaag

SEQ ID NO: 1342747 - RNA, 19 nt, Human
uagaauaaaggcaguuuuc

SEQ ID NO: 1342748 - RNA, 21 nt, Human
uagaauaaaggcaguuuucua

SEQ ID NO: 1342749 - RNA, 22 nt, Human
uagaauaaaggcaguuuucuaa

SEQ ID NO: 1342750 - RNA, 20 nt, Human
uacuugucuguuuuaaaaac

SEQ ID NO: 1342751 - RNA, 15 nt, Human
uacuugucuguuuua

SEQ ID NO: 1342752 - RNA, 14 nt, Human
uacuugucuguuuu

SEQ ID NO: 1342753 - RNA, 14 nt, Human
uacuuguuucagag

SEQ ID NO: 1342754 - RNA, 15 nt, Human
uacuuguuucagagu

SEQ ID NO: 1342755 - RNA, 18 nt, Human
uagaauuaacacaugauc

SEQ ID NO: 1342756 - RNA, 16 nt, Human
uagaauuaacacauga

SEQ ID NO: 1342757 - RNA, 15 nt, Human
uagaauuaacacaug

SEQ ID NO: 1342758 - RNA, 22 nt, Human
uagaauuauaacuguaaagaug

SEQ ID NO: 1342759 - RNA, 15 nt, Human
uagaauuaucuaauu

SEQ ID NO: 1342760 - RNA, 16 nt, Human
uagaauuaucuaauuu

SEQ ID NO: 1342761 - RNA, 19 nt, Human
uagaauuaucuaauuuaua

SEQ ID NO: 1342762 - RNA, 21 nt, Human
uagaauuaucuaauuuauaaa

SEQ ID NO: 1342763 - RNA, 22 nt, Human
uagaauuaucuaauuuauaaaa

SEQ ID NO: 1342764 - RNA, 23 nt, Human
uagaauuaucuaauuuauaaaaa

SEQ ID NO: 1342765 - RNA, 12 nt, Human
uagaauuauuua

SEQ ID NO: 1342766 - RNA, 15 nt, Human
uagaauuauuuaaac

SEQ ID NO: 1342767 - RNA, 16 nt, Human
uagaauuauuuaaaca

SEQ ID NO: 1342768 - RNA, 21 nt, Human
uagaauuauaacuggaaagaa

SEQ ID NO: 1342769 - RNA, 17 nt, Human
uagaauguaaaugucuc

SEQ ID NO: 1342770 - RNA, 18 nt, Human
uagaauguaaaugucuca

SEQ ID NO: 1342771 - RNA, 19 nt, Human
uagaaugugugucaauuua

SEQ ID NO: 1342772 - RNA, 16 nt, Human
uagaauguaaaugucu

SEQ ID NO: 1342773 - RNA, 15 nt, Human
uagaauguaaauguc

SEQ ID NO: 1342774 - RNA, 14 nt, Human
uagaauguaaaugu

SEQ ID NO: 1342775 - RNA, 18 nt, Human
uagaauguaaagcuuguc

SEQ ID NO: 1342776 - RNA, 15 nt, Human
uagaauguaaagcuu

SEQ ID NO: 1342777 - RNA, 17 nt, Human
uagaauguaaagcuugu

SEQ ID NO: 1342778 - RNA, 16 nt, Human
uagaaugauuucaugc

SEQ ID NO: 1342779 - RNA, 18 nt, Human
uagaaucccagcccccug

SEQ ID NO: 1342780 - RNA, 22 nt, Human
uagaaucccagcccccugacca

SEQ ID NO: 1342781 - RNA, 21 nt, Human
uagaaucccagcccccugacc

SEQ ID NO: 1342782 - RNA, 18 nt, Human
uagaaucugcaauucaaa

SEQ ID NO: 1342783 - RNA, 22 nt, Human
uagaaucugcaauucaaaaguu

SEQ ID NO: 1342784 - RNA, 12 nt, Human
uagaaugacagu

SEQ ID NO: 1342785 - RNA, 21 nt, Human
uagaaugauuucaugcuaucu

SEQ ID NO: 1342786 - RNA, 22 nt, Human
uagacucugucuaccuggucug

SEQ ID NO: 1342787 - RNA, 17 nt, Human
uagacucugucuaccug

SEQ ID NO: 1342788 - RNA, 17 nt, Human
uagacugugauucagaa

SEQ ID NO: 1342789 - RNA, 18 nt, Human
uagacugugauucagaaa

SEQ ID NO: 1342790 - RNA, 22 nt, Human
uagacuucaagcauggcuauuu

SEQ ID NO: 1342791 - RNA, 17 nt, Human
uagaccuuuucauuugu

SEQ ID NO: 1342792 - RNA, 23 nt, Human
uagacggagcccuggcaugucaa

SEQ ID NO: 1342793 - RNA, 17 nt, Human
uagaccuuguuacuucu

SEQ ID NO: 1342794 - RNA, 19 nt, Human
uagaccuuguuacuucuga

SEQ ID NO: 1342795 - RNA, 23 nt, Human
uagacuaaggccauuauuguacu

SEQ ID NO: 1342796 - RNA, 20 nt, Human
uagacccacuggacucaccu

SEQ ID NO: 1342797 - RNA, 12 nt, Human
uagaccaauaaa

SEQ ID NO: 1342798 - RNA, 10 nt, Human
uagaccaaua

SEQ ID NO: 1342799 - RNA, 15 nt, Human
uagaccaccaagccu

SEQ ID NO: 1342800 - RNA, 16 nt, Human
uagaccaccaagccuu

SEQ ID NO: 1342801 - RNA, 17 nt, Human
uagaccaccaagccuug

SEQ ID NO: 1342802 - RNA, 19 nt, Human
uagaccaccaagccuugau

SEQ ID NO: 1342803 - RNA, 19 nt, Human
uagaccagcagacagagcc

SEQ ID NO: 1342804 - RNA, 22 nt, Human
uagaccagcagacagagccagg

SEQ ID NO: 1342805 - RNA, 16 nt, Human
uagagaagcaaguaaa

SEQ ID NO: 1342806 - RNA, 13 nt, Human
uagagaagcaagu

SEQ ID NO: 1342807 - RNA, 13 nt, Human
uagagaaggaccc

SEQ ID NO: 1342808 - RNA, 15 nt, Human
uagagaagacaggcu

SEQ ID NO: 1342809 - RNA, 18 nt, Human
uagagaagacaggcugga

SEQ ID NO: 1342810 - RNA, 22 nt, Human
uagagaaggacccggaggggcc

SEQ ID NO: 1342811 - RNA, 19 nt, Human
uagagaaguauacauaagu

SEQ ID NO: 1342812 - RNA, 22 nt, Human
uagagucccagguuggcucugc

SEQ ID NO: 1342813 - RNA, 16 nt, Human
uagaggugagaaauuu

SEQ ID NO: 1342814 - RNA, 17 nt, Human
uagaggugagaaauuua

SEQ ID NO: 1342815 - RNA, 17 nt, Human
uagagucugaacagcug

SEQ ID NO: 1342816 - RNA, 15 nt, Human
uagagugucuuucca

SEQ ID NO: 1342817 - RNA, 21 nt, Human
uacauggcuggagcuagaauu

SEQ ID NO: 1342818 - RNA, 12 nt, Human
uacaugaaacag

SEQ ID NO: 1342819 - RNA, 13 nt, Human
uacaugaaacaga

SEQ ID NO: 1342820 - RNA, 14 nt, Human
uacaugaaacagaa

SEQ ID NO: 1342821 - RNA, 15 nt, Human
uacaugaaacagaaa

SEQ ID NO: 1342822 - RNA, 21 nt, Human
uacaugaaacagaaacaaaaa

SEQ ID NO: 1342823 - RNA, 21 nt, Human
uacaugcacuuggcugcauaa

SEQ ID NO: 1342824 - RNA, 14 nt, Human
uacaugcauacacu

SEQ ID NO: 1342825 - RNA, 20 nt, Human
uacaugcauacacucucaaa

SEQ ID NO: 1342826 - RNA, 21 nt, Human
uacaugcauacacucucaaag

SEQ ID NO: 1342827 - RNA, 20 nt, Human
uacaugcauuacugcaugca

SEQ ID NO: 1342828 - RNA, 22 nt, Human
uacaugcauugagcucucucau

SEQ ID NO: 1342829 - RNA, 17 nt, Human
uacaugcuaagagaagu

SEQ ID NO: 1342830 - RNA, 18 nt, Human
uacaugcuaagagaagua

SEQ ID NO: 1342831 - RNA, 19 nt, Human
uacaugcuaagagaaguag

SEQ ID NO: 1342832 - RNA, 12 nt, Human
uacaugcuuauu

SEQ ID NO: 1342833 - RNA, 15 nt, Human
uacaugcuuauucca

SEQ ID NO: 1342834 - RNA, 16 nt, Human
uacaugcuuauuccau

SEQ ID NO: 1342835 - RNA, 17 nt, Human
uacaugcuuauuccaug

SEQ ID NO: 1342836 - RNA, 20 nt, Human
uacaugcuuauuccaugacu

SEQ ID NO: 1342837 - RNA, 21 nt, Human
uacaugcuuauuccaugacug

SEQ ID NO: 1342838 - RNA, 23 nt, Human
uacaugcuuauuccaugacugcu

SEQ ID NO: 1342839 - RNA, 18 nt, Human
uacaguuuugaguagagu

SEQ ID NO: 1342840 - RNA, 13 nt, Human
uacauaacugaaa

SEQ ID NO: 1342841 - RNA, 15 nt, Human
uacauaacugaaaau

SEQ ID NO: 1342842 - RNA, 17 nt, Human
uacauaacugaaaaugu

SEQ ID NO: 1342843 - RNA, 21 nt, Human
uacauaacugaaaaugugcua

SEQ ID NO: 1342844 - RNA, 14 nt, Human
uacaguuuuaacug

SEQ ID NO: 1342845 - RNA, 15 nt, Human
uacaguuuuaacugu

SEQ ID NO: 1342846 - RNA, 17 nt, Human
uacaguuuuaacugugg

SEQ ID NO: 1342847 - RNA, 19 nt, Human
uacaguuuuaacuguggau

SEQ ID NO: 1342848 - RNA, 21 nt, Human
uacaguuuuaacuguggauau

SEQ ID NO: 1342849 - RNA, 20 nt, Human
uacaguuuuaacuguggaua

SEQ ID NO: 1342850 - RNA, 23 nt, Human
uacaguucggugagcuacaaaug

SEQ ID NO: 1342851 - RNA, 20 nt, Human
uacaggaugaugacuaugga

SEQ ID NO: 1342852 - RNA, 14 nt, Human
uacaggauuugaaa

SEQ ID NO: 1342853 - RNA, 13 nt, Human
uacaguucugcuc

SEQ ID NO: 1342854 - RNA, 20 nt, Human
uacaguucugcucugguugu

SEQ ID NO: 1342855 - RNA, 14 nt, Human
uacaguucuguggu

SEQ ID NO: 1342856 - RNA, 15 nt, Human
uacaguucugugguu

SEQ ID NO: 1342857 - RNA, 21 nt, Human
uacaguucugugguuucaugu

SEQ ID NO: 1342858 - RNA, 16 nt, Human
uacagcuaaucagcau

SEQ ID NO: 1342859 - RNA, 18 nt, Human
uacagcuaaucagcauuc

SEQ ID NO: 1342860 - RNA, 17 nt, Human
uacacuguguaaauacc

SEQ ID NO: 1342861 - RNA, 15 nt, Human
uacagcuggggugca

SEQ ID NO: 1342862 - RNA, 14 nt, Human
uacagcuguauugu

SEQ ID NO: 1342863 - RNA, 19 nt, Human
uacagcuguauugucugaa

SEQ ID NO: 1342864 - RNA, 18 nt, Human
uacagcuguauugucuga

SEQ ID NO: 1342865 - RNA, 13 nt, Human
uacagcugccugc

SEQ ID NO: 1342866 - RNA, 15 nt, Human
uacagcugagcuaug

SEQ ID NO: 1342867 - RNA, 14 nt, Human
uacagcugccugca

SEQ ID NO: 1342868 - RNA, 13 nt, Human
uacagcuggcucu

SEQ ID NO: 1342869 - RNA, 17 nt, Human
uacagcuggggugcagg

SEQ ID NO: 1342870 - RNA, 21 nt, Human
uacagcucagaaguuucuucu

SEQ ID NO: 1342871 - RNA, 15 nt, Human
uacaaccuccgccuc

SEQ ID NO: 1342872 - RNA, 16 nt, Human
uacaaccaauggaaug

SEQ ID NO: 1342873 - RNA, 13 nt, Human
uacaaauggauuu

SEQ ID NO: 1342874 - RNA, 17 nt, Human
uacaaauguuaaaaugu

SEQ ID NO: 1342875 - RNA, 18 nt, Human
uacaaauguuaaaaugug

SEQ ID NO: 1342876 - RNA, 23 nt, Human
uacaaauguuaaaauguguuguu

SEQ ID NO: 1342877 - RNA, 21 nt, Human
uacaaauguuaaaauguguug

SEQ ID NO: 1342878 - RNA, 22 nt, Human
uacaacggagucaaaaauuaaa

SEQ ID NO: 1342879 - RNA, 15 nt, Human
uacaacggagucaaa

SEQ ID NO: 1342880 - RNA, 17 nt, Human
uacaacucauacacucg

SEQ ID NO: 1342881 - RNA, 23 nt, Human
uacaacugccucgaaacacagaa

SEQ ID NO: 1342882 - RNA, 14 nt, Human
uacaagaagcauuu

SEQ ID NO: 1342883 - RNA, 15 nt, Human
uacaagaagcauuuu

SEQ ID NO: 1342884 - RNA, 17 nt, Human
uacacacggugccuuua

SEQ ID NO: 1342885 - RNA, 16 nt, Human
uacacacggugccuuu

SEQ ID NO: 1342886 - RNA, 13 nt, Human
uacacagucagcu

SEQ ID NO: 1342887 - RNA, 21 nt, Human
uacacauguaucuaugcauuu

SEQ ID NO: 1342888 - RNA, 21 nt, Human
uacacucucaaagcaaauaau

SEQ ID NO: 1342889 - RNA, 19 nt, Human
uacacucguaugauacuuc

SEQ ID NO: 1342890 - RNA, 13 nt, Human
uacacucugcugu

SEQ ID NO: 1342891 - RNA, 14 nt, Human
uacacucugcuguu

SEQ ID NO: 1342892 - RNA, 23 nt, Human
uacacucugcuguuugacaccuc

SEQ ID NO: 1342893 - RNA, 16 nt, Human
uacacucuuuguaaga

SEQ ID NO: 1342894 - RNA, 15 nt, Human
uacacucugcuguuu

SEQ ID NO: 1342895 - RNA, 20 nt, Human
uaauuccuucagcacuuuag

SEQ ID NO: 1342896 - RNA, 21 nt, Human
uaauuccuucagcacuuuaga

SEQ ID NO: 1342897 - RNA, 11 nt, Human
uaauucuaaau

SEQ ID NO: 1342898 - RNA, 18 nt, Human
uaauucuaaaugaauguu

SEQ ID NO: 1342899 - RNA, 15 nt, Human
uaauucuaugagaua

SEQ ID NO: 1342900 - RNA, 15 nt, Human
uaauucuaugccugu

SEQ ID NO: 1342901 - RNA, 23 nt, Human
uaauucuauuaaagugcuaaggu

SEQ ID NO: 1342902 - RNA, 19 nt, Human
uaauucucagaaaggcaag

SEQ ID NO: 1342903 - RNA, 14 nt, Human
uaauuccuucagca

SEQ ID NO: 1342904 - RNA, 14 nt, Human
uaauuagugccacu

SEQ ID NO: 1342905 - RNA, 19 nt, Human
uaauuagugccacuuaaug

SEQ ID NO: 1342906 - RNA, 21 nt, Human
uaauuagugccacuuaaugua

SEQ ID NO: 1342907 - RNA, 22 nt, Human
uaauuagugccacuuaauguau

SEQ ID NO: 1342908 - RNA, 18 nt, Human
uaauuuugugaagcaaaa

SEQ ID NO: 1342909 - RNA, 13 nt, Human
uaauuuuguguaa

SEQ ID NO: 1342910 - RNA, 19 nt, Human
uaauuuuguguaagaaaua

SEQ ID NO: 1342911 - RNA, 20 nt, Human
uaauuuuguguaagaaauac

SEQ ID NO: 1342912 - RNA, 12 nt, Human
uaauuuuuauau

SEQ ID NO: 1342913 - RNA, 16 nt, Human
uaauuuuuacagaauu

SEQ ID NO: 1342914 - RNA, 17 nt, Human
uaauuuuuacagaauug

SEQ ID NO: 1342915 - RNA, 16 nt, Human
uaauuuuuauauuuga

SEQ ID NO: 1342916 - RNA, 17 nt, Human
uaauuuuuauauuugaa

SEQ ID NO: 1342917 - RNA, 22 nt, Human
uaauuuuuacagaauugcuugu

SEQ ID NO: 1342918 - RNA, 19 nt, Human
uacaaagguuuaaaugaac

SEQ ID NO: 1342919 - RNA, 20 nt, Human
uacaaagguuuaaaugaaca

SEQ ID NO: 1342920 - RNA, 20 nt, Human
uacaaaguuucaauuuguuu

SEQ ID NO: 1342921 - RNA, 16 nt, Human
uacaaaucaaguauuu

SEQ ID NO: 1342922 - RNA, 16 nt, Human
uacaaaucagaaguca

SEQ ID NO: 1342923 - RNA, 17 nt, Human
uacaaaucagaagucau

SEQ ID NO: 1342924 - RNA, 19 nt, Human
uacaaaucagaagucaucu

SEQ ID NO: 1342925 - RNA, 20 nt, Human
uacaaaucagaagucaucuu

SEQ ID NO: 1342926 - RNA, 21 nt, Human
uacaaaucagaagucaucuug

SEQ ID NO: 1342927 - RNA, 22 nt, Human
uacaaaucagaagucaucuugc

SEQ ID NO: 1342928 - RNA, 12 nt, Human
uacaaaugaaaa

SEQ ID NO: 1342929 - RNA, 15 nt, Human
uacaaagguuuaaau

SEQ ID NO: 1342930 - RNA, 16 nt, Human
uacaaagguuuaaaug

SEQ ID NO: 1342931 - RNA, 17 nt, Human
uacaaagguuuaaauga

SEQ ID NO: 1342932 - RNA, 18 nt, Human
uacaaagguuuaaaugaa

SEQ ID NO: 1342933 - RNA, 19 nt, Human
uacaaacugaagaguaauc

SEQ ID NO: 1342934 - RNA, 19 nt, Human
uacaaacucccacuuguca

SEQ ID NO: 1342935 - RNA, 15 nt, Human
uacaaacugaagagu

SEQ ID NO: 1342936 - RNA, 16 nt, Human
uacaaagauucucuau

SEQ ID NO: 1342937 - RNA, 17 nt, Human
uacaaagcccuuuuaua

SEQ ID NO: 1342938 - RNA, 18 nt, Human
uacaaaggcuuauuaauu

SEQ ID NO: 1342939 - RNA, 14 nt, Human
uacaaagguuuaaa

SEQ ID NO: 1342940 - RNA, 22 nt, Human
uaccaaaaaucucaauauuuca

SEQ ID NO: 1342941 - RNA, 20 nt, Human
uacauuuuuugggcagcaau

SEQ ID NO: 1342942 - RNA, 15 nt, Human
uaccaaaaauaaaua

SEQ ID NO: 1342943 - RNA, 20 nt, Human
uaccguaggcuuuguauuca

SEQ ID NO: 1342944 - RNA, 22 nt, Human
uaccgagucucuucuccacugg

SEQ ID NO: 1342945 - RNA, 19 nt, Human
uaccgcgucuacccuggga

SEQ ID NO: 1342946 - RNA, 20 nt, Human
uaccgaguucaagugauuuu

SEQ ID NO: 1342947 - RNA, 22 nt, Human
uaccuaacgaaguauccuucag

SEQ ID NO: 1342948 - RNA, 14 nt, Human
uaccgaaugugucu

SEQ ID NO: 1342949 - RNA, 15 nt, Human
uaccgaaugugucuu

SEQ ID NO: 1342950 - RNA, 17 nt, Human
uaccgagucucuucucc

SEQ ID NO: 1342951 - RNA, 17 nt, Human
uaccgaaugugucuuua

SEQ ID NO: 1342952 - RNA, 16 nt, Human
uaccgaaugugucuuu

SEQ ID NO: 1342953 - RNA, 18 nt, Human
uaccgagucucuucucca

SEQ ID NO: 1342954 - RNA, 21 nt, Human
uaccgagucucuucuccacug

SEQ ID NO: 1342955 - RNA, 17 nt, Human
uaccuaagauuacaaau

SEQ ID NO: 1342956 - RNA, 20 nt, Human
uaccuaagauuacaaaucag

SEQ ID NO: 1342957 - RNA, 22 nt, Human
uaccuaagauuacaaaucagaa

SEQ ID NO: 1342958 - RNA, 17 nt, Human
uaccuaagaaguacauu

SEQ ID NO: 1342959 - RNA, 13 nt, Human
uaccuacuuugac

SEQ ID NO: 1342960 - RNA, 14 nt, Human
uaccuacuuugacu

SEQ ID NO: 1342961 - RNA, 21 nt, Human
uaccuacuuugacuuuuugca

SEQ ID NO: 1342962 - RNA, 18 nt, Human
uaccuagauuuaauauaa

SEQ ID NO: 1342963 - RNA, 22 nt, Human
uaccuagcgggauggggcuccc

SEQ ID NO: 1342964 - RNA, 15 nt, Human
uaccuagcuggcucu

SEQ ID NO: 1342965 - RNA, 21 nt, Human
uaccucaauuuucacuguguc

SEQ ID NO: 1342966 - RNA, 20 nt, Human
uaccucaauuuucacugugu

SEQ ID NO: 1342967 - RNA, 18 nt, Human
uaccucaauuuucacugu

SEQ ID NO: 1342968 - RNA, 11 nt, Human
uaccucagccu

SEQ ID NO: 1342969 - RNA, 13 nt, Human
uaccucagccugg

SEQ ID NO: 1342970 - RNA, 21 nt, Human
uaccuaucccaccuccauccc

SEQ ID NO: 1342971 - RNA, 14 nt, Human
uaccucagccuggg

SEQ ID NO: 1342972 - RNA, 15 nt, Human
uaccucagccugggc

SEQ ID NO: 1342973 - RNA, 21 nt, Human
uaccucagccugggcgcuggu

SEQ ID NO: 1342974 - RNA, 14 nt, Human
uaccucaggcagcu

SEQ ID NO: 1342975 - RNA, 16 nt, Human
uaccucaggcagcuca

SEQ ID NO: 1342976 - RNA, 17 nt, Human
uaccucaggcagcucaa

SEQ ID NO: 1342977 - RNA, 18 nt, Human
uaccucaggcagcucaag

SEQ ID NO: 1342978 - RNA, 17 nt, Human
uaccucagccugggcgc

SEQ ID NO: 1342979 - RNA, 22 nt, Human
uacgaaccuacaguuuuaacug

SEQ ID NO: 1342980 - RNA, 18 nt, Human
uacuaaagccaaacauau

SEQ ID NO: 1342981 - RNA, 23 nt, Human
uacuaacaaucagcuccuuccug

SEQ ID NO: 1342982 - RNA, 14 nt, Human
uacuaaagccaaac

SEQ ID NO: 1342983 - RNA, 20 nt, Human
uacuaagcauugaauggcua

SEQ ID NO: 1342984 - RNA, 19 nt, Human
uacuaaggaagauuacuca

SEQ ID NO: 1342985 - RNA, 16 nt, Human
uacuaaggacguuguu

SEQ ID NO: 1342986 - RNA, 16 nt, Human
uacgaaauaauuguug

SEQ ID NO: 1342987 - RNA, 17 nt, Human
uacgaaauaauuguugu

SEQ ID NO: 1342988 - RNA, 22 nt, Human
uacgaaauaauuguuguucugu

SEQ ID NO: 1342989 - RNA, 20 nt, Human
uacgaaauaauuguuguucu

SEQ ID NO: 1342990 - RNA, 20 nt, Human
uaccuuuuuauuugcaugug

SEQ ID NO: 1342991 - RNA, 23 nt, Human
uaccucuccagccucagcucuca

SEQ ID NO: 1342992 - RNA, 15 nt, Human
uaccucuauauacca

SEQ ID NO: 1342993 - RNA, 16 nt, Human
uaccucuauauaccaa

SEQ ID NO: 1342994 - RNA, 19 nt, Human
uaccucuaauaguauaaac

SEQ ID NO: 1342995 - RNA, 18 nt, Human
uaccucuaauaguauaaa

SEQ ID NO: 1342996 - RNA, 17 nt, Human
uaccucuaauaguauaa

SEQ ID NO: 1342997 - RNA, 16 nt, Human
uaccucuaauaguaua

SEQ ID NO: 1342998 - RNA, 13 nt, Human
uaccuccugagaa

SEQ ID NO: 1342999 - RNA, 14 nt, Human
uaccuccugagaaa

SEQ ID NO: 1343000 - RNA, 21 nt, Human
uaccuuuugaggagccccagc

SEQ ID NO: 1343001 - RNA, 22 nt, Human
uaccuuagugcaguuauuugcu

SEQ ID NO: 1343002 - RNA, 18 nt, Human
uaccuuauaguuacugug

SEQ ID NO: 1343003 - RNA, 16 nt, Human
uaccuuauaguuacug

SEQ ID NO: 1343004 - RNA, 17 nt, Human
uaccuuauaguuacugu

SEQ ID NO: 1343005 - RNA, 20 nt, Human
uaccuuagugcaguuauuug

SEQ ID NO: 1343006 - RNA, 19 nt, Human
uaccuuagugcaguuauuu

SEQ ID NO: 1343007 - RNA, 18 nt, Human
uaccuuagugcaguuauu

SEQ ID NO: 1343008 - RNA, 17 nt, Human
uaccuuagugcaguuau

SEQ ID NO: 1343009 - RNA, 16 nt, Human
uaccuuagugcaguua

SEQ ID NO: 1343010 - RNA, 14 nt, Human
uaccuuagugcagu

SEQ ID NO: 1343011 - RNA, 15 nt, Human
uacugcucuccucca

SEQ ID NO: 1343012 - RNA, 12 nt, Human
uacugcucugag

SEQ ID NO: 1343013 - RNA, 13 nt, Human
uacugcucugaga

SEQ ID NO: 1343014 - RNA, 14 nt, Human
uacugcucugagaa

SEQ ID NO: 1343015 - RNA, 20 nt, Human
uacugcuacagcaauuucua

SEQ ID NO: 1343016 - RNA, 12 nt, Human
uacugcgacuuu

SEQ ID NO: 1343017 - RNA, 16 nt, Human
uacugcgacuuucugc

SEQ ID NO: 1343018 - RNA, 17 nt, Human
uacugcgacuuucugcc

SEQ ID NO: 1343019 - RNA, 18 nt, Human
uacugcgacuuucugccu

SEQ ID NO: 1343020 - RNA, 19 nt, Human
uacugcgacuuucugccug

SEQ ID NO: 1343021 - RNA, 20 nt, Human
uacugcgacuuucugccugg

SEQ ID NO: 1343022 - RNA, 21 nt, Human
uacugcgacuuucugccugga

SEQ ID NO: 1343023 - RNA, 22 nt, Human
uacugcgacuuucugccuggag

SEQ ID NO: 1343024 - RNA, 20 nt, Human
uacugcuuaauucaaauaau

SEQ ID NO: 1343025 - RNA, 19 nt, Human
uacugcuuaauucaaauaa

SEQ ID NO: 1343026 - RNA, 13 nt, Human
uacugcuuaauuc

SEQ ID NO: 1343027 - RNA, 20 nt, Human
uacugcugagauacauacag

SEQ ID NO: 1343028 - RNA, 21 nt, Human
uacugcugagauacauacaga

SEQ ID NO: 1343029 - RNA, 24 nt, Human
uacugcuuggagcugagcaaauca

SEQ ID NO: 1343030 - RNA, 19 nt, Human
uacugcuuggagcugagca

SEQ ID NO: 1343031 - RNA, 14 nt, Human
uacuggaaagcuuu

SEQ ID NO: 1343032 - RNA, 18 nt, Human
uacuggaaauuaggggau

SEQ ID NO: 1343033 - RNA, 23 nt, Human
uacugucauccucaaagaaagug

SEQ ID NO: 1343034 - RNA, 22 nt, Human
uacugugugugugaaugaacac

SEQ ID NO: 1343035 - RNA, 23 nt, Human
uacugugugugugaaugaacacu

SEQ ID NO: 1343036 - RNA, 15 nt, Human
uacuguguuaugcaa

SEQ ID NO: 1343037 - RNA, 16 nt, Human
uacuguguuaugcaaa

SEQ ID NO: 1343038 - RNA, 17 nt, Human
uacuguguuaugcaaaa

SEQ ID NO: 1343039 - RNA, 22 nt, Human
uacuguguuaugcaaaagcaag

SEQ ID NO: 1343040 - RNA, 19 nt, Human
uacuugcucuugaugccug

SEQ ID NO: 1343041 - RNA, 18 nt, Human
uacuugcucuugaugccu

SEQ ID NO: 1343042 - RNA, 14 nt, Human
uacuugcucuugau

SEQ ID NO: 1343043 - RNA, 13 nt, Human
uacuugcucuuga

SEQ ID NO: 1343044 - RNA, 20 nt, Human
uacuugcucuugaugccugg

SEQ ID NO: 1343045 - RNA, 18 nt, Human
uacuugaagggccagagc

SEQ ID NO: 1343046 - RNA, 19 nt, Human
uacuugaagggccagagcc

SEQ ID NO: 1343047 - RNA, 20 nt, Human
uacuugaagggccagagcca

SEQ ID NO: 1343048 - RNA, 19 nt, Human
uacuuguaaauauaaagac

SEQ ID NO: 1343049 - RNA, 20 nt, Human
uacuuguaaauauaaagacg

SEQ ID NO: 1343050 - RNA, 12 nt, Human
uacuuguaauua

SEQ ID NO: 1343051 - RNA, 13 nt, Human
uacuuguaauuau

SEQ ID NO: 1343052 - RNA, 15 nt, Human
uacuuguaauuaugg

SEQ ID NO: 1343053 - RNA, 13 nt, Human
uacuugucuguuu

SEQ ID NO: 1343054 - RNA, 14 nt, Human
uacuuguaauuaug

SEQ ID NO: 1343055 - RNA, 19 nt, Human
uacuguuuauuaaaguaca

SEQ ID NO: 1343056 - RNA, 16 nt, Human
uacuugaacguuuucu

SEQ ID NO: 1343057 - RNA, 18 nt, Human
uacuugaacguuuucuaa

SEQ ID NO: 1343058 - RNA, 19 nt, Human
uacuugaacguuuucuaau

SEQ ID NO: 1343059 - RNA, 20 nt, Human
uacuugaacguuuucuaauu

SEQ ID NO: 1343060 - RNA, 21 nt, Human
uacuugaacguuuucuaauug

SEQ ID NO: 1343061 - RNA, 23 nt, Human
uacuugaacguuuucuaauugcu

SEQ ID NO: 1343062 - RNA, 24 nt, Human
uacuugaacguuuucuaauugcuu

SEQ ID NO: 1343063 - RNA, 11 nt, Human
uacuugaaggg

SEQ ID NO: 1343064 - RNA, 12 nt, Human
uacuugaagggc

SEQ ID NO: 1343065 - RNA, 14 nt, Human
uacuugaagggcca

SEQ ID NO: 1343066 - RNA, 15 nt, Human
uacuugaagggccag

SEQ ID NO: 1343067 - RNA, 16 nt, Human
uacuugaagggccaga

SEQ ID NO: 1343068 - RNA, 17 nt, Human
uacuugaagggccagag

SEQ ID NO: 1343069 - RNA, 21 nt, Human
uacugccuauuuuaauaaaca

SEQ ID NO: 1343070 - RNA, 10 nt, Human
uacugccugc

SEQ ID NO: 1343071 - RNA, 11 nt, Human
uacugccugcu

SEQ ID NO: 1343072 - RNA, 12 nt, Human
uacugccugcuu

SEQ ID NO: 1343073 - RNA, 14 nt, Human
uacugccugcuugg

SEQ ID NO: 1343074 - RNA, 16 nt, Human
uacugccugcuugggg

SEQ ID NO: 1343075 - RNA, 14 nt, Human
uacugccuauuuua

SEQ ID NO: 1343076 - RNA, 20 nt, Human
uacugccauucacuucauaa

SEQ ID NO: 1343077 - RNA, 22 nt, Human
uacugccgucagugcugugcug

SEQ ID NO: 1343078 - RNA, 19 nt, Human
uacugcccaggccugccug

SEQ ID NO: 1343079 - RNA, 20 nt, Human
uacugcccaggccugccugu

SEQ ID NO: 1343080 - RNA, 21 nt, Human
uacugcccaggccugccuguu

SEQ ID NO: 1343081 - RNA, 22 nt, Human
uacugcccaggccugccuguuc

SEQ ID NO: 1343082 - RNA, 17 nt, Human
uacuccuaugaucugag

SEQ ID NO: 1343083 - RNA, 13 nt, Human
uacucuaagaucu

SEQ ID NO: 1343084 - RNA, 15 nt, Human
uacucuaagaucuua

SEQ ID NO: 1343085 - RNA, 18 nt, Human
uacucuaagaucuuagau

SEQ ID NO: 1343086 - RNA, 20 nt, Human
uacucuaagaucuuagauuc

SEQ ID NO: 1343087 - RNA, 21 nt, Human
uacucuaagaucuuagauucu

SEQ ID NO: 1343088 - RNA, 22 nt, Human
uacucuaagaucuuagauucuc

SEQ ID NO: 1343089 - RNA, 16 nt, Human
uacugcaaaaagaaaa

SEQ ID NO: 1343090 - RNA, 14 nt, Human
uacugcaaaucagg

SEQ ID NO: 1343091 - RNA, 21 nt, Human
uacugcaaaucaggcuuuugu

SEQ ID NO: 1343092 - RNA, 23 nt, Human
uacugcaaaucaggcuuuuguuu

SEQ ID NO: 1343093 - RNA, 16 nt, Human
uacugcauuauuugag

SEQ ID NO: 1343094 - RNA, 13 nt, Human
uacugcaugcacu

SEQ ID NO: 1343095 - RNA, 22 nt, Human
uacugcaaaucaggcuuuuguu

SEQ ID NO: 1343096 - RNA, 21 nt, Human
uacugcaagguucaacuuauu

SEQ ID NO: 1343097 - RNA, 12 nt, Human
uacugcagccuc

SEQ ID NO: 1343098 - RNA, 17 nt, Human
uacugcagccuccagag

SEQ ID NO: 1343099 - RNA, 12 nt, Human
uacuccucccag

SEQ ID NO: 1343100 - RNA, 19 nt, Human
uacuccuaugaucugaguc

SEQ ID NO: 1343101 - RNA, 13 nt, Human
uacucccaggcac

SEQ ID NO: 1343102 - RNA, 14 nt, Human
uacucccucucagg

SEQ ID NO: 1343103 - RNA, 22 nt, Human
uacuccaaaacuucguuuaaug

SEQ ID NO: 1343104 - RNA, 19 nt, Human
uacuccaaaacuucguuua

SEQ ID NO: 1343105 - RNA, 13 nt, Human
uacuccacacugc

SEQ ID NO: 1343106 - RNA, 14 nt, Human
uacuccacacugca

SEQ ID NO: 1343107 - RNA, 11 nt, Human
uacucauuuuu

SEQ ID NO: 1343108 - RNA, 14 nt, Human
uacucauuuuucau

SEQ ID NO: 1343109 - RNA, 16 nt, Human
uacucauuuuucauga

SEQ ID NO: 1343110 - RNA, 17 nt, Human
uacuccacacugcacaa

SEQ ID NO: 1343111 - RNA, 20 nt, Human
uacucccaggcacugucuua

SEQ ID NO: 1343112 - RNA, 16 nt, Human
uacuaauuccacaccu

SEQ ID NO: 1343113 - RNA, 13 nt, Human
uacuaaugaaaac

SEQ ID NO: 1343114 - RNA, 16 nt, Human
uacuaaugaaaacaga

SEQ ID NO: 1343115 - RNA, 13 nt, Human
uacuaauuccaca

SEQ ID NO: 1343116 - RNA, 12 nt, Human
uaaguccagugu

SEQ ID NO: 1343117 - RNA, 13 nt, Human
uaagucagaacag

SEQ ID NO: 1343118 - RNA, 14 nt, Human
uaaguccaguccag

SEQ ID NO: 1343119 - RNA, 22 nt, Human
uaaguccaguccaguccuaucu

SEQ ID NO: 1343120 - RNA, 13 nt, Human
uaagugaaauaag

SEQ ID NO: 1343121 - RNA, 15 nt, Human
uaagugaaaaacaug

SEQ ID NO: 1343122 - RNA, 15 nt, Human
uaagugaaaauauag

SEQ ID NO: 1343123 - RNA, 22 nt, Human
uaagugauugcugguuuuaguu

SEQ ID NO: 1343124 - RNA, 18 nt, Human
uaagugaacacccaugaa

SEQ ID NO: 1343125 - RNA, 16 nt, Human
uaagugcccucuccca

SEQ ID NO: 1343126 - RNA, 14 nt, Human
uaagugcccucucc

SEQ ID NO: 1343127 - RNA, 15 nt, Human
uaagugcccucuccc

SEQ ID NO: 1343128 - RNA, 21 nt, Human
uaagugcccucucccacccuc

SEQ ID NO: 1343129 - RNA, 16 nt, Human
uaagugauuguaugaa

SEQ ID NO: 1343130 - RNA, 20 nt, Human
uaauaaaggacuguaaucuu

SEQ ID NO: 1343131 - RNA, 16 nt, Human
uaauaaaggacuguaa

SEQ ID NO: 1343132 - RNA, 13 nt, Human
uaauaaaggacug

SEQ ID NO: 1343133 - RNA, 12 nt, Human
uaauaaaggacu

SEQ ID NO: 1343134 - RNA, 12 nt, Human
uaauaaagcugu

SEQ ID NO: 1343135 - RNA, 15 nt, Human
uaaguggugugugua

SEQ ID NO: 1343136 - RNA, 16 nt, Human
uaagugguguguguau

SEQ ID NO: 1343137 - RNA, 14 nt, Human
uaaguguacauaug

SEQ ID NO: 1343138 - RNA, 18 nt, Human
uaaguguacauaugugcu

SEQ ID NO: 1343139 - RNA, 14 nt, Human
uaaggcaaucaugg

SEQ ID NO: 1343140 - RNA, 19 nt, Human
uaaggcucuaugagucuag

SEQ ID NO: 1343141 - RNA, 22 nt, Human
uaaggcucuaugagucuagaug

SEQ ID NO: 1343142 - RNA, 14 nt, Human
uaaggcucugagag

SEQ ID NO: 1343143 - RNA, 15 nt, Human
uaaggcucugagagu

SEQ ID NO: 1343144 - RNA, 20 nt, Human
uaaggcaacaaaagaagccc

SEQ ID NO: 1343145 - RNA, 19 nt, Human
uaaggcucugagagucuag

SEQ ID NO: 1343146 - RNA, 22 nt, Human
uaaggcucugagagucuagauu

SEQ ID NO: 1343147 - RNA, 24 nt, Human
uaaggcucugagagucuagauucu

SEQ ID NO: 1343148 - RNA, 13 nt, Human
uaaggcuguguaa

SEQ ID NO: 1343149 - RNA, 16 nt, Human
uaaggcuguguaagau

SEQ ID NO: 1343150 - RNA, 22 nt, Human
uaaggcuguguaagauuuguuu

SEQ ID NO: 1343151 - RNA, 18 nt, Human
uaagcccagugcacugaa

SEQ ID NO: 1343152 - RNA, 16 nt, Human
uaagccuaaaaguggg

SEQ ID NO: 1343153 - RNA, 19 nt, Human
uaaggggaggaaccagagu

SEQ ID NO: 1343154 - RNA, 19 nt, Human
uaagggccagaaauaucuu

SEQ ID NO: 1343155 - RNA, 14 nt, Human
uaagggcacugacg

SEQ ID NO: 1343156 - RNA, 16 nt, Human
uaagggcccaggucag

SEQ ID NO: 1343157 - RNA, 22 nt, Human
uaagggaaguaguuaucauguu

SEQ ID NO: 1343158 - RNA, 19 nt, Human
uaagggaaguaguuaucau

SEQ ID NO: 1343159 - RNA, 13 nt, Human
uaagggaagaauu

SEQ ID NO: 1343160 - RNA, 13 nt, Human
uaagggguggggc

SEQ ID NO: 1343161 - RNA, 16 nt, Human
uaagggugacaaaugg

SEQ ID NO: 1343162 - RNA, 17 nt, Human
uaagggucgaaagcucu

SEQ ID NO: 1343163 - RNA, 18 nt, Human
uaagguacaagaagcauu

SEQ ID NO: 1343164 - RNA, 19 nt, Human
uaagguacaagaagcauuu

SEQ ID NO: 1343165 - RNA, 17 nt, Human
uaagguccgguguucua

SEQ ID NO: 1343166 - RNA, 18 nt, Human
uaagguccgguguucuaa

SEQ ID NO: 1343167 - RNA, 20 nt, Human
uaagguccgguguucuaaga

SEQ ID NO: 1343168 - RNA, 21 nt, Human
uaagguccgguguucuaagau

SEQ ID NO: 1343169 - RNA, 21 nt, Human
uaaggugcucucuuucugucu

SEQ ID NO: 1343170 - RNA, 13 nt, Human
uaagguguagcca

SEQ ID NO: 1343171 - RNA, 19 nt, Human
uaagguguagccacaccag

SEQ ID NO: 1343172 - RNA, 21 nt, Human
uaagguguagccacaccagga

SEQ ID NO: 1343173 - RNA, 16 nt, Human
uaagucaacuuagcau

SEQ ID NO: 1343174 - RNA, 17 nt, Human
uaagucaacaguaaacc

SEQ ID NO: 1343175 - RNA, 14 nt, Human
uaagucagaacagc

SEQ ID NO: 1343176 - RNA, 14 nt, Human
uaagucaacaguaa

SEQ ID NO: 1343177 - RNA, 15 nt, Human
uaagucaacaguaaa

SEQ ID NO: 1343178 - RNA, 16 nt, Human
uaagucaacaguaaac

SEQ ID NO: 1343179 - RNA, 15 nt, Human
uaagucaaccugccu

SEQ ID NO: 1343180 - RNA, 17 nt, Human
uaagucaaccugccuga

SEQ ID NO: 1343181 - RNA, 20 nt, Human
uaaguauuuuccuguuguca

SEQ ID NO: 1343182 - RNA, 21 nt, Human
uaaguauuuuccuguugucaa

SEQ ID NO: 1343183 - RNA, 14 nt, Human
uaauaauguuucaa

SEQ ID NO: 1343184 - RNA, 20 nt, Human
uaauaaucucacauauacaa

SEQ ID NO: 1343185 - RNA, 23 nt, Human
uaauaucccacugggagaaagga

SEQ ID NO: 1343186 - RNA, 17 nt, Human
uaauaucccuacaugua

SEQ ID NO: 1343187 - RNA, 18 nt, Human
uaauaucccuacauguau

SEQ ID NO: 1343188 - RNA, 12 nt, Human
uaauauccuaaa

SEQ ID NO: 1343189 - RNA, 14 nt, Human
uaauauccuaaaca

SEQ ID NO: 1343190 - RNA, 17 nt, Human
uaauauccuaaacauca

SEQ ID NO: 1343191 - RNA, 15 nt, Human
uaauauccuaaacau

SEQ ID NO: 1343192 - RNA, 22 nt, Human
uaauauggccacaguagucuug

SEQ ID NO: 1343193 - RNA, 18 nt, Human
uaauaugcuuaaaauaag

SEQ ID NO: 1343194 - RNA, 14 nt, Human
uaauccccuucucc

SEQ ID NO: 1343195 - RNA, 15 nt, Human
uaauccccuucuccc

SEQ ID NO: 1343196 - RNA, 17 nt, Human
uaauccccuucuccccu

SEQ ID NO: 1343197 - RNA, 18 nt, Human
uaauccccuucuccccug

SEQ ID NO: 1343198 - RNA, 21 nt, Human
uaauccccuucuccccugcac

SEQ ID NO: 1343199 - RNA, 13 nt, Human
uaaucccugcuuu

SEQ ID NO: 1343200 - RNA, 14 nt, Human
uaaucccugcuuuu

SEQ ID NO: 1343201 - RNA, 17 nt, Human
uaaucccugcuuuuugu

SEQ ID NO: 1343202 - RNA, 21 nt, Human
uaaucccugcuuuuuguguuu

SEQ ID NO: 1343203 - RNA, 19 nt, Human
uaauccgaaucucuuuuug

SEQ ID NO: 1343204 - RNA, 21 nt, Human
uaauccgaaucucuuuuugcu

SEQ ID NO: 1343205 - RNA, 16 nt, Human
uaauccgccaauauua

SEQ ID NO: 1343206 - RNA, 15 nt, Human
uaaucuggacuccuc

SEQ ID NO: 1343207 - RNA, 13 nt, Human
uaaucugccuccc

SEQ ID NO: 1343208 - RNA, 17 nt, Human
uaaucuggacuccucug

SEQ ID NO: 1343209 - RNA, 18 nt, Human
uaaucuggacuccucugu

SEQ ID NO: 1343210 - RNA, 18 nt, Human
uaauccgccaauauuagu

SEQ ID NO: 1343211 - RNA, 14 nt, Human
uaaucuagaacaca

SEQ ID NO: 1343212 - RNA, 22 nt, Human
uaaucuagaacacaggcaaaau

SEQ ID NO: 1343213 - RNA, 17 nt, Human
uaaucuagauaucgacu

SEQ ID NO: 1343214 - RNA, 22 nt, Human
uaaucuagauaucgacuuguuu

SEQ ID NO: 1343215 - RNA, 19 nt, Human
uaaucuggacuccucuguc

SEQ ID NO: 1343216 - RNA, 20 nt, Human
uaaucuggacuccucugucc

SEQ ID NO: 1343217 - RNA, 21 nt, Human
uaaucuggacuccucugucca

SEQ ID NO: 1343218 - RNA, 22 nt, Human
uaaucuggacuccucuguccag

SEQ ID NO: 1343219 - RNA, 18 nt, Human
uaaucugggccagaauuu

SEQ ID NO: 1343220 - RNA, 23 nt, Human
uaaucugggccagaauuucaaac

SEQ ID NO: 1343221 - RNA, 15 nt, Human
uaaucugccucccuc

SEQ ID NO: 1343222 - RNA, 17 nt, Human
uaaugauaacuggaaac

SEQ ID NO: 1343223 - RNA, 22 nt, Human
uaaugauaacuggaaacuucag

SEQ ID NO: 1343224 - RNA, 23 nt, Human
uaaugauaacuggaaacuucagc

SEQ ID NO: 1343225 - RNA, 17 nt, Human
uaauggcaugagaaaua

SEQ ID NO: 1343226 - RNA, 21 nt, Human
uaauggcugauaauuuuaaau

SEQ ID NO: 1343227 - RNA, 15 nt, Human
uaauggcaguuauau

SEQ ID NO: 1343228 - RNA, 21 nt, Human
uaauggcaguuauauuuugca

SEQ ID NO: 1343229 - RNA, 15 nt, Human
uaauggcaugagaaa

SEQ ID NO: 1343230 - RNA, 15 nt, Human
uaaugcuuugaaauu

SEQ ID NO: 1343231 - RNA, 22 nt, Human
uaauguuuuuugccacagcuuu

SEQ ID NO: 1343232 - RNA, 16 nt, Human
uaauguuugcauauaa

SEQ ID NO: 1343233 - RNA, 21 nt, Human
uaauguuuuuugccacagcuu

SEQ ID NO: 1343234 - RNA, 23 nt, Human
uaauguuuuuugccacagcuuuu

SEQ ID NO: 1343235 - RNA, 15 nt, Human
uaauguuugcauaua

SEQ ID NO: 1343236 - RNA, 14 nt, Human
uaauguuugcauau

SEQ ID NO: 1343237 - RNA, 22 nt, Human
uaauguuucuggauuucauacu

SEQ ID NO: 1343238 - RNA, 15 nt, Human
uaaugggauuuucuu

SEQ ID NO: 1343239 - RNA, 22 nt, Human
uaauggcugauaauuuuaaauu

SEQ ID NO: 1343240 - RNA, 19 nt, Human
uaaugguacugacuuugcu

SEQ ID NO: 1343241 - RNA, 23 nt, Human
uaaugguacugacuuugcuugcu

SEQ ID NO: 1343242 - RNA, 21 nt, Human
uaauguuggguagaaagagau

SEQ ID NO: 1343243 - RNA, 20 nt, Human
uaauguuguaugucuuguuu

SEQ ID NO: 1343244 - RNA, 21 nt, Human
uaauguuguaugucuuguuua

SEQ ID NO: 1343245 - RNA, 21 nt, Human
uaauguuggacaccuuuaggu

SEQ ID NO: 1343246 - RNA, 14 nt, Human
uaauguuguuauuu

SEQ ID NO: 1343247 - RNA, 18 nt, Human
uaauguuguuauuuaaag

SEQ ID NO: 1343248 - RNA, 22 nt, Human
uaauguuucaaacauauauaac

SEQ ID NO: 1343249 - RNA, 13 nt, Human
uaaauucuuucau

SEQ ID NO: 1343250 - RNA, 20 nt, Human
uaaauugacacuuaaaaaug

SEQ ID NO: 1343251 - RNA, 23 nt, Human
uaaauugacacuuaaaaaugguu

SEQ ID NO: 1343252 - RNA, 15 nt, Human
uaaauuuauuuucuu

SEQ ID NO: 1343253 - RNA, 20 nt, Human
uaaauuucuauuuuuaucug

SEQ ID NO: 1343254 - RNA, 17 nt, Human
uaaauuugacuuuucug

SEQ ID NO: 1343255 - RNA, 19 nt, Human
uaaauuugacuuuucugua

SEQ ID NO: 1343256 - RNA, 18 nt, Human
uaaauuugacuuuucugu

SEQ ID NO: 1343257 - RNA, 13 nt, Human
uaacacuaauaua

SEQ ID NO: 1343258 - RNA, 16 nt, Human
uaacacuaauauauuu

SEQ ID NO: 1343259 - RNA, 20 nt, Human
uaacacuaauauauuuaaaa

SEQ ID NO: 1343260 - RNA, 22 nt, Human
uaacacuaauauauuuaaaaau

SEQ ID NO: 1343261 - RNA, 23 nt, Human
uaacacuaauauauuuaaaaaua

SEQ ID NO: 1343262 - RNA, 14 nt, Human
uaacacucagaagc

SEQ ID NO: 1343263 - RNA, 18 nt, Human
uaacacucagaagccugg

SEQ ID NO: 1343264 - RNA, 19 nt, Human
uaacacucagaagccuggg

SEQ ID NO: 1343265 - RNA, 20 nt, Human
uaacacucagaagccugggg

SEQ ID NO: 1343266 - RNA, 21 nt, Human
uaacacucagaagccuggggg

SEQ ID NO: 1343267 - RNA, 22 nt, Human
uaaauucucucucuugcaggaa

SEQ ID NO: 1343268 - RNA, 18 nt, Human
uaaauucccguuuuguca

SEQ ID NO: 1343269 - RNA, 19 nt, Human
uaaauucccguuuugucac

SEQ ID NO: 1343270 - RNA, 17 nt, Human
uaaaugucucacugagc

SEQ ID NO: 1343271 - RNA, 15 nt, Human
uaaaugucucacuga

SEQ ID NO: 1343272 - RNA, 15 nt, Human
uaaauguccauucuu

SEQ ID NO: 1343273 - RNA, 20 nt, Human
uaaaugucuuuaaugcaaua

SEQ ID NO: 1343274 - RNA, 18 nt, Human
uaaaugucuuuaaugcaa

SEQ ID NO: 1343275 - RNA, 19 nt, Human
uaaaugucuuuaaugcaau

SEQ ID NO: 1343276 - RNA, 19 nt, Human
uaaaugugaugaauacugu

SEQ ID NO: 1343277 - RNA, 19 nt, Human
uaaaugugauucaccucuu

SEQ ID NO: 1343278 - RNA, 19 nt, Human
uaaaugugcaauagaaggu

SEQ ID NO: 1343279 - RNA, 22 nt, Human
uaaaugugcaauagaaggugau

SEQ ID NO: 1343280 - RNA, 16 nt, Human
uaaauucacaaacuuu

SEQ ID NO: 1343281 - RNA, 18 nt, Human
uaaauucacaaacuuuua

SEQ ID NO: 1343282 - RNA, 13 nt, Human
uaaauguauacua

SEQ ID NO: 1343283 - RNA, 12 nt, Human
uaaauguauacu

SEQ ID NO: 1343284 - RNA, 21 nt, Human
uaaauguaguucugcuccaga

SEQ ID NO: 1343285 - RNA, 17 nt, Human
uaaauguagaguuuuua

SEQ ID NO: 1343286 - RNA, 18 nt, Human
uaaauguagaguuuuuaa

SEQ ID NO: 1343287 - RNA, 17 nt, Human
uaaauguaaagacaaaa

SEQ ID NO: 1343288 - RNA, 13 nt, Human
uaaauguaaagau

SEQ ID NO: 1343289 - RNA, 16 nt, Human
uaaauguaaagauauu

SEQ ID NO: 1343290 - RNA, 17 nt, Human
uaaauguaaagauauuu

SEQ ID NO: 1343291 - RNA, 20 nt, Human
uaaauguauacuauaguacc

SEQ ID NO: 1343292 - RNA, 17 nt, Human
uaaauguauacuauagu

SEQ ID NO: 1343293 - RNA, 15 nt, Human
uaaauguauacuaua

SEQ ID NO: 1343294 - RNA, 17 nt, Human
uaaaugucacuuuuuga

SEQ ID NO: 1343295 - RNA, 21 nt, Human
uaaaugucacuuuuugaggca

SEQ ID NO: 1343296 - RNA, 22 nt, Human
uaaaugucacuuuuugaggcaa

SEQ ID NO: 1343297 - RNA, 23 nt, Human
uaaaugucacuuuuugaggcaaa

SEQ ID NO: 1343298 - RNA, 20 nt, Human
uaaauggcuuccuggcaaua

SEQ ID NO: 1343299 - RNA, 23 nt, Human
uaaauggccucauguggcuggaa

SEQ ID NO: 1343300 - RNA, 13 nt, Human
uaaauggcuguaa

SEQ ID NO: 1343301 - RNA, 17 nt, Human
uaaauggggcucacaaa

SEQ ID NO: 1343302 - RNA, 17 nt, Human
uaaaguugguaaaccuu

SEQ ID NO: 1343303 - RNA, 23 nt, Human
uaaaguucuguacucaaauguag

SEQ ID NO: 1343304 - RNA, 16 nt, Human
uaaaguugauaaagau

SEQ ID NO: 1343305 - RNA, 20 nt, Human
uaaaguugauaaagauuuuu

SEQ ID NO: 1343306 - RNA, 16 nt, Human
uaaaguugguaaaccu

SEQ ID NO: 1343307 - RNA, 13 nt, Human
uaaaguucuaaga

SEQ ID NO: 1343308 - RNA, 14 nt, Human
uaaaguucuaagau

SEQ ID NO: 1343309 - RNA, 15 nt, Human
uaaaguucuaagauu

SEQ ID NO: 1343310 - RNA, 16 nt, Human
uaaaguucuaagauuc

SEQ ID NO: 1343311 - RNA, 17 nt, Human
uaaaguucuaagauucu

SEQ ID NO: 1343312 - RNA, 18 nt, Human
uaaaguucuaagauucug

SEQ ID NO: 1343313 - RNA, 19 nt, Human
uaaaguucuaagauucuga

SEQ ID NO: 1343314 - RNA, 22 nt, Human
uaaaguucuaagauucugauuu

SEQ ID NO: 1343315 - RNA, 18 nt, Human
uaaaguuguuugugccuu

SEQ ID NO: 1343316 - RNA, 12 nt, Human
uaaauggccuca

SEQ ID NO: 1343317 - RNA, 16 nt, Human
uaaauggccucaugug

SEQ ID NO: 1343318 - RNA, 22 nt, Human
uaaauggccucauguggcugga

SEQ ID NO: 1343319 - RNA, 12 nt, Human
uaaaugcccugc

SEQ ID NO: 1343320 - RNA, 13 nt, Human
uaaaugcccugcu

SEQ ID NO: 1343321 - RNA, 14 nt, Human
uaagagagaaugag

SEQ ID NO: 1343322 - RNA, 23 nt, Human
uaagagagaaugagagacacacu

SEQ ID NO: 1343323 - RNA, 13 nt, Human
uaagagagaauga

SEQ ID NO: 1343324 - RNA, 16 nt, Human
uaagaacaacuaccug

SEQ ID NO: 1343325 - RNA, 18 nt, Human
uaagaaccauugauuuaa

SEQ ID NO: 1343326 - RNA, 14 nt, Human
uaagaaccuggaac

SEQ ID NO: 1343327 - RNA, 18 nt, Human
uaagaaauugaauacuuu

SEQ ID NO: 1343328 - RNA, 21 nt, Human
uaagaaauugaauacuuugaa

SEQ ID NO: 1343329 - RNA, 22 nt, Human
uaagaaauugaauacuuugaau

SEQ ID NO: 1343330 - RNA, 23 nt, Human
uaagaaauugaauacuuugaaug

SEQ ID NO: 1343331 - RNA, 14 nt, Human
uaagaaauuucaca

SEQ ID NO: 1343332 - RNA, 21 nt, Human
uaagaaaauaucacuugucaa

SEQ ID NO: 1343333 - RNA, 15 nt, Human
uaagaaaauaaaugu

SEQ ID NO: 1343334 - RNA, 20 nt, Human
uaagaaacaacucuuugaga

SEQ ID NO: 1343335 - RNA, 21 nt, Human
uaagaaacaacucuuugagaa

SEQ ID NO: 1343336 - RNA, 20 nt, Human
uaagaaacuuuuuuauuuaa

SEQ ID NO: 1343337 - RNA, 14 nt, Human
uaagaaauugaaua

SEQ ID NO: 1343338 - RNA, 15 nt, Human
uaagaaauugaauac

SEQ ID NO: 1343339 - RNA, 17 nt, Human
uaagaaauugaauacuu

SEQ ID NO: 1343340 - RNA, 23 nt, Human
uaagaaaccuacugcccaggcac

SEQ ID NO: 1343341 - RNA, 19 nt, Human
uaagaaacuuuuuuauuua

SEQ ID NO: 1343342 - RNA, 21 nt, Human
uaagaaacuuuuuuauuuaaa

SEQ ID NO: 1343343 - RNA, 15 nt, Human
uaacuggaaacuuca

SEQ ID NO: 1343344 - RNA, 14 nt, Human
uaacugcuuucugu

SEQ ID NO: 1343345 - RNA, 17 nt, Human
uaacugcuuucuguucc

SEQ ID NO: 1343346 - RNA, 20 nt, Human
uaacugcuuucuguuccaaa

SEQ ID NO: 1343347 - RNA, 21 nt, Human
uaacugcuuucuguuccaaau

SEQ ID NO: 1343348 - RNA, 15 nt, Human
uaacuggaaaacaga

SEQ ID NO: 1343349 - RNA, 18 nt, Human
uaacuggaaaacagaaca

SEQ ID NO: 1343350 - RNA, 19 nt, Human
uaacuggaaaacagaacac

SEQ ID NO: 1343351 - RNA, 20 nt, Human
uaacuggaaaacagaacacu

SEQ ID NO: 1343352 - RNA, 21 nt, Human
uaacuggaaaacagaacacuu

SEQ ID NO: 1343353 - RNA, 22 nt, Human
uaacuggaaaacagaacacuua

SEQ ID NO: 1343354 - RNA, 13 nt, Human
uaacuggaaagaa

SEQ ID NO: 1343355 - RNA, 15 nt, Human
uaacuggaaagaagu

SEQ ID NO: 1343356 - RNA, 14 nt, Human
uaacuggaaagaag

SEQ ID NO: 1343357 - RNA, 13 nt, Human
uaacuuuuguaag

SEQ ID NO: 1343358 - RNA, 18 nt, Human
uaacuuuuguaagacaaa

SEQ ID NO: 1343359 - RNA, 12 nt, Human
uaacuuuuguga

SEQ ID NO: 1343360 - RNA, 16 nt, Human
uaacuuuugugaauua

SEQ ID NO: 1343361 - RNA, 22 nt, Human
uaacuuuugugaauuaggcugu

SEQ ID NO: 1343362 - RNA, 19 nt, Human
uaacuuuuuuuuuucuuua

SEQ ID NO: 1343363 - RNA, 16 nt, Human
uaacuuuuuuuuuucu

SEQ ID NO: 1343364 - RNA, 23 nt, Human
uaacuauugcauuuauauguacc

SEQ ID NO: 1343365 - RNA, 21 nt, Human
uaacuauugcauuuauaugua

SEQ ID NO: 1343366 - RNA, 16 nt, Human
uaacuauugcauuuau

SEQ ID NO: 1343367 - RNA, 14 nt, Human
uaacucccauuacc

SEQ ID NO: 1343368 - RNA, 12 nt, Human
uaacuccuccca

SEQ ID NO: 1343369 - RNA, 15 nt, Human
uaacuauugcauuua

SEQ ID NO: 1343370 - RNA, 16 nt, Human
uaaccccccuguacac

SEQ ID NO: 1343371 - RNA, 17 nt, Human
uaaccccccuguacaca

SEQ ID NO: 1343372 - RNA, 22 nt, Human
uaacugacaagcuccauuuaaa

SEQ ID NO: 1343373 - RNA, 14 nt, Human
uaacugacuauucu

SEQ ID NO: 1343374 - RNA, 21 nt, Human
uaacugacuauucuugaugua

SEQ ID NO: 1343375 - RNA, 21 nt, Human
uaacugacaagcuccauuuaa

SEQ ID NO: 1343376 - RNA, 20 nt, Human
uaacugacaagccaucuuga

SEQ ID NO: 1343377 - RNA, 16 nt, Human
uaacugacaagccauc

SEQ ID NO: 1343378 - RNA, 17 nt, Human
uaacugacaagccaucu

SEQ ID NO: 1343379 - RNA, 22 nt, Human
uaacugacuauucuugauguaa

SEQ ID NO: 1343380 - RNA, 11 nt, Human
uaacugacaag

SEQ ID NO: 1343381 - RNA, 22 nt, Human
uaacugaauaccacucuguaau

SEQ ID NO: 1343382 - RNA, 19 nt, Human
uaacugaauaccacucugu

SEQ ID NO: 1343383 - RNA, 21 nt, Human
uaacugaauaccacucuguaa

SEQ ID NO: 1343384 - RNA, 14 nt, Human
uaacugaauaccac

SEQ ID NO: 1343385 - RNA, 15 nt, Human
uaacugaauaccacu

SEQ ID NO: 1343386 - RNA, 16 nt, Human
uaacugaauaccacuc

SEQ ID NO: 1343387 - RNA, 18 nt, Human
uaacugaauaccacucug

SEQ ID NO: 1343388 - RNA, 15 nt, Human
uaacuccucccaggg

SEQ ID NO: 1343389 - RNA, 16 nt, Human
uaacuccucccagggu

SEQ ID NO: 1343390 - RNA, 21 nt, Human
uaacuccucccaggguuuuaa

SEQ ID NO: 1343391 - RNA, 18 nt, Human
uaacuccucccaggguuu

SEQ ID NO: 1343392 - RNA, 14 nt, Human
uaacucucuuuaug

SEQ ID NO: 1343393 - RNA, 22 nt, Human
uaacucuucuuucauuucuucu

SEQ ID NO: 1343394 - RNA, 14 nt, Human
uaacugaaaaugug

SEQ ID NO: 1343395 - RNA, 20 nt, Human
uaacugaaaaugugcuauac

SEQ ID NO: 1343396 - RNA, 21 nt, Human
uaacugaaaaugugcuauacu

SEQ ID NO: 1343397 - RNA, 20 nt, Human
uaacugaaaauuauuuaaac

SEQ ID NO: 1343398 - RNA, 23 nt, Human
uaacugaacauccaaaaucuuga

SEQ ID NO: 1343399 - RNA, 13 nt, Human
uaaccagaucauu

SEQ ID NO: 1343400 - RNA, 22 nt, Human
uaaccagaucuagucaaucaag

SEQ ID NO: 1343401 - RNA, 20 nt, Human
uaaccagacacauacucauu

SEQ ID NO: 1343402 - RNA, 22 nt, Human
uaaccagacacauacucauuuu

SEQ ID NO: 1343403 - RNA, 19 nt, Human
uaaccauguguuauguuuu

SEQ ID NO: 1343404 - RNA, 17 nt, Human
uaacccacugagaggac

SEQ ID NO: 1343405 - RNA, 11 nt, Human
uaacauuccuc

SEQ ID NO: 1343406 - RNA, 20 nt, Human
uaacauuccucaugaaugua

SEQ ID NO: 1343407 - RNA, 21 nt, Human
uaacauuccucaugaauguaa

SEQ ID NO: 1343408 - RNA, 22 nt, Human
uaacauuccucaugaauguaaa

SEQ ID NO: 1343409 - RNA, 23 nt, Human
uaacauuccucaugaauguaaau

SEQ ID NO: 1343410 - RNA, 13 nt, Human
uaacauuugcugu

SEQ ID NO: 1343411 - RNA, 14 nt, Human
uaacauuugcuguu

SEQ ID NO: 1343412 - RNA, 16 nt, Human
uaacauuugcuguuuu

SEQ ID NO: 1343413 - RNA, 22 nt, Human
uaacauuugcuguuuuaaacau

SEQ ID NO: 1343414 - RNA, 17 nt, Human
uaacauuugcuguuuua

SEQ ID NO: 1343415 - RNA, 13 nt, Human
uaaccacugcuuc

SEQ ID NO: 1343416 - RNA, 12 nt, Human
uaaccacugcuu

SEQ ID NO: 1343417 - RNA, 22 nt, Human
guuucauauuuuucauagcuaa

SEQ ID NO: 1343418 - RNA, 16 nt, Human
guuucauccuuuucau

SEQ ID NO: 1343419 - RNA, 18 nt, Human
guuucauguaauccucaa

SEQ ID NO: 1343420 - RNA, 17 nt, Human
guuucauguuaguuacc

SEQ ID NO: 1343421 - RNA, 21 nt, Human
guuucauguuaguuaccuuau

SEQ ID NO: 1343422 - RNA, 14 nt, Human
guuuaucaguaaau

SEQ ID NO: 1343423 - RNA, 14 nt, Human
guuuaucauucaag

SEQ ID NO: 1343424 - RNA, 15 nt, Human
guuuaucauucaagu

SEQ ID NO: 1343425 - RNA, 16 nt, Human
guuuaucauucaagug

SEQ ID NO: 1343426 - RNA, 17 nt, Human
guuuaucauucaagugu

SEQ ID NO: 1343427 - RNA, 20 nt, Human
guuuaucauucaaguguaaa

SEQ ID NO: 1343428 - RNA, 22 nt, Human
guuuauccuuucauauaguuag

SEQ ID NO: 1343429 - RNA, 15 nt, Human
guuuauccuuucaua

SEQ ID NO: 1343430 - RNA, 18 nt, Human
guuuaugaaaaagaagaa

SEQ ID NO: 1343431 - RNA, 21 nt, Human
guuuagcuggaaaaguauguu

SEQ ID NO: 1343432 - RNA, 19 nt, Human
guuuaggaacuacugagga

SEQ ID NO: 1343433 - RNA, 20 nt, Human
guuuaggauguugaaaaagu

SEQ ID NO: 1343434 - RNA, 20 nt, Human
guuuauauaagcuuguauuc

SEQ ID NO: 1343435 - RNA, 15 nt, Human
guuuauacacugugu

SEQ ID NO: 1343436 - RNA, 18 nt, Human
guuuaguggcucaacauu

SEQ ID NO: 1343437 - RNA, 19 nt, Human
guuuauacacuguguaaau

SEQ ID NO: 1343438 - RNA, 15 nt, Human
guuguuaugaugugc

SEQ ID NO: 1343439 - RNA, 23 nt, Human
guuguuaugaugugcuuaacagg

SEQ ID NO: 1343440 - RNA, 17 nt, Human
guuguuaugugaucaug

SEQ ID NO: 1343441 - RNA, 16 nt, Human
guuguucgggccaagg

SEQ ID NO: 1343442 - RNA, 14 nt, Human
guuguuaugaugug

SEQ ID NO: 1343443 - RNA, 13 nt, Human
guuguuaugaugu

SEQ ID NO: 1343444 - RNA, 17 nt, Human
guuguuaucuguuugag

SEQ ID NO: 1343445 - RNA, 14 nt, Human
guuguuaucuguuu

SEQ ID NO: 1343446 - RNA, 17 nt, Human
guuguuucuguuccaaa

SEQ ID NO: 1343447 - RNA, 14 nt, Human
guuguuucuguucc

SEQ ID NO: 1343448 - RNA, 13 nt, Human
guuguucgggcca

SEQ ID NO: 1343449 - RNA, 12 nt, Human
guuguucuguua

SEQ ID NO: 1343450 - RNA, 14 nt, Human
guuguucuguuaac

SEQ ID NO: 1343451 - RNA, 15 nt, Human
guuguucuguuaacu

SEQ ID NO: 1343452 - RNA, 18 nt, Human
guuguucuguuaacugaa

SEQ ID NO: 1343453 - RNA, 10 nt, Human
guuguucuuu

SEQ ID NO: 1343454 - RNA, 13 nt, Human
guuguuucuguuc

SEQ ID NO: 1343455 - RNA, 16 nt, Human
guuuagaacacacaca

SEQ ID NO: 1343456 - RNA, 15 nt, Human
guuuacauuuuaugg

SEQ ID NO: 1343457 - RNA, 15 nt, Human
guuuaccagaaagca

SEQ ID NO: 1343458 - RNA, 18 nt, Human
guuuaccaguugccuuuu

SEQ ID NO: 1343459 - RNA, 22 nt, Human
guuuacauuuuauggugccuag

SEQ ID NO: 1343460 - RNA, 15 nt, Human
guuuaccaguugccu

SEQ ID NO: 1343461 - RNA, 12 nt, Human
guuuaccuugua

SEQ ID NO: 1343462 - RNA, 22 nt, Human
guuuacuagggaucccucaucu

SEQ ID NO: 1343463 - RNA, 19 nt, Human
guugucugcaacucugaag

SEQ ID NO: 1343464 - RNA, 22 nt, Human
guugucugaagucacugcacag

SEQ ID NO: 1343465 - RNA, 19 nt, Human
guugucugaagucacugca

SEQ ID NO: 1343466 - RNA, 15 nt, Human
guugucucugaugca

SEQ ID NO: 1343467 - RNA, 18 nt, Human
guugucucugaugcagcu

SEQ ID NO: 1343468 - RNA, 13 nt, Human
guugucucuguuu

SEQ ID NO: 1343469 - RNA, 15 nt, Human
guuguccuuuucaua

SEQ ID NO: 1343470 - RNA, 17 nt, Human
guugucguaaagauuug

SEQ ID NO: 1343471 - RNA, 14 nt, Human
guugucuaagaaau

SEQ ID NO: 1343472 - RNA, 15 nt, Human
guugucuaagaaauu

SEQ ID NO: 1343473 - RNA, 21 nt, Human
guugucuaagaaauugaauac

SEQ ID NO: 1343474 - RNA, 18 nt, Human
guugucuaagaaauugaa

SEQ ID NO: 1343475 - RNA, 18 nt, Human
guugucucuagagcaggg

SEQ ID NO: 1343476 - RNA, 11 nt, Human
guugucucuga

SEQ ID NO: 1343477 - RNA, 14 nt, Human
guugucucugaugc

SEQ ID NO: 1343478 - RNA, 20 nt, Human
guugucucugaugcagcuua

SEQ ID NO: 1343479 - RNA, 14 nt, Human
guugucuggcaagg

SEQ ID NO: 1343480 - RNA, 16 nt, Human
guugucuggcaaggac

SEQ ID NO: 1343481 - RNA, 20 nt, Human
guugugaguuuaccuuguau

SEQ ID NO: 1343482 - RNA, 12 nt, Human
guugugccaaau

SEQ ID NO: 1343483 - RNA, 13 nt, Human
guugugcuugagc

SEQ ID NO: 1343484 - RNA, 13 nt, Human
guuguggccuuug

SEQ ID NO: 1343485 - RNA, 21 nt, Human
guuguggccuuugcgcuccug

SEQ ID NO: 1343486 - RNA, 24 nt, Human
guuguggccuuugcgcuccuggcc

SEQ ID NO: 1343487 - RNA, 18 nt, Human
guuguggguaguggggaa

SEQ ID NO: 1343488 - RNA, 22 nt, Human
guuggcucugccaguccugucc

SEQ ID NO: 1343489 - RNA, 15 nt, Human
guuggcuagauuaac

SEQ ID NO: 1343490 - RNA, 24 nt, Human
guuggcguaggcuacagagaagcc

SEQ ID NO: 1343491 - RNA, 22 nt, Human
guuggcguaggcuacagagaag

SEQ ID NO: 1343492 - RNA, 23 nt, Human
guuggcguaggcuacagagaagc

SEQ ID NO: 1343493 - RNA, 15 nt, Human
guuggcucugccagu

SEQ ID NO: 1343494 - RNA, 19 nt, Human
guuggcucugccaguccug

SEQ ID NO: 1343495 - RNA, 23 nt, Human
guuggcucugccaguccuguccu

SEQ ID NO: 1343496 - RNA, 18 nt, Human
guuggcguaggcuacaga

SEQ ID NO: 1343497 - RNA, 19 nt, Human
guuggcguaggcuacagag

SEQ ID NO: 1343498 - RNA, 20 nt, Human
guuggcguaggcuacagaga

SEQ ID NO: 1343499 - RNA, 21 nt, Human
guuggcguaggcuacagagaa

SEQ ID NO: 1343500 - RNA, 18 nt, Human
guuggccaggcuggucua

SEQ ID NO: 1343501 - RNA, 22 nt, Human
guuggccauauuuaccucagcc

SEQ ID NO: 1343502 - RNA, 23 nt, Human
guuggccauauuuaccucagccu

SEQ ID NO: 1343503 - RNA, 14 nt, Human
guugucaagaauag

SEQ ID NO: 1343504 - RNA, 18 nt, Human
guugucaagaauagcauu

SEQ ID NO: 1343505 - RNA, 22 nt, Human
guugucaagaauagcauuguaa

SEQ ID NO: 1343506 - RNA, 16 nt, Human
guugucaccagaucug

SEQ ID NO: 1343507 - RNA, 17 nt, Human
guuguccucagccccgc

SEQ ID NO: 1343508 - RNA, 23 nt, Human
guuguccucagccccgcguggaa

SEQ ID NO: 1343509 - RNA, 20 nt, Human
guuguccuccuuccggggaa

SEQ ID NO: 1343510 - RNA, 22 nt, Human
guuguccuccuuccggggaagg

SEQ ID NO: 1343511 - RNA, 14 nt, Human
guuguccuuuucau

SEQ ID NO: 1343512 - RNA, 17 nt, Human
guuuuaaaaugagaaau

SEQ ID NO: 1343513 - RNA, 20 nt, Human
guuuucaaaauuguuacaaa

SEQ ID NO: 1343514 - RNA, 16 nt, Human
guuuuaaaaugagaaa

SEQ ID NO: 1343515 - RNA, 15 nt, Human
guuuuaaaaugagaa

SEQ ID NO: 1343516 - RNA, 17 nt, Human
guuuuaaaaaccuguuc

SEQ ID NO: 1343517 - RNA, 16 nt, Human
guuuuaaaaagccagu

SEQ ID NO: 1343518 - RNA, 15 nt, Human
guuuuaaaaagccag

SEQ ID NO: 1343519 - RNA, 13 nt, Human
guuuguuuguugc

SEQ ID NO: 1343520 - RNA, 14 nt, Human
guuuguuuuugcgu

SEQ ID NO: 1343521 - RNA, 12 nt, Human
guuuguuuuugg

SEQ ID NO: 1343522 - RNA, 21 nt, Human
guuuuccuaugcuuugaaaca

SEQ ID NO: 1343523 - RNA, 17 nt, Human
guuuuccuaugcuuuga

SEQ ID NO: 1343524 - RNA, 17 nt, Human
guuuuccucucaauaaa

SEQ ID NO: 1343525 - RNA, 17 nt, Human
guuuuggugguuuuagu

SEQ ID NO: 1343526 - RNA, 17 nt, Human
guuuuguguuuguugua

SEQ ID NO: 1343527 - RNA, 18 nt, Human
guuuuguguuuguuguag

SEQ ID NO: 1343528 - RNA, 17 nt, Human
guuuuguuauauaauuu

SEQ ID NO: 1343529 - RNA, 14 nt, Human
guuuuguucaccau

SEQ ID NO: 1343530 - RNA, 21 nt, Human
guuuuguucaccauuauaaug

SEQ ID NO: 1343531 - RNA, 14 nt, Human
guuuuguugacauu

SEQ ID NO: 1343532 - RNA, 16 nt, Human
guuuuguugacauucu

SEQ ID NO: 1343533 - RNA, 17 nt, Human
guuuuguugacauucug

SEQ ID NO: 1343534 - RNA, 18 nt, Human
guuuuguugacauucuga

SEQ ID NO: 1343535 - RNA, 21 nt, Human
guuuuguugacauucugaaug

SEQ ID NO: 1343536 - RNA, 22 nt, Human
guuuuguugacauucugaaugc

SEQ ID NO: 1343537 - RNA, 17 nt, Human
guuuccuccaagcuauu

SEQ ID NO: 1343538 - RNA, 18 nt, Human
guuuccucuaguucuuug

SEQ ID NO: 1343539 - RNA, 22 nt, Human
guuuccucuaguucuuuguuca

SEQ ID NO: 1343540 - RNA, 13 nt, Human
guuuccucuguuc

SEQ ID NO: 1343541 - RNA, 20 nt, Human
guuuccucuguucaaagcug

SEQ ID NO: 1343542 - RNA, 22 nt, Human
guuuccucuguucaaagcugcc

SEQ ID NO: 1343543 - RNA, 23 nt, Human
guuuccucuguucaaagcugccu

SEQ ID NO: 1343544 - RNA, 21 nt, Human
guuuccccacaaaacaaagca

SEQ ID NO: 1343545 - RNA, 18 nt, Human
guuucccuacugaagccc

SEQ ID NO: 1343546 - RNA, 22 nt, Human
guuucuuaaauaagaaacuuuu

SEQ ID NO: 1343547 - RNA, 21 nt, Human
guuucuuaaauaagaaacuuu

SEQ ID NO: 1343548 - RNA, 23 nt, Human
guuucuugccucauuuuuuuccu

SEQ ID NO: 1343549 - RNA, 13 nt, Human
guuucuugccuca

SEQ ID NO: 1343550 - RNA, 14 nt, Human
guuucuugccucau

SEQ ID NO: 1343551 - RNA, 22 nt, Human
guuucuugccucauuuuuuucc

SEQ ID NO: 1343552 - RNA, 15 nt, Human
guuucuuuaaaauug

SEQ ID NO: 1343553 - RNA, 19 nt, Human
guuucuuuguaaugaaaac

SEQ ID NO: 1343554 - RNA, 16 nt, Human
guuugacuagaugaug

SEQ ID NO: 1343555 - RNA, 18 nt, Human
guuugacuagaugaugga

SEQ ID NO: 1343556 - RNA, 19 nt, Human
guuugacuagaugauggau

SEQ ID NO: 1343557 - RNA, 13 nt, Human
guuuggugcuucu

SEQ ID NO: 1343558 - RNA, 19 nt, Human
guuuggggcagaaaggacu

SEQ ID NO: 1343559 - RNA, 15 nt, Human
guuuggggcaggagu

SEQ ID NO: 1343560 - RNA, 17 nt, Human
guuuggggcaggaguag

SEQ ID NO: 1343561 - RNA, 21 nt, Human
guuuggggcaggaguagcuga

SEQ ID NO: 1343562 - RNA, 23 nt, Human
guuuggggcaggaguagcugagc

SEQ ID NO: 1343563 - RNA, 19 nt, Human
guuuggguaaaauacuuuu

SEQ ID NO: 1343564 - RNA, 20 nt, Human
guuuggguaaaauacuuuua

SEQ ID NO: 1343565 - RNA, 17 nt, Human
guuuggguuuuuuuccu

SEQ ID NO: 1343566 - RNA, 18 nt, Human
guuuguuccccaagacau

SEQ ID NO: 1343567 - RNA, 20 nt, Human
guuuguguguugucucuuga

SEQ ID NO: 1343568 - RNA, 15 nt, Human
guuuguguucuguuu

SEQ ID NO: 1343569 - RNA, 17 nt, Human
guuuguguucuguuuug

SEQ ID NO: 1343570 - RNA, 22 nt, Human
guuuguguauuuacgcuuugau

SEQ ID NO: 1343571 - RNA, 13 nt, Human
guuugugugucuu

SEQ ID NO: 1343572 - RNA, 14 nt, Human
guuugugugucuua

SEQ ID NO: 1343573 - RNA, 15 nt, Human
guuugugugucuuaa

SEQ ID NO: 1343574 - RNA, 22 nt, Human
guuuguagugccacuguuguuu

SEQ ID NO: 1343575 - RNA, 13 nt, Human
guuuguaugaaac

SEQ ID NO: 1343576 - RNA, 18 nt, Human
guuugucgcucaugugug

SEQ ID NO: 1343577 - RNA, 15 nt, Human
uaaaauccauacauu

SEQ ID NO: 1343578 - RNA, 17 nt, Human
uaaaauccauacauuug

SEQ ID NO: 1343579 - RNA, 22 nt, Human
uaaaagguauuaaauugauguu

SEQ ID NO: 1343580 - RNA, 20 nt, Human
uaaaaucagcuauuuuguga

SEQ ID NO: 1343581 - RNA, 21 nt, Human
uaaaaggaaagaaaacaucuu

SEQ ID NO: 1343582 - RNA, 19 nt, Human
uaaaaggaagccaaagagu

SEQ ID NO: 1343583 - RNA, 13 nt, Human
uaaaagcacgaca

SEQ ID NO: 1343584 - RNA, 15 nt, Human
uaaaaggaaagaaaa

SEQ ID NO: 1343585 - RNA, 18 nt, Human
uaaaagcaaaaaagaaaa

SEQ ID NO: 1343586 - RNA, 19 nt, Human
uaaaagcaaaaaagaaaac

SEQ ID NO: 1343587 - RNA, 20 nt, Human
uaaaagcaaaaaagaaaacc

SEQ ID NO: 1343588 - RNA, 22 nt, Human
uaaaagcaaaaaagaaaaccuu

SEQ ID NO: 1343589 - RNA, 23 nt, Human
uaaaagcaaaaaagaaaaccuuu

SEQ ID NO: 1343590 - RNA, 13 nt, Human
uaaaagcaaauca

SEQ ID NO: 1343591 - RNA, 14 nt, Human
uaaaagcaaaucau

SEQ ID NO: 1343592 - RNA, 15 nt, Human
uaaaagcaaaucauu

SEQ ID NO: 1343593 - RNA, 20 nt, Human
uaaaagcaaaucauuuguuu

SEQ ID NO: 1343594 - RNA, 21 nt, Human
uaaaagcaaaucauuuguuua

SEQ ID NO: 1343595 - RNA, 14 nt, Human
uaaaaggaagccaa

SEQ ID NO: 1343596 - RNA, 12 nt, Human
uaaaagcaaaaa

SEQ ID NO: 1343597 - RNA, 16 nt, Human
uaaaagcaaaaaagaa

SEQ ID NO: 1343598 - RNA, 17 nt, Human
uaaaagcaaaaaagaaa

SEQ ID NO: 1343599 - RNA, 21 nt, Human
uaaaacagguuauaacagugu

SEQ ID NO: 1343600 - RNA, 22 nt, Human
uaaaacagguagaauuaucuaa

SEQ ID NO: 1343601 - RNA, 17 nt, Human
uaaaacaucauuacuau

SEQ ID NO: 1343602 - RNA, 19 nt, Human
uaaaacaucuuugaaauua

SEQ ID NO: 1343603 - RNA, 12 nt, Human
uaaaacauuaaa

SEQ ID NO: 1343604 - RNA, 15 nt, Human
uaaaacauuaaaaua

SEQ ID NO: 1343605 - RNA, 16 nt, Human
uaaaacauuaaaauau

SEQ ID NO: 1343606 - RNA, 19 nt, Human
uaaaacauuaaaauauaau

SEQ ID NO: 1343607 - RNA, 12 nt, Human
uaaaacauuaau

SEQ ID NO: 1343608 - RNA, 14 nt, Human
uaaaacauuuauuu

SEQ ID NO: 1343609 - RNA, 20 nt, Human
uaaaacauuuauuuugacau

SEQ ID NO: 1343610 - RNA, 21 nt, Human
uaaaaacaaagaaauuaugug

SEQ ID NO: 1343611 - RNA, 18 nt, Human
guuuuuaauguauaguaa

SEQ ID NO: 1343612 - RNA, 21 nt, Human
guuuuuaaggguuuguggaaa

SEQ ID NO: 1343613 - RNA, 19 nt, Human
guuuuuaauaaaagaaaau

SEQ ID NO: 1343614 - RNA, 13 nt, Human
guuuuguuuacag

SEQ ID NO: 1343615 - RNA, 12 nt, Human
guuuuuaaugua

SEQ ID NO: 1343616 - RNA, 13 nt, Human
guuuuuaauguau

SEQ ID NO: 1343617 - RNA, 21 nt, Human
guuuuuacaaauguuaaaaug

SEQ ID NO: 1343618 - RNA, 14 nt, Human
guuuuguuuacaga

SEQ ID NO: 1343619 - RNA, 20 nt, Human
guuuuguuucgcucuuugag

SEQ ID NO: 1343620 - RNA, 19 nt, Human
uaaaaaugguuuaaauggu

SEQ ID NO: 1343621 - RNA, 18 nt, Human
uaaaaaugguuuaaaugg

SEQ ID NO: 1343622 - RNA, 20 nt, Human
uaaaaacagauuuggaaaga

SEQ ID NO: 1343623 - RNA, 22 nt, Human
uaaaaacagauuuggaaagacu

SEQ ID NO: 1343624 - RNA, 15 nt, Human
uaaaaagaagugcug

SEQ ID NO: 1343625 - RNA, 13 nt, Human
uaaaaagaaaggc

SEQ ID NO: 1343626 - RNA, 14 nt, Human
uaaaaagaucacuu

SEQ ID NO: 1343627 - RNA, 18 nt, Human
uaaaaagauugaaguauu

SEQ ID NO: 1343628 - RNA, 20 nt, Human
uaaaaagauugaaguauuuu

SEQ ID NO: 1343629 - RNA, 22 nt, Human
uaaaacaagcacuaaacaaaga

SEQ ID NO: 1343630 - RNA, 22 nt, Human
uaaaacaaagccacuuucaauc

SEQ ID NO: 1343631 - RNA, 14 nt, Human
uaaaacaaagccac

SEQ ID NO: 1343632 - RNA, 18 nt, Human
uaaaacaaacaauaccug

SEQ ID NO: 1343633 - RNA, 13 nt, Human
uaaaaaugucuua

SEQ ID NO: 1343634 - RNA, 21 nt, Human
uaaaaauguucuauuuuaauu

SEQ ID NO: 1343635 - RNA, 23 nt, Human
uaaaaauuaaauuggaaagcagg

SEQ ID NO: 1343636 - RNA, 17 nt, Human
uaaaaauugugaucaga

SEQ ID NO: 1343637 - RNA, 22 nt, Human
uaaaaauuguuaauuuuuccua

SEQ ID NO: 1343638 - RNA, 19 nt, Human
uaaaacacuuccauaaucu

SEQ ID NO: 1343639 - RNA, 13 nt, Human
uaaaacaaugaau

SEQ ID NO: 1343640 - RNA, 14 nt, Human
uaaaacacacaggu

SEQ ID NO: 1343641 - RNA, 11 nt, Human
uaaaacacuug

SEQ ID NO: 1343642 - RNA, 14 nt, Human
uaaaacagaagccu

SEQ ID NO: 1343643 - RNA, 13 nt, Human
uaaaacagacacu

SEQ ID NO: 1343644 - RNA, 15 nt, Human
uaaaacagacacugg

SEQ ID NO: 1343645 - RNA, 17 nt, Human
uaaaacagacacuggca

SEQ ID NO: 1343646 - RNA, 18 nt, Human
uaaaacagacacuggcau

SEQ ID NO: 1343647 - RNA, 19 nt, Human
uaaaacagacacuggcaug

SEQ ID NO: 1343648 - RNA, 21 nt, Human
uaaaacagguagaauuaucua

SEQ ID NO: 1343649 - RNA, 14 nt, Human
uaaaggaauuuaaa

SEQ ID NO: 1343650 - RNA, 11 nt, Human
uaaaggaaaag

SEQ ID NO: 1343651 - RNA, 14 nt, Human
uaaaggaaaagaca

SEQ ID NO: 1343652 - RNA, 17 nt, Human
uaaaggaaaagacacau

SEQ ID NO: 1343653 - RNA, 16 nt, Human
uaaaggaaaagacaca

SEQ ID NO: 1343654 - RNA, 14 nt, Human
uaaaggcaguuuuc

SEQ ID NO: 1343655 - RNA, 17 nt, Human
uaaaggcaguuuucuaa

SEQ ID NO: 1343656 - RNA, 21 nt, Human
uaaagccucaagguuuuaggu

SEQ ID NO: 1343657 - RNA, 15 nt, Human
uaaagcugguuuaau

SEQ ID NO: 1343658 - RNA, 19 nt, Human
uaaagcugguuuaauguuu

SEQ ID NO: 1343659 - RNA, 19 nt, Human
uaaagcuugcaacaaaauu

SEQ ID NO: 1343660 - RNA, 11 nt, Human
uaaagcuuguc

SEQ ID NO: 1343661 - RNA, 19 nt, Human
uaaagcuuucagaauaugu

SEQ ID NO: 1343662 - RNA, 23 nt, Human
uaaagcuuucagaauaugucagu

SEQ ID NO: 1343663 - RNA, 14 nt, Human
uaaaguguuugaaa

SEQ ID NO: 1343664 - RNA, 14 nt, Human
uaaaguuaaguuga

SEQ ID NO: 1343665 - RNA, 20 nt, Human
uaaaguuaguaucuuuugau

SEQ ID NO: 1343666 - RNA, 14 nt, Human
uaaaguucaaacuc

SEQ ID NO: 1343667 - RNA, 15 nt, Human
uaaaguucaacaugu

SEQ ID NO: 1343668 - RNA, 18 nt, Human
uaaaguucaacauguuau

SEQ ID NO: 1343669 - RNA, 12 nt, Human
uaaaguucuaag

SEQ ID NO: 1343670 - RNA, 17 nt, Human
uaaagcagguucuuguu

SEQ ID NO: 1343671 - RNA, 15 nt, Human
uaaagccaugcugga

SEQ ID NO: 1343672 - RNA, 11 nt, Human
uaaagccucaa

SEQ ID NO: 1343673 - RNA, 12 nt, Human
uaaagccuccuc

SEQ ID NO: 1343674 - RNA, 18 nt, Human
uaaagcaggccuuuugau

SEQ ID NO: 1343675 - RNA, 19 nt, Human
uaaagcaggccuuuugaua

SEQ ID NO: 1343676 - RNA, 20 nt, Human
uaaagcaggccuuuugauau

SEQ ID NO: 1343677 - RNA, 16 nt, Human
uaaagcagguucuugu

SEQ ID NO: 1343678 - RNA, 18 nt, Human
uaaagcaggcagaacuca

SEQ ID NO: 1343679 - RNA, 12 nt, Human
uaaagaaaagau

SEQ ID NO: 1343680 - RNA, 13 nt, Human
uaaagaaaagaug

SEQ ID NO: 1343681 - RNA, 14 nt, Human
uaaagaaaagaugc

SEQ ID NO: 1343682 - RNA, 15 nt, Human
uaaagaaaagaugca

SEQ ID NO: 1343683 - RNA, 18 nt, Human
uaaagaaaagaugcacuu

SEQ ID NO: 1343684 - RNA, 15 nt, Human
uaaagcaauaugcau

SEQ ID NO: 1343685 - RNA, 17 nt, Human
uaaagcaauaugcauuu

SEQ ID NO: 1343686 - RNA, 18 nt, Human
uaaacacucuugaaaaau

SEQ ID NO: 1343687 - RNA, 15 nt, Human
uaaacaucaaucuuu

SEQ ID NO: 1343688 - RNA, 18 nt, Human
uaaacaucaaucuuuaaa

SEQ ID NO: 1343689 - RNA, 22 nt, Human
uaaacaugacuccauagaccuu

SEQ ID NO: 1343690 - RNA, 15 nt, Human
uaaacaucauucauu

SEQ ID NO: 1343691 - RNA, 17 nt, Human
uaaacaucauucauuuu

SEQ ID NO: 1343692 - RNA, 17 nt, Human
uaaacacucuugaaaaa

SEQ ID NO: 1343693 - RNA, 15 nt, Human
uaaacacucuugaaa

SEQ ID NO: 1343694 - RNA, 15 nt, Human
uaaaaucuugucaug

SEQ ID NO: 1343695 - RNA, 16 nt, Human
uaaaaucuugucaugu

SEQ ID NO: 1343696 - RNA, 18 nt, Human
uaaaaucuugucaugugu

SEQ ID NO: 1343697 - RNA, 18 nt, Human
uaaaauccauacauuugu

SEQ ID NO: 1343698 - RNA, 14 nt, Human
uaaaaucugucacg

SEQ ID NO: 1343699 - RNA, 13 nt, Human
uaaaaucuuauag

SEQ ID NO: 1343700 - RNA, 17 nt, Human
uaaaaucuuauaguucu

SEQ ID NO: 1343701 - RNA, 18 nt, Human
uaaaaucuuauaguucua

SEQ ID NO: 1343702 - RNA, 16 nt, Human
uaaaaucuugaaaaug

SEQ ID NO: 1343703 - RNA, 19 nt, Human
uaaaaucuuauaguucuag

SEQ ID NO: 1343704 - RNA, 11 nt, Human
uaaaaucuugu

SEQ ID NO: 1343705 - RNA, 12 nt, Human
uaaaaucuuguc

SEQ ID NO: 1343706 - RNA, 14 nt, Human
uaaaaucuugucau

SEQ ID NO: 1343707 - RNA, 19 nt, Human
uaaaaucuugucaugugua

SEQ ID NO: 1343708 - RNA, 18 nt, Human
uaaacuguuucuuuaaaa

SEQ ID NO: 1343709 - RNA, 16 nt, Human
uaaacuuauaacccac

SEQ ID NO: 1343710 - RNA, 18 nt, Human
uaaacuuccccaucuucu

SEQ ID NO: 1343711 - RNA, 9 nt, Human
uaaagaaaa

SEQ ID NO: 1343712 - RNA, 12 nt, Human
uaaagaaaaaaa

SEQ ID NO: 1343713 - RNA, 11 nt, Human
uaaagaaaaaa

SEQ ID NO: 1343714 - RNA, 16 nt, Human
uaaagaaaaaaaugua

SEQ ID NO: 1343715 - RNA, 17 nt, Human
uaaagaaaaaaauguau

SEQ ID NO: 1343716 - RNA, 23 nt, Human
uaaagaaaaaaauguauuuuaug

SEQ ID NO: 1343717 - RNA, 15 nt, Human
uaaagaaaaaaauug

SEQ ID NO: 1343718 - RNA, 16 nt, Human
uaaagaaaaaaauuga

SEQ ID NO: 1343719 - RNA, 17 nt, Human
uaaagaaaaaaauugaa

SEQ ID NO: 1343720 - RNA, 18 nt, Human
uaaagaaaaaaauugaaa

SEQ ID NO: 1343721 - RNA, 20 nt, Human
uaaagaaaaaaauugaaaug

SEQ ID NO: 1343722 - RNA, 21 nt, Human
uaaagaaaaaaauugaaaugu

SEQ ID NO: 1343723 - RNA, 22 nt, Human
uaaagaaaaaaauugaaaugua

SEQ ID NO: 1343724 - RNA, 23 nt, Human
uaaagaaaaaaauugaaauguaa

SEQ ID NO: 1343725 - RNA, 14 nt, Human
uaaagaaaaacaaa

SEQ ID NO: 1343726 - RNA, 15 nt, Human
uaaagaaaaacaaac

SEQ ID NO: 1343727 - RNA, 19 nt, Human
uaaaccaaggcuagaacca

SEQ ID NO: 1343728 - RNA, 19 nt, Human
uaaacuguacagugucuuu

SEQ ID NO: 1343729 - RNA, 12 nt, Human
uaaacugugcac

SEQ ID NO: 1343730 - RNA, 14 nt, Human
uaaacugugcacca

SEQ ID NO: 1343731 - RNA, 20 nt, Human
uaaacuguacagugucuuuu

SEQ ID NO: 1343732 - RNA, 15 nt, Human
uaaacuguguacaua

SEQ ID NO: 1343733 - RNA, 18 nt, Human
uaaacuguguacauaacu

SEQ ID NO: 1343734 - RNA, 17 nt, Human
uaaacuguguauuccaa

SEQ ID NO: 1343735 - RNA, 22 nt, Human
uaaacuguguauuccaagacau

SEQ ID NO: 1343736 - RNA, 18 nt, Human
uaaacaugacuccauaga

SEQ ID NO: 1343737 - RNA, 20 nt, Human
uaaacauuaauagcagccuu

SEQ ID NO: 1343738 - RNA, 22 nt, Human
uaaacauuaauagcagccuuuc

SEQ ID NO: 1343739 - RNA, 21 nt, Human
uaaacauuaauagcagccuuu

SEQ ID NO: 1343740 - RNA, 19 nt, Human
uaaacauuauuaaguaacu

SEQ ID NO: 1343741 - RNA, 23 nt, Human
uaaacauuauuaaguaacuuauu

SEQ ID NO: 1343742 - RNA, 18 nt, Human
guuccuuggccaugcaga

SEQ ID NO: 1343743 - RNA, 13 nt, Human
guuccuuucuuuu

SEQ ID NO: 1343744 - RNA, 17 nt, Human
guuccuuccucugagcc

SEQ ID NO: 1343745 - RNA, 13 nt, Human
guuccuucccaau

SEQ ID NO: 1343746 - RNA, 14 nt, Human
guuccuucccaauc

SEQ ID NO: 1343747 - RNA, 17 nt, Human
guuccuucccaauccag

SEQ ID NO: 1343748 - RNA, 20 nt, Human
guuccuucccugugccuccu

SEQ ID NO: 1343749 - RNA, 18 nt, Human
guuccuuccucugagccu

SEQ ID NO: 1343750 - RNA, 19 nt, Human
guuccuuccucugagccuu

SEQ ID NO: 1343751 - RNA, 13 nt, Human
guucgcagccacc

SEQ ID NO: 1343752 - RNA, 15 nt, Human
guucgcagccacccu

SEQ ID NO: 1343753 - RNA, 16 nt, Human
guucgcagccacccug

SEQ ID NO: 1343754 - RNA, 17 nt, Human
guucgcagccacccuga

SEQ ID NO: 1343755 - RNA, 19 nt, Human
guucgcagccacccugagg

SEQ ID NO: 1343756 - RNA, 14 nt, Human
guucgcauggucac

SEQ ID NO: 1343757 - RNA, 20 nt, Human
guucgcauggucacacacug

SEQ ID NO: 1343758 - RNA, 20 nt, Human
guucgcagccacccugagga

SEQ ID NO: 1343759 - RNA, 19 nt, Human
guucuaaaaauugugauca

SEQ ID NO: 1343760 - RNA, 16 nt, Human
guucuaaaagguguga

SEQ ID NO: 1343761 - RNA, 10 nt, Human
guucuaaagc

SEQ ID NO: 1343762 - RNA, 12 nt, Human
guucuaaagcuc

SEQ ID NO: 1343763 - RNA, 14 nt, Human
guucuaaagcucug

SEQ ID NO: 1343764 - RNA, 16 nt, Human
guucuaaagcucugac

SEQ ID NO: 1343765 - RNA, 12 nt, Human
guucuaaaguuc

SEQ ID NO: 1343766 - RNA, 13 nt, Human
guucuaaaguucu

SEQ ID NO: 1343767 - RNA, 14 nt, Human
guucuaaaguucua

SEQ ID NO: 1343768 - RNA, 15 nt, Human
guucuaaaguucuaa

SEQ ID NO: 1343769 - RNA, 16 nt, Human
guucuaaaguucuaag

SEQ ID NO: 1343770 - RNA, 17 nt, Human
guucuaaaguucuaaga

SEQ ID NO: 1343771 - RNA, 18 nt, Human
guucuaaaguucuaagau

SEQ ID NO: 1343772 - RNA, 19 nt, Human
guucuaaaguucuaagauu

SEQ ID NO: 1343773 - RNA, 21 nt, Human
guucuaaaguucuaagauucu

SEQ ID NO: 1343774 - RNA, 13 nt, Human
guucuaaccuccu

SEQ ID NO: 1343775 - RNA, 16 nt, Human
guucuaaccuuuacau

SEQ ID NO: 1343776 - RNA, 15 nt, Human
guucuaagacucaaa

SEQ ID NO: 1343777 - RNA, 17 nt, Human
guucuaagacucaaaug

SEQ ID NO: 1343778 - RNA, 20 nt, Human
guucuaagacucaaauguuc

SEQ ID NO: 1343779 - RNA, 21 nt, Human
guucuaagacucaaauguucu

SEQ ID NO: 1343780 - RNA, 13 nt, Human
guucuaagaugug

SEQ ID NO: 1343781 - RNA, 21 nt, Human
guucuaagaugugauauucua

SEQ ID NO: 1343782 - RNA, 22 nt, Human
guucuaagaugugauauucuaa

SEQ ID NO: 1343783 - RNA, 13 nt, Human
guucuaagauucu

SEQ ID NO: 1343784 - RNA, 14 nt, Human
guucuaagauucua

SEQ ID NO: 1343785 - RNA, 15 nt, Human
guucuaagauucuaa

SEQ ID NO: 1343786 - RNA, 17 nt, Human
guucuaagauucuaaug

SEQ ID NO: 1343787 - RNA, 20 nt, Human
guucuaagauucuaaugaug

SEQ ID NO: 1343788 - RNA, 14 nt, Human
guucuaagauucug

SEQ ID NO: 1343789 - RNA, 15 nt, Human
guucuaagauucuga

SEQ ID NO: 1343790 - RNA, 11 nt, Human
guucuaaggcc

SEQ ID NO: 1343791 - RNA, 13 nt, Human
guucuaaggccua

SEQ ID NO: 1343792 - RNA, 20 nt, Human
guucuaaggccuaggauucu

SEQ ID NO: 1343793 - RNA, 21 nt, Human
guucuaaggccuaggauucua

SEQ ID NO: 1343794 - RNA, 22 nt, Human
guucuaaggccuaggauucuaa

SEQ ID NO: 1343795 - RNA, 23 nt, Human
guucuaaggccuaggauucuaaa

SEQ ID NO: 1343796 - RNA, 11 nt, Human
guucuaaggcu

SEQ ID NO: 1343797 - RNA, 12 nt, Human
guucuaaggcuc

SEQ ID NO: 1343798 - RNA, 13 nt, Human
guucuaaggcucu

SEQ ID NO: 1343799 - RNA, 14 nt, Human
guucuaaggcucug

SEQ ID NO: 1343800 - RNA, 16 nt, Human
guucuaaggcucugag

SEQ ID NO: 1343801 - RNA, 17 nt, Human
guucuaaggcucugaga

SEQ ID NO: 1343802 - RNA, 16 nt, Human
guucuaagucuuucca

SEQ ID NO: 1343803 - RNA, 12 nt, Human
guucugaagaag

SEQ ID NO: 1343804 - RNA, 13 nt, Human
guucugaagaaga

SEQ ID NO: 1343805 - RNA, 17 nt, Human
guucuaagucuuuccau

SEQ ID NO: 1343806 - RNA, 19 nt, Human
guucuaagucuuuccauug

SEQ ID NO: 1343807 - RNA, 14 nt, Human
guucuaaguuucua

SEQ ID NO: 1343808 - RNA, 15 nt, Human
guucuaaguuucuaa

SEQ ID NO: 1343809 - RNA, 16 nt, Human
guucuaaguuucuaag

SEQ ID NO: 1343810 - RNA, 17 nt, Human
guucuaaguuucuaaga

SEQ ID NO: 1343811 - RNA, 18 nt, Human
guucuaaguuucuaagau

SEQ ID NO: 1343812 - RNA, 19 nt, Human
guucuaaguuucuaagauu

SEQ ID NO: 1343813 - RNA, 21 nt, Human
guucuaaguuucuaagauucu

SEQ ID NO: 1343814 - RNA, 22 nt, Human
guucuaaguuucuaagauucua

SEQ ID NO: 1343815 - RNA, 17 nt, Human
guucuaauaauuucuaa

SEQ ID NO: 1343816 - RNA, 19 nt, Human
guucuaauaauuucuaaug

SEQ ID NO: 1343817 - RNA, 14 nt, Human
guucugaagaagau

SEQ ID NO: 1343818 - RNA, 15 nt, Human
guucugaagaagaug

SEQ ID NO: 1343819 - RNA, 21 nt, Human
guucugagauggcucccaggg

SEQ ID NO: 1343820 - RNA, 20 nt, Human
guucugagauggcucccagg

SEQ ID NO: 1343821 - RNA, 15 nt, Human
guucugcacacagca

SEQ ID NO: 1343822 - RNA, 16 nt, Human
guucugcacacagcac

SEQ ID NO: 1343823 - RNA, 12 nt, Human
guucugccagga

SEQ ID NO: 1343824 - RNA, 13 nt, Human
guucugccaggag

SEQ ID NO: 1343825 - RNA, 14 nt, Human
guucugccaggaga

SEQ ID NO: 1343826 - RNA, 13 nt, Human
guucugccugcca

SEQ ID NO: 1343827 - RNA, 15 nt, Human
guucugccugccagc

SEQ ID NO: 1343828 - RNA, 17 nt, Human
guucugccugccagcug

SEQ ID NO: 1343829 - RNA, 19 nt, Human
guucugccugccagcugca

SEQ ID NO: 1343830 - RNA, 22 nt, Human
guucugccugccagcugcacug

SEQ ID NO: 1343831 - RNA, 23 nt, Human
guucugccugccagcugcacuga

SEQ ID NO: 1343832 - RNA, 14 nt, Human
guucuuucuuccuc

SEQ ID NO: 1343833 - RNA, 15 nt, Human
guucuuucuuccucu

SEQ ID NO: 1343834 - RNA, 16 nt, Human
guucuggcuguuugag

SEQ ID NO: 1343835 - RNA, 20 nt, Human
guucuuucauuugcuuugga

SEQ ID NO: 1343836 - RNA, 22 nt, Human
guucuuucauuugcuuuggaag

SEQ ID NO: 1343837 - RNA, 16 nt, Human
guucuuucuuccucug

SEQ ID NO: 1343838 - RNA, 17 nt, Human
guucuuucuuccucugc

SEQ ID NO: 1343839 - RNA, 18 nt, Human
guucuuucuuccucugcu

SEQ ID NO: 1343840 - RNA, 19 nt, Human
guucuuucuuccucugcug

SEQ ID NO: 1343841 - RNA, 21 nt, Human
guucuuuguucauagcccagu

SEQ ID NO: 1343842 - RNA, 19 nt, Human
guucuuuuugaaguauuua

SEQ ID NO: 1343843 - RNA, 23 nt, Human
guucuuugcugcauucugccucu

SEQ ID NO: 1343844 - RNA, 11 nt, Human
guucuuuggaa

SEQ ID NO: 1343845 - RNA, 15 nt, Human
guucuuugggccaga

SEQ ID NO: 1343846 - RNA, 16 nt, Human
guucuuugggccagac

SEQ ID NO: 1343847 - RNA, 17 nt, Human
guucuuugggccagaca

SEQ ID NO: 1343848 - RNA, 22 nt, Human
guucuuugggccagacaugcca

SEQ ID NO: 1343849 - RNA, 13 nt, Human
guucuuuguucau

SEQ ID NO: 1343850 - RNA, 20 nt, Human
guucuuuguucauagcccag

SEQ ID NO: 1343851 - RNA, 19 nt, Human
guugaaaaaguuuguuuuu

SEQ ID NO: 1343852 - RNA, 22 nt, Human
guugaaaauaaaguguauauuu

SEQ ID NO: 1343853 - RNA, 21 nt, Human
guugaaaaaguuuguuuuugc

SEQ ID NO: 1343854 - RNA, 14 nt, Human
guucugcucugguu

SEQ ID NO: 1343855 - RNA, 22 nt, Human
guucugcucugguuguuucugu

SEQ ID NO: 1343856 - RNA, 15 nt, Human
guucugcucaucauu

SEQ ID NO: 1343857 - RNA, 18 nt, Human
guucugcucaucauucuc

SEQ ID NO: 1343858 - RNA, 23 nt, Human
guucugcucaucauucucugucu

SEQ ID NO: 1343859 - RNA, 16 nt, Human
guucugcuccagacag

SEQ ID NO: 1343860 - RNA, 20 nt, Human
guucugcuccagacagggaa

SEQ ID NO: 1343861 - RNA, 17 nt, Human
guucugcuccagacagg

SEQ ID NO: 1343862 - RNA, 13 nt, Human
guugaauacuuuu

SEQ ID NO: 1343863 - RNA, 17 nt, Human
guugaauacuuuuuaca

SEQ ID NO: 1343864 - RNA, 13 nt, Human
guugaagccuuug

SEQ ID NO: 1343865 - RNA, 14 nt, Human
guugaagccuuugu

SEQ ID NO: 1343866 - RNA, 23 nt, Human
guugaagcaaaucgaaugaaauu

SEQ ID NO: 1343867 - RNA, 20 nt, Human
guugauggugguauguuuuc

SEQ ID NO: 1343868 - RNA, 21 nt, Human
guugauggugguauguuuuca

SEQ ID NO: 1343869 - RNA, 14 nt, Human
guugauuaaagaug

SEQ ID NO: 1343870 - RNA, 20 nt, Human
guugaaagguuuuuuuucag

SEQ ID NO: 1343871 - RNA, 21 nt, Human
guugaaagguuuuuuuucagu

SEQ ID NO: 1343872 - RNA, 16 nt, Human
guugaaauaugauguu

SEQ ID NO: 1343873 - RNA, 13 nt, Human
guugaaagguuuu

SEQ ID NO: 1343874 - RNA, 14 nt, Human
guugaaagguuuuu

SEQ ID NO: 1343875 - RNA, 18 nt, Human
guugaagagguuuuaaag

SEQ ID NO: 1343876 - RNA, 18 nt, Human
guugaagcaaaucgaaug

SEQ ID NO: 1343877 - RNA, 23 nt, Human
guugaaagguuuuuuuucaguug

SEQ ID NO: 1343878 - RNA, 14 nt, Human
guugcaacuuugua

SEQ ID NO: 1343879 - RNA, 22 nt, Human
guugauuuuuuuuuuuuuuucc

SEQ ID NO: 1343880 - RNA, 16 nt, Human
guugauuacagugcag

SEQ ID NO: 1343881 - RNA, 23 nt, Human
guugauucgguauccccccaucu

SEQ ID NO: 1343882 - RNA, 16 nt, Human
guugcaacuuuguaua

SEQ ID NO: 1343883 - RNA, 23 nt, Human
guugauuuuuuuuuuuuuuuccu

SEQ ID NO: 1343884 - RNA, 19 nt, Human
guugcacagcaucucagcu

SEQ ID NO: 1343885 - RNA, 16 nt, Human
guugcacagcaucuca

SEQ ID NO: 1343886 - RNA, 16 nt, Human
guugcacagcuaugaa

SEQ ID NO: 1343887 - RNA, 11 nt, Human
guugcacagca

SEQ ID NO: 1343888 - RNA, 10 nt, Human
guugcacagc

SEQ ID NO: 1343889 - RNA, 14 nt, Human
guugcacacuuugg

SEQ ID NO: 1343890 - RNA, 15 nt, Human
guugcacacuuuggu

SEQ ID NO: 1343891 - RNA, 23 nt, Human
guugcagcccugcugcugccugc

SEQ ID NO: 1343892 - RNA, 16 nt, Human
guugcagacaggaauc

SEQ ID NO: 1343893 - RNA, 20 nt, Human
guugcagacaggaaucuuaa

SEQ ID NO: 1343894 - RNA, 20 nt, Human
guugcagcuguuuuguugac

SEQ ID NO: 1343895 - RNA, 23 nt, Human
guugcagcuguuuuguugacauu

SEQ ID NO: 1343896 - RNA, 17 nt, Human
guugcagucacucuagu

SEQ ID NO: 1343897 - RNA, 20 nt, Human
guugcauguaguaacacuaa

SEQ ID NO: 1343898 - RNA, 20 nt, Human
guugcauuaaaaaugcauau

SEQ ID NO: 1343899 - RNA, 16 nt, Human
guugcauguaguaaca

SEQ ID NO: 1343900 - RNA, 23 nt, Human
guugcauuuguuuuguuuacaga

SEQ ID NO: 1343901 - RNA, 19 nt, Human
guugccaaauauguccugg

SEQ ID NO: 1343902 - RNA, 20 nt, Human
guugccaaauauguccuggg

SEQ ID NO: 1343903 - RNA, 14 nt, Human
guugcagacaggaa

SEQ ID NO: 1343904 - RNA, 15 nt, Human
guugcagacaggaau

SEQ ID NO: 1343905 - RNA, 17 nt, Human
guugcacguguguuuuu

SEQ ID NO: 1343906 - RNA, 19 nt, Human
guugcacguguguuuuucu

SEQ ID NO: 1343907 - RNA, 21 nt, Human
guugcacguguguuuuucuau

SEQ ID NO: 1343908 - RNA, 22 nt, Human
guugcacguguguuuuucuauu

SEQ ID NO: 1343909 - RNA, 23 nt, Human
guugcacguguguuuuucuauua

SEQ ID NO: 1343910 - RNA, 15 nt, Human
guuggagugcagugg

SEQ ID NO: 1343911 - RNA, 14 nt, Human
guuggagugcagug

SEQ ID NO: 1343912 - RNA, 13 nt, Human
guuggagcuccag

SEQ ID NO: 1343913 - RNA, 17 nt, Human
guuggagcuccagccug

SEQ ID NO: 1343914 - RNA, 17 nt, Human
guuggacaagcuucuga

SEQ ID NO: 1343915 - RNA, 21 nt, Human
guuggacaccuuuagguucuu

SEQ ID NO: 1343916 - RNA, 16 nt, Human
guugccaguuguccuc

SEQ ID NO: 1343917 - RNA, 23 nt, Human
guugccauccuaccgucuuuucc

SEQ ID NO: 1343918 - RNA, 21 nt, Human
guugccaaauauguccugggg

SEQ ID NO: 1343919 - RNA, 15 nt, Human
guugccaagcuccaa

SEQ ID NO: 1343920 - RNA, 18 nt, Human
guugccaagcuccaagcc

SEQ ID NO: 1343921 - RNA, 19 nt, Human
guugccaagcuccaagccc

SEQ ID NO: 1343922 - RNA, 14 nt, Human
guuggccaggcugc

SEQ ID NO: 1343923 - RNA, 19 nt, Human
guuggcauagcucuggggu

SEQ ID NO: 1343924 - RNA, 14 nt, Human
guuggccaggcugg

SEQ ID NO: 1343925 - RNA, 15 nt, Human
guuggccaggcuggu

SEQ ID NO: 1343926 - RNA, 19 nt, Human
guuggccaggcugcucuug

SEQ ID NO: 1343927 - RNA, 18 nt, Human
guuggccaggcuggucuc

SEQ ID NO: 1343928 - RNA, 15 nt, Human
guuggcauagcucug

SEQ ID NO: 1343929 - RNA, 18 nt, Human
guuggcauagcucugggg

SEQ ID NO: 1343930 - RNA, 13 nt, Human
guuggcaggcugg

SEQ ID NO: 1343931 - RNA, 14 nt, Human
guuggcaggcuggc

SEQ ID NO: 1343932 - RNA, 15 nt, Human
guuggcaggcuggcc

SEQ ID NO: 1343933 - RNA, 16 nt, Human
guuggcaggcuggcca

SEQ ID NO: 1343934 - RNA, 17 nt, Human
guuggcaggcuggccag

SEQ ID NO: 1343935 - RNA, 20 nt, Human
guuggcaggcuggccagucc

SEQ ID NO: 1343936 - RNA, 23 nt, Human
guuaccucugccucagaaaacaa

SEQ ID NO: 1343937 - RNA, 17 nt, Human
guuaccucuauauacca

SEQ ID NO: 1343938 - RNA, 21 nt, Human
guuaccucuauauaccaaagc

SEQ ID NO: 1343939 - RNA, 22 nt, Human
guuaccugaaaacacugugcac

SEQ ID NO: 1343940 - RNA, 13 nt, Human
guuaccuguagau

SEQ ID NO: 1343941 - RNA, 16 nt, Human
guuaccauuuacaugu

SEQ ID NO: 1343942 - RNA, 20 nt, Human
guuacccaguaacucaucug

SEQ ID NO: 1343943 - RNA, 13 nt, Human
guuaccuacuuug

SEQ ID NO: 1343944 - RNA, 16 nt, Human
guuaccuacuuugacu

SEQ ID NO: 1343945 - RNA, 16 nt, Human
guuacccaaauuaaga

SEQ ID NO: 1343946 - RNA, 23 nt, Human
guuaccauuaaaccaucucccug

SEQ ID NO: 1343947 - RNA, 15 nt, Human
guuaccaugucuuuc

SEQ ID NO: 1343948 - RNA, 16 nt, Human
guuaccauuaaaccau

SEQ ID NO: 1343949 - RNA, 19 nt, Human
guuaccauuaaaccaucuc

SEQ ID NO: 1343950 - RNA, 21 nt, Human
guuaccauuaaaccaucuccc

SEQ ID NO: 1343951 - RNA, 13 nt, Human
guuacagaagcug

SEQ ID NO: 1343952 - RNA, 13 nt, Human
guuacaguucugu

SEQ ID NO: 1343953 - RNA, 14 nt, Human
guuacaguucugug

SEQ ID NO: 1343954 - RNA, 15 nt, Human
guuacaguucugugg

SEQ ID NO: 1343955 - RNA, 14 nt, Human
guuacauguuugca

SEQ ID NO: 1343956 - RNA, 16 nt, Human
guuacauguuugcacc

SEQ ID NO: 1343957 - RNA, 21 nt, Human
guuacuccaaaacuucguuua

SEQ ID NO: 1343958 - RNA, 15 nt, Human
guuacuacaugcacu

SEQ ID NO: 1343959 - RNA, 15 nt, Human
guuaccuuauaguua

SEQ ID NO: 1343960 - RNA, 18 nt, Human
guuaccuuauaguuacug

SEQ ID NO: 1343961 - RNA, 20 nt, Human
guuaccuuauaguuacugug

SEQ ID NO: 1343962 - RNA, 22 nt, Human
guuaccuuauaguuacugugua

SEQ ID NO: 1343963 - RNA, 18 nt, Human
guuacguagccuaaggcu

SEQ ID NO: 1343964 - RNA, 16 nt, Human
guuaguuccacugaga

SEQ ID NO: 1343965 - RNA, 16 nt, Human
guuaguuuguauauau

SEQ ID NO: 1343966 - RNA, 17 nt, Human
guuaguuuguauauauu

SEQ ID NO: 1343967 - RNA, 21 nt, Human
guuaguuuguauauauuauua

SEQ ID NO: 1343968 - RNA, 15 nt, Human
guuauaaaaaauggu

SEQ ID NO: 1343969 - RNA, 22 nt, Human
guuauaaaaaaugguucagaau

SEQ ID NO: 1343970 - RNA, 16 nt, Human
guuauaaaaaaugguu

SEQ ID NO: 1343971 - RNA, 14 nt, Human
guuauaaagauaca

SEQ ID NO: 1343972 - RNA, 15 nt, Human
guuauaaagauacag

SEQ ID NO: 1343973 - RNA, 13 nt, Human
guuaucucugugu

SEQ ID NO: 1343974 - RNA, 14 nt, Human
guuaucucuguguu

SEQ ID NO: 1343975 - RNA, 19 nt, Human
guuaucuaauagggcaauu

SEQ ID NO: 1343976 - RNA, 12 nt, Human
guuaucucugug

SEQ ID NO: 1343977 - RNA, 15 nt, Human
guuaucuaaguuaau

SEQ ID NO: 1343978 - RNA, 18 nt, Human
guuaucuaaguuaauuua

SEQ ID NO: 1343979 - RNA, 21 nt, Human
guuaucuaaguuaauuuaaag

SEQ ID NO: 1343980 - RNA, 20 nt, Human
guuauccaccugccuuggcu

SEQ ID NO: 1343981 - RNA, 22 nt, Human
guuaucauguuaguaauaccuc

SEQ ID NO: 1343982 - RNA, 23 nt, Human
guuaucauguuaguaauaccucu

SEQ ID NO: 1343983 - RNA, 15 nt, Human
guuaugacuauguaa

SEQ ID NO: 1343984 - RNA, 22 nt, Human
guuaucuucucaaguucuaaga

SEQ ID NO: 1343985 - RNA, 20 nt, Human
guuaugaaauucacccccuu

SEQ ID NO: 1343986 - RNA, 17 nt, Human
guuaucuguuugagaaa

SEQ ID NO: 1343987 - RNA, 18 nt, Human
guuaucuucucaaguucu

SEQ ID NO: 1343988 - RNA, 19 nt, Human
guuaucuucucaaguucua

SEQ ID NO: 1343989 - RNA, 21 nt, Human
guuaucuucucaaguucuaag

SEQ ID NO: 1343990 - RNA, 23 nt, Human
guuaucuucucaaguucuaagau

SEQ ID NO: 1343991 - RNA, 17 nt, Human
guuaugacuauguaaac

SEQ ID NO: 1343992 - RNA, 22 nt, Human
guuaugaugugcuuaacaggga

SEQ ID NO: 1343993 - RNA, 17 nt, Human
guuaugaugugcuuaac

SEQ ID NO: 1343994 - RNA, 16 nt, Human
guuaugaugugcuuaa

SEQ ID NO: 1343995 - RNA, 14 nt, Human
guuaugaugugcuu

SEQ ID NO: 1343996 - RNA, 12 nt, Human
guuaucauguua

SEQ ID NO: 1343997 - RNA, 11 nt, Human
guuaucauguu

SEQ ID NO: 1343998 - RNA, 13 nt, Human
guuaucagugcuu

SEQ ID NO: 1343999 - RNA, 16 nt, Human
guuaucagugcuuccc

SEQ ID NO: 1344000 - RNA, 17 nt, Human
guuaucagugcuucccg

SEQ ID NO: 1344001 - RNA, 20 nt, Human
guuaucaccgugggcucccu

SEQ ID NO: 1344002 - RNA, 22 nt, Human
guuaucaccgugggcucccuga

SEQ ID NO: 1344003 - RNA, 20 nt, Human
guuaucaccuagcugaaugu

SEQ ID NO: 1344004 - RNA, 14 nt, Human
guuauauauaaaua

SEQ ID NO: 1344005 - RNA, 16 nt, Human
guuauauauaaauaua

SEQ ID NO: 1344006 - RNA, 19 nt, Human
guuauauauaaauauauua

SEQ ID NO: 1344007 - RNA, 22 nt, Human
guuauauauaaauauauuauua

SEQ ID NO: 1344008 - RNA, 22 nt, Human
guuauauauggggaugguaguu

SEQ ID NO: 1344009 - RNA, 19 nt, Human
guuauauugaaaaaauaga

SEQ ID NO: 1344010 - RNA, 14 nt, Human
guuauauuuugcag

SEQ ID NO: 1344011 - RNA, 13 nt, Human
guuauaagacucu

SEQ ID NO: 1344012 - RNA, 14 nt, Human
guuauaagacucuc

SEQ ID NO: 1344013 - RNA, 20 nt, Human
guuauagacagucguuccca

SEQ ID NO: 1344014 - RNA, 21 nt, Human
guuauagugaauacugcuaca

SEQ ID NO: 1344015 - RNA, 13 nt, Human
guuauauaaucau

SEQ ID NO: 1344016 - RNA, 12 nt, Human
guuauauaauuu

SEQ ID NO: 1344017 - RNA, 15 nt, Human
guuauauaauuuaga

SEQ ID NO: 1344018 - RNA, 14 nt, Human
guuauauaauuuag

SEQ ID NO: 1344019 - RNA, 13 nt, Human
guuauauauaaau

SEQ ID NO: 1344020 - RNA, 17 nt, Human
guuauuauauuuacaaa

SEQ ID NO: 1344021 - RNA, 21 nt, Human
guuauuaacuuuaauguuuuu

SEQ ID NO: 1344022 - RNA, 22 nt, Human
guuauuagagauuaccuccuga

SEQ ID NO: 1344023 - RNA, 20 nt, Human
guuaugauuuuuuuuucaua

SEQ ID NO: 1344024 - RNA, 16 nt, Human
guuaugcaaaagcaag

SEQ ID NO: 1344025 - RNA, 13 nt, Human
guuaugcugugac

SEQ ID NO: 1344026 - RNA, 23 nt, Human
guucaagugauucucaugccuca

SEQ ID NO: 1344027 - RNA, 21 nt, Human
guucaauauaagcuuuucuuu

SEQ ID NO: 1344028 - RNA, 12 nt, Human
guucaauauuuu

SEQ ID NO: 1344029 - RNA, 16 nt, Human
guucacaccagagaac

SEQ ID NO: 1344030 - RNA, 24 nt, Human
guucacucuacuuagcaugucccu

SEQ ID NO: 1344031 - RNA, 12 nt, Human
guucacauuuuu

SEQ ID NO: 1344032 - RNA, 17 nt, Human
guucaccauuauaauga

SEQ ID NO: 1344033 - RNA, 16 nt, Human
guucacuuuugacaaa

SEQ ID NO: 1344034 - RNA, 20 nt, Human
guucacuuuugacaaaggca

SEQ ID NO: 1344035 - RNA, 20 nt, Human
guucagaauuaaacuuuuaa

SEQ ID NO: 1344036 - RNA, 22 nt, Human
guucagaauuuaguguauccau

SEQ ID NO: 1344037 - RNA, 19 nt, Human
guucagaguccuuaaaaug

SEQ ID NO: 1344038 - RNA, 22 nt, Human
guucauggcagauguaggaggg

SEQ ID NO: 1344039 - RNA, 16 nt, Human
guucauguaaauaaua

SEQ ID NO: 1344040 - RNA, 20 nt, Human
guucaugggggagggggcag

SEQ ID NO: 1344041 - RNA, 12 nt, Human
guucaugagaau

SEQ ID NO: 1344042 - RNA, 19 nt, Human
guucaugagaaucuauauu

SEQ ID NO: 1344043 - RNA, 14 nt, Human
guucaugagaaucu

SEQ ID NO: 1344044 - RNA, 15 nt, Human
guucaugcagcugug

SEQ ID NO: 1344045 - RNA, 16 nt, Human
guucaugcagcugugg

SEQ ID NO: 1344046 - RNA, 12 nt, Human
guucaugaaaga

SEQ ID NO: 1344047 - RNA, 16 nt, Human
guucaucaaugaauga

SEQ ID NO: 1344048 - RNA, 16 nt, Human
guucauccauucuauu

SEQ ID NO: 1344049 - RNA, 18 nt, Human
guucauauuaagaaugau

SEQ ID NO: 1344050 - RNA, 15 nt, Human
guucagccaagguuu

SEQ ID NO: 1344051 - RNA, 18 nt, Human
guucagcacugucccuug

SEQ ID NO: 1344052 - RNA, 12 nt, Human
guucagaauuua

SEQ ID NO: 1344053 - RNA, 19 nt, Human
guucagcauggcauccaag

SEQ ID NO: 1344054 - RNA, 12 nt, Human
guucagccaagg

SEQ ID NO: 1344055 - RNA, 14 nt, Human
guucagcacugucc

SEQ ID NO: 1344056 - RNA, 15 nt, Human
guucagcacuguccc

SEQ ID NO: 1344057 - RNA, 16 nt, Human
guucagcacugucccu

SEQ ID NO: 1344058 - RNA, 22 nt, Human
guucagcacugucccuugccuc

SEQ ID NO: 1344059 - RNA, 15 nt, Human
guucauuccuccagg

SEQ ID NO: 1344060 - RNA, 16 nt, Human
guucauugcacuuuga

SEQ ID NO: 1344061 - RNA, 13 nt, Human
guucauuuccuca

SEQ ID NO: 1344062 - RNA, 13 nt, Human
guucauuugugua

SEQ ID NO: 1344063 - RNA, 14 nt, Human
guucauuccuccag

SEQ ID NO: 1344064 - RNA, 13 nt, Human
guucauuccucca

SEQ ID NO: 1344065 - RNA, 18 nt, Human
guucauuagaaauauuuu

SEQ ID NO: 1344066 - RNA, 16 nt, Human
guucauuagaaauauu

SEQ ID NO: 1344067 - RNA, 19 nt, Human
guucauuagaaauauuuua

SEQ ID NO: 1344068 - RNA, 14 nt, Human
guuccaaauucagu

SEQ ID NO: 1344069 - RNA, 15 nt, Human
guuccaaauucaguu

SEQ ID NO: 1344070 - RNA, 20 nt, Human
guuccaaauucaguuucaua

SEQ ID NO: 1344071 - RNA, 14 nt, Human
guuccaagagucua

SEQ ID NO: 1344072 - RNA, 16 nt, Human
guuccaagagucuaaa

SEQ ID NO: 1344073 - RNA, 18 nt, Human
guuccaagagucuaaaga

SEQ ID NO: 1344074 - RNA, 20 nt, Human
guuccaagagucuaaagaug

SEQ ID NO: 1344075 - RNA, 11 nt, Human
guuccacagac

SEQ ID NO: 1344076 - RNA, 14 nt, Human
guuccacagaggac

SEQ ID NO: 1344077 - RNA, 12 nt, Human
guuccacagacg

SEQ ID NO: 1344078 - RNA, 12 nt, Human
guuccacugaga

SEQ ID NO: 1344079 - RNA, 13 nt, Human
guuccacugagac

SEQ ID NO: 1344080 - RNA, 23 nt, Human
guuccagcaauucuccugccuca

SEQ ID NO: 1344081 - RNA, 20 nt, Human
guuccagcaauucuccugcc

SEQ ID NO: 1344082 - RNA, 21 nt, Human
guuccagcaauucuccugccu

SEQ ID NO: 1344083 - RNA, 14 nt, Human
guuccacugagacc

SEQ ID NO: 1344084 - RNA, 18 nt, Human
guuccacuuauagccucu

SEQ ID NO: 1344085 - RNA, 23 nt, Human
guuccuagugauggcuuaugaua

SEQ ID NO: 1344086 - RNA, 14 nt, Human
guuccuagagaaga

SEQ ID NO: 1344087 - RNA, 15 nt, Human
guuccggcauggaca

SEQ ID NO: 1344088 - RNA, 19 nt, Human
guuccuaagagugcugggc

SEQ ID NO: 1344089 - RNA, 20 nt, Human
guuccagggucccucugugu

SEQ ID NO: 1344090 - RNA, 21 nt, Human
guuccagggucccucugugua

SEQ ID NO: 1344091 - RNA, 17 nt, Human
guuccagaagugugacu

SEQ ID NO: 1344092 - RNA, 19 nt, Human
guuccacuuauagccucug

SEQ ID NO: 1344093 - RNA, 14 nt, Human
guuccagaaaguaa

SEQ ID NO: 1344094 - RNA, 17 nt, Human
guuccagggucccucug

SEQ ID NO: 1344095 - RNA, 19 nt, Human
guuccagggucccucugug

SEQ ID NO: 1344096 - RNA, 23 nt, Human
guuccuccccuccuccuggacuc

SEQ ID NO: 1344097 - RNA, 16 nt, Human
guuccuccccuccagc

SEQ ID NO: 1344098 - RNA, 23 nt, Human
guuccuccccuccagcucccugu

SEQ ID NO: 1344099 - RNA, 16 nt, Human
guuccugugcacagcc

SEQ ID NO: 1344100 - RNA, 15 nt, Human
guuccugugcacagc

SEQ ID NO: 1344101 - RNA, 14 nt, Human
guuccuguggcucc

SEQ ID NO: 1344102 - RNA, 16 nt, Human
guuccuguggcucccu

SEQ ID NO: 1344103 - RNA, 12 nt, Human
guuccuucccaa

SEQ ID NO: 1344104 - RNA, 12 nt, Human
guuccugcaugc

SEQ ID NO: 1344105 - RNA, 11 nt, Human
guuccugcugc

SEQ ID NO: 1344106 - RNA, 14 nt, Human
guuccugcugcugu

SEQ ID NO: 1344107 - RNA, 15 nt, Human
guuccugcugcuguc

SEQ ID NO: 1344108 - RNA, 22 nt, Human
guuccugcugcugucugggugc

SEQ ID NO: 1344109 - RNA, 17 nt, Human
guuccugcugcugucug

SEQ ID NO: 1344110 - RNA, 12 nt, Human
guguguuuuaaa

SEQ ID NO: 1344111 - RNA, 15 nt, Human
guguguuucugaucu

SEQ ID NO: 1344112 - RNA, 17 nt, Human
guguguugauacuguug

SEQ ID NO: 1344113 - RNA, 19 nt, Human
guguguugauacuguugca

SEQ ID NO: 1344114 - RNA, 20 nt, Human
guguguugauacuguugcac

SEQ ID NO: 1344115 - RNA, 21 nt, Human
guguguugauacuguugcacg

SEQ ID NO: 1344116 - RNA, 23 nt, Human
guguguugauacuguugcacgug

SEQ ID NO: 1344117 - RNA, 22 nt, Human
guguguugauacuguugcacgu

SEQ ID NO: 1344118 - RNA, 14 nt, Human
guguguugucucuu

SEQ ID NO: 1344119 - RNA, 16 nt, Human
guguguugucucuuga

SEQ ID NO: 1344120 - RNA, 16 nt, Human
gugugcuuuuuuugug

SEQ ID NO: 1344121 - RNA, 21 nt, Human
guguggaaguuauuaacuuua

SEQ ID NO: 1344122 - RNA, 14 nt, Human
guguggacaggacu

SEQ ID NO: 1344123 - RNA, 13 nt, Human
guguggacaggac

SEQ ID NO: 1344124 - RNA, 18 nt, Human
guguggagagggaaugug

SEQ ID NO: 1344125 - RNA, 20 nt, Human
guguggagagggaaugugaa

SEQ ID NO: 1344126 - RNA, 19 nt, Human
guguggcuuucagagccuc

SEQ ID NO: 1344127 - RNA, 11 nt, Human
gugugggagac

SEQ ID NO: 1344128 - RNA, 21 nt, Human
guguggagagggaaugugaaa

SEQ ID NO: 1344129 - RNA, 14 nt, Human
guguggcuccuucc

SEQ ID NO: 1344130 - RNA, 17 nt, Human
gugugcucaggagcccu

SEQ ID NO: 1344131 - RNA, 16 nt, Human
gugugcucaggagccc

SEQ ID NO: 1344132 - RNA, 16 nt, Human
gugugcggcugugugu

SEQ ID NO: 1344133 - RNA, 16 nt, Human
gugugcccccuucaag

SEQ ID NO: 1344134 - RNA, 13 nt, Human
gugugcccucugg

SEQ ID NO: 1344135 - RNA, 16 nt, Human
gugugcccucugggcu

SEQ ID NO: 1344136 - RNA, 17 nt, Human
gugugcccucugggcuc

SEQ ID NO: 1344137 - RNA, 22 nt, Human
gugugcccucugggcucugagu

SEQ ID NO: 1344138 - RNA, 21 nt, Human
gugugcccucugggcucugag

SEQ ID NO: 1344139 - RNA, 19 nt, Human
gugugcucaggagcccugg

SEQ ID NO: 1344140 - RNA, 18 nt, Human
gugugcucaggagcccug

SEQ ID NO: 1344141 - RNA, 15 nt, Human
gugugcucuccauuc

SEQ ID NO: 1344142 - RNA, 16 nt, Human
gugugcucuccauucu

SEQ ID NO: 1344143 - RNA, 21 nt, Human
gugugcucuccauucugcucc

SEQ ID NO: 1344144 - RNA, 22 nt, Human
gugugcucuccauucugcuccu

SEQ ID NO: 1344145 - RNA, 23 nt, Human
gugugcucuccauucugcuccuu

SEQ ID NO: 1344146 - RNA, 11 nt, Human
gugugcuggga

SEQ ID NO: 1344147 - RNA, 12 nt, Human
gugugcugggag

SEQ ID NO: 1344148 - RNA, 19 nt, Human
gugugcugggagcuccacu

SEQ ID NO: 1344149 - RNA, 17 nt, Human
gugugcuuuuuuugugu

SEQ ID NO: 1344150 - RNA, 17 nt, Human
gugucucaggcugccug

SEQ ID NO: 1344151 - RNA, 19 nt, Human
gugucucaggcugccugag

SEQ ID NO: 1344152 - RNA, 20 nt, Human
gugucucaggcugccugagu

SEQ ID NO: 1344153 - RNA, 14 nt, Human
gugucuaagauucu

SEQ ID NO: 1344154 - RNA, 15 nt, Human
gugucuaagauucua

SEQ ID NO: 1344155 - RNA, 16 nt, Human
gugucuaagauucuag

SEQ ID NO: 1344156 - RNA, 17 nt, Human
gugucuaagauucuaga

SEQ ID NO: 1344157 - RNA, 18 nt, Human
gugucuaagauucuagau

SEQ ID NO: 1344158 - RNA, 19 nt, Human
gugucuaagauucuagauc

SEQ ID NO: 1344159 - RNA, 20 nt, Human
gugucuaagauucuagauca

SEQ ID NO: 1344160 - RNA, 11 nt, Human
gugucucaggc

SEQ ID NO: 1344161 - RNA, 12 nt, Human
gugucucaggcu

SEQ ID NO: 1344162 - RNA, 14 nt, Human
gugucucaggcugc

SEQ ID NO: 1344163 - RNA, 15 nt, Human
gugucucaggcugcc

SEQ ID NO: 1344164 - RNA, 16 nt, Human
gugucucaggcugccu

SEQ ID NO: 1344165 - RNA, 14 nt, Human
gugucccuaaugug

SEQ ID NO: 1344166 - RNA, 12 nt, Human
guguccuacaga

SEQ ID NO: 1344167 - RNA, 14 nt, Human
guguccuacagaaa

SEQ ID NO: 1344168 - RNA, 13 nt, Human
guguccuacagaa

SEQ ID NO: 1344169 - RNA, 20 nt, Human
guguccuccugggguucuuu

SEQ ID NO: 1344170 - RNA, 18 nt, Human
guguccucuucccucucu

SEQ ID NO: 1344171 - RNA, 13 nt, Human
guguccugacacu

SEQ ID NO: 1344172 - RNA, 21 nt, Human
guguccugcaccggggccugg

SEQ ID NO: 1344173 - RNA, 22 nt, Human
guguccugagcucagcguggag

SEQ ID NO: 1344174 - RNA, 23 nt, Human
guguccugagccccagggagagg

SEQ ID NO: 1344175 - RNA, 13 nt, Human
guguccugagcuc

SEQ ID NO: 1344176 - RNA, 15 nt, Human
guguccugagcucag

SEQ ID NO: 1344177 - RNA, 16 nt, Human
gugucugagagauuca

SEQ ID NO: 1344178 - RNA, 17 nt, Human
gugucuggcacagccug

SEQ ID NO: 1344179 - RNA, 15 nt, Human
gugucugcucaguaa

SEQ ID NO: 1344180 - RNA, 14 nt, Human
gugugaucgucuga

SEQ ID NO: 1344181 - RNA, 14 nt, Human
gugugcaaggcagc

SEQ ID NO: 1344182 - RNA, 17 nt, Human
gugugcaaggcagccgu

SEQ ID NO: 1344183 - RNA, 20 nt, Human
gugugcacaaauauuuauuu

SEQ ID NO: 1344184 - RNA, 16 nt, Human
gugugcaccaggguug

SEQ ID NO: 1344185 - RNA, 19 nt, Human
gugugcacgcgugugcagg

SEQ ID NO: 1344186 - RNA, 13 nt, Human
gugugcaggagcg

SEQ ID NO: 1344187 - RNA, 18 nt, Human
guuaaaggugaacauugg

SEQ ID NO: 1344188 - RNA, 16 nt, Human
guuaaauacaggaaac

SEQ ID NO: 1344189 - RNA, 20 nt, Human
guuaaauacaggaaacaguu

SEQ ID NO: 1344190 - RNA, 12 nt, Human
guuaaaaugugu

SEQ ID NO: 1344191 - RNA, 20 nt, Human
guuaaaaacagauuuggaaa

SEQ ID NO: 1344192 - RNA, 14 nt, Human
guuaaaaauaaggu

SEQ ID NO: 1344193 - RNA, 17 nt, Human
guuaacuauugcauuua

SEQ ID NO: 1344194 - RNA, 24 nt, Human
guuaacauuccaagacucuagagu

SEQ ID NO: 1344195 - RNA, 14 nt, Human
guuaacugaauacc

SEQ ID NO: 1344196 - RNA, 16 nt, Human
guuaacugaauaccac

SEQ ID NO: 1344197 - RNA, 20 nt, Human
guuaacugaauaccacucug

SEQ ID NO: 1344198 - RNA, 22 nt, Human
guuaacugaauaccacucugua

SEQ ID NO: 1344199 - RNA, 23 nt, Human
guuaacugaauaccacucuguaa

SEQ ID NO: 1344200 - RNA, 20 nt, Human
guuaacagaagggagggcag

SEQ ID NO: 1344201 - RNA, 21 nt, Human
guuaacagaagggagggcaga

SEQ ID NO: 1344202 - RNA, 23 nt, Human
guuaacagaagggagggcagagc

SEQ ID NO: 1344203 - RNA, 23 nt, Human
guuaacauuccaagacucuagag

SEQ ID NO: 1344204 - RNA, 12 nt, Human
guuaaauguaga

SEQ ID NO: 1344205 - RNA, 21 nt, Human
guuaacacacuaccgaaugug

SEQ ID NO: 1344206 - RNA, 17 nt, Human
guuacacuuuuuggaag

SEQ ID NO: 1344207 - RNA, 18 nt, Human
guuacacuuuuuggaagu

SEQ ID NO: 1344208 - RNA, 22 nt, Human
guuacacuuuuuggaagugaaa

SEQ ID NO: 1344209 - RNA, 18 nt, Human
guuaacugagugccuuuu

SEQ ID NO: 1344210 - RNA, 14 nt, Human
guuaagaaaauaaa

SEQ ID NO: 1344211 - RNA, 15 nt, Human
guuaagaaaauaaau

SEQ ID NO: 1344212 - RNA, 15 nt, Human
guuaagaaauuucac

SEQ ID NO: 1344213 - RNA, 18 nt, Human
guguuuuucauaaagcag

SEQ ID NO: 1344214 - RNA, 21 nt, Human
guguuuuguucaccauuauaa

SEQ ID NO: 1344215 - RNA, 14 nt, Human
guguuuuucuauua

SEQ ID NO: 1344216 - RNA, 15 nt, Human
guguuuuucuauuaa

SEQ ID NO: 1344217 - RNA, 17 nt, Human
guguuuuucuauuaaaa

SEQ ID NO: 1344218 - RNA, 18 nt, Human
guguuuuucuauuaaaag

SEQ ID NO: 1344219 - RNA, 19 nt, Human
guguuuuucuauuaaaaga

SEQ ID NO: 1344220 - RNA, 21 nt, Human
guguuuuucuauuaaaagacu

SEQ ID NO: 1344221 - RNA, 23 nt, Human
guguuuuucuauuaaaagacuca

SEQ ID NO: 1344222 - RNA, 22 nt, Human
guguuuuucuauuaaaagacuc

SEQ ID NO: 1344223 - RNA, 19 nt, Human
guguuuuuuuaugaauggg

SEQ ID NO: 1344224 - RNA, 13 nt, Human
guguucugugaua

SEQ ID NO: 1344225 - RNA, 15 nt, Human
guguuuuaauuuaaa

SEQ ID NO: 1344226 - RNA, 15 nt, Human
guguuuugaaagaau

SEQ ID NO: 1344227 - RNA, 20 nt, Human
guguuuugaaagaauagaac

SEQ ID NO: 1344228 - RNA, 16 nt, Human
guguuuuguucaccau

SEQ ID NO: 1344229 - RNA, 16 nt, Human
guguuaucaccuagcu

SEQ ID NO: 1344230 - RNA, 21 nt, Human
guguuauuuggaaccuuguuu

SEQ ID NO: 1344231 - RNA, 20 nt, Human
guguuauuuucauucaaagu

SEQ ID NO: 1344232 - RNA, 23 nt, Human
guguuauuuuguuuuuccuucca

SEQ ID NO: 1344233 - RNA, 14 nt, Human
guguucaauauuuu

SEQ ID NO: 1344234 - RNA, 16 nt, Human
guguucaauauuuucu

SEQ ID NO: 1344235 - RNA, 14 nt, Human
guguucauuguuuc

SEQ ID NO: 1344236 - RNA, 17 nt, Human
guguucccauuucagcu

SEQ ID NO: 1344237 - RNA, 17 nt, Human
guguuccccacuguauc

SEQ ID NO: 1344238 - RNA, 21 nt, Human
guguucccauuucagcugauc

SEQ ID NO: 1344239 - RNA, 18 nt, Human
guguuccccuuccacuga

SEQ ID NO: 1344240 - RNA, 19 nt, Human
guguuccccuuccacugag

SEQ ID NO: 1344241 - RNA, 22 nt, Human
guguuccccuuccacugagggc

SEQ ID NO: 1344242 - RNA, 23 nt, Human
guguuccccuuccacugagggca

SEQ ID NO: 1344243 - RNA, 15 nt, Human
guguucccuauccaa

SEQ ID NO: 1344244 - RNA, 14 nt, Human
guguuccuuccgcu

SEQ ID NO: 1344245 - RNA, 13 nt, Human
guguucuaagaug

SEQ ID NO: 1344246 - RNA, 22 nt, Human
guguucuaagaugugauauucu

SEQ ID NO: 1344247 - RNA, 15 nt, Human
guguucuccugcugc

SEQ ID NO: 1344248 - RNA, 20 nt, Human
guguucuccugcugcucccu

SEQ ID NO: 1344249 - RNA, 22 nt, Human
guguucuccugcugcucccuca

SEQ ID NO: 1344250 - RNA, 23 nt, Human
guguucuccugcugcucccucag

SEQ ID NO: 1344251 - RNA, 11 nt, Human
guguucuccuu

SEQ ID NO: 1344252 - RNA, 16 nt, Human
guguucuccuuuuccu

SEQ ID NO: 1344253 - RNA, 14 nt, Human
guguguuuuucaua

SEQ ID NO: 1344254 - RNA, 14 nt, Human
guguguuuuucuau

SEQ ID NO: 1344255 - RNA, 15 nt, Human
guguguuuuucuauu

SEQ ID NO: 1344256 - RNA, 16 nt, Human
guguguuuuucuauua

SEQ ID NO: 1344257 - RNA, 20 nt, Human
guguguuuuucuauuaaaag

SEQ ID NO: 1344258 - RNA, 21 nt, Human
guguguuuuucuauuaaaaga

SEQ ID NO: 1344259 - RNA, 21 nt, Human
guguuaaaugugaugaauacu

SEQ ID NO: 1344260 - RNA, 14 nt, Human
guguuaacagaagg

SEQ ID NO: 1344261 - RNA, 22 nt, Human
guguuaacagaagggagggcag

SEQ ID NO: 1344262 - RNA, 23 nt, Human
guguuaacagaagggagggcaga

SEQ ID NO: 1344263 - RNA, 14 nt, Human
guguuaacauucca

SEQ ID NO: 1344264 - RNA, 17 nt, Human
guguuaacauuccaaga

SEQ ID NO: 1344265 - RNA, 15 nt, Human
guguuaagcucugcu

SEQ ID NO: 1344266 - RNA, 14 nt, Human
guguuaagcucugc

SEQ ID NO: 1344267 - RNA, 19 nt, Human
guguguuuuaaaaugagaa

SEQ ID NO: 1344268 - RNA, 16 nt, Human
guguguuuuaaaauga

SEQ ID NO: 1344269 - RNA, 13 nt, Human
guguguuuuaaaa

SEQ ID NO: 1344270 - RNA, 12 nt, Human
guguuaauuuuu

SEQ ID NO: 1344271 - RNA, 15 nt, Human
guguuaauuuuugau

SEQ ID NO: 1344272 - RNA, 23 nt, Human
guguuacccaguaacucaucugu

SEQ ID NO: 1344273 - RNA, 16 nt, Human
guguuaccugaaaaca

SEQ ID NO: 1344274 - RNA, 12 nt, Human
guguuaccugua

SEQ ID NO: 1344275 - RNA, 20 nt, Human
guguuacuaaaaaaaagaug

SEQ ID NO: 1344276 - RNA, 21 nt, Human
guguuacuaaaaaaaagauga

SEQ ID NO: 1344277 - RNA, 23 nt, Human
guguuagggaagggccugccaca

SEQ ID NO: 1344278 - RNA, 19 nt, Human
guguuacuguaauuccuca

SEQ ID NO: 1344279 - RNA, 15 nt, Human
guguuacuguaauuc

SEQ ID NO: 1344280 - RNA, 21 nt, Human
guguuagccuuuuuuccccag

SEQ ID NO: 1344281 - RNA, 16 nt, Human
guguuagggaagggcc

SEQ ID NO: 1344282 - RNA, 22 nt, Human
guguuagggaagggccugccac

SEQ ID NO: 1344283 - RNA, 14 nt, Human
guguaugcacagua

SEQ ID NO: 1344284 - RNA, 17 nt, Human
guguaugcacaugaacu

SEQ ID NO: 1344285 - RNA, 19 nt, Human
guguauggaaauaaaugua

SEQ ID NO: 1344286 - RNA, 22 nt, Human
gugucccagaagaugacugagg

SEQ ID NO: 1344287 - RNA, 18 nt, Human
gugucccagaagaugacu

SEQ ID NO: 1344288 - RNA, 21 nt, Human
gugucccauucccccagugcg

SEQ ID NO: 1344289 - RNA, 12 nt, Human
guguccccaaca

SEQ ID NO: 1344290 - RNA, 18 nt, Human
guguccccaacagcgccc

SEQ ID NO: 1344291 - RNA, 19 nt, Human
guguccccaacagcgccca

SEQ ID NO: 1344292 - RNA, 18 nt, Human
gugucccccucuguccag

SEQ ID NO: 1344293 - RNA, 14 nt, Human
gugucccccucugu

SEQ ID NO: 1344294 - RNA, 15 nt, Human
guguaucaaaaugcu

SEQ ID NO: 1344295 - RNA, 14 nt, Human
guguaucucacacu

SEQ ID NO: 1344296 - RNA, 17 nt, Human
guguauaaacaagaaaa

SEQ ID NO: 1344297 - RNA, 19 nt, Human
guguauaaacaagaaaaau

SEQ ID NO: 1344298 - RNA, 12 nt, Human
guguauauauau

SEQ ID NO: 1344299 - RNA, 13 nt, Human
guguauauggaca

SEQ ID NO: 1344300 - RNA, 22 nt, Human
guguagcuacagagaaaccagc

SEQ ID NO: 1344301 - RNA, 12 nt, Human
guguagcuguga

SEQ ID NO: 1344302 - RNA, 15 nt, Human
guguagcugugaccu

SEQ ID NO: 1344303 - RNA, 16 nt, Human
guguagcugugaccug

SEQ ID NO: 1344304 - RNA, 18 nt, Human
guguagcugugaccugcu

SEQ ID NO: 1344305 - RNA, 19 nt, Human
guguagcugugaccugcug

SEQ ID NO: 1344306 - RNA, 20 nt, Human
guguagcugugaccugcuga

SEQ ID NO: 1344307 - RNA, 21 nt, Human
guguagcugugaccugcugag

SEQ ID NO: 1344308 - RNA, 22 nt, Human
guguagcugugaccugcugagc

SEQ ID NO: 1344309 - RNA, 14 nt, Human
guguagcuuugcuc

SEQ ID NO: 1344310 - RNA, 23 nt, Human
guguagcugugaccugcugagcu

SEQ ID NO: 1344311 - RNA, 15 nt, Human
guguaguucauguaa

SEQ ID NO: 1344312 - RNA, 17 nt, Human
guguaguucauguaaau

SEQ ID NO: 1344313 - RNA, 12 nt, Human
guguauaaaaau

SEQ ID NO: 1344314 - RNA, 14 nt, Human
guguauaaaaauaa

SEQ ID NO: 1344315 - RNA, 18 nt, Human
guguauaaaaauaaaaaa

SEQ ID NO: 1344316 - RNA, 12 nt, Human
guguauaaacaa

SEQ ID NO: 1344317 - RNA, 14 nt, Human
guguauaaacaaga

SEQ ID NO: 1344318 - RNA, 17 nt, Human
guguaccauuugccucc

SEQ ID NO: 1344319 - RNA, 20 nt, Human
guguaccgcgucuacccugg

SEQ ID NO: 1344320 - RNA, 22 nt, Human
guguaccgcgucuacccuggga

SEQ ID NO: 1344321 - RNA, 14 nt, Human
guguagaacacuaa

SEQ ID NO: 1344322 - RNA, 15 nt, Human
guguagaacacuaau

SEQ ID NO: 1344323 - RNA, 19 nt, Human
guguagaacacuaauucau

SEQ ID NO: 1344324 - RNA, 16 nt, Human
guguagcaacuacagu

SEQ ID NO: 1344325 - RNA, 17 nt, Human
guguagccacaccagga

SEQ ID NO: 1344326 - RNA, 11 nt, Human
guguagccuuu

SEQ ID NO: 1344327 - RNA, 12 nt, Human
guguagccuuuu

SEQ ID NO: 1344328 - RNA, 13 nt, Human
guguagccuuuuu

SEQ ID NO: 1344329 - RNA, 20 nt, Human
guguagccuuuuuguauaaa

SEQ ID NO: 1344330 - RNA, 15 nt, Human
guguagcuacagaga

SEQ ID NO: 1344331 - RNA, 16 nt, Human
guguagcuacagagaa

SEQ ID NO: 1344332 - RNA, 17 nt, Human
guguagcuacagagaaa

SEQ ID NO: 1344333 - RNA, 18 nt, Human
guguagcuacagagaaac

SEQ ID NO: 1344334 - RNA, 20 nt, Human
guguagcuacagagaaacca

SEQ ID NO: 1344335 - RNA, 16 nt, Human
guguacauaacugaaa

SEQ ID NO: 1344336 - RNA, 12 nt, Human
guguacauaugu

SEQ ID NO: 1344337 - RNA, 15 nt, Human
guguacauaugugcu

SEQ ID NO: 1344338 - RNA, 14 nt, Human
guguacauaacuga

SEQ ID NO: 1344339 - RNA, 16 nt, Human
guguaaugaauaccuu

SEQ ID NO: 1344340 - RNA, 18 nt, Human
guguaauugagaaggaaa

SEQ ID NO: 1344341 - RNA, 17 nt, Human
guguaagacaaaaagcu

SEQ ID NO: 1344342 - RNA, 17 nt, Human
guggugcgagugcguga

SEQ ID NO: 1344343 - RNA, 21 nt, Human
guguaagauuuguuuuuaaac

SEQ ID NO: 1344344 - RNA, 19 nt, Human
guguaagggccagaaauau

SEQ ID NO: 1344345 - RNA, 21 nt, Human
guguaaguagauaggccaugg

SEQ ID NO: 1344346 - RNA, 23 nt, Human
guggugaaaagcagguugauaaa

SEQ ID NO: 1344347 - RNA, 20 nt, Human
guggucuguuggcaggcugg

SEQ ID NO: 1344348 - RNA, 21 nt, Human
guggucuguuggcaggcuggc

SEQ ID NO: 1344349 - RNA, 22 nt, Human
guggucuguuggcaggcuggcc

SEQ ID NO: 1344350 - RNA, 23 nt, Human
guggucuguuggcaggcuggcca

SEQ ID NO: 1344351 - RNA, 13 nt, Human
guggucuguuggc

SEQ ID NO: 1344352 - RNA, 17 nt, Human
guggucuguuggcaggc

SEQ ID NO: 1344353 - RNA, 19 nt, Human
guggucuguuggcaggcug

SEQ ID NO: 1344354 - RNA, 13 nt, Human
gugguagagaagc

SEQ ID NO: 1344355 - RNA, 14 nt, Human
gugguacccucugg

SEQ ID NO: 1344356 - RNA, 21 nt, Human
gugguaagcaacauggcuuug

SEQ ID NO: 1344357 - RNA, 12 nt, Human
gugguacagaga

SEQ ID NO: 1344358 - RNA, 13 nt, Human
gugguacagagaa

SEQ ID NO: 1344359 - RNA, 14 nt, Human
gugguacagagaag

SEQ ID NO: 1344360 - RNA, 15 nt, Human
gugguacagagaagc

SEQ ID NO: 1344361 - RNA, 16 nt, Human
gugguacagagaagcc

SEQ ID NO: 1344362 - RNA, 17 nt, Human
gugguacagagaagcca

SEQ ID NO: 1344363 - RNA, 18 nt, Human
gugguacagagaagccag

SEQ ID NO: 1344364 - RNA, 22 nt, Human
gugguacagagaagccagcuug

SEQ ID NO: 1344365 - RNA, 14 nt, Human
gugguaucuugcag

SEQ ID NO: 1344366 - RNA, 23 nt, Human
gugguacagagaagccagcuugu

SEQ ID NO: 1344367 - RNA, 14 nt, Human
gugguauuuucaau

SEQ ID NO: 1344368 - RNA, 23 nt, Human
gugguauuuucaauagccacuaa

SEQ ID NO: 1344369 - RNA, 15 nt, Human
guggucacagcggag

SEQ ID NO: 1344370 - RNA, 16 nt, Human
guggucacagcggagg

SEQ ID NO: 1344371 - RNA, 18 nt, Human
guggucacagcggaggug

SEQ ID NO: 1344372 - RNA, 22 nt, Human
guggucacagcggaggugugga

SEQ ID NO: 1344373 - RNA, 14 nt, Human
guggucacagcugu

SEQ ID NO: 1344374 - RNA, 21 nt, Human
gugguauuuucaauagccacu

SEQ ID NO: 1344375 - RNA, 15 nt, Human
gugggcauucaaaug

SEQ ID NO: 1344376 - RNA, 17 nt, Human
gugggccaacaaagaac

SEQ ID NO: 1344377 - RNA, 15 nt, Human
gugggccagucugug

SEQ ID NO: 1344378 - RNA, 16 nt, Human
gugggccagucugugg

SEQ ID NO: 1344379 - RNA, 13 nt, Human
gugggccugggcu

SEQ ID NO: 1344380 - RNA, 17 nt, Human
gugggccagucugugga

SEQ ID NO: 1344381 - RNA, 18 nt, Human
gugggccagucuguggau

SEQ ID NO: 1344382 - RNA, 14 nt, Human
gugggccccacccu

SEQ ID NO: 1344383 - RNA, 13 nt, Human
gugggcucccuga

SEQ ID NO: 1344384 - RNA, 14 nt, Human
gugggcucccugac

SEQ ID NO: 1344385 - RNA, 15 nt, Human
gugggcucccugacu

SEQ ID NO: 1344386 - RNA, 19 nt, Human
gugggccuucagggaguga

SEQ ID NO: 1344387 - RNA, 17 nt, Human
gugggccugggcuccug

SEQ ID NO: 1344388 - RNA, 18 nt, Human
gugggccugggcuccugg

SEQ ID NO: 1344389 - RNA, 20 nt, Human
gugggccugggcuccuggac

SEQ ID NO: 1344390 - RNA, 21 nt, Human
gugggccugggcuccuggacc

SEQ ID NO: 1344391 - RNA, 18 nt, Human
gugggcgugagaccugcc

SEQ ID NO: 1344392 - RNA, 21 nt, Human
gugggcgugagaccugccccu

SEQ ID NO: 1344393 - RNA, 22 nt, Human
gugggcgugagaccugccccuc

SEQ ID NO: 1344394 - RNA, 17 nt, Human
guggguuuuuauuuccu

SEQ ID NO: 1344395 - RNA, 12 nt, Human
gugguaaaaagg

SEQ ID NO: 1344396 - RNA, 18 nt, Human
guggguuuuuuaguugaa

SEQ ID NO: 1344397 - RNA, 14 nt, Human
guggggccagguca

SEQ ID NO: 1344398 - RNA, 17 nt, Human
guggggcagcuccucug

SEQ ID NO: 1344399 - RNA, 14 nt, Human
guggguuccacaga

SEQ ID NO: 1344400 - RNA, 15 nt, Human
guggguuccacagac

SEQ ID NO: 1344401 - RNA, 13 nt, Human
guggggcagaggc

SEQ ID NO: 1344402 - RNA, 21 nt, Human
guggggagagacgggcccugg

SEQ ID NO: 1344403 - RNA, 17 nt, Human
guggggagacugggcug

SEQ ID NO: 1344404 - RNA, 14 nt, Human
gugggcuugauucu

SEQ ID NO: 1344405 - RNA, 22 nt, Human
gugggcuuguggggccugggag

SEQ ID NO: 1344406 - RNA, 13 nt, Human
guggggaggggcu

SEQ ID NO: 1344407 - RNA, 19 nt, Human
guggggauaggccagccgc

SEQ ID NO: 1344408 - RNA, 12 nt, Human
guggggaguggg

SEQ ID NO: 1344409 - RNA, 15 nt, Human
gugcuaauuuugaaa

SEQ ID NO: 1344410 - RNA, 13 nt, Human
gugcuaauuuuga

SEQ ID NO: 1344411 - RNA, 15 nt, Human
guggcuacucugugc

SEQ ID NO: 1344412 - RNA, 16 nt, Human
guggcuacucugugcc

SEQ ID NO: 1344413 - RNA, 17 nt, Human
guggcuacucugugcca

SEQ ID NO: 1344414 - RNA, 18 nt, Human
guggcuacucugugccag

SEQ ID NO: 1344415 - RNA, 20 nt, Human
guggcuacucugugccagag

SEQ ID NO: 1344416 - RNA, 21 nt, Human
guggcuacucugugccagagc

SEQ ID NO: 1344417 - RNA, 22 nt, Human
guggcuacucugugccagagcc

SEQ ID NO: 1344418 - RNA, 23 nt, Human
guggcuacucugugccagagccu

SEQ ID NO: 1344419 - RNA, 13 nt, Human
guggcuccuuccc

SEQ ID NO: 1344420 - RNA, 15 nt, Human
guggcugcuguggga

SEQ ID NO: 1344421 - RNA, 16 nt, Human
guggcucgggaggcga

SEQ ID NO: 1344422 - RNA, 20 nt, Human
guggcuccucccggugccca

SEQ ID NO: 1344423 - RNA, 13 nt, Human
guggcuccucccg

SEQ ID NO: 1344424 - RNA, 15 nt, Human
guggcucagccagca

SEQ ID NO: 1344425 - RNA, 22 nt, Human
guggcucacucagcacuuggcc

SEQ ID NO: 1344426 - RNA, 15 nt, Human
guggcugguccaggg

SEQ ID NO: 1344427 - RNA, 17 nt, Human
guggcugguccagggcu

SEQ ID NO: 1344428 - RNA, 18 nt, Human
guggcuucccgcucagcc

SEQ ID NO: 1344429 - RNA, 19 nt, Human
guggcuucccgcucagccc

SEQ ID NO: 1344430 - RNA, 20 nt, Human
guggcuucccgcucagcccu

SEQ ID NO: 1344431 - RNA, 20 nt, Human
guggcuggaagauccugcgg

SEQ ID NO: 1344432 - RNA, 13 nt, Human
guggcuggggcau

SEQ ID NO: 1344433 - RNA, 12 nt, Human
guggcuggaaga

SEQ ID NO: 1344434 - RNA, 17 nt, Human
guggcuggaagauccug

SEQ ID NO: 1344435 - RNA, 18 nt, Human
gugcacuggccccacccu

SEQ ID NO: 1344436 - RNA, 13 nt, Human
gugcacugggagg

SEQ ID NO: 1344437 - RNA, 15 nt, Human
gugcacugggaggcu

SEQ ID NO: 1344438 - RNA, 17 nt, Human
gugcacuggccccaccc

SEQ ID NO: 1344439 - RNA, 16 nt, Human
gugcacuggccccacc

SEQ ID NO: 1344440 - RNA, 21 nt, Human
gugcacugggaggcuccccuu

SEQ ID NO: 1344441 - RNA, 20 nt, Human
gugcacugggaggcuccccu

SEQ ID NO: 1344442 - RNA, 13 nt, Human
gugcacuggcccc

SEQ ID NO: 1344443 - RNA, 21 nt, Human
gugcacugcccauggacaggc

SEQ ID NO: 1344444 - RNA, 19 nt, Human
gugcacugcccauggacag

SEQ ID NO: 1344445 - RNA, 20 nt, Human
gugcacugcccauggacagg

SEQ ID NO: 1344446 - RNA, 15 nt, Human
gugcacugcccaugg

SEQ ID NO: 1344447 - RNA, 21 nt, Human
gugauuuuuaugccaccugaa

SEQ ID NO: 1344448 - RNA, 23 nt, Human
gugauuuuuuuuuuuuuccuguc

SEQ ID NO: 1344449 - RNA, 24 nt, Human
gugauccacccgccucagccuccc

SEQ ID NO: 1344450 - RNA, 20 nt, Human
gugauccacccgccucagcc

SEQ ID NO: 1344451 - RNA, 18 nt, Human
gugauuuacgcucauugu

SEQ ID NO: 1344452 - RNA, 19 nt, Human
gugcagcccccacugccuu

SEQ ID NO: 1344453 - RNA, 17 nt, Human
gugcagccgcugagcga

SEQ ID NO: 1344454 - RNA, 18 nt, Human
gugcagccgcugagcgag

SEQ ID NO: 1344455 - RNA, 15 nt, Human
gugcagcauuucacu

SEQ ID NO: 1344456 - RNA, 16 nt, Human
gugcagcauuucacuu

SEQ ID NO: 1344457 - RNA, 16 nt, Human
gugcaguuauuugcuu

SEQ ID NO: 1344458 - RNA, 13 nt, Human
gugcaucucagcc

SEQ ID NO: 1344459 - RNA, 14 nt, Human
gugcaucucagccc

SEQ ID NO: 1344460 - RNA, 11 nt, Human
gugcaucaggc

SEQ ID NO: 1344461 - RNA, 20 nt, Human
gugcaucaggcuuucuuuuu

SEQ ID NO: 1344462 - RNA, 13 nt, Human
gugccaggaccag

SEQ ID NO: 1344463 - RNA, 16 nt, Human
gugccaggaccaguca

SEQ ID NO: 1344464 - RNA, 13 nt, Human
gugcuaagguucu

SEQ ID NO: 1344465 - RNA, 14 nt, Human
gugcuaagguucua

SEQ ID NO: 1344466 - RNA, 15 nt, Human
gugcuaagguucuaa

SEQ ID NO: 1344467 - RNA, 17 nt, Human
gugcuaagguucuaagg

SEQ ID NO: 1344468 - RNA, 16 nt, Human
gugcuaagguucuaag

SEQ ID NO: 1344469 - RNA, 21 nt, Human
gugcguggaaugcccuucacu

SEQ ID NO: 1344470 - RNA, 13 nt, Human
gugcguggugcga

SEQ ID NO: 1344471 - RNA, 15 nt, Human
gugcguggugguccc

SEQ ID NO: 1344472 - RNA, 19 nt, Human
gugcgugguggucccuggg

SEQ ID NO: 1344473 - RNA, 20 nt, Human
gugcgugguggucccugggu

SEQ ID NO: 1344474 - RNA, 14 nt, Human
gugcgcccagggcu

SEQ ID NO: 1344475 - RNA, 15 nt, Human
gugcgcccagggcug

SEQ ID NO: 1344476 - RNA, 16 nt, Human
gugcgcccagggcugg

SEQ ID NO: 1344477 - RNA, 18 nt, Human
gugcgagggacccagcua

SEQ ID NO: 1344478 - RNA, 12 nt, Human
gugcgcccaggg

SEQ ID NO: 1344479 - RNA, 13 nt, Human
gugcgcccagggc

SEQ ID NO: 1344480 - RNA, 15 nt, Human
gugcggaccacccuc

SEQ ID NO: 1344481 - RNA, 16 nt, Human
gugcggcuggccaugg

SEQ ID NO: 1344482 - RNA, 15 nt, Human
gugcguccacgagcu

SEQ ID NO: 1344483 - RNA, 13 nt, Human
gugcgugaauauu

SEQ ID NO: 1344484 - RNA, 14 nt, Human
gugccuucucucuc

SEQ ID NO: 1344485 - RNA, 23 nt, Human
gugccuuccuguuuuucacauuu

SEQ ID NO: 1344486 - RNA, 15 nt, Human
gugccuucucucucc

SEQ ID NO: 1344487 - RNA, 15 nt, Human
gugccuucagcucua

SEQ ID NO: 1344488 - RNA, 15 nt, Human
gugccccuuccgcca

SEQ ID NO: 1344489 - RNA, 17 nt, Human
gugccccuuccgccacu

SEQ ID NO: 1344490 - RNA, 19 nt, Human
gugccccuuccgccacugg

SEQ ID NO: 1344491 - RNA, 22 nt, Human
gugccccuuccgccacuggggc

SEQ ID NO: 1344492 - RNA, 20 nt, Human
gugccccuuccgccacuggg

SEQ ID NO: 1344493 - RNA, 11 nt, Human
gugccuucauu

SEQ ID NO: 1344494 - RNA, 12 nt, Human
gugccuucauuu

SEQ ID NO: 1344495 - RNA, 14 nt, Human
gugccuucauuugg

SEQ ID NO: 1344496 - RNA, 22 nt, Human
gugccaggugaggucagcacau

SEQ ID NO: 1344497 - RNA, 20 nt, Human
gugcccaagaauagaugcug

SEQ ID NO: 1344498 - RNA, 16 nt, Human
gugccaggugagguca

SEQ ID NO: 1344499 - RNA, 19 nt, Human
gugccaugucaaacaaaua

SEQ ID NO: 1344500 - RNA, 23 nt, Human
gugcccaagaauagaugcugacu

SEQ ID NO: 1344501 - RNA, 21 nt, Human
gugcccccuucaagccugugc

SEQ ID NO: 1344502 - RNA, 21 nt, Human
gugccccucuccuucuuagcu

SEQ ID NO: 1344503 - RNA, 18 nt, Human
gugaggagcuugaaaccc

SEQ ID NO: 1344504 - RNA, 14 nt, Human
gugagcuacaaaug

SEQ ID NO: 1344505 - RNA, 13 nt, Human
gugaggagcuggg

SEQ ID NO: 1344506 - RNA, 15 nt, Human
gugagcccagcuggg

SEQ ID NO: 1344507 - RNA, 18 nt, Human
gugagcccagcuggguca

SEQ ID NO: 1344508 - RNA, 20 nt, Human
gugagcccagcugggucagg

SEQ ID NO: 1344509 - RNA, 15 nt, Human
gugacgucugggugg

SEQ ID NO: 1344510 - RNA, 16 nt, Human
gugacgucuggguggc

SEQ ID NO: 1344511 - RNA, 19 nt, Human
gugacgucuggguggcccu

SEQ ID NO: 1344512 - RNA, 21 nt, Human
gugacgucuggguggcccuua

SEQ ID NO: 1344513 - RNA, 17 nt, Human
gugacuaauggcaugag

SEQ ID NO: 1344514 - RNA, 23 nt, Human
gugacuaacuagacaccaaaguu

SEQ ID NO: 1344515 - RNA, 19 nt, Human
gugauauaaguguguguuu

SEQ ID NO: 1344516 - RNA, 22 nt, Human
gugauagucuuuugcuuuuggc

SEQ ID NO: 1344517 - RNA, 21 nt, Human
gugauauauaaguguacauau

SEQ ID NO: 1344518 - RNA, 23 nt, Human
gugauauauaaguguacauaugu

SEQ ID NO: 1344519 - RNA, 19 nt, Human
gugauaugcacaauguaga

SEQ ID NO: 1344520 - RNA, 14 nt, Human
gugauaugcacaau

SEQ ID NO: 1344521 - RNA, 13 nt, Human
gugauauucuaag

SEQ ID NO: 1344522 - RNA, 20 nt, Human
gugaucagaccauaauguua

SEQ ID NO: 1344523 - RNA, 16 nt, Human
gugaucauguguggaa

SEQ ID NO: 1344524 - RNA, 17 nt, Human
gugaucauguguggaag

SEQ ID NO: 1344525 - RNA, 18 nt, Human
gugaucauguguggaagu

SEQ ID NO: 1344526 - RNA, 12 nt, Human
gugaguuggcuu

SEQ ID NO: 1344527 - RNA, 16 nt, Human
gugaguuggcuuaccu

SEQ ID NO: 1344528 - RNA, 20 nt, Human
gugaguuggcuuaccuggcc

SEQ ID NO: 1344529 - RNA, 17 nt, Human
gugaguguuuuuaucuu

SEQ ID NO: 1344530 - RNA, 13 nt, Human
gugaguucucccu

SEQ ID NO: 1344531 - RNA, 22 nt, Human
gugaguucucccuguacagugu

SEQ ID NO: 1344532 - RNA, 13 nt, Human
gugaaugcuggga

SEQ ID NO: 1344533 - RNA, 15 nt, Human
gugaaugcugggacu

SEQ ID NO: 1344534 - RNA, 20 nt, Human
gugaaugcugggacucagcc

SEQ ID NO: 1344535 - RNA, 21 nt, Human
gugaaugcugggacucagccu

SEQ ID NO: 1344536 - RNA, 14 nt, Human
gugaauucccucac

SEQ ID NO: 1344537 - RNA, 13 nt, Human
gugaauucccuca

SEQ ID NO: 1344538 - RNA, 18 nt, Human
gugaauuguuaguuucug

SEQ ID NO: 1344539 - RNA, 21 nt, Human
gugaacaaauuuacagagaca

SEQ ID NO: 1344540 - RNA, 17 nt, Human
gugaacaaagcagccac

SEQ ID NO: 1344541 - RNA, 18 nt, Human
gugaacaaagcagccacg

SEQ ID NO: 1344542 - RNA, 13 nt, Human
gugaaugaacacu

SEQ ID NO: 1344543 - RNA, 15 nt, Human
gucuuuuuuuguaua

SEQ ID NO: 1344544 - RNA, 16 nt, Human
gucuuuuuuuguauag

SEQ ID NO: 1344545 - RNA, 17 nt, Human
gucuuuuuuuguauagu

SEQ ID NO: 1344546 - RNA, 22 nt, Human
gucuuuuuuuguauaguuaaca

SEQ ID NO: 1344547 - RNA, 19 nt, Human
gugaaaacacauuugcuuu

SEQ ID NO: 1344548 - RNA, 17 nt, Human
gugacagacaggcucuu

SEQ ID NO: 1344549 - RNA, 12 nt, Human
gugacaauaaaa

SEQ ID NO: 1344550 - RNA, 14 nt, Human
gugacaauaaaaca

SEQ ID NO: 1344551 - RNA, 13 nt, Human
gugacacaaacac

SEQ ID NO: 1344552 - RNA, 14 nt, Human
gugacacaaacaca

SEQ ID NO: 1344553 - RNA, 18 nt, Human
gugacacaaacacacaca

SEQ ID NO: 1344554 - RNA, 21 nt, Human
gugacacaaacacacacaaaa

SEQ ID NO: 1344555 - RNA, 15 nt, Human
gugacagacaggcuc

SEQ ID NO: 1344556 - RNA, 16 nt, Human
gugacagacaggcucu

SEQ ID NO: 1344557 - RNA, 21 nt, Human
gucuugggcagagcuggcucu

SEQ ID NO: 1344558 - RNA, 22 nt, Human
gucuugggcagagcuggcucug

SEQ ID NO: 1344559 - RNA, 16 nt, Human
gucuugggcagagcug

SEQ ID NO: 1344560 - RNA, 19 nt, Human
gucuugggcagagcuggcu

SEQ ID NO: 1344561 - RNA, 20 nt, Human
gucuugggcagagcuggcuc

SEQ ID NO: 1344562 - RNA, 16 nt, Human
gucuuggaacuugccu

SEQ ID NO: 1344563 - RNA, 17 nt, Human
gucuuggaacuugccug

SEQ ID NO: 1344564 - RNA, 22 nt, Human
gucuuggaacuugccugccuuu

SEQ ID NO: 1344565 - RNA, 14 nt, Human
gucuugagcucuau

SEQ ID NO: 1344566 - RNA, 16 nt, Human
gucuugagcucuauua

SEQ ID NO: 1344567 - RNA, 18 nt, Human
gucuugaugaccaaaguc

SEQ ID NO: 1344568 - RNA, 20 nt, Human
gucuucuccaacaccaccuc

SEQ ID NO: 1344569 - RNA, 15 nt, Human
gucuucucccuggaa

SEQ ID NO: 1344570 - RNA, 17 nt, Human
gucuucuuacuuggaac

SEQ ID NO: 1344571 - RNA, 20 nt, Human
gucuucuuacuuggaacuga

SEQ ID NO: 1344572 - RNA, 12 nt, Human
gucuucuuggcc

SEQ ID NO: 1344573 - RNA, 22 nt, Human
gucugugaagugagaccuuccu

SEQ ID NO: 1344574 - RNA, 18 nt, Human
gucugugaagugagaccu

SEQ ID NO: 1344575 - RNA, 13 nt, Human
gucugugccccuu

SEQ ID NO: 1344576 - RNA, 19 nt, Human
gucugugccccuuccgcca

SEQ ID NO: 1344577 - RNA, 20 nt, Human
gucugugccccuuccgccac

SEQ ID NO: 1344578 - RNA, 23 nt, Human
gucugugccccuuccgccacugg

SEQ ID NO: 1344579 - RNA, 23 nt, Human
gucugugagaugcuagaacuccc

SEQ ID NO: 1344580 - RNA, 22 nt, Human
gucugugagaugcuagaacucc

SEQ ID NO: 1344581 - RNA, 21 nt, Human
gucugugagaugcuagaacuc

SEQ ID NO: 1344582 - RNA, 17 nt, Human
gucugugagaugcuaga

SEQ ID NO: 1344583 - RNA, 16 nt, Human
gucugugagaugcuag

SEQ ID NO: 1344584 - RNA, 15 nt, Human
gucugugagaugcua

SEQ ID NO: 1344585 - RNA, 13 nt, Human
gucugagagaggc

SEQ ID NO: 1344586 - RNA, 14 nt, Human
gucugagagaggcc

SEQ ID NO: 1344587 - RNA, 15 nt, Human
gucugagagaggcca

SEQ ID NO: 1344588 - RNA, 18 nt, Human
gucugagagaggccauuc

SEQ ID NO: 1344589 - RNA, 10 nt, Human
gucugccagg

SEQ ID NO: 1344590 - RNA, 21 nt, Human
gucugccagggccccucuccc

SEQ ID NO: 1344591 - RNA, 17 nt, Human
gucugccccgcccucau

SEQ ID NO: 1344592 - RNA, 21 nt, Human
gucugcccucugcauccucug

SEQ ID NO: 1344593 - RNA, 17 nt, Human
gucugcccucugcaucc

SEQ ID NO: 1344594 - RNA, 11 nt, Human
gucugccucuu

SEQ ID NO: 1344595 - RNA, 16 nt, Human
gucugcuaucauuauu

SEQ ID NO: 1344596 - RNA, 23 nt, Human
gucugcucagacagaaccccuac

SEQ ID NO: 1344597 - RNA, 13 nt, Human
gucuguugauuaa

SEQ ID NO: 1344598 - RNA, 16 nt, Human
gucuguugauuaaaga

SEQ ID NO: 1344599 - RNA, 19 nt, Human
gucuguugauuaaagauga

SEQ ID NO: 1344600 - RNA, 14 nt, Human
gucuguuggcaggc

SEQ ID NO: 1344601 - RNA, 16 nt, Human
gucuguuggcaggcug

SEQ ID NO: 1344602 - RNA, 18 nt, Human
gucuguuggcaggcuggc

SEQ ID NO: 1344603 - RNA, 19 nt, Human
gucuguuggcaggcuggcc

SEQ ID NO: 1344604 - RNA, 20 nt, Human
gucuguuuuaaaaaccuguu

SEQ ID NO: 1344605 - RNA, 12 nt, Human
gucuguuuacug

SEQ ID NO: 1344606 - RNA, 13 nt, Human
gucuguuuacugc

SEQ ID NO: 1344607 - RNA, 20 nt, Human
gucuguuggcaggcuggcca

SEQ ID NO: 1344608 - RNA, 21 nt, Human
gucuguuggcaggcuggccag

SEQ ID NO: 1344609 - RNA, 22 nt, Human
gucuguuggcaggcuggccagu

SEQ ID NO: 1344610 - RNA, 17 nt, Human
gucuguuuauaaacauu

SEQ ID NO: 1344611 - RNA, 17 nt, Human
gucuguguuuugaaaga

SEQ ID NO: 1344612 - RNA, 16 nt, Human
gucuguuaugcuguga

SEQ ID NO: 1344613 - RNA, 17 nt, Human
gucuguucacuuuuccu

SEQ ID NO: 1344614 - RNA, 18 nt, Human
gucuguucuguuucaagg

SEQ ID NO: 1344615 - RNA, 22 nt, Human
gucugugccccuuccgccacug

SEQ ID NO: 1344616 - RNA, 13 nt, Human
gucuguggaucag

SEQ ID NO: 1344617 - RNA, 16 nt, Human
gucuguggauuuuuuc

SEQ ID NO: 1344618 - RNA, 13 nt, Human
gucuguggauuuu

SEQ ID NO: 1344619 - RNA, 18 nt, Human
gucgucaaagcugaaaug

SEQ ID NO: 1344620 - RNA, 14 nt, Human
gucggucugugccc

SEQ ID NO: 1344621 - RNA, 14 nt, Human
gucggugccuucaa

SEQ ID NO: 1344622 - RNA, 14 nt, Human
gucguaaagauuug

SEQ ID NO: 1344623 - RNA, 12 nt, Human
gucguaaagauu

SEQ ID NO: 1344624 - RNA, 17 nt, Human
gucguccuuacuccugu

SEQ ID NO: 1344625 - RNA, 12 nt, Human
gucgugccugug

SEQ ID NO: 1344626 - RNA, 13 nt, Human
gucgugccugugu

SEQ ID NO: 1344627 - RNA, 14 nt, Human
gucgugccuguguc

SEQ ID NO: 1344628 - RNA, 15 nt, Human
gucgugccugugucc

SEQ ID NO: 1344629 - RNA, 17 nt, Human
gucgugccuguguccau

SEQ ID NO: 1344630 - RNA, 18 nt, Human
gucgugccuguguccaug

SEQ ID NO: 1344631 - RNA, 23 nt, Human
gucguggacacacacagacuauu

SEQ ID NO: 1344632 - RNA, 18 nt, Human
gucguggagagcuaggag

SEQ ID NO: 1344633 - RNA, 19 nt, Human
gucguggagagcuaggagc

SEQ ID NO: 1344634 - RNA, 20 nt, Human
gucguggagagcuaggagca

SEQ ID NO: 1344635 - RNA, 24 nt, Human
gucguggagagcuaggagcaaagc

SEQ ID NO: 1344636 - RNA, 17 nt, Human
gucguggggugugcugg

SEQ ID NO: 1344637 - RNA, 15 nt, Human
gucucacccuggagg

SEQ ID NO: 1344638 - RNA, 21 nt, Human
gucguggagagcuaggagcaa

SEQ ID NO: 1344639 - RNA, 23 nt, Human
gucuaaagauggaguuucuaagg

SEQ ID NO: 1344640 - RNA, 21 nt, Human
gucuaaagcugguuuaauguu

SEQ ID NO: 1344641 - RNA, 13 nt, Human
guccuuagccugg

SEQ ID NO: 1344642 - RNA, 14 nt, Human
guccuuagccugga

SEQ ID NO: 1344643 - RNA, 14 nt, Human
gucggcugaccaug

SEQ ID NO: 1344644 - RNA, 17 nt, Human
gucggcugaccaugcuc

SEQ ID NO: 1344645 - RNA, 18 nt, Human
gucggcugaccaugcuca

SEQ ID NO: 1344646 - RNA, 14 nt, Human
gucggggcaucugg

SEQ ID NO: 1344647 - RNA, 18 nt, Human
gucggggcaucuggccug

SEQ ID NO: 1344648 - RNA, 13 nt, Human
gucccugccugga

SEQ ID NO: 1344649 - RNA, 23 nt, Human
gucccugcacagugacuucugag

SEQ ID NO: 1344650 - RNA, 13 nt, Human
guccuuacuccug

SEQ ID NO: 1344651 - RNA, 15 nt, Human
guccuuacuccugug

SEQ ID NO: 1344652 - RNA, 17 nt, Human
guccuuacuccuguggg

SEQ ID NO: 1344653 - RNA, 18 nt, Human
guccuuacuccuguggga

SEQ ID NO: 1344654 - RNA, 22 nt, Human
guccuuacuccugugggagccu

SEQ ID NO: 1344655 - RNA, 23 nt, Human
guccuuacuccugugggagccuc

SEQ ID NO: 1344656 - RNA, 20 nt, Human
gucucuauaccaauaaagug

SEQ ID NO: 1344657 - RNA, 19 nt, Human
gucucuauaccaauaaagu

SEQ ID NO: 1344658 - RNA, 18 nt, Human
gucucuauaccaauaaag

SEQ ID NO: 1344659 - RNA, 17 nt, Human
gucucuauaccaauaaa

SEQ ID NO: 1344660 - RNA, 15 nt, Human
gucucucucucucua

SEQ ID NO: 1344661 - RNA, 18 nt, Human
gucucuagagcagggauu

SEQ ID NO: 1344662 - RNA, 14 nt, Human
gucucaggcugccu

SEQ ID NO: 1344663 - RNA, 15 nt, Human
gucucacugcuugaa

SEQ ID NO: 1344664 - RNA, 19 nt, Human
gucucagccccuuucccuu

SEQ ID NO: 1344665 - RNA, 13 nt, Human
gucucaggcugcc

SEQ ID NO: 1344666 - RNA, 15 nt, Human
gucucaggcugccug

SEQ ID NO: 1344667 - RNA, 22 nt, Human
gucucuaaucugugcuguuuca

SEQ ID NO: 1344668 - RNA, 21 nt, Human
gucucuaauucuauuaaagug

SEQ ID NO: 1344669 - RNA, 12 nt, Human
gucucuagagca

SEQ ID NO: 1344670 - RNA, 22 nt, Human
gucucacugagcacuguuuucu

SEQ ID NO: 1344671 - RNA, 14 nt, Human
gucucacugcuuga

SEQ ID NO: 1344672 - RNA, 16 nt, Human
gucucacugagcacug

SEQ ID NO: 1344673 - RNA, 20 nt, Human
gucucacccuggaggcaccu

SEQ ID NO: 1344674 - RNA, 18 nt, Human
gucucaccggcucucacc

SEQ ID NO: 1344675 - RNA, 19 nt, Human
gucucaccggcucucaccu

SEQ ID NO: 1344676 - RNA, 20 nt, Human
gucucaccggcucucaccug

SEQ ID NO: 1344677 - RNA, 19 nt, Human
gucucaccuggacuuaagc

SEQ ID NO: 1344678 - RNA, 17 nt, Human
gucucuggaauuugaaa

SEQ ID NO: 1344679 - RNA, 16 nt, Human
gucucugaugcagcuu

SEQ ID NO: 1344680 - RNA, 19 nt, Human
gucucugaugcagcuuaua

SEQ ID NO: 1344681 - RNA, 17 nt, Human
gucucugcaaacugccu

SEQ ID NO: 1344682 - RNA, 19 nt, Human
gucucugaggggcuaccag

SEQ ID NO: 1344683 - RNA, 15 nt, Human
gucucugaugcagcu

SEQ ID NO: 1344684 - RNA, 13 nt, Human
gucucugagcauu

SEQ ID NO: 1344685 - RNA, 18 nt, Human
gucucucugggccuuagg

SEQ ID NO: 1344686 - RNA, 19 nt, Human
gucucucucucucuacaaa

SEQ ID NO: 1344687 - RNA, 14 nt, Human
gucucucuucucuc

SEQ ID NO: 1344688 - RNA, 15 nt, Human
gucucucuucucucc

SEQ ID NO: 1344689 - RNA, 19 nt, Human
gucucucuucucuccagcu

SEQ ID NO: 1344690 - RNA, 20 nt, Human
gucucucuucucuccagcug

SEQ ID NO: 1344691 - RNA, 23 nt, Human
gucucucuucucuccagcugacu

SEQ ID NO: 1344692 - RNA, 21 nt, Human
gucucuggauuauauuaugaa

SEQ ID NO: 1344693 - RNA, 16 nt, Human
gucucugguuccuccc

SEQ ID NO: 1344694 - RNA, 17 nt, Human
gucucugguuccucccc

SEQ ID NO: 1344695 - RNA, 18 nt, Human
gucucuucuccacuggau

SEQ ID NO: 1344696 - RNA, 23 nt, Human
gucucuucugaauaaagcaauua

SEQ ID NO: 1344697 - RNA, 14 nt, Human
gucucuucugagcu

SEQ ID NO: 1344698 - RNA, 22 nt, Human
gucucuucugagcuauuucauc

SEQ ID NO: 1344699 - RNA, 22 nt, Human
gucucuucugaauaaagcaauu

SEQ ID NO: 1344700 - RNA, 21 nt, Human
gucucuucugaauaaagcaau

SEQ ID NO: 1344701 - RNA, 20 nt, Human
gucucuucugaauaaagcaa

SEQ ID NO: 1344702 - RNA, 19 nt, Human
gucucuucugaauaaagca

SEQ ID NO: 1344703 - RNA, 19 nt, Human
gucugacuuucuuuuuuga

SEQ ID NO: 1344704 - RNA, 12 nt, Human
gucucuugcuug

SEQ ID NO: 1344705 - RNA, 20 nt, Human
gucccuaauaaagcugugug

SEQ ID NO: 1344706 - RNA, 18 nt, Human
gucccuaauaaagcugug

SEQ ID NO: 1344707 - RNA, 21 nt, Human
gucccuaccgagucucuucuc

SEQ ID NO: 1344708 - RNA, 22 nt, Human
gucccuaccgagucucuucucc

SEQ ID NO: 1344709 - RNA, 23 nt, Human
gucccuaccgagucucuucucca

SEQ ID NO: 1344710 - RNA, 21 nt, Human
gucccuaccccauggugcuag

SEQ ID NO: 1344711 - RNA, 16 nt, Human
gucccucccccuuguc

SEQ ID NO: 1344712 - RNA, 23 nt, Human
gucccuccgggaccuggugcugc

SEQ ID NO: 1344713 - RNA, 21 nt, Human
gucccugcacagugacuucug

SEQ ID NO: 1344714 - RNA, 14 nt, Human
gucccucuguguau

SEQ ID NO: 1344715 - RNA, 22 nt, Human
gucccucuguguauuugcuuuu

SEQ ID NO: 1344716 - RNA, 22 nt, Human
gucccucucauuuagccugucc

SEQ ID NO: 1344717 - RNA, 11 nt, Human
gucccucugug

SEQ ID NO: 1344718 - RNA, 12 nt, Human
gucccucugugu

SEQ ID NO: 1344719 - RNA, 13 nt, Human
gucccucugugua

SEQ ID NO: 1344720 - RNA, 17 nt, Human
gucccuaauaaagcugu

SEQ ID NO: 1344721 - RNA, 16 nt, Human
gucccuaauaaagcug

SEQ ID NO: 1344722 - RNA, 17 nt, Human
gucccaugaucccugug

SEQ ID NO: 1344723 - RNA, 13 nt, Human
gucccauguggug

SEQ ID NO: 1344724 - RNA, 23 nt, Human
gucccauucccccagugcggcca

SEQ ID NO: 1344725 - RNA, 19 nt, Human
gucccauucccccagugcg

SEQ ID NO: 1344726 - RNA, 21 nt, Human
gucccauuuuagccaagcuua

SEQ ID NO: 1344727 - RNA, 15 nt, Human
guccccaacagcgcc

SEQ ID NO: 1344728 - RNA, 16 nt, Human
guccccaacagcgccc

SEQ ID NO: 1344729 - RNA, 19 nt, Human
guccccaacagcgcccaaa

SEQ ID NO: 1344730 - RNA, 15 nt, Human
gucccaucccugcgu

SEQ ID NO: 1344731 - RNA, 18 nt, Human
gucccaggcugagccuca

SEQ ID NO: 1344732 - RNA, 19 nt, Human
gucccaggcugagccucag

SEQ ID NO: 1344733 - RNA, 21 nt, Human
gucccaggcugagccucaguc

SEQ ID NO: 1344734 - RNA, 15 nt, Human
gucccaggcugagcc

SEQ ID NO: 1344735 - RNA, 16 nt, Human
gucccaggcugagccu

SEQ ID NO: 1344736 - RNA, 17 nt, Human
gucccaggcugagccuc

SEQ ID NO: 1344737 - RNA, 21 nt, Human
gucauucagauaugauucaaa

SEQ ID NO: 1344738 - RNA, 16 nt, Human
gucauucguucugugg

SEQ ID NO: 1344739 - RNA, 21 nt, Human
gucauucgcuacuaugauuua

SEQ ID NO: 1344740 - RNA, 21 nt, Human
gucauuguuauauaaucauua

SEQ ID NO: 1344741 - RNA, 13 nt, Human
gucaggaaagaga

SEQ ID NO: 1344742 - RNA, 22 nt, Human
gucagcugggacaccccgacuu

SEQ ID NO: 1344743 - RNA, 14 nt, Human
gucauguuuaucug

SEQ ID NO: 1344744 - RNA, 13 nt, Human
gucauguuuaucu

SEQ ID NO: 1344745 - RNA, 11 nt, Human
gucauuaaaug

SEQ ID NO: 1344746 - RNA, 22 nt, Human
guccacaggcuucugagcagcg

SEQ ID NO: 1344747 - RNA, 15 nt, Human
guccacgacugucuc

SEQ ID NO: 1344748 - RNA, 16 nt, Human
guccacgacugucucc

SEQ ID NO: 1344749 - RNA, 18 nt, Human
guccacgacugucuccau

SEQ ID NO: 1344750 - RNA, 15 nt, Human
guccaguccaguccu

SEQ ID NO: 1344751 - RNA, 17 nt, Human
guccaguccaguccuau

SEQ ID NO: 1344752 - RNA, 17 nt, Human
guccaguccuaucuggg

SEQ ID NO: 1344753 - RNA, 18 nt, Human
guccaguccuaucugggc

SEQ ID NO: 1344754 - RNA, 19 nt, Human
guccaguccuaucugggcu

SEQ ID NO: 1344755 - RNA, 23 nt, Human
guccaguccuaucugggcuuccu

SEQ ID NO: 1344756 - RNA, 15 nt, Human
guccagguccuggug

SEQ ID NO: 1344757 - RNA, 16 nt, Human
guccagguccuggugg

SEQ ID NO: 1344758 - RNA, 17 nt, Human
guccagguccugguggg

SEQ ID NO: 1344759 - RNA, 21 nt, Human
guccagguccugguggggcag

SEQ ID NO: 1344760 - RNA, 22 nt, Human
guccagguccugguggggcagc

SEQ ID NO: 1344761 - RNA, 23 nt, Human
guccagguccugguggggcagcu

SEQ ID NO: 1344762 - RNA, 14 nt, Human
guccagcuccaacc

SEQ ID NO: 1344763 - RNA, 18 nt, Human
guccagggcuagugacuu

SEQ ID NO: 1344764 - RNA, 15 nt, Human
guauuaagaaaggaa

SEQ ID NO: 1344765 - RNA, 16 nt, Human
guauuaagaaaggaag

SEQ ID NO: 1344766 - RNA, 20 nt, Human
guauuuuaaaagaaugauua

SEQ ID NO: 1344767 - RNA, 13 nt, Human
guauuuuaaucac

SEQ ID NO: 1344768 - RNA, 18 nt, Human
guauuacacucuguaauu

SEQ ID NO: 1344769 - RNA, 16 nt, Human
guauuacacucuguaa

SEQ ID NO: 1344770 - RNA, 18 nt, Human
guauuuuaaaauagcguu

SEQ ID NO: 1344771 - RNA, 23 nt, Human
guauuuuaaaauagcguucuugu

SEQ ID NO: 1344772 - RNA, 21 nt, Human
guauuuuaguaagagauuccu

SEQ ID NO: 1344773 - RNA, 19 nt, Human
guauuuuagugaacuugaa

SEQ ID NO: 1344774 - RNA, 20 nt, Human
guauuuuagugaacuugaaa

SEQ ID NO: 1344775 - RNA, 13 nt, Human
guauuuuauguua

SEQ ID NO: 1344776 - RNA, 16 nt, Human
guauuuuauguuauau

SEQ ID NO: 1344777 - RNA, 17 nt, Human
guauuuuauguuauaua

SEQ ID NO: 1344778 - RNA, 22 nt, Human
guauuuuauguuauauauaaau

SEQ ID NO: 1344779 - RNA, 13 nt, Human
guauuuucaauag

SEQ ID NO: 1344780 - RNA, 17 nt, Human
guauuuucaauagccac

SEQ ID NO: 1344781 - RNA, 18 nt, Human
guauuuuguauuguuuca

SEQ ID NO: 1344782 - RNA, 16 nt, Human
gucaccagagacuuua

SEQ ID NO: 1344783 - RNA, 21 nt, Human
gucaccacgacuggccagggc

SEQ ID NO: 1344784 - RNA, 13 nt, Human
gucaccagagacu

SEQ ID NO: 1344785 - RNA, 13 nt, Human
gucaccagguacu

SEQ ID NO: 1344786 - RNA, 17 nt, Human
gucaccacccugcucau

SEQ ID NO: 1344787 - RNA, 16 nt, Human
gucaccacgacuggcc

SEQ ID NO: 1344788 - RNA, 17 nt, Human
gucaccacgacuggcca

SEQ ID NO: 1344789 - RNA, 19 nt, Human
gucaccacgacuggccagg

SEQ ID NO: 1344790 - RNA, 15 nt, Human
gucaaugcagccccc

SEQ ID NO: 1344791 - RNA, 16 nt, Human
gucaaugacaugaauu

SEQ ID NO: 1344792 - RNA, 23 nt, Human
gucaaugacaugaauuuuagcuu

SEQ ID NO: 1344793 - RNA, 18 nt, Human
gucaaucaagucuguuua

SEQ ID NO: 1344794 - RNA, 23 nt, Human
gucaauaaaauccauacauuugu

SEQ ID NO: 1344795 - RNA, 22 nt, Human
gucaauaaaauccauacauuug

SEQ ID NO: 1344796 - RNA, 21 nt, Human
gucaagggcagcuuugcucau

SEQ ID NO: 1344797 - RNA, 16 nt, Human
gucacuacgccuggcu

SEQ ID NO: 1344798 - RNA, 13 nt, Human
gucacucaaggcg

SEQ ID NO: 1344799 - RNA, 22 nt, Human
gucacuaaagcaggccuuuuga

SEQ ID NO: 1344800 - RNA, 19 nt, Human
gucacucuagucaaugaca

SEQ ID NO: 1344801 - RNA, 16 nt, Human
gucagacccuggaggc

SEQ ID NO: 1344802 - RNA, 16 nt, Human
gucagacgccugagga

SEQ ID NO: 1344803 - RNA, 17 nt, Human
gucagacgccugaggaa

SEQ ID NO: 1344804 - RNA, 18 nt, Human
gucagacgccugaggaac

SEQ ID NO: 1344805 - RNA, 20 nt, Human
gucagauccaggagcuccag

SEQ ID NO: 1344806 - RNA, 14 nt, Human
gucagauccaggag

SEQ ID NO: 1344807 - RNA, 17 nt, Human
gucagauccaggagcuc

SEQ ID NO: 1344808 - RNA, 18 nt, Human
gucagauccaggagcucc

SEQ ID NO: 1344809 - RNA, 22 nt, Human
gucagaugcugugcaaauguua

SEQ ID NO: 1344810 - RNA, 17 nt, Human
gucagauucuugcaucc

SEQ ID NO: 1344811 - RNA, 15 nt, Human
gucagauucuugcau

SEQ ID NO: 1344812 - RNA, 16 nt, Human
gucagauucuugcauc

SEQ ID NO: 1344813 - RNA, 20 nt, Human
gucagagccaugucuucucc

SEQ ID NO: 1344814 - RNA, 21 nt, Human
gucagagccaugucuucuccc

SEQ ID NO: 1344815 - RNA, 22 nt, Human
gucagagccaugucuucucccu

SEQ ID NO: 1344816 - RNA, 15 nt, Human
guauacuauaguacc

SEQ ID NO: 1344817 - RNA, 15 nt, Human
guauacuguaggcac

SEQ ID NO: 1344818 - RNA, 15 nt, Human
guauaccugauuuuu

SEQ ID NO: 1344819 - RNA, 13 nt, Human
guauaccucacuu

SEQ ID NO: 1344820 - RNA, 23 nt, Human
guauacuagggagccauuugaga

SEQ ID NO: 1344821 - RNA, 18 nt, Human
guauaauuggauuuccua

SEQ ID NO: 1344822 - RNA, 19 nt, Human
guauaauuggauuuccuaa

SEQ ID NO: 1344823 - RNA, 20 nt, Human
guauaauuggauuuccuaau

SEQ ID NO: 1344824 - RNA, 13 nt, Human
guagugcuuugag

SEQ ID NO: 1344825 - RNA, 17 nt, Human
guauaauucacauugua

SEQ ID NO: 1344826 - RNA, 14 nt, Human
guaguguuggagaa

SEQ ID NO: 1344827 - RNA, 15 nt, Human
guaguguuggagaag

SEQ ID NO: 1344828 - RNA, 17 nt, Human
guaguguuggagaagaa

SEQ ID NO: 1344829 - RNA, 23 nt, Human
guagugcuacaggguccaacaua

SEQ ID NO: 1344830 - RNA, 18 nt, Human
guaguggggaagaggguu

SEQ ID NO: 1344831 - RNA, 19 nt, Human
guagugauuuuuaugccac

SEQ ID NO: 1344832 - RNA, 16 nt, Human
guagucuugaugacca

SEQ ID NO: 1344833 - RNA, 20 nt, Human
guagucucacugcuugaacu

SEQ ID NO: 1344834 - RNA, 19 nt, Human
guagucucacugcuugaac

SEQ ID NO: 1344835 - RNA, 12 nt, Human
guagucuugaug

SEQ ID NO: 1344836 - RNA, 12 nt, Human
guaguccuguga

SEQ ID NO: 1344837 - RNA, 22 nt, Human
guaguagcguuuuuuaaaugua

SEQ ID NO: 1344838 - RNA, 16 nt, Human
guaguaggcauuuuua

SEQ ID NO: 1344839 - RNA, 22 nt, Human
guaguaugauagguuauuuuga

SEQ ID NO: 1344840 - RNA, 13 nt, Human
guaguaugauggg

SEQ ID NO: 1344841 - RNA, 17 nt, Human
guaguauggccuguguc

SEQ ID NO: 1344842 - RNA, 20 nt, Human
guaguauggccugugucacu

SEQ ID NO: 1344843 - RNA, 15 nt, Human
guaguauuuuuugua

SEQ ID NO: 1344844 - RNA, 19 nt, Human
guaguauuuuuuguauaau

SEQ ID NO: 1344845 - RNA, 20 nt, Human
guaguauuuuuuguauaauu

SEQ ID NO: 1344846 - RNA, 23 nt, Human
guaguauuuuuuguauaauugga

SEQ ID NO: 1344847 - RNA, 17 nt, Human
guagguucagccaaggu

SEQ ID NO: 1344848 - RNA, 13 nt, Human
guagguugcacac

SEQ ID NO: 1344849 - RNA, 14 nt, Human
guagguugcacacu

SEQ ID NO: 1344850 - RNA, 19 nt, Human
guagguugcacacuuuggu

SEQ ID NO: 1344851 - RNA, 18 nt, Human
guagguugcacacuuugg

SEQ ID NO: 1344852 - RNA, 15 nt, Human
guaguaaauaaugcu

SEQ ID NO: 1344853 - RNA, 17 nt, Human
guaguaaauaaugcuuu

SEQ ID NO: 1344854 - RNA, 21 nt, Human
guaguaaauaaugcuuugaaa

SEQ ID NO: 1344855 - RNA, 13 nt, Human
guaguaacacuaa

SEQ ID NO: 1344856 - RNA, 14 nt, Human
guaguaacacuaau

SEQ ID NO: 1344857 - RNA, 15 nt, Human
guaguaauugacaug

SEQ ID NO: 1344858 - RNA, 15 nt, Human
guaguaacacuaaua

SEQ ID NO: 1344859 - RNA, 15 nt, Human
guaguaccaaaauaa

SEQ ID NO: 1344860 - RNA, 16 nt, Human
guaguaccaaaauaaa

SEQ ID NO: 1344861 - RNA, 22 nt, Human
guaggggcuuauaauaaaggac

SEQ ID NO: 1344862 - RNA, 16 nt, Human
guaggggcugggaaca

SEQ ID NO: 1344863 - RNA, 16 nt, Human
guagggggcuggagga

SEQ ID NO: 1344864 - RNA, 17 nt, Human
guagggggcuggaggag

SEQ ID NO: 1344865 - RNA, 19 nt, Human
guagggggcuggaggagcc

SEQ ID NO: 1344866 - RNA, 21 nt, Human
guagggggcuggaggagccca

SEQ ID NO: 1344867 - RNA, 13 nt, Human
guaggggccccuc

SEQ ID NO: 1344868 - RNA, 20 nt, Human
guaggggccccucucagccc

SEQ ID NO: 1344869 - RNA, 13 nt, Human
guaggggcuggga

SEQ ID NO: 1344870 - RNA, 15 nt, Human
guaggggcugggaac

SEQ ID NO: 1344871 - RNA, 17 nt, Human
guaggggcugggaacag

SEQ ID NO: 1344872 - RNA, 14 nt, Human
guagggugggccuu

SEQ ID NO: 1344873 - RNA, 20 nt, Human
guagggggcuggaggagccc

SEQ ID NO: 1344874 - RNA, 22 nt, Human
guaggguaaaucaguaagaggu

SEQ ID NO: 1344875 - RNA, 22 nt, Human
guaggguaauuaguaacaugug

SEQ ID NO: 1344876 - RNA, 17 nt, Human
guagggugggccuucag

SEQ ID NO: 1344877 - RNA, 22 nt, Human
guagggugggccuucagggagu

SEQ ID NO: 1344878 - RNA, 21 nt, Human
guagguuauuaugauuagcuu

SEQ ID NO: 1344879 - RNA, 24 nt, Human
guagguggaagcuagacacaugaa

SEQ ID NO: 1344880 - RNA, 23 nt, Human
guagguggaagcuagacacauga

SEQ ID NO: 1344881 - RNA, 15 nt, Human
guagguucagccaag

SEQ ID NO: 1344882 - RNA, 16 nt, Human
guagguucagccaagg

SEQ ID NO: 1344883 - RNA, 12 nt, Human
guagggugggag

SEQ ID NO: 1344884 - RNA, 15 nt, Human
guagggugggagugg

SEQ ID NO: 1344885 - RNA, 12 nt, Human
guaggguuucua

SEQ ID NO: 1344886 - RNA, 19 nt, Human
guagaguugaucaaaauca

SEQ ID NO: 1344887 - RNA, 14 nt, Human
guagaguugcugag

SEQ ID NO: 1344888 - RNA, 21 nt, Human
guagauaaguguucugucuga

SEQ ID NO: 1344889 - RNA, 23 nt, Human
guagaguugcugagagggcucga

SEQ ID NO: 1344890 - RNA, 15 nt, Human
guagaguugcugaga

SEQ ID NO: 1344891 - RNA, 22 nt, Human
guagauauuggacaaagaaccu

SEQ ID NO: 1344892 - RNA, 15 nt, Human
guagaugcauuuggg

SEQ ID NO: 1344893 - RNA, 20 nt, Human
guagaugcauuuggguccag

SEQ ID NO: 1344894 - RNA, 22 nt, Human
guagaugcauuuggguccagga

SEQ ID NO: 1344895 - RNA, 17 nt, Human
guagaugggagggaggc

SEQ ID NO: 1344896 - RNA, 21 nt, Human
guagaugggagggaggcucag

SEQ ID NO: 1344897 - RNA, 16 nt, Human
guagcauccuggaaua

SEQ ID NO: 1344898 - RNA, 13 nt, Human
guagcacuuacug

SEQ ID NO: 1344899 - RNA, 23 nt, Human
guagcacaaguuauuuaaaucug

SEQ ID NO: 1344900 - RNA, 14 nt, Human
guagauucagguaa

SEQ ID NO: 1344901 - RNA, 18 nt, Human
guagauucagguaauaca

SEQ ID NO: 1344902 - RNA, 15 nt, Human
guagauugauuguau

SEQ ID NO: 1344903 - RNA, 13 nt, Human
guagauugcagaa

SEQ ID NO: 1344904 - RNA, 21 nt, Human
guagauugcagaaaauucugu

SEQ ID NO: 1344905 - RNA, 23 nt, Human
guagauugcagaaaauucugugc

SEQ ID NO: 1344906 - RNA, 14 nt, Human
guagauuuuccaaa

SEQ ID NO: 1344907 - RNA, 21 nt, Human
guagcauuuguguugaagagg

SEQ ID NO: 1344908 - RNA, 17 nt, Human
guagcaugcuuguugca

SEQ ID NO: 1344909 - RNA, 13 nt, Human
guagccacaccag

SEQ ID NO: 1344910 - RNA, 16 nt, Human
guagccacaccaggau

SEQ ID NO: 1344911 - RNA, 15 nt, Human
guagccagcacacag

SEQ ID NO: 1344912 - RNA, 18 nt, Human
guagccagcacacagggc

SEQ ID NO: 1344913 - RNA, 19 nt, Human
guagccagcacacagggca

SEQ ID NO: 1344914 - RNA, 21 nt, Human
guagccagcacacagggcagu

SEQ ID NO: 1344915 - RNA, 15 nt, Human
guagccacaccagga

SEQ ID NO: 1344916 - RNA, 11 nt, Human
guagccagccg

SEQ ID NO: 1344917 - RNA, 21 nt, Human
guagccagccggggcgagugg

SEQ ID NO: 1344918 - RNA, 15 nt, Human
guagccagccggggc

SEQ ID NO: 1344919 - RNA, 15 nt, Human
guagccccagugaca

SEQ ID NO: 1344920 - RNA, 19 nt, Human
guagccccagugacagcua

SEQ ID NO: 1344921 - RNA, 16 nt, Human
guagccccagugacag

SEQ ID NO: 1344922 - RNA, 21 nt, Human
guaggcuacagagaagccuuc

SEQ ID NO: 1344923 - RNA, 14 nt, Human
guaggcuacagaga

SEQ ID NO: 1344924 - RNA, 15 nt, Human
guaggcuacagagaa

SEQ ID NO: 1344925 - RNA, 16 nt, Human
guaggcuacagagaag

SEQ ID NO: 1344926 - RNA, 17 nt, Human
guaggcuacagagaagc

SEQ ID NO: 1344927 - RNA, 18 nt, Human
guaggcuacagagaagcc

SEQ ID NO: 1344928 - RNA, 19 nt, Human
guaggcuacagagaagccu

SEQ ID NO: 1344929 - RNA, 20 nt, Human
guaggcuacagagaagccuu

SEQ ID NO: 1344930 - RNA, 22 nt, Human
guaggcuacagagaagccuuca

SEQ ID NO: 1344931 - RNA, 13 nt, Human
guagggagggcgg

SEQ ID NO: 1344932 - RNA, 15 nt, Human
guagggaguuguggg

SEQ ID NO: 1344933 - RNA, 17 nt, Human
guauguuagugcaaauu

SEQ ID NO: 1344934 - RNA, 12 nt, Human
guaugugugugu

SEQ ID NO: 1344935 - RNA, 13 nt, Human
guaugugugugug

SEQ ID NO: 1344936 - RNA, 22 nt, Human
guaugaucaaauguuuaaucau

SEQ ID NO: 1344937 - RNA, 17 nt, Human
guaugaucaaauguuua

SEQ ID NO: 1344938 - RNA, 16 nt, Human
guaugaucaaauguuu

SEQ ID NO: 1344939 - RNA, 15 nt, Human
guaugaucaaauguu

SEQ ID NO: 1344940 - RNA, 14 nt, Human
guaugaucaaaugu

SEQ ID NO: 1344941 - RNA, 13 nt, Human
guaugaucaaaug

SEQ ID NO: 1344942 - RNA, 24 nt, Human
guaugauagguuauuuugauguaa

SEQ ID NO: 1344943 - RNA, 16 nt, Human
guaugauacuucgaca

SEQ ID NO: 1344944 - RNA, 17 nt, Human
guauguugaagccuuug

SEQ ID NO: 1344945 - RNA, 22 nt, Human
guauguucaacuaggaucagaa

SEQ ID NO: 1344946 - RNA, 19 nt, Human
guauguucuaaccuuuaca

SEQ ID NO: 1344947 - RNA, 17 nt, Human
guauuaaaauguaugca

SEQ ID NO: 1344948 - RNA, 14 nt, Human
guauuaaaauguau

SEQ ID NO: 1344949 - RNA, 18 nt, Human
guauuaagaaaaucuauu

SEQ ID NO: 1344950 - RNA, 12 nt, Human
guauuaagaaag

SEQ ID NO: 1344951 - RNA, 14 nt, Human
guauuaagaaagga

SEQ ID NO: 1344952 - RNA, 16 nt, Human
guaugaacuugaggac

SEQ ID NO: 1344953 - RNA, 15 nt, Human
guaugaacuugagga

SEQ ID NO: 1344954 - RNA, 17 nt, Human
guaugaaccaccgcgcc

SEQ ID NO: 1344955 - RNA, 23 nt, Human
guaugaacuugaggacacauguc

SEQ ID NO: 1344956 - RNA, 22 nt, Human
guaugaacuugaggacacaugu

SEQ ID NO: 1344957 - RNA, 20 nt, Human
guaugaacuugaggacacau

SEQ ID NO: 1344958 - RNA, 19 nt, Human
guaugaacuugaggacaca

SEQ ID NO: 1344959 - RNA, 18 nt, Human
guaugaauaaagacaccu

SEQ ID NO: 1344960 - RNA, 19 nt, Human
guaugaauaaagacaccua

SEQ ID NO: 1344961 - RNA, 19 nt, Human
guaugaaacuaaagccuuu

SEQ ID NO: 1344962 - RNA, 16 nt, Human
guaugaagaguguuau

SEQ ID NO: 1344963 - RNA, 14 nt, Human
guaugaauuauuca

SEQ ID NO: 1344964 - RNA, 18 nt, Human
guaugaauuauucaauuu

SEQ ID NO: 1344965 - RNA, 22 nt, Human
guaugaaagauggcugugccuc

SEQ ID NO: 1344966 - RNA, 23 nt, Human
guaugaaagauggcugugccucu

SEQ ID NO: 1344967 - RNA, 13 nt, Human
guaucuuuugaua

SEQ ID NO: 1344968 - RNA, 17 nt, Human
guaugaaacuaaagccu

SEQ ID NO: 1344969 - RNA, 22 nt, Human
guaucuugcaguaucggcacug

SEQ ID NO: 1344970 - RNA, 14 nt, Human
guaucuugcaguau

SEQ ID NO: 1344971 - RNA, 16 nt, Human
guauagacuccugaaa

SEQ ID NO: 1344972 - RNA, 18 nt, Human
guauagcaugcaucuguu

SEQ ID NO: 1344973 - RNA, 20 nt, Human
guauagcaugcaucuguuua

SEQ ID NO: 1344974 - RNA, 18 nt, Human
guauagcugcuuccagug

SEQ ID NO: 1344975 - RNA, 14 nt, Human
guauaguuaacaca

SEQ ID NO: 1344976 - RNA, 23 nt, Human
guauauacacccaagaugggcau

SEQ ID NO: 1344977 - RNA, 12 nt, Human
guauauacuuug

SEQ ID NO: 1344978 - RNA, 12 nt, Human
guauauacuuuu

SEQ ID NO: 1344979 - RNA, 13 nt, Human
guauauacuuuuu

SEQ ID NO: 1344980 - RNA, 23 nt, Human
guauauacuuugaaaggagaugu

SEQ ID NO: 1344981 - RNA, 10 nt, Human
guauauauau

SEQ ID NO: 1344982 - RNA, 23 nt, Human
guauauauauauauauguacagu

SEQ ID NO: 1344983 - RNA, 18 nt, Human
guauauauauauauaugu

SEQ ID NO: 1344984 - RNA, 17 nt, Human
guaucucuucagucucu

SEQ ID NO: 1344985 - RNA, 13 nt, Human
guaucucuucagu

SEQ ID NO: 1344986 - RNA, 12 nt, Human
guaucucuucag

SEQ ID NO: 1344987 - RNA, 17 nt, Human
guaucuaugcauuuucu

SEQ ID NO: 1344988 - RNA, 13 nt, Human
guaucucacacuc

SEQ ID NO: 1344989 - RNA, 11 nt, Human
guaucucagaa

SEQ ID NO: 1344990 - RNA, 13 nt, Human
guaucucagaaag

SEQ ID NO: 1344991 - RNA, 14 nt, Human
guaucucagaaagu

SEQ ID NO: 1344992 - RNA, 18 nt, Human
guaucucagaaagugccu

SEQ ID NO: 1344993 - RNA, 20 nt, Human
guaucucagaaagugccuga

SEQ ID NO: 1344994 - RNA, 22 nt, Human
guaucucagaaagugccugaca

SEQ ID NO: 1344995 - RNA, 21 nt, Human
guaucucagaaagugccugac

SEQ ID NO: 1344996 - RNA, 18 nt, Human
guaucggcacuguacaaa

SEQ ID NO: 1344997 - RNA, 16 nt, Human
guaucggcacuguaca

SEQ ID NO: 1344998 - RNA, 15 nt, Human
guaucggcacuguac

SEQ ID NO: 1344999 - RNA, 13 nt, Human
guaucggcacugu

SEQ ID NO: 1345000 - RNA, 18 nt, Human
guaucuaggcaacauagu

SEQ ID NO: 1345001 - RNA, 15 nt, Human
guauauuacaaugau

SEQ ID NO: 1345002 - RNA, 14 nt, Human
guauauuacaauga

SEQ ID NO: 1345003 - RNA, 13 nt, Human
guauauuacaaug

SEQ ID NO: 1345004 - RNA, 13 nt, Human
guauaugucucag

SEQ ID NO: 1345005 - RNA, 15 nt, Human
guauaugucucaggu

SEQ ID NO: 1345006 - RNA, 21 nt, Human
guauaugucucaggucccugc

SEQ ID NO: 1345007 - RNA, 16 nt, Human
guauauguugggugca

SEQ ID NO: 1345008 - RNA, 16 nt, Human
guauaugguauuuauu

SEQ ID NO: 1345009 - RNA, 23 nt, Human
guauaucuagguuuaugacagua

SEQ ID NO: 1345010 - RNA, 20 nt, Human
guauaucuagguuuaugaca

SEQ ID NO: 1345011 - RNA, 19 nt, Human
guauaucuagguuuaugac

SEQ ID NO: 1345012 - RNA, 17 nt, Human
guauauauuuuuuuuua

SEQ ID NO: 1345013 - RNA, 15 nt, Human
uuucucugauacaga

SEQ ID NO: 1345014 - RNA, 16 nt, Human
uuucucugauacagaa

SEQ ID NO: 1345015 - RNA, 17 nt, Human
uuucucugauacagaaa

SEQ ID NO: 1345016 - RNA, 18 nt, Human
uuucucugauacagaaaa

SEQ ID NO: 1345017 - RNA, 21 nt, Human
uuucugaaauuuccugggagc

SEQ ID NO: 1345018 - RNA, 11 nt, Human
uuucucugcca

SEQ ID NO: 1345019 - RNA, 13 nt, Human
uuucucugcagaa

SEQ ID NO: 1345020 - RNA, 21 nt, Human
uuucucugcagaaacuacuga

SEQ ID NO: 1345021 - RNA, 13 nt, Human
uuucugaacagcu

SEQ ID NO: 1345022 - RNA, 15 nt, Human
uuucugaacagcugg

SEQ ID NO: 1345023 - RNA, 16 nt, Human
uuucugaacagcuggu

SEQ ID NO: 1345024 - RNA, 17 nt, Human
uuucugaacagcuggug

SEQ ID NO: 1345025 - RNA, 19 nt, Human
uuucugaacagcuggugua

SEQ ID NO: 1345026 - RNA, 22 nt, Human
uuucugaacagcugguguagcu

SEQ ID NO: 1345027 - RNA, 14 nt, Human
uuucuaaaguaaaa

SEQ ID NO: 1345028 - RNA, 12 nt, Human
uuucuaaaguaa

SEQ ID NO: 1345029 - RNA, 18 nt, Human
uuucuacuuugaagucau

SEQ ID NO: 1345030 - RNA, 22 nt, Human
uuucuacuuugaagucauacca

SEQ ID NO: 1345031 - RNA, 13 nt, Human
uuucuagaaagag

SEQ ID NO: 1345032 - RNA, 13 nt, Human
uuucuagaccaau

SEQ ID NO: 1345033 - RNA, 16 nt, Human
uuucuagagcacugcc

SEQ ID NO: 1345034 - RNA, 21 nt, Human
uuacauuuuuugggcagcaau

SEQ ID NO: 1345035 - RNA, 21 nt, Human
uuaccaaaaauaaauauaucu

SEQ ID NO: 1345036 - RNA, 15 nt, Human
uuaccaaaagucaac

SEQ ID NO: 1345037 - RNA, 16 nt, Human
uuaccaaagaugaaug

SEQ ID NO: 1345038 - RNA, 23 nt, Human
uuaccaaagaugaaugaagcaaa

SEQ ID NO: 1345039 - RNA, 12 nt, Human
uuaccaaccugu

SEQ ID NO: 1345040 - RNA, 13 nt, Human
uuaccaaccuguu

SEQ ID NO: 1345041 - RNA, 23 nt, Human
uuacauuuuauggugccuaguau

SEQ ID NO: 1345042 - RNA, 14 nt, Human
uuacauuuuauggu

SEQ ID NO: 1345043 - RNA, 18 nt, Human
uuacauuuuaaacacauu

SEQ ID NO: 1345044 - RNA, 12 nt, Human
uuacauuuucag

SEQ ID NO: 1345045 - RNA, 20 nt, Human
uuaccaaccuguuaccuacu

SEQ ID NO: 1345046 - RNA, 15 nt, Human
uuaccaaauaaagua

SEQ ID NO: 1345047 - RNA, 12 nt, Human
uuuccugcccug

SEQ ID NO: 1345048 - RNA, 13 nt, Human
uuuccugcccugg

SEQ ID NO: 1345049 - RNA, 22 nt, Human
uuuccugccuuuuaguuccugu

SEQ ID NO: 1345050 - RNA, 16 nt, Human
uuuccuggacacucag

SEQ ID NO: 1345051 - RNA, 20 nt, Human
uuuccuggacacucagaccu

SEQ ID NO: 1345052 - RNA, 23 nt, Human
uuuccugccuuuuaguuccugug

SEQ ID NO: 1345053 - RNA, 19 nt, Human
uuuccucagacucuaagaa

SEQ ID NO: 1345054 - RNA, 13 nt, Human
uuuccucccucag

SEQ ID NO: 1345055 - RNA, 18 nt, Human
uuugaaucaucaagucuu

SEQ ID NO: 1345056 - RNA, 18 nt, Human
uuugaagcacagugauca

SEQ ID NO: 1345057 - RNA, 19 nt, Human
uuugaaucaauaauauauu

SEQ ID NO: 1345058 - RNA, 18 nt, Human
uuugaaucacaugaauua

SEQ ID NO: 1345059 - RNA, 19 nt, Human
uuugaauccucucucugug

SEQ ID NO: 1345060 - RNA, 12 nt, Human
uuucuugccuca

SEQ ID NO: 1345061 - RNA, 13 nt, Human
uuucuugccucau

SEQ ID NO: 1345062 - RNA, 17 nt, Human
uuugaagaacaugugag

SEQ ID NO: 1345063 - RNA, 18 nt, Human
uuugaagaacaugugaga

SEQ ID NO: 1345064 - RNA, 14 nt, Human
uuugaacuuuuuau

SEQ ID NO: 1345065 - RNA, 14 nt, Human
uuucuuccucugcu

SEQ ID NO: 1345066 - RNA, 16 nt, Human
uuucuuccucugcuga

SEQ ID NO: 1345067 - RNA, 19 nt, Human
uuucuucuauugccucuga

SEQ ID NO: 1345068 - RNA, 17 nt, Human
uuucuucuauugccucu

SEQ ID NO: 1345069 - RNA, 11 nt, Human
uuucuuccucu

SEQ ID NO: 1345070 - RNA, 13 nt, Human
uuucuuccucugc

SEQ ID NO: 1345071 - RNA, 17 nt, Human
uuucuuccuaccaaguc

SEQ ID NO: 1345072 - RNA, 22 nt, Human
uuucuuccuaccaagucaaacu

SEQ ID NO: 1345073 - RNA, 23 nt, Human
uuucuuccuaccaagucaaacuu

SEQ ID NO: 1345074 - RNA, 18 nt, Human
uuucuucaccaaaucuug

SEQ ID NO: 1345075 - RNA, 16 nt, Human
uuucuucacugcaaca

SEQ ID NO: 1345076 - RNA, 17 nt, Human
uuucuucacugcaacau

SEQ ID NO: 1345077 - RNA, 19 nt, Human
uuucuucacugcaacauga

SEQ ID NO: 1345078 - RNA, 22 nt, Human
uuucuucacugcaacaugauga

SEQ ID NO: 1345079 - RNA, 14 nt, Human
uuucugaccaaaga

SEQ ID NO: 1345080 - RNA, 12 nt, Human
uuucuguuuucu

SEQ ID NO: 1345081 - RNA, 17 nt, Human
uuucuuaaaaaguuaua

SEQ ID NO: 1345082 - RNA, 16 nt, Human
uuucuuaaaccuucag

SEQ ID NO: 1345083 - RNA, 18 nt, Human
uuucuuaaaccuucaguu

SEQ ID NO: 1345084 - RNA, 18 nt, Human
uuuggagggaagcucuug

SEQ ID NO: 1345085 - RNA, 17 nt, Human
uuuggaguccccucacc

SEQ ID NO: 1345086 - RNA, 20 nt, Human
uuuggagucagacagaugug

SEQ ID NO: 1345087 - RNA, 18 nt, Human
uuuggagaguuuccugaa

SEQ ID NO: 1345088 - RNA, 19 nt, Human
uuuggacaaaauggaauac

SEQ ID NO: 1345089 - RNA, 11 nt, Human
uuuggaaugug

SEQ ID NO: 1345090 - RNA, 20 nt, Human
uuuggaguccccucaccucc

SEQ ID NO: 1345091 - RNA, 17 nt, Human
uuuggagguuuauuacg

SEQ ID NO: 1345092 - RNA, 15 nt, Human
uuuggauauguaaaa

SEQ ID NO: 1345093 - RNA, 21 nt, Human
uuuggauauguaaaacauuua

SEQ ID NO: 1345094 - RNA, 10 nt, Human
uuuggaugcc

SEQ ID NO: 1345095 - RNA, 15 nt, Human
uuuggucucuugcuu

SEQ ID NO: 1345096 - RNA, 19 nt, Human
uuuggauauguaaaacauu

SEQ ID NO: 1345097 - RNA, 18 nt, Human
uuuggugauuacauuuua

SEQ ID NO: 1345098 - RNA, 13 nt, Human
uuuguauaaaaua

SEQ ID NO: 1345099 - RNA, 14 nt, Human
uuuguauaaaauaa

SEQ ID NO: 1345100 - RNA, 16 nt, Human
uuuguauaaaauaauu

SEQ ID NO: 1345101 - RNA, 21 nt, Human
uuuggugcuucucagauuucu

SEQ ID NO: 1345102 - RNA, 14 nt, Human
uuuggugagaaccu

SEQ ID NO: 1345103 - RNA, 19 nt, Human
uuugguuuucacauuggaa

SEQ ID NO: 1345104 - RNA, 21 nt, Human
uuugguuucccaagagcuacg

SEQ ID NO: 1345105 - RNA, 15 nt, Human
uuugcaucugaaaau

SEQ ID NO: 1345106 - RNA, 13 nt, Human
uuugcaucucagu

SEQ ID NO: 1345107 - RNA, 17 nt, Human
uuugaauguguuucaca

SEQ ID NO: 1345108 - RNA, 15 nt, Human
uuugaauguguuuca

SEQ ID NO: 1345109 - RNA, 18 nt, Human
uuugaaugcugcaaguua

SEQ ID NO: 1345110 - RNA, 17 nt, Human
uuugaaugauuuuucuu

SEQ ID NO: 1345111 - RNA, 22 nt, Human
uuugaaugauuuuucuuuacaa

SEQ ID NO: 1345112 - RNA, 16 nt, Human
uuugcauuaaauuaca

SEQ ID NO: 1345113 - RNA, 19 nt, Human
uuugcauuaaauuacagaa

SEQ ID NO: 1345114 - RNA, 17 nt, Human
uuugcauuaaauucaca

SEQ ID NO: 1345115 - RNA, 14 nt, Human
uuugcaucucagua

SEQ ID NO: 1345116 - RNA, 14 nt, Human
uuugcauuaaauua

SEQ ID NO: 1345117 - RNA, 15 nt, Human
uuugcauuaaauuac

SEQ ID NO: 1345118 - RNA, 21 nt, Human
uuuuaaaagaaugauuaugaa

SEQ ID NO: 1345119 - RNA, 13 nt, Human
uuuguugacauua

SEQ ID NO: 1345120 - RNA, 14 nt, Human
uuuguugacauuag

SEQ ID NO: 1345121 - RNA, 15 nt, Human
uuuguugacauucug

SEQ ID NO: 1345122 - RNA, 16 nt, Human
uuuguugacauucuga

SEQ ID NO: 1345123 - RNA, 17 nt, Human
uuuguugacauucugaa

SEQ ID NO: 1345124 - RNA, 18 nt, Human
uuuuaaagacuuuuauga

SEQ ID NO: 1345125 - RNA, 12 nt, Human
uuuuaaagaauu

SEQ ID NO: 1345126 - RNA, 15 nt, Human
uuuguucuucuuaaa

SEQ ID NO: 1345127 - RNA, 20 nt, Human
uuuguucgcauggucacaca

SEQ ID NO: 1345128 - RNA, 14 nt, Human
uuuguauaaaagug

SEQ ID NO: 1345129 - RNA, 20 nt, Human
uuuguauaaaagugugaaau

SEQ ID NO: 1345130 - RNA, 14 nt, Human
uuuguaucuugaug

SEQ ID NO: 1345131 - RNA, 16 nt, Human
uuuuaaauguauacua

SEQ ID NO: 1345132 - RNA, 20 nt, Human
uuuuaaauucccguuuuguc

SEQ ID NO: 1345133 - RNA, 12 nt, Human
uuuuaaauguau

SEQ ID NO: 1345134 - RNA, 19 nt, Human
uuuuaaaugcauaaaugca

SEQ ID NO: 1345135 - RNA, 13 nt, Human
uuuuaaagaauug

SEQ ID NO: 1345136 - RNA, 18 nt, Human
uuuuaaagaccccuaacc

SEQ ID NO: 1345137 - RNA, 18 nt, Human
uuuuaaauauuuuuucuu

SEQ ID NO: 1345138 - RNA, 22 nt, Human
uuuuaauaugcuuaaaauaagc

SEQ ID NO: 1345139 - RNA, 18 nt, Human
uuuuaauccgccaauauu

SEQ ID NO: 1345140 - RNA, 19 nt, Human
uuuuaauccgccaauauua

SEQ ID NO: 1345141 - RNA, 20 nt, Human
uuuuaauccgccaauauuag

SEQ ID NO: 1345142 - RNA, 21 nt, Human
uuuuaaucucuaacaguggac

SEQ ID NO: 1345143 - RNA, 16 nt, Human
uuuuaaugaacaaaug

SEQ ID NO: 1345144 - RNA, 20 nt, Human
uuuuugaaaagcagacauuu

SEQ ID NO: 1345145 - RNA, 23 nt, Human
uuuuugaaaaagcgaaaaaauca

SEQ ID NO: 1345146 - RNA, 21 nt, Human
uuuuucuuuucggaaaucuua

SEQ ID NO: 1345147 - RNA, 17 nt, Human
uuuuugaaaaagcgaaa

SEQ ID NO: 1345148 - RNA, 13 nt, Human
uuuuucugauaaa

SEQ ID NO: 1345149 - RNA, 17 nt, Human
uuuuucugauaaaagau

SEQ ID NO: 1345150 - RNA, 12 nt, Human
uuuuucuugucu

SEQ ID NO: 1345151 - RNA, 22 nt, Human
uuuuucuugucuauaaagcauu

SEQ ID NO: 1345152 - RNA, 12 nt, Human
uuuuucuuuaca

SEQ ID NO: 1345153 - RNA, 17 nt, Human
uuuuucuugucuauaaa

SEQ ID NO: 1345154 - RNA, 19 nt, Human
uuuuucuuuauaagaaagc

SEQ ID NO: 1345155 - RNA, 16 nt, Human
uuuuuugggcagcaau

SEQ ID NO: 1345156 - RNA, 13 nt, Human
uuuuuuguaccaa

SEQ ID NO: 1345157 - RNA, 14 nt, Human
uuuuuuguaccauu

SEQ ID NO: 1345158 - RNA, 15 nt, Human
uuuuuuguauaguua

SEQ ID NO: 1345159 - RNA, 12 nt, Human
uuuuuuguauag

SEQ ID NO: 1345160 - RNA, 12 nt, Human
uuuuuuguugac

SEQ ID NO: 1345161 - RNA, 10 nt, Human
uuuuuugaga

SEQ ID NO: 1345162 - RNA, 15 nt, Human
uuuuugaagcuguau

SEQ ID NO: 1345163 - RNA, 9 nt, Human
uuuuuugca

SEQ ID NO: 1345164 - RNA, 10 nt, Human
uuuuuugcag

SEQ ID NO: 1345165 - RNA, 17 nt, Human
uuuuuugcaguaacugu

SEQ ID NO: 1345166 - RNA, 21 nt, Human
uuuuuuggccaucugcuccug

SEQ ID NO: 1345167 - RNA, 19 nt, Human
uuuuucucuaggaaauauu

SEQ ID NO: 1345168 - RNA, 23 nt, Human
uuuuucucugauacagaaaaguu

SEQ ID NO: 1345169 - RNA, 21 nt, Human
uuuuucucgcuguccuuucua

SEQ ID NO: 1345170 - RNA, 16 nt, Human
uuuuucucucaacacc

SEQ ID NO: 1345171 - RNA, 18 nt, Human
uuuuucucucaacaccau

SEQ ID NO: 1345172 - RNA, 15 nt, Human
uuuuucuaacuacaa

SEQ ID NO: 1345173 - RNA, 14 nt, Human
uuuuucuaaaggag

SEQ ID NO: 1345174 - RNA, 11 nt, Human
uuuuucuauua

SEQ ID NO: 1345175 - RNA, 13 nt, Human
uuuuucuauuaaa

SEQ ID NO: 1345176 - RNA, 18 nt, Human
uuuuucuauuaaaagacu

SEQ ID NO: 1345177 - RNA, 19 nt, Human
uuuuucuauuaaaagacuc

SEQ ID NO: 1345178 - RNA, 21 nt, Human
uuuuucuauuaaaagacucau

SEQ ID NO: 1345179 - RNA, 22 nt, Human
uuuuuccuucaaaguuuaauaa

SEQ ID NO: 1345180 - RNA, 18 nt, Human
uuuuuccuucaaaguuua

SEQ ID NO: 1345181 - RNA, 19 nt, Human
uuuuuccuucaaaguuuaa

SEQ ID NO: 1345182 - RNA, 11 nt, Human
uuuuuccuuuu

SEQ ID NO: 1345183 - RNA, 10 nt, Human
uuuuuccuuu

SEQ ID NO: 1345184 - RNA, 18 nt, Human
uuuuuccuuuaacugaca

SEQ ID NO: 1345185 - RNA, 16 nt, Human
uuuuucguuuguuugu

SEQ ID NO: 1345186 - RNA, 13 nt, Human
uuuuucuaaagga

SEQ ID NO: 1345187 - RNA, 13 nt, Human
uuuuuccucucca

SEQ ID NO: 1345188 - RNA, 11 nt, Human
uuuuuccuguc

SEQ ID NO: 1345189 - RNA, 18 nt, Human
uuuuuccuagcccucuca

SEQ ID NO: 1345190 - RNA, 13 nt, Human
uuuuuaagugaaa

SEQ ID NO: 1345191 - RNA, 20 nt, Human
uuuuuaagugaaaauauagc

SEQ ID NO: 1345192 - RNA, 16 nt, Human
uuuuuaagaauaucug

SEQ ID NO: 1345193 - RNA, 17 nt, Human
uuuuuaagaauaucugu

SEQ ID NO: 1345194 - RNA, 18 nt, Human
uuuuuaagaauaucugua

SEQ ID NO: 1345195 - RNA, 13 nt, Human
uuuuuaagaauug

SEQ ID NO: 1345196 - RNA, 14 nt, Human
uuuuuaagcucuga

SEQ ID NO: 1345197 - RNA, 20 nt, Human
uuuuuaagcucugagcuguc

SEQ ID NO: 1345198 - RNA, 18 nt, Human
uuuuuaaagacuuuuaug

SEQ ID NO: 1345199 - RNA, 13 nt, Human
uuuuuaaagacuu

SEQ ID NO: 1345200 - RNA, 12 nt, Human
uuuuuaaagacu

SEQ ID NO: 1345201 - RNA, 16 nt, Human
uuuuuaaacaaguauu

SEQ ID NO: 1345202 - RNA, 13 nt, Human
uuuuuaaacauca

SEQ ID NO: 1345203 - RNA, 13 nt, Human
uuuuuaaacugua

SEQ ID NO: 1345204 - RNA, 15 nt, Human
uuuuuaaacuguaca

SEQ ID NO: 1345205 - RNA, 16 nt, Human
uuuuuaaacuguacag

SEQ ID NO: 1345206 - RNA, 17 nt, Human
uuuuuaaacuguacagu

SEQ ID NO: 1345207 - RNA, 18 nt, Human
uuuuuaaacuguacagug

SEQ ID NO: 1345208 - RNA, 19 nt, Human
uuuuuaaacuguacagugu

SEQ ID NO: 1345209 - RNA, 21 nt, Human
uuuuuaaacuguacagugucu

SEQ ID NO: 1345210 - RNA, 18 nt, Human
uuuuuaaaaaagaaacau

SEQ ID NO: 1345211 - RNA, 11 nt, Human
uuuugucucug

SEQ ID NO: 1345212 - RNA, 15 nt, Human
uuuuuaaaaaagcuu

SEQ ID NO: 1345213 - RNA, 17 nt, Human
uuuuuaaaaaagcuuaa

SEQ ID NO: 1345214 - RNA, 22 nt, Human
uuuuuaaaaaagcuuaaaacuu

SEQ ID NO: 1345215 - RNA, 23 nt, Human
uuuuuaaaaaagcuuaaaacuuu

SEQ ID NO: 1345216 - RNA, 14 nt, Human
uuuuuaaaaagcaa

SEQ ID NO: 1345217 - RNA, 17 nt, Human
uuuuguauucucugagc

SEQ ID NO: 1345218 - RNA, 18 nt, Human
uuuugucacuuuuucuga

SEQ ID NO: 1345219 - RNA, 23 nt, Human
uuuugucaaugcaguugucucug

SEQ ID NO: 1345220 - RNA, 15 nt, Human
uuuugucuacacacc

SEQ ID NO: 1345221 - RNA, 10 nt, Human
uuuugucucu

SEQ ID NO: 1345222 - RNA, 12 nt, Human
uuuugucucugc

SEQ ID NO: 1345223 - RNA, 11 nt, Human
uuuuguaccaa

SEQ ID NO: 1345224 - RNA, 21 nt, Human
uuuuguagcuggggcuuugau

SEQ ID NO: 1345225 - RNA, 14 nt, Human
uuuuguauaauugg

SEQ ID NO: 1345226 - RNA, 16 nt, Human
uuuuguauaauuggau

SEQ ID NO: 1345227 - RNA, 23 nt, Human
uuuuguauaauuggauuuccuaa

SEQ ID NO: 1345228 - RNA, 24 nt, Human
uuuuguauaauuggauuuccuaau

SEQ ID NO: 1345229 - RNA, 16 nt, Human
uuuuguauaaaauaga

SEQ ID NO: 1345230 - RNA, 20 nt, Human
uuuuguauaguuaacacacu

SEQ ID NO: 1345231 - RNA, 20 nt, Human
uuuuggugguuuuagugauu

SEQ ID NO: 1345232 - RNA, 18 nt, Human
uuuuguaaacucaaaaua

SEQ ID NO: 1345233 - RNA, 14 nt, Human
uuuuguaagacaaa

SEQ ID NO: 1345234 - RNA, 19 nt, Human
uuuuguaaguugaagcaaa

SEQ ID NO: 1345235 - RNA, 17 nt, Human
uuuuguaauaauaaaga

SEQ ID NO: 1345236 - RNA, 19 nt, Human
uuuuguaauaauaaagaau

SEQ ID NO: 1345237 - RNA, 18 nt, Human
uuuucuaaaguaaaaaca

SEQ ID NO: 1345238 - RNA, 20 nt, Human
uuuucuaaaggaguuuaugu

SEQ ID NO: 1345239 - RNA, 23 nt, Human
uuuucuaacagaaagcaugauuu

SEQ ID NO: 1345240 - RNA, 12 nt, Human
uuuucuaacugg

SEQ ID NO: 1345241 - RNA, 16 nt, Human
uuuucuaagaaacauu

SEQ ID NO: 1345242 - RNA, 18 nt, Human
uuuucuaagaaacauuua

SEQ ID NO: 1345243 - RNA, 11 nt, Human
uuuucuuucuc

SEQ ID NO: 1345244 - RNA, 13 nt, Human
uuuucuuugaaua

SEQ ID NO: 1345245 - RNA, 20 nt, Human
uuuucuuugaauaaauguca

SEQ ID NO: 1345246 - RNA, 15 nt, Human
uuuucuuugaauaaa

SEQ ID NO: 1345247 - RNA, 12 nt, Human
uuuucuuugugu

SEQ ID NO: 1345248 - RNA, 19 nt, Human
uuuucuuuguguagcuuug

SEQ ID NO: 1345249 - RNA, 16 nt, Human
uuuucuuuguguagcu

SEQ ID NO: 1345250 - RNA, 14 nt, Human
uuuuccugaaaacc

SEQ ID NO: 1345251 - RNA, 17 nt, Human
uuuuaauuuacaaaaau

SEQ ID NO: 1345252 - RNA, 12 nt, Human
uuuuccuguccu

SEQ ID NO: 1345253 - RNA, 13 nt, Human
uuuuccuguccuc

SEQ ID NO: 1345254 - RNA, 20 nt, Human
uuuuccuguccucuuucagc

SEQ ID NO: 1345255 - RNA, 22 nt, Human
uuuuccuguccucuuucagcuc

SEQ ID NO: 1345256 - RNA, 21 nt, Human
uuuuccuguccucuuucagcu

SEQ ID NO: 1345257 - RNA, 16 nt, Human
uuuuccuucaaaguuu

SEQ ID NO: 1345258 - RNA, 11 nt, Human
uuuuaauuauu

SEQ ID NO: 1345259 - RNA, 16 nt, Human
uuuuaauuauuauucu

SEQ ID NO: 1345260 - RNA, 17 nt, Human
uuuuaauuauuauucuu

SEQ ID NO: 1345261 - RNA, 20 nt, Human
uuuuaauuauuauuuauaua

SEQ ID NO: 1345262 - RNA, 23 nt, Human
uuuuaauuauuauuuauauaugu

SEQ ID NO: 1345263 - RNA, 12 nt, Human
uuuuaauucauu

SEQ ID NO: 1345264 - RNA, 18 nt, Human
uuuuggucuggagggaag

SEQ ID NO: 1345265 - RNA, 14 nt, Human
uuuuggucauugua

SEQ ID NO: 1345266 - RNA, 21 nt, Human
uuuugguccaaguugugcuua

SEQ ID NO: 1345267 - RNA, 22 nt, Human
uuuuggcugaaauucuccugga

SEQ ID NO: 1345268 - RNA, 19 nt, Human
uuuugguaaagacuggcuu

SEQ ID NO: 1345269 - RNA, 16 nt, Human
uuuuggauuggacaaa

SEQ ID NO: 1345270 - RNA, 19 nt, Human
uuuuggcaaaacucuacuu

SEQ ID NO: 1345271 - RNA, 11 nt, Human
uuuuggcaccu

SEQ ID NO: 1345272 - RNA, 11 nt, Human
uuuuggaugcc

SEQ ID NO: 1345273 - RNA, 16 nt, Human
uuuuggauuguauauu

SEQ ID NO: 1345274 - RNA, 13 nt, Human
uuuugaaaaacug

SEQ ID NO: 1345275 - RNA, 13 nt, Human
uuuugaaucaaua

SEQ ID NO: 1345276 - RNA, 13 nt, Human
uuuucuuuucuau

SEQ ID NO: 1345277 - RNA, 16 nt, Human
gcgcgaucucagcuca

SEQ ID NO: 1345278 - RNA, 15 nt, Human
gcgcgaucucagcuc

SEQ ID NO: 1345279 - RNA, 20 nt, Human
gcgcgagggccucaaaggcc

SEQ ID NO: 1345280 - RNA, 22 nt, Human
gcgccgucuccaggggcugcuu

SEQ ID NO: 1345281 - RNA, 22 nt, Human
gcgacagugagacucugucuca

SEQ ID NO: 1345282 - RNA, 13 nt, Human
gcgccgucuccag

SEQ ID NO: 1345283 - RNA, 15 nt, Human
gcgccgucuccaggg

SEQ ID NO: 1345284 - RNA, 12 nt, Human
gcgacagugaga

SEQ ID NO: 1345285 - RNA, 15 nt, Human
gcgcuaucucccugc

SEQ ID NO: 1345286 - RNA, 20 nt, Human
gcgcuaucucccugccuccu

SEQ ID NO: 1345287 - RNA, 13 nt, Human
gcgcucagggcca

SEQ ID NO: 1345288 - RNA, 22 nt, Human
gcgcucagggccaugcugaggc

SEQ ID NO: 1345289 - RNA, 12 nt, Human
gcgcggcuggga

SEQ ID NO: 1345290 - RNA, 18 nt, Human
gcgcggcugggaggaggg

SEQ ID NO: 1345291 - RNA, 19 nt, Human
gcgcgugcaugugugcgug

SEQ ID NO: 1345292 - RNA, 22 nt, Human
gcgcuaauucaaggaauuucuu

SEQ ID NO: 1345293 - RNA, 16 nt, Human
gcgcucagggccaugc

SEQ ID NO: 1345294 - RNA, 10 nt, Human
gcggacacac

SEQ ID NO: 1345295 - RNA, 15 nt, Human
gcgggcagagggcug

SEQ ID NO: 1345296 - RNA, 16 nt, Human
gcgggcagagggcugg

SEQ ID NO: 1345297 - RNA, 17 nt, Human
gcgggcagagggcugga

SEQ ID NO: 1345298 - RNA, 19 nt, Human
gcgggcagagggcuggagg

SEQ ID NO: 1345299 - RNA, 13 nt, Human
gcgggucacagga

SEQ ID NO: 1345300 - RNA, 15 nt, Human
gcgggucacaggagg

SEQ ID NO: 1345301 - RNA, 15 nt, Human
gcgggcgcgugagug

SEQ ID NO: 1345302 - RNA, 21 nt, Human
gcggggcuugccuucuggugu

SEQ ID NO: 1345303 - RNA, 23 nt, Human
gcggggguuccguguccaccccc

SEQ ID NO: 1345304 - RNA, 18 nt, Human
gcgggcagagggcuggag

SEQ ID NO: 1345305 - RNA, 14 nt, Human
gcgucuacccuggg

SEQ ID NO: 1345306 - RNA, 15 nt, Human
gcgucuacccuggga

SEQ ID NO: 1345307 - RNA, 18 nt, Human
gcgguuccggcauggaca

SEQ ID NO: 1345308 - RNA, 20 nt, Human
gcgguuuacucacugcugca

SEQ ID NO: 1345309 - RNA, 21 nt, Human
gcgguuugguuugcagcgacu

SEQ ID NO: 1345310 - RNA, 14 nt, Human
gcguaaguacagag

SEQ ID NO: 1345311 - RNA, 15 nt, Human
gcguaaguacagaga

SEQ ID NO: 1345312 - RNA, 16 nt, Human
gcguaaguacagagaa

SEQ ID NO: 1345313 - RNA, 17 nt, Human
gcguaaguacagagaag

SEQ ID NO: 1345314 - RNA, 18 nt, Human
gcguaaguacagagaagc

SEQ ID NO: 1345315 - RNA, 19 nt, Human
gcguaaguacagagaagcc

SEQ ID NO: 1345316 - RNA, 20 nt, Human
gcguaaguacagagaagcca

SEQ ID NO: 1345317 - RNA, 21 nt, Human
gcguaaguacagagaagccau

SEQ ID NO: 1345318 - RNA, 23 nt, Human
gcguaaguacagagaagccauca

SEQ ID NO: 1345319 - RNA, 19 nt, Human
gcgggucacaggagggagg

SEQ ID NO: 1345320 - RNA, 20 nt, Human
gcgggucacaggagggaggg

SEQ ID NO: 1345321 - RNA, 15 nt, Human
gcgggucugcuccca

SEQ ID NO: 1345322 - RNA, 17 nt, Human
gcgggucugcucccaag

SEQ ID NO: 1345323 - RNA, 21 nt, Human
gcgggugaacaaagcagccac

SEQ ID NO: 1345324 - RNA, 22 nt, Human
gcgggugaacaaagcagccacg

SEQ ID NO: 1345325 - RNA, 17 nt, Human
gcggugcuugauagaaa

SEQ ID NO: 1345326 - RNA, 20 nt, Human
gcggugggaccuagggaggc

SEQ ID NO: 1345327 - RNA, 14 nt, Human
gcggugggccuggu

SEQ ID NO: 1345328 - RNA, 21 nt, Human
gcggugucucuccugccccuu

SEQ ID NO: 1345329 - RNA, 18 nt, Human
gcgguuauaaaaaauggu

SEQ ID NO: 1345330 - RNA, 19 nt, Human
gcgguuauaaaaaaugguu

SEQ ID NO: 1345331 - RNA, 23 nt, Human
gcgguuaugaaauucacccccuu

SEQ ID NO: 1345332 - RNA, 22 nt, Human
gcgguuauaaaaaaugguucag

SEQ ID NO: 1345333 - RNA, 12 nt, Human
gcgguucaggaa

SEQ ID NO: 1345334 - RNA, 16 nt, Human
gcgucuacccugggau

SEQ ID NO: 1345335 - RNA, 21 nt, Human
gcgucuggaaguccaaugugg

SEQ ID NO: 1345336 - RNA, 15 nt, Human
gcuaaagacaugaag

SEQ ID NO: 1345337 - RNA, 17 nt, Human
gcuaaagcaauaugcau

SEQ ID NO: 1345338 - RNA, 19 nt, Human
gcuaaagcaauaugcauuu

SEQ ID NO: 1345339 - RNA, 14 nt, Human
gcuaagacuuccua

SEQ ID NO: 1345340 - RNA, 13 nt, Human
gcuaagagaagua

SEQ ID NO: 1345341 - RNA, 14 nt, Human
gcuaagagaaguag

SEQ ID NO: 1345342 - RNA, 14 nt, Human
gcuacagagaagcc

SEQ ID NO: 1345343 - RNA, 15 nt, Human
gcuacagagaagccu

SEQ ID NO: 1345344 - RNA, 16 nt, Human
gcuacagagaagccuu

SEQ ID NO: 1345345 - RNA, 17 nt, Human
gcuacagagaagccuuc

SEQ ID NO: 1345346 - RNA, 23 nt, Human
gcuacagagaagccuucaagcuc

SEQ ID NO: 1345347 - RNA, 18 nt, Human
gcuacagagaagccuuca

SEQ ID NO: 1345348 - RNA, 17 nt, Human
gcuacagcaauuucuaa

SEQ ID NO: 1345349 - RNA, 19 nt, Human
gcuacagcaauuucuaauu

SEQ ID NO: 1345350 - RNA, 19 nt, Human
gcuaggaaauccagggugg

SEQ ID NO: 1345351 - RNA, 21 nt, Human
gcuagaauugaguguuuaaag

SEQ ID NO: 1345352 - RNA, 16 nt, Human
gcuagacacaugaagg

SEQ ID NO: 1345353 - RNA, 22 nt, Human
gcuaggaaauccaggguggugg

SEQ ID NO: 1345354 - RNA, 16 nt, Human
gcuauagaugucuuuu

SEQ ID NO: 1345355 - RNA, 20 nt, Human
gcuauagaugucuuuuccca

SEQ ID NO: 1345356 - RNA, 21 nt, Human
gcuauagaugucuuuucccau

SEQ ID NO: 1345357 - RNA, 19 nt, Human
gcuagaacucccuuucaac

SEQ ID NO: 1345358 - RNA, 18 nt, Human
gcuaccuguguggacagg

SEQ ID NO: 1345359 - RNA, 19 nt, Human
gcuaccuguguggacagga

SEQ ID NO: 1345360 - RNA, 20 nt, Human
gcuaccuguguggacaggac

SEQ ID NO: 1345361 - RNA, 13 nt, Human
gcuacauaauuua

SEQ ID NO: 1345362 - RNA, 19 nt, Human
gcuaccugcucagcccugc

SEQ ID NO: 1345363 - RNA, 20 nt, Human
gcuaccugcucagcccugca

SEQ ID NO: 1345364 - RNA, 14 nt, Human
gcuaccugugugga

SEQ ID NO: 1345365 - RNA, 17 nt, Human
gcuaccuguguggacag

SEQ ID NO: 1345366 - RNA, 22 nt, Human
gcuaccuguguggacaggacua

SEQ ID NO: 1345367 - RNA, 16 nt, Human
gccuuugaccugccuc

SEQ ID NO: 1345368 - RNA, 15 nt, Human
gccuuggccuguguu

SEQ ID NO: 1345369 - RNA, 15 nt, Human
gccuuggccucccaa

SEQ ID NO: 1345370 - RNA, 11 nt, Human
gccuuggccug

SEQ ID NO: 1345371 - RNA, 12 nt, Human
gccuuggccugg

SEQ ID NO: 1345372 - RNA, 13 nt, Human
gccuuggccugga

SEQ ID NO: 1345373 - RNA, 14 nt, Human
gccuuggccuggag

SEQ ID NO: 1345374 - RNA, 15 nt, Human
gccuuggccuggagc

SEQ ID NO: 1345375 - RNA, 16 nt, Human
gccuuggccuggagca

SEQ ID NO: 1345376 - RNA, 23 nt, Human
gccuuggccuguguucuuccugg

SEQ ID NO: 1345377 - RNA, 18 nt, Human
gccuuuggacuugucccg

SEQ ID NO: 1345378 - RNA, 23 nt, Human
gccuuugcgcuccuggcccagcc

SEQ ID NO: 1345379 - RNA, 22 nt, Human
gccuuuggaaacagcucgacuu

SEQ ID NO: 1345380 - RNA, 16 nt, Human
gccuuugcgcuccugg

SEQ ID NO: 1345381 - RNA, 18 nt, Human
gccuuugcgcuccuggcc

SEQ ID NO: 1345382 - RNA, 19 nt, Human
gccuuugcgcuccuggccc

SEQ ID NO: 1345383 - RNA, 21 nt, Human
gccuuugcgcuccuggcccag

SEQ ID NO: 1345384 - RNA, 14 nt, Human
gccuuugagcucag

SEQ ID NO: 1345385 - RNA, 14 nt, Human
gccuuugccaggug

SEQ ID NO: 1345386 - RNA, 16 nt, Human
gccuuugccaggugac

SEQ ID NO: 1345387 - RNA, 15 nt, Human
gccuuugccagguga

SEQ ID NO: 1345388 - RNA, 15 nt, Human
gccuuugcgcuccug

SEQ ID NO: 1345389 - RNA, 15 nt, Human
gccuuuggcaggugc

SEQ ID NO: 1345390 - RNA, 13 nt, Human
gccuuuggcaggu

SEQ ID NO: 1345391 - RNA, 14 nt, Human
gccuuuuucauuua

SEQ ID NO: 1345392 - RNA, 15 nt, Human
gccuuuuucauuuau

SEQ ID NO: 1345393 - RNA, 17 nt, Human
gccuuuuucauuuaucu

SEQ ID NO: 1345394 - RNA, 18 nt, Human
gccuuuuucauuuaucua

SEQ ID NO: 1345395 - RNA, 19 nt, Human
gccuuuuucauuuaucuau

SEQ ID NO: 1345396 - RNA, 15 nt, Human
gccuuuuuucuguau

SEQ ID NO: 1345397 - RNA, 23 nt, Human
gccuuuuuucuguauaaaugucu

SEQ ID NO: 1345398 - RNA, 22 nt, Human
gcgaaaaaaucagguggcuuuu

SEQ ID NO: 1345399 - RNA, 22 nt, Human
gccuuuuucauuuaucuauaau

SEQ ID NO: 1345400 - RNA, 17 nt, Human
gccuuuuuguuucaaug

SEQ ID NO: 1345401 - RNA, 13 nt, Human
gccuuuuuucccc

SEQ ID NO: 1345402 - RNA, 14 nt, Human
gccuuuuuucccca

SEQ ID NO: 1345403 - RNA, 15 nt, Human
gccuuuuuuccccag

SEQ ID NO: 1345404 - RNA, 16 nt, Human
gccuuuuuuccccaga

SEQ ID NO: 1345405 - RNA, 17 nt, Human
gccuuuuuuccccagac

SEQ ID NO: 1345406 - RNA, 19 nt, Human
gccuuuuuuccccagacuu

SEQ ID NO: 1345407 - RNA, 20 nt, Human
gccuuuuuuccccagacuug

SEQ ID NO: 1345408 - RNA, 23 nt, Human
gccuuuuuuccccagacuuguug

SEQ ID NO: 1345409 - RNA, 16 nt, Human
gccuucauucugcaag

SEQ ID NO: 1345410 - RNA, 12 nt, Human
gccuuccaccca

SEQ ID NO: 1345411 - RNA, 14 nt, Human
gccuuccacccagg

SEQ ID NO: 1345412 - RNA, 17 nt, Human
gccuuccacccaggggc

SEQ ID NO: 1345413 - RNA, 13 nt, Human
gccuucagggagu

SEQ ID NO: 1345414 - RNA, 21 nt, Human
gccuucagggagugagggauu

SEQ ID NO: 1345415 - RNA, 13 nt, Human
gccuucaucuccc

SEQ ID NO: 1345416 - RNA, 18 nt, Human
gccuucauaucauccaca

SEQ ID NO: 1345417 - RNA, 21 nt, Human
gccuucauaucauccacacau

SEQ ID NO: 1345418 - RNA, 18 nt, Human
gccuucgauacaccgggc

SEQ ID NO: 1345419 - RNA, 22 nt, Human
gccuucgauacaccgggccugg

SEQ ID NO: 1345420 - RNA, 19 nt, Human
gccuuccuguuuuucacau

SEQ ID NO: 1345421 - RNA, 23 nt, Human
gccuucgauacaccgggccugga

SEQ ID NO: 1345422 - RNA, 13 nt, Human
gccuugcuuguua

SEQ ID NO: 1345423 - RNA, 11 nt, Human
gccuugcuugu

SEQ ID NO: 1345424 - RNA, 13 nt, Human
gccuguuuaagag

SEQ ID NO: 1345425 - RNA, 19 nt, Human
gccuguuucccaggcccac

SEQ ID NO: 1345426 - RNA, 14 nt, Human
gccuguuuggccuc

SEQ ID NO: 1345427 - RNA, 16 nt, Human
gccuguuuggccucuc

SEQ ID NO: 1345428 - RNA, 21 nt, Human
gccuguuuggccucucuaucc

SEQ ID NO: 1345429 - RNA, 12 nt, Human
gccuguuuaaga

SEQ ID NO: 1345430 - RNA, 22 nt, Human
gccuuaucuugcaccccaaagc

SEQ ID NO: 1345431 - RNA, 18 nt, Human
gccuggucucacccugga

SEQ ID NO: 1345432 - RNA, 19 nt, Human
gccuggucucacccuggag

SEQ ID NO: 1345433 - RNA, 20 nt, Human
gccuggucucacccuggagg

SEQ ID NO: 1345434 - RNA, 22 nt, Human
gccuggucucacccuggaggca

SEQ ID NO: 1345435 - RNA, 14 nt, Human
gccuggggucugga

SEQ ID NO: 1345436 - RNA, 18 nt, Human
gccuggggugacccggca

SEQ ID NO: 1345437 - RNA, 22 nt, Human
gccuggggugacccggcacccc

SEQ ID NO: 1345438 - RNA, 19 nt, Human
gccuggggugacccggcac

SEQ ID NO: 1345439 - RNA, 21 nt, Human
gccugggucucaccggcucuc

SEQ ID NO: 1345440 - RNA, 20 nt, Human
gccuggugcccagcacaugu

SEQ ID NO: 1345441 - RNA, 16 nt, Human
gccugggggugccagg

SEQ ID NO: 1345442 - RNA, 17 nt, Human
gccugggggugccagga

SEQ ID NO: 1345443 - RNA, 21 nt, Human
gccugggggugccaggaccag

SEQ ID NO: 1345444 - RNA, 18 nt, Human
gccugccagcugcacuga

SEQ ID NO: 1345445 - RNA, 23 nt, Human
gccugccaccuggaccccugcau

SEQ ID NO: 1345446 - RNA, 11 nt, Human
gccugccagga

SEQ ID NO: 1345447 - RNA, 12 nt, Human
gccugccaggag

SEQ ID NO: 1345448 - RNA, 13 nt, Human
gccugccaggagg

SEQ ID NO: 1345449 - RNA, 14 nt, Human
gccugccaggagga

SEQ ID NO: 1345450 - RNA, 18 nt, Human
gccugccaggaggaccca

SEQ ID NO: 1345451 - RNA, 20 nt, Human
gccugccaggaggacccagg

SEQ ID NO: 1345452 - RNA, 21 nt, Human
gccugccaggaggacccaggg

SEQ ID NO: 1345453 - RNA, 23 nt, Human
gccugccaggaggacccagggcu

SEQ ID NO: 1345454 - RNA, 14 nt, Human
gccugccagcugca

SEQ ID NO: 1345455 - RNA, 15 nt, Human
gccugccagcugcac

SEQ ID NO: 1345456 - RNA, 16 nt, Human
gccugccaccuggacc

SEQ ID NO: 1345457 - RNA, 17 nt, Human
gccugccaccuggaccc

SEQ ID NO: 1345458 - RNA, 18 nt, Human
gccugccaccuggacccc

SEQ ID NO: 1345459 - RNA, 22 nt, Human
gccugccaccuggaccccugca

SEQ ID NO: 1345460 - RNA, 13 nt, Human
gccugcaaacugg

SEQ ID NO: 1345461 - RNA, 14 nt, Human
gccugcaaacuggg

SEQ ID NO: 1345462 - RNA, 16 nt, Human
gccugcaaacugggaa

SEQ ID NO: 1345463 - RNA, 17 nt, Human
gccugcaaacugggaac

SEQ ID NO: 1345464 - RNA, 23 nt, Human
gccugcaaacugggaaccccuuu

SEQ ID NO: 1345465 - RNA, 21 nt, Human
gccugccaccuccccccacaa

SEQ ID NO: 1345466 - RNA, 12 nt, Human
gccugccaccug

SEQ ID NO: 1345467 - RNA, 13 nt, Human
gccugccaccugg

SEQ ID NO: 1345468 - RNA, 14 nt, Human
gccugccaccugga

SEQ ID NO: 1345469 - RNA, 15 nt, Human
gccugccaccuggac

SEQ ID NO: 1345470 - RNA, 23 nt, Human
gccucccuucaugcauggaaauu

SEQ ID NO: 1345471 - RNA, 14 nt, Human
gccucccuuguggc

SEQ ID NO: 1345472 - RNA, 22 nt, Human
gccucccuucaugcauggaaau

SEQ ID NO: 1345473 - RNA, 20 nt, Human
gccucccuucaugcauggaa

SEQ ID NO: 1345474 - RNA, 18 nt, Human
gccucccuucaugcaugg

SEQ ID NO: 1345475 - RNA, 15 nt, Human
gccucccuucaugca

SEQ ID NO: 1345476 - RNA, 18 nt, Human
gccucucaucaacugaau

SEQ ID NO: 1345477 - RNA, 19 nt, Human
gccucucaucaacugaaug

SEQ ID NO: 1345478 - RNA, 21 nt, Human
gccuccucacccccagcuuug

SEQ ID NO: 1345479 - RNA, 16 nt, Human
gccucucaucaacuga

SEQ ID NO: 1345480 - RNA, 14 nt, Human
gccuccucaccccc

SEQ ID NO: 1345481 - RNA, 16 nt, Human
gccuccucacccccag

SEQ ID NO: 1345482 - RNA, 17 nt, Human
gccuccucacccccagc

SEQ ID NO: 1345483 - RNA, 18 nt, Human
gccuccucacccccagcu

SEQ ID NO: 1345484 - RNA, 19 nt, Human
gccuccucacccccagcuu

SEQ ID NO: 1345485 - RNA, 14 nt, Human
gccucccagguuca

SEQ ID NO: 1345486 - RNA, 12 nt, Human
gccucagagacc

SEQ ID NO: 1345487 - RNA, 15 nt, Human
gccucagagaccagg

SEQ ID NO: 1345488 - RNA, 17 nt, Human
gccucagagaccagggc

SEQ ID NO: 1345489 - RNA, 18 nt, Human
gccucagagaccagggcu

SEQ ID NO: 1345490 - RNA, 15 nt, Human
gccucagauuccuuc

SEQ ID NO: 1345491 - RNA, 22 nt, Human
gccucagauuccuucccaugga

SEQ ID NO: 1345492 - RNA, 16 nt, Human
gccucagauuccuucc

SEQ ID NO: 1345493 - RNA, 18 nt, Human
gccucagauuccuuccca

SEQ ID NO: 1345494 - RNA, 15 nt, Human
gccucccaaaugagc

SEQ ID NO: 1345495 - RNA, 23 nt, Human
gccucugaggccagccuggccuc

SEQ ID NO: 1345496 - RNA, 22 nt, Human
gccucugaggccagccuggccu

SEQ ID NO: 1345497 - RNA, 21 nt, Human
gccucugcacacccuccagag

SEQ ID NO: 1345498 - RNA, 23 nt, Human
gccucugccaaaggaugugauau

SEQ ID NO: 1345499 - RNA, 21 nt, Human
gccucugcccaggcacugcua

SEQ ID NO: 1345500 - RNA, 20 nt, Human
gccugacuagggagccaugu

SEQ ID NO: 1345501 - RNA, 19 nt, Human
gccugacuagggagccaug

SEQ ID NO: 1345502 - RNA, 14 nt, Human
gccugacugccaag

SEQ ID NO: 1345503 - RNA, 15 nt, Human
gccugacugccaagc

SEQ ID NO: 1345504 - RNA, 16 nt, Human
gccugacugccaagcc

SEQ ID NO: 1345505 - RNA, 17 nt, Human
gccugacugccaagcca

SEQ ID NO: 1345506 - RNA, 20 nt, Human
gccugacugccaagccaugg

SEQ ID NO: 1345507 - RNA, 13 nt, Human
gccugaguacucc

SEQ ID NO: 1345508 - RNA, 13 nt, Human
gccugagucaccu

SEQ ID NO: 1345509 - RNA, 16 nt, Human
gccugagguuacugga

SEQ ID NO: 1345510 - RNA, 18 nt, Human
gccugagggaaaggccag

SEQ ID NO: 1345511 - RNA, 20 nt, Human
gccugagggaaaggccagca

SEQ ID NO: 1345512 - RNA, 21 nt, Human
gccugaggucaggaguucaag

SEQ ID NO: 1345513 - RNA, 18 nt, Human
gccucugaggccagccug

SEQ ID NO: 1345514 - RNA, 19 nt, Human
gccucugaggccagccugg

SEQ ID NO: 1345515 - RNA, 20 nt, Human
gccucugaggccagccuggc

SEQ ID NO: 1345516 - RNA, 21 nt, Human
gccucugaggccagccuggcc

SEQ ID NO: 1345517 - RNA, 19 nt, Human
gccucugagaagcucugaa

SEQ ID NO: 1345518 - RNA, 13 nt, Human
gccucugagagca

SEQ ID NO: 1345519 - RNA, 14 nt, Human
gccucugagagcau

SEQ ID NO: 1345520 - RNA, 16 nt, Human
gccucugagagcauca

SEQ ID NO: 1345521 - RNA, 12 nt, Human
gccucugaggcc

SEQ ID NO: 1345522 - RNA, 13 nt, Human
gccucugaggcca

SEQ ID NO: 1345523 - RNA, 14 nt, Human
gccucugaggccag

SEQ ID NO: 1345524 - RNA, 15 nt, Human
gccucugaggccagc

SEQ ID NO: 1345525 - RNA, 16 nt, Human
gccucugaggccagcc

SEQ ID NO: 1345526 - RNA, 17 nt, Human
gccucugaggccagccu

SEQ ID NO: 1345527 - RNA, 20 nt, Human
gccucucuauccucucuucc

SEQ ID NO: 1345528 - RNA, 21 nt, Human
gccucucuauccucucuuccu

SEQ ID NO: 1345529 - RNA, 23 nt, Human
gccucucuauccucucuuccucu

SEQ ID NO: 1345530 - RNA, 21 nt, Human
gccucuccacucaugugacuc

SEQ ID NO: 1345531 - RNA, 24 nt, Human
gccucuccacucaugugacucuuu

SEQ ID NO: 1345532 - RNA, 18 nt, Human
gccuccguccccugccca

SEQ ID NO: 1345533 - RNA, 14 nt, Human
gccucucuacaguc

SEQ ID NO: 1345534 - RNA, 16 nt, Human
gccgugguccuuuggg

SEQ ID NO: 1345535 - RNA, 17 nt, Human
gccuaaccugccgagag

SEQ ID NO: 1345536 - RNA, 15 nt, Human
gccuaaccgagauca

SEQ ID NO: 1345537 - RNA, 13 nt, Human
gccuauggagagc

SEQ ID NO: 1345538 - RNA, 14 nt, Human
gccuauggagagcc

SEQ ID NO: 1345539 - RNA, 22 nt, Human
gccuaugugcaugcagcaucua

SEQ ID NO: 1345540 - RNA, 18 nt, Human
gccuauguggucuaaggu

SEQ ID NO: 1345541 - RNA, 16 nt, Human
gccuauggagagcccu

SEQ ID NO: 1345542 - RNA, 17 nt, Human
gccuauggagagcccug

SEQ ID NO: 1345543 - RNA, 18 nt, Human
gccuauggagagcccugg

SEQ ID NO: 1345544 - RNA, 19 nt, Human
gccuauggagagcccuggg

SEQ ID NO: 1345545 - RNA, 20 nt, Human
gccuauggagagcccuggga

SEQ ID NO: 1345546 - RNA, 21 nt, Human
gccuauggagagcccugggac

SEQ ID NO: 1345547 - RNA, 22 nt, Human
gccuauggagagcccugggacc

SEQ ID NO: 1345548 - RNA, 21 nt, Human
gccuauuaucugucagcugca

SEQ ID NO: 1345549 - RNA, 20 nt, Human
gccucaagguuuuagguucu

SEQ ID NO: 1345550 - RNA, 21 nt, Human
gccucaagguuuuagguucua

SEQ ID NO: 1345551 - RNA, 22 nt, Human
gccucaagguuuuagguucuaa

SEQ ID NO: 1345552 - RNA, 17 nt, Human
gccgugcucgccccagc

SEQ ID NO: 1345553 - RNA, 21 nt, Human
gccgugcucgccccagcaggu

SEQ ID NO: 1345554 - RNA, 19 nt, Human
gccguggcuucccgcucag

SEQ ID NO: 1345555 - RNA, 14 nt, Human
gccgugccuucagc

SEQ ID NO: 1345556 - RNA, 15 nt, Human
gccgugccuucagcu

SEQ ID NO: 1345557 - RNA, 17 nt, Human
gccgugccuucagcucu

SEQ ID NO: 1345558 - RNA, 19 nt, Human
gccgugccuucagcucuac

SEQ ID NO: 1345559 - RNA, 20 nt, Human
gccguggggccgccgccucu

SEQ ID NO: 1345560 - RNA, 23 nt, Human
gccguggggccgccgccucuuuc

SEQ ID NO: 1345561 - RNA, 21 nt, Human
gccguggcuucccgcucagcc

SEQ ID NO: 1345562 - RNA, 22 nt, Human
gccguggcuucccgcucagccc

SEQ ID NO: 1345563 - RNA, 20 nt, Human
gccgugcucgccccagcagg

SEQ ID NO: 1345564 - RNA, 23 nt, Human
gccgugggcaauugucugaaaag

SEQ ID NO: 1345565 - RNA, 17 nt, Human
gccgugggccccacccu

SEQ ID NO: 1345566 - RNA, 18 nt, Human
gccgugggccccacccuc

SEQ ID NO: 1345567 - RNA, 23 nt, Human
gccgugggccccacccucgggga

SEQ ID NO: 1345568 - RNA, 20 nt, Human
gccguccccuagagucccag

SEQ ID NO: 1345569 - RNA, 23 nt, Human
gccguccuaaccucgggccugcu

SEQ ID NO: 1345570 - RNA, 24 nt, Human
gccggucgcccuuugcugcauggc

SEQ ID NO: 1345571 - RNA, 21 nt, Human
gccggucgcccuuugcugcau

SEQ ID NO: 1345572 - RNA, 13 nt, Human
gccguaauuuaac

SEQ ID NO: 1345573 - RNA, 14 nt, Human
gccguaauuuaacu

SEQ ID NO: 1345574 - RNA, 17 nt, Human
gccgucagugcugugcu

SEQ ID NO: 1345575 - RNA, 16 nt, Human
gcccugcuuugggcug

SEQ ID NO: 1345576 - RNA, 18 nt, Human
gcccugcuuugggcugcc

SEQ ID NO: 1345577 - RNA, 18 nt, Human
gcccugcagacccugccc

SEQ ID NO: 1345578 - RNA, 19 nt, Human
gcccugcagacccugcccu

SEQ ID NO: 1345579 - RNA, 20 nt, Human
gcccugcagacccugcccuu

SEQ ID NO: 1345580 - RNA, 15 nt, Human
gcccugcuuccugcu

SEQ ID NO: 1345581 - RNA, 16 nt, Human
gcccugcuuccugcuu

SEQ ID NO: 1345582 - RNA, 19 nt, Human
gcccugcuuccugcuugcc

SEQ ID NO: 1345583 - RNA, 19 nt, Human
gcccugcuuugggcugccc

SEQ ID NO: 1345584 - RNA, 22 nt, Human
gcccugcuuccugcuugccaag

SEQ ID NO: 1345585 - RNA, 18 nt, Human
gcccuugcuuaccucuca

SEQ ID NO: 1345586 - RNA, 20 nt, Human
gcccuuggggguccuccucc

SEQ ID NO: 1345587 - RNA, 22 nt, Human
gcccuuggggguccuccuccag

SEQ ID NO: 1345588 - RNA, 21 nt, Human
gcccuuggggguccuccucca

SEQ ID NO: 1345589 - RNA, 23 nt, Human
gcccuugugaaucaagggucagg

SEQ ID NO: 1345590 - RNA, 17 nt, Human
gcccuuguuuggggcag

SEQ ID NO: 1345591 - RNA, 18 nt, Human
gcccuuguuuggggcagg

SEQ ID NO: 1345592 - RNA, 19 nt, Human
gcccuuguuuggggcagga

SEQ ID NO: 1345593 - RNA, 20 nt, Human
gcccuuguuuggggcaggag

SEQ ID NO: 1345594 - RNA, 21 nt, Human
gcccuuguuuggggcaggagu

SEQ ID NO: 1345595 - RNA, 22 nt, Human
gcccuuguuuggggcaggagua

SEQ ID NO: 1345596 - RNA, 14 nt, Human
gccgaagcuaacag

SEQ ID NO: 1345597 - RNA, 15 nt, Human
gccgaagcuaacagg

SEQ ID NO: 1345598 - RNA, 19 nt, Human
gccgaagcuaacagggaag

SEQ ID NO: 1345599 - RNA, 20 nt, Human
gccgacccccucucccugca

SEQ ID NO: 1345600 - RNA, 23 nt, Human
gccgacccccucucccugcaugg

SEQ ID NO: 1345601 - RNA, 22 nt, Human
gccgggaccacccugagccggc

SEQ ID NO: 1345602 - RNA, 20 nt, Human
gccgggcgugguggugagug

SEQ ID NO: 1345603 - RNA, 16 nt, Human
gccggggaacuggcca

SEQ ID NO: 1345604 - RNA, 17 nt, Human
gccggggaacuggccaa

SEQ ID NO: 1345605 - RNA, 20 nt, Human
gccggggaacuggccaagcu

SEQ ID NO: 1345606 - RNA, 22 nt, Human
gccggggaacuggccaagcuga

SEQ ID NO: 1345607 - RNA, 18 nt, Human
gccgggaccacccugagc

SEQ ID NO: 1345608 - RNA, 20 nt, Human
gccgggaccacccugagccg

SEQ ID NO: 1345609 - RNA, 13 nt, Human
gccggcuccuugg

SEQ ID NO: 1345610 - RNA, 19 nt, Human
gccggcuucaugccagcua

SEQ ID NO: 1345611 - RNA, 24 nt, Human
gccgacccccucucccugcauggc

SEQ ID NO: 1345612 - RNA, 15 nt, Human
gccaugcagaaagca

SEQ ID NO: 1345613 - RNA, 18 nt, Human
gccaugaugccucugucu

SEQ ID NO: 1345614 - RNA, 20 nt, Human
gccaugcgcccccuccgccc

SEQ ID NO: 1345615 - RNA, 19 nt, Human
gccaugacaacuucuaauu

SEQ ID NO: 1345616 - RNA, 23 nt, Human
gccaugacaacuucuaauugcca

SEQ ID NO: 1345617 - RNA, 14 nt, Human
gccaugacccugcc

SEQ ID NO: 1345618 - RNA, 21 nt, Human
gccaugacccugccucuccca

SEQ ID NO: 1345619 - RNA, 16 nt, Human
gccaugacccugccuc

SEQ ID NO: 1345620 - RNA, 17 nt, Human
gccaugacccugccucu

SEQ ID NO: 1345621 - RNA, 18 nt, Human
gccaugacccugccucuc

SEQ ID NO: 1345622 - RNA, 20 nt, Human
gccaugaguuccagaaagua

SEQ ID NO: 1345623 - RNA, 13 nt, Human
gccaugaugccuc

SEQ ID NO: 1345624 - RNA, 15 nt, Human
gccaugaugccucug

SEQ ID NO: 1345625 - RNA, 19 nt, Human
gccaugaugccucugucuu

SEQ ID NO: 1345626 - RNA, 17 nt, Human
gccaugauggcaacaga

SEQ ID NO: 1345627 - RNA, 19 nt, Human
gccaugauggcaacagauc

SEQ ID NO: 1345628 - RNA, 21 nt, Human
gccaugauggcaacagaucug

SEQ ID NO: 1345629 - RNA, 23 nt, Human
gccaugauggcaacagaucugga

SEQ ID NO: 1345630 - RNA, 16 nt, Human
gccaucugcuccugga

SEQ ID NO: 1345631 - RNA, 21 nt, Human
gccaucugggcuccuccaggg

SEQ ID NO: 1345632 - RNA, 17 nt, Human
gccaggcugggucgccc

SEQ ID NO: 1345633 - RNA, 15 nt, Human
gccaggcugaccaca

SEQ ID NO: 1345634 - RNA, 16 nt, Human
gccaggcugaccacag

SEQ ID NO: 1345635 - RNA, 17 nt, Human
gccaggcugaccacagc

SEQ ID NO: 1345636 - RNA, 23 nt, Human
gccaggcugggucgcccuggacu

SEQ ID NO: 1345637 - RNA, 18 nt, Human
gccaggcugaccacagca

SEQ ID NO: 1345638 - RNA, 19 nt, Human
gccaggcugaccacagcac

SEQ ID NO: 1345639 - RNA, 20 nt, Human
gccaggcugaccacagcaca

SEQ ID NO: 1345640 - RNA, 17 nt, Human
gccaggcuggucuaaaa

SEQ ID NO: 1345641 - RNA, 15 nt, Human
gccaguaacaggcuc

SEQ ID NO: 1345642 - RNA, 19 nt, Human
gccaguaacgcgucuuccu

SEQ ID NO: 1345643 - RNA, 12 nt, Human
gccagucaggcc

SEQ ID NO: 1345644 - RNA, 22 nt, Human
gccaggcugaccacagcacagc

SEQ ID NO: 1345645 - RNA, 14 nt, Human
gccaucaccucaga

SEQ ID NO: 1345646 - RNA, 15 nt, Human
gccaucaccucagau

SEQ ID NO: 1345647 - RNA, 19 nt, Human
gccaucaccucagauggca

SEQ ID NO: 1345648 - RNA, 23 nt, Human
gccaucaccucagauggcagcuu

SEQ ID NO: 1345649 - RNA, 14 nt, Human
gccaucaccuuaga

SEQ ID NO: 1345650 - RNA, 20 nt, Human
gccaucaccuuagaccacca

SEQ ID NO: 1345651 - RNA, 22 nt, Human
gccaucaccuuagaccaccaag

SEQ ID NO: 1345652 - RNA, 23 nt, Human
gccaucaucuccugccuuccucc

SEQ ID NO: 1345653 - RNA, 19 nt, Human
gccaguaauccuguaggaa

SEQ ID NO: 1345654 - RNA, 14 nt, Human
gccaguaauccugu

SEQ ID NO: 1345655 - RNA, 12 nt, Human
gccaguauuuua

SEQ ID NO: 1345656 - RNA, 20 nt, Human
gccaguaacgcgucuuccug

SEQ ID NO: 1345657 - RNA, 21 nt, Human
gccaguaacgcgucuuccuga

SEQ ID NO: 1345658 - RNA, 22 nt, Human
gccaguaacgcgucuuccugag

SEQ ID NO: 1345659 - RNA, 16 nt, Human
gccaguaacaggcuca

SEQ ID NO: 1345660 - RNA, 14 nt, Human
gccaguauuuuaaa

SEQ ID NO: 1345661 - RNA, 13 nt, Human
gccaguccaggcu

SEQ ID NO: 1345662 - RNA, 14 nt, Human
gccaguccaggcug

SEQ ID NO: 1345663 - RNA, 20 nt, Human
gccaguccaggcugccgugg

SEQ ID NO: 1345664 - RNA, 21 nt, Human
gccaguccaggcugccguggg

SEQ ID NO: 1345665 - RNA, 24 nt, Human
gcccaaccugcucuccucuugcca

SEQ ID NO: 1345666 - RNA, 16 nt, Human
gccaugcuccucuucc

SEQ ID NO: 1345667 - RNA, 18 nt, Human
gccaugcuccucuucccc

SEQ ID NO: 1345668 - RNA, 20 nt, Human
gccaugcuccucuuccccag

SEQ ID NO: 1345669 - RNA, 21 nt, Human
gccaugcuccucuuccccaga

SEQ ID NO: 1345670 - RNA, 17 nt, Human
gccauggguagccuggg

SEQ ID NO: 1345671 - RNA, 19 nt, Human
gccauggguagccugggug

SEQ ID NO: 1345672 - RNA, 20 nt, Human
gccauggguagccugggugu

SEQ ID NO: 1345673 - RNA, 21 nt, Human
gcccaagaauagaugcugacu

SEQ ID NO: 1345674 - RNA, 22 nt, Human
gcccaagaauagaugcugacug

SEQ ID NO: 1345675 - RNA, 20 nt, Human
gcccacauagugaugguucc

SEQ ID NO: 1345676 - RNA, 16 nt, Human
gcccacagugucaggc

SEQ ID NO: 1345677 - RNA, 15 nt, Human
gcccacauuggaaga

SEQ ID NO: 1345678 - RNA, 21 nt, Human
gcccaccauuuggcaucccug

SEQ ID NO: 1345679 - RNA, 15 nt, Human
gcccaagccagaggc

SEQ ID NO: 1345680 - RNA, 16 nt, Human
gcccaagccagaggcu

SEQ ID NO: 1345681 - RNA, 17 nt, Human
gcccaagccagaggcug

SEQ ID NO: 1345682 - RNA, 18 nt, Human
gcccaagccagaggcugg

SEQ ID NO: 1345683 - RNA, 21 nt, Human
gcccaagccagaggcuggguu

SEQ ID NO: 1345684 - RNA, 23 nt, Human
gcccaagccagaggcuggguuca

SEQ ID NO: 1345685 - RNA, 15 nt, Human
gcccaaggcucccgg

SEQ ID NO: 1345686 - RNA, 14 nt, Human
gcccaaggcucccg

SEQ ID NO: 1345687 - RNA, 16 nt, Human
gcccaccccacccacu

SEQ ID NO: 1345688 - RNA, 21 nt, Human
gcccaccccacccacuucugc

SEQ ID NO: 1345689 - RNA, 22 nt, Human
gcccaccccacccacuucugca

SEQ ID NO: 1345690 - RNA, 20 nt, Human
gcccagaauaaguuauugca

SEQ ID NO: 1345691 - RNA, 23 nt, Human
gcccagaauaaguuauugcaguu

SEQ ID NO: 1345692 - RNA, 16 nt, Human
gcccagaauaaguuau

SEQ ID NO: 1345693 - RNA, 21 nt, Human
gccacuccagaccccuggcuu

SEQ ID NO: 1345694 - RNA, 20 nt, Human
gccacuccagaccccuggcu

SEQ ID NO: 1345695 - RNA, 21 nt, Human
gccaacacgcaccugccucag

SEQ ID NO: 1345696 - RNA, 23 nt, Human
gccaacacgcaccugccucagga

SEQ ID NO: 1345697 - RNA, 21 nt, Human
gccaaauuuaaaacuguugga

SEQ ID NO: 1345698 - RNA, 17 nt, Human
gccaacacgcaccugcc

SEQ ID NO: 1345699 - RNA, 20 nt, Human
gccaacacgcaccugccuca

SEQ ID NO: 1345700 - RNA, 22 nt, Human
gccacuccagaccccuggcuuu

SEQ ID NO: 1345701 - RNA, 21 nt, Human
gccacuccgagaggugggcca

SEQ ID NO: 1345702 - RNA, 13 nt, Human
gccacuccucuga

SEQ ID NO: 1345703 - RNA, 14 nt, Human
gccacuccucugac

SEQ ID NO: 1345704 - RNA, 15 nt, Human
gccacuccucugacu

SEQ ID NO: 1345705 - RNA, 17 nt, Human
gccacuccucugacuca

SEQ ID NO: 1345706 - RNA, 21 nt, Human
gccacuccucugacucagggc

SEQ ID NO: 1345707 - RNA, 12 nt, Human
gccagaggcugg

SEQ ID NO: 1345708 - RNA, 13 nt, Human
gccagaggcuggg

SEQ ID NO: 1345709 - RNA, 15 nt, Human
gccagauccagccug

SEQ ID NO: 1345710 - RNA, 16 nt, Human
gccagauccagccugg

SEQ ID NO: 1345711 - RNA, 17 nt, Human
gccagauccagccuggg

SEQ ID NO: 1345712 - RNA, 20 nt, Human
gccagauccagccugggguc

SEQ ID NO: 1345713 - RNA, 21 nt, Human
gccagaugcacaucccuggaa

SEQ ID NO: 1345714 - RNA, 22 nt, Human
gccagaugcacaucccuggaag

SEQ ID NO: 1345715 - RNA, 13 nt, Human
gccagagauccaa

SEQ ID NO: 1345716 - RNA, 16 nt, Human
gccagagauccaaaag

SEQ ID NO: 1345717 - RNA, 20 nt, Human
gccagagauccaaaagaagc

SEQ ID NO: 1345718 - RNA, 21 nt, Human
gccagagauccaaaagaagcc

SEQ ID NO: 1345719 - RNA, 22 nt, Human
gccagagauccaaaagaagccc

SEQ ID NO: 1345720 - RNA, 14 nt, Human
gccagaggccccca

SEQ ID NO: 1345721 - RNA, 15 nt, Human
gccagaggcccccag

SEQ ID NO: 1345722 - RNA, 16 nt, Human
gccagaggcccccagc

SEQ ID NO: 1345723 - RNA, 18 nt, Human
gccagaggcccccagccc

SEQ ID NO: 1345724 - RNA, 19 nt, Human
gccagaggcccccagccca

SEQ ID NO: 1345725 - RNA, 20 nt, Human
gccagaggcccccagcccag

SEQ ID NO: 1345726 - RNA, 23 nt, Human
gccagaggcccccagcccagggc

SEQ ID NO: 1345727 - RNA, 24 nt, Human
gccagaggcccccagcccagggcu

SEQ ID NO: 1345728 - RNA, 22 nt, Human
gccagaggcucguugacuggcu

SEQ ID NO: 1345729 - RNA, 21 nt, Human
gccagccgagcaggaggccua

SEQ ID NO: 1345730 - RNA, 24 nt, Human
gccagccgagcaggaggccuagga

SEQ ID NO: 1345731 - RNA, 19 nt, Human
gccagccgcgcaucagacu

SEQ ID NO: 1345732 - RNA, 20 nt, Human
gccagccgcgcaucagacug

SEQ ID NO: 1345733 - RNA, 23 nt, Human
gccagccggggcgaguggcacgu

SEQ ID NO: 1345734 - RNA, 12 nt, Human
gccagcugcccc

SEQ ID NO: 1345735 - RNA, 19 nt, Human
gccagcugcccccagagcc

SEQ ID NO: 1345736 - RNA, 14 nt, Human
gccagccucgccca

SEQ ID NO: 1345737 - RNA, 12 nt, Human
gccagccuggcc

SEQ ID NO: 1345738 - RNA, 13 nt, Human
gccagccuggccu

SEQ ID NO: 1345739 - RNA, 14 nt, Human
gccagccuggccuc

SEQ ID NO: 1345740 - RNA, 15 nt, Human
gccagccuggccucc

SEQ ID NO: 1345741 - RNA, 16 nt, Human
gccagccuggccuccu

SEQ ID NO: 1345742 - RNA, 17 nt, Human
gccagccuggccuccug

SEQ ID NO: 1345743 - RNA, 19 nt, Human
gccagccuggccuccugcc

SEQ ID NO: 1345744 - RNA, 20 nt, Human
gccagccuggccuccugccu

SEQ ID NO: 1345745 - RNA, 23 nt, Human
gccagccuggccuccugccucua

SEQ ID NO: 1345746 - RNA, 22 nt, Human
gccagccuggccuccugccucu

SEQ ID NO: 1345747 - RNA, 23 nt, Human
gccagcucuguaucaggacccag

SEQ ID NO: 1345748 - RNA, 12 nt, Human
gccagcucuguu

SEQ ID NO: 1345749 - RNA, 13 nt, Human
gccagcucuguuc

SEQ ID NO: 1345750 - RNA, 18 nt, Human
gccagcucuguucuuccu

SEQ ID NO: 1345751 - RNA, 21 nt, Human
gccagcucuguucuuccucag

SEQ ID NO: 1345752 - RNA, 22 nt, Human
gccagcucuguucuuccucagc

SEQ ID NO: 1345753 - RNA, 23 nt, Human
gccagcucuguucuuccucagcc

SEQ ID NO: 1345754 - RNA, 14 nt, Human
gccagcugcacuga

SEQ ID NO: 1345755 - RNA, 20 nt, Human
gccagcugcacugaugcugc

SEQ ID NO: 1345756 - RNA, 22 nt, Human
gccaggaagcuuuggugagaac

SEQ ID NO: 1345757 - RNA, 17 nt, Human
gccaggaauuucccagg

SEQ ID NO: 1345758 - RNA, 18 nt, Human
gccaggaauuucccagga

SEQ ID NO: 1345759 - RNA, 19 nt, Human
gccaggaauuucccaggac

SEQ ID NO: 1345760 - RNA, 20 nt, Human
gccaggaauuucccaggacc

SEQ ID NO: 1345761 - RNA, 21 nt, Human
gccaggaauuucccaggaccc

SEQ ID NO: 1345762 - RNA, 22 nt, Human
gccaggaauuucccaggacccu

SEQ ID NO: 1345763 - RNA, 23 nt, Human
gccaggaauuucccaggacccug

SEQ ID NO: 1345764 - RNA, 22 nt, Human
gccaggaccagucaaccugggc

SEQ ID NO: 1345765 - RNA, 23 nt, Human
gccaggaccagucccagagcagg

SEQ ID NO: 1345766 - RNA, 13 nt, Human
gccaggacucugc

SEQ ID NO: 1345767 - RNA, 14 nt, Human
gccaggacucugca

SEQ ID NO: 1345768 - RNA, 15 nt, Human
gccaggacucugcag

SEQ ID NO: 1345769 - RNA, 16 nt, Human
gccaggacucugcagc

SEQ ID NO: 1345770 - RNA, 17 nt, Human
gccaggacucugcagcc

SEQ ID NO: 1345771 - RNA, 18 nt, Human
gccaggacucugcagccu

SEQ ID NO: 1345772 - RNA, 19 nt, Human
gccaggacucugcagccuc

SEQ ID NO: 1345773 - RNA, 20 nt, Human
gccaggacucugcagccuca

SEQ ID NO: 1345774 - RNA, 21 nt, Human
gccaggacucugcagccucag

SEQ ID NO: 1345775 - RNA, 12 nt, Human
gccaggagaagc

SEQ ID NO: 1345776 - RNA, 13 nt, Human
gccaggagaagcu

SEQ ID NO: 1345777 - RNA, 14 nt, Human
gccaggagaagcuc

SEQ ID NO: 1345778 - RNA, 15 nt, Human
gccaggagaagcuca

SEQ ID NO: 1345779 - RNA, 17 nt, Human
gccaggagaagcucagc

SEQ ID NO: 1345780 - RNA, 19 nt, Human
gccaggagaagcucagcug

SEQ ID NO: 1345781 - RNA, 22 nt, Human
gccaggagaagcucagcugcau

SEQ ID NO: 1345782 - RNA, 18 nt, Human
gccaggagcacggcucug

SEQ ID NO: 1345783 - RNA, 19 nt, Human
gccaggagcacggcucugu

SEQ ID NO: 1345784 - RNA, 21 nt, Human
gccaggagcacggcucugucc

SEQ ID NO: 1345785 - RNA, 15 nt, Human
gccaggcuaauuuuu

SEQ ID NO: 1345786 - RNA, 13 nt, Human
gccaggcucucuu

SEQ ID NO: 1345787 - RNA, 20 nt, Human
gccccuggucccucugcagu

SEQ ID NO: 1345788 - RNA, 21 nt, Human
gccccugggguggccaccagu

SEQ ID NO: 1345789 - RNA, 14 nt, Human
gccccuucugcuca

SEQ ID NO: 1345790 - RNA, 15 nt, Human
gccccuucugcucag

SEQ ID NO: 1345791 - RNA, 17 nt, Human
gccccuucugcucagcu

SEQ ID NO: 1345792 - RNA, 18 nt, Human
gccccuucugcucagcuc

SEQ ID NO: 1345793 - RNA, 15 nt, Human
gccccugggguggcc

SEQ ID NO: 1345794 - RNA, 20 nt, Human
gccccucuggucgcuccugc

SEQ ID NO: 1345795 - RNA, 22 nt, Human
gccccucuggucgcuccugccc

SEQ ID NO: 1345796 - RNA, 17 nt, Human
gccccucuuggagaagu

SEQ ID NO: 1345797 - RNA, 22 nt, Human
gccccucuuggagaagucucag

SEQ ID NO: 1345798 - RNA, 23 nt, Human
gccccucuuggagaagucucagc

SEQ ID NO: 1345799 - RNA, 16 nt, Human
gccccugaacaagaau

SEQ ID NO: 1345800 - RNA, 12 nt, Human
gcccgacagccu

SEQ ID NO: 1345801 - RNA, 14 nt, Human
gcccgacagccugg

SEQ ID NO: 1345802 - RNA, 15 nt, Human
gcccgacagccuggc

SEQ ID NO: 1345803 - RNA, 19 nt, Human
gcccgaggaggugucucag

SEQ ID NO: 1345804 - RNA, 20 nt, Human
gcccgaggaggugucucagg

SEQ ID NO: 1345805 - RNA, 21 nt, Human
gcccgaggaggugucucaggc

SEQ ID NO: 1345806 - RNA, 22 nt, Human
gcccgaggaggugucucaggcu

SEQ ID NO: 1345807 - RNA, 23 nt, Human
gcccgaggaggugucucaggcug

SEQ ID NO: 1345808 - RNA, 13 nt, Human
gcccgcacaccug

SEQ ID NO: 1345809 - RNA, 19 nt, Human
gccccuucugcucagcucu

SEQ ID NO: 1345810 - RNA, 20 nt, Human
gccccuucugcucagcucug

SEQ ID NO: 1345811 - RNA, 23 nt, Human
gccccuucugcucagcucugggc

SEQ ID NO: 1345812 - RNA, 19 nt, Human
gccccuugacaacuggcag

SEQ ID NO: 1345813 - RNA, 15 nt, Human
gccccuuggacacgc

SEQ ID NO: 1345814 - RNA, 12 nt, Human
gccccuuuauaa

SEQ ID NO: 1345815 - RNA, 13 nt, Human
gccccuuuauaaa

SEQ ID NO: 1345816 - RNA, 21 nt, Human
gccccuuucccuuguagcucc

SEQ ID NO: 1345817 - RNA, 23 nt, Human
gccccuuucccuuguagcuccuc

SEQ ID NO: 1345818 - RNA, 16 nt, Human
gccccuuugcugaccc

SEQ ID NO: 1345819 - RNA, 17 nt, Human
gccccuuugcugacccu

SEQ ID NO: 1345820 - RNA, 20 nt, Human
gccccuuugcugacccuccc

SEQ ID NO: 1345821 - RNA, 18 nt, Human
gccccuuugcugacccuc

SEQ ID NO: 1345822 - RNA, 16 nt, Human
gccccucccccugcca

SEQ ID NO: 1345823 - RNA, 17 nt, Human
gccccuccccuccaaaa

SEQ ID NO: 1345824 - RNA, 16 nt, Human
gccccuccccuccaaa

SEQ ID NO: 1345825 - RNA, 16 nt, Human
gccccucccucccaga

SEQ ID NO: 1345826 - RNA, 18 nt, Human
gccccucccucccagagc

SEQ ID NO: 1345827 - RNA, 20 nt, Human
gccccucccucccagagcac

SEQ ID NO: 1345828 - RNA, 14 nt, Human
gccccucuggucgc

SEQ ID NO: 1345829 - RNA, 18 nt, Human
gccccucuggucgcuccu

SEQ ID NO: 1345830 - RNA, 19 nt, Human
gccccucuggucgcuccug

SEQ ID NO: 1345831 - RNA, 17 nt, Human
gcccccugucucucagg

SEQ ID NO: 1345832 - RNA, 18 nt, Human
gccccucacccugccuua

SEQ ID NO: 1345833 - RNA, 18 nt, Human
gcccucccuguuccccag

SEQ ID NO: 1345834 - RNA, 20 nt, Human
gcccucccuguuccccagag

SEQ ID NO: 1345835 - RNA, 22 nt, Human
gcccucccuguuccccagagaa

SEQ ID NO: 1345836 - RNA, 21 nt, Human
gcccucccuguuccccagaga

SEQ ID NO: 1345837 - RNA, 12 nt, Human
gcccugagccag

SEQ ID NO: 1345838 - RNA, 19 nt, Human
gcccugagccagggucucc

SEQ ID NO: 1345839 - RNA, 21 nt, Human
gcccugagccagggucuccag

SEQ ID NO: 1345840 - RNA, 22 nt, Human
gcccugagccagggucuccaga

SEQ ID NO: 1345841 - RNA, 23 nt, Human
gcccugagccagggucuccagaa

SEQ ID NO: 1345842 - RNA, 17 nt, Human
gcccugcagacccugcc

SEQ ID NO: 1345843 - RNA, 13 nt, Human
gcccuccacaccu

SEQ ID NO: 1345844 - RNA, 14 nt, Human
gcccuccacaccug

SEQ ID NO: 1345845 - RNA, 15 nt, Human
gcccuccacaccugc

SEQ ID NO: 1345846 - RNA, 16 nt, Human
gcccuccacaccugcg

SEQ ID NO: 1345847 - RNA, 19 nt, Human
gcccuccacaccugcggcc

SEQ ID NO: 1345848 - RNA, 18 nt, Human
gcccuccacaccugcggc

SEQ ID NO: 1345849 - RNA, 20 nt, Human
gcccuccaucuaaacugccc

SEQ ID NO: 1345850 - RNA, 21 nt, Human
gcccuccaucuaaacugcccc

SEQ ID NO: 1345851 - RNA, 14 nt, Human
gcccuccaggcuuu

SEQ ID NO: 1345852 - RNA, 19 nt, Human
gcccucauggccccucuga

SEQ ID NO: 1345853 - RNA, 22 nt, Human
gcccucauggccccucugaccu

SEQ ID NO: 1345854 - RNA, 15 nt, Human
gcccgggagcucagg

SEQ ID NO: 1345855 - RNA, 15 nt, Human
gcccggcuccugguc

SEQ ID NO: 1345856 - RNA, 17 nt, Human
gcccgggagcucaggaa

SEQ ID NO: 1345857 - RNA, 19 nt, Human
gcccgggagcucaggaacc

SEQ ID NO: 1345858 - RNA, 20 nt, Human
gcccaggcuggagugcaaug

SEQ ID NO: 1345859 - RNA, 13 nt, Human
gcccagagcccag

SEQ ID NO: 1345860 - RNA, 12 nt, Human
gcccaggccuca

SEQ ID NO: 1345861 - RNA, 14 nt, Human
gcccaggccucacc

SEQ ID NO: 1345862 - RNA, 19 nt, Human
gcccaggcuggagugcagu

SEQ ID NO: 1345863 - RNA, 20 nt, Human
gcccaggcuggagugcagug

SEQ ID NO: 1345864 - RNA, 12 nt, Human
gcccagggaggc

SEQ ID NO: 1345865 - RNA, 13 nt, Human
gcccagggaggcc

SEQ ID NO: 1345866 - RNA, 21 nt, Human
gcccagggaggccgaagcuaa

SEQ ID NO: 1345867 - RNA, 14 nt, Human
gcccagggcccaga

SEQ ID NO: 1345868 - RNA, 12 nt, Human
gcccagggcucc

SEQ ID NO: 1345869 - RNA, 14 nt, Human
gcccagggcuccug

SEQ ID NO: 1345870 - RNA, 15 nt, Human
gcccagggcuccugc

SEQ ID NO: 1345871 - RNA, 16 nt, Human
gcccagggcuccugca

SEQ ID NO: 1345872 - RNA, 18 nt, Human
gcccagggcuccugcacu

SEQ ID NO: 1345873 - RNA, 15 nt, Human
gcccagggcugggag

SEQ ID NO: 1345874 - RNA, 14 nt, Human
gccccacuuguccu

SEQ ID NO: 1345875 - RNA, 16 nt, Human
gccccacuuguccuua

SEQ ID NO: 1345876 - RNA, 18 nt, Human
gccccacuuguccuuagc

SEQ ID NO: 1345877 - RNA, 17 nt, Human
gccccacuuguccuuag

SEQ ID NO: 1345878 - RNA, 22 nt, Human
gccccacccugggcccugggcu

SEQ ID NO: 1345879 - RNA, 23 nt, Human
gccccacccugggcccugggcug

SEQ ID NO: 1345880 - RNA, 24 nt, Human
gccccacccugggcccugggcugg

SEQ ID NO: 1345881 - RNA, 12 nt, Human
gccccacuccuc

SEQ ID NO: 1345882 - RNA, 20 nt, Human
gccccacuccucugcugacc

SEQ ID NO: 1345883 - RNA, 13 nt, Human
gccccacuccucu

SEQ ID NO: 1345884 - RNA, 17 nt, Human
gcccagggcugggagga

SEQ ID NO: 1345885 - RNA, 20 nt, Human
gcccagggcugggaggaagg

SEQ ID NO: 1345886 - RNA, 21 nt, Human
gcccagggcugggaggaagga

SEQ ID NO: 1345887 - RNA, 20 nt, Human
gcccauaugcuaccaccagc

SEQ ID NO: 1345888 - RNA, 21 nt, Human
gcccauaugcuaccaccagcu

SEQ ID NO: 1345889 - RNA, 23 nt, Human
gcccauaugcuaccaccagcugu

SEQ ID NO: 1345890 - RNA, 22 nt, Human
gcccauaugcuaccaccagcug

SEQ ID NO: 1345891 - RNA, 21 nt, Human
gcccaucaggguaggcuggag

SEQ ID NO: 1345892 - RNA, 12 nt, Human
gcccaucagggu

SEQ ID NO: 1345893 - RNA, 15 nt, Human
gccccacccugggcc

SEQ ID NO: 1345894 - RNA, 16 nt, Human
gccccacccugggccc

SEQ ID NO: 1345895 - RNA, 19 nt, Human
gccccacccugggcccugg

SEQ ID NO: 1345896 - RNA, 20 nt, Human
gccccacccugggcccuggg

SEQ ID NO: 1345897 - RNA, 14 nt, Human
gccccaucagugcu

SEQ ID NO: 1345898 - RNA, 19 nt, Human
gccccaguuguauuuauuu

SEQ ID NO: 1345899 - RNA, 21 nt, Human
gccccauaauuuuuuuuuucc

SEQ ID NO: 1345900 - RNA, 22 nt, Human
gccccaguuccuguggcucccu

SEQ ID NO: 1345901 - RNA, 14 nt, Human
gccccagugacagc

SEQ ID NO: 1345902 - RNA, 18 nt, Human
gccccaggggaacacugg

SEQ ID NO: 1345903 - RNA, 15 nt, Human
gccccaggccugaaa

SEQ ID NO: 1345904 - RNA, 19 nt, Human
gccccaggcucguggacug

SEQ ID NO: 1345905 - RNA, 19 nt, Human
gccccaggggaacacuggg

SEQ ID NO: 1345906 - RNA, 13 nt, Human
gccccagcacagc

SEQ ID NO: 1345907 - RNA, 20 nt, Human
gccccagcacagcuugaccu

SEQ ID NO: 1345908 - RNA, 12 nt, Human
gccccaggccug

SEQ ID NO: 1345909 - RNA, 12 nt, Human
gccccauuccug

SEQ ID NO: 1345910 - RNA, 15 nt, Human
gccccauuccuggga

SEQ ID NO: 1345911 - RNA, 21 nt, Human
gcccccaaccauuuccucaga

SEQ ID NO: 1345912 - RNA, 22 nt, Human
gcccccaaccauuuccucagac

SEQ ID NO: 1345913 - RNA, 14 nt, Human
gcccccaccccauu

SEQ ID NO: 1345914 - RNA, 11 nt, Human
gcccccacccu

SEQ ID NO: 1345915 - RNA, 12 nt, Human
gcccccacccug

SEQ ID NO: 1345916 - RNA, 14 nt, Human
gcccccugcccccc

SEQ ID NO: 1345917 - RNA, 18 nt, Human
gcccccugccccccagcc

SEQ ID NO: 1345918 - RNA, 14 nt, Human
gcccccacccuguu

SEQ ID NO: 1345919 - RNA, 15 nt, Human
gcccccugcugccau

SEQ ID NO: 1345920 - RNA, 14 nt, Human
gcccccugucucuc

SEQ ID NO: 1345921 - RNA, 16 nt, Human
gcccccugucucucag

SEQ ID NO: 1345922 - RNA, 19 nt, Human
gcauucaaauguauuacag

SEQ ID NO: 1345923 - RNA, 21 nt, Human
gcauuauuugagaagcugcuc

SEQ ID NO: 1345924 - RNA, 15 nt, Human
gcauuauuugagaag

SEQ ID NO: 1345925 - RNA, 18 nt, Human
gcauucagaagaaaaaga

SEQ ID NO: 1345926 - RNA, 16 nt, Human
gcauucagaagaaaaa

SEQ ID NO: 1345927 - RNA, 20 nt, Human
gcauucugccucucuaggac

SEQ ID NO: 1345928 - RNA, 16 nt, Human
gcauucuggaccucug

SEQ ID NO: 1345929 - RNA, 19 nt, Human
gcauucuggaccucugggu

SEQ ID NO: 1345930 - RNA, 13 nt, Human
gcauuauuuucca

SEQ ID NO: 1345931 - RNA, 14 nt, Human
gcauucuucucugu

SEQ ID NO: 1345932 - RNA, 13 nt, Human
gcauucuucucug

SEQ ID NO: 1345933 - RNA, 11 nt, Human
gcauuauuuga

SEQ ID NO: 1345934 - RNA, 23 nt, Human
gcauuauuggaauauaauuguuu

SEQ ID NO: 1345935 - RNA, 22 nt, Human
gcauuauuggaauauaauuguu

SEQ ID NO: 1345936 - RNA, 16 nt, Human
gcauuuguguugaaga

SEQ ID NO: 1345937 - RNA, 18 nt, Human
gcauuuguugguuuauca

SEQ ID NO: 1345938 - RNA, 18 nt, Human
gcauuuguuuauguaauu

SEQ ID NO: 1345939 - RNA, 19 nt, Human
gcauuuguuuauguaauuu

SEQ ID NO: 1345940 - RNA, 20 nt, Human
gcauuuguuuauguaauuuc

SEQ ID NO: 1345941 - RNA, 16 nt, Human
gcauugaaaagagcug

SEQ ID NO: 1345942 - RNA, 12 nt, Human
gcauugaacaca

SEQ ID NO: 1345943 - RNA, 16 nt, Human
gcauugaacacaaacu

SEQ ID NO: 1345944 - RNA, 18 nt, Human
gcauugaacacaaacugu

SEQ ID NO: 1345945 - RNA, 19 nt, Human
gcauugaacacaaacugua

SEQ ID NO: 1345946 - RNA, 22 nt, Human
gcauuuguuucuuucucugagg

SEQ ID NO: 1345947 - RNA, 16 nt, Human
gccaaaaaaaaauaca

SEQ ID NO: 1345948 - RNA, 17 nt, Human
gccaaaaagugaaauaa

SEQ ID NO: 1345949 - RNA, 13 nt, Human
gccaaaaauagcu

SEQ ID NO: 1345950 - RNA, 22 nt, Human
gccaaaaagugaaauaaugugu

SEQ ID NO: 1345951 - RNA, 17 nt, Human
gccaaaccucaccaacu

SEQ ID NO: 1345952 - RNA, 16 nt, Human
gcaucugaaaauugau

SEQ ID NO: 1345953 - RNA, 13 nt, Human
gcaucuguuuauu

SEQ ID NO: 1345954 - RNA, 23 nt, Human
gcaucacuuaacggaccaaagca

SEQ ID NO: 1345955 - RNA, 13 nt, Human
gcaucagaaagag

SEQ ID NO: 1345956 - RNA, 17 nt, Human
gcaucagaaagaggcag

SEQ ID NO: 1345957 - RNA, 16 nt, Human
gcaucagaaagggagg

SEQ ID NO: 1345958 - RNA, 18 nt, Human
gcaucagaaagggagggc

SEQ ID NO: 1345959 - RNA, 22 nt, Human
gcaucagacugugaaccccacg

SEQ ID NO: 1345960 - RNA, 19 nt, Human
gcaucagaaagggagggcu

SEQ ID NO: 1345961 - RNA, 21 nt, Human
gcaucagaaagggagggcucu

SEQ ID NO: 1345962 - RNA, 23 nt, Human
gcaucagaaagggagggcucuga

SEQ ID NO: 1345963 - RNA, 22 nt, Human
gcaucagaaagggagggcucug

SEQ ID NO: 1345964 - RNA, 12 nt, Human
gcaucuuuugua

SEQ ID NO: 1345965 - RNA, 16 nt, Human
gcaucuuuuguauuaa

SEQ ID NO: 1345966 - RNA, 23 nt, Human
gcaucuuuuguauuaagaaagga

SEQ ID NO: 1345967 - RNA, 19 nt, Human
gcaucuuuuguauuaagaa

SEQ ID NO: 1345968 - RNA, 22 nt, Human
gcaucuuggggggguggccgcu

SEQ ID NO: 1345969 - RNA, 13 nt, Human
gcauuauauuuau

SEQ ID NO: 1345970 - RNA, 20 nt, Human
gcauggcaaggacugcaggg

SEQ ID NO: 1345971 - RNA, 15 nt, Human
gcauggauuucuuug

SEQ ID NO: 1345972 - RNA, 16 nt, Human
gcauggauuucuuuga

SEQ ID NO: 1345973 - RNA, 18 nt, Human
gcauggauuucuuugaaa

SEQ ID NO: 1345974 - RNA, 20 nt, Human
gcauggauauaguuuuacuu

SEQ ID NO: 1345975 - RNA, 17 nt, Human
gcaugagaaauacaaaa

SEQ ID NO: 1345976 - RNA, 14 nt, Human
gcaugagaaauaca

SEQ ID NO: 1345977 - RNA, 17 nt, Human
gcaugagggguuccucc

SEQ ID NO: 1345978 - RNA, 19 nt, Human
gcaugagggguuccucccc

SEQ ID NO: 1345979 - RNA, 20 nt, Human
gcaugagggguuccuccccu

SEQ ID NO: 1345980 - RNA, 22 nt, Human
gcaugagggguuccuccccucc

SEQ ID NO: 1345981 - RNA, 22 nt, Human
gcaguggcaucaucucagcuca

SEQ ID NO: 1345982 - RNA, 12 nt, Human
gcaguggccuua

SEQ ID NO: 1345983 - RNA, 23 nt, Human
gcaguggauggccgugaaugggu

SEQ ID NO: 1345984 - RNA, 15 nt, Human
gcaguggcaggcaga

SEQ ID NO: 1345985 - RNA, 22 nt, Human
gcaguggcaggcagaggcccag

SEQ ID NO: 1345986 - RNA, 13 nt, Human
gcagugcuuuugg

SEQ ID NO: 1345987 - RNA, 22 nt, Human
gcagguaugaucggcaggacac

SEQ ID NO: 1345988 - RNA, 22 nt, Human
gcagggugcaguaucaugcccu

SEQ ID NO: 1345989 - RNA, 22 nt, Human
gcagggugggcuuguggggccu

SEQ ID NO: 1345990 - RNA, 13 nt, Human
gcagggcagucau

SEQ ID NO: 1345991 - RNA, 21 nt, Human
gcagggccccaggcauugcca

SEQ ID NO: 1345992 - RNA, 13 nt, Human
gcagggccgggga

SEQ ID NO: 1345993 - RNA, 14 nt, Human
gcagggccggggaa

SEQ ID NO: 1345994 - RNA, 20 nt, Human
gcagggccggggaacuggcc

SEQ ID NO: 1345995 - RNA, 23 nt, Human
gcagggccggggaacuggccaag

SEQ ID NO: 1345996 - RNA, 22 nt, Human
gcagggccggggaacuggccaa

SEQ ID NO: 1345997 - RNA, 16 nt, Human
gcaggggccuggagau

SEQ ID NO: 1345998 - RNA, 20 nt, Human
gcaggggccuggagauccuc

SEQ ID NO: 1345999 - RNA, 19 nt, Human
gcaggggccgggggcaguc

SEQ ID NO: 1346000 - RNA, 20 nt, Human
gcaggggccgggggcagucu

SEQ ID NO: 1346001 - RNA, 15 nt, Human
gcaggggccuccaug

SEQ ID NO: 1346002 - RNA, 13 nt, Human
gcaggggccugga

SEQ ID NO: 1346003 - RNA, 14 nt, Human
gcaggggccuggag

SEQ ID NO: 1346004 - RNA, 17 nt, Human
gcauagguuuaauaauu

SEQ ID NO: 1346005 - RNA, 13 nt, Human
gcauacuuuuuaa

SEQ ID NO: 1346006 - RNA, 20 nt, Human
gcauaguaccaaucauuuua

SEQ ID NO: 1346007 - RNA, 12 nt, Human
gcauauaaaauu

SEQ ID NO: 1346008 - RNA, 13 nt, Human
gcauaucauaaug

SEQ ID NO: 1346009 - RNA, 15 nt, Human
gcauauuuuuuuucu

SEQ ID NO: 1346010 - RNA, 19 nt, Human
gcauaugaguaagggcacu

SEQ ID NO: 1346011 - RNA, 23 nt, Human
gcauaugaguaagggcacugacg

SEQ ID NO: 1346012 - RNA, 22 nt, Human
gcaguggcgcgaucucagcuca

SEQ ID NO: 1346013 - RNA, 18 nt, Human
gcaguggcgcgaucucag

SEQ ID NO: 1346014 - RNA, 20 nt, Human
gcaguguagggaguuguggg

SEQ ID NO: 1346015 - RNA, 18 nt, Human
gcagugucuguguuuuga

SEQ ID NO: 1346016 - RNA, 15 nt, Human
gcagugugaggccag

SEQ ID NO: 1346017 - RNA, 22 nt, Human
gcaguggcgugaucucagcuca

SEQ ID NO: 1346018 - RNA, 13 nt, Human
gcauagaaguaaa

SEQ ID NO: 1346019 - RNA, 17 nt, Human
gcaguucugaagaagau

SEQ ID NO: 1346020 - RNA, 15 nt, Human
gcaguucugaagaag

SEQ ID NO: 1346021 - RNA, 12 nt, Human
gcaguuauuugc

SEQ ID NO: 1346022 - RNA, 17 nt, Human
gcagauucagaaaugag

SEQ ID NO: 1346023 - RNA, 21 nt, Human
gcagauucagaaaugaggcca

SEQ ID NO: 1346024 - RNA, 19 nt, Human
gcagauucagaaaugaggc

SEQ ID NO: 1346025 - RNA, 21 nt, Human
gcagauucucccuugcucugc

SEQ ID NO: 1346026 - RNA, 19 nt, Human
gcagauucucccuugcucu

SEQ ID NO: 1346027 - RNA, 21 nt, Human
gcagauuuucagcaaacucuu

SEQ ID NO: 1346028 - RNA, 14 nt, Human
gcagauccaggacu

SEQ ID NO: 1346029 - RNA, 17 nt, Human
gcagacauuuuaaaaaa

SEQ ID NO: 1346030 - RNA, 19 nt, Human
gcagacaugugcacuugaa

SEQ ID NO: 1346031 - RNA, 13 nt, Human
gcagaccaccccg

SEQ ID NO: 1346032 - RNA, 17 nt, Human
gcagaccaccccgccug

SEQ ID NO: 1346033 - RNA, 21 nt, Human
gcagaccaccccgccugcccu

SEQ ID NO: 1346034 - RNA, 20 nt, Human
gcagaccacgcccguccugc

SEQ ID NO: 1346035 - RNA, 23 nt, Human
gcagaccacgcccguccugccug

SEQ ID NO: 1346036 - RNA, 17 nt, Human
gcagaccacauugcuuu

SEQ ID NO: 1346037 - RNA, 14 nt, Human
gcagacccugcccu

SEQ ID NO: 1346038 - RNA, 15 nt, Human
gcagacccugcccuu

SEQ ID NO: 1346039 - RNA, 18 nt, Human
gcagauaaacaguaguga

SEQ ID NO: 1346040 - RNA, 16 nt, Human
gcagcaauuuaaaugu

SEQ ID NO: 1346041 - RNA, 15 nt, Human
gcagcaauuuaaaug

SEQ ID NO: 1346042 - RNA, 12 nt, Human
gcagcaauuuaa

SEQ ID NO: 1346043 - RNA, 17 nt, Human
gcagcaauuuaaauguu

SEQ ID NO: 1346044 - RNA, 18 nt, Human
gcagcacaaguguaauga

SEQ ID NO: 1346045 - RNA, 19 nt, Human
gcagcccccacccccaagg

SEQ ID NO: 1346046 - RNA, 14 nt, Human
gcagcccccagcuc

SEQ ID NO: 1346047 - RNA, 19 nt, Human
gcagcccccagcucccacc

SEQ ID NO: 1346048 - RNA, 20 nt, Human
gcagccccgugggguuccuc

SEQ ID NO: 1346049 - RNA, 23 nt, Human
gcagcccccagcucccaccuccc

SEQ ID NO: 1346050 - RNA, 21 nt, Human
gcagcccugcugcugccugcc

SEQ ID NO: 1346051 - RNA, 20 nt, Human
gcagcccugcugcugccugc

SEQ ID NO: 1346052 - RNA, 13 nt, Human
gcagcccugcuuu

SEQ ID NO: 1346053 - RNA, 14 nt, Human
gcagcccugcuuug

SEQ ID NO: 1346054 - RNA, 10 nt, Human
gcagccuggg

SEQ ID NO: 1346055 - RNA, 14 nt, Human
gcagccuggggcug

SEQ ID NO: 1346056 - RNA, 17 nt, Human
gcagccuggggcuggcc

SEQ ID NO: 1346057 - RNA, 12 nt, Human
gcagccuuguga

SEQ ID NO: 1346058 - RNA, 16 nt, Human
gcagcucaagagaucc

SEQ ID NO: 1346059 - RNA, 23 nt, Human
gcagcucaagcagcgaccgcccc

SEQ ID NO: 1346060 - RNA, 18 nt, Human
gcagcucaagagauccca

SEQ ID NO: 1346061 - RNA, 14 nt, Human
gcagcuuguagcca

SEQ ID NO: 1346062 - RNA, 15 nt, Human
gcagcuuguagccag

SEQ ID NO: 1346063 - RNA, 16 nt, Human
gcagcuuguagccagc

SEQ ID NO: 1346064 - RNA, 17 nt, Human
gcagcuuguagccagcc

SEQ ID NO: 1346065 - RNA, 18 nt, Human
gcagcuuguagccagccg

SEQ ID NO: 1346066 - RNA, 19 nt, Human
gcagcuuguagccagccgg

SEQ ID NO: 1346067 - RNA, 20 nt, Human
gcagcuuguagccagccggg

SEQ ID NO: 1346068 - RNA, 21 nt, Human
gcagcuuguagccagccgggg

SEQ ID NO: 1346069 - RNA, 22 nt, Human
gcagcuuguagccagccggggc

SEQ ID NO: 1346070 - RNA, 23 nt, Human
gcagcuuguagccagccggggcg

SEQ ID NO: 1346071 - RNA, 20 nt, Human
gcaggaaggcugagaggaga

SEQ ID NO: 1346072 - RNA, 15 nt, Human
gcagcuuugcucaua

SEQ ID NO: 1346073 - RNA, 13 nt, Human
gcaggaaggagcu

SEQ ID NO: 1346074 - RNA, 14 nt, Human
gcaggaaggagcug

SEQ ID NO: 1346075 - RNA, 15 nt, Human
gcaggaaggagcugc

SEQ ID NO: 1346076 - RNA, 16 nt, Human
gcaggaaggagcugcc

SEQ ID NO: 1346077 - RNA, 17 nt, Human
gcaggaaggagcugccu

SEQ ID NO: 1346078 - RNA, 18 nt, Human
gcaggaaggagcugccug

SEQ ID NO: 1346079 - RNA, 19 nt, Human
gcaggaaggagcugccugg

SEQ ID NO: 1346080 - RNA, 20 nt, Human
gcaggaaggagcugccugga

SEQ ID NO: 1346081 - RNA, 21 nt, Human
gcaggaaggagcugccuggac

SEQ ID NO: 1346082 - RNA, 23 nt, Human
gcaggaaggagcugccuggaccc

SEQ ID NO: 1346083 - RNA, 22 nt, Human
gcaggaaggagcugccuggacc

SEQ ID NO: 1346084 - RNA, 11 nt, Human
gcaggaaggcu

SEQ ID NO: 1346085 - RNA, 14 nt, Human
gcagcuuugcucau

SEQ ID NO: 1346086 - RNA, 13 nt, Human
gcagcuuugcuca

SEQ ID NO: 1346087 - RNA, 16 nt, Human
gcagcuuuuaaaagau

SEQ ID NO: 1346088 - RNA, 19 nt, Human
gcagcuuuagaaucccagc

SEQ ID NO: 1346089 - RNA, 21 nt, Human
gcaggaaaugaaaaugucuug

SEQ ID NO: 1346090 - RNA, 23 nt, Human
gcaggaaaugaaaaugucuugug

SEQ ID NO: 1346091 - RNA, 19 nt, Human
gcaggcagaggcccaggcu

SEQ ID NO: 1346092 - RNA, 20 nt, Human
gcaggcagaggcccaggcug

SEQ ID NO: 1346093 - RNA, 21 nt, Human
gcaggcagaggcccaggcugc

SEQ ID NO: 1346094 - RNA, 14 nt, Human
gcaggcagccagca

SEQ ID NO: 1346095 - RNA, 19 nt, Human
gcaggcagccagcaucugg

SEQ ID NO: 1346096 - RNA, 21 nt, Human
gcaggcagccagcaucugggc

SEQ ID NO: 1346097 - RNA, 15 nt, Human
gcaggcagaggccca

SEQ ID NO: 1346098 - RNA, 16 nt, Human
gcaggcagaggcccag

SEQ ID NO: 1346099 - RNA, 16 nt, Human
gcacggcagccacagc

SEQ ID NO: 1346100 - RNA, 14 nt, Human
gcacggcucugucc

SEQ ID NO: 1346101 - RNA, 18 nt, Human
gcacggcucuguccccag

SEQ ID NO: 1346102 - RNA, 19 nt, Human
gcacggcucuguccccagc

SEQ ID NO: 1346103 - RNA, 20 nt, Human
gcacggcucuguccccagcc

SEQ ID NO: 1346104 - RNA, 22 nt, Human
gcacggcucuguccccagccug

SEQ ID NO: 1346105 - RNA, 14 nt, Human
gcacggcagccaca

SEQ ID NO: 1346106 - RNA, 13 nt, Human
gcacgacagugga

SEQ ID NO: 1346107 - RNA, 17 nt, Human
gcaccugggcccugggg

SEQ ID NO: 1346108 - RNA, 13 nt, Human
gcaccuuucuagu

SEQ ID NO: 1346109 - RNA, 17 nt, Human
gcaccuuucuaguugaa

SEQ ID NO: 1346110 - RNA, 18 nt, Human
gcaccuuucuaguugaaa

SEQ ID NO: 1346111 - RNA, 15 nt, Human
gcacgaaauguuauu

SEQ ID NO: 1346112 - RNA, 16 nt, Human
gcacgaccgccccagu

SEQ ID NO: 1346113 - RNA, 21 nt, Human
gcacccuaguucuaccucagg

SEQ ID NO: 1346114 - RNA, 18 nt, Human
gcaccuggcaucgcacca

SEQ ID NO: 1346115 - RNA, 15 nt, Human
gcaccugggcccugg

SEQ ID NO: 1346116 - RNA, 16 nt, Human
gcaccugggcccuggg

SEQ ID NO: 1346117 - RNA, 18 nt, Human
gcaccugggcccuggggc

SEQ ID NO: 1346118 - RNA, 14 nt, Human
gcaccagacaccca

SEQ ID NO: 1346119 - RNA, 22 nt, Human
gcaaugccacagcccugucagc

SEQ ID NO: 1346120 - RNA, 16 nt, Human
gcaccagaauguauau

SEQ ID NO: 1346121 - RNA, 13 nt, Human
gcaccaggaagcc

SEQ ID NO: 1346122 - RNA, 14 nt, Human
gcaccaggaagccg

SEQ ID NO: 1346123 - RNA, 16 nt, Human
gcaccaugcugcuggg

SEQ ID NO: 1346124 - RNA, 18 nt, Human
gcaccaugcugcugggga

SEQ ID NO: 1346125 - RNA, 20 nt, Human
gcaccaugcugcuggggaag

SEQ ID NO: 1346126 - RNA, 23 nt, Human
gcaccaugcugcuggggaagaca

SEQ ID NO: 1346127 - RNA, 15 nt, Human
gcaccauucugacuc

SEQ ID NO: 1346128 - RNA, 17 nt, Human
gcaccauucugacucgg

SEQ ID NO: 1346129 - RNA, 23 nt, Human
gcaccauucugacucgguuucuc

SEQ ID NO: 1346130 - RNA, 12 nt, Human
gcacugcugccc

SEQ ID NO: 1346131 - RNA, 22 nt, Human
gcacugguggcccgacagccug

SEQ ID NO: 1346132 - RNA, 23 nt, Human
gcacugguggcccgacagccugg

SEQ ID NO: 1346133 - RNA, 24 nt, Human
gcacugguggcccgacagccuggc

SEQ ID NO: 1346134 - RNA, 19 nt, Human
gcacugcccugguggcccu

SEQ ID NO: 1346135 - RNA, 21 nt, Human
gcacugccugcucccauccug

SEQ ID NO: 1346136 - RNA, 19 nt, Human
gcacugccugcucccaucc

SEQ ID NO: 1346137 - RNA, 17 nt, Human
gcacguaaaguacuugu

SEQ ID NO: 1346138 - RNA, 21 nt, Human
gcacguaaaguacuuguaguu

SEQ ID NO: 1346139 - RNA, 18 nt, Human
gcacguaaaguacuugua

SEQ ID NO: 1346140 - RNA, 13 nt, Human
gcacguggccucu

SEQ ID NO: 1346141 - RNA, 14 nt, Human
gcacguggccucuu

SEQ ID NO: 1346142 - RNA, 15 nt, Human
gcacguggccucuug

SEQ ID NO: 1346143 - RNA, 17 nt, Human
gcacguggccucuugag

SEQ ID NO: 1346144 - RNA, 19 nt, Human
gcacguggccucuugagca

SEQ ID NO: 1346145 - RNA, 14 nt, Human
gcacugccacuggg

SEQ ID NO: 1346146 - RNA, 13 nt, Human
gcacugccaggag

SEQ ID NO: 1346147 - RNA, 14 nt, Human
gcacugccaggagg

SEQ ID NO: 1346148 - RNA, 15 nt, Human
gcacugccaggaggg

SEQ ID NO: 1346149 - RNA, 16 nt, Human
gcacugccaggaggga

SEQ ID NO: 1346150 - RNA, 17 nt, Human
gcacugccaggagggac

SEQ ID NO: 1346151 - RNA, 18 nt, Human
gcacugccaggagggaca

SEQ ID NO: 1346152 - RNA, 23 nt, Human
gcacugccaggagggacaaagga

SEQ ID NO: 1346153 - RNA, 21 nt, Human
gcacugcccauggacaggcug

SEQ ID NO: 1346154 - RNA, 12 nt, Human
gcacugcccugg

SEQ ID NO: 1346155 - RNA, 13 nt, Human
gcacugcccuggu

SEQ ID NO: 1346156 - RNA, 15 nt, Human
gcagacagcuccacc

SEQ ID NO: 1346157 - RNA, 20 nt, Human
gcagacaggccccgugaggc

SEQ ID NO: 1346158 - RNA, 21 nt, Human
gcacuguacaaaaaaaucuuc

SEQ ID NO: 1346159 - RNA, 18 nt, Human
gcacuuaaagcuuucaga

SEQ ID NO: 1346160 - RNA, 9 nt, Human
gcacuguaa

SEQ ID NO: 1346161 - RNA, 12 nt, Human
gcacuguaaaau

SEQ ID NO: 1346162 - RNA, 13 nt, Human
gcacuguaaaaug

SEQ ID NO: 1346163 - RNA, 14 nt, Human
gcacuguaaaaugu

SEQ ID NO: 1346164 - RNA, 16 nt, Human
gcacuguaaaaugugg

SEQ ID NO: 1346165 - RNA, 23 nt, Human
gcacuguaaaaugugggauuaug

SEQ ID NO: 1346166 - RNA, 22 nt, Human
gcacuuacugguaggaccaagc

SEQ ID NO: 1346167 - RNA, 18 nt, Human
gcacuuauuuaaugccga

SEQ ID NO: 1346168 - RNA, 18 nt, Human
gcacuucaaauucaaaua

SEQ ID NO: 1346169 - RNA, 20 nt, Human
gcacuuccucucgcggcccu

SEQ ID NO: 1346170 - RNA, 22 nt, Human
gcacuuccucucgcggcccuca

SEQ ID NO: 1346171 - RNA, 14 nt, Human
gcagaauaguauuu

SEQ ID NO: 1346172 - RNA, 23 nt, Human
gcagaauccuaggcuccacccca

SEQ ID NO: 1346173 - RNA, 15 nt, Human
gauuuccagccuucu

SEQ ID NO: 1346174 - RNA, 21 nt, Human
gauugcaauaucugaagcccu

SEQ ID NO: 1346175 - RNA, 15 nt, Human
gauugcacguggccu

SEQ ID NO: 1346176 - RNA, 16 nt, Human
gauugcacguggccuc

SEQ ID NO: 1346177 - RNA, 17 nt, Human
gauugcacguggccucu

SEQ ID NO: 1346178 - RNA, 19 nt, Human
gauugcacguggccucuug

SEQ ID NO: 1346179 - RNA, 20 nt, Human
gauugcacguggccucuuga

SEQ ID NO: 1346180 - RNA, 23 nt, Human
gauugcacguggccucuugagca

SEQ ID NO: 1346181 - RNA, 19 nt, Human
gauugcagaaaauucugug

SEQ ID NO: 1346182 - RNA, 14 nt, Human
gauuucugaggaaa

SEQ ID NO: 1346183 - RNA, 22 nt, Human
gauuuggucaacacuaacauga

SEQ ID NO: 1346184 - RNA, 20 nt, Human
gauuuggcuugacaaaggca

SEQ ID NO: 1346185 - RNA, 21 nt, Human
gauuugcauugaacacaaacu

SEQ ID NO: 1346186 - RNA, 15 nt, Human
gauuuuccugaaaac

SEQ ID NO: 1346187 - RNA, 13 nt, Human
gauuuuccaaaug

SEQ ID NO: 1346188 - RNA, 22 nt, Human
gauuuuccaggacuguuucaaa

SEQ ID NO: 1346189 - RNA, 12 nt, Human
gauuuucaguua

SEQ ID NO: 1346190 - RNA, 14 nt, Human
gauuuucaguuacu

SEQ ID NO: 1346191 - RNA, 20 nt, Human
gauuuucugcuacuuugcug

SEQ ID NO: 1346192 - RNA, 15 nt, Human
gauuuucugguucua

SEQ ID NO: 1346193 - RNA, 16 nt, Human
gauuuucugguucuaa

SEQ ID NO: 1346194 - RNA, 12 nt, Human
gauuuuuaccag

SEQ ID NO: 1346195 - RNA, 15 nt, Human
gauuuuuaugucugg

SEQ ID NO: 1346196 - RNA, 12 nt, Human
gauuuuucuuua

SEQ ID NO: 1346197 - RNA, 13 nt, Human
gauuuuucuuuaa

SEQ ID NO: 1346198 - RNA, 15 nt, Human
gauuuuucuuuaacu

SEQ ID NO: 1346199 - RNA, 14 nt, Human
gauuuuucuuuaca

SEQ ID NO: 1346200 - RNA, 20 nt, Human
gauuuuucuuuacaaaacaa

SEQ ID NO: 1346201 - RNA, 18 nt, Human
gauuuucaaagcuuuuuc

SEQ ID NO: 1346202 - RNA, 19 nt, Human
gauuuucaaagcuuuuucc

SEQ ID NO: 1346203 - RNA, 22 nt, Human
gauuugugucugugacuuuugu

SEQ ID NO: 1346204 - RNA, 14 nt, Human
gauuuguacugaaa

SEQ ID NO: 1346205 - RNA, 19 nt, Human
gauuuguaacccacugaga

SEQ ID NO: 1346206 - RNA, 14 nt, Human
gauuugucccaggu

SEQ ID NO: 1346207 - RNA, 19 nt, Human
gauuccagagcacugcucc

SEQ ID NO: 1346208 - RNA, 22 nt, Human
gauuccagagaguggcuccucc

SEQ ID NO: 1346209 - RNA, 19 nt, Human
gauuccagagaguggcucc

SEQ ID NO: 1346210 - RNA, 20 nt, Human
gauuccagagaguggcuccu

SEQ ID NO: 1346211 - RNA, 18 nt, Human
gauuccagccaucaccuu

SEQ ID NO: 1346212 - RNA, 14 nt, Human
gauuccagccauca

SEQ ID NO: 1346213 - RNA, 18 nt, Human
gauuccauugguccaaga

SEQ ID NO: 1346214 - RNA, 19 nt, Human
gauucauaguaacuucuua

SEQ ID NO: 1346215 - RNA, 18 nt, Human
gauggggguuucaccaua

SEQ ID NO: 1346216 - RNA, 18 nt, Human
gauggggaccagcagccc

SEQ ID NO: 1346217 - RNA, 23 nt, Human
gauggggcaggccaccuggcucu

SEQ ID NO: 1346218 - RNA, 16 nt, Human
gaugggggaacucaga

SEQ ID NO: 1346219 - RNA, 19 nt, Human
gaugggggaacucagaucc

SEQ ID NO: 1346220 - RNA, 20 nt, Human
gaugggggaacucagaucca

SEQ ID NO: 1346221 - RNA, 22 nt, Human
gaugggggaacucagauccagg

SEQ ID NO: 1346222 - RNA, 20 nt, Human
gauggcuaacuuacaaagau

SEQ ID NO: 1346223 - RNA, 13 nt, Human
gauuccuucccau

SEQ ID NO: 1346224 - RNA, 12 nt, Human
gauuccuuccca

SEQ ID NO: 1346225 - RNA, 13 nt, Human
gauuccuuuaaca

SEQ ID NO: 1346226 - RNA, 14 nt, Human
gauuccuuuaacaa

SEQ ID NO: 1346227 - RNA, 15 nt, Human
gauuccuuuaacaac

SEQ ID NO: 1346228 - RNA, 21 nt, Human
gauuccuuuaacaacauguuu

SEQ ID NO: 1346229 - RNA, 20 nt, Human
gauuccuuuaacaacauguu

SEQ ID NO: 1346230 - RNA, 17 nt, Human
gauucgaaugacacugu

SEQ ID NO: 1346231 - RNA, 16 nt, Human
gauucgaaugacacug

SEQ ID NO: 1346232 - RNA, 16 nt, Human
gauucgguaucccccc

SEQ ID NO: 1346233 - RNA, 17 nt, Human
gauucgguaucccccca

SEQ ID NO: 1346234 - RNA, 11 nt, Human
gauucuaaaau

SEQ ID NO: 1346235 - RNA, 12 nt, Human
gauucuaaaaug

SEQ ID NO: 1346236 - RNA, 22 nt, Human
gauucuaaaaugugauguucua

SEQ ID NO: 1346237 - RNA, 11 nt, Human
gauucuaaaga

SEQ ID NO: 1346238 - RNA, 12 nt, Human
gauucuaaagau

SEQ ID NO: 1346239 - RNA, 13 nt, Human
gauucuaaagauu

SEQ ID NO: 1346240 - RNA, 15 nt, Human
gauucuaaagauucu

SEQ ID NO: 1346241 - RNA, 14 nt, Human
gauucuaaagauuc

SEQ ID NO: 1346242 - RNA, 18 nt, Human
gauugcaauaucugaagc

SEQ ID NO: 1346243 - RNA, 21 nt, Human
gcaaacaggaucaguuaacua

SEQ ID NO: 1346244 - RNA, 13 nt, Human
gcaaagcccagcu

SEQ ID NO: 1346245 - RNA, 22 nt, Human
gcaaagcagcaacuauucacaa

SEQ ID NO: 1346246 - RNA, 16 nt, Human
gcaaagccaggucccu

SEQ ID NO: 1346247 - RNA, 21 nt, Human
gcaaagcccagcuugaaaccu

SEQ ID NO: 1346248 - RNA, 15 nt, Human
gauuuuucuuuacaa

SEQ ID NO: 1346249 - RNA, 13 nt, Human
gauuuuugccucu

SEQ ID NO: 1346250 - RNA, 22 nt, Human
gauuuuuguuuuguuuuuacaa

SEQ ID NO: 1346251 - RNA, 16 nt, Human
gauuuuuuaauaauuu

SEQ ID NO: 1346252 - RNA, 17 nt, Human
gauuuuuuaauaauuua

SEQ ID NO: 1346253 - RNA, 13 nt, Human
gcaaaauugcaaa

SEQ ID NO: 1346254 - RNA, 17 nt, Human
gcaaaauugcaaaucuu

SEQ ID NO: 1346255 - RNA, 12 nt, Human
gcaaacacuuaa

SEQ ID NO: 1346256 - RNA, 13 nt, Human
gcaaagcccccag

SEQ ID NO: 1346257 - RNA, 15 nt, Human
gcaaagcccccagag

SEQ ID NO: 1346258 - RNA, 19 nt, Human
gcaaagcccccagagccca

SEQ ID NO: 1346259 - RNA, 23 nt, Human
gcaaagcccccagagcccaggcu

SEQ ID NO: 1346260 - RNA, 11 nt, Human
gcaaagccugu

SEQ ID NO: 1346261 - RNA, 12 nt, Human
gcaaagccuguu

SEQ ID NO: 1346262 - RNA, 19 nt, Human
gcaaagccuguucauggca

SEQ ID NO: 1346263 - RNA, 20 nt, Human
gcaaagccuguucauggcag

SEQ ID NO: 1346264 - RNA, 18 nt, Human
gcaaaucauuuguuuaaa

SEQ ID NO: 1346265 - RNA, 14 nt, Human
gcaaaucauuuguu

SEQ ID NO: 1346266 - RNA, 17 nt, Human
gcaaaucaggcuuuugu

SEQ ID NO: 1346267 - RNA, 21 nt, Human
gcaaaucaccacaaacuguaa

SEQ ID NO: 1346268 - RNA, 21 nt, Human
gcaagaaucagagaaggaaca

SEQ ID NO: 1346269 - RNA, 21 nt, Human
gcaagaaggcaaaaauaguuu

SEQ ID NO: 1346270 - RNA, 15 nt, Human
gcaagaccaguugaa

SEQ ID NO: 1346271 - RNA, 19 nt, Human
gcaagacuucucuuugccu

SEQ ID NO: 1346272 - RNA, 21 nt, Human
gcaagacuucucuuugccuca

SEQ ID NO: 1346273 - RNA, 22 nt, Human
gcaagacuucucuuugccucaa

SEQ ID NO: 1346274 - RNA, 18 nt, Human
gcaagaggccguggcugc

SEQ ID NO: 1346275 - RNA, 20 nt, Human
gcaagaggccguggcugcug

SEQ ID NO: 1346276 - RNA, 22 nt, Human
gcaagaggccguggcugcugug

SEQ ID NO: 1346277 - RNA, 23 nt, Human
gcaagaggccguggcugcugugg

SEQ ID NO: 1346278 - RNA, 16 nt, Human
gcaagaaggcaaaaau

SEQ ID NO: 1346279 - RNA, 20 nt, Human
gcaagaaggcaaaaauaguu

SEQ ID NO: 1346280 - RNA, 23 nt, Human
gcaagaaggcaaaaauaguuugg

SEQ ID NO: 1346281 - RNA, 14 nt, Human
gcaacagaucugga

SEQ ID NO: 1346282 - RNA, 16 nt, Human
gcaacagaucuggaac

SEQ ID NO: 1346283 - RNA, 17 nt, Human
gcaacagaucuggaacc

SEQ ID NO: 1346284 - RNA, 18 nt, Human
gcaacagaucuggaaccu

SEQ ID NO: 1346285 - RNA, 20 nt, Human
gcaacagaucuggaaccuca

SEQ ID NO: 1346286 - RNA, 22 nt, Human
gcaacagaucuggaaccucagc

SEQ ID NO: 1346287 - RNA, 16 nt, Human
gcaacagaucaguaaa

SEQ ID NO: 1346288 - RNA, 17 nt, Human
gcaaauccuuugugaaa

SEQ ID NO: 1346289 - RNA, 18 nt, Human
gcaaauccuuugugaaaa

SEQ ID NO: 1346290 - RNA, 22 nt, Human
gcaaaucgaaugaaauuaacug

SEQ ID NO: 1346291 - RNA, 18 nt, Human
gcaacacuggucugcugu

SEQ ID NO: 1346292 - RNA, 18 nt, Human
gcaacacuuuuuauguua

SEQ ID NO: 1346293 - RNA, 19 nt, Human
gcaacacuggucugcuguu

SEQ ID NO: 1346294 - RNA, 15 nt, Human
gcaacagaucaguaa

SEQ ID NO: 1346295 - RNA, 12 nt, Human
gcaacagaucug

SEQ ID NO: 1346296 - RNA, 13 nt, Human
gcaacagaucugg

SEQ ID NO: 1346297 - RNA, 15 nt, Human
gcaagguacucuggu

SEQ ID NO: 1346298 - RNA, 17 nt, Human
gcaagguacucugguga

SEQ ID NO: 1346299 - RNA, 16 nt, Human
gcaaugaugaaugaga

SEQ ID NO: 1346300 - RNA, 17 nt, Human
gcaaugaugaaugagaa

SEQ ID NO: 1346301 - RNA, 13 nt, Human
gcaaugccacagc

SEQ ID NO: 1346302 - RNA, 17 nt, Human
gcaaugccacagcccug

SEQ ID NO: 1346303 - RNA, 19 nt, Human
gcaaugccacagcccuguc

SEQ ID NO: 1346304 - RNA, 21 nt, Human
gcaaugccacagcccugucag

SEQ ID NO: 1346305 - RNA, 15 nt, Human
gcaaugccaucaucu

SEQ ID NO: 1346306 - RNA, 18 nt, Human
gcaaugccaucaucuccu

SEQ ID NO: 1346307 - RNA, 19 nt, Human
gcaaugccaucaucuccug

SEQ ID NO: 1346308 - RNA, 20 nt, Human
gcaaggccugguguuucuug

SEQ ID NO: 1346309 - RNA, 24 nt, Human
gcaaggcccgagcagcugagcagg

SEQ ID NO: 1346310 - RNA, 14 nt, Human
gcaaggcccgagca

SEQ ID NO: 1346311 - RNA, 16 nt, Human
gcaaggcccgagcagc

SEQ ID NO: 1346312 - RNA, 17 nt, Human
gcaaggcccgagcagcu

SEQ ID NO: 1346313 - RNA, 18 nt, Human
gcaaggcccgagcagcug

SEQ ID NO: 1346314 - RNA, 19 nt, Human
gcaaggcccgagcagcuga

SEQ ID NO: 1346315 - RNA, 20 nt, Human
gcaaggcccgagcagcugag

SEQ ID NO: 1346316 - RNA, 21 nt, Human
gcaaggcccgagcagcugagc

SEQ ID NO: 1346317 - RNA, 22 nt, Human
gcaaggcccgagcagcugagca

SEQ ID NO: 1346318 - RNA, 23 nt, Human
gcaaggcccgagcagcugagcag

SEQ ID NO: 1346319 - RNA, 10 nt, Human
gcaagccaga

SEQ ID NO: 1346320 - RNA, 15 nt, Human
gcaagauaaacauua

SEQ ID NO: 1346321 - RNA, 18 nt, Human
gcaagauaaacauuauua

SEQ ID NO: 1346322 - RNA, 19 nt, Human
gcaagccuaagggauccug

SEQ ID NO: 1346323 - RNA, 17 nt, Human
gcaaggaccuaaaacau

SEQ ID NO: 1346324 - RNA, 14 nt, Human
gcaaggacuuugua

SEQ ID NO: 1346325 - RNA, 16 nt, Human
gcaaggacuuuguaca

SEQ ID NO: 1346326 - RNA, 19 nt, Human
gcaaggacuuuguacauuu

SEQ ID NO: 1346327 - RNA, 13 nt, Human
gcaaggcagccgu

SEQ ID NO: 1346328 - RNA, 15 nt, Human
gcaaggcagccgugg

SEQ ID NO: 1346329 - RNA, 19 nt, Human
gaucucagcucacugcaac

SEQ ID NO: 1346330 - RNA, 17 nt, Human
gaucucagcucacugca

SEQ ID NO: 1346331 - RNA, 17 nt, Human
gaucucagcucacuaca

SEQ ID NO: 1346332 - RNA, 12 nt, Human
gaucucagcuca

SEQ ID NO: 1346333 - RNA, 23 nt, Human
gaucucaccaggcagccucuggg

SEQ ID NO: 1346334 - RNA, 20 nt, Human
gaucucaccaggcagccucu

SEQ ID NO: 1346335 - RNA, 11 nt, Human
gaucuaaauaa

SEQ ID NO: 1346336 - RNA, 14 nt, Human
gaucuaaauaaaau

SEQ ID NO: 1346337 - RNA, 16 nt, Human
gaucuaaauaaaaugc

SEQ ID NO: 1346338 - RNA, 17 nt, Human
gaucuaaauaaaaugcu

SEQ ID NO: 1346339 - RNA, 18 nt, Human
gaucuaaauaaaaugcua

SEQ ID NO: 1346340 - RNA, 13 nt, Human
gaucuauuucaug

SEQ ID NO: 1346341 - RNA, 14 nt, Human
gaucuauuucaugu

SEQ ID NO: 1346342 - RNA, 16 nt, Human
gaucuauuucauguuu

SEQ ID NO: 1346343 - RNA, 14 nt, Human
gaucucaccaggca

SEQ ID NO: 1346344 - RNA, 15 nt, Human
gaucucaccaggcag

SEQ ID NO: 1346345 - RNA, 16 nt, Human
gaucucaccaggcagc

SEQ ID NO: 1346346 - RNA, 19 nt, Human
gaucucaccaggcagccuc

SEQ ID NO: 1346347 - RNA, 17 nt, Human
gauccugcggguggggc

SEQ ID NO: 1346348 - RNA, 18 nt, Human
gauccugcggguggggcu

SEQ ID NO: 1346349 - RNA, 13 nt, Human
gaucgccuucccc

SEQ ID NO: 1346350 - RNA, 14 nt, Human
gaucgccuucccca

SEQ ID NO: 1346351 - RNA, 16 nt, Human
gaucgccuuccccacc

SEQ ID NO: 1346352 - RNA, 17 nt, Human
gaucgccuuccccaccc

SEQ ID NO: 1346353 - RNA, 13 nt, Human
gaucggcaggaca

SEQ ID NO: 1346354 - RNA, 19 nt, Human
gaucggcaggacacccuga

SEQ ID NO: 1346355 - RNA, 18 nt, Human
gaucgucugacugguguu

SEQ ID NO: 1346356 - RNA, 16 nt, Human
gaucguucaaagcaug

SEQ ID NO: 1346357 - RNA, 13 nt, Human
gauccuggaaauc

SEQ ID NO: 1346358 - RNA, 19 nt, Human
gaucccuagcugugaccuc

SEQ ID NO: 1346359 - RNA, 21 nt, Human
gaucccuagcugugaccucuc

SEQ ID NO: 1346360 - RNA, 12 nt, Human
gaucccucaucu

SEQ ID NO: 1346361 - RNA, 21 nt, Human
gauccccacgccacagcccuu

SEQ ID NO: 1346362 - RNA, 18 nt, Human
gauccccacgccacagcc

SEQ ID NO: 1346363 - RNA, 19 nt, Human
gauccccacgccacagccc

SEQ ID NO: 1346364 - RNA, 15 nt, Human
gaucccuagcuguga

SEQ ID NO: 1346365 - RNA, 18 nt, Human
gaucuguuuugaaggcaa

SEQ ID NO: 1346366 - RNA, 19 nt, Human
gaucuguuuugaaggcaaa

SEQ ID NO: 1346367 - RNA, 13 nt, Human
gaucuguuuugaa

SEQ ID NO: 1346368 - RNA, 17 nt, Human
gaucuguuuugaaggca

SEQ ID NO: 1346369 - RNA, 19 nt, Human
gaugaaaauaaagaaugga

SEQ ID NO: 1346370 - RNA, 14 nt, Human
gaucuuuuauuuug

SEQ ID NO: 1346371 - RNA, 15 nt, Human
gaucuuuuauuuugc

SEQ ID NO: 1346372 - RNA, 21 nt, Human
gaugaagagagagagggccug

SEQ ID NO: 1346373 - RNA, 16 nt, Human
gaugaagggcccgaga

SEQ ID NO: 1346374 - RNA, 16 nt, Human
gaugcaccaccaagcc

SEQ ID NO: 1346375 - RNA, 15 nt, Human
gaugcacaucccugg

SEQ ID NO: 1346376 - RNA, 16 nt, Human
gaugcacaucccugga

SEQ ID NO: 1346377 - RNA, 22 nt, Human
gaugacaagaaaggcugcugua

SEQ ID NO: 1346378 - RNA, 16 nt, Human
gaugaaguuuuacauu

SEQ ID NO: 1346379 - RNA, 17 nt, Human
gaugaaguuuuacauug

SEQ ID NO: 1346380 - RNA, 15 nt, Human
gaugcauuugggucc

SEQ ID NO: 1346381 - RNA, 16 nt, Human
gaugcauuugggucca

SEQ ID NO: 1346382 - RNA, 18 nt, Human
gaugcauuuggguccagg

SEQ ID NO: 1346383 - RNA, 19 nt, Human
gaugcauuuggguccagga

SEQ ID NO: 1346384 - RNA, 20 nt, Human
gaugcauuuggguccaggag

SEQ ID NO: 1346385 - RNA, 21 nt, Human
gaugcauuuggguccaggagg

SEQ ID NO: 1346386 - RNA, 22 nt, Human
gaugcauuuggguccaggagga

SEQ ID NO: 1346387 - RNA, 19 nt, Human
gaugccaaaaaaaaauaca

SEQ ID NO: 1346388 - RNA, 19 nt, Human
gaugccaauauuaaaucug

SEQ ID NO: 1346389 - RNA, 15 nt, Human
gaugccacacaagga

SEQ ID NO: 1346390 - RNA, 15 nt, Human
gaugccagccaagcu

SEQ ID NO: 1346391 - RNA, 20 nt, Human
gauggcugugccucugccug

SEQ ID NO: 1346392 - RNA, 21 nt, Human
gauggcuaguaucaaaagaaa

SEQ ID NO: 1346393 - RNA, 13 nt, Human
gauggcucccagg

SEQ ID NO: 1346394 - RNA, 23 nt, Human
gauggcucccaggggcucccucc

SEQ ID NO: 1346395 - RNA, 18 nt, Human
gauggcucccaggggcuc

SEQ ID NO: 1346396 - RNA, 13 nt, Human
gauggcugugccu

SEQ ID NO: 1346397 - RNA, 17 nt, Human
gauggcugugccucugc

SEQ ID NO: 1346398 - RNA, 18 nt, Human
gauggcugugccucugcc

SEQ ID NO: 1346399 - RNA, 19 nt, Human
gauggcugugccucugccu

SEQ ID NO: 1346400 - RNA, 12 nt, Human
gaugccagccaa

SEQ ID NO: 1346401 - RNA, 23 nt, Human
gauggaugccaauauuaaaucug

SEQ ID NO: 1346402 - RNA, 12 nt, Human
gauggauuuuau

SEQ ID NO: 1346403 - RNA, 13 nt, Human
gauggauuuuaua

SEQ ID NO: 1346404 - RNA, 14 nt, Human
gauggcgcaggaac

SEQ ID NO: 1346405 - RNA, 11 nt, Human
gauacagaaaa

SEQ ID NO: 1346406 - RNA, 17 nt, Human
gauaagguaaaaugcca

SEQ ID NO: 1346407 - RNA, 19 nt, Human
gauaaguguucugucugac

SEQ ID NO: 1346408 - RNA, 19 nt, Human
gauacaccgggccuggaga

SEQ ID NO: 1346409 - RNA, 20 nt, Human
gauagaugcuggcccagggc

SEQ ID NO: 1346410 - RNA, 21 nt, Human
gauagaugcuggcccagggcc

SEQ ID NO: 1346411 - RNA, 12 nt, Human
gauagaugcugg

SEQ ID NO: 1346412 - RNA, 16 nt, Human
gauagaugcuggccca

SEQ ID NO: 1346413 - RNA, 17 nt, Human
gauagaugcuggcccag

SEQ ID NO: 1346414 - RNA, 18 nt, Human
gauagaugcuggcccagg

SEQ ID NO: 1346415 - RNA, 19 nt, Human
gauaaaguugguaaaccuu

SEQ ID NO: 1346416 - RNA, 19 nt, Human
gauaaagauuuuuuaauaa

SEQ ID NO: 1346417 - RNA, 17 nt, Human
gauaaagccucaagguu

SEQ ID NO: 1346418 - RNA, 17 nt, Human
gauaaagauuuuuuaau

SEQ ID NO: 1346419 - RNA, 22 nt, Human
gauaaauaguuuaugauuccac

SEQ ID NO: 1346420 - RNA, 21 nt, Human
gauaaauauugagcagaucua

SEQ ID NO: 1346421 - RNA, 22 nt, Human
gauaagaguagaaacugcaggg

SEQ ID NO: 1346422 - RNA, 16 nt, Human
gauaagaguuggcugg

SEQ ID NO: 1346423 - RNA, 14 nt, Human
gauaagaucuuuua

SEQ ID NO: 1346424 - RNA, 20 nt, Human
gauaagaucuuuuauuuugc

SEQ ID NO: 1346425 - RNA, 13 nt, Human
gauaaggaaauca

SEQ ID NO: 1346426 - RNA, 15 nt, Human
gauaaggccuguggg

SEQ ID NO: 1346427 - RNA, 20 nt, Human
gauaagguaaaaugccauga

SEQ ID NO: 1346428 - RNA, 22 nt, Human
gauaaguguucugucugacuuu

SEQ ID NO: 1346429 - RNA, 12 nt, Human
gaucccccagaa

SEQ ID NO: 1346430 - RNA, 16 nt, Human
gauccccacgccacag

SEQ ID NO: 1346431 - RNA, 17 nt, Human
gauccccacgccacagc

SEQ ID NO: 1346432 - RNA, 17 nt, Human
gaucccaugagcuccuu

SEQ ID NO: 1346433 - RNA, 20 nt, Human
gauccccaagccuggcaagg

SEQ ID NO: 1346434 - RNA, 20 nt, Human
gaucauugugaaauuauuca

SEQ ID NO: 1346435 - RNA, 15 nt, Human
gaucauguguggaag

SEQ ID NO: 1346436 - RNA, 18 nt, Human
gaucauuuguuggaauga

SEQ ID NO: 1346437 - RNA, 14 nt, Human
gaucauugugaaau

SEQ ID NO: 1346438 - RNA, 21 nt, Human
gaucauguguggaaguuauua

SEQ ID NO: 1346439 - RNA, 14 nt, Human
gaucaguuaacuau

SEQ ID NO: 1346440 - RNA, 20 nt, Human
gaucaguguaccauuugccu

SEQ ID NO: 1346441 - RNA, 21 nt, Human
gaucaguuaagaaauuucaca

SEQ ID NO: 1346442 - RNA, 18 nt, Human
gaucaguuauaaguagca

SEQ ID NO: 1346443 - RNA, 17 nt, Human
gaucaguauuuaacuaa

SEQ ID NO: 1346444 - RNA, 19 nt, Human
gaucaguauuuaacuaauu

SEQ ID NO: 1346445 - RNA, 23 nt, Human
gaucagugggccuccaaggaggg

SEQ ID NO: 1346446 - RNA, 21 nt, Human
gaucaaguuauuuuuaauuug

SEQ ID NO: 1346447 - RNA, 20 nt, Human
gaucaauuauaguuucugag

SEQ ID NO: 1346448 - RNA, 23 nt, Human
gauagucuuuugcuuuuggcaaa

SEQ ID NO: 1346449 - RNA, 13 nt, Human
gaucaaggccuua

SEQ ID NO: 1346450 - RNA, 23 nt, Human
gaucaaggccuuauuggaaagca

SEQ ID NO: 1346451 - RNA, 22 nt, Human
gaucaaggccuuauuggaaagc

SEQ ID NO: 1346452 - RNA, 16 nt, Human
gaucaauuauaguuuc

SEQ ID NO: 1346453 - RNA, 18 nt, Human
gaucaauuauaguuucug

SEQ ID NO: 1346454 - RNA, 19 nt, Human
gaucaauuauaguuucuga

SEQ ID NO: 1346455 - RNA, 17 nt, Human
gaucagaugcuccaaga

SEQ ID NO: 1346456 - RNA, 21 nt, Human
gaucagaugcuccaagauucu

SEQ ID NO: 1346457 - RNA, 22 nt, Human
gaucagaugcuccaagauucua

SEQ ID NO: 1346458 - RNA, 19 nt, Human
gaucagcaaaccggggccu

SEQ ID NO: 1346459 - RNA, 18 nt, Human
gaucagccagugaccaac

SEQ ID NO: 1346460 - RNA, 16 nt, Human
gaucagccccacccug

SEQ ID NO: 1346461 - RNA, 21 nt, Human
gaucagccccacccuggccua

SEQ ID NO: 1346462 - RNA, 22 nt, Human
gaucagccccacccuggccuag

SEQ ID NO: 1346463 - RNA, 23 nt, Human
gaucagccccacccuggccuaga

SEQ ID NO: 1346464 - RNA, 16 nt, Human
gagcucgugggacagu

SEQ ID NO: 1346465 - RNA, 14 nt, Human
gagcuccagccuga

SEQ ID NO: 1346466 - RNA, 14 nt, Human
gagcuccagcuccu

SEQ ID NO: 1346467 - RNA, 19 nt, Human
gagcuccagcuccuuuggg

SEQ ID NO: 1346468 - RNA, 20 nt, Human
gagcuccagcuccuuugggc

SEQ ID NO: 1346469 - RNA, 14 nt, Human
gagcuccagugucc

SEQ ID NO: 1346470 - RNA, 16 nt, Human
gagcuccaguguccug

SEQ ID NO: 1346471 - RNA, 18 nt, Human
gagcuccaguguccugag

SEQ ID NO: 1346472 - RNA, 19 nt, Human
gagcuccaguguccugagc

SEQ ID NO: 1346473 - RNA, 22 nt, Human
gagcuccaguguccugagcuca

SEQ ID NO: 1346474 - RNA, 23 nt, Human
gagcuccaguguccugagcucag

SEQ ID NO: 1346475 - RNA, 17 nt, Human
gagcucccacaagccug

SEQ ID NO: 1346476 - RNA, 19 nt, Human
gagcucccacaagccugag

SEQ ID NO: 1346477 - RNA, 20 nt, Human
gagcucccacaagccugagg

SEQ ID NO: 1346478 - RNA, 16 nt, Human
gagcugauggagaagg

SEQ ID NO: 1346479 - RNA, 15 nt, Human
gagcugauggagaag

SEQ ID NO: 1346480 - RNA, 16 nt, Human
gagcugaggcagcagu

SEQ ID NO: 1346481 - RNA, 17 nt, Human
gagcugaggccacacuc

SEQ ID NO: 1346482 - RNA, 22 nt, Human
gagcugaagguuguggccuuug

SEQ ID NO: 1346483 - RNA, 20 nt, Human
gagcugaagguuguggccuu

SEQ ID NO: 1346484 - RNA, 14 nt, Human
gagcugaccagccg

SEQ ID NO: 1346485 - RNA, 13 nt, Human
gagccugccgagc

SEQ ID NO: 1346486 - RNA, 14 nt, Human
gagccugccgagca

SEQ ID NO: 1346487 - RNA, 15 nt, Human
gagccugccgagcaa

SEQ ID NO: 1346488 - RNA, 16 nt, Human
gagccugccgagcaac

SEQ ID NO: 1346489 - RNA, 18 nt, Human
gagccugccgagcaaccg

SEQ ID NO: 1346490 - RNA, 21 nt, Human
gagccugccgagcaaccgugg

SEQ ID NO: 1346491 - RNA, 23 nt, Human
gagccugccgagcaaccguggcc

SEQ ID NO: 1346492 - RNA, 22 nt, Human
gagccugccgagcaaccguggc

SEQ ID NO: 1346493 - RNA, 20 nt, Human
gagcucaggaaccgaggcag

SEQ ID NO: 1346494 - RNA, 13 nt, Human
gagcucagcgugg

SEQ ID NO: 1346495 - RNA, 23 nt, Human
gagcucagaaaauaucccuccug

SEQ ID NO: 1346496 - RNA, 20 nt, Human
gagcucagaaaauaucccuc

SEQ ID NO: 1346497 - RNA, 21 nt, Human
gagcucaggaaccgaggcagg

SEQ ID NO: 1346498 - RNA, 22 nt, Human
gagcucaggaaccgaggcaggg

SEQ ID NO: 1346499 - RNA, 12 nt, Human
gagcuaggagca

SEQ ID NO: 1346500 - RNA, 17 nt, Human
gagcuaggagcaaagcc

SEQ ID NO: 1346501 - RNA, 18 nt, Human
gagcuaggagcaaagccu

SEQ ID NO: 1346502 - RNA, 19 nt, Human
gagcuaggagcaaagccug

SEQ ID NO: 1346503 - RNA, 21 nt, Human
gagcuaggagcaaagccuguu

SEQ ID NO: 1346504 - RNA, 20 nt, Human
gagcuaggagcaaagccugu

SEQ ID NO: 1346505 - RNA, 13 nt, Human
gagcuauugcugu

SEQ ID NO: 1346506 - RNA, 14 nt, Human
gagcucacaaggca

SEQ ID NO: 1346507 - RNA, 16 nt, Human
gagcucacaaggcagc

SEQ ID NO: 1346508 - RNA, 17 nt, Human
gagcucacaaggcagca

SEQ ID NO: 1346509 - RNA, 18 nt, Human
gagcucacaaggcagcaa

SEQ ID NO: 1346510 - RNA, 20 nt, Human
gagcucacaaggcagcaagg

SEQ ID NO: 1346511 - RNA, 21 nt, Human
gagcucacaaggcagcaaggc

SEQ ID NO: 1346512 - RNA, 23 nt, Human
gagcucacaaggcagcaaggccc

SEQ ID NO: 1346513 - RNA, 22 nt, Human
gagcucacaaggcagcaaggcc

SEQ ID NO: 1346514 - RNA, 19 nt, Human
gagcucagaaaauaucccu

SEQ ID NO: 1346515 - RNA, 14 nt, Human
gagcuuuuguagaa

SEQ ID NO: 1346516 - RNA, 23 nt, Human
gagcuuugucuacuucaaaaguu

SEQ ID NO: 1346517 - RNA, 21 nt, Human
gagcuuugacucaggagccug

SEQ ID NO: 1346518 - RNA, 18 nt, Human
gagcuuugacucaggagc

SEQ ID NO: 1346519 - RNA, 20 nt, Human
gaggaaaaccaagccguggc

SEQ ID NO: 1346520 - RNA, 21 nt, Human
gaggaaaaccaagccguggcu

SEQ ID NO: 1346521 - RNA, 23 nt, Human
gaggaaaaccaagccguggcuuc

SEQ ID NO: 1346522 - RNA, 12 nt, Human
gagcugccugga

SEQ ID NO: 1346523 - RNA, 14 nt, Human
gagcugccuggacc

SEQ ID NO: 1346524 - RNA, 15 nt, Human
gagcugccuggaccc

SEQ ID NO: 1346525 - RNA, 16 nt, Human
gagcugccuggacccg

SEQ ID NO: 1346526 - RNA, 13 nt, Human
gagcuugggaaug

SEQ ID NO: 1346527 - RNA, 17 nt, Human
gagcuuucugaacagcu

SEQ ID NO: 1346528 - RNA, 19 nt, Human
gagcuuucugaacagcugg

SEQ ID NO: 1346529 - RNA, 20 nt, Human
gagcuuucugaacagcuggu

SEQ ID NO: 1346530 - RNA, 22 nt, Human
gagcuuucugaacagcuggugu

SEQ ID NO: 1346531 - RNA, 23 nt, Human
gagcuuucugaacagcuggugua

SEQ ID NO: 1346532 - RNA, 15 nt, Human
gagcuuugacucagg

SEQ ID NO: 1346533 - RNA, 13 nt, Human
gaggaagaauggu

SEQ ID NO: 1346534 - RNA, 13 nt, Human
gaggaaaucccuu

SEQ ID NO: 1346535 - RNA, 15 nt, Human
gaggaaaucccuuca

SEQ ID NO: 1346536 - RNA, 20 nt, Human
gaggaaaucccuucauacuu

SEQ ID NO: 1346537 - RNA, 17 nt, Human
gaggaaaucccuucaua

SEQ ID NO: 1346538 - RNA, 23 nt, Human
gagcccacuguacuugcucuuga

SEQ ID NO: 1346539 - RNA, 11 nt, Human
gagcccacugu

SEQ ID NO: 1346540 - RNA, 21 nt, Human
gagcccacuguacuugcucuu

SEQ ID NO: 1346541 - RNA, 18 nt, Human
gagcccacuguacuugcu

SEQ ID NO: 1346542 - RNA, 20 nt, Human
gagcccacgacacugcagcc

SEQ ID NO: 1346543 - RNA, 14 nt, Human
gagcccacuccauc

SEQ ID NO: 1346544 - RNA, 22 nt, Human
gagcccacuccaucugguagaa

SEQ ID NO: 1346545 - RNA, 22 nt, Human
gagccgauuguccuaucuccag

SEQ ID NO: 1346546 - RNA, 16 nt, Human
gagccggccccaggcu

SEQ ID NO: 1346547 - RNA, 23 nt, Human
gagccggccccaggcucguggac

SEQ ID NO: 1346548 - RNA, 20 nt, Human
gagccggggugggguggcug

SEQ ID NO: 1346549 - RNA, 17 nt, Human
gagccgggucugccucu

SEQ ID NO: 1346550 - RNA, 20 nt, Human
gagccgggucugccucuucu

SEQ ID NO: 1346551 - RNA, 21 nt, Human
gagccgggucugccucuucug

SEQ ID NO: 1346552 - RNA, 22 nt, Human
gagccgggucugccucuucugg

SEQ ID NO: 1346553 - RNA, 19 nt, Human
gagccggguguccccaaca

SEQ ID NO: 1346554 - RNA, 20 nt, Human
gagccggguggaucgccuga

SEQ ID NO: 1346555 - RNA, 22 nt, Human
gagccggggugggguggcugca

SEQ ID NO: 1346556 - RNA, 19 nt, Human
gagccucagucucccuccc

SEQ ID NO: 1346557 - RNA, 13 nt, Human
gagccgugguccu

SEQ ID NO: 1346558 - RNA, 17 nt, Human
gagccgugguccuuugg

SEQ ID NO: 1346559 - RNA, 19 nt, Human
gagccucgcaacccgugcc

SEQ ID NO: 1346560 - RNA, 20 nt, Human
gagccucgcaacccgugcca

SEQ ID NO: 1346561 - RNA, 23 nt, Human
gagccucgcaacccgugccaagu

SEQ ID NO: 1346562 - RNA, 10 nt, Human
gagccugagg

SEQ ID NO: 1346563 - RNA, 12 nt, Human
gagccugaggga

SEQ ID NO: 1346564 - RNA, 15 nt, Human
gagccugagggaucu

SEQ ID NO: 1346565 - RNA, 21 nt, Human
gagccugacccucaucuuucu

SEQ ID NO: 1346566 - RNA, 19 nt, Human
gagccugaauuuuguugcu

SEQ ID NO: 1346567 - RNA, 21 nt, Human
gagccaggaagaucccccaga

SEQ ID NO: 1346568 - RNA, 12 nt, Human
gagccaggagaa

SEQ ID NO: 1346569 - RNA, 13 nt, Human
gagccaggagaag

SEQ ID NO: 1346570 - RNA, 14 nt, Human
gagccaggagaagc

SEQ ID NO: 1346571 - RNA, 15 nt, Human
gagccaggagaagcu

SEQ ID NO: 1346572 - RNA, 21 nt, Human
gagccaggagaagcucagcug

SEQ ID NO: 1346573 - RNA, 20 nt, Human
gagccaggaagaucccccag

SEQ ID NO: 1346574 - RNA, 21 nt, Human
gagccagcuaagggguggggc

SEQ ID NO: 1346575 - RNA, 22 nt, Human
gagccagcuaagggguggggcu

SEQ ID NO: 1346576 - RNA, 14 nt, Human
gagcagcgagccug

SEQ ID NO: 1346577 - RNA, 14 nt, Human
gagccagccgagca

SEQ ID NO: 1346578 - RNA, 19 nt, Human
gagccagccgagcaggagg

SEQ ID NO: 1346579 - RNA, 21 nt, Human
gagccagccgagcaggaggcc

SEQ ID NO: 1346580 - RNA, 20 nt, Human
gagccagccgagcaggaggc

SEQ ID NO: 1346581 - RNA, 18 nt, Human
gagccagcuaaggggugg

SEQ ID NO: 1346582 - RNA, 17 nt, Human
gagccaggagaagcuca

SEQ ID NO: 1346583 - RNA, 12 nt, Human
gagccagggucu

SEQ ID NO: 1346584 - RNA, 15 nt, Human
gagcagcgagccugc

SEQ ID NO: 1346585 - RNA, 23 nt, Human
gagcagagcugauggagaaggaa

SEQ ID NO: 1346586 - RNA, 20 nt, Human
gagcagagcugauggagaag

SEQ ID NO: 1346587 - RNA, 16 nt, Human
gagcagaggggcugaa

SEQ ID NO: 1346588 - RNA, 16 nt, Human
gagcagaggggcagag

SEQ ID NO: 1346589 - RNA, 20 nt, Human
gagcagaggggcagaggccc

SEQ ID NO: 1346590 - RNA, 15 nt, Human
gagcagaggggcuga

SEQ ID NO: 1346591 - RNA, 15 nt, Human
gagauaguuuucauc

SEQ ID NO: 1346592 - RNA, 16 nt, Human
gagauaguuuucaucc

SEQ ID NO: 1346593 - RNA, 17 nt, Human
gagauaguuuucaucca

SEQ ID NO: 1346594 - RNA, 16 nt, Human
gagauacauacagaau

SEQ ID NO: 1346595 - RNA, 13 nt, Human
gagauacauacag

SEQ ID NO: 1346596 - RNA, 22 nt, Human
gagaagcaaguaaaaaggcuaa

SEQ ID NO: 1346597 - RNA, 15 nt, Human
gagaagauaaggucu

SEQ ID NO: 1346598 - RNA, 14 nt, Human
gagaagaacugaaa

SEQ ID NO: 1346599 - RNA, 16 nt, Human
gagaagaacugaaauc

SEQ ID NO: 1346600 - RNA, 20 nt, Human
gagaacccagcccacccccg

SEQ ID NO: 1346601 - RNA, 13 nt, Human
gagaaugagccuc

SEQ ID NO: 1346602 - RNA, 16 nt, Human
gagaagccagcuuguu

SEQ ID NO: 1346603 - RNA, 20 nt, Human
gagaagccagcuuguuuaca

SEQ ID NO: 1346604 - RNA, 12 nt, Human
gagaagccagga

SEQ ID NO: 1346605 - RNA, 22 nt, Human
gagaagccaggaauuucccagg

SEQ ID NO: 1346606 - RNA, 23 nt, Human
gagaagccaggaauuucccagga

SEQ ID NO: 1346607 - RNA, 17 nt, Human
gagaagccaucaccuca

SEQ ID NO: 1346608 - RNA, 19 nt, Human
gagaagccaucaccucaga

SEQ ID NO: 1346609 - RNA, 20 nt, Human
gagaagccaucaccucagau

SEQ ID NO: 1346610 - RNA, 23 nt, Human
gagaagccaucaccucagauggc

SEQ ID NO: 1346611 - RNA, 22 nt, Human
gagaagccaucaccucagaugg

SEQ ID NO: 1346612 - RNA, 14 nt, Human
gagaagcccgugug

SEQ ID NO: 1346613 - RNA, 15 nt, Human
gagaagcccguguga

SEQ ID NO: 1346614 - RNA, 16 nt, Human
gagaagcccgugugag

SEQ ID NO: 1346615 - RNA, 12 nt, Human
gagaagccuuca

SEQ ID NO: 1346616 - RNA, 16 nt, Human
gagacagccaacuaug

SEQ ID NO: 1346617 - RNA, 17 nt, Human
gagacagacuagaaguu

SEQ ID NO: 1346618 - RNA, 15 nt, Human
gagacacuggccccu

SEQ ID NO: 1346619 - RNA, 17 nt, Human
gagacacuggccccuca

SEQ ID NO: 1346620 - RNA, 14 nt, Human
gagacacugguggg

SEQ ID NO: 1346621 - RNA, 17 nt, Human
gagacacugguggggau

SEQ ID NO: 1346622 - RNA, 15 nt, Human
gagacagacuagaag

SEQ ID NO: 1346623 - RNA, 9 nt, Human
gagacagag

SEQ ID NO: 1346624 - RNA, 18 nt, Human
gagacacacugaagaagc

SEQ ID NO: 1346625 - RNA, 11 nt, Human
gagacaaagcu

SEQ ID NO: 1346626 - RNA, 15 nt, Human
gagacacaccugagg

SEQ ID NO: 1346627 - RNA, 21 nt, Human
gagaauuucuaccauuucaga

SEQ ID NO: 1346628 - RNA, 19 nt, Human
gagacaaacaccucccagg

SEQ ID NO: 1346629 - RNA, 20 nt, Human
gagacaaacaccucccagga

SEQ ID NO: 1346630 - RNA, 22 nt, Human
gagacaaacaccucccaggaga

SEQ ID NO: 1346631 - RNA, 17 nt, Human
gagacaacgugcucuuu

SEQ ID NO: 1346632 - RNA, 12 nt, Human
gacuugugucug

SEQ ID NO: 1346633 - RNA, 23 nt, Human
gacuuguuggcguaggcuacaga

SEQ ID NO: 1346634 - RNA, 13 nt, Human
gacuuguguccca

SEQ ID NO: 1346635 - RNA, 18 nt, Human
gacuugugucccaugauc

SEQ ID NO: 1346636 - RNA, 13 nt, Human
gacuugugucucu

SEQ ID NO: 1346637 - RNA, 16 nt, Human
gacuugugucucugug

SEQ ID NO: 1346638 - RNA, 18 nt, Human
gacuugucccgggacacc

SEQ ID NO: 1346639 - RNA, 19 nt, Human
gacucgguuucuccaaacu

SEQ ID NO: 1346640 - RNA, 13 nt, Human
gacucgguuucuc

SEQ ID NO: 1346641 - RNA, 19 nt, Human
gacuuguauauuuuaagaa

SEQ ID NO: 1346642 - RNA, 16 nt, Human
gacuuguuuuugcaca

SEQ ID NO: 1346643 - RNA, 15 nt, Human
gacuuguuuuugcac

SEQ ID NO: 1346644 - RNA, 16 nt, Human
gacucggaaucuauuu

SEQ ID NO: 1346645 - RNA, 14 nt, Human
gacucggggguggg

SEQ ID NO: 1346646 - RNA, 16 nt, Human
gacucgggggugggga

SEQ ID NO: 1346647 - RNA, 12 nt, Human
gagaaaugaaaa

SEQ ID NO: 1346648 - RNA, 23 nt, Human
gagaaaucuggcuucuggccagg

SEQ ID NO: 1346649 - RNA, 17 nt, Human
gagaacaaacagaucga

SEQ ID NO: 1346650 - RNA, 13 nt, Human
gagaaccaaaucu

SEQ ID NO: 1346651 - RNA, 17 nt, Human
gagaaccaaaucuggaa

SEQ ID NO: 1346652 - RNA, 18 nt, Human
gagaaccaaaucuggaag

SEQ ID NO: 1346653 - RNA, 11 nt, Human
gagaaacuucc

SEQ ID NO: 1346654 - RNA, 19 nt, Human
gagaaagaggcaccaggaa

SEQ ID NO: 1346655 - RNA, 18 nt, Human
gagaaauaagugcccucu

SEQ ID NO: 1346656 - RNA, 14 nt, Human
gagaaauacaaaaa

SEQ ID NO: 1346657 - RNA, 15 nt, Human
gagaaauacaaaaau

SEQ ID NO: 1346658 - RNA, 23 nt, Human
gagaaauagcuuaugaaaagaau

SEQ ID NO: 1346659 - RNA, 20 nt, Human
gagaaauauggacacuuaau

SEQ ID NO: 1346660 - RNA, 17 nt, Human
gagaaacaguugguaac

SEQ ID NO: 1346661 - RNA, 18 nt, Human
gagaaacaguugguaacu

SEQ ID NO: 1346662 - RNA, 19 nt, Human
gagaaacaguugguaacuu

SEQ ID NO: 1346663 - RNA, 21 nt, Human
gagaaacaguugguaacuuuu

SEQ ID NO: 1346664 - RNA, 22 nt, Human
gagaaacaguugguaacuuuug

SEQ ID NO: 1346665 - RNA, 13 nt, Human
gagaaaccagcuu

SEQ ID NO: 1346666 - RNA, 14 nt, Human
gagaaaccagcuuc

SEQ ID NO: 1346667 - RNA, 15 nt, Human
gagaaaccagcuucc

SEQ ID NO: 1346668 - RNA, 16 nt, Human
gagaaaccagcuuccu

SEQ ID NO: 1346669 - RNA, 17 nt, Human
gagaaaccagcuuccuu

SEQ ID NO: 1346670 - RNA, 19 nt, Human
gagaaaccagcuuccuuca

SEQ ID NO: 1346671 - RNA, 21 nt, Human
gagaaaccagcuuccuucaga

SEQ ID NO: 1346672 - RNA, 23 nt, Human
gagaaaccagcuuccuucagaga

SEQ ID NO: 1346673 - RNA, 24 nt, Human
gagaaacuuaaauguuauuaucug

SEQ ID NO: 1346674 - RNA, 19 nt, Human
gagagagguugaaaaacaa

SEQ ID NO: 1346675 - RNA, 16 nt, Human
gagagaguugaaccua

SEQ ID NO: 1346676 - RNA, 21 nt, Human
gagagaguuguuuuaauaacu

SEQ ID NO: 1346677 - RNA, 16 nt, Human
gagagcagugcuuuug

SEQ ID NO: 1346678 - RNA, 14 nt, Human
gagagcaucaggcc

SEQ ID NO: 1346679 - RNA, 13 nt, Human
gagagcagugcuu

SEQ ID NO: 1346680 - RNA, 16 nt, Human
gagagccaccaagagg

SEQ ID NO: 1346681 - RNA, 17 nt, Human
gagagagguugaaaaac

SEQ ID NO: 1346682 - RNA, 13 nt, Human
gagagaggccauu

SEQ ID NO: 1346683 - RNA, 21 nt, Human
gagagaggccauucuuuccca

SEQ ID NO: 1346684 - RNA, 22 nt, Human
gagagccagcuaaggggugggg

SEQ ID NO: 1346685 - RNA, 19 nt, Human
gagagacacacugaagaag

SEQ ID NO: 1346686 - RNA, 11 nt, Human
gagacuuguuu

SEQ ID NO: 1346687 - RNA, 21 nt, Human
gagacuuuccauuacaaguau

SEQ ID NO: 1346688 - RNA, 17 nt, Human
gagauacagaauuuuau

SEQ ID NO: 1346689 - RNA, 13 nt, Human
gagaguggcuccu

SEQ ID NO: 1346690 - RNA, 14 nt, Human
gagaguuuccugaa

SEQ ID NO: 1346691 - RNA, 19 nt, Human
gagagugaacaaauuuaca

SEQ ID NO: 1346692 - RNA, 15 nt, Human
gagagugaacaaauu

SEQ ID NO: 1346693 - RNA, 17 nt, Human
gagagguugucuguggc

SEQ ID NO: 1346694 - RNA, 20 nt, Human
gagagguuugcagucccaag

SEQ ID NO: 1346695 - RNA, 20 nt, Human
gagagggcucgagggguggg

SEQ ID NO: 1346696 - RNA, 14 nt, Human
gagaggugggccag

SEQ ID NO: 1346697 - RNA, 22 nt, Human
gagaggugggccagucugugga

SEQ ID NO: 1346698 - RNA, 23 nt, Human
gagaggugggccagucuguggau

SEQ ID NO: 1346699 - RNA, 15 nt, Human
gagagggcgcaggcc

SEQ ID NO: 1346700 - RNA, 16 nt, Human
gagagggcgcaggccg

SEQ ID NO: 1346701 - RNA, 17 nt, Human
gagagggcgcaggccgu

SEQ ID NO: 1346702 - RNA, 18 nt, Human
gagagggcgcaggccgug

SEQ ID NO: 1346703 - RNA, 21 nt, Human
gagagggcucgaggggugggc

SEQ ID NO: 1346704 - RNA, 12 nt, Human
gagacauccagc

SEQ ID NO: 1346705 - RNA, 13 nt, Human
gagacaugugaca

SEQ ID NO: 1346706 - RNA, 11 nt, Human
gagacauccag

SEQ ID NO: 1346707 - RNA, 19 nt, Human
gagacauaaccacugcuuc

SEQ ID NO: 1346708 - RNA, 13 nt, Human
gagacaucagccc

SEQ ID NO: 1346709 - RNA, 14 nt, Human
gagacaugugacau

SEQ ID NO: 1346710 - RNA, 22 nt, Human
gagacauuaacucauuagacug

SEQ ID NO: 1346711 - RNA, 16 nt, Human
gagacauuaacucauu

SEQ ID NO: 1346712 - RNA, 13 nt, Human
gagacagcccagg

SEQ ID NO: 1346713 - RNA, 15 nt, Human
gagacauacuugaag

SEQ ID NO: 1346714 - RNA, 18 nt, Human
gagacauacuugaagggc

SEQ ID NO: 1346715 - RNA, 20 nt, Human
gagacauacuugaagggcca

SEQ ID NO: 1346716 - RNA, 21 nt, Human
gagacauacuugaagggccag

SEQ ID NO: 1346717 - RNA, 13 nt, Human
gagacagcucugc

SEQ ID NO: 1346718 - RNA, 18 nt, Human
gagacagcucugcauacu

SEQ ID NO: 1346719 - RNA, 15 nt, Human
gagacagcucugcau

SEQ ID NO: 1346720 - RNA, 12 nt, Human
gagaccaccucu

SEQ ID NO: 1346721 - RNA, 22 nt, Human
gagaccaagauggcccauccug

SEQ ID NO: 1346722 - RNA, 13 nt, Human
gagaccagggcuc

SEQ ID NO: 1346723 - RNA, 12 nt, Human
gagaccaccagg

SEQ ID NO: 1346724 - RNA, 12 nt, Human
gagaccagggcu

SEQ ID NO: 1346725 - RNA, 15 nt, Human
gagacugcccagcua

SEQ ID NO: 1346726 - RNA, 22 nt, Human
gagacugucucaagagggcacu

SEQ ID NO: 1346727 - RNA, 23 nt, Human
gagacugucucaagagggcacug

SEQ ID NO: 1346728 - RNA, 21 nt, Human
gagacugucuggccccccugg

SEQ ID NO: 1346729 - RNA, 22 nt, Human
gagacugucuggccccccuggu

SEQ ID NO: 1346730 - RNA, 17 nt, Human
gagacugugugugcccu

SEQ ID NO: 1346731 - RNA, 19 nt, Human
gagacugugugugcccucu

SEQ ID NO: 1346732 - RNA, 21 nt, Human
gagacugugugugcccucugg

SEQ ID NO: 1346733 - RNA, 22 nt, Human
gagacugugugugcccucuggg

SEQ ID NO: 1346734 - RNA, 13 nt, Human
gagacuuguauga

SEQ ID NO: 1346735 - RNA, 13 nt, Human
gagacuugggaau

SEQ ID NO: 1346736 - RNA, 23 nt, Human
gagacugugugugcccucugggc

SEQ ID NO: 1346737 - RNA, 14 nt, Human
gagacuguuuggaa

SEQ ID NO: 1346738 - RNA, 16 nt, Human
gagacuguuuggaaau

SEQ ID NO: 1346739 - RNA, 18 nt, Human
gagacuuagggcaccagg

SEQ ID NO: 1346740 - RNA, 21 nt, Human
gagacuuagggcaccaggggu

SEQ ID NO: 1346741 - RNA, 16 nt, Human
gacggguuucaccaug

SEQ ID NO: 1346742 - RNA, 17 nt, Human
gacgggguuucaccaug

SEQ ID NO: 1346743 - RNA, 15 nt, Human
gacgcacugagcaac

SEQ ID NO: 1346744 - RNA, 15 nt, Human
gacgcauaugaguaa

SEQ ID NO: 1346745 - RNA, 22 nt, Human
gacgacacggucggggcaucug

SEQ ID NO: 1346746 - RNA, 18 nt, Human
gacgaggggugucuuggg

SEQ ID NO: 1346747 - RNA, 19 nt, Human
gacgcaagggccugauggg

SEQ ID NO: 1346748 - RNA, 12 nt, Human
gacgcacugagc

SEQ ID NO: 1346749 - RNA, 16 nt, Human
gacggugcccaagcca

SEQ ID NO: 1346750 - RNA, 18 nt, Human
gacggugcccaagccaga

SEQ ID NO: 1346751 - RNA, 23 nt, Human
gacggugcccaagccagaggcug

SEQ ID NO: 1346752 - RNA, 17 nt, Human
gaccuuguuacuucuga

SEQ ID NO: 1346753 - RNA, 16 nt, Human
gaccuuguuacuucug

SEQ ID NO: 1346754 - RNA, 21 nt, Human
gaccuuuccaccacagccagc

SEQ ID NO: 1346755 - RNA, 23 nt, Human
gaccuuuccaccacagccagcac

SEQ ID NO: 1346756 - RNA, 13 nt, Human
gaccuuuccacca

SEQ ID NO: 1346757 - RNA, 17 nt, Human
gaccuuuccaccacagc

SEQ ID NO: 1346758 - RNA, 18 nt, Human
gaccuuuccaccacagcc

SEQ ID NO: 1346759 - RNA, 17 nt, Human
gaccuuuuucugcacua

SEQ ID NO: 1346760 - RNA, 21 nt, Human
gacgacaagugcugaacagug

SEQ ID NO: 1346761 - RNA, 19 nt, Human
gaccugccucggccuccca

SEQ ID NO: 1346762 - RNA, 18 nt, Human
gaccugccugcauaggag

SEQ ID NO: 1346763 - RNA, 12 nt, Human
gaccugccugua

SEQ ID NO: 1346764 - RNA, 15 nt, Human
gaccugcuaggccag

SEQ ID NO: 1346765 - RNA, 17 nt, Human
gaccugcuaggccagag

SEQ ID NO: 1346766 - RNA, 18 nt, Human
gaccugcuaggccagagc

SEQ ID NO: 1346767 - RNA, 19 nt, Human
gaccugcuaggccagagcc

SEQ ID NO: 1346768 - RNA, 23 nt, Human
gaccugcuaggccagagcccacu

SEQ ID NO: 1346769 - RNA, 10 nt, Human
gaccugcuga

SEQ ID NO: 1346770 - RNA, 21 nt, Human
gaccugcuaggccagagccca

SEQ ID NO: 1346771 - RNA, 18 nt, Human
gaccugcugaccugugca

SEQ ID NO: 1346772 - RNA, 19 nt, Human
gaccugcugaccugugcac

SEQ ID NO: 1346773 - RNA, 11 nt, Human
gaccugcugag

SEQ ID NO: 1346774 - RNA, 13 nt, Human
gaccugcugagcu

SEQ ID NO: 1346775 - RNA, 14 nt, Human
gaccugcugagcuc

SEQ ID NO: 1346776 - RNA, 16 nt, Human
gaccugcugagcucug

SEQ ID NO: 1346777 - RNA, 17 nt, Human
gaccugcugagcucuga

SEQ ID NO: 1346778 - RNA, 18 nt, Human
gaccugcugagcucugag

SEQ ID NO: 1346779 - RNA, 22 nt, Human
gaccugcugagcucugagaggc

SEQ ID NO: 1346780 - RNA, 19 nt, Human
gaccugcugagcucugaga

SEQ ID NO: 1346781 - RNA, 20 nt, Human
gaccuggaagggaggugggc

SEQ ID NO: 1346782 - RNA, 13 nt, Human
gacucauucugaa

SEQ ID NO: 1346783 - RNA, 16 nt, Human
gacucauucugaagga

SEQ ID NO: 1346784 - RNA, 17 nt, Human
gacucauucugaaggag

SEQ ID NO: 1346785 - RNA, 12 nt, Human
gacuccaggccc

SEQ ID NO: 1346786 - RNA, 14 nt, Human
gacuccaggcccaa

SEQ ID NO: 1346787 - RNA, 15 nt, Human
gacucagguugucug

SEQ ID NO: 1346788 - RNA, 19 nt, Human
gacucagguggcccuacug

SEQ ID NO: 1346789 - RNA, 15 nt, Human
gacucaguggggagg

SEQ ID NO: 1346790 - RNA, 15 nt, Human
gacucaucuuucccu

SEQ ID NO: 1346791 - RNA, 17 nt, Human
gacucaucuuucccucc

SEQ ID NO: 1346792 - RNA, 18 nt, Human
gacucaucuuucccuccu

SEQ ID NO: 1346793 - RNA, 19 nt, Human
gacucaucuuucccuccuu

SEQ ID NO: 1346794 - RNA, 21 nt, Human
gacucaucuuucccuccuugg

SEQ ID NO: 1346795 - RNA, 22 nt, Human
gacucaucuuucccuccuuggu

SEQ ID NO: 1346796 - RNA, 19 nt, Human
gacuccaggcccaaggcuc

SEQ ID NO: 1346797 - RNA, 18 nt, Human
gacuccaggcccaaggcu

SEQ ID NO: 1346798 - RNA, 13 nt, Human
gacucccauuccu

SEQ ID NO: 1346799 - RNA, 22 nt, Human
gacucccauuccugaagaacca

SEQ ID NO: 1346800 - RNA, 23 nt, Human
gacucccauuccugaagaaccag

SEQ ID NO: 1346801 - RNA, 12 nt, Human
gacuaauuucaa

SEQ ID NO: 1346802 - RNA, 13 nt, Human
gacuaauuucaaa

SEQ ID NO: 1346803 - RNA, 22 nt, Human
gacuaauuucaaaaugcuuuuu

SEQ ID NO: 1346804 - RNA, 19 nt, Human
gacuacagcuggggugcag

SEQ ID NO: 1346805 - RNA, 22 nt, Human
gacuacagcuggggugcaggga

SEQ ID NO: 1346806 - RNA, 18 nt, Human
gacuacuugggagcaccg

SEQ ID NO: 1346807 - RNA, 20 nt, Human
gacuacuugggagcaccgcc

SEQ ID NO: 1346808 - RNA, 20 nt, Human
gacuagaaaauuuaaaacau

SEQ ID NO: 1346809 - RNA, 19 nt, Human
gacuagaccuccagcuguu

SEQ ID NO: 1346810 - RNA, 22 nt, Human
gacucagcucugacauucugau

SEQ ID NO: 1346811 - RNA, 23 nt, Human
gacucagcucugacauucugauu

SEQ ID NO: 1346812 - RNA, 16 nt, Human
gacucaggagccugug

SEQ ID NO: 1346813 - RNA, 15 nt, Human
gacucaggagccugu

SEQ ID NO: 1346814 - RNA, 22 nt, Human
gacucaggcccccaccuggcuc

SEQ ID NO: 1346815 - RNA, 23 nt, Human
gacucaggcccccaccuggcuca

SEQ ID NO: 1346816 - RNA, 18 nt, Human
gacucagggaggcuaaau

SEQ ID NO: 1346817 - RNA, 12 nt, Human
gacucagggcag

SEQ ID NO: 1346818 - RNA, 13 nt, Human
gacucagggcagc

SEQ ID NO: 1346819 - RNA, 16 nt, Human
gacucagggcagcgcc

SEQ ID NO: 1346820 - RNA, 17 nt, Human
gacucagggcagcgcca

SEQ ID NO: 1346821 - RNA, 18 nt, Human
gacucagggcagcgccag

SEQ ID NO: 1346822 - RNA, 23 nt, Human
gacucagggcagcgccaggcuga

SEQ ID NO: 1346823 - RNA, 12 nt, Human
gacucagggcuc

SEQ ID NO: 1346824 - RNA, 13 nt, Human
gacucagggcucc

SEQ ID NO: 1346825 - RNA, 14 nt, Human
gacucagggcuccu

SEQ ID NO: 1346826 - RNA, 16 nt, Human
gacucagggcuccugg

SEQ ID NO: 1346827 - RNA, 17 nt, Human
gacucagggcuccuggg

SEQ ID NO: 1346828 - RNA, 19 nt, Human
gacucagggcuccuggguu

SEQ ID NO: 1346829 - RNA, 20 nt, Human
gaccggcggaccccagccau

SEQ ID NO: 1346830 - RNA, 19 nt, Human
gaccggcggaccccagcca

SEQ ID NO: 1346831 - RNA, 15 nt, Human
gaccggccugccagg

SEQ ID NO: 1346832 - RNA, 16 nt, Human
gaccggccugccagga

SEQ ID NO: 1346833 - RNA, 17 nt, Human
gaccggccugccaggag

SEQ ID NO: 1346834 - RNA, 18 nt, Human
gaccggccugccaggagg

SEQ ID NO: 1346835 - RNA, 15 nt, Human
gaccggcggcucgga

SEQ ID NO: 1346836 - RNA, 19 nt, Human
gaccggccugccaggagga

SEQ ID NO: 1346837 - RNA, 20 nt, Human
gacccuuauugcuguccugg

SEQ ID NO: 1346838 - RNA, 17 nt, Human
gacccuugacaccugcu

SEQ ID NO: 1346839 - RNA, 16 nt, Human
gacccuuauugcuguc

SEQ ID NO: 1346840 - RNA, 17 nt, Human
gaccggagagugggggu

SEQ ID NO: 1346841 - RNA, 16 nt, Human
gaccuaaauggccuca

SEQ ID NO: 1346842 - RNA, 20 nt, Human
gaccuaaauggccucaugug

SEQ ID NO: 1346843 - RNA, 13 nt, Human
gaccuacaggggg

SEQ ID NO: 1346844 - RNA, 20 nt, Human
gaccuacagggggucuggcu

SEQ ID NO: 1346845 - RNA, 21 nt, Human
gaccuacagggggucuggcug

SEQ ID NO: 1346846 - RNA, 22 nt, Human
gaccuacagggggucuggcugg

SEQ ID NO: 1346847 - RNA, 23 nt, Human
gaccuacagggggucuggcuggu

SEQ ID NO: 1346848 - RNA, 21 nt, Human
gaccucaccaagcugcugugg

SEQ ID NO: 1346849 - RNA, 13 nt, Human
gaccucagaagua

SEQ ID NO: 1346850 - RNA, 16 nt, Human
gaccucagaaguaaag

SEQ ID NO: 1346851 - RNA, 22 nt, Human
gaccugccucccuucaugcaug

SEQ ID NO: 1346852 - RNA, 11 nt, Human
gaccugccucc

SEQ ID NO: 1346853 - RNA, 15 nt, Human
gaccugccucggccu

SEQ ID NO: 1346854 - RNA, 21 nt, Human
gaccugccccuccucucugcc

SEQ ID NO: 1346855 - RNA, 23 nt, Human
gaccugauuucugagcauuuaau

SEQ ID NO: 1346856 - RNA, 14 nt, Human
gaccugauccugga

SEQ ID NO: 1346857 - RNA, 15 nt, Human
gaccugauccuggag

SEQ ID NO: 1346858 - RNA, 18 nt, Human
gaccugauccuggaggcc

SEQ ID NO: 1346859 - RNA, 21 nt, Human
gaccugauccuggaggcccag

SEQ ID NO: 1346860 - RNA, 16 nt, Human
gaccugcacuggggag

SEQ ID NO: 1346861 - RNA, 20 nt, Human
gaccugcacuggggagcccg

SEQ ID NO: 1346862 - RNA, 18 nt, Human
gaccucaggcaaucugcc

SEQ ID NO: 1346863 - RNA, 13 nt, Human
gaccugaggcugu

SEQ ID NO: 1346864 - RNA, 14 nt, Human
gaccugaggcugug

SEQ ID NO: 1346865 - RNA, 15 nt, Human
gaccugaggcugugg

SEQ ID NO: 1346866 - RNA, 17 nt, Human
gaccugaggcugugguc

SEQ ID NO: 1346867 - RNA, 22 nt, Human
gacccaggacaggauccaggcc

SEQ ID NO: 1346868 - RNA, 13 nt, Human
gacccaggacagg

SEQ ID NO: 1346869 - RNA, 12 nt, Human
gacccaggacag

SEQ ID NO: 1346870 - RNA, 15 nt, Human
gacccaggaaaggca

SEQ ID NO: 1346871 - RNA, 21 nt, Human
gacccaggaaaggcaggauug

SEQ ID NO: 1346872 - RNA, 14 nt, Human
gacccacaugccau

SEQ ID NO: 1346873 - RNA, 23 nt, Human
gacccacaugccauuuguacuga

SEQ ID NO: 1346874 - RNA, 12 nt, Human
gacccacaugcu

SEQ ID NO: 1346875 - RNA, 16 nt, Human
gacccagcggacacac

SEQ ID NO: 1346876 - RNA, 20 nt, Human
gaccaagauggcccauccug

SEQ ID NO: 1346877 - RNA, 23 nt, Human
gaccccucauagcccucacccug

SEQ ID NO: 1346878 - RNA, 22 nt, Human
gaccccucauagcccucacccu

SEQ ID NO: 1346879 - RNA, 11 nt, Human
gaccccagggc

SEQ ID NO: 1346880 - RNA, 13 nt, Human
gaccccagggcac

SEQ ID NO: 1346881 - RNA, 14 nt, Human
gaccccagggcaca

SEQ ID NO: 1346882 - RNA, 15 nt, Human
gaccccagggcacag

SEQ ID NO: 1346883 - RNA, 16 nt, Human
gaccccagggcacagg

SEQ ID NO: 1346884 - RNA, 17 nt, Human
gaccccagggcacagga

SEQ ID NO: 1346885 - RNA, 18 nt, Human
gaccccagggcacaggag

SEQ ID NO: 1346886 - RNA, 19 nt, Human
gaccccagggcacaggagc

SEQ ID NO: 1346887 - RNA, 21 nt, Human
gaccccagggcacaggagcua

SEQ ID NO: 1346888 - RNA, 19 nt, Human
gaccccaucaccuacucac

SEQ ID NO: 1346889 - RNA, 12 nt, Human
gacaccugcccu

SEQ ID NO: 1346890 - RNA, 11 nt, Human
gacaccugccc

SEQ ID NO: 1346891 - RNA, 10 nt, Human
gacaccugcc

SEQ ID NO: 1346892 - RNA, 9 nt, Human
gacaccugc

SEQ ID NO: 1346893 - RNA, 15 nt, Human
gacaccuaggcuagg

SEQ ID NO: 1346894 - RNA, 16 nt, Human
gacaccuaggcuaggg

SEQ ID NO: 1346895 - RNA, 20 nt, Human
gacaccuaggcuaggguggg

SEQ ID NO: 1346896 - RNA, 16 nt, Human
gacaccuaacucuucu

SEQ ID NO: 1346897 - RNA, 18 nt, Human
gacaccuaacucuucuuu

SEQ ID NO: 1346898 - RNA, 13 nt, Human
gacaccucuuuuu

SEQ ID NO: 1346899 - RNA, 17 nt, Human
gacaccuacugaguggc

SEQ ID NO: 1346900 - RNA, 15 nt, Human
gacaccuaacucuuc

SEQ ID NO: 1346901 - RNA, 15 nt, Human
gacacccuucuccca

SEQ ID NO: 1346902 - RNA, 19 nt, Human
gacacccuucucccacucu

SEQ ID NO: 1346903 - RNA, 23 nt, Human
gacacccuucucccacucuccua

SEQ ID NO: 1346904 - RNA, 12 nt, Human
gacacaggccug

SEQ ID NO: 1346905 - RNA, 13 nt, Human
gacacaggccugu

SEQ ID NO: 1346906 - RNA, 14 nt, Human
gacacaggccugug

SEQ ID NO: 1346907 - RNA, 15 nt, Human
gacacaggccugugu

SEQ ID NO: 1346908 - RNA, 16 nt, Human
gacacaggccugugua

SEQ ID NO: 1346909 - RNA, 17 nt, Human
gacacaggccuguguag

SEQ ID NO: 1346910 - RNA, 17 nt, Human
gacacagugaccauacu

SEQ ID NO: 1346911 - RNA, 13 nt, Human
gacacaguuccug

SEQ ID NO: 1346912 - RNA, 21 nt, Human
gacacaggccuguguagcugu

SEQ ID NO: 1346913 - RNA, 14 nt, Human
gacacaguuccugg

SEQ ID NO: 1346914 - RNA, 15 nt, Human
gacacaguuccuggg

SEQ ID NO: 1346915 - RNA, 19 nt, Human
gacacauacucauuuuuca

SEQ ID NO: 1346916 - RNA, 16 nt, Human
gacacaguuccuggga

SEQ ID NO: 1346917 - RNA, 23 nt, Human
gacaccugcccugcccugccacc

SEQ ID NO: 1346918 - RNA, 18 nt, Human
gacaccugggagaaaucu

SEQ ID NO: 1346919 - RNA, 14 nt, Human
gacaccuuggacau

SEQ ID NO: 1346920 - RNA, 12 nt, Human
gacaccugggag

SEQ ID NO: 1346921 - RNA, 14 nt, Human
gacaccuuuagguu

SEQ ID NO: 1346922 - RNA, 22 nt, Human
gacaccugcccugcccugccac

SEQ ID NO: 1346923 - RNA, 16 nt, Human
gacaccugcccugccc

SEQ ID NO: 1346924 - RNA, 15 nt, Human
gacaccugcccugcc

SEQ ID NO: 1346925 - RNA, 14 nt, Human
gacaccugcccugc

SEQ ID NO: 1346926 - RNA, 13 nt, Human
gacaccugcccug

SEQ ID NO: 1346927 - RNA, 19 nt, Human
gacaccuuuuuucaacagu

SEQ ID NO: 1346928 - RNA, 22 nt, Human
gacacggucggggcaucuggcc

SEQ ID NO: 1346929 - RNA, 15 nt, Human
gacaagcucacagac

SEQ ID NO: 1346930 - RNA, 21 nt, Human
gacaagcauggucccacaucc

SEQ ID NO: 1346931 - RNA, 16 nt, Human
gacaagccagaacuug

SEQ ID NO: 1346932 - RNA, 13 nt, Human
gacaaucaugugu

SEQ ID NO: 1346933 - RNA, 14 nt, Human
gacaaucaugugug

SEQ ID NO: 1346934 - RNA, 22 nt, Human
gacaagugaugcuaaaaccuga

SEQ ID NO: 1346935 - RNA, 20 nt, Human
gacaagugcugaacagugga

SEQ ID NO: 1346936 - RNA, 15 nt, Human
gacaaguggacucag

SEQ ID NO: 1346937 - RNA, 20 nt, Human
gacaaguggacucagggcag

SEQ ID NO: 1346938 - RNA, 14 nt, Human
gacaauaaaacauu

SEQ ID NO: 1346939 - RNA, 15 nt, Human
gacaaucaugugugu

SEQ ID NO: 1346940 - RNA, 13 nt, Human
gacaauuuauaau

SEQ ID NO: 1346941 - RNA, 17 nt, Human
gacacacacagacuauu

SEQ ID NO: 1346942 - RNA, 22 nt, Human
gacaugggacauuugcucaugg

SEQ ID NO: 1346943 - RNA, 20 nt, Human
gacauggagguucuaaggcc

SEQ ID NO: 1346944 - RNA, 21 nt, Human
gacauggagguucuaaggccu

SEQ ID NO: 1346945 - RNA, 13 nt, Human
gacaugaagccac

SEQ ID NO: 1346946 - RNA, 16 nt, Human
gacaugaagcuguugu

SEQ ID NO: 1346947 - RNA, 22 nt, Human
gacaugaagccacgggugccag

SEQ ID NO: 1346948 - RNA, 19 nt, Human
gacaugcgguagccagcac

SEQ ID NO: 1346949 - RNA, 22 nt, Human
gacaugcgguagccagcacaca

SEQ ID NO: 1346950 - RNA, 23 nt, Human
gacaugcgguagccagcacacag

SEQ ID NO: 1346951 - RNA, 14 nt, Human
gacauggagguucu

SEQ ID NO: 1346952 - RNA, 15 nt, Human
gacauggagguucua

SEQ ID NO: 1346953 - RNA, 16 nt, Human
gacauggagguucuaa

SEQ ID NO: 1346954 - RNA, 19 nt, Human
gacauggagguucuaaggc

SEQ ID NO: 1346955 - RNA, 14 nt, Human
gaccaaaaguuaca

SEQ ID NO: 1346956 - RNA, 19 nt, Human
gaccaaaaguuacauguuu

SEQ ID NO: 1346957 - RNA, 16 nt, Human
gaccaaagggagucug

SEQ ID NO: 1346958 - RNA, 21 nt, Human
gaccaaagggagucugccagg

SEQ ID NO: 1346959 - RNA, 15 nt, Human
gacaugucuguucua

SEQ ID NO: 1346960 - RNA, 17 nt, Human
gacaugucuguucuaca

SEQ ID NO: 1346961 - RNA, 18 nt, Human
gacaucaaaaaaggcagu

SEQ ID NO: 1346962 - RNA, 19 nt, Human
gacaucaaaaaaggcaguu

SEQ ID NO: 1346963 - RNA, 14 nt, Human
gacaucaacagaua

SEQ ID NO: 1346964 - RNA, 17 nt, Human
gacaucuugucauuuuu

SEQ ID NO: 1346965 - RNA, 20 nt, Human
gacaugaagauucuuuccca

SEQ ID NO: 1346966 - RNA, 21 nt, Human
gacaggcuggaagauagcugu

SEQ ID NO: 1346967 - RNA, 22 nt, Human
gacaggcuggaagauagcugug

SEQ ID NO: 1346968 - RNA, 18 nt, Human
gacaggcucuuagcagcu

SEQ ID NO: 1346969 - RNA, 19 nt, Human
gacaggcucuuagcagcuu

SEQ ID NO: 1346970 - RNA, 13 nt, Human
gacaggcucuuag

SEQ ID NO: 1346971 - RNA, 17 nt, Human
gacaggcucuuagcagc

SEQ ID NO: 1346972 - RNA, 12 nt, Human
gacaggcuggcu

SEQ ID NO: 1346973 - RNA, 14 nt, Human
gacaggcuggcucc

SEQ ID NO: 1346974 - RNA, 21 nt, Human
gacaggcuggcuccagaugca

SEQ ID NO: 1346975 - RNA, 22 nt, Human
gacaggcuggcuccagaugcag

SEQ ID NO: 1346976 - RNA, 17 nt, Human
gacauacccccuccccc

SEQ ID NO: 1346977 - RNA, 15 nt, Human
gacaggauccaggcc

SEQ ID NO: 1346978 - RNA, 13 nt, Human
gacaggauccagg

SEQ ID NO: 1346979 - RNA, 18 nt, Human
gacaggauccaggccggc

SEQ ID NO: 1346980 - RNA, 23 nt, Human
gacaggaugguucccuugaugaa

SEQ ID NO: 1346981 - RNA, 13 nt, Human
gacagcugugccu

SEQ ID NO: 1346982 - RNA, 14 nt, Human
gacagcugugccuc

SEQ ID NO: 1346983 - RNA, 15 nt, Human
gacagcugugccucg

SEQ ID NO: 1346984 - RNA, 17 nt, Human
gacagcugugccucgcu

SEQ ID NO: 1346985 - RNA, 19 nt, Human
gacagcugugccucgcucc

SEQ ID NO: 1346986 - RNA, 21 nt, Human
gacagcuucucauccugcagg

SEQ ID NO: 1346987 - RNA, 22 nt, Human
gacagcuucucauccugcaggc

SEQ ID NO: 1346988 - RNA, 19 nt, Human
gacaggacuaacacucaga

SEQ ID NO: 1346989 - RNA, 21 nt, Human
gacaggacuaacacucagaag

SEQ ID NO: 1346990 - RNA, 22 nt, Human
gacaggacuaacacucagaagc

SEQ ID NO: 1346991 - RNA, 23 nt, Human
gacaggacuaacacucagaagcc

SEQ ID NO: 1346992 - RNA, 24 nt, Human
gacaggacuaacacucagaagccu

SEQ ID NO: 1346993 - RNA, 19 nt, Human
gacagccaacuauggccug

SEQ ID NO: 1346994 - RNA, 12 nt, Human
gacagcaugaga

SEQ ID NO: 1346995 - RNA, 16 nt, Human
gacagaugaggcuuuc

SEQ ID NO: 1346996 - RNA, 19 nt, Human
gacagaugaaugccgugga

SEQ ID NO: 1346997 - RNA, 20 nt, Human
gacagaugaaugccguggau

SEQ ID NO: 1346998 - RNA, 15 nt, Human
gacagaugaggcuuu

SEQ ID NO: 1346999 - RNA, 20 nt, Human
gacagaugaggcuuuccaug

SEQ ID NO: 1347000 - RNA, 22 nt, Human
gacagccaacuauggccugugg

SEQ ID NO: 1347001 - RNA, 19 nt, Human
gacagaucucugcuuugga

SEQ ID NO: 1347002 - RNA, 21 nt, Human
gacagaucucugcuuuggaaa

SEQ ID NO: 1347003 - RNA, 23 nt, Human
gacagaucucugcuuuggaaauc

SEQ ID NO: 1347004 - RNA, 19 nt, Human
gacacggucggggcaucug

SEQ ID NO: 1347005 - RNA, 18 nt, Human
gaagaucccccagaaaag

SEQ ID NO: 1347006 - RNA, 15 nt, Human
gaagaucccccagaa

SEQ ID NO: 1347007 - RNA, 14 nt, Human
gaagaucccccaga

SEQ ID NO: 1347008 - RNA, 22 nt, Human
gaagauccugcggguggggcuu

SEQ ID NO: 1347009 - RNA, 14 nt, Human
gaagauccugcggg

SEQ ID NO: 1347010 - RNA, 21 nt, Human
gaagaucuaaauaaaaugcua

SEQ ID NO: 1347011 - RNA, 15 nt, Human
gaagauaaacgugga

SEQ ID NO: 1347012 - RNA, 14 nt, Human
gaagauauuuuucc

SEQ ID NO: 1347013 - RNA, 22 nt, Human
gaagauugagauguguucacaa

SEQ ID NO: 1347014 - RNA, 17 nt, Human
gaagauugagauguguu

SEQ ID NO: 1347015 - RNA, 14 nt, Human
gaagauucuuuccc

SEQ ID NO: 1347016 - RNA, 17 nt, Human
gaagauguagaggagaa

SEQ ID NO: 1347017 - RNA, 13 nt, Human
gaagaugacugag

SEQ ID NO: 1347018 - RNA, 14 nt, Human
gaagaugacugagg

SEQ ID NO: 1347019 - RNA, 19 nt, Human
gaagaaguuucaucauuuu

SEQ ID NO: 1347020 - RNA, 15 nt, Human
gaagagccuuccacc

SEQ ID NO: 1347021 - RNA, 14 nt, Human
gaagaaggugaaua

SEQ ID NO: 1347022 - RNA, 16 nt, Human
gaagaaggugggagga

SEQ ID NO: 1347023 - RNA, 16 nt, Human
gaagaagggcacccua

SEQ ID NO: 1347024 - RNA, 17 nt, Human
gaagagccuuccaccca

SEQ ID NO: 1347025 - RNA, 19 nt, Human
gaagagccuuccacccagg

SEQ ID NO: 1347026 - RNA, 22 nt, Human
gaagagcgagagaucaaagaug

SEQ ID NO: 1347027 - RNA, 22 nt, Human
gaagagccuuccacccaggggc

SEQ ID NO: 1347028 - RNA, 10 nt, Human
gaagaggacu

SEQ ID NO: 1347029 - RNA, 22 nt, Human
gaacuugaaauauccugcuuga

SEQ ID NO: 1347030 - RNA, 15 nt, Human
gaacuugaacugauu

SEQ ID NO: 1347031 - RNA, 16 nt, Human
gaacuugaacugauuc

SEQ ID NO: 1347032 - RNA, 14 nt, Human
gaaccacaagacug

SEQ ID NO: 1347033 - RNA, 15 nt, Human
gaaccacaagacugc

SEQ ID NO: 1347034 - RNA, 19 nt, Human
gaaccaauaaaauaauuuu

SEQ ID NO: 1347035 - RNA, 16 nt, Human
gaacucccuuucaaca

SEQ ID NO: 1347036 - RNA, 15 nt, Human
gaacuccuaaaucaa

SEQ ID NO: 1347037 - RNA, 16 nt, Human
gaacuccuaaaucaag

SEQ ID NO: 1347038 - RNA, 13 nt, Human
gaacuccugaccu

SEQ ID NO: 1347039 - RNA, 20 nt, Human
gaacuugugucccuaaugug

SEQ ID NO: 1347040 - RNA, 15 nt, Human
gaacuuguuuucugg

SEQ ID NO: 1347041 - RNA, 24 nt, Human
gaacuuuccacauucagagcuuac

SEQ ID NO: 1347042 - RNA, 22 nt, Human
gaacuuggggaguuaagaccug

SEQ ID NO: 1347043 - RNA, 14 nt, Human
gaagaaagaagaca

SEQ ID NO: 1347044 - RNA, 23 nt, Human
gaagaaagaggugaccccagggc

SEQ ID NO: 1347045 - RNA, 17 nt, Human
gaagaaagaggugaccc

SEQ ID NO: 1347046 - RNA, 15 nt, Human
gaagaaaguggaaaa

SEQ ID NO: 1347047 - RNA, 13 nt, Human
gaagaaccagucc

SEQ ID NO: 1347048 - RNA, 23 nt, Human
gaaguccaagcauuuagauguau

SEQ ID NO: 1347049 - RNA, 14 nt, Human
gaaguccaaugugg

SEQ ID NO: 1347050 - RNA, 17 nt, Human
gaaguccaauguggcaa

SEQ ID NO: 1347051 - RNA, 18 nt, Human
gaagucauaccaaugaaa

SEQ ID NO: 1347052 - RNA, 15 nt, Human
gaaguccggccccag

SEQ ID NO: 1347053 - RNA, 22 nt, Human
gaagucguccuuacuccugugg

SEQ ID NO: 1347054 - RNA, 23 nt, Human
gaagucguccuuacuccuguggg

SEQ ID NO: 1347055 - RNA, 24 nt, Human
gaagucguccuuacuccuguggga

SEQ ID NO: 1347056 - RNA, 16 nt, Human
gaagucacagggcagu

SEQ ID NO: 1347057 - RNA, 20 nt, Human
gaagucacagggcaguaccu

SEQ ID NO: 1347058 - RNA, 21 nt, Human
gaagucacauuccugaacagg

SEQ ID NO: 1347059 - RNA, 15 nt, Human
gaagucacugcacag

SEQ ID NO: 1347060 - RNA, 16 nt, Human
gaagucacauuccuga

SEQ ID NO: 1347061 - RNA, 20 nt, Human
gaagucacauuccugaacag

SEQ ID NO: 1347062 - RNA, 14 nt, Human
gaaguaacuacagu

SEQ ID NO: 1347063 - RNA, 19 nt, Human
gaaggugauguugccaucc

SEQ ID NO: 1347064 - RNA, 21 nt, Human
gaaggugauuuaagggcccag

SEQ ID NO: 1347065 - RNA, 21 nt, Human
gaaggugaggagcuugaaacc

SEQ ID NO: 1347066 - RNA, 19 nt, Human
gaaguauuuugcuggaaua

SEQ ID NO: 1347067 - RNA, 21 nt, Human
gaaguauuuuuucaguauuau

SEQ ID NO: 1347068 - RNA, 15 nt, Human
gaagucaaagcaagg

SEQ ID NO: 1347069 - RNA, 16 nt, Human
gaagucaaagcaagga

SEQ ID NO: 1347070 - RNA, 19 nt, Human
gaagucaauuacucuauaa

SEQ ID NO: 1347071 - RNA, 13 nt, Human
gaagucacagggc

SEQ ID NO: 1347072 - RNA, 15 nt, Human
gaagucacagggcag

SEQ ID NO: 1347073 - RNA, 20 nt, Human
gaagguauaucuagguuuau

SEQ ID NO: 1347074 - RNA, 14 nt, Human
gaagggggcggccu

SEQ ID NO: 1347075 - RNA, 20 nt, Human
gaaggugaaacauuuucucc

SEQ ID NO: 1347076 - RNA, 12 nt, Human
gaaggugaauag

SEQ ID NO: 1347077 - RNA, 22 nt, Human
gaaggugaauagccauauuugu

SEQ ID NO: 1347078 - RNA, 22 nt, Human
gaaggggccucaccgagugggg

SEQ ID NO: 1347079 - RNA, 19 nt, Human
gaaggcauuugcagggucc

SEQ ID NO: 1347080 - RNA, 22 nt, Human
gaaggcagggggaagguggggu

SEQ ID NO: 1347081 - RNA, 13 nt, Human
gaaggcauggcgg

SEQ ID NO: 1347082 - RNA, 17 nt, Human
gaaggcauuugcagggu

SEQ ID NO: 1347083 - RNA, 23 nt, Human
gaaggcauuugcaggguccucuu

SEQ ID NO: 1347084 - RNA, 14 nt, Human
gaaggggccagagg

SEQ ID NO: 1347085 - RNA, 16 nt, Human
gaaggggccagaggcu

SEQ ID NO: 1347086 - RNA, 17 nt, Human
gaaggggccagaggcuc

SEQ ID NO: 1347087 - RNA, 21 nt, Human
gaaggaucccaugagcuccuu

SEQ ID NO: 1347088 - RNA, 18 nt, Human
gaaggcagggagggccug

SEQ ID NO: 1347089 - RNA, 16 nt, Human
gaaggauucugcuggc

SEQ ID NO: 1347090 - RNA, 21 nt, Human
gaaggauucugcuggccucug

SEQ ID NO: 1347091 - RNA, 20 nt, Human
gaaggcagggagggccuggg

SEQ ID NO: 1347092 - RNA, 22 nt, Human
gaaggcagggagggccugggcc

SEQ ID NO: 1347093 - RNA, 23 nt, Human
gaaggcagggagggccugggccc

SEQ ID NO: 1347094 - RNA, 21 nt, Human
gaaggcagggggaaggugggg

SEQ ID NO: 1347095 - RNA, 22 nt, Human
gaaggaaggcuccaucuccagu

SEQ ID NO: 1347096 - RNA, 20 nt, Human
gaaggaaggcagggaggagg

SEQ ID NO: 1347097 - RNA, 19 nt, Human
gaaggaaggcagggaggag

SEQ ID NO: 1347098 - RNA, 18 nt, Human
gaaggaaggcagggagga

SEQ ID NO: 1347099 - RNA, 19 nt, Human
gaaggaggacccaggacag

SEQ ID NO: 1347100 - RNA, 18 nt, Human
gaaggaggacccaggaca

SEQ ID NO: 1347101 - RNA, 15 nt, Human
gaaggaggagccugu

SEQ ID NO: 1347102 - RNA, 16 nt, Human
gaaggaggagccuguc

SEQ ID NO: 1347103 - RNA, 22 nt, Human
gaaggaggagccuguccugccu

SEQ ID NO: 1347104 - RNA, 17 nt, Human
gaaggaggacccaggac

SEQ ID NO: 1347105 - RNA, 16 nt, Human
gaaggaggacccagga

SEQ ID NO: 1347106 - RNA, 15 nt, Human
gaaggaggacccagg

SEQ ID NO: 1347107 - RNA, 14 nt, Human
gaaggaggacccag

SEQ ID NO: 1347108 - RNA, 13 nt, Human
gaaggaggaccca

SEQ ID NO: 1347109 - RNA, 23 nt, Human
gaaggacccggaggggccuggca

SEQ ID NO: 1347110 - RNA, 22 nt, Human
gaaggacccggaggggccuggc

SEQ ID NO: 1347111 - RNA, 22 nt, Human
gaaggaauaaauugcuccuuga

SEQ ID NO: 1347112 - RNA, 13 nt, Human
gaagccaaagagu

SEQ ID NO: 1347113 - RNA, 19 nt, Human
gaagcauuuguuucuacuu

SEQ ID NO: 1347114 - RNA, 13 nt, Human
gaagcauuuguuu

SEQ ID NO: 1347115 - RNA, 16 nt, Human
gaagcuguugugugag

SEQ ID NO: 1347116 - RNA, 12 nt, Human
gaagccuggggg

SEQ ID NO: 1347117 - RNA, 13 nt, Human
gaagccugggggc

SEQ ID NO: 1347118 - RNA, 16 nt, Human
gaagccugggggccug

SEQ ID NO: 1347119 - RNA, 17 nt, Human
gaagccugggggccugg

SEQ ID NO: 1347120 - RNA, 18 nt, Human
gaagccugggggccuggc

SEQ ID NO: 1347121 - RNA, 19 nt, Human
gaagccugggggccuggcu

SEQ ID NO: 1347122 - RNA, 20 nt, Human
gaagccugggggccuggcug

SEQ ID NO: 1347123 - RNA, 22 nt, Human
gaagccugggggccuggcuggc

SEQ ID NO: 1347124 - RNA, 21 nt, Human
gaagccugggggccuggcugg

SEQ ID NO: 1347125 - RNA, 16 nt, Human
gaagccuucaagcucu

SEQ ID NO: 1347126 - RNA, 17 nt, Human
gaagccuucaagcucug

SEQ ID NO: 1347127 - RNA, 18 nt, Human
gaagccuucaagcucuga

SEQ ID NO: 1347128 - RNA, 19 nt, Human
gaagccuucaagcucugag

SEQ ID NO: 1347129 - RNA, 22 nt, Human
gaagccuucaagcucugaggga

SEQ ID NO: 1347130 - RNA, 20 nt, Human
gaagccuucaagcucugagg

SEQ ID NO: 1347131 - RNA, 10 nt, Human
gaagccuucc

SEQ ID NO: 1347132 - RNA, 23 nt, Human
gaagccuuccccuuauccucccu

SEQ ID NO: 1347133 - RNA, 14 nt, Human
gaaauaaacgucuu

SEQ ID NO: 1347134 - RNA, 23 nt, Human
gaaauaaaaggaagccaaagagu

SEQ ID NO: 1347135 - RNA, 16 nt, Human
gaaauaaacgucuuaa

SEQ ID NO: 1347136 - RNA, 17 nt, Human
gaaauaaacgucuuaaa

SEQ ID NO: 1347137 - RNA, 18 nt, Human
gaaauaaacgucuuaaau

SEQ ID NO: 1347138 - RNA, 21 nt, Human
gaaauaaacgucuuaaauauu

SEQ ID NO: 1347139 - RNA, 17 nt, Human
gaaauaaaggaugugau

SEQ ID NO: 1347140 - RNA, 20 nt, Human
gaaauaaaggaugugauugu

SEQ ID NO: 1347141 - RNA, 11 nt, Human
gaaauauauau

SEQ ID NO: 1347142 - RNA, 12 nt, Human
gaaauauauauu

SEQ ID NO: 1347143 - RNA, 13 nt, Human
gaaauauauauua

SEQ ID NO: 1347144 - RNA, 14 nt, Human
gaaauauauauuau

SEQ ID NO: 1347145 - RNA, 22 nt, Human
gaaauauauauuauacuuguaa

SEQ ID NO: 1347146 - RNA, 15 nt, Human
gaaauauauauuaua

SEQ ID NO: 1347147 - RNA, 15 nt, Human
gaaauauuuauuuua

SEQ ID NO: 1347148 - RNA, 16 nt, Human
gaaauauuuauuuuaa

SEQ ID NO: 1347149 - RNA, 15 nt, Human
gaaauauccugcuug

SEQ ID NO: 1347150 - RNA, 15 nt, Human
gaaaugaauuaaagu

SEQ ID NO: 1347151 - RNA, 13 nt, Human
gaaauauuuauuu

SEQ ID NO: 1347152 - RNA, 22 nt, Human
gaaaugaggccauggacucugu

SEQ ID NO: 1347153 - RNA, 23 nt, Human
gaaaugugguagccucacuuuua

SEQ ID NO: 1347154 - RNA, 17 nt, Human
gaaauuaccuguggaua

SEQ ID NO: 1347155 - RNA, 18 nt, Human
gaaauuaccuguggauau

SEQ ID NO: 1347156 - RNA, 22 nt, Human
gaaauucccuucaucuggaacc

SEQ ID NO: 1347157 - RNA, 21 nt, Human
gaaauucccuucaucuggaac

SEQ ID NO: 1347158 - RNA, 17 nt, Human
gaaauucccuucaucug

SEQ ID NO: 1347159 - RNA, 12 nt, Human
gaaauuccaaag

SEQ ID NO: 1347160 - RNA, 23 nt, Human
gaaauuaugugacauuuuacauu

SEQ ID NO: 1347161 - RNA, 22 nt, Human
gaaauuaugugacauuuuacau

SEQ ID NO: 1347162 - RNA, 23 nt, Human
gaaauuaguacuccccuccuuga

SEQ ID NO: 1347163 - RNA, 19 nt, Human
gaaauuaccuguggauauu

SEQ ID NO: 1347164 - RNA, 21 nt, Human
gaaauuuccugggagcuuuug

SEQ ID NO: 1347165 - RNA, 22 nt, Human
gaacaguuguguuugaagcaca

SEQ ID NO: 1347166 - RNA, 17 nt, Human
gaacaucccuuuuucaa

SEQ ID NO: 1347167 - RNA, 17 nt, Human
gaacaucugaguccugg

SEQ ID NO: 1347168 - RNA, 21 nt, Human
gaacaucugaguccuggauga

SEQ ID NO: 1347169 - RNA, 18 nt, Human
gaacaucugaguccugga

SEQ ID NO: 1347170 - RNA, 19 nt, Human
gaacauggccuaagggcca

SEQ ID NO: 1347171 - RNA, 15 nt, Human
gaacauggggaggag

SEQ ID NO: 1347172 - RNA, 19 nt, Human
gaacaugugagagguuuga

SEQ ID NO: 1347173 - RNA, 16 nt, Human
gaaccaaaucuggaag

SEQ ID NO: 1347174 - RNA, 17 nt, Human
gaaccaaaucuggaagc

SEQ ID NO: 1347175 - RNA, 24 nt, Human
gaaccaacaaccucaacugccuac

SEQ ID NO: 1347176 - RNA, 19 nt, Human
gaaccaacaaguaaauauu

SEQ ID NO: 1347177 - RNA, 15 nt, Human
gaaccaacacuaaca

SEQ ID NO: 1347178 - RNA, 24 nt, Human
gaacaguuaccucugccucagaaa

SEQ ID NO: 1347179 - RNA, 20 nt, Human
gaacaguuguguuugaagca

SEQ ID NO: 1347180 - RNA, 20 nt, Human
gaacagggaaaauaggcagg

SEQ ID NO: 1347181 - RNA, 21 nt, Human
gaacagggaaaauaggcagga

SEQ ID NO: 1347182 - RNA, 17 nt, Human
gaacaggauauucucac

SEQ ID NO: 1347183 - RNA, 20 nt, Human
gaacagcugguguagcuaca

SEQ ID NO: 1347184 - RNA, 22 nt, Human
gaacagcugguguagcuacaga

SEQ ID NO: 1347185 - RNA, 23 nt, Human
gaacagcugguguagcuacagag

SEQ ID NO: 1347186 - RNA, 24 nt, Human
gaacagcugguguagcuacagaga

SEQ ID NO: 1347187 - RNA, 15 nt, Human
gaacagcuguaaucu

SEQ ID NO: 1347188 - RNA, 15 nt, Human
gaacagcugguguag

SEQ ID NO: 1347189 - RNA, 19 nt, Human
gaacagcugguguagcuac

SEQ ID NO: 1347190 - RNA, 20 nt, Human
gaaagucagccauaucucca

SEQ ID NO: 1347191 - RNA, 19 nt, Human
gaaagucagauucuugcau

SEQ ID NO: 1347192 - RNA, 13 nt, Human
gaaagucuguccu

SEQ ID NO: 1347193 - RNA, 14 nt, Human
gaaagucuguccuu

SEQ ID NO: 1347194 - RNA, 23 nt, Human
gaaaggaagcauuguaaaauaau

SEQ ID NO: 1347195 - RNA, 21 nt, Human
gaaaggaagcauuguaaaaua

SEQ ID NO: 1347196 - RNA, 16 nt, Human
gaaaggaagcugugcg

SEQ ID NO: 1347197 - RNA, 12 nt, Human
gaaaggagaugu

SEQ ID NO: 1347198 - RNA, 23 nt, Human
gaaagccaaggagucacugagac

SEQ ID NO: 1347199 - RNA, 14 nt, Human
gaaaguuuacagga

SEQ ID NO: 1347200 - RNA, 16 nt, Human
gaaaguuuacaggaaa

SEQ ID NO: 1347201 - RNA, 16 nt, Human
gaaauaaaaggaagcc

SEQ ID NO: 1347202 - RNA, 17 nt, Human
gaaauaaaaggaagcca

SEQ ID NO: 1347203 - RNA, 18 nt, Human
gaaauaaaaggaagccaa

SEQ ID NO: 1347204 - RNA, 19 nt, Human
gaaauaaaaggaagccaaa

SEQ ID NO: 1347205 - RNA, 22 nt, Human
gaaagugagcaguguuagcuua

SEQ ID NO: 1347206 - RNA, 16 nt, Human
gaaagugagcaguguu

SEQ ID NO: 1347207 - RNA, 15 nt, Human
gaaagugagcagugu

SEQ ID NO: 1347208 - RNA, 13 nt, Human
gaaagugccugac

SEQ ID NO: 1347209 - RNA, 15 nt, Human
gaaagugccuuucag

SEQ ID NO: 1347210 - RNA, 16 nt, Human
gaaagugccuuucagg

SEQ ID NO: 1347211 - RNA, 15 nt, Human
gaaagucuguccuug

SEQ ID NO: 1347212 - RNA, 16 nt, Human
gaaagucuguccuuga

SEQ ID NO: 1347213 - RNA, 23 nt, Human
gaaagucuguccuugaaggacua

SEQ ID NO: 1347214 - RNA, 17 nt, Human
gaaagugccuuucagga

SEQ ID NO: 1347215 - RNA, 21 nt, Human
gaaagugccuuucaggaucua

SEQ ID NO: 1347216 - RNA, 22 nt, Human
gaaagugccuuucaggaucuau

SEQ ID NO: 1347217 - RNA, 17 nt, Human
gaaagugggcaaaagcu

SEQ ID NO: 1347218 - RNA, 18 nt, Human
gaaagugggcaaaagcuu

SEQ ID NO: 1347219 - RNA, 11 nt, Human
gaaaguguauu

SEQ ID NO: 1347220 - RNA, 15 nt, Human
gaaaguguauuugga

SEQ ID NO: 1347221 - RNA, 23 nt, Human
gaaaguguauuuggaaauaaagu

SEQ ID NO: 1347222 - RNA, 21 nt, Human
gaaacgagacuuuccauuaca

SEQ ID NO: 1347223 - RNA, 20 nt, Human
gaaacuaggugcauauuuau

SEQ ID NO: 1347224 - RNA, 23 nt, Human
gaaacgagacuuuccauuacaag

SEQ ID NO: 1347225 - RNA, 18 nt, Human
gaaacucauagacacuga

SEQ ID NO: 1347226 - RNA, 17 nt, Human
gaaaccuuccacccagu

SEQ ID NO: 1347227 - RNA, 15 nt, Human
gaaaccuuccaccca

SEQ ID NO: 1347228 - RNA, 12 nt, Human
gaaaaauguagg

SEQ ID NO: 1347229 - RNA, 14 nt, Human
gaaaaauguaggag

SEQ ID NO: 1347230 - RNA, 17 nt, Human
gaaaaauguaggagacu

SEQ ID NO: 1347231 - RNA, 20 nt, Human
gaaaaauguguauuuuaaga

SEQ ID NO: 1347232 - RNA, 20 nt, Human
gaaaaaucuaagugauauaa

SEQ ID NO: 1347233 - RNA, 21 nt, Human
gaaaaacuuuggaaccagacu

SEQ ID NO: 1347234 - RNA, 22 nt, Human
gaaaaacuuuggaaccagacuc

SEQ ID NO: 1347235 - RNA, 14 nt, Human
gaaaaagaagaauc

SEQ ID NO: 1347236 - RNA, 15 nt, Human
gaaaaagacauucag

SEQ ID NO: 1347237 - RNA, 12 nt, Human
gaaaaagaagca

SEQ ID NO: 1347238 - RNA, 22 nt, Human
gaaagauggcugugccucugcc

SEQ ID NO: 1347239 - RNA, 14 nt, Human
gaaagauaacuagg

SEQ ID NO: 1347240 - RNA, 17 nt, Human
gaaagauaauucacugu

SEQ ID NO: 1347241 - RNA, 16 nt, Human
gaaagagauacagagg

SEQ ID NO: 1347242 - RNA, 17 nt, Human
gaaagaguccauuguuu

SEQ ID NO: 1347243 - RNA, 14 nt, Human
gaaagcagaacagu

SEQ ID NO: 1347244 - RNA, 13 nt, Human
gaaagcagaacag

SEQ ID NO: 1347245 - RNA, 23 nt, Human
gaaagauggcugugccucugccu

SEQ ID NO: 1347246 - RNA, 12 nt, Human
gaaagcaaagca

SEQ ID NO: 1347247 - RNA, 15 nt, Human
gaaagcaaagcacag

SEQ ID NO: 1347248 - RNA, 16 nt, Human
gaaagcaaagcacaga

SEQ ID NO: 1347249 - RNA, 18 nt, Human
gaaagcaaagcacagaga

SEQ ID NO: 1347250 - RNA, 20 nt, Human
gaaagcaagaaucagagaag

SEQ ID NO: 1347251 - RNA, 18 nt, Human
gaaacugaggaauuuucu

SEQ ID NO: 1347252 - RNA, 22 nt, Human
gaaacugaggaauuuucuuugu

SEQ ID NO: 1347253 - RNA, 15 nt, Human
gaaacugcagggaaa

SEQ ID NO: 1347254 - RNA, 22 nt, Human
cuuuuaaaugauugaauuauau

SEQ ID NO: 1347255 - RNA, 23 nt, Human
cuuuuaaagaaaaaaauugaaau

SEQ ID NO: 1347256 - RNA, 15 nt, Human
cuuuuaaagaaaaaa

SEQ ID NO: 1347257 - RNA, 21 nt, Human
cuuuuaaagaaaaaaauugaa

SEQ ID NO: 1347258 - RNA, 22 nt, Human
cuuuuaaagaaaaaaauugaaa

SEQ ID NO: 1347259 - RNA, 15 nt, Human
cuuuuaaaagauuuu

SEQ ID NO: 1347260 - RNA, 17 nt, Human
cuuuuaaaccauuuucu

SEQ ID NO: 1347261 - RNA, 12 nt, Human
cuuuuaaacugu

SEQ ID NO: 1347262 - RNA, 13 nt, Human
cuuuuaaacugug

SEQ ID NO: 1347263 - RNA, 15 nt, Human
cuuuuaaacugugua

SEQ ID NO: 1347264 - RNA, 22 nt, Human
cuuuuaacuguuguagaagaca

SEQ ID NO: 1347265 - RNA, 22 nt, Human
cuuuuaacagagucugaaccua

SEQ ID NO: 1347266 - RNA, 22 nt, Human
cuuuggaguccccucaccuccu

SEQ ID NO: 1347267 - RNA, 14 nt, Human
cuuuggaguccccu

SEQ ID NO: 1347268 - RNA, 16 nt, Human
cuuuggaguccccuca

SEQ ID NO: 1347269 - RNA, 18 nt, Human
cuuuggaguccccucacc

SEQ ID NO: 1347270 - RNA, 18 nt, Human
cuuuuaaaacacuuccau

SEQ ID NO: 1347271 - RNA, 12 nt, Human
cuuuggacuugu

SEQ ID NO: 1347272 - RNA, 17 nt, Human
cuuuggaccuaauccaa

SEQ ID NO: 1347273 - RNA, 14 nt, Human
cuuuggaaccagac

SEQ ID NO: 1347274 - RNA, 15 nt, Human
cuuuggaaccagacu

SEQ ID NO: 1347275 - RNA, 16 nt, Human
cuuuggaaccagacuc

SEQ ID NO: 1347276 - RNA, 21 nt, Human
cuuuggaaccagacucuugcc

SEQ ID NO: 1347277 - RNA, 23 nt, Human
cuuuggaaccagacucuugccug

SEQ ID NO: 1347278 - RNA, 22 nt, Human
cuuuggaaccagacucuugccu

SEQ ID NO: 1347279 - RNA, 16 nt, Human
cuuuggaccuaaucca

SEQ ID NO: 1347280 - RNA, 12 nt, Human
cuuuucacugcu

SEQ ID NO: 1347281 - RNA, 15 nt, Human
cuuuuaaugaacaaa

SEQ ID NO: 1347282 - RNA, 16 nt, Human
cuuuuaaugaacaaau

SEQ ID NO: 1347283 - RNA, 18 nt, Human
cuuuuaaugaacaaaugg

SEQ ID NO: 1347284 - RNA, 21 nt, Human
cuuuucacauccauuuccccu

SEQ ID NO: 1347285 - RNA, 18 nt, Human
cuuuuccucucucccgga

SEQ ID NO: 1347286 - RNA, 15 nt, Human
cuuuuccuucccaaa

SEQ ID NO: 1347287 - RNA, 16 nt, Human
cuuuuccuucccuuuu

SEQ ID NO: 1347288 - RNA, 22 nt, Human
cuuuuccuucccuuuucuguuc

SEQ ID NO: 1347289 - RNA, 20 nt, Human
cuuuuccuucccuuuucugu

SEQ ID NO: 1347290 - RNA, 16 nt, Human
cuuuucacugcuggcu

SEQ ID NO: 1347291 - RNA, 13 nt, Human
cuuuucauuugug

SEQ ID NO: 1347292 - RNA, 14 nt, Human
cuuuucccuucuuu

SEQ ID NO: 1347293 - RNA, 19 nt, Human
cuuuucccuuugugaguca

SEQ ID NO: 1347294 - RNA, 16 nt, Human
cuuuuccucucucccg

SEQ ID NO: 1347295 - RNA, 16 nt, Human
cuuuuuucaaaagaaa

SEQ ID NO: 1347296 - RNA, 19 nt, Human
cuuuuuuaucaugugaaau

SEQ ID NO: 1347297 - RNA, 22 nt, Human
cuuuuuccaacucagaaauuca

SEQ ID NO: 1347298 - RNA, 21 nt, Human
cuuuuucuccagcugggcucu

SEQ ID NO: 1347299 - RNA, 13 nt, Human
cuuuuuccagagg

SEQ ID NO: 1347300 - RNA, 20 nt, Human
cuuuuuauauauauauauaa

SEQ ID NO: 1347301 - RNA, 12 nt, Human
cuuuuucauuua

SEQ ID NO: 1347302 - RNA, 13 nt, Human
cuuuuucauuuau

SEQ ID NO: 1347303 - RNA, 15 nt, Human
cuuuuucauuuaucu

SEQ ID NO: 1347304 - RNA, 23 nt, Human
cuuuuucauuuaucuauaauuua

SEQ ID NO: 1347305 - RNA, 14 nt, Human
cuuuuuauauauau

SEQ ID NO: 1347306 - RNA, 17 nt, Human
cuuuuuccaacaagaag

SEQ ID NO: 1347307 - RNA, 23 nt, Human
cuuuuuccaacuuggcugcagga

SEQ ID NO: 1347308 - RNA, 15 nt, Human
cuuuuuaauaugcuu

SEQ ID NO: 1347309 - RNA, 16 nt, Human
cuuuuuaauaugcuua

SEQ ID NO: 1347310 - RNA, 22 nt, Human
cuuuuuacccauuuguucauau

SEQ ID NO: 1347311 - RNA, 15 nt, Human
cuuuuuaccuuucau

SEQ ID NO: 1347312 - RNA, 20 nt, Human
cuuuuuaccaaguuucaggu

SEQ ID NO: 1347313 - RNA, 17 nt, Human
cuuuuuaccuuucauac

SEQ ID NO: 1347314 - RNA, 16 nt, Human
cuuuuuaccuuucaua

SEQ ID NO: 1347315 - RNA, 18 nt, Human
cuuuugcaacuuaauacu

SEQ ID NO: 1347316 - RNA, 18 nt, Human
cuuuuuaaaguucaaacu

SEQ ID NO: 1347317 - RNA, 20 nt, Human
cuuuuuaaauguaaagauau

SEQ ID NO: 1347318 - RNA, 21 nt, Human
cuuuuuaaauguaaagauauu

SEQ ID NO: 1347319 - RNA, 14 nt, Human
cuuuuuaauaugcu

SEQ ID NO: 1347320 - RNA, 15 nt, Human
cuuuugauaugcaua

SEQ ID NO: 1347321 - RNA, 23 nt, Human
cuuuugauaugcauauuuguuua

SEQ ID NO: 1347322 - RNA, 16 nt, Human
cuuuugauauuaaauu

SEQ ID NO: 1347323 - RNA, 13 nt, Human
cuuuugauauuaa

SEQ ID NO: 1347324 - RNA, 20 nt, Human
cuuuugcaaagaaagaaaaa

SEQ ID NO: 1347325 - RNA, 21 nt, Human
cuuuugcaaagaaagaaaaaa

SEQ ID NO: 1347326 - RNA, 15 nt, Human
cuuuugcaaccagga

SEQ ID NO: 1347327 - RNA, 16 nt, Human
cuuuugcaaccaggaa

SEQ ID NO: 1347328 - RNA, 17 nt, Human
cuuuugcaaccaggaac

SEQ ID NO: 1347329 - RNA, 24 nt, Human
cuuuugcaaccaggaacagcaaau

SEQ ID NO: 1347330 - RNA, 16 nt, Human
cuuuucuaacagaaag

SEQ ID NO: 1347331 - RNA, 20 nt, Human
cuuuucuaacagaaagcaug

SEQ ID NO: 1347332 - RNA, 21 nt, Human
cuuucuuucaauaaaacgcag

SEQ ID NO: 1347333 - RNA, 13 nt, Human
cuuucuuucuuua

SEQ ID NO: 1347334 - RNA, 15 nt, Human
cuuucuuuauuuuga

SEQ ID NO: 1347335 - RNA, 18 nt, Human
cuuucuuuguuuggcugg

SEQ ID NO: 1347336 - RNA, 22 nt, Human
cuuucuuuucuggaauguaauc

SEQ ID NO: 1347337 - RNA, 20 nt, Human
cuuugaaauuauguaaauua

SEQ ID NO: 1347338 - RNA, 18 nt, Human
cuuugaaauugaaccuuu

SEQ ID NO: 1347339 - RNA, 23 nt, Human
cuuugaaauugaaccuuugugcc

SEQ ID NO: 1347340 - RNA, 20 nt, Human
cuuugaaauugaaccuuugu

SEQ ID NO: 1347341 - RNA, 16 nt, Human
cuuugaaggggccuca

SEQ ID NO: 1347342 - RNA, 13 nt, Human
cuuucuuccaaac

SEQ ID NO: 1347343 - RNA, 19 nt, Human
cuuucuuccaaacaggcuc

SEQ ID NO: 1347344 - RNA, 22 nt, Human
cuuucuuccaaacaggcucaga

SEQ ID NO: 1347345 - RNA, 23 nt, Human
cuuucuguuccaaauucaguuuc

SEQ ID NO: 1347346 - RNA, 21 nt, Human
cuuugccacccucaugcugug

SEQ ID NO: 1347347 - RNA, 13 nt, Human
cuuugccagguga

SEQ ID NO: 1347348 - RNA, 16 nt, Human
cuuugcacugauauau

SEQ ID NO: 1347349 - RNA, 21 nt, Human
cuuugccaggugacugucugg

SEQ ID NO: 1347350 - RNA, 22 nt, Human
cuuugccaggugacugucuggg

SEQ ID NO: 1347351 - RNA, 15 nt, Human
cuuugcccagaaaga

SEQ ID NO: 1347352 - RNA, 18 nt, Human
cuuugcccaguuggagac

SEQ ID NO: 1347353 - RNA, 18 nt, Human
cuuugcccugcugcccuc

SEQ ID NO: 1347354 - RNA, 20 nt, Human
cuuugcccugcugcccuccc

SEQ ID NO: 1347355 - RNA, 22 nt, Human
cuuugcccugcugcccuccccc

SEQ ID NO: 1347356 - RNA, 19 nt, Human
cuuugcccuucuuucuacc

SEQ ID NO: 1347357 - RNA, 16 nt, Human
cuuugcccuucuuucu

SEQ ID NO: 1347358 - RNA, 11 nt, Human
cuuugccucaa

SEQ ID NO: 1347359 - RNA, 22 nt, Human
cuuuggaaaguacacucugcug

SEQ ID NO: 1347360 - RNA, 23 nt, Human
cuuuggaaaguacacucugcugu

SEQ ID NO: 1347361 - RNA, 24 nt, Human
cuuuggaaaguacacucugcuguu

SEQ ID NO: 1347362 - RNA, 23 nt, Human
cuuugaauguguuucacaguuug

SEQ ID NO: 1347363 - RNA, 18 nt, Human
cuuugaauguguuucaca

SEQ ID NO: 1347364 - RNA, 18 nt, Human
cuuugaaggggccucacc

SEQ ID NO: 1347365 - RNA, 13 nt, Human
cuuugaaguagcu

SEQ ID NO: 1347366 - RNA, 17 nt, Human
cuuugaaguagcucuuu

SEQ ID NO: 1347367 - RNA, 16 nt, Human
cuuugaagucauacca

SEQ ID NO: 1347368 - RNA, 11 nt, Human
cuuugaauaaa

SEQ ID NO: 1347369 - RNA, 21 nt, Human
cuuugaaguuagcuuuaacuu

SEQ ID NO: 1347370 - RNA, 12 nt, Human
cuuugaauaaau

SEQ ID NO: 1347371 - RNA, 14 nt, Human
cuuugaauaaaugu

SEQ ID NO: 1347372 - RNA, 16 nt, Human
cuuugaauaaauguca

SEQ ID NO: 1347373 - RNA, 18 nt, Human
cuuugaauaaaugucacu

SEQ ID NO: 1347374 - RNA, 19 nt, Human
cuuugaauaaaugucacuu

SEQ ID NO: 1347375 - RNA, 18 nt, Human
cuuugaauccucucucug

SEQ ID NO: 1347376 - RNA, 19 nt, Human
cuuugaauccucucucugu

SEQ ID NO: 1347377 - RNA, 23 nt, Human
cuuugaauccucucucuguguua

SEQ ID NO: 1347378 - RNA, 14 nt, Human
cuuugaauguguuu

SEQ ID NO: 1347379 - RNA, 16 nt, Human
cuuugaauguguuuca

SEQ ID NO: 1347380 - RNA, 19 nt, Human
cuuuauuuuguguuuagga

SEQ ID NO: 1347381 - RNA, 22 nt, Human
cuuguguguaugcacaugaacu

SEQ ID NO: 1347382 - RNA, 13 nt, Human
cuuuauuuugaga

SEQ ID NO: 1347383 - RNA, 14 nt, Human
cuugucaugugaca

SEQ ID NO: 1347384 - RNA, 17 nt, Human
cuugugucucugugcuu

SEQ ID NO: 1347385 - RNA, 18 nt, Human
cuugugucucugugcuuu

SEQ ID NO: 1347386 - RNA, 21 nt, Human
cuugugucucugugcuuuuaa

SEQ ID NO: 1347387 - RNA, 10 nt, Human
cuugugucug

SEQ ID NO: 1347388 - RNA, 20 nt, Human
cuuguguguaugcacaugaa

SEQ ID NO: 1347389 - RNA, 21 nt, Human
cuuguguguaugcacaugaac

SEQ ID NO: 1347390 - RNA, 11 nt, Human
cuuuauuuuga

SEQ ID NO: 1347391 - RNA, 19 nt, Human
cuuucaaaaccuuuugaaa

SEQ ID NO: 1347392 - RNA, 20 nt, Human
cuuucaaaggagaaugaauc

SEQ ID NO: 1347393 - RNA, 19 nt, Human
cuuucaagcagucgugccu

SEQ ID NO: 1347394 - RNA, 20 nt, Human
cuuucaagcagucgugccug

SEQ ID NO: 1347395 - RNA, 22 nt, Human
cuuucaagcagucgugccugug

SEQ ID NO: 1347396 - RNA, 23 nt, Human
cuuucaagcagucgugccugugu

SEQ ID NO: 1347397 - RNA, 20 nt, Human
cuuucaagucaguucuguga

SEQ ID NO: 1347398 - RNA, 17 nt, Human
cuuucaauacagauaua

SEQ ID NO: 1347399 - RNA, 17 nt, Human
cuuucauguaaacugug

SEQ ID NO: 1347400 - RNA, 19 nt, Human
cuuucauguaaacugugca

SEQ ID NO: 1347401 - RNA, 20 nt, Human
cuuucauguaaacugugcac

SEQ ID NO: 1347402 - RNA, 21 nt, Human
cuuucauguaaacugugcacc

SEQ ID NO: 1347403 - RNA, 17 nt, Human
cuuucccauggggaggg

SEQ ID NO: 1347404 - RNA, 18 nt, Human
cuuuccccaccagaugcu

SEQ ID NO: 1347405 - RNA, 22 nt, Human
cuuuccccaccagaugcugaaa

SEQ ID NO: 1347406 - RNA, 19 nt, Human
cuuuccccaccagaugcug

SEQ ID NO: 1347407 - RNA, 15 nt, Human
cuuuccccaugucuc

SEQ ID NO: 1347408 - RNA, 20 nt, Human
cuuuccccaugucucgacuc

SEQ ID NO: 1347409 - RNA, 21 nt, Human
cuuuccccaugucucgacuca

SEQ ID NO: 1347410 - RNA, 19 nt, Human
cuuuccucaaaacuucaga

SEQ ID NO: 1347411 - RNA, 21 nt, Human
cuuuccgguguuuaagacauu

SEQ ID NO: 1347412 - RNA, 21 nt, Human
cuuucccuuguagcuccuccc

SEQ ID NO: 1347413 - RNA, 23 nt, Human
cuuucccuuguagcuccuccccu

SEQ ID NO: 1347414 - RNA, 18 nt, Human
cuuucauuccuucagauu

SEQ ID NO: 1347415 - RNA, 21 nt, Human
cuuuccacggagccacuccuc

SEQ ID NO: 1347416 - RNA, 22 nt, Human
cuuuccacggagccacuccucu

SEQ ID NO: 1347417 - RNA, 13 nt, Human
cuuguauuaugug

SEQ ID NO: 1347418 - RNA, 18 nt, Human
cuuguauccccugcaggc

SEQ ID NO: 1347419 - RNA, 21 nt, Human
cuuguaugaaagauggcugug

SEQ ID NO: 1347420 - RNA, 14 nt, Human
cuuguaagacccuu

SEQ ID NO: 1347421 - RNA, 13 nt, Human
cuuguaaauauaa

SEQ ID NO: 1347422 - RNA, 14 nt, Human
cuuguaaauauaaa

SEQ ID NO: 1347423 - RNA, 16 nt, Human
cuuguaaauauaaaga

SEQ ID NO: 1347424 - RNA, 17 nt, Human
cuuguaaauauaaagac

SEQ ID NO: 1347425 - RNA, 23 nt, Human
cuuguaaauuauuaauuuaugca

SEQ ID NO: 1347426 - RNA, 14 nt, Human
cuuguaacuaaaau

SEQ ID NO: 1347427 - RNA, 16 nt, Human
cuuguaacuaaaauaa

SEQ ID NO: 1347428 - RNA, 17 nt, Human
cuuguaacuaaaauaau

SEQ ID NO: 1347429 - RNA, 22 nt, Human
cuuguaacuaaaauaauuuugu

SEQ ID NO: 1347430 - RNA, 19 nt, Human
cuuguaaauauaaagacgu

SEQ ID NO: 1347431 - RNA, 18 nt, Human
cuuguauuauguguguuu

SEQ ID NO: 1347432 - RNA, 16 nt, Human
cuuguauuccaagcau

SEQ ID NO: 1347433 - RNA, 20 nt, Human
cuuguauuccaagcauauaa

SEQ ID NO: 1347434 - RNA, 23 nt, Human
cuugucacgccagacuucccacg

SEQ ID NO: 1347435 - RNA, 15 nt, Human
cuugucacugguaga

SEQ ID NO: 1347436 - RNA, 23 nt, Human
cuugucacugguagaccaaaaua

SEQ ID NO: 1347437 - RNA, 22 nt, Human
cuugucacugguagaccaaaau

SEQ ID NO: 1347438 - RNA, 17 nt, Human
cuugucaggagugugug

SEQ ID NO: 1347439 - RNA, 21 nt, Human
cuugucaggagugugugugag

SEQ ID NO: 1347440 - RNA, 20 nt, Human
cuugucaggaguguguguga

SEQ ID NO: 1347441 - RNA, 18 nt, Human
cuuguaaaggaauuuaaa

SEQ ID NO: 1347442 - RNA, 23 nt, Human
cuugguuuuuacugcucugagaa

SEQ ID NO: 1347443 - RNA, 12 nt, Human
cuuguaaauaua

SEQ ID NO: 1347444 - RNA, 18 nt, Human
cuuguaaaaauuaaaagu

SEQ ID NO: 1347445 - RNA, 21 nt, Human
cuugguuuuuacugcucugag

SEQ ID NO: 1347446 - RNA, 22 nt, Human
cuugguuuuuacugcucugaga

SEQ ID NO: 1347447 - RNA, 21 nt, Human
cuugguuuugcuacauaauua

SEQ ID NO: 1347448 - RNA, 20 nt, Human
cuugguuuuuacugcucuga

SEQ ID NO: 1347449 - RNA, 22 nt, Human
cuuggggaguuaagaccuggca

SEQ ID NO: 1347450 - RNA, 23 nt, Human
cuuggggaguuaagaccuggcag

SEQ ID NO: 1347451 - RNA, 20 nt, Human
cuuggggaguuuaggguggg

SEQ ID NO: 1347452 - RNA, 21 nt, Human
cuuggggaguuuagggugggg

SEQ ID NO: 1347453 - RNA, 15 nt, Human
cuuggggccuaugca

SEQ ID NO: 1347454 - RNA, 19 nt, Human
cuuggggauucuuccaucu

SEQ ID NO: 1347455 - RNA, 21 nt, Human
cuuggggauucuuccaucuga

SEQ ID NO: 1347456 - RNA, 13 nt, Human
cuuggcugcagga

SEQ ID NO: 1347457 - RNA, 12 nt, Human
cuuggcuggugu

SEQ ID NO: 1347458 - RNA, 13 nt, Human
cuuggcuggugug

SEQ ID NO: 1347459 - RNA, 14 nt, Human
cuuggcuggugugg

SEQ ID NO: 1347460 - RNA, 20 nt, Human
cuuggcuggugugguacaga

SEQ ID NO: 1347461 - RNA, 21 nt, Human
cuuggcuggugugguacagag

SEQ ID NO: 1347462 - RNA, 22 nt, Human
cuuggcuggugugguacagaga

SEQ ID NO: 1347463 - RNA, 23 nt, Human
cuuggcuggugugguacagagaa

SEQ ID NO: 1347464 - RNA, 17 nt, Human
cuugccaaauauaaaua

SEQ ID NO: 1347465 - RNA, 13 nt, Human
cuugcauguaacg

SEQ ID NO: 1347466 - RNA, 13 nt, Human
cuugcuggaagac

SEQ ID NO: 1347467 - RNA, 15 nt, Human
cuugcuuuuaaaauc

SEQ ID NO: 1347468 - RNA, 13 nt, Human
cuugcuuuucaug

SEQ ID NO: 1347469 - RNA, 14 nt, Human
cuugcuuuucaugc

SEQ ID NO: 1347470 - RNA, 15 nt, Human
cuuggacauccuccu

SEQ ID NO: 1347471 - RNA, 16 nt, Human
cuuggacauccuccuc

SEQ ID NO: 1347472 - RNA, 17 nt, Human
cuuggacauccuccucc

SEQ ID NO: 1347473 - RNA, 19 nt, Human
cuuggacauccuccuccca

SEQ ID NO: 1347474 - RNA, 20 nt, Human
cuuggacauccuccucccac

SEQ ID NO: 1347475 - RNA, 21 nt, Human
cuuggacauccuccucccacc

SEQ ID NO: 1347476 - RNA, 22 nt, Human
cuuggacauccuccucccaccc

SEQ ID NO: 1347477 - RNA, 16 nt, Human
cuugcuggucuaguca

SEQ ID NO: 1347478 - RNA, 18 nt, Human
cuugcuuggggaacuugu

SEQ ID NO: 1347479 - RNA, 21 nt, Human
cuugcuuucuuuguuuggcug

SEQ ID NO: 1347480 - RNA, 23 nt, Human
cuuggcucacacucgacaugaaa

SEQ ID NO: 1347481 - RNA, 18 nt, Human
cuuggcucgaaucucugu

SEQ ID NO: 1347482 - RNA, 19 nt, Human
cuuggcucgaaucucugug

SEQ ID NO: 1347483 - RNA, 20 nt, Human
cuuggcucgaaucucugugc

SEQ ID NO: 1347484 - RNA, 21 nt, Human
cuuggcucgaaucucugugcc

SEQ ID NO: 1347485 - RNA, 22 nt, Human
cuuggcucgaaucucugugccu

SEQ ID NO: 1347486 - RNA, 19 nt, Human
cuuggagcuauuuuccagg

SEQ ID NO: 1347487 - RNA, 20 nt, Human
cuuggagcuauuuuccaggc

SEQ ID NO: 1347488 - RNA, 16 nt, Human
cuuggauacuuggauu

SEQ ID NO: 1347489 - RNA, 18 nt, Human
cuuggauguaccugcccc

SEQ ID NO: 1347490 - RNA, 17 nt, Human
cuuggauuccugauagu

SEQ ID NO: 1347491 - RNA, 16 nt, Human
cuuggauucuuuccau

SEQ ID NO: 1347492 - RNA, 17 nt, Human
cuuggauucuuuccauu

SEQ ID NO: 1347493 - RNA, 18 nt, Human
cuuggauucuuuccauuu

SEQ ID NO: 1347494 - RNA, 21 nt, Human
cuuggauucuuuccauuugca

SEQ ID NO: 1347495 - RNA, 18 nt, Human
cuugcuuuucaugcaaac

SEQ ID NO: 1347496 - RNA, 20 nt, Human
cuugaacccgggaggcagag

SEQ ID NO: 1347497 - RNA, 19 nt, Human
cuugaacccgggaggcaga

SEQ ID NO: 1347498 - RNA, 14 nt, Human
cuugaacugauuca

SEQ ID NO: 1347499 - RNA, 13 nt, Human
cuugaccaggcug

SEQ ID NO: 1347500 - RNA, 20 nt, Human
cuugaaauuaagaaggcaaa

SEQ ID NO: 1347501 - RNA, 13 nt, Human
cuugaaauuuuaa

SEQ ID NO: 1347502 - RNA, 14 nt, Human
cuugaaauuuuaac

SEQ ID NO: 1347503 - RNA, 13 nt, Human
cuucuuuccacag

SEQ ID NO: 1347504 - RNA, 19 nt, Human
cuucuuuccacagaagcuc

SEQ ID NO: 1347505 - RNA, 17 nt, Human
cuucuuucauuucuucu

SEQ ID NO: 1347506 - RNA, 16 nt, Human
cuucuuucugucuuua

SEQ ID NO: 1347507 - RNA, 17 nt, Human
cuucuuucugucuuuaa

SEQ ID NO: 1347508 - RNA, 16 nt, Human
cuucuuucuagaaaga

SEQ ID NO: 1347509 - RNA, 20 nt, Human
cuucuuuuuucaaaagaaag

SEQ ID NO: 1347510 - RNA, 19 nt, Human
cuucuuuuuucaaaagaaa

SEQ ID NO: 1347511 - RNA, 17 nt, Human
cuucuuuuuuugugaug

SEQ ID NO: 1347512 - RNA, 18 nt, Human
cuugaaauauccugcuug

SEQ ID NO: 1347513 - RNA, 19 nt, Human
cuugaaauauccugcuuga

SEQ ID NO: 1347514 - RNA, 21 nt, Human
cuugaaauuaagaaggcaaaa

SEQ ID NO: 1347515 - RNA, 19 nt, Human
cuucuuuuaaaccauuuuc

SEQ ID NO: 1347516 - RNA, 13 nt, Human
cuucuuuugcucu

SEQ ID NO: 1347517 - RNA, 14 nt, Human
cuucuuuugcucuu

SEQ ID NO: 1347518 - RNA, 13 nt, Human
cuucuuuugugaa

SEQ ID NO: 1347519 - RNA, 18 nt, Human
cuugaggacacaugucca

SEQ ID NO: 1347520 - RNA, 17 nt, Human
cuugaggacacaugucc

SEQ ID NO: 1347521 - RNA, 18 nt, Human
cuugagccaggaggccug

SEQ ID NO: 1347522 - RNA, 18 nt, Human
cuugagggcaagagccac

SEQ ID NO: 1347523 - RNA, 18 nt, Human
cuugaggucucagccccu

SEQ ID NO: 1347524 - RNA, 16 nt, Human
cuugaggacacauguc

SEQ ID NO: 1347525 - RNA, 15 nt, Human
cuugaggacacaugu

SEQ ID NO: 1347526 - RNA, 14 nt, Human
cuugaggacacaug

SEQ ID NO: 1347527 - RNA, 13 nt, Human
cuugaggacacau

SEQ ID NO: 1347528 - RNA, 12 nt, Human
cuugaggacaca

SEQ ID NO: 1347529 - RNA, 21 nt, Human
cuugagcaguggcugguccag

SEQ ID NO: 1347530 - RNA, 16 nt, Human
cuugagcauguuacug

SEQ ID NO: 1347531 - RNA, 22 nt, Human
cuugagcauguuacugacagag

SEQ ID NO: 1347532 - RNA, 13 nt, Human
cuugagccaguaa

SEQ ID NO: 1347533 - RNA, 16 nt, Human
cuugagccaguaauug

SEQ ID NO: 1347534 - RNA, 21 nt, Human
cuugaccaggcugccucccuu

SEQ ID NO: 1347535 - RNA, 13 nt, Human
cuugagcaguggc

SEQ ID NO: 1347536 - RNA, 14 nt, Human
cuugagcaguggcu

SEQ ID NO: 1347537 - RNA, 16 nt, Human
cuugagcaguggcugg

SEQ ID NO: 1347538 - RNA, 23 nt, Human
cuugcaggaaggacuaugaaaag

SEQ ID NO: 1347539 - RNA, 19 nt, Human
cuugcaguaucggcacugu

SEQ ID NO: 1347540 - RNA, 20 nt, Human
cuugcaguaucggcacugua

SEQ ID NO: 1347541 - RNA, 18 nt, Human
cuugcaguaucggcacug

SEQ ID NO: 1347542 - RNA, 21 nt, Human
cuugcaugguuuagaaagcuu

SEQ ID NO: 1347543 - RNA, 13 nt, Human
cuugcaugcuugc

SEQ ID NO: 1347544 - RNA, 21 nt, Human
cuugagugggguuaucucugu

SEQ ID NO: 1347545 - RNA, 23 nt, Human
cuugagugggguuaucucugugu

SEQ ID NO: 1347546 - RNA, 22 nt, Human
cuugagugggguuaucucugug

SEQ ID NO: 1347547 - RNA, 20 nt, Human
cuugcacgaccgccccaguu

SEQ ID NO: 1347548 - RNA, 19 nt, Human
cuugcacgaccgccccagu

SEQ ID NO: 1347549 - RNA, 22 nt, Human
cuguaccuuuugaggagcccca

SEQ ID NO: 1347550 - RNA, 20 nt, Human
cuguauagcugcuuccagug

SEQ ID NO: 1347551 - RNA, 14 nt, Human
cuguaccugagagg

SEQ ID NO: 1347552 - RNA, 20 nt, Human
cuguaccuuuugaggagccc

SEQ ID NO: 1347553 - RNA, 15 nt, Human
cuguaugauucccag

SEQ ID NO: 1347554 - RNA, 13 nt, Human
cuguauauacuuu

SEQ ID NO: 1347555 - RNA, 23 nt, Human
cuguaugaucaaauguuuaauca

SEQ ID NO: 1347556 - RNA, 16 nt, Human
cuguaugucuuaaaac

SEQ ID NO: 1347557 - RNA, 16 nt, Human
cuguauguucaacuag

SEQ ID NO: 1347558 - RNA, 15 nt, Human
cuguauuaagccacu

SEQ ID NO: 1347559 - RNA, 18 nt, Human
cuguauuugaaauaagaa

SEQ ID NO: 1347560 - RNA, 22 nt, Human
cuguauuugaaauaagaauuca

SEQ ID NO: 1347561 - RNA, 18 nt, Human
cuguauuugaaucagccu

SEQ ID NO: 1347562 - RNA, 13 nt, Human
cuguauuuuaaaa

SEQ ID NO: 1347563 - RNA, 16 nt, Human
cuguauuuuaaaagaa

SEQ ID NO: 1347564 - RNA, 15 nt, Human
cuguauuuguuccca

SEQ ID NO: 1347565 - RNA, 16 nt, Human
cuguauuuguucccaa

SEQ ID NO: 1347566 - RNA, 17 nt, Human
cuguauuuguucccaag

SEQ ID NO: 1347567 - RNA, 18 nt, Human
cuguauuuguucccaaga

SEQ ID NO: 1347568 - RNA, 19 nt, Human
cuguauuuguucccaagag

SEQ ID NO: 1347569 - RNA, 19 nt, Human
cuguauuuuaaaagaauga

SEQ ID NO: 1347570 - RNA, 14 nt, Human
cugucccaccccca

SEQ ID NO: 1347571 - RNA, 16 nt, Human
cugucccacccccacc

SEQ ID NO: 1347572 - RNA, 18 nt, Human
cuguccaggcacugcugc

SEQ ID NO: 1347573 - RNA, 19 nt, Human
cuguccaggcacugcugcc

SEQ ID NO: 1347574 - RNA, 17 nt, Human
cuguccacaggcuucug

SEQ ID NO: 1347575 - RNA, 22 nt, Human
cuguccacaggcuucugagcag

SEQ ID NO: 1347576 - RNA, 12 nt, Human
cuguccagaaag

SEQ ID NO: 1347577 - RNA, 20 nt, Human
cuguccaggcacugcugccc

SEQ ID NO: 1347578 - RNA, 21 nt, Human
cuguccaggcacugcugccca

SEQ ID NO: 1347579 - RNA, 22 nt, Human
cuguccaggcacugcugcccag

SEQ ID NO: 1347580 - RNA, 23 nt, Human
cuguccaggcacugcugcccagc

SEQ ID NO: 1347581 - RNA, 23 nt, Human
cugucccuugccccccuggccuc

SEQ ID NO: 1347582 - RNA, 18 nt, Human
cugucucaagagggcacu

SEQ ID NO: 1347583 - RNA, 19 nt, Human
cugucucaagagggcacug

SEQ ID NO: 1347584 - RNA, 20 nt, Human
cugucucaagagggcacugg

SEQ ID NO: 1347585 - RNA, 21 nt, Human
cugucucaagagggcacuggu

SEQ ID NO: 1347586 - RNA, 13 nt, Human
cuguccucagccu

SEQ ID NO: 1347587 - RNA, 12 nt, Human
cugucucaucca

SEQ ID NO: 1347588 - RNA, 15 nt, Human
cugucucauccauca

SEQ ID NO: 1347589 - RNA, 16 nt, Human
cugucucauccaucau

SEQ ID NO: 1347590 - RNA, 17 nt, Human
cugucucauccaucauc

SEQ ID NO: 1347591 - RNA, 20 nt, Human
cugucucauccaucaucaug

SEQ ID NO: 1347592 - RNA, 21 nt, Human
cugucucauccaucaucaugu

SEQ ID NO: 1347593 - RNA, 18 nt, Human
cugucucuacuaaaaaua

SEQ ID NO: 1347594 - RNA, 15 nt, Human
cugucucgagcgccc

SEQ ID NO: 1347595 - RNA, 16 nt, Human
cugucucgagcgcccu

SEQ ID NO: 1347596 - RNA, 17 nt, Human
cugucucgagcgcccug

SEQ ID NO: 1347597 - RNA, 18 nt, Human
cugucucgagcgcccugc

SEQ ID NO: 1347598 - RNA, 19 nt, Human
cugucucgagcgcccugca

SEQ ID NO: 1347599 - RNA, 20 nt, Human
cugucucgagcgcccugcag

SEQ ID NO: 1347600 - RNA, 21 nt, Human
cugucucgagcgcccugcaga

SEQ ID NO: 1347601 - RNA, 23 nt, Human
cugucucgagcgcccugcagacc

SEQ ID NO: 1347602 - RNA, 22 nt, Human
cugucucgagcgcccugcagac

SEQ ID NO: 1347603 - RNA, 19 nt, Human
cugucucucagggccaggc

SEQ ID NO: 1347604 - RNA, 20 nt, Human
cugucucucagggccaggcc

SEQ ID NO: 1347605 - RNA, 13 nt, Human
cugucucucauga

SEQ ID NO: 1347606 - RNA, 17 nt, Human
cugucucucaugaaccu

SEQ ID NO: 1347607 - RNA, 12 nt, Human
cuguccccagcc

SEQ ID NO: 1347608 - RNA, 14 nt, Human
cuguccccagccug

SEQ ID NO: 1347609 - RNA, 16 nt, Human
cuguccccagccuggg

SEQ ID NO: 1347610 - RNA, 15 nt, Human
cuguccccagccugg

SEQ ID NO: 1347611 - RNA, 13 nt, Human
cuguccccccacu

SEQ ID NO: 1347612 - RNA, 15 nt, Human
cuguccccccacucc

SEQ ID NO: 1347613 - RNA, 16 nt, Human
cuguccccccacuccc

SEQ ID NO: 1347614 - RNA, 21 nt, Human
cuguccccccacucccucaca

SEQ ID NO: 1347615 - RNA, 11 nt, Human
cugucccuagg

SEQ ID NO: 1347616 - RNA, 15 nt, Human
cugucccucccccuu

SEQ ID NO: 1347617 - RNA, 12 nt, Human
cugucccuccgg

SEQ ID NO: 1347618 - RNA, 17 nt, Human
cugucccuccgggaccu

SEQ ID NO: 1347619 - RNA, 18 nt, Human
cugucccuugccccccug

SEQ ID NO: 1347620 - RNA, 20 nt, Human
cugucccuugccccccuggc

SEQ ID NO: 1347621 - RNA, 21 nt, Human
cugucccuugccccccuggcc

SEQ ID NO: 1347622 - RNA, 22 nt, Human
cugucccuugccccccuggccu

SEQ ID NO: 1347623 - RNA, 13 nt, Human
cugucccuugccu

SEQ ID NO: 1347624 - RNA, 15 nt, Human
cugucccuugccuca

SEQ ID NO: 1347625 - RNA, 16 nt, Human
cugucccuugccucaa

SEQ ID NO: 1347626 - RNA, 20 nt, Human
cugucccuugccucaaugcc

SEQ ID NO: 1347627 - RNA, 21 nt, Human
cugucccuugccucaaugcca

SEQ ID NO: 1347628 - RNA, 22 nt, Human
cugggucgcccuggacugugug

SEQ ID NO: 1347629 - RNA, 23 nt, Human
cugggucucaccggcucucaccu

SEQ ID NO: 1347630 - RNA, 13 nt, Human
cugggucucuaau

SEQ ID NO: 1347631 - RNA, 19 nt, Human
cugggucucaccggcucuc

SEQ ID NO: 1347632 - RNA, 18 nt, Human
cugggucgcccuggacug

SEQ ID NO: 1347633 - RNA, 17 nt, Human
cugggucgcccuggacu

SEQ ID NO: 1347634 - RNA, 14 nt, Human
cuggguugggauca

SEQ ID NO: 1347635 - RNA, 16 nt, Human
cuggguugggaucagg

SEQ ID NO: 1347636 - RNA, 23 nt, Human
cuggguugggaucagggguagga

SEQ ID NO: 1347637 - RNA, 20 nt, Human
cugggccuauggagagcccu

SEQ ID NO: 1347638 - RNA, 21 nt, Human
cugggccuauggagagcccug

SEQ ID NO: 1347639 - RNA, 23 nt, Human
cugggccuauggagagcccuggg

SEQ ID NO: 1347640 - RNA, 22 nt, Human
cugggccuauggagagcccugg

SEQ ID NO: 1347641 - RNA, 22 nt, Human
cugggcuccggaggacucacca

SEQ ID NO: 1347642 - RNA, 15 nt, Human
cugguccaaaagauu

SEQ ID NO: 1347643 - RNA, 22 nt, Human
cugguccaaaagauugcugaaa

SEQ ID NO: 1347644 - RNA, 20 nt, Human
cuggucacaggacucugccu

SEQ ID NO: 1347645 - RNA, 21 nt, Human
cuggucacaggacucugccuc

SEQ ID NO: 1347646 - RNA, 22 nt, Human
cuggucacaggacucugccucc

SEQ ID NO: 1347647 - RNA, 23 nt, Human
cuggucacaggacucugccuccu

SEQ ID NO: 1347648 - RNA, 14 nt, Human
cuggucaccuagga

SEQ ID NO: 1347649 - RNA, 16 nt, Human
cuggucaccuaggaag

SEQ ID NO: 1347650 - RNA, 17 nt, Human
cuggucaccuaggaagc

SEQ ID NO: 1347651 - RNA, 18 nt, Human
cuggucaccuaggaagcc

SEQ ID NO: 1347652 - RNA, 19 nt, Human
cuggucaccuaggaagccu

SEQ ID NO: 1347653 - RNA, 22 nt, Human
cuggucaccuaggaagccucag

SEQ ID NO: 1347654 - RNA, 18 nt, Human
cuggucacggauuugugu

SEQ ID NO: 1347655 - RNA, 23 nt, Human
cuggucaccuaggaagccucaga

SEQ ID NO: 1347656 - RNA, 17 nt, Human
cugguagaagggaaagc

SEQ ID NO: 1347657 - RNA, 21 nt, Human
cugguagaagggaaagcccau

SEQ ID NO: 1347658 - RNA, 22 nt, Human
cugguagaagggaaagcccaua

SEQ ID NO: 1347659 - RNA, 13 nt, Human
cugguagagcagg

SEQ ID NO: 1347660 - RNA, 20 nt, Human
cugguaggaauagcauguca

SEQ ID NO: 1347661 - RNA, 22 nt, Human
cugguaggaauagcaugucacu

SEQ ID NO: 1347662 - RNA, 23 nt, Human
cugguaggaauagcaugucacua

SEQ ID NO: 1347663 - RNA, 15 nt, Human
cugguaggaccaagc

SEQ ID NO: 1347664 - RNA, 17 nt, Human
cugguaggaccaagcau

SEQ ID NO: 1347665 - RNA, 18 nt, Human
cugguaggaccaagcauc

SEQ ID NO: 1347666 - RNA, 18 nt, Human
cugguauauccaaaagcu

SEQ ID NO: 1347667 - RNA, 18 nt, Human
cuguaaggcaaucauggu

SEQ ID NO: 1347668 - RNA, 23 nt, Human
cugguuccagggucccucugugu

SEQ ID NO: 1347669 - RNA, 21 nt, Human
cuguaaggauccggaaagaag

SEQ ID NO: 1347670 - RNA, 20 nt, Human
cugguucacacugaccaaga

SEQ ID NO: 1347671 - RNA, 13 nt, Human
cugguuccagggu

SEQ ID NO: 1347672 - RNA, 14 nt, Human
cugguuccaggguc

SEQ ID NO: 1347673 - RNA, 15 nt, Human
cugguuccagggucc

SEQ ID NO: 1347674 - RNA, 16 nt, Human
cugguuccaggguccc

SEQ ID NO: 1347675 - RNA, 18 nt, Human
cugguuccagggucccuc

SEQ ID NO: 1347676 - RNA, 22 nt, Human
cugguuccagggucccucugug

SEQ ID NO: 1347677 - RNA, 14 nt, Human
cugguguuucuuga

SEQ ID NO: 1347678 - RNA, 13 nt, Human
cugguguuucuug

SEQ ID NO: 1347679 - RNA, 20 nt, Human
cugguguuggacaagcuucu

SEQ ID NO: 1347680 - RNA, 22 nt, Human
cugguguuggacaagcuucuga

SEQ ID NO: 1347681 - RNA, 23 nt, Human
cuggugugguacagagaagccag

SEQ ID NO: 1347682 - RNA, 12 nt, Human
cugguguuaaca

SEQ ID NO: 1347683 - RNA, 13 nt, Human
cugguguuaacag

SEQ ID NO: 1347684 - RNA, 14 nt, Human
cugguguuaacaga

SEQ ID NO: 1347685 - RNA, 15 nt, Human
cugguguuaacagaa

SEQ ID NO: 1347686 - RNA, 16 nt, Human
cugguguuaacagaag

SEQ ID NO: 1347687 - RNA, 17 nt, Human
cugguguuaacagaagg

SEQ ID NO: 1347688 - RNA, 22 nt, Human
cugguguuaacagaagggaggg

SEQ ID NO: 1347689 - RNA, 23 nt, Human
cugguuaauauuuauaggucacu

SEQ ID NO: 1347690 - RNA, 19 nt, Human
cugguuaaauaaggcaggg

SEQ ID NO: 1347691 - RNA, 22 nt, Human
cugguuagguuaggacuugccc

SEQ ID NO: 1347692 - RNA, 16 nt, Human
cuggucucgaacuccu

SEQ ID NO: 1347693 - RNA, 21 nt, Human
cuggucucgaacuccugaccu

SEQ ID NO: 1347694 - RNA, 14 nt, Human
cugguggcacagga

SEQ ID NO: 1347695 - RNA, 23 nt, Human
cuggucucaaacuccugaccuca

SEQ ID NO: 1347696 - RNA, 13 nt, Human
cuggucucacccu

SEQ ID NO: 1347697 - RNA, 16 nt, Human
cuggucucacccugga

SEQ ID NO: 1347698 - RNA, 17 nt, Human
cuggucucacccuggag

SEQ ID NO: 1347699 - RNA, 23 nt, Human
cuggucucacccuggaggcaccu

SEQ ID NO: 1347700 - RNA, 18 nt, Human
cuggucucacccuggagg

SEQ ID NO: 1347701 - RNA, 15 nt, Human
cugguggcacaggag

SEQ ID NO: 1347702 - RNA, 14 nt, Human
cuggugugguacag

SEQ ID NO: 1347703 - RNA, 16 nt, Human
cuggugugguacagag

SEQ ID NO: 1347704 - RNA, 17 nt, Human
cuggugugguacagaga

SEQ ID NO: 1347705 - RNA, 18 nt, Human
cuggugugguacagagaa

SEQ ID NO: 1347706 - RNA, 19 nt, Human
cuggugugguacagagaag

SEQ ID NO: 1347707 - RNA, 20 nt, Human
cuggugugguacagagaagc

SEQ ID NO: 1347708 - RNA, 21 nt, Human
cuggugugguacagagaagcc

SEQ ID NO: 1347709 - RNA, 22 nt, Human
cuggugugguacagagaagcca

SEQ ID NO: 1347710 - RNA, 13 nt, Human
cuguaaggcucua

SEQ ID NO: 1347711 - RNA, 14 nt, Human
cuguaaggcucuag

SEQ ID NO: 1347712 - RNA, 15 nt, Human
cuguaaggcucuaga

SEQ ID NO: 1347713 - RNA, 16 nt, Human
cuguaaggcucuagau

SEQ ID NO: 1347714 - RNA, 17 nt, Human
cuguaaggcucuagauc

SEQ ID NO: 1347715 - RNA, 18 nt, Human
cuguaaggcucuagauca

SEQ ID NO: 1347716 - RNA, 20 nt, Human
cuguaaggcucuagaucaua

SEQ ID NO: 1347717 - RNA, 22 nt, Human
cuguaaggcucuagaucauaag

SEQ ID NO: 1347718 - RNA, 20 nt, Human
cuguaaguagaugcauuugg

SEQ ID NO: 1347719 - RNA, 21 nt, Human
cuguaaguugggcuugcuauu

SEQ ID NO: 1347720 - RNA, 22 nt, Human
cuguaaguugggcuugcuauuc

SEQ ID NO: 1347721 - RNA, 24 nt, Human
cuguaaguugggcuugcuauucug

SEQ ID NO: 1347722 - RNA, 15 nt, Human
cuguacagcuggcuc

SEQ ID NO: 1347723 - RNA, 16 nt, Human
cuguacagcuggcucu

SEQ ID NO: 1347724 - RNA, 17 nt, Human
cuguacagcuggcucua

SEQ ID NO: 1347725 - RNA, 18 nt, Human
cuguacagcuggcucuac

SEQ ID NO: 1347726 - RNA, 11 nt, Human
cuguacagugu

SEQ ID NO: 1347727 - RNA, 14 nt, Human
cuguacagugucuu

SEQ ID NO: 1347728 - RNA, 15 nt, Human
cuguacagugucuuu

SEQ ID NO: 1347729 - RNA, 16 nt, Human
cuguacagugucuuuu

SEQ ID NO: 1347730 - RNA, 15 nt, Human
cuguacaguguuacc

SEQ ID NO: 1347731 - RNA, 17 nt, Human
cuguaccaguuaauuuu

SEQ ID NO: 1347732 - RNA, 18 nt, Human
cuguaccaguuaauuuuu

SEQ ID NO: 1347733 - RNA, 13 nt, Human
cuguacccaguuu

SEQ ID NO: 1347734 - RNA, 21 nt, Human
cuguacagugucuuuuuuugu

SEQ ID NO: 1347735 - RNA, 13 nt, Human
cuguacaguguua

SEQ ID NO: 1347736 - RNA, 15 nt, Human
cuguacauuguggga

SEQ ID NO: 1347737 - RNA, 12 nt, Human
cuguaccaguua

SEQ ID NO: 1347738 - RNA, 16 nt, Human
cuguaccaguuaauuu

SEQ ID NO: 1347739 - RNA, 21 nt, Human
cugggaggcucuggagcccac

SEQ ID NO: 1347740 - RNA, 20 nt, Human
cugggaggcucuggagccca

SEQ ID NO: 1347741 - RNA, 18 nt, Human
cugggaggcucuggagcc

SEQ ID NO: 1347742 - RNA, 14 nt, Human
cugggaggcaguga

SEQ ID NO: 1347743 - RNA, 22 nt, Human
cugggaggcucuggagcccacu

SEQ ID NO: 1347744 - RNA, 21 nt, Human
cugggaguaguugucuuuccu

SEQ ID NO: 1347745 - RNA, 23 nt, Human
cugggaguaguugucuuuccugg

SEQ ID NO: 1347746 - RNA, 14 nt, Human
cugggagucacaca

SEQ ID NO: 1347747 - RNA, 19 nt, Human
cugggaggagggcaggcau

SEQ ID NO: 1347748 - RNA, 14 nt, Human
cugggaggaaggac

SEQ ID NO: 1347749 - RNA, 23 nt, Human
cugggagcccccagccugucaga

SEQ ID NO: 1347750 - RNA, 16 nt, Human
cugggagcuccacucu

SEQ ID NO: 1347751 - RNA, 17 nt, Human
cugggagcuccacucug

SEQ ID NO: 1347752 - RNA, 20 nt, Human
cugggagcuccacucugcuu

SEQ ID NO: 1347753 - RNA, 21 nt, Human
cugggagcuccacucugcuuc

SEQ ID NO: 1347754 - RNA, 21 nt, Human
cugggagcccccagccuguca

SEQ ID NO: 1347755 - RNA, 22 nt, Human
cugggaggaaggacuucccugu

SEQ ID NO: 1347756 - RNA, 17 nt, Human
cugggagcccccagccu

SEQ ID NO: 1347757 - RNA, 18 nt, Human
cugggagcccccagccug

SEQ ID NO: 1347758 - RNA, 19 nt, Human
cugggagcccccagccugu

SEQ ID NO: 1347759 - RNA, 20 nt, Human
cugggagcccccagccuguc

SEQ ID NO: 1347760 - RNA, 14 nt, Human
cugggagaggcagc

SEQ ID NO: 1347761 - RNA, 15 nt, Human
cugggagaggcagcc

SEQ ID NO: 1347762 - RNA, 18 nt, Human
cugggagaggcagcccag

SEQ ID NO: 1347763 - RNA, 19 nt, Human
cugggagaggcagcccagg

SEQ ID NO: 1347764 - RNA, 23 nt, Human
cugggagaggcagcccaggaagu

SEQ ID NO: 1347765 - RNA, 20 nt, Human
cugggagaggcagcccagga

SEQ ID NO: 1347766 - RNA, 15 nt, Human
cugggagauucaagg

SEQ ID NO: 1347767 - RNA, 19 nt, Human
cugggagauucaagggacc

SEQ ID NO: 1347768 - RNA, 16 nt, Human
cugggagcccccagcc

SEQ ID NO: 1347769 - RNA, 23 nt, Human
cugggauuacaggugugagccac

SEQ ID NO: 1347770 - RNA, 13 nt, Human
cugggcccaugaa

SEQ ID NO: 1347771 - RNA, 10 nt, Human
cugggccccu

SEQ ID NO: 1347772 - RNA, 19 nt, Human
cugggccccaguuguauuu

SEQ ID NO: 1347773 - RNA, 15 nt, Human
cugggccccaguugu

SEQ ID NO: 1347774 - RNA, 13 nt, Human
cugggcccugggc

SEQ ID NO: 1347775 - RNA, 14 nt, Human
cugggcccugggcu

SEQ ID NO: 1347776 - RNA, 15 nt, Human
cugggcccugggcug

SEQ ID NO: 1347777 - RNA, 16 nt, Human
cugggcccugggcugg

SEQ ID NO: 1347778 - RNA, 18 nt, Human
cugggcccugggcuggaa

SEQ ID NO: 1347779 - RNA, 12 nt, Human
cugggcccuggg

SEQ ID NO: 1347780 - RNA, 13 nt, Human
cugggcccugggg

SEQ ID NO: 1347781 - RNA, 14 nt, Human
cugggcccuggggc

SEQ ID NO: 1347782 - RNA, 15 nt, Human
cugggcccuggggcc

SEQ ID NO: 1347783 - RNA, 17 nt, Human
cugggcccuggggccug

SEQ ID NO: 1347784 - RNA, 18 nt, Human
cugggcccuggggccugu

SEQ ID NO: 1347785 - RNA, 20 nt, Human
cugggcccuggggccuguac

SEQ ID NO: 1347786 - RNA, 22 nt, Human
cugggcccuggggccuguacug

SEQ ID NO: 1347787 - RNA, 15 nt, Human
cugggccgcugccac

SEQ ID NO: 1347788 - RNA, 16 nt, Human
cugggccgcugccacg

SEQ ID NO: 1347789 - RNA, 12 nt, Human
cugggccuaugg

SEQ ID NO: 1347790 - RNA, 16 nt, Human
cugggccuauggagag

SEQ ID NO: 1347791 - RNA, 17 nt, Human
cugggccuauggagagc

SEQ ID NO: 1347792 - RNA, 18 nt, Human
cugggccuauggagagcc

SEQ ID NO: 1347793 - RNA, 19 nt, Human
cugggccuauggagagccc

SEQ ID NO: 1347794 - RNA, 16 nt, Human
cugggauuacaggugu

SEQ ID NO: 1347795 - RNA, 18 nt, Human
cugggauuacagguguga

SEQ ID NO: 1347796 - RNA, 16 nt, Human
cugggagucacacagu

SEQ ID NO: 1347797 - RNA, 17 nt, Human
cugggagucacacagug

SEQ ID NO: 1347798 - RNA, 22 nt, Human
cugggagucacacaguguugga

SEQ ID NO: 1347799 - RNA, 18 nt, Human
cuggcuuggccacagcca

SEQ ID NO: 1347800 - RNA, 20 nt, Human
cuggcuuggccacagccagg

SEQ ID NO: 1347801 - RNA, 16 nt, Human
cuggcuugggcagcau

SEQ ID NO: 1347802 - RNA, 23 nt, Human
cuggcuugggacuaaaugcccug

SEQ ID NO: 1347803 - RNA, 21 nt, Human
cuggcuuucauuuucucucag

SEQ ID NO: 1347804 - RNA, 22 nt, Human
cuggcuuucauuuucucucagg

SEQ ID NO: 1347805 - RNA, 23 nt, Human
cuggcuuucauuuucucucaggu

SEQ ID NO: 1347806 - RNA, 23 nt, Human
cuggcuuuucacugcuggcugcc

SEQ ID NO: 1347807 - RNA, 14 nt, Human
cuggcuuuuauuaa

SEQ ID NO: 1347808 - RNA, 22 nt, Human
cuggcuuuuauuaaugcacuuu

SEQ ID NO: 1347809 - RNA, 23 nt, Human
cuggcuuuuauuaaugcacuuuc

SEQ ID NO: 1347810 - RNA, 23 nt, Human
cugggaaaaacuuuggaaccaga

SEQ ID NO: 1347811 - RNA, 22 nt, Human
cugggaaaaacuuuggaaccag

SEQ ID NO: 1347812 - RNA, 18 nt, Human
cugggaaagccccugccc

SEQ ID NO: 1347813 - RNA, 16 nt, Human
cugggaaagccccugc

SEQ ID NO: 1347814 - RNA, 13 nt, Human
cugggagaggcag

SEQ ID NO: 1347815 - RNA, 12 nt, Human
cuggcugguguu

SEQ ID NO: 1347816 - RNA, 16 nt, Human
cuggcugguguuaaca

SEQ ID NO: 1347817 - RNA, 18 nt, Human
cuggcugguguuaacaga

SEQ ID NO: 1347818 - RNA, 21 nt, Human
cuggcugguguuaacagaagg

SEQ ID NO: 1347819 - RNA, 22 nt, Human
cuggcugguguuaacagaaggg

SEQ ID NO: 1347820 - RNA, 15 nt, Human
cuggcuguaaggcuc

SEQ ID NO: 1347821 - RNA, 16 nt, Human
cuggcuguaaggcucu

SEQ ID NO: 1347822 - RNA, 17 nt, Human
cuggcuguaaggcucua

SEQ ID NO: 1347823 - RNA, 12 nt, Human
cuggcugggacg

SEQ ID NO: 1347824 - RNA, 16 nt, Human
cuggcugggacguggc

SEQ ID NO: 1347825 - RNA, 19 nt, Human
cuggcugggacguggcuca

SEQ ID NO: 1347826 - RNA, 21 nt, Human
cuggcugggacguggcucagc

SEQ ID NO: 1347827 - RNA, 23 nt, Human
cuggcugggacguggcucagcca

SEQ ID NO: 1347828 - RNA, 16 nt, Human
cuggcuggcugagggc

SEQ ID NO: 1347829 - RNA, 17 nt, Human
cuggcugguagagcagg

SEQ ID NO: 1347830 - RNA, 18 nt, Human
cuggcugguagagcaggu

SEQ ID NO: 1347831 - RNA, 18 nt, Human
cuggcuguggccuaaccu

SEQ ID NO: 1347832 - RNA, 19 nt, Human
cuggcuguaaggcucuaga

SEQ ID NO: 1347833 - RNA, 20 nt, Human
cuggcuguaaggcucuagau

SEQ ID NO: 1347834 - RNA, 17 nt, Human
cuggccuuuuucauuua

SEQ ID NO: 1347835 - RNA, 19 nt, Human
cuggccuuuuucauuuauc

SEQ ID NO: 1347836 - RNA, 20 nt, Human
cuggccuuuuucauuuaucu

SEQ ID NO: 1347837 - RNA, 21 nt, Human
cuggccuuuuucauuuaucua

SEQ ID NO: 1347838 - RNA, 22 nt, Human
cuggcgacacguagcagcuuag

SEQ ID NO: 1347839 - RNA, 17 nt, Human
cuggcuggccucaccca

SEQ ID NO: 1347840 - RNA, 13 nt, Human
cuggcuggccuca

SEQ ID NO: 1347841 - RNA, 11 nt, Human
cuggcuggcug

SEQ ID NO: 1347842 - RNA, 14 nt, Human
cuggcuggcugagg

SEQ ID NO: 1347843 - RNA, 15 nt, Human
cuggcuggcugaggg

SEQ ID NO: 1347844 - RNA, 17 nt, Human
cuggcuggcugagggca

SEQ ID NO: 1347845 - RNA, 18 nt, Human
cuggaauacaugaaauau

SEQ ID NO: 1347846 - RNA, 23 nt, Human
cuggaaucaggaauauuuuccaa

SEQ ID NO: 1347847 - RNA, 20 nt, Human
cuggaaucagcucaggacug

SEQ ID NO: 1347848 - RNA, 20 nt, Human
cuggaagugcuaauuuugaa

SEQ ID NO: 1347849 - RNA, 19 nt, Human
cuggaaugaguugaggcca

SEQ ID NO: 1347850 - RNA, 24 nt, Human
cuggaaugaguugaggccacugug

SEQ ID NO: 1347851 - RNA, 15 nt, Human
cuggcaacacagagg

SEQ ID NO: 1347852 - RNA, 16 nt, Human
cuggcaacacagaggc

SEQ ID NO: 1347853 - RNA, 14 nt, Human
cuggcaacaucuuu

SEQ ID NO: 1347854 - RNA, 17 nt, Human
cuggcaacaucuuuauc

SEQ ID NO: 1347855 - RNA, 23 nt, Human
cuggcacagccuggcuguggccu

SEQ ID NO: 1347856 - RNA, 15 nt, Human
cuggcacagggcagu

SEQ ID NO: 1347857 - RNA, 16 nt, Human
cuggcacagggcagug

SEQ ID NO: 1347858 - RNA, 16 nt, Human
cuggcacagccuggcu

SEQ ID NO: 1347859 - RNA, 21 nt, Human
cuggcacagccuggcuguggc

SEQ ID NO: 1347860 - RNA, 19 nt, Human
cuggcaaggacuuuguaca

SEQ ID NO: 1347861 - RNA, 20 nt, Human
cuggcaaggacuuuguacau

SEQ ID NO: 1347862 - RNA, 15 nt, Human
cuggcacagccuggc

SEQ ID NO: 1347863 - RNA, 23 nt, Human
cuggcauuacaggugugagccac

SEQ ID NO: 1347864 - RNA, 18 nt, Human
cuggcauuagaauuauuu

SEQ ID NO: 1347865 - RNA, 18 nt, Human
cuggcaugucaacagcgu

SEQ ID NO: 1347866 - RNA, 19 nt, Human
cuggcauuagaauuauuua

SEQ ID NO: 1347867 - RNA, 19 nt, Human
cuggccaagcugaggugcc

SEQ ID NO: 1347868 - RNA, 21 nt, Human
cuggccaagcugaggugccca

SEQ ID NO: 1347869 - RNA, 23 nt, Human
cuggccaagcugaggugcccagg

SEQ ID NO: 1347870 - RNA, 22 nt, Human
cuggccaagcugaggugcccag

SEQ ID NO: 1347871 - RNA, 15 nt, Human
cuggcauuacagcug

SEQ ID NO: 1347872 - RNA, 16 nt, Human
cuggcauuacagcugg

SEQ ID NO: 1347873 - RNA, 13 nt, Human
cuggccccccugg

SEQ ID NO: 1347874 - RNA, 19 nt, Human
cuggccccccugguccccu

SEQ ID NO: 1347875 - RNA, 22 nt, Human
cuggccccccugguccccuccu

SEQ ID NO: 1347876 - RNA, 13 nt, Human
cuggcccccuccc

SEQ ID NO: 1347877 - RNA, 15 nt, Human
cuggcccccucccug

SEQ ID NO: 1347878 - RNA, 16 nt, Human
cuggcccccucccugg

SEQ ID NO: 1347879 - RNA, 21 nt, Human
cuggccccaggaccuggcugc

SEQ ID NO: 1347880 - RNA, 17 nt, Human
cuggccccauggucagc

SEQ ID NO: 1347881 - RNA, 16 nt, Human
cuggccucccaaauga

SEQ ID NO: 1347882 - RNA, 20 nt, Human
cuggcccccucccuggauga

SEQ ID NO: 1347883 - RNA, 17 nt, Human
cuggcccccucccugga

SEQ ID NO: 1347884 - RNA, 18 nt, Human
cuggcccccucccuggau

SEQ ID NO: 1347885 - RNA, 22 nt, Human
cuggccucacccaccccugcac

SEQ ID NO: 1347886 - RNA, 19 nt, Human
cuggcccccucccuggaug

SEQ ID NO: 1347887 - RNA, 14 nt, Human
cuggccucccaaau

SEQ ID NO: 1347888 - RNA, 12 nt, Human
cuggccagcgag

SEQ ID NO: 1347889 - RNA, 20 nt, Human
cuggccagcgagcgcccagc

SEQ ID NO: 1347890 - RNA, 23 nt, Human
cuggccagcgagcgcccagcucc

SEQ ID NO: 1347891 - RNA, 13 nt, Human
cuggccagggcca

SEQ ID NO: 1347892 - RNA, 14 nt, Human
cuggccagggccac

SEQ ID NO: 1347893 - RNA, 17 nt, Human
cuggccagggccacgcu

SEQ ID NO: 1347894 - RNA, 18 nt, Human
cuggccagggccacgcuc

SEQ ID NO: 1347895 - RNA, 20 nt, Human
cuggccagggccacgcucca

SEQ ID NO: 1347896 - RNA, 22 nt, Human
cuggccagggccacgcuccagc

SEQ ID NO: 1347897 - RNA, 23 nt, Human
cuggccagggccacgcuccagcu

SEQ ID NO: 1347898 - RNA, 15 nt, Human
cuggccaguccaggc

SEQ ID NO: 1347899 - RNA, 16 nt, Human
cuggccaguccaggcu

SEQ ID NO: 1347900 - RNA, 17 nt, Human
cuggccaguccaggcug

SEQ ID NO: 1347901 - RNA, 18 nt, Human
cuggccaguccaggcugc

SEQ ID NO: 1347902 - RNA, 16 nt, Human
cuggccccaggaccug

SEQ ID NO: 1347903 - RNA, 20 nt, Human
cuggccccaggaccuggcug

SEQ ID NO: 1347904 - RNA, 14 nt, Human
cuggccuggacugu

SEQ ID NO: 1347905 - RNA, 15 nt, Human
cuggccuucggccuc

SEQ ID NO: 1347906 - RNA, 21 nt, Human
cuggccuucggccuccauccu

SEQ ID NO: 1347907 - RNA, 18 nt, Human
cuggccuucggccuccau

SEQ ID NO: 1347908 - RNA, 17 nt, Human
cuggccuucggccucca

SEQ ID NO: 1347909 - RNA, 16 nt, Human
cuggccuucggccucc

SEQ ID NO: 1347910 - RNA, 23 nt, Human
cugcaggucccuaauaaagcugu

SEQ ID NO: 1347911 - RNA, 14 nt, Human
cugcaguaaaucuu

SEQ ID NO: 1347912 - RNA, 17 nt, Human
cugcaguaaaucuuuua

SEQ ID NO: 1347913 - RNA, 16 nt, Human
cugcaguaugaaaaua

SEQ ID NO: 1347914 - RNA, 17 nt, Human
cugcaguaugaaaauaa

SEQ ID NO: 1347915 - RNA, 22 nt, Human
cugcaggucccuaauaaagcug

SEQ ID NO: 1347916 - RNA, 21 nt, Human
cugcaggucccuaauaaagcu

SEQ ID NO: 1347917 - RNA, 20 nt, Human
cugcaggucccuaauaaagc

SEQ ID NO: 1347918 - RNA, 19 nt, Human
cugcaggucccuaauaaag

SEQ ID NO: 1347919 - RNA, 23 nt, Human
cugcagucucuauaccaauaaag

SEQ ID NO: 1347920 - RNA, 21 nt, Human
cugcagucucuauaccaauaa

SEQ ID NO: 1347921 - RNA, 17 nt, Human
cugcagucucuauacca

SEQ ID NO: 1347922 - RNA, 13 nt, Human
cugcaguccugga

SEQ ID NO: 1347923 - RNA, 23 nt, Human
cugcagucccagcggugggaccu

SEQ ID NO: 1347924 - RNA, 15 nt, Human
cugcaguucgacucu

SEQ ID NO: 1347925 - RNA, 17 nt, Human
cugcaguucgacucugu

SEQ ID NO: 1347926 - RNA, 20 nt, Human
cugcaguucgacucugugcu

SEQ ID NO: 1347927 - RNA, 21 nt, Human
cugcaguucgacucugugcug

SEQ ID NO: 1347928 - RNA, 22 nt, Human
cugcaguuuugcuaucugggcu

SEQ ID NO: 1347929 - RNA, 18 nt, Human
cugcaggucccuaauaaa

SEQ ID NO: 1347930 - RNA, 17 nt, Human
cugcaggucccuaauaa

SEQ ID NO: 1347931 - RNA, 16 nt, Human
cugcaggucccuaaua

SEQ ID NO: 1347932 - RNA, 15 nt, Human
cugcaggucccuaau

SEQ ID NO: 1347933 - RNA, 14 nt, Human
cugcaggucccuaa

SEQ ID NO: 1347934 - RNA, 13 nt, Human
cugcaggucccua

SEQ ID NO: 1347935 - RNA, 12 nt, Human
cugcaggucccu

SEQ ID NO: 1347936 - RNA, 11 nt, Human
cugcagguccc

SEQ ID NO: 1347937 - RNA, 17 nt, Human
cugcagggggugugucu

SEQ ID NO: 1347938 - RNA, 20 nt, Human
cugcagggggugugucugcu

SEQ ID NO: 1347939 - RNA, 23 nt, Human
cugcagggggugugucugcucag

SEQ ID NO: 1347940 - RNA, 23 nt, Human
cugaggccagccuggccuccugc

SEQ ID NO: 1347941 - RNA, 20 nt, Human
cugcacccuggauuugcaua

SEQ ID NO: 1347942 - RNA, 20 nt, Human
cugcacuccagucuggguga

SEQ ID NO: 1347943 - RNA, 16 nt, Human
cugcacucccaccuga

SEQ ID NO: 1347944 - RNA, 18 nt, Human
cugcacucccaccugaca

SEQ ID NO: 1347945 - RNA, 19 nt, Human
cugcacucccaccugacac

SEQ ID NO: 1347946 - RNA, 22 nt, Human
cugcacucccaccugacacacc

SEQ ID NO: 1347947 - RNA, 16 nt, Human
cugcacuggggagccc

SEQ ID NO: 1347948 - RNA, 22 nt, Human
cugcacuggggagcccgucuca

SEQ ID NO: 1347949 - RNA, 11 nt, Human
cugcacuguaa

SEQ ID NO: 1347950 - RNA, 13 nt, Human
cugcacuguaaaa

SEQ ID NO: 1347951 - RNA, 14 nt, Human
cugcacuguaaaau

SEQ ID NO: 1347952 - RNA, 15 nt, Human
cugcacuguaaaaug

SEQ ID NO: 1347953 - RNA, 20 nt, Human
cugcacuguaaaauguggga

SEQ ID NO: 1347954 - RNA, 16 nt, Human
cugcacuguaaaaugu

SEQ ID NO: 1347955 - RNA, 18 nt, Human
cugcacuguaaaaugugg

SEQ ID NO: 1347956 - RNA, 15 nt, Human
cugcacuuacuugcu

SEQ ID NO: 1347957 - RNA, 22 nt, Human
cugcagaauuuggguucugccu

SEQ ID NO: 1347958 - RNA, 15 nt, Human
cugcagaccacgccc

SEQ ID NO: 1347959 - RNA, 13 nt, Human
cugcagacccugc

SEQ ID NO: 1347960 - RNA, 14 nt, Human
cugcagacccugcc

SEQ ID NO: 1347961 - RNA, 15 nt, Human
cugcagacccugccc

SEQ ID NO: 1347962 - RNA, 18 nt, Human
cugcagacuucccagcua

SEQ ID NO: 1347963 - RNA, 17 nt, Human
cugcagacuucccagcu

SEQ ID NO: 1347964 - RNA, 12 nt, Human
cugcagaggacg

SEQ ID NO: 1347965 - RNA, 11 nt, Human
cugcagaggcc

SEQ ID NO: 1347966 - RNA, 13 nt, Human
cugcagaggccag

SEQ ID NO: 1347967 - RNA, 16 nt, Human
cugcagacccugcccu

SEQ ID NO: 1347968 - RNA, 17 nt, Human
cugcagacccugcccuu

SEQ ID NO: 1347969 - RNA, 21 nt, Human
cugcagacccugcccuuguuu

SEQ ID NO: 1347970 - RNA, 15 nt, Human
cugcagacucacugu

SEQ ID NO: 1347971 - RNA, 14 nt, Human
cugcagacuuccca

SEQ ID NO: 1347972 - RNA, 15 nt, Human
cugcagacuucccag

SEQ ID NO: 1347973 - RNA, 16 nt, Human
cugcagacuucccagc

SEQ ID NO: 1347974 - RNA, 17 nt, Human
cugcagaggccagaggc

SEQ ID NO: 1347975 - RNA, 20 nt, Human
cugcagaggccagaggcccc

SEQ ID NO: 1347976 - RNA, 21 nt, Human
cugcagaggccagaggccccc

SEQ ID NO: 1347977 - RNA, 17 nt, Human
cugcccaggccugccug

SEQ ID NO: 1347978 - RNA, 15 nt, Human
cugccccaacuccuu

SEQ ID NO: 1347979 - RNA, 20 nt, Human
cugccccaacuccuuccagc

SEQ ID NO: 1347980 - RNA, 22 nt, Human
cugccccaacuccuuccagcua

SEQ ID NO: 1347981 - RNA, 13 nt, Human
cugccccaacucu

SEQ ID NO: 1347982 - RNA, 24 nt, Human
cugccccaacuccuuccagcuagu

SEQ ID NO: 1347983 - RNA, 18 nt, Human
cugccccacuuguccuua

SEQ ID NO: 1347984 - RNA, 21 nt, Human
cugccccacuuguccuuagcc

SEQ ID NO: 1347985 - RNA, 20 nt, Human
cugccccacuuguccuuagc

SEQ ID NO: 1347986 - RNA, 17 nt, Human
cugccauucacuucaua

SEQ ID NO: 1347987 - RNA, 17 nt, Human
cugccauuaaagaauau

SEQ ID NO: 1347988 - RNA, 21 nt, Human
cugcccaccucagccucccaa

SEQ ID NO: 1347989 - RNA, 22 nt, Human
cugccccuuggacacgcucagu

SEQ ID NO: 1347990 - RNA, 19 nt, Human
cugcccgggagcucaggaa

SEQ ID NO: 1347991 - RNA, 20 nt, Human
cugcccuaaugcgcaggcug

SEQ ID NO: 1347992 - RNA, 21 nt, Human
cugcccuaaugcgcaggcugg

SEQ ID NO: 1347993 - RNA, 22 nt, Human
cugcccuaaugcgcaggcuggc

SEQ ID NO: 1347994 - RNA, 17 nt, Human
cugcccuaccugcccca

SEQ ID NO: 1347995 - RNA, 14 nt, Human
cugcauacuuuuua

SEQ ID NO: 1347996 - RNA, 20 nt, Human
cugcauacuuuuuaaaugua

SEQ ID NO: 1347997 - RNA, 15 nt, Human
cugcaguuuugcuau

SEQ ID NO: 1347998 - RNA, 16 nt, Human
cugcaguuuugcuauc

SEQ ID NO: 1347999 - RNA, 21 nt, Human
cugcaguuuugcuaucugggc

SEQ ID NO: 1348000 - RNA, 15 nt, Human
cugcauaauguuucu

SEQ ID NO: 1348001 - RNA, 22 nt, Human
cugcauaauguuucuggauuuc

SEQ ID NO: 1348002 - RNA, 20 nt, Human
cugcauaggaguuuggagga

SEQ ID NO: 1348003 - RNA, 22 nt, Human
cugcauaggaguuuggaggaag

SEQ ID NO: 1348004 - RNA, 23 nt, Human
cugcauaggaguuuggaggaagu

SEQ ID NO: 1348005 - RNA, 14 nt, Human
cugcauauguugaa

SEQ ID NO: 1348006 - RNA, 21 nt, Human
cugcauauguugaauacuuuu

SEQ ID NO: 1348007 - RNA, 17 nt, Human
cugccacccagccccag

SEQ ID NO: 1348008 - RNA, 18 nt, Human
cugccacccagccccagc

SEQ ID NO: 1348009 - RNA, 20 nt, Human
cugccacccagccccagcca

SEQ ID NO: 1348010 - RNA, 23 nt, Human
cugccacccagccccagccaggg

SEQ ID NO: 1348011 - RNA, 12 nt, Human
cugccacccagg

SEQ ID NO: 1348012 - RNA, 14 nt, Human
cugccacccaggau

SEQ ID NO: 1348013 - RNA, 16 nt, Human
cugccacccaggaucc

SEQ ID NO: 1348014 - RNA, 14 nt, Human
cugccacccuugac

SEQ ID NO: 1348015 - RNA, 21 nt, Human
cugccaccuccccccacaagu

SEQ ID NO: 1348016 - RNA, 17 nt, Human
cugccaccuccccccac

SEQ ID NO: 1348017 - RNA, 11 nt, Human
cugccagcugc

SEQ ID NO: 1348018 - RNA, 12 nt, Human
cugccagcugca

SEQ ID NO: 1348019 - RNA, 13 nt, Human
cugccagcugcac

SEQ ID NO: 1348020 - RNA, 11 nt, Human
cugccaggaga

SEQ ID NO: 1348021 - RNA, 16 nt, Human
cugccagcugcacuga

SEQ ID NO: 1348022 - RNA, 17 nt, Human
cugccagcugcacugau

SEQ ID NO: 1348023 - RNA, 15 nt, Human
cugccauuaaagaau

SEQ ID NO: 1348024 - RNA, 23 nt, Human
cugcugccugcuuuuuauggccu

SEQ ID NO: 1348025 - RNA, 14 nt, Human
cugcugccugcuuu

SEQ ID NO: 1348026 - RNA, 11 nt, Human
cugcugccugc

SEQ ID NO: 1348027 - RNA, 15 nt, Human
cugcugccucccucu

SEQ ID NO: 1348028 - RNA, 21 nt, Human
cugcucuuggcuggacccagc

SEQ ID NO: 1348029 - RNA, 22 nt, Human
cugcucuuggcuggacccagcc

SEQ ID NO: 1348030 - RNA, 16 nt, Human
cugcucuuggcuggac

SEQ ID NO: 1348031 - RNA, 17 nt, Human
cugcucuuggcuggacc

SEQ ID NO: 1348032 - RNA, 19 nt, Human
cugcucuuggcuggaccca

SEQ ID NO: 1348033 - RNA, 20 nt, Human
cugcucuuggcuggacccag

SEQ ID NO: 1348034 - RNA, 17 nt, Human
cugcucugguuguuucu

SEQ ID NO: 1348035 - RNA, 18 nt, Human
cugcucugguuguuucug

SEQ ID NO: 1348036 - RNA, 21 nt, Human
cugcucugguuguuucuguuc

SEQ ID NO: 1348037 - RNA, 16 nt, Human
cugcucuugaacuccu

SEQ ID NO: 1348038 - RNA, 18 nt, Human
cugcucuugaacuccuga

SEQ ID NO: 1348039 - RNA, 19 nt, Human
cugcucuugaacuccugac

SEQ ID NO: 1348040 - RNA, 22 nt, Human
cugcucugguuguuucuguucc

SEQ ID NO: 1348041 - RNA, 15 nt, Human
cugcucuuggcugga

SEQ ID NO: 1348042 - RNA, 12 nt, Human
cugcucugaugc

SEQ ID NO: 1348043 - RNA, 13 nt, Human
cugcucugaugca

SEQ ID NO: 1348044 - RNA, 18 nt, Human
cugcucugaugcaucaga

SEQ ID NO: 1348045 - RNA, 20 nt, Human
cugcucugcgugucaccugu

SEQ ID NO: 1348046 - RNA, 21 nt, Human
cugcucugcgugucaccugug

SEQ ID NO: 1348047 - RNA, 22 nt, Human
cugcucugcgugucaccugugc

SEQ ID NO: 1348048 - RNA, 22 nt, Human
cugcgggugaacaaagcagcca

SEQ ID NO: 1348049 - RNA, 23 nt, Human
cugcgggugaacaaagcagccac

SEQ ID NO: 1348050 - RNA, 14 nt, Human
cugcucccauccug

SEQ ID NO: 1348051 - RNA, 19 nt, Human
cugcucccauccugugugu

SEQ ID NO: 1348052 - RNA, 18 nt, Human
cugcucccauccugugug

SEQ ID NO: 1348053 - RNA, 18 nt, Human
cugcucggggugcacagg

SEQ ID NO: 1348054 - RNA, 19 nt, Human
cugcucggggugcacagga

SEQ ID NO: 1348055 - RNA, 20 nt, Human
cugcucggggugcacaggag

SEQ ID NO: 1348056 - RNA, 21 nt, Human
cugcucggggugcacaggagg

SEQ ID NO: 1348057 - RNA, 22 nt, Human
cugcucggggugcacaggaggg

SEQ ID NO: 1348058 - RNA, 23 nt, Human
cugcucggggugcacaggagggg

SEQ ID NO: 1348059 - RNA, 18 nt, Human
cugcucguccccaaguga

SEQ ID NO: 1348060 - RNA, 21 nt, Human
cugcucguccccaagugaccu

SEQ ID NO: 1348061 - RNA, 22 nt, Human
cugcucguccccaagugaccua

SEQ ID NO: 1348062 - RNA, 12 nt, Human
cugcucuaacag

SEQ ID NO: 1348063 - RNA, 17 nt, Human
cugcucuaacagcccuc

SEQ ID NO: 1348064 - RNA, 22 nt, Human
cugccugcuuuuuauggccugu

SEQ ID NO: 1348065 - RNA, 15 nt, Human
cugccugcucccauc

SEQ ID NO: 1348066 - RNA, 18 nt, Human
cugccugcucccauccug

SEQ ID NO: 1348067 - RNA, 18 nt, Human
cugccugcucgcucccug

SEQ ID NO: 1348068 - RNA, 12 nt, Human
cugccugcuugg

SEQ ID NO: 1348069 - RNA, 13 nt, Human
cugccugcuuggg

SEQ ID NO: 1348070 - RNA, 19 nt, Human
cugccuggaagagcagccc

SEQ ID NO: 1348071 - RNA, 13 nt, Human
cugccuuccuccu

SEQ ID NO: 1348072 - RNA, 14 nt, Human
cugccuuccuccug

SEQ ID NO: 1348073 - RNA, 15 nt, Human
cugccuuccuccugg

SEQ ID NO: 1348074 - RNA, 16 nt, Human
cugccuuccuccuggg

SEQ ID NO: 1348075 - RNA, 18 nt, Human
cugccuuccuccugggcc

SEQ ID NO: 1348076 - RNA, 21 nt, Human
cugccuuccuccugggcccuc

SEQ ID NO: 1348077 - RNA, 13 nt, Human
cugccuucgcuuc

SEQ ID NO: 1348078 - RNA, 14 nt, Human
cugccuucgcuucu

SEQ ID NO: 1348079 - RNA, 15 nt, Human
cugccuucgcuucuu

SEQ ID NO: 1348080 - RNA, 17 nt, Human
cugccuucgcuucuugc

SEQ ID NO: 1348081 - RNA, 20 nt, Human
cugccuucgcuucuugccuc

SEQ ID NO: 1348082 - RNA, 12 nt, Human
cugcgcacugug

SEQ ID NO: 1348083 - RNA, 22 nt, Human
cugcgcccuuaacugcauccag

SEQ ID NO: 1348084 - RNA, 15 nt, Human
cugcgggucacagga

SEQ ID NO: 1348085 - RNA, 21 nt, Human
cugcgggucacaggagggagg

SEQ ID NO: 1348086 - RNA, 22 nt, Human
cugcgggucacaggagggaggg

SEQ ID NO: 1348087 - RNA, 23 nt, Human
cugcgggucacaggagggagggg

SEQ ID NO: 1348088 - RNA, 22 nt, Human
cugcccucucccaaaaaacuac

SEQ ID NO: 1348089 - RNA, 15 nt, Human
cugcccugcccugcc

SEQ ID NO: 1348090 - RNA, 14 nt, Human
cugcccugcccugc

SEQ ID NO: 1348091 - RNA, 20 nt, Human
cugccugcaguacuuuaccu

SEQ ID NO: 1348092 - RNA, 21 nt, Human
cugccugcaguacuuuaccuc

SEQ ID NO: 1348093 - RNA, 17 nt, Human
cugccugcauaggaguu

SEQ ID NO: 1348094 - RNA, 15 nt, Human
cugccugccagcugc

SEQ ID NO: 1348095 - RNA, 16 nt, Human
cugccugccagcugca

SEQ ID NO: 1348096 - RNA, 20 nt, Human
cugccugccagcugcacuga

SEQ ID NO: 1348097 - RNA, 21 nt, Human
cugccugccagcugcacugau

SEQ ID NO: 1348098 - RNA, 13 nt, Human
cugccugcuccca

SEQ ID NO: 1348099 - RNA, 14 nt, Human
cugccugcucccau

SEQ ID NO: 1348100 - RNA, 18 nt, Human
cuggaagugacuuuggcu

SEQ ID NO: 1348101 - RNA, 15 nt, Human
cuggaagugacuuug

SEQ ID NO: 1348102 - RNA, 16 nt, Human
cuggaaguccaaugug

SEQ ID NO: 1348103 - RNA, 19 nt, Human
cuggaaguccaauguggca

SEQ ID NO: 1348104 - RNA, 15 nt, Human
cuggaagggaggugg

SEQ ID NO: 1348105 - RNA, 19 nt, Human
cuggaaggggaagggacac

SEQ ID NO: 1348106 - RNA, 18 nt, Human
cuggaagcuaauuugcau

SEQ ID NO: 1348107 - RNA, 19 nt, Human
cuggaagcuaauuugcauu

SEQ ID NO: 1348108 - RNA, 22 nt, Human
cuggaagcuaauuugcauuaaa

SEQ ID NO: 1348109 - RNA, 15 nt, Human
cuggaagcugggagg

SEQ ID NO: 1348110 - RNA, 20 nt, Human
cuggaagcugggaggucagg

SEQ ID NO: 1348111 - RNA, 22 nt, Human
cuggaagccaaaauguaggcuu

SEQ ID NO: 1348112 - RNA, 15 nt, Human
cuggaagccagcuuu

SEQ ID NO: 1348113 - RNA, 16 nt, Human
cuggaagccagcuuuc

SEQ ID NO: 1348114 - RNA, 17 nt, Human
cuggaagccagcuuucc

SEQ ID NO: 1348115 - RNA, 17 nt, Human
cuggaagccccugggcc

SEQ ID NO: 1348116 - RNA, 21 nt, Human
cuggaagccccugggcccagu

SEQ ID NO: 1348117 - RNA, 20 nt, Human
cuggaagccccugggcccag

SEQ ID NO: 1348118 - RNA, 17 nt, Human
cuggaagcuaauuugca

SEQ ID NO: 1348119 - RNA, 18 nt, Human
cugcuuucuguuccaaau

SEQ ID NO: 1348120 - RNA, 17 nt, Human
cugcuuucuguuccaaa

SEQ ID NO: 1348121 - RNA, 19 nt, Human
cugcuuuaaaaaugucuua

SEQ ID NO: 1348122 - RNA, 17 nt, Human
cugcuuugggcugcccu

SEQ ID NO: 1348123 - RNA, 12 nt, Human
cugcuuugggcu

SEQ ID NO: 1348124 - RNA, 13 nt, Human
cugcuuuggaaau

SEQ ID NO: 1348125 - RNA, 21 nt, Human
cugcuuugcucuucaagaaau

SEQ ID NO: 1348126 - RNA, 16 nt, Human
cugcuuugggcugccc

SEQ ID NO: 1348127 - RNA, 20 nt, Human
cugcuuugggaagccgugcu

SEQ ID NO: 1348128 - RNA, 21 nt, Human
cugcuugaugggauucuggac

SEQ ID NO: 1348129 - RNA, 23 nt, Human
cugcuugaugggauucuggacag

SEQ ID NO: 1348130 - RNA, 13 nt, Human
cugcuugauuuuu

SEQ ID NO: 1348131 - RNA, 23 nt, Human
cugcuugccaaggcagaggccug

SEQ ID NO: 1348132 - RNA, 20 nt, Human
cugcuugauuuuugccucuu

SEQ ID NO: 1348133 - RNA, 18 nt, Human
cugcuugccaaggcagag

SEQ ID NO: 1348134 - RNA, 21 nt, Human
cugcuugccaaggcagaggcc

SEQ ID NO: 1348135 - RNA, 13 nt, Human
cugcuugcccuaa

SEQ ID NO: 1348136 - RNA, 15 nt, Human
cugcuugcccuaagc

SEQ ID NO: 1348137 - RNA, 16 nt, Human
cugcuugcccuaagca

SEQ ID NO: 1348138 - RNA, 19 nt, Human
cugcuugcccuaagcagaa

SEQ ID NO: 1348139 - RNA, 22 nt, Human
cugcuugcccuaagcagaaagu

SEQ ID NO: 1348140 - RNA, 20 nt, Human
cugcuugcccuaagcagaaa

SEQ ID NO: 1348141 - RNA, 17 nt, Human
cugcuuggagcugagca

SEQ ID NO: 1348142 - RNA, 16 nt, Human
cugcuuggagcugagc

SEQ ID NO: 1348143 - RNA, 19 nt, Human
cugcuuggggggugaugag

SEQ ID NO: 1348144 - RNA, 22 nt, Human
cugcuuggggggugaugagggc

SEQ ID NO: 1348145 - RNA, 21 nt, Human
cugcuuggggggugaugaggg

SEQ ID NO: 1348146 - RNA, 18 nt, Human
cugcuugguccuugauuu

SEQ ID NO: 1348147 - RNA, 19 nt, Human
cugcuucugacauaaucca

SEQ ID NO: 1348148 - RNA, 21 nt, Human
cugcuucucugacuucugccu

SEQ ID NO: 1348149 - RNA, 22 nt, Human
cugcuucucugacuucugccug

SEQ ID NO: 1348150 - RNA, 23 nt, Human
cugcuucucugacuucugccugg

SEQ ID NO: 1348151 - RNA, 22 nt, Human
cugcuucucccaggcaaggcug

SEQ ID NO: 1348152 - RNA, 20 nt, Human
cugcuucucccaggcaaggc

SEQ ID NO: 1348153 - RNA, 21 nt, Human
cugcuucucccaggcaaggcu

SEQ ID NO: 1348154 - RNA, 13 nt, Human
cugcuucucugac

SEQ ID NO: 1348155 - RNA, 14 nt, Human
cugcuucucugacu

SEQ ID NO: 1348156 - RNA, 15 nt, Human
cugcuucucugacuu

SEQ ID NO: 1348157 - RNA, 16 nt, Human
cugcuucucugacuuc

SEQ ID NO: 1348158 - RNA, 17 nt, Human
cugcuucucugacuucu

SEQ ID NO: 1348159 - RNA, 19 nt, Human
cugcuucucugacuucugc

SEQ ID NO: 1348160 - RNA, 20 nt, Human
cugcuucucugacuucugcc

SEQ ID NO: 1348161 - RNA, 12 nt, Human
cugcuugaggaa

SEQ ID NO: 1348162 - RNA, 13 nt, Human
cugcuugaggaaa

SEQ ID NO: 1348163 - RNA, 14 nt, Human
cugcuugaggaaaa

SEQ ID NO: 1348164 - RNA, 16 nt, Human
cugcuugaggaaaaca

SEQ ID NO: 1348165 - RNA, 14 nt, Human
cugcuguacugaag

SEQ ID NO: 1348166 - RNA, 15 nt, Human
cugcuguacugaagu

SEQ ID NO: 1348167 - RNA, 13 nt, Human
cugcuguacugaa

SEQ ID NO: 1348168 - RNA, 12 nt, Human
cugcuguacuga

SEQ ID NO: 1348169 - RNA, 17 nt, Human
cugcugucccucccccu

SEQ ID NO: 1348170 - RNA, 20 nt, Human
cugcugucccucccccuugu

SEQ ID NO: 1348171 - RNA, 12 nt, Human
cugcuuccugcu

SEQ ID NO: 1348172 - RNA, 13 nt, Human
cugcuuccugcuu

SEQ ID NO: 1348173 - RNA, 15 nt, Human
cugcuuccugcuugc

SEQ ID NO: 1348174 - RNA, 14 nt, Human
cugcuuccugcuug

SEQ ID NO: 1348175 - RNA, 13 nt, Human
cugcuucucccag

SEQ ID NO: 1348176 - RNA, 14 nt, Human
cugcuucucccagg

SEQ ID NO: 1348177 - RNA, 15 nt, Human
cugcuucucccaggc

SEQ ID NO: 1348178 - RNA, 17 nt, Human
cugcuucucccaggcaa

SEQ ID NO: 1348179 - RNA, 18 nt, Human
cugcuucucccaggcaag

SEQ ID NO: 1348180 - RNA, 19 nt, Human
cugcuucucccaggcaagg

SEQ ID NO: 1348181 - RNA, 13 nt, Human
cugcugccugccu

SEQ ID NO: 1348182 - RNA, 13 nt, Human
cugcuggcugccu

SEQ ID NO: 1348183 - RNA, 14 nt, Human
cugcuggcugccuu

SEQ ID NO: 1348184 - RNA, 15 nt, Human
cugcuggcugccuua

SEQ ID NO: 1348185 - RNA, 14 nt, Human
cugcugggcucagu

SEQ ID NO: 1348186 - RNA, 15 nt, Human
cugcugggcucagug

SEQ ID NO: 1348187 - RNA, 18 nt, Human
cugcugggcucagugaag

SEQ ID NO: 1348188 - RNA, 16 nt, Human
cugcugggcucaguga

SEQ ID NO: 1348189 - RNA, 13 nt, Human
cugcuggggccug

SEQ ID NO: 1348190 - RNA, 14 nt, Human
cugcuggggccugg

SEQ ID NO: 1348191 - RNA, 15 nt, Human
cugcuggggccuggg

SEQ ID NO: 1348192 - RNA, 16 nt, Human
cugcuggggccuggga

SEQ ID NO: 1348193 - RNA, 17 nt, Human
cugcuggggccugggac

SEQ ID NO: 1348194 - RNA, 18 nt, Human
cugcuggggccugggaca

SEQ ID NO: 1348195 - RNA, 22 nt, Human
cugcuggggccugggacaacug

SEQ ID NO: 1348196 - RNA, 19 nt, Human
cugcuggggccugggacaa

SEQ ID NO: 1348197 - RNA, 16 nt, Human
cugcugguccguggga

SEQ ID NO: 1348198 - RNA, 17 nt, Human
cugcugguccgugggac

SEQ ID NO: 1348199 - RNA, 19 nt, Human
cucuuuaaaaggaaagaaa

SEQ ID NO: 1348200 - RNA, 19 nt, Human
cucuucuuucauuucuucu

SEQ ID NO: 1348201 - RNA, 16 nt, Human
cucuuguugagccgug

SEQ ID NO: 1348202 - RNA, 21 nt, Human
cucuuguugagccgugggcaa

SEQ ID NO: 1348203 - RNA, 23 nt, Human
cucuuuaaaaggaaagaaaacau

SEQ ID NO: 1348204 - RNA, 20 nt, Human
cucuuuaaaaggaaagaaaa

SEQ ID NO: 1348205 - RNA, 14 nt, Human
cucuuuauacagcu

SEQ ID NO: 1348206 - RNA, 20 nt, Human
cucuuccgugacgucacugg

SEQ ID NO: 1348207 - RNA, 16 nt, Human
cucuuccuacuggucu

SEQ ID NO: 1348208 - RNA, 18 nt, Human
cucuuccuacuggucucu

SEQ ID NO: 1348209 - RNA, 20 nt, Human
cucuuccuacuggucucucu

SEQ ID NO: 1348210 - RNA, 23 nt, Human
cucuucuuaauguacauagugcu

SEQ ID NO: 1348211 - RNA, 20 nt, Human
cucuucuuccagguagcuga

SEQ ID NO: 1348212 - RNA, 24 nt, Human
cucuucuuaauguacauagugcua

SEQ ID NO: 1348213 - RNA, 22 nt, Human
cucuucuuaauguacauagugc

SEQ ID NO: 1348214 - RNA, 18 nt, Human
cucuucuuaauguacaua

SEQ ID NO: 1348215 - RNA, 13 nt, Human
cucuucuuaaugu

SEQ ID NO: 1348216 - RNA, 15 nt, Human
cucuucuugaaauuu

SEQ ID NO: 1348217 - RNA, 20 nt, Human
cucuucuugaaauuuuaacc

SEQ ID NO: 1348218 - RNA, 23 nt, Human
cucuucuuuuaaaccauuuucuu

SEQ ID NO: 1348219 - RNA, 17 nt, Human
cucuucuuuagaacagg

SEQ ID NO: 1348220 - RNA, 12 nt, Human
cucuucuuuaga

SEQ ID NO: 1348221 - RNA, 15 nt, Human
cucuugaacuccuga

SEQ ID NO: 1348222 - RNA, 23 nt, Human
cucuuggggaguuuagggugggg

SEQ ID NO: 1348223 - RNA, 21 nt, Human
cugaaauaaacgucuuaaaua

SEQ ID NO: 1348224 - RNA, 16 nt, Human
cugaaagccauggaga

SEQ ID NO: 1348225 - RNA, 22 nt, Human
cugaaauagacccacaagaggc

SEQ ID NO: 1348226 - RNA, 16 nt, Human
cugaaaggaagcugug

SEQ ID NO: 1348227 - RNA, 17 nt, Human
cucuuucuuucaauaaa

SEQ ID NO: 1348228 - RNA, 15 nt, Human
cucuuucuucccaug

SEQ ID NO: 1348229 - RNA, 15 nt, Human
cucuuucugucuucu

SEQ ID NO: 1348230 - RNA, 15 nt, Human
cucuuucuguauaua

SEQ ID NO: 1348231 - RNA, 21 nt, Human
cucuuuaugcuugcaaaaacu

SEQ ID NO: 1348232 - RNA, 17 nt, Human
cucuuuaugaucuggcc

SEQ ID NO: 1348233 - RNA, 13 nt, Human
cucuuucccuggu

SEQ ID NO: 1348234 - RNA, 14 nt, Human
cucuuucccugguc

SEQ ID NO: 1348235 - RNA, 15 nt, Human
cucuuucccuggucc

SEQ ID NO: 1348236 - RNA, 17 nt, Human
cucuuucccuggucccu

SEQ ID NO: 1348237 - RNA, 13 nt, Human
cucuuugccucaa

SEQ ID NO: 1348238 - RNA, 12 nt, Human
cucuuugagaaa

SEQ ID NO: 1348239 - RNA, 12 nt, Human
cucuuugccuca

SEQ ID NO: 1348240 - RNA, 10 nt, Human
cucuuugaga

SEQ ID NO: 1348241 - RNA, 14 nt, Human
cucuuugagaaaua

SEQ ID NO: 1348242 - RNA, 13 nt, Human
cugaaauuuccug

SEQ ID NO: 1348243 - RNA, 13 nt, Human
cugaaauuucaga

SEQ ID NO: 1348244 - RNA, 23 nt, Human
cugaaauuuccugggagcuuuug

SEQ ID NO: 1348245 - RNA, 18 nt, Human
cugaaaucaauuaaaagu

SEQ ID NO: 1348246 - RNA, 13 nt, Human
cugaaaugaagau

SEQ ID NO: 1348247 - RNA, 20 nt, Human
cugaaauucuccuggagguc

SEQ ID NO: 1348248 - RNA, 16 nt, Human
cugaaauuuccuggga

SEQ ID NO: 1348249 - RNA, 14 nt, Human
cugaaauuucagau

SEQ ID NO: 1348250 - RNA, 13 nt, Human
cugaaauuuuaua

SEQ ID NO: 1348251 - RNA, 19 nt, Human
cugaaauuuuauaugcuua

SEQ ID NO: 1348252 - RNA, 22 nt, Human
cugaacaccauagguagaaugu

SEQ ID NO: 1348253 - RNA, 18 nt, Human
cugaacaccauugaaggc

SEQ ID NO: 1348254 - RNA, 19 nt, Human
cugaacaccauugaaggcu

SEQ ID NO: 1348255 - RNA, 20 nt, Human
cugaacaccauugaaggcuu

SEQ ID NO: 1348256 - RNA, 12 nt, Human
cugaacagcugg

SEQ ID NO: 1348257 - RNA, 13 nt, Human
cugaacagcuggu

SEQ ID NO: 1348258 - RNA, 14 nt, Human
cugaacagcuggug

SEQ ID NO: 1348259 - RNA, 23 nt, Human
cugaagaagcaccaaucaugaau

SEQ ID NO: 1348260 - RNA, 21 nt, Human
cugaacuccugccauagucuu

SEQ ID NO: 1348261 - RNA, 13 nt, Human
cugaacugaacac

SEQ ID NO: 1348262 - RNA, 19 nt, Human
cugaacugauggguuucuc

SEQ ID NO: 1348263 - RNA, 23 nt, Human
cugaagacaccguucauucaggc

SEQ ID NO: 1348264 - RNA, 16 nt, Human
cugaacucugacaaca

SEQ ID NO: 1348265 - RNA, 17 nt, Human
cugaacucugacaacag

SEQ ID NO: 1348266 - RNA, 19 nt, Human
cugaacuaaagugcugcac

SEQ ID NO: 1348267 - RNA, 15 nt, Human
cugaacucaaacuga

SEQ ID NO: 1348268 - RNA, 18 nt, Human
cugaacucaaacugagga

SEQ ID NO: 1348269 - RNA, 13 nt, Human
cugaacucacuuu

SEQ ID NO: 1348270 - RNA, 15 nt, Human
cugaacagcuggugu

SEQ ID NO: 1348271 - RNA, 16 nt, Human
cugaacagcuggugua

SEQ ID NO: 1348272 - RNA, 13 nt, Human
cugaacagcugua

SEQ ID NO: 1348273 - RNA, 12 nt, Human
cugaacagugga

SEQ ID NO: 1348274 - RNA, 19 nt, Human
cugaacagcugguguagcu

SEQ ID NO: 1348275 - RNA, 15 nt, Human
cugaacuaaagugcu

SEQ ID NO: 1348276 - RNA, 22 nt, Human
cucugucuccuaagcuggagug

SEQ ID NO: 1348277 - RNA, 13 nt, Human
cucugucucgagc

SEQ ID NO: 1348278 - RNA, 18 nt, Human
cucugucucgagcgcccu

SEQ ID NO: 1348279 - RNA, 20 nt, Human
cucugucucgagcgcccugc

SEQ ID NO: 1348280 - RNA, 21 nt, Human
cucugucucgagcgcccugca

SEQ ID NO: 1348281 - RNA, 22 nt, Human
cucugucucgagcgcccugcag

SEQ ID NO: 1348282 - RNA, 23 nt, Human
cucugucucgagcgcccugcaga

SEQ ID NO: 1348283 - RNA, 22 nt, Human
cucuggcuuggccacagccagg

SEQ ID NO: 1348284 - RNA, 14 nt, Human
cucugucucaucca

SEQ ID NO: 1348285 - RNA, 15 nt, Human
cucugucucauccau

SEQ ID NO: 1348286 - RNA, 22 nt, Human
cucuggcuccagcuggccggga

SEQ ID NO: 1348287 - RNA, 19 nt, Human
cucuggcuguaaggcucua

SEQ ID NO: 1348288 - RNA, 20 nt, Human
cucuggcuguaaggcucuag

SEQ ID NO: 1348289 - RNA, 21 nt, Human
cucuggcuguaaggcucuaga

SEQ ID NO: 1348290 - RNA, 22 nt, Human
cucuggcuguaaggcucuagau

SEQ ID NO: 1348291 - RNA, 20 nt, Human
cucuggcuuggccacagcca

SEQ ID NO: 1348292 - RNA, 21 nt, Human
cucuggcuuggccacagccag

SEQ ID NO: 1348293 - RNA, 20 nt, Human
cucugugccagagccugggg

SEQ ID NO: 1348294 - RNA, 21 nt, Human
cucugugccagagccuggggc

SEQ ID NO: 1348295 - RNA, 13 nt, Human
cucugugccuucg

SEQ ID NO: 1348296 - RNA, 12 nt, Human
cucugugcuggc

SEQ ID NO: 1348297 - RNA, 15 nt, Human
cucugugcuggccag

SEQ ID NO: 1348298 - RNA, 19 nt, Human
cucugugcuggccagcgag

SEQ ID NO: 1348299 - RNA, 16 nt, Human
cucugugcuggccagc

SEQ ID NO: 1348300 - RNA, 13 nt, Human
cucugugcugugu

SEQ ID NO: 1348301 - RNA, 17 nt, Human
cucugucuggcaaugcc

SEQ ID NO: 1348302 - RNA, 20 nt, Human
cucugucuggcaaugccaca

SEQ ID NO: 1348303 - RNA, 13 nt, Human
cucugucuucugg

SEQ ID NO: 1348304 - RNA, 14 nt, Human
cucugucuucugga

SEQ ID NO: 1348305 - RNA, 17 nt, Human
cucugucuucuggacug

SEQ ID NO: 1348306 - RNA, 17 nt, Human
cucugugagggugcuga

SEQ ID NO: 1348307 - RNA, 20 nt, Human
cucugugcacuuauuuauga

SEQ ID NO: 1348308 - RNA, 14 nt, Human
cucugugccagagc

SEQ ID NO: 1348309 - RNA, 15 nt, Human
cucugugccagagcc

SEQ ID NO: 1348310 - RNA, 16 nt, Human
cucugugccagagccu

SEQ ID NO: 1348311 - RNA, 17 nt, Human
cucugugccagagccug

SEQ ID NO: 1348312 - RNA, 18 nt, Human
cucugugccagagccugg

SEQ ID NO: 1348313 - RNA, 19 nt, Human
cucugugccagagccuggg

SEQ ID NO: 1348314 - RNA, 19 nt, Human
cucuguucauuccuccagg

SEQ ID NO: 1348315 - RNA, 18 nt, Human
cucuguucauuccuccag

SEQ ID NO: 1348316 - RNA, 13 nt, Human
cucuguucauuuc

SEQ ID NO: 1348317 - RNA, 14 nt, Human
cucuguucauuucc

SEQ ID NO: 1348318 - RNA, 17 nt, Human
cucuguucauuccucca

SEQ ID NO: 1348319 - RNA, 15 nt, Human
cucuguucauuccuc

SEQ ID NO: 1348320 - RNA, 18 nt, Human
cucuguucaaagcugccu

SEQ ID NO: 1348321 - RNA, 20 nt, Human
cucuguuaauaaucucacau

SEQ ID NO: 1348322 - RNA, 22 nt, Human
cucuguuacacuuuuuggaagu

SEQ ID NO: 1348323 - RNA, 15 nt, Human
cucuguucaaagcug

SEQ ID NO: 1348324 - RNA, 22 nt, Human
cucuguucaaagcugccugucc

SEQ ID NO: 1348325 - RNA, 18 nt, Human
cucuguguauuugcuuuu

SEQ ID NO: 1348326 - RNA, 19 nt, Human
cucuguguauuugcuuuuu

SEQ ID NO: 1348327 - RNA, 22 nt, Human
cucugugcuuuuaaaugcauaa

SEQ ID NO: 1348328 - RNA, 17 nt, Human
cucugugggcuggcagu

SEQ ID NO: 1348329 - RNA, 17 nt, Human
cucuguucauuuccuca

SEQ ID NO: 1348330 - RNA, 16 nt, Human
cucuguucauuuccuc

SEQ ID NO: 1348331 - RNA, 12 nt, Human
cucuggccuucg

SEQ ID NO: 1348332 - RNA, 22 nt, Human
cucuggcagccacacuucucag

SEQ ID NO: 1348333 - RNA, 19 nt, Human
cucuggccuucggccucca

SEQ ID NO: 1348334 - RNA, 15 nt, Human
cucuggcuccagcug

SEQ ID NO: 1348335 - RNA, 16 nt, Human
cucuggcuccagcugg

SEQ ID NO: 1348336 - RNA, 14 nt, Human
cucuggaggggagg

SEQ ID NO: 1348337 - RNA, 15 nt, Human
cucuggaggggaggg

SEQ ID NO: 1348338 - RNA, 16 nt, Human
cucuggaggggagggg

SEQ ID NO: 1348339 - RNA, 19 nt, Human
cucuggagggguguggcuc

SEQ ID NO: 1348340 - RNA, 20 nt, Human
cucuggagggguguggcucc

SEQ ID NO: 1348341 - RNA, 21 nt, Human
cucuggagggguguggcuccu

SEQ ID NO: 1348342 - RNA, 13 nt, Human
cucucucccuuuu

SEQ ID NO: 1348343 - RNA, 14 nt, Human
cucugcuucucacg

SEQ ID NO: 1348344 - RNA, 12 nt, Human
cucugcuucucu

SEQ ID NO: 1348345 - RNA, 13 nt, Human
cucugcuucucug

SEQ ID NO: 1348346 - RNA, 14 nt, Human
cucugcuucucuga

SEQ ID NO: 1348347 - RNA, 15 nt, Human
cucugcuucucugac

SEQ ID NO: 1348348 - RNA, 16 nt, Human
cucugcuucucugacu

SEQ ID NO: 1348349 - RNA, 17 nt, Human
cucugcuucucugacuu

SEQ ID NO: 1348350 - RNA, 21 nt, Human
cucugcuucucugacuucugc

SEQ ID NO: 1348351 - RNA, 19 nt, Human
cugaggaucagaguaaucc

SEQ ID NO: 1348352 - RNA, 20 nt, Human
cugaggagucugagguccug

SEQ ID NO: 1348353 - RNA, 17 nt, Human
cugaggaucagaguaau

SEQ ID NO: 1348354 - RNA, 15 nt, Human
cugagcugaccagcc

SEQ ID NO: 1348355 - RNA, 12 nt, Human
cugagcugaggc

SEQ ID NO: 1348356 - RNA, 13 nt, Human
cugagcugaggca

SEQ ID NO: 1348357 - RNA, 15 nt, Human
cugagcugaggcagc

SEQ ID NO: 1348358 - RNA, 19 nt, Human
cugaggagucugagguccu

SEQ ID NO: 1348359 - RNA, 12 nt, Human
cugagcucugag

SEQ ID NO: 1348360 - RNA, 13 nt, Human
cugagcucugaga

SEQ ID NO: 1348361 - RNA, 14 nt, Human
cugagcucugagag

SEQ ID NO: 1348362 - RNA, 15 nt, Human
cugagcucugagagg

SEQ ID NO: 1348363 - RNA, 16 nt, Human
cugagcucugagaggc

SEQ ID NO: 1348364 - RNA, 17 nt, Human
cugagcucugagaggcc

SEQ ID NO: 1348365 - RNA, 18 nt, Human
cugagcucugagaggccc

SEQ ID NO: 1348366 - RNA, 19 nt, Human
cugagcucugagaggcccu

SEQ ID NO: 1348367 - RNA, 20 nt, Human
cugagcucugagaggcccug

SEQ ID NO: 1348368 - RNA, 21 nt, Human
cugagcucugagaggcccugg

SEQ ID NO: 1348369 - RNA, 23 nt, Human
cugagcucugagaggcccuggau

SEQ ID NO: 1348370 - RNA, 22 nt, Human
cugagcucugagaggcccugga

SEQ ID NO: 1348371 - RNA, 12 nt, Human
cugaggccacac

SEQ ID NO: 1348372 - RNA, 14 nt, Human
cugaggccacacuc

SEQ ID NO: 1348373 - RNA, 20 nt, Human
cugaggccacacucagcaca

SEQ ID NO: 1348374 - RNA, 21 nt, Human
cugaggccacacucagcacaa

SEQ ID NO: 1348375 - RNA, 24 nt, Human
cugaggccacacucagcacaaggc

SEQ ID NO: 1348376 - RNA, 17 nt, Human
cugaggccacccagagg

SEQ ID NO: 1348377 - RNA, 12 nt, Human
cugaggccagcc

SEQ ID NO: 1348378 - RNA, 13 nt, Human
cugaggccagccu

SEQ ID NO: 1348379 - RNA, 15 nt, Human
cugaggcagcagugu

SEQ ID NO: 1348380 - RNA, 17 nt, Human
cugaggcagcaguguga

SEQ ID NO: 1348381 - RNA, 22 nt, Human
cugaggcagcagugugaggcca

SEQ ID NO: 1348382 - RNA, 23 nt, Human
cugaggcagcagugugaggccag

SEQ ID NO: 1348383 - RNA, 24 nt, Human
cugaggcagcagugugaggccagg

SEQ ID NO: 1348384 - RNA, 14 nt, Human
cugaggccagccug

SEQ ID NO: 1348385 - RNA, 15 nt, Human
cugaggccagccugg

SEQ ID NO: 1348386 - RNA, 16 nt, Human
cugaggccagccuggc

SEQ ID NO: 1348387 - RNA, 17 nt, Human
cugaggccagccuggcc

SEQ ID NO: 1348388 - RNA, 18 nt, Human
cugaggccagccuggccu

SEQ ID NO: 1348389 - RNA, 19 nt, Human
cugaggccagccuggccuc

SEQ ID NO: 1348390 - RNA, 20 nt, Human
cugaggccagccuggccucc

SEQ ID NO: 1348391 - RNA, 22 nt, Human
cugaggccagccuggccuccug

SEQ ID NO: 1348392 - RNA, 15 nt, Human
cugagacaaugccuu

SEQ ID NO: 1348393 - RNA, 17 nt, Human
cugagccagggucucca

SEQ ID NO: 1348394 - RNA, 18 nt, Human
cugagccagggucuccag

SEQ ID NO: 1348395 - RNA, 19 nt, Human
cugagccagggucuccaga

SEQ ID NO: 1348396 - RNA, 22 nt, Human
cugagccagggucuccagaaag

SEQ ID NO: 1348397 - RNA, 16 nt, Human
cugagccagugucagg

SEQ ID NO: 1348398 - RNA, 22 nt, Human
cugagccagugucaggaggaag

SEQ ID NO: 1348399 - RNA, 20 nt, Human
cugagccagggucuccagaa

SEQ ID NO: 1348400 - RNA, 23 nt, Human
cugagcccgguaagagcaaaaga

SEQ ID NO: 1348401 - RNA, 16 nt, Human
cugagccucagucucc

SEQ ID NO: 1348402 - RNA, 21 nt, Human
cugagccucagucucccuccc

SEQ ID NO: 1348403 - RNA, 18 nt, Human
cugagccggccccaggcu

SEQ ID NO: 1348404 - RNA, 19 nt, Human
cugagccggccccaggcuc

SEQ ID NO: 1348405 - RNA, 23 nt, Human
cugagccggccccaggcucgugg

SEQ ID NO: 1348406 - RNA, 16 nt, Human
cugagccggccccagg

SEQ ID NO: 1348407 - RNA, 20 nt, Human
cugagcgacagugagacucu

SEQ ID NO: 1348408 - RNA, 16 nt, Human
cugagcgacagugaga

SEQ ID NO: 1348409 - RNA, 15 nt, Human
cugagccuuguaauu

SEQ ID NO: 1348410 - RNA, 16 nt, Human
cugagccuuguaauuc

SEQ ID NO: 1348411 - RNA, 22 nt, Human
cugagccucagucucccucccu

SEQ ID NO: 1348412 - RNA, 12 nt, Human
cugagccugccg

SEQ ID NO: 1348413 - RNA, 13 nt, Human
cugagccugccga

SEQ ID NO: 1348414 - RNA, 14 nt, Human
cugagccugccgag

SEQ ID NO: 1348415 - RNA, 15 nt, Human
cugagccugccgagc

SEQ ID NO: 1348416 - RNA, 16 nt, Human
cugagccugccgagca

SEQ ID NO: 1348417 - RNA, 19 nt, Human
cugagccugccgagcaacc

SEQ ID NO: 1348418 - RNA, 16 nt, Human
cugagcuauguaguau

SEQ ID NO: 1348419 - RNA, 14 nt, Human
cugagcucacaagg

SEQ ID NO: 1348420 - RNA, 17 nt, Human
cugagcucacaaggcag

SEQ ID NO: 1348421 - RNA, 18 nt, Human
cugagcucacaaggcagc

SEQ ID NO: 1348422 - RNA, 19 nt, Human
cugagcucacaaggcagca

SEQ ID NO: 1348423 - RNA, 20 nt, Human
cugagcucacaaggcagcaa

SEQ ID NO: 1348424 - RNA, 23 nt, Human
cugagcucacaaggcagcaaggc

SEQ ID NO: 1348425 - RNA, 22 nt, Human
cugagcucacaaggcagcaagg

SEQ ID NO: 1348426 - RNA, 15 nt, Human
cugagcucagcgugg

SEQ ID NO: 1348427 - RNA, 16 nt, Human
cugagcucagcgugga

SEQ ID NO: 1348428 - RNA, 17 nt, Human
cugagcucagcguggag

SEQ ID NO: 1348429 - RNA, 22 nt, Human
cugagcuccagcuccuuugggc

SEQ ID NO: 1348430 - RNA, 17 nt, Human
cugagcuccagcuccuu

SEQ ID NO: 1348431 - RNA, 12 nt, Human
cugagcuccugu

SEQ ID NO: 1348432 - RNA, 17 nt, Human
cugagcuccuguccccu

SEQ ID NO: 1348433 - RNA, 22 nt, Human
cugagcuccuguccccugcuac

SEQ ID NO: 1348434 - RNA, 21 nt, Human
cugagccuuguaauucuaaau

SEQ ID NO: 1348435 - RNA, 20 nt, Human
cugagcgaggagaugcuccu

SEQ ID NO: 1348436 - RNA, 21 nt, Human
cugagcgaguggagucugcca

SEQ ID NO: 1348437 - RNA, 15 nt, Human
cugagcgccaggaug

SEQ ID NO: 1348438 - RNA, 13 nt, Human
cugagcgccucca

SEQ ID NO: 1348439 - RNA, 15 nt, Human
cugagcgccuccauc

SEQ ID NO: 1348440 - RNA, 22 nt, Human
cugagcgccuccauccaaggcc

SEQ ID NO: 1348441 - RNA, 18 nt, Human
cugagcgaguggagucug

SEQ ID NO: 1348442 - RNA, 15 nt, Human
cugagcuagaacccu

SEQ ID NO: 1348443 - RNA, 13 nt, Human
cugagcuauuuca

SEQ ID NO: 1348444 - RNA, 16 nt, Human
cugagcuauuucaucu

SEQ ID NO: 1348445 - RNA, 21 nt, Human
cugagcuauuucaucuauuuu

SEQ ID NO: 1348446 - RNA, 14 nt, Human
cugagaaauuuaua

SEQ ID NO: 1348447 - RNA, 11 nt, Human
cugagaaauuu

SEQ ID NO: 1348448 - RNA, 16 nt, Human
cugagaaagcucaaag

SEQ ID NO: 1348449 - RNA, 22 nt, Human
cugagaaccguagaugauuuca

SEQ ID NO: 1348450 - RNA, 15 nt, Human
cugacuuggcuggug

SEQ ID NO: 1348451 - RNA, 16 nt, Human
cugacuuggcuggugu

SEQ ID NO: 1348452 - RNA, 17 nt, Human
cugacuuggcuggugug

SEQ ID NO: 1348453 - RNA, 20 nt, Human
cugacuuggcugguguggua

SEQ ID NO: 1348454 - RNA, 22 nt, Human
cugacuuggcuggugugguaca

SEQ ID NO: 1348455 - RNA, 19 nt, Human
cugacuuucuuuuuugaua

SEQ ID NO: 1348456 - RNA, 16 nt, Human
cugagaaucagacuga

SEQ ID NO: 1348457 - RNA, 21 nt, Human
cugagaauuguugagauacuu

SEQ ID NO: 1348458 - RNA, 12 nt, Human
cugagaaccugg

SEQ ID NO: 1348459 - RNA, 13 nt, Human
cugagaaccuggc

SEQ ID NO: 1348460 - RNA, 14 nt, Human
cugagaaccuggcc

SEQ ID NO: 1348461 - RNA, 15 nt, Human
cugagaaccuggccu

SEQ ID NO: 1348462 - RNA, 16 nt, Human
cugagaaccuggccuu

SEQ ID NO: 1348463 - RNA, 17 nt, Human
cugagaaccuggccuuc

SEQ ID NO: 1348464 - RNA, 18 nt, Human
cugagaaccuggccuuca

SEQ ID NO: 1348465 - RNA, 19 nt, Human
cugagaaccuggccuucag

SEQ ID NO: 1348466 - RNA, 20 nt, Human
cugagaaccuggccuucagu

SEQ ID NO: 1348467 - RNA, 16 nt, Human
cugagaagcucugaag

SEQ ID NO: 1348468 - RNA, 13 nt, Human
cugagaagcucug

SEQ ID NO: 1348469 - RNA, 17 nt, Human
cugacucuuaagaagac

SEQ ID NO: 1348470 - RNA, 18 nt, Human
cugacuagggagccaugu

SEQ ID NO: 1348471 - RNA, 18 nt, Human
cugacuauucuugaugua

SEQ ID NO: 1348472 - RNA, 19 nt, Human
cugacuauucuugauguaa

SEQ ID NO: 1348473 - RNA, 20 nt, Human
cugacuauucuugauguaaa

SEQ ID NO: 1348474 - RNA, 21 nt, Human
cugacuauucuugauguaaaa

SEQ ID NO: 1348475 - RNA, 22 nt, Human
cugacuauucuugauguaaaau

SEQ ID NO: 1348476 - RNA, 23 nt, Human
cugacuauucuugauguaaaauc

SEQ ID NO: 1348477 - RNA, 22 nt, Human
cugacucacaccugaacugaac

SEQ ID NO: 1348478 - RNA, 12 nt, Human
cugacucagggc

SEQ ID NO: 1348479 - RNA, 14 nt, Human
cugacucagggcuc

SEQ ID NO: 1348480 - RNA, 15 nt, Human
cugacucagggcucc

SEQ ID NO: 1348481 - RNA, 17 nt, Human
cugacuucaucucccac

SEQ ID NO: 1348482 - RNA, 23 nt, Human
cugacuucaucucccaccuagca

SEQ ID NO: 1348483 - RNA, 11 nt, Human
cugacuucugc

SEQ ID NO: 1348484 - RNA, 12 nt, Human
cugacuucugcc

SEQ ID NO: 1348485 - RNA, 13 nt, Human
cugacuucugccu

SEQ ID NO: 1348486 - RNA, 14 nt, Human
cugacuucugccug

SEQ ID NO: 1348487 - RNA, 15 nt, Human
cugacuucugccugg

SEQ ID NO: 1348488 - RNA, 16 nt, Human
cugacuucugccugga

SEQ ID NO: 1348489 - RNA, 18 nt, Human
cugacuucugccuggaga

SEQ ID NO: 1348490 - RNA, 19 nt, Human
cugacuucugccuggagac

SEQ ID NO: 1348491 - RNA, 12 nt, Human
cugacuuggcug

SEQ ID NO: 1348492 - RNA, 14 nt, Human
cugacuuggcuggu

SEQ ID NO: 1348493 - RNA, 11 nt, Human
cugacagcagc

SEQ ID NO: 1348494 - RNA, 15 nt, Human
cugacagcagcaucu

SEQ ID NO: 1348495 - RNA, 16 nt, Human
cugacagcagcaucuc

SEQ ID NO: 1348496 - RNA, 17 nt, Human
cugacagcagcaucucu

SEQ ID NO: 1348497 - RNA, 21 nt, Human
cugacaggugaggucuguucc

SEQ ID NO: 1348498 - RNA, 19 nt, Human
cugacaguuuacagacgcu

SEQ ID NO: 1348499 - RNA, 13 nt, Human
cugacaucaaaaa

SEQ ID NO: 1348500 - RNA, 15 nt, Human
cugacaucaaaaaag

SEQ ID NO: 1348501 - RNA, 17 nt, Human
cugacaucaaaaaaggc

SEQ ID NO: 1348502 - RNA, 23 nt, Human
cugacaugaagcuguugugugag

SEQ ID NO: 1348503 - RNA, 14 nt, Human
cugacauguggggc

SEQ ID NO: 1348504 - RNA, 19 nt, Human
cugacauguggggccaggu

SEQ ID NO: 1348505 - RNA, 21 nt, Human
cugacauguggggccagguca

SEQ ID NO: 1348506 - RNA, 18 nt, Human
cugacauuuggaguguuc

SEQ ID NO: 1348507 - RNA, 21 nt, Human
cugacauuuggaguguucccc

SEQ ID NO: 1348508 - RNA, 15 nt, Human
cugaccaaacagcca

SEQ ID NO: 1348509 - RNA, 15 nt, Human
cugaccacacgcggg

SEQ ID NO: 1348510 - RNA, 21 nt, Human
cugacuagggagccauguuuc

SEQ ID NO: 1348511 - RNA, 21 nt, Human
cucucucauacccucccuccc

SEQ ID NO: 1348512 - RNA, 23 nt, Human
cucucuaggguacauggugcugg

SEQ ID NO: 1348513 - RNA, 14 nt, Human
cucucuauccucuc

SEQ ID NO: 1348514 - RNA, 24 nt, Human
cucucuauccucucuuccucuucc

SEQ ID NO: 1348515 - RNA, 14 nt, Human
cucucuaugccucu

SEQ ID NO: 1348516 - RNA, 22 nt, Human
cucucuaggguacauggugcug

SEQ ID NO: 1348517 - RNA, 15 nt, Human
cucuccugucucccu

SEQ ID NO: 1348518 - RNA, 17 nt, Human
cucuccugucucccucc

SEQ ID NO: 1348519 - RNA, 16 nt, Human
cucuccuggcuuccca

SEQ ID NO: 1348520 - RNA, 17 nt, Human
cucuccuggcuucccau

SEQ ID NO: 1348521 - RNA, 18 nt, Human
cucuccugucucccuccu

SEQ ID NO: 1348522 - RNA, 22 nt, Human
cucuccuucaugacagccucca

SEQ ID NO: 1348523 - RNA, 14 nt, Human
cucuccuuccugug

SEQ ID NO: 1348524 - RNA, 12 nt, Human
cucuccuggcuu

SEQ ID NO: 1348525 - RNA, 13 nt, Human
cucuccuggcuuc

SEQ ID NO: 1348526 - RNA, 22 nt, Human
cucuccuggcuucccaucccca

SEQ ID NO: 1348527 - RNA, 18 nt, Human
cucuccagccucagcucu

SEQ ID NO: 1348528 - RNA, 15 nt, Human
cucuccacugccuuc

SEQ ID NO: 1348529 - RNA, 14 nt, Human
cucuccagcugacu

SEQ ID NO: 1348530 - RNA, 15 nt, Human
cucuccagcugacua

SEQ ID NO: 1348531 - RNA, 16 nt, Human
cucuccagcugacuaa

SEQ ID NO: 1348532 - RNA, 14 nt, Human
cucuccucuugcca

SEQ ID NO: 1348533 - RNA, 15 nt, Human
cucuccucuugccac

SEQ ID NO: 1348534 - RNA, 16 nt, Human
cucuccucuugccacu

SEQ ID NO: 1348535 - RNA, 17 nt, Human
cucuccucuugccacug

SEQ ID NO: 1348536 - RNA, 19 nt, Human
cucuccucuugccacugcc

SEQ ID NO: 1348537 - RNA, 22 nt, Human
cucuccucuugccacugccucu

SEQ ID NO: 1348538 - RNA, 12 nt, Human
cucuccucuucu

SEQ ID NO: 1348539 - RNA, 15 nt, Human
cucuccugccccuug

SEQ ID NO: 1348540 - RNA, 16 nt, Human
cucuccaaaccacuuu

SEQ ID NO: 1348541 - RNA, 15 nt, Human
cucuccaaaccacuu

SEQ ID NO: 1348542 - RNA, 18 nt, Human
cucucauuuagccugucc

SEQ ID NO: 1348543 - RNA, 17 nt, Human
cucucauuuagccuguc

SEQ ID NO: 1348544 - RNA, 12 nt, Human
cucuccacugcc

SEQ ID NO: 1348545 - RNA, 14 nt, Human
cucuccacugccuu

SEQ ID NO: 1348546 - RNA, 22 nt, Human
cucuccacucaugugacucuuu

SEQ ID NO: 1348547 - RNA, 11 nt, Human
cucuccacugc

SEQ ID NO: 1348548 - RNA, 21 nt, Human
cucuccacucaugugacucuu

SEQ ID NO: 1348549 - RNA, 17 nt, Human
cucuauaccaauaaagu

SEQ ID NO: 1348550 - RNA, 16 nt, Human
cucuauaccaauaaag

SEQ ID NO: 1348551 - RNA, 15 nt, Human
cucuauaccaauaaa

SEQ ID NO: 1348552 - RNA, 13 nt, Human
cucuaguucuuug

SEQ ID NO: 1348553 - RNA, 15 nt, Human
cucuaguucuuuguu

SEQ ID NO: 1348554 - RNA, 18 nt, Human
cucuaguucuuuguucau

SEQ ID NO: 1348555 - RNA, 17 nt, Human
cucuagugcgguuuacu

SEQ ID NO: 1348556 - RNA, 21 nt, Human
cucuaguuuuuucuuccuuuu

SEQ ID NO: 1348557 - RNA, 15 nt, Human
cucuaggaaauauuu

SEQ ID NO: 1348558 - RNA, 13 nt, Human
cucuagaguccaa

SEQ ID NO: 1348559 - RNA, 15 nt, Human
cucuagaguccaagg

SEQ ID NO: 1348560 - RNA, 16 nt, Human
cucuagaguccaaggu

SEQ ID NO: 1348561 - RNA, 14 nt, Human
cucuagaucauaag

SEQ ID NO: 1348562 - RNA, 12 nt, Human
cucuagauucca

SEQ ID NO: 1348563 - RNA, 12 nt, Human
cucuagaaucug

SEQ ID NO: 1348564 - RNA, 16 nt, Human
cucuagacacugccac

SEQ ID NO: 1348565 - RNA, 21 nt, Human
cucuagacacugccacacagg

SEQ ID NO: 1348566 - RNA, 21 nt, Human
cucuagagaaauaagaucuuu

SEQ ID NO: 1348567 - RNA, 19 nt, Human
cucuagagcagacuacagc

SEQ ID NO: 1348568 - RNA, 13 nt, Human
cucuagagcaggg

SEQ ID NO: 1348569 - RNA, 16 nt, Human
cucuagagcagggauu

SEQ ID NO: 1348570 - RNA, 22 nt, Human
cucuagagcagacuacagcugg

SEQ ID NO: 1348571 - RNA, 17 nt, Human
cucuaggaaauauuuau

SEQ ID NO: 1348572 - RNA, 16 nt, Human
cucuagcugugggggu

SEQ ID NO: 1348573 - RNA, 21 nt, Human
cucuaggguacauggugcugg

SEQ ID NO: 1348574 - RNA, 23 nt, Human
cucuagguacgaugacaguguuc

SEQ ID NO: 1348575 - RNA, 15 nt, Human
cucuaguauuccaga

SEQ ID NO: 1348576 - RNA, 15 nt, Human
cucuagucaaugaca

SEQ ID NO: 1348577 - RNA, 18 nt, Human
cucuagucaaugacauga

SEQ ID NO: 1348578 - RNA, 22 nt, Human
cucuagucaaugacaugaauuu

SEQ ID NO: 1348579 - RNA, 17 nt, Human
cucuacaucuucugccu

SEQ ID NO: 1348580 - RNA, 18 nt, Human
cucuacaucuucugccuu

SEQ ID NO: 1348581 - RNA, 12 nt, Human
cucuaccugaca

SEQ ID NO: 1348582 - RNA, 22 nt, Human
cucuaccugacacucccuuggg

SEQ ID NO: 1348583 - RNA, 19 nt, Human
cucuacccauauuacagau

SEQ ID NO: 1348584 - RNA, 16 nt, Human
cucuacccauauuaca

SEQ ID NO: 1348585 - RNA, 14 nt, Human
cucuaccccaauuu

SEQ ID NO: 1348586 - RNA, 16 nt, Human
cucuacuuagcauguc

SEQ ID NO: 1348587 - RNA, 17 nt, Human
cucuacuuaauccaaug

SEQ ID NO: 1348588 - RNA, 18 nt, Human
cucuacuuaauccaaugg

SEQ ID NO: 1348589 - RNA, 17 nt, Human
cucuacuuagcaugucc

SEQ ID NO: 1348590 - RNA, 19 nt, Human
cucuacuuagcaugucccu

SEQ ID NO: 1348591 - RNA, 20 nt, Human
cucuacuuagcaugucccua

SEQ ID NO: 1348592 - RNA, 14 nt, Human
cucuaccuucuccc

SEQ ID NO: 1348593 - RNA, 15 nt, Human
cucuaccuucucccc

SEQ ID NO: 1348594 - RNA, 16 nt, Human
cucuaccuucucccca

SEQ ID NO: 1348595 - RNA, 18 nt, Human
cucuaccuucuccccagc

SEQ ID NO: 1348596 - RNA, 21 nt, Human
cucuaccuucuccccagcucc

SEQ ID NO: 1348597 - RNA, 22 nt, Human
cucuaccuucuccccagcuccc

SEQ ID NO: 1348598 - RNA, 21 nt, Human
cucuacuaacaaucagcuccu

SEQ ID NO: 1348599 - RNA, 20 nt, Human
cucuacuaaugccucuucau

SEQ ID NO: 1348600 - RNA, 17 nt, Human
cucuacugaaugucauu

SEQ ID NO: 1348601 - RNA, 20 nt, Human
cucuacugaaugucauugaa

SEQ ID NO: 1348602 - RNA, 12 nt, Human
cucuacugggaa

SEQ ID NO: 1348603 - RNA, 13 nt, Human
cucuacugggaag

SEQ ID NO: 1348604 - RNA, 16 nt, Human
cucuacugggaaggcu

SEQ ID NO: 1348605 - RNA, 19 nt, Human
cucuacugggaaggcuacu

SEQ ID NO: 1348606 - RNA, 16 nt, Human
cucgcugccagcucug

SEQ ID NO: 1348607 - RNA, 19 nt, Human
cucgcugccagcucuguau

SEQ ID NO: 1348608 - RNA, 21 nt, Human
cuccuucaacaauucuaaaau

SEQ ID NO: 1348609 - RNA, 15 nt, Human
cucgcuggacucuca

SEQ ID NO: 1348610 - RNA, 16 nt, Human
cucgcuggacucucag

SEQ ID NO: 1348611 - RNA, 19 nt, Human
cucgcuggacucucagucu

SEQ ID NO: 1348612 - RNA, 18 nt, Human
cucgcuguccuuucuaga

SEQ ID NO: 1348613 - RNA, 17 nt, Human
cucggcucacugcaucc

SEQ ID NO: 1348614 - RNA, 18 nt, Human
cucggcucacugcauccu

SEQ ID NO: 1348615 - RNA, 19 nt, Human
cucggcuccccaugugucc

SEQ ID NO: 1348616 - RNA, 22 nt, Human
cucggcuccccauguguccugg

SEQ ID NO: 1348617 - RNA, 13 nt, Human
cucggaggaagcc

SEQ ID NO: 1348618 - RNA, 17 nt, Human
cucggaggaagccccca

SEQ ID NO: 1348619 - RNA, 21 nt, Human
cucuacagcuaaucagcauuc

SEQ ID NO: 1348620 - RNA, 23 nt, Human
cucuacagagcuucccugacuca

SEQ ID NO: 1348621 - RNA, 15 nt, Human
cucuacaucuucugc

SEQ ID NO: 1348622 - RNA, 17 nt, Human
cucuacagagcuucccu

SEQ ID NO: 1348623 - RNA, 18 nt, Human
cucuacagagcuucccug

SEQ ID NO: 1348624 - RNA, 20 nt, Human
cucuacagagcuucccugac

SEQ ID NO: 1348625 - RNA, 22 nt, Human
cucuacagagcuucccugacuc

SEQ ID NO: 1348626 - RNA, 18 nt, Human
cucuaauucuauuaaagu

SEQ ID NO: 1348627 - RNA, 17 nt, Human
cucuaauucuuccuuug

SEQ ID NO: 1348628 - RNA, 16 nt, Human
cucuacaaacucccac

SEQ ID NO: 1348629 - RNA, 17 nt, Human
cucuacaaacucccacu

SEQ ID NO: 1348630 - RNA, 15 nt, Human
cucuacacucuugua

SEQ ID NO: 1348631 - RNA, 20 nt, Human
cucuaauucacagugcucuu

SEQ ID NO: 1348632 - RNA, 17 nt, Human
cucuaacgccugagccc

SEQ ID NO: 1348633 - RNA, 18 nt, Human
cucuaacgccugagccca

SEQ ID NO: 1348634 - RNA, 20 nt, Human
cucuaacgccugagcccagg

SEQ ID NO: 1348635 - RNA, 21 nt, Human
cucuaacgccugagcccaggg

SEQ ID NO: 1348636 - RNA, 22 nt, Human
cucuaacgccugagcccaggga

SEQ ID NO: 1348637 - RNA, 20 nt, Human
cucuaacuuggcucacacuc

SEQ ID NO: 1348638 - RNA, 12 nt, Human
cucuaagaaaga

SEQ ID NO: 1348639 - RNA, 14 nt, Human
cucuaagaaagaac

SEQ ID NO: 1348640 - RNA, 14 nt, Human
cucuaagaucuuag

SEQ ID NO: 1348641 - RNA, 16 nt, Human
cucuaagaucuuagau

SEQ ID NO: 1348642 - RNA, 19 nt, Human
cucuaagaucuuagauucu

SEQ ID NO: 1348643 - RNA, 22 nt, Human
cucuaagaucuuagauucucug

SEQ ID NO: 1348644 - RNA, 13 nt, Human
cucuaacauuucc

SEQ ID NO: 1348645 - RNA, 12 nt, Human
cucuaacgccug

SEQ ID NO: 1348646 - RNA, 13 nt, Human
cucuaacgccuga

SEQ ID NO: 1348647 - RNA, 15 nt, Human
cucuaacgccugagc

SEQ ID NO: 1348648 - RNA, 16 nt, Human
cucuaacgccugagcc

SEQ ID NO: 1348649 - RNA, 22 nt, Human
cuccuccaggguggcagcaaca

SEQ ID NO: 1348650 - RNA, 15 nt, Human
cuccuccaugggaga

SEQ ID NO: 1348651 - RNA, 18 nt, Human
cuccuccaugggagaaaa

SEQ ID NO: 1348652 - RNA, 15 nt, Human
cuccucccacccggc

SEQ ID NO: 1348653 - RNA, 12 nt, Human
cuccucccaggg

SEQ ID NO: 1348654 - RNA, 14 nt, Human
cuccucccaggguu

SEQ ID NO: 1348655 - RNA, 21 nt, Human
cuccuccaggguggcagcaac

SEQ ID NO: 1348656 - RNA, 13 nt, Human
cuccuccagggug

SEQ ID NO: 1348657 - RNA, 14 nt, Human
cuccuccaccucaa

SEQ ID NO: 1348658 - RNA, 15 nt, Human
cuccuccaggaagcc

SEQ ID NO: 1348659 - RNA, 15 nt, Human
cuccuccaccucaac

SEQ ID NO: 1348660 - RNA, 16 nt, Human
cuccuccaggaagccu

SEQ ID NO: 1348661 - RNA, 13 nt, Human
cuccuccagggac

SEQ ID NO: 1348662 - RNA, 14 nt, Human
cuccuccagggaca

SEQ ID NO: 1348663 - RNA, 15 nt, Human
cuccucaucccgugu

SEQ ID NO: 1348664 - RNA, 11 nt, Human
cuccucaugua

SEQ ID NO: 1348665 - RNA, 20 nt, Human
cuccucauguacauacccug

SEQ ID NO: 1348666 - RNA, 18 nt, Human
cuccucauucacaucgca

SEQ ID NO: 1348667 - RNA, 17 nt, Human
cuccucgagaucccaac

SEQ ID NO: 1348668 - RNA, 15 nt, Human
cuccuccuuuuucca

SEQ ID NO: 1348669 - RNA, 21 nt, Human
cuccucgagaucccaacacug

SEQ ID NO: 1348670 - RNA, 24 nt, Human
cuccucgagaucccaacacugcca

SEQ ID NO: 1348671 - RNA, 15 nt, Human
cuccucuccccagcc

SEQ ID NO: 1348672 - RNA, 14 nt, Human
cuccucccggugcc

SEQ ID NO: 1348673 - RNA, 14 nt, Human
cuccuccccuggag

SEQ ID NO: 1348674 - RNA, 23 nt, Human
cuccuccccuggagggggaaugg

SEQ ID NO: 1348675 - RNA, 22 nt, Human
cuccucccaggguuuuaacuuu

SEQ ID NO: 1348676 - RNA, 21 nt, Human
cuccucccaggguuuuaacuu

SEQ ID NO: 1348677 - RNA, 19 nt, Human
cuccuccccaacugugggg

SEQ ID NO: 1348678 - RNA, 15 nt, Human
cuccucccggugccc

SEQ ID NO: 1348679 - RNA, 17 nt, Human
cuccucccggugcccaa

SEQ ID NO: 1348680 - RNA, 15 nt, Human
cuccuccccuggagg

SEQ ID NO: 1348681 - RNA, 10 nt, Human
cuccucccuc

SEQ ID NO: 1348682 - RNA, 16 nt, Human
cuccucccucccucuc

SEQ ID NO: 1348683 - RNA, 22 nt, Human
cucccucaucaaggacacgggc

SEQ ID NO: 1348684 - RNA, 23 nt, Human
cucccucaucaaggacacgggcc

SEQ ID NO: 1348685 - RNA, 13 nt, Human
cucccucauucca

SEQ ID NO: 1348686 - RNA, 14 nt, Human
cucccucagugccc

SEQ ID NO: 1348687 - RNA, 23 nt, Human
cucccucagugcccucauuuuau

SEQ ID NO: 1348688 - RNA, 15 nt, Human
cuccgccucccgggu

SEQ ID NO: 1348689 - RNA, 17 nt, Human
cuccgcccugccacuca

SEQ ID NO: 1348690 - RNA, 15 nt, Human
cuccgcccugccacu

SEQ ID NO: 1348691 - RNA, 16 nt, Human
cuccgcccugccacuc

SEQ ID NO: 1348692 - RNA, 13 nt, Human
cuccgcccugcca

SEQ ID NO: 1348693 - RNA, 14 nt, Human
cuccgcccugccac

SEQ ID NO: 1348694 - RNA, 13 nt, Human
cuccgccauccac

SEQ ID NO: 1348695 - RNA, 15 nt, Human
cuccgcccccaggua

SEQ ID NO: 1348696 - RNA, 16 nt, Human
cuccgcccccagguag

SEQ ID NO: 1348697 - RNA, 17 nt, Human
cuccucacccccagcuu

SEQ ID NO: 1348698 - RNA, 20 nt, Human
cuccucacccccagcuuugc

SEQ ID NO: 1348699 - RNA, 21 nt, Human
cuccucacccccagcuuugcu

SEQ ID NO: 1348700 - RNA, 16 nt, Human
cuccugccucagccuc

SEQ ID NO: 1348701 - RNA, 12 nt, Human
cuccugccucua

SEQ ID NO: 1348702 - RNA, 22 nt, Human
cuccugccucuacugggaaggc

SEQ ID NO: 1348703 - RNA, 15 nt, Human
cuccugccucuacug

SEQ ID NO: 1348704 - RNA, 16 nt, Human
cuccugccuuccuccu

SEQ ID NO: 1348705 - RNA, 18 nt, Human
cuccugccuuccuccugg

SEQ ID NO: 1348706 - RNA, 19 nt, Human
cuccugccuuccuccuggg

SEQ ID NO: 1348707 - RNA, 20 nt, Human
cuccugccuuccuccugggc

SEQ ID NO: 1348708 - RNA, 21 nt, Human
cuccugccuugaaaaagacau

SEQ ID NO: 1348709 - RNA, 14 nt, Human
cuccugccuugaaa

SEQ ID NO: 1348710 - RNA, 23 nt, Human
cuccugcuaacggugcucagggg

SEQ ID NO: 1348711 - RNA, 21 nt, Human
cuccuguggccccacccuggg

SEQ ID NO: 1348712 - RNA, 22 nt, Human
cuccuguggccccacccugggc

SEQ ID NO: 1348713 - RNA, 13 nt, Human
cuccugugggagc

SEQ ID NO: 1348714 - RNA, 15 nt, Human
cuccugugggagccu

SEQ ID NO: 1348715 - RNA, 16 nt, Human
cuccugugggagccuc

SEQ ID NO: 1348716 - RNA, 17 nt, Human
cuccugugggagccucg

SEQ ID NO: 1348717 - RNA, 18 nt, Human
cuccugugggagccucgc

SEQ ID NO: 1348718 - RNA, 19 nt, Human
cuccugugggagccucgca

SEQ ID NO: 1348719 - RNA, 11 nt, Human
cuccugugacc

SEQ ID NO: 1348720 - RNA, 14 nt, Human
cuccugugcucagc

SEQ ID NO: 1348721 - RNA, 16 nt, Human
cuccugugcucagccc

SEQ ID NO: 1348722 - RNA, 17 nt, Human
cuccugugcucagcccu

SEQ ID NO: 1348723 - RNA, 19 nt, Human
cuccugugcucagcccuga

SEQ ID NO: 1348724 - RNA, 20 nt, Human
cuccugugcucagcccugag

SEQ ID NO: 1348725 - RNA, 22 nt, Human
cuccugugcucagcccugagga

SEQ ID NO: 1348726 - RNA, 13 nt, Human
cuccuguggcccc

SEQ ID NO: 1348727 - RNA, 19 nt, Human
cuccuguggccccacccug

SEQ ID NO: 1348728 - RNA, 20 nt, Human
cuccuguggccccacccugg

SEQ ID NO: 1348729 - RNA, 18 nt, Human
cuccugcacuuacuugcu

SEQ ID NO: 1348730 - RNA, 19 nt, Human
cuccugcacuuacuugcuu

SEQ ID NO: 1348731 - RNA, 20 nt, Human
cuccugcacuuacuugcuua

SEQ ID NO: 1348732 - RNA, 22 nt, Human
cuccugcacuuacuugcuuauu

SEQ ID NO: 1348733 - RNA, 17 nt, Human
cuccucuccccagccca

SEQ ID NO: 1348734 - RNA, 18 nt, Human
cuccucuccccagcccag

SEQ ID NO: 1348735 - RNA, 19 nt, Human
cuccucuccccagcccaga

SEQ ID NO: 1348736 - RNA, 20 nt, Human
cuccucuccccagcccagag

SEQ ID NO: 1348737 - RNA, 21 nt, Human
cuccucuccccagcccagaga

SEQ ID NO: 1348738 - RNA, 22 nt, Human
cuccucuccccagcccagagac

SEQ ID NO: 1348739 - RNA, 23 nt, Human
cuccucuccccagcccagagaca

SEQ ID NO: 1348740 - RNA, 19 nt, Human
cuccugagugcuugcuuuu

SEQ ID NO: 1348741 - RNA, 16 nt, Human
cuccugagugcuugcu

SEQ ID NO: 1348742 - RNA, 15 nt, Human
cuccugcacuuacuu

SEQ ID NO: 1348743 - RNA, 17 nt, Human
cuccugcacuuacuugc

SEQ ID NO: 1348744 - RNA, 14 nt, Human
cuccugcagaccac

SEQ ID NO: 1348745 - RNA, 15 nt, Human
cuccugcagccccag

SEQ ID NO: 1348746 - RNA, 13 nt, Human
cuccugccucagc

SEQ ID NO: 1348747 - RNA, 20 nt, Human
cuccauggcccugccaugcu

SEQ ID NO: 1348748 - RNA, 13 nt, Human
cuccaugucucug

SEQ ID NO: 1348749 - RNA, 22 nt, Human
cuccaugucucugagcauuaga

SEQ ID NO: 1348750 - RNA, 17 nt, Human
cucccaaagugcuggga

SEQ ID NO: 1348751 - RNA, 16 nt, Human
cuccaucuccacucca

SEQ ID NO: 1348752 - RNA, 14 nt, Human
cuccaucugguaga

SEQ ID NO: 1348753 - RNA, 15 nt, Human
cuccaucugguagaa

SEQ ID NO: 1348754 - RNA, 13 nt, Human
cuccaugcugccu

SEQ ID NO: 1348755 - RNA, 23 nt, Human
cuccaucugguagaagggaaagc

SEQ ID NO: 1348756 - RNA, 18 nt, Human
cuccauccuacccccugu

SEQ ID NO: 1348757 - RNA, 23 nt, Human
cuccauccuacccccugugccuu

SEQ ID NO: 1348758 - RNA, 20 nt, Human
cuccauccuacccccugugc

SEQ ID NO: 1348759 - RNA, 22 nt, Human
cuccauccuacccccugugccu

SEQ ID NO: 1348760 - RNA, 20 nt, Human
cuccauccugaggcuccacu

SEQ ID NO: 1348761 - RNA, 18 nt, Human
cuccauccugaggcucca

SEQ ID NO: 1348762 - RNA, 16 nt, Human
cuccauccugaggcuc

SEQ ID NO: 1348763 - RNA, 11 nt, Human
cuccauccuga

SEQ ID NO: 1348764 - RNA, 22 nt, Human
cucccaagcaccugggauuaca

SEQ ID NO: 1348765 - RNA, 21 nt, Human
cucccaaagugcugggauuaa

SEQ ID NO: 1348766 - RNA, 16 nt, Human
cucccaggggcucccu

SEQ ID NO: 1348767 - RNA, 17 nt, Human
cucccaggggcucccuc

SEQ ID NO: 1348768 - RNA, 18 nt, Human
cucccaggggcucccucc

SEQ ID NO: 1348769 - RNA, 22 nt, Human
cucccaggggcucccuccgccc

SEQ ID NO: 1348770 - RNA, 18 nt, Human
cucccaaagugcugggau

SEQ ID NO: 1348771 - RNA, 22 nt, Human
cucccaaagugcugggauuaca

SEQ ID NO: 1348772 - RNA, 19 nt, Human
cucccaggggcucccuccg

SEQ ID NO: 1348773 - RNA, 21 nt, Human
cucccaggggcucccuccgcc

SEQ ID NO: 1348774 - RNA, 12 nt, Human
cucccaggguuu

SEQ ID NO: 1348775 - RNA, 15 nt, Human
cucccaggguuuuaa

SEQ ID NO: 1348776 - RNA, 16 nt, Human
cucccaggguuuuaac

SEQ ID NO: 1348777 - RNA, 20 nt, Human
cucccaggguuuuaacuuug

SEQ ID NO: 1348778 - RNA, 22 nt, Human
cucccaggguuuuaacuuuguu

SEQ ID NO: 1348779 - RNA, 21 nt, Human
cucccaggguuuuaacuuugu

SEQ ID NO: 1348780 - RNA, 13 nt, Human
cucccuacccuaa

SEQ ID NO: 1348781 - RNA, 20 nt, Human
cucccggcuaugggggcacu

SEQ ID NO: 1348782 - RNA, 17 nt, Human
cucccuaguuccuucau

SEQ ID NO: 1348783 - RNA, 21 nt, Human
cucccuauacugcuuggagcu

SEQ ID NO: 1348784 - RNA, 18 nt, Human
cucccuauacugcuugga

SEQ ID NO: 1348785 - RNA, 19 nt, Human
cucccuauuaaccuagaga

SEQ ID NO: 1348786 - RNA, 22 nt, Human
cucccggaauuccgucaccacg

SEQ ID NO: 1348787 - RNA, 19 nt, Human
cucccggagguuggguggg

SEQ ID NO: 1348788 - RNA, 20 nt, Human
cucccggagguugggugggc

SEQ ID NO: 1348789 - RNA, 22 nt, Human
cuccccacucugcucugaugca

SEQ ID NO: 1348790 - RNA, 20 nt, Human
cuccccaacugaccaccuuu

SEQ ID NO: 1348791 - RNA, 23 nt, Human
cuccccaacugaccaccuuuguu

SEQ ID NO: 1348792 - RNA, 16 nt, Human
cucccauuuuggaauu

SEQ ID NO: 1348793 - RNA, 21 nt, Human
cuccccaaaggcuuugcccug

SEQ ID NO: 1348794 - RNA, 19 nt, Human
cuccccaaaggcuuugccc

SEQ ID NO: 1348795 - RNA, 20 nt, Human
cuccccaaaggcuuugcccu

SEQ ID NO: 1348796 - RNA, 15 nt, Human
cuccccaacccccaa

SEQ ID NO: 1348797 - RNA, 21 nt, Human
cuccccacucugcucugaugc

SEQ ID NO: 1348798 - RNA, 18 nt, Human
cuccccagggaagcagca

SEQ ID NO: 1348799 - RNA, 14 nt, Human
cuccccagcuccca

SEQ ID NO: 1348800 - RNA, 16 nt, Human
cuccccagcucccagg

SEQ ID NO: 1348801 - RNA, 15 nt, Human
cuccccagcucccag

SEQ ID NO: 1348802 - RNA, 14 nt, Human
cuccccagggaagc

SEQ ID NO: 1348803 - RNA, 12 nt, Human
cuaccaggaaag

SEQ ID NO: 1348804 - RNA, 22 nt, Human
cuaccaggucaaaauagugcca

SEQ ID NO: 1348805 - RNA, 13 nt, Human
cuaccaguauuua

SEQ ID NO: 1348806 - RNA, 19 nt, Human
cuaccaguauuuagaagcc

SEQ ID NO: 1348807 - RNA, 20 nt, Human
cuaccaguauuuagaagcca

SEQ ID NO: 1348808 - RNA, 20 nt, Human
cuacagagcuucccugacuc

SEQ ID NO: 1348809 - RNA, 22 nt, Human
cuacagagaagccuucaagcuc

SEQ ID NO: 1348810 - RNA, 13 nt, Human
cuacccccugugc

SEQ ID NO: 1348811 - RNA, 14 nt, Human
cuacccccugugcc

SEQ ID NO: 1348812 - RNA, 15 nt, Human
cuaccccgcagacac

SEQ ID NO: 1348813 - RNA, 20 nt, Human
cuaccccgcagacaccuugg

SEQ ID NO: 1348814 - RNA, 16 nt, Human
cuacaauucauugugu

SEQ ID NO: 1348815 - RNA, 12 nt, Human
cuacacacccug

SEQ ID NO: 1348816 - RNA, 16 nt, Human
cuacacuccagugaga

SEQ ID NO: 1348817 - RNA, 17 nt, Human
cuacacuccagugagac

SEQ ID NO: 1348818 - RNA, 16 nt, Human
cuacagagaagccuuc

SEQ ID NO: 1348819 - RNA, 17 nt, Human
cuacagagaagccuuca

SEQ ID NO: 1348820 - RNA, 16 nt, Human
cuacagagcuucccug

SEQ ID NO: 1348821 - RNA, 17 nt, Human
cuacagagcuucccuga

SEQ ID NO: 1348822 - RNA, 18 nt, Human
cuacagagcuucccugac

SEQ ID NO: 1348823 - RNA, 16 nt, Human
cuacagagaaaccagc

SEQ ID NO: 1348824 - RNA, 17 nt, Human
cuacagagaaaccagcu

SEQ ID NO: 1348825 - RNA, 18 nt, Human
cuacagagaaaccagcuu

SEQ ID NO: 1348826 - RNA, 19 nt, Human
cuacagagaaaccagcuuc

SEQ ID NO: 1348827 - RNA, 20 nt, Human
cuacagagaaaccagcuucc

SEQ ID NO: 1348828 - RNA, 21 nt, Human
cuacagagaaaccagcuuccu

SEQ ID NO: 1348829 - RNA, 11 nt, Human
cuacagagaag

SEQ ID NO: 1348830 - RNA, 12 nt, Human
cuacagagaagc

SEQ ID NO: 1348831 - RNA, 13 nt, Human
cuacagagaagcc

SEQ ID NO: 1348832 - RNA, 14 nt, Human
cuacagagaagccu

SEQ ID NO: 1348833 - RNA, 15 nt, Human
cuacagagaagccuu

SEQ ID NO: 1348834 - RNA, 23 nt, Human
cuacagagaagccuucaagcucu

SEQ ID NO: 1348835 - RNA, 23 nt, Human
cuacacucuuguaauaaaauguc

SEQ ID NO: 1348836 - RNA, 12 nt, Human
cuacagaaaaac

SEQ ID NO: 1348837 - RNA, 13 nt, Human
cuacagaaaaacc

SEQ ID NO: 1348838 - RNA, 14 nt, Human
cuacagaaaaaccu

SEQ ID NO: 1348839 - RNA, 15 nt, Human
cuacagaaaaaccuu

SEQ ID NO: 1348840 - RNA, 16 nt, Human
cuacagaaaaaccuug

SEQ ID NO: 1348841 - RNA, 20 nt, Human
cuacagaaaaaccuuggguu

SEQ ID NO: 1348842 - RNA, 17 nt, Human
cuacagaaaaaccuugg

SEQ ID NO: 1348843 - RNA, 17 nt, Human
cuacagaacuucagaaa

SEQ ID NO: 1348844 - RNA, 20 nt, Human
cuacagaacuucagaaagac

SEQ ID NO: 1348845 - RNA, 19 nt, Human
cuacagaacuucagaaaga

SEQ ID NO: 1348846 - RNA, 10 nt, Human
cuacagagaa

SEQ ID NO: 1348847 - RNA, 11 nt, Human
cuacagagaaa

SEQ ID NO: 1348848 - RNA, 12 nt, Human
cuacagagaaac

SEQ ID NO: 1348849 - RNA, 14 nt, Human
cuacagagaaacca

SEQ ID NO: 1348850 - RNA, 15 nt, Human
cuacagagaaaccag

SEQ ID NO: 1348851 - RNA, 23 nt, Human
cuaauguggaccuuagaauacag

SEQ ID NO: 1348852 - RNA, 18 nt, Human
cuaauguuugcauauaag

SEQ ID NO: 1348853 - RNA, 16 nt, Human
cuaauguuugcauaua

SEQ ID NO: 1348854 - RNA, 15 nt, Human
cuaauguuugcauau

SEQ ID NO: 1348855 - RNA, 17 nt, Human
cuaauguuugcauauaa

SEQ ID NO: 1348856 - RNA, 17 nt, Human
cuaauuaauuguaaucu

SEQ ID NO: 1348857 - RNA, 19 nt, Human
cuaauuaauuguaaucuga

SEQ ID NO: 1348858 - RNA, 17 nt, Human
cuacaagcuaaaauuag

SEQ ID NO: 1348859 - RNA, 19 nt, Human
cuacaagcuaaaauuagau

SEQ ID NO: 1348860 - RNA, 16 nt, Human
cuaaugccucuucauu

SEQ ID NO: 1348861 - RNA, 19 nt, Human
cuaaugaaugcauaaaaug

SEQ ID NO: 1348862 - RNA, 22 nt, Human
cuaaugaaugcauaaaauguua

SEQ ID NO: 1348863 - RNA, 22 nt, Human
cuaaugacaucaccacaguuua

SEQ ID NO: 1348864 - RNA, 18 nt, Human
cuaaucugugcuguuuca

SEQ ID NO: 1348865 - RNA, 19 nt, Human
cuaaucugugcuguuucaa

SEQ ID NO: 1348866 - RNA, 20 nt, Human
cuaaucugugcuguuucaaa

SEQ ID NO: 1348867 - RNA, 21 nt, Human
cuaaucugugcuguuucaaag

SEQ ID NO: 1348868 - RNA, 22 nt, Human
cuaaucugugcuguuucaaagu

SEQ ID NO: 1348869 - RNA, 17 nt, Human
cuaaucuuauucauuuu

SEQ ID NO: 1348870 - RNA, 18 nt, Human
cuaaucuuauucauuuuc

SEQ ID NO: 1348871 - RNA, 19 nt, Human
cuaaucuuauucauuuucu

SEQ ID NO: 1348872 - RNA, 21 nt, Human
cuaaucuuauucauuuucucu

SEQ ID NO: 1348873 - RNA, 16 nt, Human
cuaaucuacuuucugu

SEQ ID NO: 1348874 - RNA, 19 nt, Human
cuaaucuagauaucgacuu

SEQ ID NO: 1348875 - RNA, 18 nt, Human
cuaaucuauggucgggag

SEQ ID NO: 1348876 - RNA, 20 nt, Human
cuaaucuauggucgggagac

SEQ ID NO: 1348877 - RNA, 16 nt, Human
cuaauccucuuuuucu

SEQ ID NO: 1348878 - RNA, 14 nt, Human
cuaaucucuguaaa

SEQ ID NO: 1348879 - RNA, 20 nt, Human
cuaaucucuguaaagcuaaa

SEQ ID NO: 1348880 - RNA, 17 nt, Human
cuaaucagcauucucac

SEQ ID NO: 1348881 - RNA, 19 nt, Human
cuaaucagcauucucacuc

SEQ ID NO: 1348882 - RNA, 20 nt, Human
cuaaucagcauucucacucc

SEQ ID NO: 1348883 - RNA, 17 nt, Human
cuaauccaggcagaucc

SEQ ID NO: 1348884 - RNA, 18 nt, Human
cuaauccaggcagaucca

SEQ ID NO: 1348885 - RNA, 19 nt, Human
cuaauccaggcagauccag

SEQ ID NO: 1348886 - RNA, 20 nt, Human
cuaauccaggcagauccagg

SEQ ID NO: 1348887 - RNA, 23 nt, Human
cuaauccaggcagauccaggacu

SEQ ID NO: 1348888 - RNA, 15 nt, Human
cuaauccccuucucc

SEQ ID NO: 1348889 - RNA, 16 nt, Human
cuaauccccuucuccc

SEQ ID NO: 1348890 - RNA, 18 nt, Human
cuaauccccuucuccccu

SEQ ID NO: 1348891 - RNA, 20 nt, Human
cuaauccccuucuccccugc

SEQ ID NO: 1348892 - RNA, 14 nt, Human
cuaauaaagcugug

SEQ ID NO: 1348893 - RNA, 11 nt, Human
cuaagguucua

SEQ ID NO: 1348894 - RNA, 12 nt, Human
cuaagguucuaa

SEQ ID NO: 1348895 - RNA, 15 nt, Human
cuaauaaacuaauaa

SEQ ID NO: 1348896 - RNA, 17 nt, Human
cuaauaaacuaauaauu

SEQ ID NO: 1348897 - RNA, 13 nt, Human
cuaauaaagcugu

SEQ ID NO: 1348898 - RNA, 18 nt, Human
cuaauaaacuaauaauug

SEQ ID NO: 1348899 - RNA, 19 nt, Human
cuaauaaacuaauaauugc

SEQ ID NO: 1348900 - RNA, 21 nt, Human
cuaauaaacuaauaauugcag

SEQ ID NO: 1348901 - RNA, 13 nt, Human
cuaauauuuuccu

SEQ ID NO: 1348902 - RNA, 17 nt, Human
cuaauauuuuccuccug

SEQ ID NO: 1348903 - RNA, 12 nt, Human
cuaauaaagcug

SEQ ID NO: 1348904 - RNA, 21 nt, Human
cuaaggucuuggaacuugccu

SEQ ID NO: 1348905 - RNA, 23 nt, Human
cuaaggucuuggaacuugccugc

SEQ ID NO: 1348906 - RNA, 13 nt, Human
cuaagguucuaag

SEQ ID NO: 1348907 - RNA, 17 nt, Human
cuaagcuaggaaugaaa

SEQ ID NO: 1348908 - RNA, 22 nt, Human
cuaagcuaggaaugaaauccug

SEQ ID NO: 1348909 - RNA, 22 nt, Human
cuaagccagcugcccccagagc

SEQ ID NO: 1348910 - RNA, 23 nt, Human
cuaagcgcuagaggaagcagcca

SEQ ID NO: 1348911 - RNA, 14 nt, Human
cuaagcuaggaaug

SEQ ID NO: 1348912 - RNA, 22 nt, Human
cuaagggucgaaagcucuagaa

SEQ ID NO: 1348913 - RNA, 19 nt, Human
cuaagguccgguguucuaa

SEQ ID NO: 1348914 - RNA, 20 nt, Human
cuaagguccgguguucuaag

SEQ ID NO: 1348915 - RNA, 21 nt, Human
cuaagguccgguguucuaaga

SEQ ID NO: 1348916 - RNA, 22 nt, Human
cuaagguccgguguucuaagau

SEQ ID NO: 1348917 - RNA, 17 nt, Human
cuaagggucgaaagcuc

SEQ ID NO: 1348918 - RNA, 18 nt, Human
cuaagggucgaaagcucu

SEQ ID NO: 1348919 - RNA, 19 nt, Human
cuaagggucgaaagcucua

SEQ ID NO: 1348920 - RNA, 21 nt, Human
cuaagggucgaaagcucuaga

SEQ ID NO: 1348921 - RNA, 23 nt, Human
cuaagggucgaaagcucuagaau

SEQ ID NO: 1348922 - RNA, 23 nt, Human
cuaaggaguguagcaacuacagu

SEQ ID NO: 1348923 - RNA, 14 nt, Human
cuaaggcugaacuu

SEQ ID NO: 1348924 - RNA, 22 nt, Human
cuaaggcucugagagucuagau

SEQ ID NO: 1348925 - RNA, 23 nt, Human
cuaaggcucugagagucuagauu

SEQ ID NO: 1348926 - RNA, 21 nt, Human
cuaaggcucugagagucuaga

SEQ ID NO: 1348927 - RNA, 16 nt, Human
cuaacaugaagaccuu

SEQ ID NO: 1348928 - RNA, 17 nt, Human
cuaacauguccugccua

SEQ ID NO: 1348929 - RNA, 18 nt, Human
cuaagauucuaaaggucc

SEQ ID NO: 1348930 - RNA, 13 nt, Human
cuaagauucuaau

SEQ ID NO: 1348931 - RNA, 15 nt, Human
cuaagauucuaauga

SEQ ID NO: 1348932 - RNA, 21 nt, Human
cuaagauucuaaugaugauca

SEQ ID NO: 1348933 - RNA, 12 nt, Human
cuaagauucuag

SEQ ID NO: 1348934 - RNA, 13 nt, Human
cuaagauucuaga

SEQ ID NO: 1348935 - RNA, 14 nt, Human
cuaagcaaaaugug

SEQ ID NO: 1348936 - RNA, 14 nt, Human
cuaagauucuagau

SEQ ID NO: 1348937 - RNA, 15 nt, Human
cuaagauucuagauc

SEQ ID NO: 1348938 - RNA, 16 nt, Human
cuaagauucuagauca

SEQ ID NO: 1348939 - RNA, 18 nt, Human
cuaagauucuagaucaga

SEQ ID NO: 1348940 - RNA, 22 nt, Human
cuaagauucuagaucagaugcu

SEQ ID NO: 1348941 - RNA, 11 nt, Human
cuaagauucug

SEQ ID NO: 1348942 - RNA, 12 nt, Human
cuaagauucuga

SEQ ID NO: 1348943 - RNA, 18 nt, Human
cuaagauucugauuuuag

SEQ ID NO: 1348944 - RNA, 18 nt, Human
cuaagcaaaaugugauau

SEQ ID NO: 1348945 - RNA, 15 nt, Human
cuaagcaaaauguga

SEQ ID NO: 1348946 - RNA, 19 nt, Human
cuaagauucugauuuuagg

SEQ ID NO: 1348947 - RNA, 16 nt, Human
cuaagcaacuaggccu

SEQ ID NO: 1348948 - RNA, 13 nt, Human
cuaagcagaaagu

SEQ ID NO: 1348949 - RNA, 14 nt, Human
cuaagcagaaagug

SEQ ID NO: 1348950 - RNA, 15 nt, Human
cuaagcagaaagugc

SEQ ID NO: 1348951 - RNA, 16 nt, Human
cuaagcagaaagugcc

SEQ ID NO: 1348952 - RNA, 17 nt, Human
cuaagcagaaagugccu

SEQ ID NO: 1348953 - RNA, 18 nt, Human
cuaagcagaaagugccuu

SEQ ID NO: 1348954 - RNA, 19 nt, Human
cuaagcagaaagugccuuu

SEQ ID NO: 1348955 - RNA, 21 nt, Human
cuaagcagaaagugccuuuca

SEQ ID NO: 1348956 - RNA, 23 nt, Human
cuaagcagaaagugccuuucagg

SEQ ID NO: 1348957 - RNA, 22 nt, Human
cuaagcagaaagugccuuucag

SEQ ID NO: 1348958 - RNA, 21 nt, Human
cuaagcauaaaagaugaaaga

SEQ ID NO: 1348959 - RNA, 13 nt, Human
cuaagcaucuaag

SEQ ID NO: 1348960 - RNA, 15 nt, Human
cuaagcaucuaaguu

SEQ ID NO: 1348961 - RNA, 14 nt, Human
cuaagcaucuaagu

SEQ ID NO: 1348962 - RNA, 19 nt, Human
cuaagccagcaccggacca

SEQ ID NO: 1348963 - RNA, 15 nt, Human
cuaagccagcugccc

SEQ ID NO: 1348964 - RNA, 16 nt, Human
cuaagccagcugcccc

SEQ ID NO: 1348965 - RNA, 23 nt, Human
cuacuucuuuuuucaaaagaaag

SEQ ID NO: 1348966 - RNA, 22 nt, Human
cuacuucuuuugcucuuagcug

SEQ ID NO: 1348967 - RNA, 14 nt, Human
cuacuugcucaggu

SEQ ID NO: 1348968 - RNA, 18 nt, Human
cuacuugggaggcugaga

SEQ ID NO: 1348969 - RNA, 15 nt, Human
cuacuugggaggcug

SEQ ID NO: 1348970 - RNA, 22 nt, Human
cuacuuucugugucuauggauu

SEQ ID NO: 1348971 - RNA, 19 nt, Human
cuacuuuauaacuaacaug

SEQ ID NO: 1348972 - RNA, 14 nt, Human
cuacuuuauaacua

SEQ ID NO: 1348973 - RNA, 18 nt, Human
cuacuuuauaacuaacau

SEQ ID NO: 1348974 - RNA, 18 nt, Human
cuacuuugacuuuuugca

SEQ ID NO: 1348975 - RNA, 19 nt, Human
cuacuuugacuuuuugcau

SEQ ID NO: 1348976 - RNA, 20 nt, Human
cuacuuugacuuuuugcauu

SEQ ID NO: 1348977 - RNA, 21 nt, Human
cuacuuugacuuuuugcauuu

SEQ ID NO: 1348978 - RNA, 19 nt, Human
cuacuugggaggcugagau

SEQ ID NO: 1348979 - RNA, 22 nt, Human
cuacuuauuguagcauccugga

SEQ ID NO: 1348980 - RNA, 18 nt, Human
cuacuuaugaaaugugca

SEQ ID NO: 1348981 - RNA, 19 nt, Human
cuacuuaugaaaugugcac

SEQ ID NO: 1348982 - RNA, 16 nt, Human
cuacuuccaaacuaau

SEQ ID NO: 1348983 - RNA, 19 nt, Human
cuacuuccaaacuaauuuu

SEQ ID NO: 1348984 - RNA, 23 nt, Human
cuacuguguuaugcaaaagcaag

SEQ ID NO: 1348985 - RNA, 15 nt, Human
cuacuguguguguga

SEQ ID NO: 1348986 - RNA, 17 nt, Human
cuacugugugugugaau

SEQ ID NO: 1348987 - RNA, 19 nt, Human
cuacugugugugugaauga

SEQ ID NO: 1348988 - RNA, 20 nt, Human
cuacugugugugugaaugaa

SEQ ID NO: 1348989 - RNA, 16 nt, Human
cuacuguguuaugcaa

SEQ ID NO: 1348990 - RNA, 14 nt, Human
cuacuuccccuucc

SEQ ID NO: 1348991 - RNA, 15 nt, Human
cuacuuccccuuccu

SEQ ID NO: 1348992 - RNA, 20 nt, Human
cuacuuccccuuccuaauuc

SEQ ID NO: 1348993 - RNA, 22 nt, Human
cuacuuccccauggcccugagc

SEQ ID NO: 1348994 - RNA, 23 nt, Human
cuacuuccccauggcccugagcg

SEQ ID NO: 1348995 - RNA, 13 nt, Human
cuacuuccuccuc

SEQ ID NO: 1348996 - RNA, 20 nt, Human
cuacuuccugugacuucagc

SEQ ID NO: 1348997 - RNA, 17 nt, Human
cuacuucggggcuggga

SEQ ID NO: 1348998 - RNA, 17 nt, Human
cuacuucuguaauugug

SEQ ID NO: 1348999 - RNA, 18 nt, Human
cuacuucuguaauugugu

SEQ ID NO: 1349000 - RNA, 17 nt, Human
cuacuuccuccucccca

SEQ ID NO: 1349001 - RNA, 19 nt, Human
cuacuuccuccuccccacu

SEQ ID NO: 1349002 - RNA, 20 nt, Human
cuacuuccuccuccccacuu

SEQ ID NO: 1349003 - RNA, 21 nt, Human
cuacuguaaggcaaucauggu

SEQ ID NO: 1349004 - RNA, 14 nt, Human
cuacugacaugugg

SEQ ID NO: 1349005 - RNA, 15 nt, Human
cuacugacauguggg

SEQ ID NO: 1349006 - RNA, 20 nt, Human
cuacugacauguggggccag

SEQ ID NO: 1349007 - RNA, 22 nt, Human
cuacugacggaguccuguguuu

SEQ ID NO: 1349008 - RNA, 13 nt, Human
cuacugaagcccu

SEQ ID NO: 1349009 - RNA, 14 nt, Human
cuacugaagcccuu

SEQ ID NO: 1349010 - RNA, 15 nt, Human
cuacugaaugucauu

SEQ ID NO: 1349011 - RNA, 15 nt, Human
cuacccuaaccaagu

SEQ ID NO: 1349012 - RNA, 16 nt, Human
cuagcaaaagugcaag

SEQ ID NO: 1349013 - RNA, 17 nt, Human
cuagcaaaagugcaaga

SEQ ID NO: 1349014 - RNA, 14 nt, Human
cuagcacagauggc

SEQ ID NO: 1349015 - RNA, 22 nt, Human
cuagauguuuauucuucuagag

SEQ ID NO: 1349016 - RNA, 12 nt, Human
cuagauucaaag

SEQ ID NO: 1349017 - RNA, 14 nt, Human
cuagauucaaaggu

SEQ ID NO: 1349018 - RNA, 15 nt, Human
cuagauucaaagguu

SEQ ID NO: 1349019 - RNA, 16 nt, Human
cuagauucaaagguuc

SEQ ID NO: 1349020 - RNA, 17 nt, Human
cuagauucaaagguucu

SEQ ID NO: 1349021 - RNA, 18 nt, Human
cuagauucaaagguucua

SEQ ID NO: 1349022 - RNA, 20 nt, Human
cuagauucaaagguucuagg

SEQ ID NO: 1349023 - RNA, 21 nt, Human
cuagauucaaagguucuaggu

SEQ ID NO: 1349024 - RNA, 14 nt, Human
cuagauucagggaa

SEQ ID NO: 1349025 - RNA, 22 nt, Human
cuagauuccauugguccaagau

SEQ ID NO: 1349026 - RNA, 23 nt, Human
cuagauuccauugguccaagauu

SEQ ID NO: 1349027 - RNA, 24 nt, Human
cuagauugagagaagagacaaaca

SEQ ID NO: 1349028 - RNA, 21 nt, Human
cuagauugcuaaggagcugau

SEQ ID NO: 1349029 - RNA, 12 nt, Human
cuagauuuaaua

SEQ ID NO: 1349030 - RNA, 14 nt, Human
cuagauuuaauaua

SEQ ID NO: 1349031 - RNA, 18 nt, Human
cuagauuuaauauaaagu

SEQ ID NO: 1349032 - RNA, 15 nt, Human
cuagaucagaugcuc

SEQ ID NO: 1349033 - RNA, 18 nt, Human
cuagaucagaugcuccaa

SEQ ID NO: 1349034 - RNA, 20 nt, Human
cuagaucagaugcuccaaga

SEQ ID NO: 1349035 - RNA, 15 nt, Human
cuagaucauaaggcu

SEQ ID NO: 1349036 - RNA, 17 nt, Human
cuagaucauaaggcuuc

SEQ ID NO: 1349037 - RNA, 18 nt, Human
cuagaucauaaggcuuca

SEQ ID NO: 1349038 - RNA, 22 nt, Human
cuagaucauaaggcuucaaaau

SEQ ID NO: 1349039 - RNA, 15 nt, Human
cuagauccuaagggu

SEQ ID NO: 1349040 - RNA, 16 nt, Human
cuagauccuaaggguc

SEQ ID NO: 1349041 - RNA, 17 nt, Human
cuagaugaaguuuuaca

SEQ ID NO: 1349042 - RNA, 17 nt, Human
cuagauccuaagggucg

SEQ ID NO: 1349043 - RNA, 20 nt, Human
cuagaugauuaaauaagauu

SEQ ID NO: 1349044 - RNA, 21 nt, Human
cuagaugauuaaauaagauuc

SEQ ID NO: 1349045 - RNA, 23 nt, Human
cuagaugauuaaauaagauucua

SEQ ID NO: 1349046 - RNA, 22 nt, Human
cuagaugauuaaauaagauucu

SEQ ID NO: 1349047 - RNA, 13 nt, Human
cuagauggaccug

SEQ ID NO: 1349048 - RNA, 16 nt, Human
cuagauggaccugccu

SEQ ID NO: 1349049 - RNA, 18 nt, Human
cuagauggaccugccugc

SEQ ID NO: 1349050 - RNA, 16 nt, Human
cuagauguaguauuuu

SEQ ID NO: 1349051 - RNA, 20 nt, Human
cuagauguaguauuuuuugu

SEQ ID NO: 1349052 - RNA, 22 nt, Human
cuagauguaguauuuuuuguau

SEQ ID NO: 1349053 - RNA, 23 nt, Human
cuagauguaguauuuuuuguaua

SEQ ID NO: 1349054 - RNA, 21 nt, Human
cuagauguauaacuaggagcu

SEQ ID NO: 1349055 - RNA, 21 nt, Human
cuagauguuuauucuucuaga

SEQ ID NO: 1349056 - RNA, 23 nt, Human
cuagauguuuauucuucuagagu

SEQ ID NO: 1349057 - RNA, 17 nt, Human
cuacuuugauaugacug

SEQ ID NO: 1349058 - RNA, 21 nt, Human
cuacuuugauaugacuguuuu

SEQ ID NO: 1349059 - RNA, 16 nt, Human
cuagaccuccagcugu

SEQ ID NO: 1349060 - RNA, 17 nt, Human
cuagaccuccagcuguu

SEQ ID NO: 1349061 - RNA, 18 nt, Human
cuagacucccaagcugga

SEQ ID NO: 1349062 - RNA, 11 nt, Human
cuagagcuccu

SEQ ID NO: 1349063 - RNA, 12 nt, Human
cuagagcuccuc

SEQ ID NO: 1349064 - RNA, 13 nt, Human
cuagagcuccucc

SEQ ID NO: 1349065 - RNA, 15 nt, Human
cuagagcuccucccu

SEQ ID NO: 1349066 - RNA, 17 nt, Human
cuagagcuccucccucu

SEQ ID NO: 1349067 - RNA, 19 nt, Human
cuagagcuccucccucuca

SEQ ID NO: 1349068 - RNA, 20 nt, Human
cuagagcuccucccucucaa

SEQ ID NO: 1349069 - RNA, 16 nt, Human
cuagaggaagcagcca

SEQ ID NO: 1349070 - RNA, 15 nt, Human
cuagaggugagaaau

SEQ ID NO: 1349071 - RNA, 17 nt, Human
cuagaggugagaaauuu

SEQ ID NO: 1349072 - RNA, 19 nt, Human
cuagaggugagaaauuuaa

SEQ ID NO: 1349073 - RNA, 15 nt, Human
cuagaguccaagguu

SEQ ID NO: 1349074 - RNA, 20 nt, Human
cuagaguccaagguuuaaag

SEQ ID NO: 1349075 - RNA, 23 nt, Human
cuagaguccaagguuuaaagagu

SEQ ID NO: 1349076 - RNA, 21 nt, Human
cuagagucccagguuggcucu

SEQ ID NO: 1349077 - RNA, 16 nt, Human
cuagagucugaacagc

SEQ ID NO: 1349078 - RNA, 19 nt, Human
cuagagucugaacagcugu

SEQ ID NO: 1349079 - RNA, 20 nt, Human
cuagagucugaacagcugua

SEQ ID NO: 1349080 - RNA, 22 nt, Human
cuaggacugaauuaugaaacuu

SEQ ID NO: 1349081 - RNA, 18 nt, Human
cuaggagaaccaaaucug

SEQ ID NO: 1349082 - RNA, 21 nt, Human
cuaggagaaccaaaucuggaa

SEQ ID NO: 1349083 - RNA, 23 nt, Human
cuaggagaaccaaaucuggaagc

SEQ ID NO: 1349084 - RNA, 20 nt, Human
cuaggacacaguuccuggga

SEQ ID NO: 1349085 - RNA, 21 nt, Human
cuaggaccaugguuaagaguc

SEQ ID NO: 1349086 - RNA, 23 nt, Human
cuaggaccaugguuaagagucca

SEQ ID NO: 1349087 - RNA, 16 nt, Human
cuaggaagaggagugg

SEQ ID NO: 1349088 - RNA, 14 nt, Human
cuaggaagccucag

SEQ ID NO: 1349089 - RNA, 16 nt, Human
cuaggaagccucagau

SEQ ID NO: 1349090 - RNA, 15 nt, Human
cuaggaagccucaga

SEQ ID NO: 1349091 - RNA, 16 nt, Human
cuaggaaugaaauccu

SEQ ID NO: 1349092 - RNA, 17 nt, Human
cuaggaaugaaauccug

SEQ ID NO: 1349093 - RNA, 15 nt, Human
cuaggacacaguucc

SEQ ID NO: 1349094 - RNA, 19 nt, Human
cuaggacacaguuccuggg

SEQ ID NO: 1349095 - RNA, 21 nt, Human
cuaggagcuuugacucaggag

SEQ ID NO: 1349096 - RNA, 22 nt, Human
cuaggagcuuugacucaggagc

SEQ ID NO: 1349097 - RNA, 13 nt, Human
cuaggagggagac

SEQ ID NO: 1349098 - RNA, 18 nt, Human
cuaggagggagacacugg

SEQ ID NO: 1349099 - RNA, 22 nt, Human
cuaggagggagacacuggcccc

SEQ ID NO: 1349100 - RNA, 13 nt, Human
cuaggagcaaagc

SEQ ID NO: 1349101 - RNA, 15 nt, Human
cuaggagcaaagccu

SEQ ID NO: 1349102 - RNA, 16 nt, Human
cuaggagcaaagccug

SEQ ID NO: 1349103 - RNA, 17 nt, Human
cuaggagcaaagccugu

SEQ ID NO: 1349104 - RNA, 20 nt, Human
cuaggagcaaagccuguuca

SEQ ID NO: 1349105 - RNA, 18 nt, Human
cuaggagcaaagccuguu

SEQ ID NO: 1349106 - RNA, 17 nt, Human
cuaggagcuuugacuca

SEQ ID NO: 1349107 - RNA, 20 nt, Human
cuaggagcuuugacucagga

SEQ ID NO: 1349108 - RNA, 23 nt, Human
cuaggagggagacacuggccccu

SEQ ID NO: 1349109 - RNA, 23 nt, Human
cuaggagcuuugacucaggagcc

SEQ ID NO: 1349110 - RNA, 15 nt, Human
cuaggaggguccucu

SEQ ID NO: 1349111 - RNA, 20 nt, Human
cuaggaggguccucugagac

SEQ ID NO: 1349112 - RNA, 16 nt, Human
cuaggaggguccucug

SEQ ID NO: 1349113 - RNA, 22 nt, Human
cuaggaugugcauucuccagcc

SEQ ID NO: 1349114 - RNA, 13 nt, Human
cuaggauuucaug

SEQ ID NO: 1349115 - RNA, 13 nt, Human
cuaggauucuaaa

SEQ ID NO: 1349116 - RNA, 13 nt, Human
cuaggcaacauag

SEQ ID NO: 1349117 - RNA, 19 nt, Human
cuaggcacuguaguucuaa

SEQ ID NO: 1349118 - RNA, 20 nt, Human
cuaggcacuguaguucuaag

SEQ ID NO: 1349119 - RNA, 21 nt, Human
cuaggcacuguaguucuaaga

SEQ ID NO: 1349120 - RNA, 22 nt, Human
cuagcagcaccguucugugcac

SEQ ID NO: 1349121 - RNA, 19 nt, Human
cuaggaagagcaggacucc

SEQ ID NO: 1349122 - RNA, 23 nt, Human
cuaggaagagcaggacuccaggc

SEQ ID NO: 1349123 - RNA, 15 nt, Human
cuaggaagaggagug

SEQ ID NO: 1349124 - RNA, 16 nt, Human
cuaggaaauccagggu

SEQ ID NO: 1349125 - RNA, 17 nt, Human
cuaggaaauccagggug

SEQ ID NO: 1349126 - RNA, 20 nt, Human
cuagcagcaccguucugugc

SEQ ID NO: 1349127 - RNA, 21 nt, Human
cuagcagcaccguucugugca

SEQ ID NO: 1349128 - RNA, 12 nt, Human
cuagcagcaccg

SEQ ID NO: 1349129 - RNA, 19 nt, Human
cuagcagcaccguucugug

SEQ ID NO: 1349130 - RNA, 22 nt, Human
cuaguauuucuaugaaauauua

SEQ ID NO: 1349131 - RNA, 18 nt, Human
cuaguauugacaaaaugu

SEQ ID NO: 1349132 - RNA, 17 nt, Human
cuaguauugacaaaaug

SEQ ID NO: 1349133 - RNA, 15 nt, Human
cuaguauugacaaaa

SEQ ID NO: 1349134 - RNA, 14 nt, Human
cuaguauugacaaa

SEQ ID NO: 1349135 - RNA, 19 nt, Human
cuaguauuucuaugaaaua

SEQ ID NO: 1349136 - RNA, 20 nt, Human
cuaguauuucuaugaaauau

SEQ ID NO: 1349137 - RNA, 23 nt, Human
cuaguaucaaaagaaagaaaauc

SEQ ID NO: 1349138 - RNA, 23 nt, Human
cuaguauuccagaccugaagaau

SEQ ID NO: 1349139 - RNA, 17 nt, Human
cuaguaucaaaagaaag

SEQ ID NO: 1349140 - RNA, 15 nt, Human
cuaguaucaaaagaa

SEQ ID NO: 1349141 - RNA, 20 nt, Human
cuaggcaguucaaagcagga

SEQ ID NO: 1349142 - RNA, 14 nt, Human
cuaggcauucugga

SEQ ID NO: 1349143 - RNA, 17 nt, Human
cuaggcauucuggaccu

SEQ ID NO: 1349144 - RNA, 20 nt, Human
cuaggcauucuggaccucug

SEQ ID NO: 1349145 - RNA, 21 nt, Human
cuaggcauucuggaccucugg

SEQ ID NO: 1349146 - RNA, 22 nt, Human
cuaggcauucuggaccucuggg

SEQ ID NO: 1349147 - RNA, 14 nt, Human
cuaggccagagccc

SEQ ID NO: 1349148 - RNA, 16 nt, Human
cuaggccagagcccac

SEQ ID NO: 1349149 - RNA, 15 nt, Human
cuaggccagagccca

SEQ ID NO: 1349150 - RNA, 13 nt, Human
cuaggcccccacu

SEQ ID NO: 1349151 - RNA, 15 nt, Human
cuaggcccccacuug

SEQ ID NO: 1349152 - RNA, 16 nt, Human
cuaggcccccacuugc

SEQ ID NO: 1349153 - RNA, 17 nt, Human
cuaggcccccacuugcc

SEQ ID NO: 1349154 - RNA, 22 nt, Human
cuaguacuugggagaccuguaa

SEQ ID NO: 1349155 - RNA, 20 nt, Human
cuaguguagaauugugcaac

SEQ ID NO: 1349156 - RNA, 13 nt, Human
cuaguguagaauu

SEQ ID NO: 1349157 - RNA, 18 nt, Human
cuaguguaucaaaaugcu

SEQ ID NO: 1349158 - RNA, 14 nt, Human
cuagugugaauuaa

SEQ ID NO: 1349159 - RNA, 15 nt, Human
cuaguguaucaaaau

SEQ ID NO: 1349160 - RNA, 19 nt, Human
cuaguauugacaaaauguu

SEQ ID NO: 1349161 - RNA, 20 nt, Human
cuaguauugacaaaauguua

SEQ ID NO: 1349162 - RNA, 12 nt, Human
cuaguccuuguu

SEQ ID NO: 1349163 - RNA, 13 nt, Human
cuagucuuuugcu

SEQ ID NO: 1349164 - RNA, 14 nt, Human
cuagucuuuugcuu

SEQ ID NO: 1349165 - RNA, 15 nt, Human
cuagucuuuugcuuu

SEQ ID NO: 1349166 - RNA, 16 nt, Human
cuagucuuuugcuuuu

SEQ ID NO: 1349167 - RNA, 12 nt, Human
cuaucuuugcca

SEQ ID NO: 1349168 - RNA, 18 nt, Human
cuaucuuacuauuucaca

SEQ ID NO: 1349169 - RNA, 19 nt, Human
cuaucuuugccacccucau

SEQ ID NO: 1349170 - RNA, 18 nt, Human
cuaucuuugccacccuca

SEQ ID NO: 1349171 - RNA, 15 nt, Human
cuaucuuugccaccc

SEQ ID NO: 1349172 - RNA, 14 nt, Human
cuaucuuugccacc

SEQ ID NO: 1349173 - RNA, 13 nt, Human
cuaugaaauauua

SEQ ID NO: 1349174 - RNA, 21 nt, Human
cuaucuuugccacccucaugc

SEQ ID NO: 1349175 - RNA, 16 nt, Human
cuaugaaaagcuagaa

SEQ ID NO: 1349176 - RNA, 21 nt, Human
cuaugaaaagcuagaauugag

SEQ ID NO: 1349177 - RNA, 17 nt, Human
cuaugaaaaugcuggcu

SEQ ID NO: 1349178 - RNA, 18 nt, Human
cuaugaaauauuauguua

SEQ ID NO: 1349179 - RNA, 17 nt, Human
cuaugaauucuaaguga

SEQ ID NO: 1349180 - RNA, 22 nt, Human
cuauauuuuuuguuaaaugauu

SEQ ID NO: 1349181 - RNA, 16 nt, Human
cuaucacccaacgcuc

SEQ ID NO: 1349182 - RNA, 19 nt, Human
cuaucacccaacgcuccaa

SEQ ID NO: 1349183 - RNA, 15 nt, Human
cuaucuuaauacuaa

SEQ ID NO: 1349184 - RNA, 16 nt, Human
cuaucaccuauuucca

SEQ ID NO: 1349185 - RNA, 21 nt, Human
cuaucaaccccagacacuggu

SEQ ID NO: 1349186 - RNA, 17 nt, Human
cuaucaaccccagacac

SEQ ID NO: 1349187 - RNA, 19 nt, Human
cuaucaaccccagacacug

SEQ ID NO: 1349188 - RNA, 20 nt, Human
cuaucaaccccagacacugg

SEQ ID NO: 1349189 - RNA, 16 nt, Human
cuaguuauacuuauuu

SEQ ID NO: 1349190 - RNA, 23 nt, Human
cuaguuauacuuauuuguauaug

SEQ ID NO: 1349191 - RNA, 20 nt, Human
cuaguuauuuacaggaacuu

SEQ ID NO: 1349192 - RNA, 22 nt, Human
cuaguuauuuacaggaacuuca

SEQ ID NO: 1349193 - RNA, 19 nt, Human
cuauauuguuugcuaagca

SEQ ID NO: 1349194 - RNA, 20 nt, Human
cuauauuuuuuguuaaauga

SEQ ID NO: 1349195 - RNA, 13 nt, Human
cucacauuuauau

SEQ ID NO: 1349196 - RNA, 16 nt, Human
cucacaucagagugac

SEQ ID NO: 1349197 - RNA, 22 nt, Human
cucacaugauuccagccaucac

SEQ ID NO: 1349198 - RNA, 15 nt, Human
cucacccauccuaga

SEQ ID NO: 1349199 - RNA, 14 nt, Human
cucacccauccuag

SEQ ID NO: 1349200 - RNA, 18 nt, Human
cucacaugauuccagcca

SEQ ID NO: 1349201 - RNA, 14 nt, Human
cucacccagugccc

SEQ ID NO: 1349202 - RNA, 16 nt, Human
cucacaugguuuacau

SEQ ID NO: 1349203 - RNA, 19 nt, Human
cucacaugguuuacauccu

SEQ ID NO: 1349204 - RNA, 22 nt, Human
cucacaugucaguaccuucaaa

SEQ ID NO: 1349205 - RNA, 16 nt, Human
cucaaggacuuugcag

SEQ ID NO: 1349206 - RNA, 22 nt, Human
cucaaggacuuugcagccggca

SEQ ID NO: 1349207 - RNA, 22 nt, Human
cucacagugaacacucaguggc

SEQ ID NO: 1349208 - RNA, 15 nt, Human
cucacagugcuuuua

SEQ ID NO: 1349209 - RNA, 17 nt, Human
cucacccauccuagagg

SEQ ID NO: 1349210 - RNA, 22 nt, Human
cucacccagugcccucuccccu

SEQ ID NO: 1349211 - RNA, 14 nt, Human
cucacccccucacc

SEQ ID NO: 1349212 - RNA, 15 nt, Human
cucacccccuucucc

SEQ ID NO: 1349213 - RNA, 16 nt, Human
cucacccccuucucca

SEQ ID NO: 1349214 - RNA, 17 nt, Human
cucacccccuucuccau

SEQ ID NO: 1349215 - RNA, 19 nt, Human
cucacccccuucuccaucc

SEQ ID NO: 1349216 - RNA, 20 nt, Human
cucacccccuucuccaucca

SEQ ID NO: 1349217 - RNA, 21 nt, Human
cucacccccuucuccauccac

SEQ ID NO: 1349218 - RNA, 20 nt, Human
cucacuaggcuucugguuga

SEQ ID NO: 1349219 - RNA, 23 nt, Human
cucacuaggcccccacuugccuc

SEQ ID NO: 1349220 - RNA, 17 nt, Human
cucacuauaccaguaua

SEQ ID NO: 1349221 - RNA, 20 nt, Human
cucacuaucccggcugcccu

SEQ ID NO: 1349222 - RNA, 21 nt, Human
cucacuaucccggcugcccuu

SEQ ID NO: 1349223 - RNA, 17 nt, Human
cucaccccuugccauaa

SEQ ID NO: 1349224 - RNA, 13 nt, Human
cucacuaggcuuc

SEQ ID NO: 1349225 - RNA, 16 nt, Human
cucacuaggcuucugg

SEQ ID NO: 1349226 - RNA, 22 nt, Human
cuauuuuaauaaacacucuuga

SEQ ID NO: 1349227 - RNA, 16 nt, Human
cuauuuuauuaugaag

SEQ ID NO: 1349228 - RNA, 18 nt, Human
cuauuuuaauaaacacuc

SEQ ID NO: 1349229 - RNA, 14 nt, Human
cuauuuguaaaucu

SEQ ID NO: 1349230 - RNA, 18 nt, Human
cuauuuguaaaucugcca

SEQ ID NO: 1349231 - RNA, 21 nt, Human
cuauuuguaaaucugccacaa

SEQ ID NO: 1349232 - RNA, 22 nt, Human
cuauuuguugaugcuuguguca

SEQ ID NO: 1349233 - RNA, 19 nt, Human
cuauuuguaaaucugccac

SEQ ID NO: 1349234 - RNA, 12 nt, Human
cuauuuucagau

SEQ ID NO: 1349235 - RNA, 18 nt, Human
cuauuuucagaugugaac

SEQ ID NO: 1349236 - RNA, 22 nt, Human
cuauuuucagaugugaaccauu

SEQ ID NO: 1349237 - RNA, 19 nt, Human
cuauuuuccaggcuucugc

SEQ ID NO: 1349238 - RNA, 23 nt, Human
cuauuuuccaggcuucugcuggg

SEQ ID NO: 1349239 - RNA, 21 nt, Human
cuauuuuccaggcuucugcug

SEQ ID NO: 1349240 - RNA, 17 nt, Human
cuauuuuggauuguaua

SEQ ID NO: 1349241 - RNA, 12 nt, Human
cuauuuuguaaa

SEQ ID NO: 1349242 - RNA, 19 nt, Human
cuauuuuguaaacucaaaa

SEQ ID NO: 1349243 - RNA, 15 nt, Human
cucaaauggggccag

SEQ ID NO: 1349244 - RNA, 16 nt, Human
cucaaauggggccaga

SEQ ID NO: 1349245 - RNA, 17 nt, Human
cucaaauggggccagau

SEQ ID NO: 1349246 - RNA, 21 nt, Human
cuaugcaugguuucagcacua

SEQ ID NO: 1349247 - RNA, 23 nt, Human
cuaugcaugguuucagcacuagc

SEQ ID NO: 1349248 - RNA, 14 nt, Human
cucaaccucuacag

SEQ ID NO: 1349249 - RNA, 19 nt, Human
cucaaauggggccagaucc

SEQ ID NO: 1349250 - RNA, 20 nt, Human
cucaaauggggccagaucca

SEQ ID NO: 1349251 - RNA, 21 nt, Human
cucaaauggggccagauccag

SEQ ID NO: 1349252 - RNA, 13 nt, Human
cucaaauguucua

SEQ ID NO: 1349253 - RNA, 15 nt, Human
cucaaauguucuaag

SEQ ID NO: 1349254 - RNA, 16 nt, Human
cucaaauguucuaagu

SEQ ID NO: 1349255 - RNA, 17 nt, Human
cucaaauguucuaaguu

SEQ ID NO: 1349256 - RNA, 19 nt, Human
cucaaauguucuaaguuuc

SEQ ID NO: 1349257 - RNA, 21 nt, Human
cucaaauguucuaaguuucua

SEQ ID NO: 1349258 - RNA, 22 nt, Human
cucaaauguucuaaguuucuaa

SEQ ID NO: 1349259 - RNA, 23 nt, Human
cucaaauguucuaaguuucuaag

SEQ ID NO: 1349260 - RNA, 24 nt, Human
cucaaauguucuaaguuucuaaga

SEQ ID NO: 1349261 - RNA, 15 nt, Human
cucaacguauuguuu

SEQ ID NO: 1349262 - RNA, 16 nt, Human
cucaacguauuguuuc

SEQ ID NO: 1349263 - RNA, 16 nt, Human
cucaaccuuaagaccu

SEQ ID NO: 1349264 - RNA, 17 nt, Human
cucaagagggcacuggu

SEQ ID NO: 1349265 - RNA, 19 nt, Human
cucaagagggcacuggugg

SEQ ID NO: 1349266 - RNA, 21 nt, Human
cucaagagggcacugguggcc

SEQ ID NO: 1349267 - RNA, 13 nt, Human
cucaacugccuac

SEQ ID NO: 1349268 - RNA, 15 nt, Human
cucaacugccuacuc

SEQ ID NO: 1349269 - RNA, 23 nt, Human
cucaacugccuacuccaaaaugu

SEQ ID NO: 1349270 - RNA, 16 nt, Human
cucaagaugaaggcaa

SEQ ID NO: 1349271 - RNA, 16 nt, Human
cucaagcgauucuccu

SEQ ID NO: 1349272 - RNA, 17 nt, Human
cucaagcgauucuccug

SEQ ID NO: 1349273 - RNA, 20 nt, Human
cucaagcucuuccuuacucc

SEQ ID NO: 1349274 - RNA, 17 nt, Human
cucaagcugcaucuaga

SEQ ID NO: 1349275 - RNA, 21 nt, Human
cuaugaccucgcccuccacaa

SEQ ID NO: 1349276 - RNA, 16 nt, Human
cuaugacuugggcacc

SEQ ID NO: 1349277 - RNA, 23 nt, Human
cuaugacuugggcacccccagcc

SEQ ID NO: 1349278 - RNA, 20 nt, Human
cuaugacuugggcaccccca

SEQ ID NO: 1349279 - RNA, 19 nt, Human
cuaugcaugguuucagcac

SEQ ID NO: 1349280 - RNA, 20 nt, Human
cuaugcaugguuucagcacu

SEQ ID NO: 1349281 - RNA, 15 nt, Human
cuaacaugauuuggg

SEQ ID NO: 1349282 - RNA, 19 nt, Human
cuaacacucagaagccugg

SEQ ID NO: 1349283 - RNA, 20 nt, Human
cuaacacucagaagccuggg

SEQ ID NO: 1349284 - RNA, 22 nt, Human
cuaacacucagaagccuggggg

SEQ ID NO: 1349285 - RNA, 23 nt, Human
cuaacacucagaagccugggggc

SEQ ID NO: 1349286 - RNA, 15 nt, Human
cuaacaugaagaccu

SEQ ID NO: 1349287 - RNA, 13 nt, Human
cuaacaaugacau

SEQ ID NO: 1349288 - RNA, 15 nt, Human
cuaacaaugacauuu

SEQ ID NO: 1349289 - RNA, 23 nt, Human
cuaacacggugcucauuuuuucu

SEQ ID NO: 1349290 - RNA, 16 nt, Human
cuaacacucagaagcc

SEQ ID NO: 1349291 - RNA, 17 nt, Human
cuaacacucagaagccu

SEQ ID NO: 1349292 - RNA, 22 nt, Human
cuaaauguaguucugcuccaga

SEQ ID NO: 1349293 - RNA, 18 nt, Human
cuaaaugugcaauagaag

SEQ ID NO: 1349294 - RNA, 21 nt, Human
cuaaaugugcaauagaaggug

SEQ ID NO: 1349295 - RNA, 17 nt, Human
cuaaauggccucaugug

SEQ ID NO: 1349296 - RNA, 19 nt, Human
cuaaauggccucauguggc

SEQ ID NO: 1349297 - RNA, 14 nt, Human
cuaaauuauuuacu

SEQ ID NO: 1349298 - RNA, 15 nt, Human
cuaaauuauuuacug

SEQ ID NO: 1349299 - RNA, 23 nt, Human
cuaaauuauuuacugcaaaaaga

SEQ ID NO: 1349300 - RNA, 23 nt, Human
cuaaauugacacuuaaaaauggu

SEQ ID NO: 1349301 - RNA, 17 nt, Human
cuaaauccuuuacuguu

SEQ ID NO: 1349302 - RNA, 21 nt, Human
cuaaauccuuuacuguuaguc

SEQ ID NO: 1349303 - RNA, 16 nt, Human
cuaaauauggacugcu

SEQ ID NO: 1349304 - RNA, 22 nt, Human
cuaaauauggacugcucaggaa

SEQ ID NO: 1349305 - RNA, 20 nt, Human
cuaaauauuaugagaugcug

SEQ ID NO: 1349306 - RNA, 20 nt, Human
cuaaauauauuuuaagacga

SEQ ID NO: 1349307 - RNA, 18 nt, Human
cuaaauauauuuuaagac

SEQ ID NO: 1349308 - RNA, 15 nt, Human
cuaaacggauuccaa

SEQ ID NO: 1349309 - RNA, 16 nt, Human
cuaaacggauuccaaa

SEQ ID NO: 1349310 - RNA, 17 nt, Human
cuaaacggauuccaaag

SEQ ID NO: 1349311 - RNA, 16 nt, Human
cuaaaugaauguuuac

SEQ ID NO: 1349312 - RNA, 14 nt, Human
cuaaaugcccugcu

SEQ ID NO: 1349313 - RNA, 13 nt, Human
cuaaaugcccugc

SEQ ID NO: 1349314 - RNA, 12 nt, Human
cuaaauggccuc

SEQ ID NO: 1349315 - RNA, 13 nt, Human
cuaaauggccuca

SEQ ID NO: 1349316 - RNA, 16 nt, Human
cuaaauggccucaugu

SEQ ID NO: 1349317 - RNA, 16 nt, Human
cguuguccucagcccc

SEQ ID NO: 1349318 - RNA, 17 nt, Human
cguuggcuagauuaacc

SEQ ID NO: 1349319 - RNA, 16 nt, Human
cguuggagaagcccgu

SEQ ID NO: 1349320 - RNA, 17 nt, Human
cguuuaagccaaaacaa

SEQ ID NO: 1349321 - RNA, 18 nt, Human
cguuuaagccaaaacaau

SEQ ID NO: 1349322 - RNA, 22 nt, Human
cguuuaagccaaaacaauguuu

SEQ ID NO: 1349323 - RNA, 23 nt, Human
cuaaaaccuuccaugucaagauu

SEQ ID NO: 1349324 - RNA, 14 nt, Human
cuaaaaccugaaau

SEQ ID NO: 1349325 - RNA, 14 nt, Human
cguuuaaugaaugc

SEQ ID NO: 1349326 - RNA, 13 nt, Human
cguuuaaugaaug

SEQ ID NO: 1349327 - RNA, 18 nt, Human
cguuuaaugaaugcuuaa

SEQ ID NO: 1349328 - RNA, 15 nt, Human
cuaaaccauugugca

SEQ ID NO: 1349329 - RNA, 13 nt, Human
cuaaacaucauuc

SEQ ID NO: 1349330 - RNA, 15 nt, Human
cuaaacccaauccaa

SEQ ID NO: 1349331 - RNA, 19 nt, Human
cuaaacccaauccaaaugg

SEQ ID NO: 1349332 - RNA, 16 nt, Human
cuaaacccaauccaaa

SEQ ID NO: 1349333 - RNA, 18 nt, Human
cuaaacacgugacacaaa

SEQ ID NO: 1349334 - RNA, 17 nt, Human
cuaaacacgugacacaa

SEQ ID NO: 1349335 - RNA, 23 nt, Human
cuaaacaucauucauuuuuguug

SEQ ID NO: 1349336 - RNA, 12 nt, Human
cuaaacauccau

SEQ ID NO: 1349337 - RNA, 17 nt, Human
cuaaaacucuuucggua

SEQ ID NO: 1349338 - RNA, 13 nt, Human
cuaaaagaaacuu

SEQ ID NO: 1349339 - RNA, 14 nt, Human
cuaaaagaaacuuu

SEQ ID NO: 1349340 - RNA, 19 nt, Human
cguggacaccugcccugcc

SEQ ID NO: 1349341 - RNA, 18 nt, Human
cguggacaccugcccugc

SEQ ID NO: 1349342 - RNA, 17 nt, Human
cguggacaccugcccug

SEQ ID NO: 1349343 - RNA, 15 nt, Human
cguggacaccugccc

SEQ ID NO: 1349344 - RNA, 14 nt, Human
cguggacaccugcc

SEQ ID NO: 1349345 - RNA, 13 nt, Human
cguggacaccugc

SEQ ID NO: 1349346 - RNA, 12 nt, Human
cguggacaccug

SEQ ID NO: 1349347 - RNA, 22 nt, Human
cguggaaugcccuucacuguca

SEQ ID NO: 1349348 - RNA, 15 nt, Human
cguggacugaguggg

SEQ ID NO: 1349349 - RNA, 19 nt, Human
cguggacugagugggaagc

SEQ ID NO: 1349350 - RNA, 21 nt, Human
cguggacugagugggaagccc

SEQ ID NO: 1349351 - RNA, 15 nt, Human
cguggagagcuagga

SEQ ID NO: 1349352 - RNA, 19 nt, Human
cguggagagcuaggagcaa

SEQ ID NO: 1349353 - RNA, 18 nt, Human
cguggagagcuaggagca

SEQ ID NO: 1349354 - RNA, 19 nt, Human
cgugcucgccccagcaggu

SEQ ID NO: 1349355 - RNA, 14 nt, Human
cgugcucuuuguuu

SEQ ID NO: 1349356 - RNA, 16 nt, Human
cgugcucuuuguuuug

SEQ ID NO: 1349357 - RNA, 17 nt, Human
cgugcucuuuguuuugu

SEQ ID NO: 1349358 - RNA, 22 nt, Human
cgugcucuuuguuuugugucuc

SEQ ID NO: 1349359 - RNA, 23 nt, Human
cgugcucuuuguuuugugucucu

SEQ ID NO: 1349360 - RNA, 23 nt, Human
cgugccaaguccagguccuggug

SEQ ID NO: 1349361 - RNA, 21 nt, Human
cgugccaaguccagguccugg

SEQ ID NO: 1349362 - RNA, 17 nt, Human
cgugggcucccugacug

SEQ ID NO: 1349363 - RNA, 11 nt, Human
cguggggaggu

SEQ ID NO: 1349364 - RNA, 12 nt, Human
cguugcccccau

SEQ ID NO: 1349365 - RNA, 21 nt, Human
cguugcccccauuucugaggu

SEQ ID NO: 1349366 - RNA, 16 nt, Human
cguugcccccauuucu

SEQ ID NO: 1349367 - RNA, 20 nt, Human
cguggcuucccgcucagccc

SEQ ID NO: 1349368 - RNA, 21 nt, Human
cguggcuucccgcucagcccu

SEQ ID NO: 1349369 - RNA, 19 nt, Human
cgugggacggugcccaagc

SEQ ID NO: 1349370 - RNA, 20 nt, Human
cgugggacggugcccaagcc

SEQ ID NO: 1349371 - RNA, 14 nt, Human
cgugggcauugucu

SEQ ID NO: 1349372 - RNA, 21 nt, Human
cgugggccccacccucgggga

SEQ ID NO: 1349373 - RNA, 13 nt, Human
cgugggcucccug

SEQ ID NO: 1349374 - RNA, 23 nt, Human
cguggcuguggcauccagagucc

SEQ ID NO: 1349375 - RNA, 18 nt, Human
cguggcuucccgcucagc

SEQ ID NO: 1349376 - RNA, 19 nt, Human
cguggcuucccgcucagcc

SEQ ID NO: 1349377 - RNA, 13 nt, Human
cguggaggcugcu

SEQ ID NO: 1349378 - RNA, 15 nt, Human
cguggaggcugcucg

SEQ ID NO: 1349379 - RNA, 14 nt, Human
cguggaggcugcuc

SEQ ID NO: 1349380 - RNA, 18 nt, Human
cguggagggguaggggcu

SEQ ID NO: 1349381 - RNA, 19 nt, Human
cguggagggguaggggcug

SEQ ID NO: 1349382 - RNA, 20 nt, Human
cguggagggguaggggcugg

SEQ ID NO: 1349383 - RNA, 17 nt, Human
cguggauugcacguggc

SEQ ID NO: 1349384 - RNA, 23 nt, Human
cguggagggguaggggcugggaa

SEQ ID NO: 1349385 - RNA, 21 nt, Human
cguggagggguaggggcuggg

SEQ ID NO: 1349386 - RNA, 21 nt, Human
cguccuuacuccugugggagc

SEQ ID NO: 1349387 - RNA, 11 nt, Human
cgucucagugu

SEQ ID NO: 1349388 - RNA, 14 nt, Human
cgucuccaggggcu

SEQ ID NO: 1349389 - RNA, 19 nt, Human
cgucuccaggggcugcuuc

SEQ ID NO: 1349390 - RNA, 20 nt, Human
cgucuccaggggcugcuucc

SEQ ID NO: 1349391 - RNA, 21 nt, Human
cgucuccaggggcugcuuccu

SEQ ID NO: 1349392 - RNA, 16 nt, Human
cguccugccuguggcg

SEQ ID NO: 1349393 - RNA, 14 nt, Human
cguccugccugugg

SEQ ID NO: 1349394 - RNA, 15 nt, Human
cguccugccuguggc

SEQ ID NO: 1349395 - RNA, 15 nt, Human
cguccuuacuccugu

SEQ ID NO: 1349396 - RNA, 16 nt, Human
cguccuuacuccugug

SEQ ID NO: 1349397 - RNA, 17 nt, Human
cguccuuacuccugugg

SEQ ID NO: 1349398 - RNA, 20 nt, Human
cguccuuacuccugugggag

SEQ ID NO: 1349399 - RNA, 22 nt, Human
cguccuuacuccugugggagcc

SEQ ID NO: 1349400 - RNA, 13 nt, Human
cguccuccucugu

SEQ ID NO: 1349401 - RNA, 14 nt, Human
cguccuccucugug

SEQ ID NO: 1349402 - RNA, 15 nt, Human
cguccuccucuguga

SEQ ID NO: 1349403 - RNA, 13 nt, Human
cguccugagaaag

SEQ ID NO: 1349404 - RNA, 13 nt, Human
cguccugccugug

SEQ ID NO: 1349405 - RNA, 23 nt, Human
cggugcccaagccagaggcuggg

SEQ ID NO: 1349406 - RNA, 17 nt, Human
cggugccuuuauuucca

SEQ ID NO: 1349407 - RNA, 21 nt, Human
cggugccuuuauuuccacugu

SEQ ID NO: 1349408 - RNA, 23 nt, Human
cggugccuuuauuuccacugugc

SEQ ID NO: 1349409 - RNA, 18 nt, Human
cgucuuuuccuguuuccu

SEQ ID NO: 1349410 - RNA, 19 nt, Human
cgugaaaacacauuugcuu

SEQ ID NO: 1349411 - RNA, 13 nt, Human
cgucuucuccaac

SEQ ID NO: 1349412 - RNA, 15 nt, Human
cgugccaaguccagg

SEQ ID NO: 1349413 - RNA, 20 nt, Human
cgugccaaguccagguccug

SEQ ID NO: 1349414 - RNA, 22 nt, Human
cuacagagaaaccagcuuccuu

SEQ ID NO: 1349415 - RNA, 17 nt, Human
cggucggggcaucuggc

SEQ ID NO: 1349416 - RNA, 24 nt, Human
cggucgcccuuugcugcauggcag

SEQ ID NO: 1349417 - RNA, 13 nt, Human
cggucugugcccc

SEQ ID NO: 1349418 - RNA, 17 nt, Human
cggugagcuacaaaugc

SEQ ID NO: 1349419 - RNA, 14 nt, Human
cggugcccaagcca

SEQ ID NO: 1349420 - RNA, 15 nt, Human
cggugcccaagccag

SEQ ID NO: 1349421 - RNA, 18 nt, Human
cggugcccaagccagagg

SEQ ID NO: 1349422 - RNA, 20 nt, Human
cggugcccaagccagaggcu

SEQ ID NO: 1349423 - RNA, 21 nt, Human
cggucuguucuguuucaaggc

SEQ ID NO: 1349424 - RNA, 14 nt, Human
cggucugugccccu

SEQ ID NO: 1349425 - RNA, 15 nt, Human
cgguagccagcacac

SEQ ID NO: 1349426 - RNA, 21 nt, Human
cgguagccagcacacagggca

SEQ ID NO: 1349427 - RNA, 22 nt, Human
cgguagccagcacacagggcag

SEQ ID NO: 1349428 - RNA, 18 nt, Human
cgguagguucagccaagg

SEQ ID NO: 1349429 - RNA, 18 nt, Human
cgguauccccccaucuug

SEQ ID NO: 1349430 - RNA, 22 nt, Human
cgguauccccccaucuugcuuc

SEQ ID NO: 1349431 - RNA, 13 nt, Human
cgggucugccucu

SEQ ID NO: 1349432 - RNA, 13 nt, Human
cgggucugcuccc

SEQ ID NO: 1349433 - RNA, 17 nt, Human
cgggucugcucccaagg

SEQ ID NO: 1349434 - RNA, 14 nt, Human
cgggucugcuccca

SEQ ID NO: 1349435 - RNA, 20 nt, Human
cgggugaacaaagcagccac

SEQ ID NO: 1349436 - RNA, 19 nt, Human
cgggucacaggagggaggg

SEQ ID NO: 1349437 - RNA, 11 nt, Human
cgggucacagg

SEQ ID NO: 1349438 - RNA, 16 nt, Human
cggggugggggcagca

SEQ ID NO: 1349439 - RNA, 22 nt, Human
cggggugggguggcugcagccu

SEQ ID NO: 1349440 - RNA, 21 nt, Human
cgggugaacaaagcagccacg

SEQ ID NO: 1349441 - RNA, 16 nt, Human
cgggugccagaagcua

SEQ ID NO: 1349442 - RNA, 16 nt, Human
cggguggggcuugggg

SEQ ID NO: 1349443 - RNA, 20 nt, Human
cggguggggcuuggggcuca

SEQ ID NO: 1349444 - RNA, 16 nt, Human
cggguugugugucugu

SEQ ID NO: 1349445 - RNA, 17 nt, Human
cggguugugugucuguu

SEQ ID NO: 1349446 - RNA, 14 nt, Human
cggggacucagccc

SEQ ID NO: 1349447 - RNA, 17 nt, Human
cggggccugggcaggag

SEQ ID NO: 1349448 - RNA, 18 nt, Human
cgggcagagggcuggagg

SEQ ID NO: 1349449 - RNA, 19 nt, Human
cgggcagagggcuggaggc

SEQ ID NO: 1349450 - RNA, 23 nt, Human
cgggcagagggcuggaggcccag

SEQ ID NO: 1349451 - RNA, 22 nt, Human
cgggcagagggcuggaggccca

SEQ ID NO: 1349452 - RNA, 19 nt, Human
cggggccugggcaggaggg

SEQ ID NO: 1349453 - RNA, 13 nt, Human
cggggcugggaag

SEQ ID NO: 1349454 - RNA, 12 nt, Human
cggggcuugccu

SEQ ID NO: 1349455 - RNA, 15 nt, Human
cggggcuugccuucu

SEQ ID NO: 1349456 - RNA, 16 nt, Human
cggggcuugccuucug

SEQ ID NO: 1349457 - RNA, 18 nt, Human
cggggcuugccuucuggu

SEQ ID NO: 1349458 - RNA, 19 nt, Human
cgggggaggguaggcagga

SEQ ID NO: 1349459 - RNA, 17 nt, Human
cgggggcagucugagag

SEQ ID NO: 1349460 - RNA, 18 nt, Human
cgggggcagucugagaga

SEQ ID NO: 1349461 - RNA, 21 nt, Human
cgggggcagucugagagaggc

SEQ ID NO: 1349462 - RNA, 17 nt, Human
cggggguggcggcggcc

SEQ ID NO: 1349463 - RNA, 21 nt, Human
cggggguggcggcggccccua

SEQ ID NO: 1349464 - RNA, 19 nt, Human
cggggguuccguguccacc

SEQ ID NO: 1349465 - RNA, 20 nt, Human
cggggguuccguguccaccc

SEQ ID NO: 1349466 - RNA, 22 nt, Human
cggggguuccguguccaccccc

SEQ ID NO: 1349467 - RNA, 22 nt, Human
cggggugagggggggcucccug

SEQ ID NO: 1349468 - RNA, 15 nt, Human
cggggugcacaggag

SEQ ID NO: 1349469 - RNA, 16 nt, Human
cggggugcacaggagg

SEQ ID NO: 1349470 - RNA, 17 nt, Human
cggggugcacaggaggg

SEQ ID NO: 1349471 - RNA, 16 nt, Human
cggggugcccacaggc

SEQ ID NO: 1349472 - RNA, 18 nt, Human
cggggugcacaggagggg

SEQ ID NO: 1349473 - RNA, 13 nt, Human
cgggacugcggag

SEQ ID NO: 1349474 - RNA, 12 nt, Human
cgggagacagca

SEQ ID NO: 1349475 - RNA, 17 nt, Human
cgggagccugacccuca

SEQ ID NO: 1349476 - RNA, 21 nt, Human
cgggagccugaucaccugccc

SEQ ID NO: 1349477 - RNA, 22 nt, Human
cgggagccaugcgcccccuccg

SEQ ID NO: 1349478 - RNA, 12 nt, Human
cggcugggagga

SEQ ID NO: 1349479 - RNA, 17 nt, Human
cgggauuaguacacacu

SEQ ID NO: 1349480 - RNA, 16 nt, Human
cgggaugguucuggcu

SEQ ID NO: 1349481 - RNA, 14 nt, Human
cgggcagagggcug

SEQ ID NO: 1349482 - RNA, 15 nt, Human
cgggcagagggcugg

SEQ ID NO: 1349483 - RNA, 16 nt, Human
cgggcagagggcugga

SEQ ID NO: 1349484 - RNA, 17 nt, Human
cggcccacaauuaauuu

SEQ ID NO: 1349485 - RNA, 17 nt, Human
cggccagggagaagcuc

SEQ ID NO: 1349486 - RNA, 16 nt, Human
cggccagggagaagcu

SEQ ID NO: 1349487 - RNA, 17 nt, Human
cggccacacagcugccg

SEQ ID NO: 1349488 - RNA, 15 nt, Human
cggcccaauccaagg

SEQ ID NO: 1349489 - RNA, 17 nt, Human
cggcccaauccaaggug

SEQ ID NO: 1349490 - RNA, 11 nt, Human
cggcugcccuu

SEQ ID NO: 1349491 - RNA, 12 nt, Human
cggcugcccuuu

SEQ ID NO: 1349492 - RNA, 17 nt, Human
cggccuaugacuugggc

SEQ ID NO: 1349493 - RNA, 18 nt, Human
cggccuaugacuugggca

SEQ ID NO: 1349494 - RNA, 19 nt, Human
cggccuaugacuugggcac

SEQ ID NO: 1349495 - RNA, 12 nt, Human
cggcugcagagg

SEQ ID NO: 1349496 - RNA, 15 nt, Human
cggcugcagaggcca

SEQ ID NO: 1349497 - RNA, 20 nt, Human
cggcugcagaggccagaggc

SEQ ID NO: 1349498 - RNA, 14 nt, Human
cggccuccauccug

SEQ ID NO: 1349499 - RNA, 12 nt, Human
cggccuccaucc

SEQ ID NO: 1349500 - RNA, 14 nt, Human
cggccggccagccc

SEQ ID NO: 1349501 - RNA, 16 nt, Human
cggccggccagccccu

SEQ ID NO: 1349502 - RNA, 23 nt, Human
cggccggccagccccuggcccca

SEQ ID NO: 1349503 - RNA, 11 nt, Human
cgcuuuuugaa

SEQ ID NO: 1349504 - RNA, 16 nt, Human
cgcuuuuugaaaaagc

SEQ ID NO: 1349505 - RNA, 15 nt, Human
cggaaggguaaacaa

SEQ ID NO: 1349506 - RNA, 17 nt, Human
cggaaggguaaacaaua

SEQ ID NO: 1349507 - RNA, 18 nt, Human
cggaaggguaaacaauau

SEQ ID NO: 1349508 - RNA, 19 nt, Human
cggaaggguaaacaauaua

SEQ ID NO: 1349509 - RNA, 21 nt, Human
cggcacagggucugcucuuuc

SEQ ID NO: 1349510 - RNA, 15 nt, Human
cggcacccccugcag

SEQ ID NO: 1349511 - RNA, 16 nt, Human
cggcacccccugcagc

SEQ ID NO: 1349512 - RNA, 17 nt, Human
cggcacccccugcagcu

SEQ ID NO: 1349513 - RNA, 19 nt, Human
cggcacccccugcagcuug

SEQ ID NO: 1349514 - RNA, 20 nt, Human
cggcacccccugcagcuugu

SEQ ID NO: 1349515 - RNA, 13 nt, Human
cggcaccugggcc

SEQ ID NO: 1349516 - RNA, 17 nt, Human
cggcaccugggcccugg

SEQ ID NO: 1349517 - RNA, 19 nt, Human
cggcaccugggcccugggg

SEQ ID NO: 1349518 - RNA, 20 nt, Human
cggcaccugggcccuggggc

SEQ ID NO: 1349519 - RNA, 23 nt, Human
cggcaccugggcccuggggccug

SEQ ID NO: 1349520 - RNA, 22 nt, Human
cggcaccugggcccuggggccu

SEQ ID NO: 1349521 - RNA, 13 nt, Human
cggcagcagcccc

SEQ ID NO: 1349522 - RNA, 17 nt, Human
cggcagcuucugccccc

SEQ ID NO: 1349523 - RNA, 20 nt, Human
cggcagcuucugcccccugc

SEQ ID NO: 1349524 - RNA, 21 nt, Human
cggcagcuucugcccccugca

SEQ ID NO: 1349525 - RNA, 22 nt, Human
cggcagcuucugcccccugcag

SEQ ID NO: 1349526 - RNA, 23 nt, Human
cggcagcuucugcccccugcaga

SEQ ID NO: 1349527 - RNA, 21 nt, Human
cggcauggacaauggaccgga

SEQ ID NO: 1349528 - RNA, 13 nt, Human
cggcauuuguuuc

SEQ ID NO: 1349529 - RNA, 15 nt, Human
cggccacacagcugc

SEQ ID NO: 1349530 - RNA, 16 nt, Human
cggccacacagcugcc

SEQ ID NO: 1349531 - RNA, 18 nt, Human
cggccacacagcugccgg

SEQ ID NO: 1349532 - RNA, 18 nt, Human
cggcugggaggagggcag

SEQ ID NO: 1349533 - RNA, 16 nt, Human
cgcccuggacugugug

SEQ ID NO: 1349534 - RNA, 13 nt, Human
cgccccuuccccc

SEQ ID NO: 1349535 - RNA, 14 nt, Human
cgcccuuuccuccu

SEQ ID NO: 1349536 - RNA, 16 nt, Human
cgcccuuuccuccuca

SEQ ID NO: 1349537 - RNA, 17 nt, Human
cgcccuuuccuccucag

SEQ ID NO: 1349538 - RNA, 19 nt, Human
cgcccuuuccuccucaggc

SEQ ID NO: 1349539 - RNA, 20 nt, Human
cgcccuuuccuccucaggca

SEQ ID NO: 1349540 - RNA, 20 nt, Human
cgcgauguggaacugcugcc

SEQ ID NO: 1349541 - RNA, 21 nt, Human
cgcgauguggaacugcugcca

SEQ ID NO: 1349542 - RNA, 22 nt, Human
cgcgauguggaacugcugccac

SEQ ID NO: 1349543 - RNA, 23 nt, Human
cgcgauguggaacugcugccacu

SEQ ID NO: 1349544 - RNA, 13 nt, Human
cgcccccugucuc

SEQ ID NO: 1349545 - RNA, 18 nt, Human
cgcccccugucucucagg

SEQ ID NO: 1349546 - RNA, 22 nt, Human
cgcccagagacccaagcugccu

SEQ ID NO: 1349547 - RNA, 22 nt, Human
ccucugcccaggcacugcuagg

SEQ ID NO: 1349548 - RNA, 12 nt, Human
cgccagcucugu

SEQ ID NO: 1349549 - RNA, 19 nt, Human
cgccagcucuguucuuccu

SEQ ID NO: 1349550 - RNA, 14 nt, Human
cgccagcucuguuc

SEQ ID NO: 1349551 - RNA, 20 nt, Human
cgcccacaggaagccugcag

SEQ ID NO: 1349552 - RNA, 21 nt, Human
cgcccacaggaagccugcagu

SEQ ID NO: 1349553 - RNA, 22 nt, Human
cgcccacaggaagccugcaguc

SEQ ID NO: 1349554 - RNA, 21 nt, Human
cgccaggauggaacacggcca

SEQ ID NO: 1349555 - RNA, 13 nt, Human
cgcccagcuccug

SEQ ID NO: 1349556 - RNA, 18 nt, Human
cgcugguccuuucuuccg

SEQ ID NO: 1349557 - RNA, 17 nt, Human
cgcuguaugucuuaaaa

SEQ ID NO: 1349558 - RNA, 13 nt, Human
cgcugucacaggc

SEQ ID NO: 1349559 - RNA, 18 nt, Human
cgcugucaggauugcgag

SEQ ID NO: 1349560 - RNA, 18 nt, Human
cgcucucuggccuucggc

SEQ ID NO: 1349561 - RNA, 13 nt, Human
cgcuccagcugcc

SEQ ID NO: 1349562 - RNA, 14 nt, Human
cgcugggugguacc

SEQ ID NO: 1349563 - RNA, 19 nt, Human
cgcugggugguacccucug

SEQ ID NO: 1349564 - RNA, 22 nt, Human
cgcugggugguacccucuggag

SEQ ID NO: 1349565 - RNA, 20 nt, Human
cgcugucaggauugcgagag

SEQ ID NO: 1349566 - RNA, 17 nt, Human
cgcuguccuuucuagag

SEQ ID NO: 1349567 - RNA, 16 nt, Human
cgcuguccuuucuaga

SEQ ID NO: 1349568 - RNA, 19 nt, Human
cgcuucuugccucugugcu

SEQ ID NO: 1349569 - RNA, 22 nt, Human
cgcuucuugccucugugcugug

SEQ ID NO: 1349570 - RNA, 14 nt, Human
cgcuuggagcagag

SEQ ID NO: 1349571 - RNA, 22 nt, Human
cgcuuggagcuauuuuccaggc

SEQ ID NO: 1349572 - RNA, 22 nt, Human
cgcuuggcgaugccagccaagc

SEQ ID NO: 1349573 - RNA, 20 nt, Human
cgcuuggcgaugccagccaa

SEQ ID NO: 1349574 - RNA, 12 nt, Human
cgcucagcccuc

SEQ ID NO: 1349575 - RNA, 16 nt, Human
cgcucagcccucccug

SEQ ID NO: 1349576 - RNA, 21 nt, Human
cgcucagcccucccugccccu

SEQ ID NO: 1349577 - RNA, 23 nt, Human
cgcuaauucaaggaauuucuuaa

SEQ ID NO: 1349578 - RNA, 16 nt, Human
cgcuacaccacucugg

SEQ ID NO: 1349579 - RNA, 17 nt, Human
cgcuacaccacucuggc

SEQ ID NO: 1349580 - RNA, 20 nt, Human
cgcuacaccacucuggcagc

SEQ ID NO: 1349581 - RNA, 23 nt, Human
cgcuacaccacucuggcagccac

SEQ ID NO: 1349582 - RNA, 15 nt, Human
cgcucucuggccuuc

SEQ ID NO: 1349583 - RNA, 15 nt, Human
cgcuccagcugcccc

SEQ ID NO: 1349584 - RNA, 19 nt, Human
cgcucagggccaugcugag

SEQ ID NO: 1349585 - RNA, 20 nt, Human
cgcucagggccaugcugagg

SEQ ID NO: 1349586 - RNA, 21 nt, Human
cgcucagggccaugcugaggc

SEQ ID NO: 1349587 - RNA, 22 nt, Human
cgcucagggccaugcugaggcc

SEQ ID NO: 1349588 - RNA, 23 nt, Human
cgcucagcucauccaugccucag

SEQ ID NO: 1349589 - RNA, 14 nt, Human
cgcggcccucagua

SEQ ID NO: 1349590 - RNA, 21 nt, Human
cgcggcccucaguagucccug

SEQ ID NO: 1349591 - RNA, 16 nt, Human
cgcgccaggauggcgc

SEQ ID NO: 1349592 - RNA, 21 nt, Human
caguggcgugaucucagcuca

SEQ ID NO: 1349593 - RNA, 21 nt, Human
caguggcgcgaucucagcuca

SEQ ID NO: 1349594 - RNA, 16 nt, Human
caguggcccauggcau

SEQ ID NO: 1349595 - RNA, 11 nt, Human
caguggccuua

SEQ ID NO: 1349596 - RNA, 21 nt, Human
caguggcaucaucucagcuca

SEQ ID NO: 1349597 - RNA, 21 nt, Human
caguggcccauggcauuuuau

SEQ ID NO: 1349598 - RNA, 13 nt, Human
caguggcaggcag

SEQ ID NO: 1349599 - RNA, 14 nt, Human
caguggcaggcaga

SEQ ID NO: 1349600 - RNA, 20 nt, Human
caguggcaggcagaggccca

SEQ ID NO: 1349601 - RNA, 21 nt, Human
caguggcaggcagaggcccag

SEQ ID NO: 1349602 - RNA, 11 nt, Human
cagugggaacu

SEQ ID NO: 1349603 - RNA, 16 nt, Human
cagugggacagggcau

SEQ ID NO: 1349604 - RNA, 18 nt, Human
caguggcugguccagggc

SEQ ID NO: 1349605 - RNA, 19 nt, Human
caguggcugguccagggcu

SEQ ID NO: 1349606 - RNA, 20 nt, Human
caguggcugguccagggcua

SEQ ID NO: 1349607 - RNA, 18 nt, Human
cagugggaaaaauguagg

SEQ ID NO: 1349608 - RNA, 19 nt, Human
cagugggaaaaauguagga

SEQ ID NO: 1349609 - RNA, 15 nt, Human
caguggaggaagagg

SEQ ID NO: 1349610 - RNA, 20 nt, Human
caguggaggaagagggacag

SEQ ID NO: 1349611 - RNA, 17 nt, Human
caguggaucacaaagug

SEQ ID NO: 1349612 - RNA, 20 nt, Human
cagugcuuuuaagugaaaau

SEQ ID NO: 1349613 - RNA, 12 nt, Human
cagugcuuuugg

SEQ ID NO: 1349614 - RNA, 21 nt, Human
cagugcuuuuggcggggagga

SEQ ID NO: 1349615 - RNA, 14 nt, Human
cagugucaaugcag

SEQ ID NO: 1349616 - RNA, 13 nt, Human
cagugucaggcac

SEQ ID NO: 1349617 - RNA, 16 nt, Human
cagugucaggcacugg

SEQ ID NO: 1349618 - RNA, 16 nt, Human
cagugucauuucucau

SEQ ID NO: 1349619 - RNA, 17 nt, Human
caguguauggaaauaaa

SEQ ID NO: 1349620 - RNA, 22 nt, Human
cagugucauuucucauccacau

SEQ ID NO: 1349621 - RNA, 13 nt, Human
caguguccugagc

SEQ ID NO: 1349622 - RNA, 14 nt, Human
caguguccugagcu

SEQ ID NO: 1349623 - RNA, 15 nt, Human
caguguccugagcuc

SEQ ID NO: 1349624 - RNA, 16 nt, Human
caguguccugagcuca

SEQ ID NO: 1349625 - RNA, 18 nt, Human
caguguccugagcucagc

SEQ ID NO: 1349626 - RNA, 22 nt, Human
caguguccugagcucagcgugg

SEQ ID NO: 1349627 - RNA, 19 nt, Human
caguguccugagcucagcg

SEQ ID NO: 1349628 - RNA, 20 nt, Human
caguguccuuggcaggcuga

SEQ ID NO: 1349629 - RNA, 12 nt, Human
cagugucuuuuu

SEQ ID NO: 1349630 - RNA, 17 nt, Human
cagugucuuuuuuugua

SEQ ID NO: 1349631 - RNA, 19 nt, Human
cagugucuuuuuuuguaua

SEQ ID NO: 1349632 - RNA, 23 nt, Human
cagugucuuuuuuuguauaguua

SEQ ID NO: 1349633 - RNA, 21 nt, Human
cagugucuuuuuuuguauagu

SEQ ID NO: 1349634 - RNA, 13 nt, Human
cagugucuguguu

SEQ ID NO: 1349635 - RNA, 23 nt, Human
cagugucuguguuuugaaagaau

SEQ ID NO: 1349636 - RNA, 16 nt, Human
cagugugaggccaggg

SEQ ID NO: 1349637 - RNA, 17 nt, Human
cagugugaggccagggc

SEQ ID NO: 1349638 - RNA, 18 nt, Human
cagugugaggccagggca

SEQ ID NO: 1349639 - RNA, 19 nt, Human
cagugugaggccagggcag

SEQ ID NO: 1349640 - RNA, 14 nt, Human
cagugugcaaggca

SEQ ID NO: 1349641 - RNA, 18 nt, Human
cagugugcaaggcagccg

SEQ ID NO: 1349642 - RNA, 20 nt, Human
cagugugcaaggcagccgug

SEQ ID NO: 1349643 - RNA, 21 nt, Human
cagugugcaaggcagccgugg

SEQ ID NO: 1349644 - RNA, 18 nt, Human
caguguggaggccacugu

SEQ ID NO: 1349645 - RNA, 19 nt, Human
caguguggaggccacuguu

SEQ ID NO: 1349646 - RNA, 20 nt, Human
caguguggaggccacuguuu

SEQ ID NO: 1349647 - RNA, 21 nt, Human
caguguguggcuuucagagcc

SEQ ID NO: 1349648 - RNA, 22 nt, Human
caguguguggcuuucagagccu

SEQ ID NO: 1349649 - RNA, 24 nt, Human
caguuaacuauugcauuuauaugu

SEQ ID NO: 1349650 - RNA, 21 nt, Human
caguuaacuauugcauuuaua

SEQ ID NO: 1349651 - RNA, 15 nt, Human
caguuaaaaaaaauu

SEQ ID NO: 1349652 - RNA, 16 nt, Human
caguuaaaaaaaauuu

SEQ ID NO: 1349653 - RNA, 19 nt, Human
caguuaaaaaaaauuuuaa

SEQ ID NO: 1349654 - RNA, 15 nt, Human
caguguuuucuggga

SEQ ID NO: 1349655 - RNA, 22 nt, Human
caguguuuucugggauaaguaa

SEQ ID NO: 1349656 - RNA, 21 nt, Human
caguguuuuuagaccuguguu

SEQ ID NO: 1349657 - RNA, 18 nt, Human
caguguuggggaugccuu

SEQ ID NO: 1349658 - RNA, 14 nt, Human
caguguugucacca

SEQ ID NO: 1349659 - RNA, 20 nt, Human
caguguugucaccagaucug

SEQ ID NO: 1349660 - RNA, 18 nt, Human
caguguuuauccuuucau

SEQ ID NO: 1349661 - RNA, 14 nt, Human
caguguuuaaaacu

SEQ ID NO: 1349662 - RNA, 18 nt, Human
caguguugagccuuuucc

SEQ ID NO: 1349663 - RNA, 19 nt, Human
caguguuagggaagggccu

SEQ ID NO: 1349664 - RNA, 13 nt, Human
caguguuagcuua

SEQ ID NO: 1349665 - RNA, 14 nt, Human
caguguuagcuuag

SEQ ID NO: 1349666 - RNA, 14 nt, Human
caguguuaaaugug

SEQ ID NO: 1349667 - RNA, 19 nt, Human
caguguuaaaugugaugaa

SEQ ID NO: 1349668 - RNA, 21 nt, Human
caguuaccucugccucagaaa

SEQ ID NO: 1349669 - RNA, 22 nt, Human
caguuacauaauucacucugag

SEQ ID NO: 1349670 - RNA, 18 nt, Human
caguuaccauuaaaccau

SEQ ID NO: 1349671 - RNA, 19 nt, Human
caguuaccauuaaaccauc

SEQ ID NO: 1349672 - RNA, 20 nt, Human
caguuaccauuaaaccaucu

SEQ ID NO: 1349673 - RNA, 23 nt, Human
caguuaccauuaaaccaucuccc

SEQ ID NO: 1349674 - RNA, 15 nt, Human
caguuccugggaaca

SEQ ID NO: 1349675 - RNA, 18 nt, Human
caguuccuguggcucccu

SEQ ID NO: 1349676 - RNA, 19 nt, Human
caguuccuguggcucccuc

SEQ ID NO: 1349677 - RNA, 14 nt, Human
caguuaagccuuug

SEQ ID NO: 1349678 - RNA, 15 nt, Human
caguuaagccuuugg

SEQ ID NO: 1349679 - RNA, 17 nt, Human
caguuaagccuuuggaa

SEQ ID NO: 1349680 - RNA, 20 nt, Human
caguuaagccuuuggaaaca

SEQ ID NO: 1349681 - RNA, 15 nt, Human
caguuaagaaauuuc

SEQ ID NO: 1349682 - RNA, 16 nt, Human
caguuaagaaauuuca

SEQ ID NO: 1349683 - RNA, 15 nt, Human
caguuaaucuugcuu

SEQ ID NO: 1349684 - RNA, 12 nt, Human
caguuaaucuug

SEQ ID NO: 1349685 - RNA, 12 nt, Human
caguuaauuuuu

SEQ ID NO: 1349686 - RNA, 12 nt, Human
caguuacacaug

SEQ ID NO: 1349687 - RNA, 13 nt, Human
caguuaauuuuuc

SEQ ID NO: 1349688 - RNA, 14 nt, Human
caguuaauuuuucc

SEQ ID NO: 1349689 - RNA, 16 nt, Human
caguuaauuuuuccaa

SEQ ID NO: 1349690 - RNA, 19 nt, Human
caguuaauuuuuccaacua

SEQ ID NO: 1349691 - RNA, 15 nt, Human
caguucugaagaaga

SEQ ID NO: 1349692 - RNA, 16 nt, Human
caguucugaagaagau

SEQ ID NO: 1349693 - RNA, 22 nt, Human
caguucugaagaagaugguacc

SEQ ID NO: 1349694 - RNA, 20 nt, Human
caguucucauggguggcacu

SEQ ID NO: 1349695 - RNA, 13 nt, Human
caguucugaagaa

SEQ ID NO: 1349696 - RNA, 14 nt, Human
caguucugaagaag

SEQ ID NO: 1349697 - RNA, 12 nt, Human
caguucugaaga

SEQ ID NO: 1349698 - RNA, 22 nt, Human
caguucggugagcuacaaaugc

SEQ ID NO: 1349699 - RNA, 15 nt, Human
caguuccuuucaaag

SEQ ID NO: 1349700 - RNA, 21 nt, Human
caguucgacucugugcuggcc

SEQ ID NO: 1349701 - RNA, 13 nt, Human
caguucgcagcca

SEQ ID NO: 1349702 - RNA, 14 nt, Human
caguucgcagccac

SEQ ID NO: 1349703 - RNA, 15 nt, Human
caguucgcagccacc

SEQ ID NO: 1349704 - RNA, 16 nt, Human
caguucgcagccaccc

SEQ ID NO: 1349705 - RNA, 18 nt, Human
caguucgcagccacccug

SEQ ID NO: 1349706 - RNA, 19 nt, Human
caguucgcagccacccuga

SEQ ID NO: 1349707 - RNA, 21 nt, Human
caguucgcagccacccugagg

SEQ ID NO: 1349708 - RNA, 22 nt, Human
caguucgcagccacccugagga

SEQ ID NO: 1349709 - RNA, 15 nt, Human
caguucuaaccuccu

SEQ ID NO: 1349710 - RNA, 18 nt, Human
caguucuaaccuccuaag

SEQ ID NO: 1349711 - RNA, 11 nt, Human
caguucuagga

SEQ ID NO: 1349712 - RNA, 15 nt, Human
caguucuaggaaaau

SEQ ID NO: 1349713 - RNA, 12 nt, Human
caguucuaggaa

SEQ ID NO: 1349714 - RNA, 16 nt, Human
caguucuuugggccag

SEQ ID NO: 1349715 - RNA, 17 nt, Human
caguucuuugggccaga

SEQ ID NO: 1349716 - RNA, 18 nt, Human
caguucuuugggccagac

SEQ ID NO: 1349717 - RNA, 19 nt, Human
caguucuuugggccagaca

SEQ ID NO: 1349718 - RNA, 19 nt, Human
caguucuucgacuguuguu

SEQ ID NO: 1349719 - RNA, 18 nt, Human
caguucuucgacuguugu

SEQ ID NO: 1349720 - RNA, 23 nt, Human
caguucugugaucugggucucua

SEQ ID NO: 1349721 - RNA, 20 nt, Human
caguucugugguuucauguu

SEQ ID NO: 1349722 - RNA, 15 nt, Human
cauaauacuugcuuu

SEQ ID NO: 1349723 - RNA, 18 nt, Human
cauaauccaguaaaauaa

SEQ ID NO: 1349724 - RNA, 17 nt, Human
cauaauccaguaaaaua

SEQ ID NO: 1349725 - RNA, 15 nt, Human
cauaaucacucuaau

SEQ ID NO: 1349726 - RNA, 16 nt, Human
cauaaucacucuaauu

SEQ ID NO: 1349727 - RNA, 19 nt, Human
cauaaucuggacuccucug

SEQ ID NO: 1349728 - RNA, 18 nt, Human
cauacauucuucaagauc

SEQ ID NO: 1349729 - RNA, 21 nt, Human
cauacauucuucaagauccca

SEQ ID NO: 1349730 - RNA, 14 nt, Human
cauacauuuucuaa

SEQ ID NO: 1349731 - RNA, 16 nt, Human
cauacauuuucuaaga

SEQ ID NO: 1349732 - RNA, 18 nt, Human
cauaccauggaggaaggc

SEQ ID NO: 1349733 - RNA, 17 nt, Human
cauacauuuuguaccaa

SEQ ID NO: 1349734 - RNA, 18 nt, Human
cauacauuuucuaagaaa

SEQ ID NO: 1349735 - RNA, 14 nt, Human
cauaccaaugaaaa

SEQ ID NO: 1349736 - RNA, 18 nt, Human
cauaagcuuaugcuuaaa

SEQ ID NO: 1349737 - RNA, 16 nt, Human
cauaagcuauuuuucu

SEQ ID NO: 1349738 - RNA, 17 nt, Human
cauaagcuauuuuucua

SEQ ID NO: 1349739 - RNA, 20 nt, Human
cauaagcuauuuuucuaacu

SEQ ID NO: 1349740 - RNA, 18 nt, Human
cauaagcuauuuuucuaa

SEQ ID NO: 1349741 - RNA, 15 nt, Human
cauaaggcuucaaaa

SEQ ID NO: 1349742 - RNA, 19 nt, Human
cauaaggcuucaaaauguu

SEQ ID NO: 1349743 - RNA, 19 nt, Human
cauaaguauuaugucucuu

SEQ ID NO: 1349744 - RNA, 15 nt, Human
cauaaguauuucaaa

SEQ ID NO: 1349745 - RNA, 12 nt, Human
cauaaguuucug

SEQ ID NO: 1349746 - RNA, 17 nt, Human
cauaagauauuuuucau

SEQ ID NO: 1349747 - RNA, 22 nt, Human
cauaacuaauacagcugagcua

SEQ ID NO: 1349748 - RNA, 17 nt, Human
cauaacuaauacagcug

SEQ ID NO: 1349749 - RNA, 11 nt, Human
cauaacugaaa

SEQ ID NO: 1349750 - RNA, 14 nt, Human
cauaacugaaaaug

SEQ ID NO: 1349751 - RNA, 14 nt, Human
cauaacugaacauc

SEQ ID NO: 1349752 - RNA, 19 nt, Human
cauaagaaaacuaagaaau

SEQ ID NO: 1349753 - RNA, 16 nt, Human
cauaaauccuugauga

SEQ ID NO: 1349754 - RNA, 11 nt, Human
cauaaauuauu

SEQ ID NO: 1349755 - RNA, 12 nt, Human
cauaaauuauug

SEQ ID NO: 1349756 - RNA, 21 nt, Human
cauaaaguugauaaagauuuu

SEQ ID NO: 1349757 - RNA, 13 nt, Human
cauaaaggaaaag

SEQ ID NO: 1349758 - RNA, 15 nt, Human
cauaaaggaaaagac

SEQ ID NO: 1349759 - RNA, 19 nt, Human
cauaaaggaaaagacacau

SEQ ID NO: 1349760 - RNA, 21 nt, Human
cauaaaggaaaagacacauuu

SEQ ID NO: 1349761 - RNA, 17 nt, Human
cauaacaauuccucuac

SEQ ID NO: 1349762 - RNA, 19 nt, Human
cauaaauuuaguauuuugu

SEQ ID NO: 1349763 - RNA, 20 nt, Human
cauaaauuuaguauuuuguu

SEQ ID NO: 1349764 - RNA, 15 nt, Human
cauaacaacuucaua

SEQ ID NO: 1349765 - RNA, 14 nt, Human
cauaacaauuccuc

SEQ ID NO: 1349766 - RNA, 15 nt, Human
cauaacaauuccucu

SEQ ID NO: 1349767 - RNA, 16 nt, Human
cauaacaauuccucua

SEQ ID NO: 1349768 - RNA, 13 nt, Human
cauaaccacugcu

SEQ ID NO: 1349769 - RNA, 14 nt, Human
cauaaccacugcuu

SEQ ID NO: 1349770 - RNA, 15 nt, Human
cauaaccacugcuuc

SEQ ID NO: 1349771 - RNA, 22 nt, Human
cauaacccaagguaccauccua

SEQ ID NO: 1349772 - RNA, 12 nt, Human
cauaaccugucu

SEQ ID NO: 1349773 - RNA, 23 nt, Human
cauaaccugucucaccuggacuu

SEQ ID NO: 1349774 - RNA, 18 nt, Human
cauaaccuuaccagauuu

SEQ ID NO: 1349775 - RNA, 16 nt, Human
cauaaagcaggcagaa

SEQ ID NO: 1349776 - RNA, 14 nt, Human
cauaaagcaggcag

SEQ ID NO: 1349777 - RNA, 20 nt, Human
cauaaacacaucacagauga

SEQ ID NO: 1349778 - RNA, 21 nt, Human
cauaaacccaguugccaucug

SEQ ID NO: 1349779 - RNA, 21 nt, Human
cauaaaaaggacaucagcaaa

SEQ ID NO: 1349780 - RNA, 20 nt, Human
cauaaaaaggacaucagcaa

SEQ ID NO: 1349781 - RNA, 19 nt, Human
cauaaaaaggacaucagca

SEQ ID NO: 1349782 - RNA, 13 nt, Human
cauaaaaaggaca

SEQ ID NO: 1349783 - RNA, 19 nt, Human
caguuuuuuuuuucuuguc

SEQ ID NO: 1349784 - RNA, 20 nt, Human
caguuuuuuuuuucuugucu

SEQ ID NO: 1349785 - RNA, 21 nt, Human
caguuuuuuuuuucuugucua

SEQ ID NO: 1349786 - RNA, 22 nt, Human
cauaaaaaggacaucagcaaac

SEQ ID NO: 1349787 - RNA, 12 nt, Human
cauaaaacaggu

SEQ ID NO: 1349788 - RNA, 15 nt, Human
cauaaaaaugaucua

SEQ ID NO: 1349789 - RNA, 11 nt, Human
caguugcagcc

SEQ ID NO: 1349790 - RNA, 22 nt, Human
caguugcacagcaucucagcuc

SEQ ID NO: 1349791 - RNA, 19 nt, Human
caguugcacuucuaagacu

SEQ ID NO: 1349792 - RNA, 11 nt, Human
caguugcaguc

SEQ ID NO: 1349793 - RNA, 14 nt, Human
caguugcagucacu

SEQ ID NO: 1349794 - RNA, 19 nt, Human
caguugcagucacucuagu

SEQ ID NO: 1349795 - RNA, 16 nt, Human
caguugcauguaguaa

SEQ ID NO: 1349796 - RNA, 18 nt, Human
caguugcauguaguaaca

SEQ ID NO: 1349797 - RNA, 19 nt, Human
caguugcauguaguaacac

SEQ ID NO: 1349798 - RNA, 20 nt, Human
caguugcauguaguaacacu

SEQ ID NO: 1349799 - RNA, 21 nt, Human
caguugcauguaguaacacua

SEQ ID NO: 1349800 - RNA, 21 nt, Human
caguugcacagcaucucagcu

SEQ ID NO: 1349801 - RNA, 18 nt, Human
caguugcacagcaucuca

SEQ ID NO: 1349802 - RNA, 17 nt, Human
caguugcacagcaucuc

SEQ ID NO: 1349803 - RNA, 16 nt, Human
caguugcacagcaucu

SEQ ID NO: 1349804 - RNA, 15 nt, Human
caguugcacagcauc

SEQ ID NO: 1349805 - RNA, 13 nt, Human
caguugcacagca

SEQ ID NO: 1349806 - RNA, 12 nt, Human
caguugcacagc

SEQ ID NO: 1349807 - RNA, 18 nt, Human
caguugagacaagaaaau

SEQ ID NO: 1349808 - RNA, 16 nt, Human
caguugagacaagaaa

SEQ ID NO: 1349809 - RNA, 16 nt, Human
caguugauuuucugga

SEQ ID NO: 1349810 - RNA, 17 nt, Human
caguugauuuucuggau

SEQ ID NO: 1349811 - RNA, 19 nt, Human
caguugaagggaggggcug

SEQ ID NO: 1349812 - RNA, 14 nt, Human
caguugaauuucau

SEQ ID NO: 1349813 - RNA, 20 nt, Human
caguucuuugggccagacau

SEQ ID NO: 1349814 - RNA, 21 nt, Human
caguucuuugggccagacaug

SEQ ID NO: 1349815 - RNA, 22 nt, Human
caguucuuugggccagacaugc

SEQ ID NO: 1349816 - RNA, 13 nt, Human
caguuuuuauuaa

SEQ ID NO: 1349817 - RNA, 19 nt, Human
caguuuuuucaccuggaag

SEQ ID NO: 1349818 - RNA, 16 nt, Human
caguuuuuuaugcuaa

SEQ ID NO: 1349819 - RNA, 18 nt, Human
caguuuuuuuuuucuugu

SEQ ID NO: 1349820 - RNA, 23 nt, Human
caguuuuuuuuuucuugucuaua

SEQ ID NO: 1349821 - RNA, 15 nt, Human
caguugucucuguuu

SEQ ID NO: 1349822 - RNA, 21 nt, Human
caguugucucugaugcagcuu

SEQ ID NO: 1349823 - RNA, 22 nt, Human
caguugucucugaugcagcuua

SEQ ID NO: 1349824 - RNA, 13 nt, Human
caguugucucugu

SEQ ID NO: 1349825 - RNA, 14 nt, Human
caguugguaacuuu

SEQ ID NO: 1349826 - RNA, 16 nt, Human
caguugguaacuuuug

SEQ ID NO: 1349827 - RNA, 17 nt, Human
caguugguaacuuuugu

SEQ ID NO: 1349828 - RNA, 14 nt, Human
caguuguauuuaac

SEQ ID NO: 1349829 - RNA, 18 nt, Human
caguuguauuuaacagaa

SEQ ID NO: 1349830 - RNA, 21 nt, Human
caguuguauuuaacagaaauu

SEQ ID NO: 1349831 - RNA, 18 nt, Human
caguugucccgauuguaa

SEQ ID NO: 1349832 - RNA, 20 nt, Human
caguugucccgauuguaacu

SEQ ID NO: 1349833 - RNA, 21 nt, Human
caguugucccgauuguaacuc

SEQ ID NO: 1349834 - RNA, 22 nt, Human
caguugucccgauuguaacuca

SEQ ID NO: 1349835 - RNA, 12 nt, Human
caguuguccucc

SEQ ID NO: 1349836 - RNA, 15 nt, Human
caguuguccuccuuc

SEQ ID NO: 1349837 - RNA, 11 nt, Human
caguugucucu

SEQ ID NO: 1349838 - RNA, 13 nt, Human
caguugucucuga

SEQ ID NO: 1349839 - RNA, 14 nt, Human
caguugucucugau

SEQ ID NO: 1349840 - RNA, 15 nt, Human
caguugucucugaug

SEQ ID NO: 1349841 - RNA, 17 nt, Human
caguugucucugaugca

SEQ ID NO: 1349842 - RNA, 23 nt, Human
caguugcauguaguaacacuaau

SEQ ID NO: 1349843 - RNA, 18 nt, Human
caguugcugcuucaauuu

SEQ ID NO: 1349844 - RNA, 19 nt, Human
caguugcugcuucaauuua

SEQ ID NO: 1349845 - RNA, 22 nt, Human
caguugccuuuuaucccaaagu

SEQ ID NO: 1349846 - RNA, 13 nt, Human
caguugccuuuua

SEQ ID NO: 1349847 - RNA, 13 nt, Human
caguuggacuuuu

SEQ ID NO: 1349848 - RNA, 15 nt, Human
caguuggacuuuuua

SEQ ID NO: 1349849 - RNA, 20 nt, Human
caguuggacuuuuuaaaaau

SEQ ID NO: 1349850 - RNA, 17 nt, Human
caguuggagcuccagcc

SEQ ID NO: 1349851 - RNA, 21 nt, Human
caguuggagcuccagccugac

SEQ ID NO: 1349852 - RNA, 22 nt, Human
caguuggagcuccagccugaca

SEQ ID NO: 1349853 - RNA, 22 nt, Human
caguuggaguuuuuuguaccaa

SEQ ID NO: 1349854 - RNA, 20 nt, Human
cauacuaauuauacccccug

SEQ ID NO: 1349855 - RNA, 15 nt, Human
cauacuaugaaauau

SEQ ID NO: 1349856 - RNA, 18 nt, Human
cauacuaugaaauaugua

SEQ ID NO: 1349857 - RNA, 17 nt, Human
cauacgcucagcucauc

SEQ ID NO: 1349858 - RNA, 22 nt, Human
cauacccuggccgcccccugcc

SEQ ID NO: 1349859 - RNA, 21 nt, Human
cauaccuccuauggguuguca

SEQ ID NO: 1349860 - RNA, 13 nt, Human
cauacccccuccc

SEQ ID NO: 1349861 - RNA, 15 nt, Human
cauacccccuccccc

SEQ ID NO: 1349862 - RNA, 18 nt, Human
cauaccccuuacaaauga

SEQ ID NO: 1349863 - RNA, 20 nt, Human
cauaccccuuacaaaugaaa

SEQ ID NO: 1349864 - RNA, 14 nt, Human
cauacccugaccug

SEQ ID NO: 1349865 - RNA, 15 nt, Human
cauacccugaccugg

SEQ ID NO: 1349866 - RNA, 16 nt, Human
cauacccugaccuggc

SEQ ID NO: 1349867 - RNA, 18 nt, Human
cauacccugaccuggccc

SEQ ID NO: 1349868 - RNA, 19 nt, Human
cauacccugaccuggcccc

SEQ ID NO: 1349869 - RNA, 12 nt, Human
cauauuuucaug

SEQ ID NO: 1349870 - RNA, 18 nt, Human
cauauuuucaccauuuga

SEQ ID NO: 1349871 - RNA, 15 nt, Human
caucaaaaaaggcag

SEQ ID NO: 1349872 - RNA, 21 nt, Human
caucaaaaaaggcaguuacca

SEQ ID NO: 1349873 - RNA, 18 nt, Human
caucaaaaacuuuggagu

SEQ ID NO: 1349874 - RNA, 22 nt, Human
caucaagucuuucacauuuaaa

SEQ ID NO: 1349875 - RNA, 16 nt, Human
caucaagacuuugcua

SEQ ID NO: 1349876 - RNA, 22 nt, Human
caucaagacuuugcuaaagaca

SEQ ID NO: 1349877 - RNA, 17 nt, Human
caucaagagacugaguc

SEQ ID NO: 1349878 - RNA, 12 nt, Human
caucaagagaau

SEQ ID NO: 1349879 - RNA, 20 nt, Human
caucaaggacacgggccugu

SEQ ID NO: 1349880 - RNA, 21 nt, Human
caucaaggacacgggccuguc

SEQ ID NO: 1349881 - RNA, 14 nt, Human
caucaaguaauaca

SEQ ID NO: 1349882 - RNA, 11 nt, Human
caucaaagagg

SEQ ID NO: 1349883 - RNA, 23 nt, Human
caucaaagaggcugaggcuggca

SEQ ID NO: 1349884 - RNA, 15 nt, Human
caucaagacuuugcu

SEQ ID NO: 1349885 - RNA, 13 nt, Human
caucaaaaugcuu

SEQ ID NO: 1349886 - RNA, 15 nt, Human
caucaaaaugcuuuu

SEQ ID NO: 1349887 - RNA, 18 nt, Human
caucaaugaaugaaugaa

SEQ ID NO: 1349888 - RNA, 19 nt, Human
caucaaguugugccaaauu

SEQ ID NO: 1349889 - RNA, 22 nt, Human
caucaauggggccagucaggcc

SEQ ID NO: 1349890 - RNA, 19 nt, Human
caucaauggggccagucag

SEQ ID NO: 1349891 - RNA, 16 nt, Human
caucaauuaaaggcaa

SEQ ID NO: 1349892 - RNA, 12 nt, Human
caucacagaaug

SEQ ID NO: 1349893 - RNA, 14 nt, Human
caucacacugggug

SEQ ID NO: 1349894 - RNA, 19 nt, Human
caucacacugggugguggc

SEQ ID NO: 1349895 - RNA, 13 nt, Human
caucacagcccag

SEQ ID NO: 1349896 - RNA, 14 nt, Human
caucacagcccagc

SEQ ID NO: 1349897 - RNA, 17 nt, Human
caucacagcccagcccg

SEQ ID NO: 1349898 - RNA, 17 nt, Human
cauauuuauaaaaauaa

SEQ ID NO: 1349899 - RNA, 19 nt, Human
cauauuuaccucagccugg

SEQ ID NO: 1349900 - RNA, 22 nt, Human
cauauuucccaugauuucaugu

SEQ ID NO: 1349901 - RNA, 18 nt, Human
cauauuuaccucagccug

SEQ ID NO: 1349902 - RNA, 12 nt, Human
cauauuuauaaa

SEQ ID NO: 1349903 - RNA, 20 nt, Human
cauaugcauauuuuuuuucu

SEQ ID NO: 1349904 - RNA, 17 nt, Human
cauauuuaccucagccu

SEQ ID NO: 1349905 - RNA, 20 nt, Human
cauagaauaaaauuuuuaau

SEQ ID NO: 1349906 - RNA, 15 nt, Human
cauagacagaagaaa

SEQ ID NO: 1349907 - RNA, 20 nt, Human
cauagacagaagaaacaagg

SEQ ID NO: 1349908 - RNA, 14 nt, Human
cauagaauaaaauu

SEQ ID NO: 1349909 - RNA, 23 nt, Human
cauagaaauguaacuuuuguaag

SEQ ID NO: 1349910 - RNA, 17 nt, Human
cauagaccuuuucauuu

SEQ ID NO: 1349911 - RNA, 19 nt, Human
cauagacagaagaaacaag

SEQ ID NO: 1349912 - RNA, 18 nt, Human
cauagagacuugggaaug

SEQ ID NO: 1349913 - RNA, 19 nt, Human
cauacuuuguuaggaaggg

SEQ ID NO: 1349914 - RNA, 22 nt, Human
cauacuuuuuaaauguaaagau

SEQ ID NO: 1349915 - RNA, 14 nt, Human
cauacuuuccugua

SEQ ID NO: 1349916 - RNA, 16 nt, Human
cauacuuuuuaaaugu

SEQ ID NO: 1349917 - RNA, 20 nt, Human
cauacuuuuuaaauguaaag

SEQ ID NO: 1349918 - RNA, 20 nt, Human
cauacuugaacguuuucuaa

SEQ ID NO: 1349919 - RNA, 21 nt, Human
cauacuugaacguuuucuaau

SEQ ID NO: 1349920 - RNA, 22 nt, Human
cauacuugaacguuuucuaauu

SEQ ID NO: 1349921 - RNA, 13 nt, Human
cauacuugaaggg

SEQ ID NO: 1349922 - RNA, 14 nt, Human
cauacuugaagggc

SEQ ID NO: 1349923 - RNA, 17 nt, Human
cauacuugaagggccag

SEQ ID NO: 1349924 - RNA, 18 nt, Human
cauacuugaagggccaga

SEQ ID NO: 1349925 - RNA, 20 nt, Human
cauacuugaagggccagagc

SEQ ID NO: 1349926 - RNA, 21 nt, Human
cauacuugaagggccagagcc

SEQ ID NO: 1349927 - RNA, 22 nt, Human
cauacuugaagggccagagcca

SEQ ID NO: 1349928 - RNA, 23 nt, Human
cauacuugaagggccagagccag

SEQ ID NO: 1349929 - RNA, 23 nt, Human
cauacuugaacguuuucuaauug

SEQ ID NO: 1349930 - RNA, 22 nt, Human
cauacucauuuuucaugauaau

SEQ ID NO: 1349931 - RNA, 13 nt, Human
cauacuggccugg

SEQ ID NO: 1349932 - RNA, 15 nt, Human
cauacuggccuggac

SEQ ID NO: 1349933 - RNA, 18 nt, Human
cauacuggccuggacugu

SEQ ID NO: 1349934 - RNA, 22 nt, Human
cauacuggccuggacuguuuuc

SEQ ID NO: 1349935 - RNA, 17 nt, Human
cauacuguaacauucag

SEQ ID NO: 1349936 - RNA, 21 nt, Human
cauaugauguacauguacuga

SEQ ID NO: 1349937 - RNA, 15 nt, Human
cauaugaucugucug

SEQ ID NO: 1349938 - RNA, 14 nt, Human
cauaugauuuacau

SEQ ID NO: 1349939 - RNA, 17 nt, Human
cauaugauguacaugua

SEQ ID NO: 1349940 - RNA, 15 nt, Human
cauaugauguacaug

SEQ ID NO: 1349941 - RNA, 14 nt, Human
cauaucauccacac

SEQ ID NO: 1349942 - RNA, 17 nt, Human
cauaucauccacacaug

SEQ ID NO: 1349943 - RNA, 18 nt, Human
cauaucauccacacauga

SEQ ID NO: 1349944 - RNA, 20 nt, Human
cauaucauccacacaugaau

SEQ ID NO: 1349945 - RNA, 18 nt, Human
cauauccaguauuguucc

SEQ ID NO: 1349946 - RNA, 22 nt, Human
cauaugaguaagggcacugacg

SEQ ID NO: 1349947 - RNA, 14 nt, Human
cauauauauacuau

SEQ ID NO: 1349948 - RNA, 14 nt, Human
cauaucacacacau

SEQ ID NO: 1349949 - RNA, 16 nt, Human
cauaucacacacauug

SEQ ID NO: 1349950 - RNA, 18 nt, Human
cauaucacacacauugcu

SEQ ID NO: 1349951 - RNA, 15 nt, Human
cauauaauguuguua

SEQ ID NO: 1349952 - RNA, 17 nt, Human
cauauaauguuguuauu

SEQ ID NO: 1349953 - RNA, 18 nt, Human
cauauaauguuguuauuu

SEQ ID NO: 1349954 - RNA, 15 nt, Human
cauauaauuauaugu

SEQ ID NO: 1349955 - RNA, 22 nt, Human
cauauaauuauauguuguaagc

SEQ ID NO: 1349956 - RNA, 16 nt, Human
cauauaauuauauguu

SEQ ID NO: 1349957 - RNA, 17 nt, Human
cauauacagcucagaag

SEQ ID NO: 1349958 - RNA, 17 nt, Human
cauauauauacuauuaa

SEQ ID NO: 1349959 - RNA, 20 nt, Human
cauagugcuaacaugaagac

SEQ ID NO: 1349960 - RNA, 12 nt, Human
cauaguucagaa

SEQ ID NO: 1349961 - RNA, 13 nt, Human
cauaguucagaau

SEQ ID NO: 1349962 - RNA, 16 nt, Human
cauauaaauagaaugu

SEQ ID NO: 1349963 - RNA, 15 nt, Human
cauauaaauagaaug

SEQ ID NO: 1349964 - RNA, 13 nt, Human
cauauaaauagaa

SEQ ID NO: 1349965 - RNA, 12 nt, Human
cauauaaaguau

SEQ ID NO: 1349966 - RNA, 19 nt, Human
cauagugcuaacaugaaga

SEQ ID NO: 1349967 - RNA, 18 nt, Human
cauagugcuaacaugaag

SEQ ID NO: 1349968 - RNA, 18 nt, Human
cauagauaaaacaucuuu

SEQ ID NO: 1349969 - RNA, 20 nt, Human
cauagagccgggugucccca

SEQ ID NO: 1349970 - RNA, 22 nt, Human
cauagagccggguguccccaac

SEQ ID NO: 1349971 - RNA, 21 nt, Human
cauagagccggguguccccaa

SEQ ID NO: 1349972 - RNA, 21 nt, Human
cauagauaaaacaucuuugaa

SEQ ID NO: 1349973 - RNA, 23 nt, Human
cauagaucagcaaaccggggccu

SEQ ID NO: 1349974 - RNA, 16 nt, Human
caucucuuguuuaaau

SEQ ID NO: 1349975 - RNA, 14 nt, Human
caucugagaaaagc

SEQ ID NO: 1349976 - RNA, 23 nt, Human
caucugagaaaagcuuugaaccc

SEQ ID NO: 1349977 - RNA, 15 nt, Human
caucugagguuuuau

SEQ ID NO: 1349978 - RNA, 21 nt, Human
caucugagguuuuauuucauu

SEQ ID NO: 1349979 - RNA, 21 nt, Human
caucugaguccuggaugauac

SEQ ID NO: 1349980 - RNA, 13 nt, Human
caucugauuaaaa

SEQ ID NO: 1349981 - RNA, 15 nt, Human
caucugaguccugga

SEQ ID NO: 1349982 - RNA, 14 nt, Human
caucuucaguuguc

SEQ ID NO: 1349983 - RNA, 15 nt, Human
caucuucaguugucu

SEQ ID NO: 1349984 - RNA, 20 nt, Human
caucuucaguugucucugau

SEQ ID NO: 1349985 - RNA, 22 nt, Human
caucuucaguugucucugaugc

SEQ ID NO: 1349986 - RNA, 23 nt, Human
caucuucaguugucucugaugca

SEQ ID NO: 1349987 - RNA, 15 nt, Human
caucuuauucagcac

SEQ ID NO: 1349988 - RNA, 14 nt, Human
caucuccacuccag

SEQ ID NO: 1349989 - RNA, 19 nt, Human
caucucauuuaauccuccc

SEQ ID NO: 1349990 - RNA, 13 nt, Human
caucuccaagcag

SEQ ID NO: 1349991 - RNA, 21 nt, Human
caucucccaccuagcagcacc

SEQ ID NO: 1349992 - RNA, 17 nt, Human
caucucccagauaaugu

SEQ ID NO: 1349993 - RNA, 18 nt, Human
caucucccagauaaugug

SEQ ID NO: 1349994 - RNA, 22 nt, Human
caucucuucuggguuccuuccu

SEQ ID NO: 1349995 - RNA, 22 nt, Human
caucucccagauaaugugaaaa

SEQ ID NO: 1349996 - RNA, 23 nt, Human
caucucugggcuggaugagcucc

SEQ ID NO: 1349997 - RNA, 14 nt, Human
caucuugcuaccag

SEQ ID NO: 1349998 - RNA, 16 nt, Human
caucuugcuaccagua

SEQ ID NO: 1349999 - RNA, 17 nt, Human
caucuugcuaccaguau

SEQ ID NO: 1350000 - RNA, 18 nt, Human
caucuugcuaccaguauu

SEQ ID NO: 1350001 - RNA, 20 nt, Human
caucuugcuaccaguauuua

SEQ ID NO: 1350002 - RNA, 22 nt, Human
caucuugcuaccaguauuuaga

SEQ ID NO: 1350003 - RNA, 23 nt, Human
caucuugcuaccaguauuuagaa

SEQ ID NO: 1350004 - RNA, 13 nt, Human
caucuugcuuccc

SEQ ID NO: 1350005 - RNA, 14 nt, Human
caucuugcuucccu

SEQ ID NO: 1350006 - RNA, 15 nt, Human
caucuugcuucccua

SEQ ID NO: 1350007 - RNA, 16 nt, Human
caucuuggaacugcau

SEQ ID NO: 1350008 - RNA, 11 nt, Human
caucuuggggg

SEQ ID NO: 1350009 - RNA, 21 nt, Human
caucuucuaaacccaauccaa

SEQ ID NO: 1350010 - RNA, 13 nt, Human
caucuucugccuu

SEQ ID NO: 1350011 - RNA, 17 nt, Human
caucuucugccuuaguc

SEQ ID NO: 1350012 - RNA, 13 nt, Human
caucuugcauuau

SEQ ID NO: 1350013 - RNA, 16 nt, Human
caucuugcauuaugca

SEQ ID NO: 1350014 - RNA, 17 nt, Human
caucuugcauuaugcaa

SEQ ID NO: 1350015 - RNA, 18 nt, Human
caucuugcccgcucaggc

SEQ ID NO: 1350016 - RNA, 20 nt, Human
caucuugcccgcucaggcug

SEQ ID NO: 1350017 - RNA, 19 nt, Human
caucuugcccgcucaggcu

SEQ ID NO: 1350018 - RNA, 12 nt, Human
caucuugcuacc

SEQ ID NO: 1350019 - RNA, 17 nt, Human
caucuagguaaauuaca

SEQ ID NO: 1350020 - RNA, 18 nt, Human
caucuagguaaauuacag

SEQ ID NO: 1350021 - RNA, 14 nt, Human
caucuagugagcag

SEQ ID NO: 1350022 - RNA, 12 nt, Human
caucuaggauuu

SEQ ID NO: 1350023 - RNA, 20 nt, Human
caucuagaggcuuccuucau

SEQ ID NO: 1350024 - RNA, 21 nt, Human
caucuagaggcuuccuucauu

SEQ ID NO: 1350025 - RNA, 22 nt, Human
caucuagaggcuuccuucauuu

SEQ ID NO: 1350026 - RNA, 23 nt, Human
caucuagaggcuuccuucauuuc

SEQ ID NO: 1350027 - RNA, 19 nt, Human
caucuaccuagauuuaaua

SEQ ID NO: 1350028 - RNA, 20 nt, Human
caucuaccuagauuuaauau

SEQ ID NO: 1350029 - RNA, 19 nt, Human
caucuagaggcuuccuuca

SEQ ID NO: 1350030 - RNA, 11 nt, Human
cauccucucca

SEQ ID NO: 1350031 - RNA, 17 nt, Human
cauccucuggagccagc

SEQ ID NO: 1350032 - RNA, 18 nt, Human
cauccucuggagccagcc

SEQ ID NO: 1350033 - RNA, 19 nt, Human
cauccucuggagccagccg

SEQ ID NO: 1350034 - RNA, 23 nt, Human
cauccucuggcuuggccacagcc

SEQ ID NO: 1350035 - RNA, 20 nt, Human
caucuaaguuauaagacucu

SEQ ID NO: 1350036 - RNA, 14 nt, Human
caucuacaaaacau

SEQ ID NO: 1350037 - RNA, 16 nt, Human
caucuacaaaacauua

SEQ ID NO: 1350038 - RNA, 20 nt, Human
caucuacaaaacauuaaacu

SEQ ID NO: 1350039 - RNA, 13 nt, Human
cauccuccuccca

SEQ ID NO: 1350040 - RNA, 16 nt, Human
cauccuccucccaccc

SEQ ID NO: 1350041 - RNA, 20 nt, Human
cauccuccucccacccggcu

SEQ ID NO: 1350042 - RNA, 17 nt, Human
caucuauagaaagcuau

SEQ ID NO: 1350043 - RNA, 22 nt, Human
caucuagugagcagucaggaaa

SEQ ID NO: 1350044 - RNA, 21 nt, Human
caucuaguuccccuguuuauu

SEQ ID NO: 1350045 - RNA, 23 nt, Human
caucuaguuccccuguuuauuca

SEQ ID NO: 1350046 - RNA, 20 nt, Human
caucuaguuccccuguuuau

SEQ ID NO: 1350047 - RNA, 14 nt, Human
caucuauuuuggau

SEQ ID NO: 1350048 - RNA, 16 nt, Human
caucuauuuuggauug

SEQ ID NO: 1350049 - RNA, 15 nt, Human
caucucaacaggccu

SEQ ID NO: 1350050 - RNA, 19 nt, Human
caucucaacaggccucagg

SEQ ID NO: 1350051 - RNA, 20 nt, Human
caucucaacaggccucaggg

SEQ ID NO: 1350052 - RNA, 22 nt, Human
caucucaacaggccucagggcu

SEQ ID NO: 1350053 - RNA, 21 nt, Human
caucucaacaggccucagggc

SEQ ID NO: 1350054 - RNA, 20 nt, Human
caucucagcucacugcaacc

SEQ ID NO: 1350055 - RNA, 19 nt, Human
caucucagcucacugcaac

SEQ ID NO: 1350056 - RNA, 21 nt, Human
caucucagcucaucuucacug

SEQ ID NO: 1350057 - RNA, 13 nt, Human
caucucagcccac

SEQ ID NO: 1350058 - RNA, 14 nt, Human
caucucaggccaga

SEQ ID NO: 1350059 - RNA, 17 nt, Human
caucucaggccagagcc

SEQ ID NO: 1350060 - RNA, 18 nt, Human
caucucaggccagagcca

SEQ ID NO: 1350061 - RNA, 17 nt, Human
caucucaguaugaauua

SEQ ID NO: 1350062 - RNA, 21 nt, Human
caucucagugaagaauacuuc

SEQ ID NO: 1350063 - RNA, 22 nt, Human
caucucagugaagaauacuucu

SEQ ID NO: 1350064 - RNA, 22 nt, Human
caucucaugccccuggcuggga

SEQ ID NO: 1350065 - RNA, 20 nt, Human
caucucauuuaauccucccu

SEQ ID NO: 1350066 - RNA, 15 nt, Human
cauccuaccgucuuu

SEQ ID NO: 1350067 - RNA, 17 nt, Human
cauccuaggcugacacc

SEQ ID NO: 1350068 - RNA, 14 nt, Human
cauccucaaagaaa

SEQ ID NO: 1350069 - RNA, 20 nt, Human
cauccucaaagaaaguguau

SEQ ID NO: 1350070 - RNA, 16 nt, Human
cauccuacaagacaca

SEQ ID NO: 1350071 - RNA, 18 nt, Human
cauccuaaagaacaaagu

SEQ ID NO: 1350072 - RNA, 19 nt, Human
cauccuaaagaacaaagua

SEQ ID NO: 1350073 - RNA, 20 nt, Human
cauccuccgccucccggguu

SEQ ID NO: 1350074 - RNA, 13 nt, Human
cauccuccagccc

SEQ ID NO: 1350075 - RNA, 14 nt, Human
cauccuccagcccc

SEQ ID NO: 1350076 - RNA, 15 nt, Human
cauccuccagccccu

SEQ ID NO: 1350077 - RNA, 22 nt, Human
cauccucaaagaaaguguauug

SEQ ID NO: 1350078 - RNA, 18 nt, Human
cauccuccacguucugcu

SEQ ID NO: 1350079 - RNA, 20 nt, Human
cauccuccacguucugcuca

SEQ ID NO: 1350080 - RNA, 21 nt, Human
cauccuccacguucugcucau

SEQ ID NO: 1350081 - RNA, 17 nt, Human
cauccuccagauagugu

SEQ ID NO: 1350082 - RNA, 12 nt, Human
cauccuccagcc

SEQ ID NO: 1350083 - RNA, 13 nt, Human
cauccagggggca

SEQ ID NO: 1350084 - RNA, 21 nt, Human
cauccagggcccccaucucau

SEQ ID NO: 1350085 - RNA, 22 nt, Human
cauccaggaggaauaagcuccc

SEQ ID NO: 1350086 - RNA, 11 nt, Human
cauccagggcc

SEQ ID NO: 1350087 - RNA, 23 nt, Human
cauccagcagauuuccagccuuc

SEQ ID NO: 1350088 - RNA, 15 nt, Human
cauccagcucacuca

SEQ ID NO: 1350089 - RNA, 16 nt, Human
cauccaauuagcuuau

SEQ ID NO: 1350090 - RNA, 14 nt, Human
cauccaaguuaaau

SEQ ID NO: 1350091 - RNA, 14 nt, Human
cauccacacaugaa

SEQ ID NO: 1350092 - RNA, 17 nt, Human
cauccacaugggagccg

SEQ ID NO: 1350093 - RNA, 20 nt, Human
cauccacauacccugaccug

SEQ ID NO: 1350094 - RNA, 12 nt, Human
cauccaccccau

SEQ ID NO: 1350095 - RNA, 14 nt, Human
cauccaccccaucc

SEQ ID NO: 1350096 - RNA, 20 nt, Human
caucccucacccauccuaga

SEQ ID NO: 1350097 - RNA, 13 nt, Human
caucccuccccag

SEQ ID NO: 1350098 - RNA, 14 nt, Human
caucccucacccau

SEQ ID NO: 1350099 - RNA, 13 nt, Human
caucccucaccca

SEQ ID NO: 1350100 - RNA, 14 nt, Human
caucccuccccagu

SEQ ID NO: 1350101 - RNA, 16 nt, Human
caucacagcccagccc

SEQ ID NO: 1350102 - RNA, 21 nt, Human
caucauucucugucucaucca

SEQ ID NO: 1350103 - RNA, 22 nt, Human
caucauucucugucucauccau

SEQ ID NO: 1350104 - RNA, 24 nt, Human
caucauucucugucucauccauca

SEQ ID NO: 1350105 - RNA, 12 nt, Human
caucauuucacu

SEQ ID NO: 1350106 - RNA, 15 nt, Human
caucauuucacuugu

SEQ ID NO: 1350107 - RNA, 20 nt, Human
caucauuucuuuuugggaga

SEQ ID NO: 1350108 - RNA, 14 nt, Human
caucauuuuuuacu

SEQ ID NO: 1350109 - RNA, 23 nt, Human
cauccaaaauaguuaagacauga

SEQ ID NO: 1350110 - RNA, 17 nt, Human
cauccaaaaucuugauc

SEQ ID NO: 1350111 - RNA, 23 nt, Human
cauccaaaaucuugaucaguuaa

SEQ ID NO: 1350112 - RNA, 15 nt, Human
cauccaaagcagaca

SEQ ID NO: 1350113 - RNA, 16 nt, Human
cauccaaagcagacag

SEQ ID NO: 1350114 - RNA, 17 nt, Human
cauccaaagcagacagc

SEQ ID NO: 1350115 - RNA, 18 nt, Human
cauccaaagcagacagcu

SEQ ID NO: 1350116 - RNA, 21 nt, Human
cauccaaagcagacagcucca

SEQ ID NO: 1350117 - RNA, 20 nt, Human
cauccaaggcacugucacua

SEQ ID NO: 1350118 - RNA, 21 nt, Human
cauccaaggccagguucuccg

SEQ ID NO: 1350119 - RNA, 17 nt, Human
cauccuacaagacacag

SEQ ID NO: 1350120 - RNA, 14 nt, Human
cauccuaacuccau

SEQ ID NO: 1350121 - RNA, 21 nt, Human
cauccuaacuccaugucucug

SEQ ID NO: 1350122 - RNA, 17 nt, Human
cauccgugccucuuuuu

SEQ ID NO: 1350123 - RNA, 21 nt, Human
cauccgugccucuuuuuaaag

SEQ ID NO: 1350124 - RNA, 22 nt, Human
cauuauuugagaagcugcucaa

SEQ ID NO: 1350125 - RNA, 20 nt, Human
cauuauuugagaagcugcuc

SEQ ID NO: 1350126 - RNA, 14 nt, Human
cauuauuugagaag

SEQ ID NO: 1350127 - RNA, 22 nt, Human
cauuauuuauguauugugcaau

SEQ ID NO: 1350128 - RNA, 17 nt, Human
cauuagcaguuugcuuu

SEQ ID NO: 1350129 - RNA, 18 nt, Human
cauuagcaguuugcuuug

SEQ ID NO: 1350130 - RNA, 15 nt, Human
cauuauuuauguauu

SEQ ID NO: 1350131 - RNA, 16 nt, Human
cauuauuuauguauug

SEQ ID NO: 1350132 - RNA, 15 nt, Human
cauuacuauaagaac

SEQ ID NO: 1350133 - RNA, 16 nt, Human
cauuagacuggaacuu

SEQ ID NO: 1350134 - RNA, 20 nt, Human
cauuagacuggaacuugaac

SEQ ID NO: 1350135 - RNA, 12 nt, Human
cauuaauucuau

SEQ ID NO: 1350136 - RNA, 15 nt, Human
cauuaccauguaaug

SEQ ID NO: 1350137 - RNA, 12 nt, Human
cauuaaucugcc

SEQ ID NO: 1350138 - RNA, 14 nt, Human
cauuaaauucacaa

SEQ ID NO: 1350139 - RNA, 17 nt, Human
cauuaaauucacaaacu

SEQ ID NO: 1350140 - RNA, 18 nt, Human
cauuaaauucacaaacuu

SEQ ID NO: 1350141 - RNA, 21 nt, Human
cauuaaauucacaaacuuuua

SEQ ID NO: 1350142 - RNA, 14 nt, Human
cauuaaauuacaga

SEQ ID NO: 1350143 - RNA, 15 nt, Human
cauuaauagcagccu

SEQ ID NO: 1350144 - RNA, 17 nt, Human
cauuaauagcagccuuu

SEQ ID NO: 1350145 - RNA, 20 nt, Human
cauuaauagcagccuuucuc

SEQ ID NO: 1350146 - RNA, 18 nt, Human
cauuaauagcagccuuuc

SEQ ID NO: 1350147 - RNA, 20 nt, Human
cauuaaucaguucauuagaa

SEQ ID NO: 1350148 - RNA, 18 nt, Human
cauuaaucugccucccuc

SEQ ID NO: 1350149 - RNA, 19 nt, Human
cauuaaacuaguguuauac

SEQ ID NO: 1350150 - RNA, 22 nt, Human
cauuaaacgauuuuuaaaaugu

SEQ ID NO: 1350151 - RNA, 11 nt, Human
cauuaaagaag

SEQ ID NO: 1350152 - RNA, 15 nt, Human
cauuaaagaagaccu

SEQ ID NO: 1350153 - RNA, 14 nt, Human
cauuaaagaagacc

SEQ ID NO: 1350154 - RNA, 13 nt, Human
cauuaaauaaauu

SEQ ID NO: 1350155 - RNA, 11 nt, Human
cauuaaauaaa

SEQ ID NO: 1350156 - RNA, 20 nt, Human
cauuaaauuacagaaauuua

SEQ ID NO: 1350157 - RNA, 13 nt, Human
cauuaaauucaca

SEQ ID NO: 1350158 - RNA, 17 nt, Human
caugugaaaucauucau

SEQ ID NO: 1350159 - RNA, 16 nt, Human
caugugaaaucauuca

SEQ ID NO: 1350160 - RNA, 15 nt, Human
caugugaaaucauuc

SEQ ID NO: 1350161 - RNA, 14 nt, Human
caugucgccucugc

SEQ ID NO: 1350162 - RNA, 15 nt, Human
caugucgccucugca

SEQ ID NO: 1350163 - RNA, 15 nt, Human
cauguacaugaagaa

SEQ ID NO: 1350164 - RNA, 17 nt, Human
cauguccuucugagccc

SEQ ID NO: 1350165 - RNA, 18 nt, Human
caugucgccucugcauuc

SEQ ID NO: 1350166 - RNA, 20 nt, Human
caugucgccucugcauucag

SEQ ID NO: 1350167 - RNA, 16 nt, Human
cauggucccacauccc

SEQ ID NO: 1350168 - RNA, 17 nt, Human
cauggucccacaucccu

SEQ ID NO: 1350169 - RNA, 18 nt, Human
cauggucccacaucccug

SEQ ID NO: 1350170 - RNA, 19 nt, Human
cauggucccacaucccugg

SEQ ID NO: 1350171 - RNA, 23 nt, Human
cauggucccacaucccugggccu

SEQ ID NO: 1350172 - RNA, 15 nt, Human
cauggugccccagga

SEQ ID NO: 1350173 - RNA, 20 nt, Human
cauggucccacaucccuggg

SEQ ID NO: 1350174 - RNA, 21 nt, Human
cauggucccacaucccugggc

SEQ ID NO: 1350175 - RNA, 22 nt, Human
cauggucccacaucccugggcc

SEQ ID NO: 1350176 - RNA, 16 nt, Human
cauggugccccaggac

SEQ ID NO: 1350177 - RNA, 17 nt, Human
cauggugccccaggacc

SEQ ID NO: 1350178 - RNA, 18 nt, Human
cauggugccccaggacca

SEQ ID NO: 1350179 - RNA, 19 nt, Human
cauggugccccaggaccag

SEQ ID NO: 1350180 - RNA, 20 nt, Human
cauggugccccaggaccagc

SEQ ID NO: 1350181 - RNA, 22 nt, Human
cauggugccccaggaccagcuc

SEQ ID NO: 1350182 - RNA, 16 nt, Human
caugguguccagacag

SEQ ID NO: 1350183 - RNA, 18 nt, Human
cauggugugaucgucuga

SEQ ID NO: 1350184 - RNA, 14 nt, Human
caugguguucuccu

SEQ ID NO: 1350185 - RNA, 15 nt, Human
caugguguucuccug

SEQ ID NO: 1350186 - RNA, 16 nt, Human
caugguguucuccugc

SEQ ID NO: 1350187 - RNA, 17 nt, Human
caugguguucuccugcu

SEQ ID NO: 1350188 - RNA, 19 nt, Human
caugguguucuccugcugc

SEQ ID NO: 1350189 - RNA, 13 nt, Human
caugguuaagagu

SEQ ID NO: 1350190 - RNA, 16 nt, Human
caugguuaagagucca

SEQ ID NO: 1350191 - RNA, 19 nt, Human
caugguuaagaguccaaga

SEQ ID NO: 1350192 - RNA, 17 nt, Human
caugguuaccaugucuu

SEQ ID NO: 1350193 - RNA, 18 nt, Human
caugguuaccaugucuuu

SEQ ID NO: 1350194 - RNA, 19 nt, Human
caugguuaccaugucuuuc

SEQ ID NO: 1350195 - RNA, 19 nt, Human
cauguaacgcaaguuccca

SEQ ID NO: 1350196 - RNA, 20 nt, Human
cauguaacgcaaguucccag

SEQ ID NO: 1350197 - RNA, 14 nt, Human
cauguaacugccua

SEQ ID NO: 1350198 - RNA, 15 nt, Human
cauguaacugccuag

SEQ ID NO: 1350199 - RNA, 16 nt, Human
cauguaacugccuaga

SEQ ID NO: 1350200 - RNA, 19 nt, Human
cauguaacugccuagaaac

SEQ ID NO: 1350201 - RNA, 20 nt, Human
cauguaacugccuagaaaca

SEQ ID NO: 1350202 - RNA, 21 nt, Human
cauguaacugccuagaaacaa

SEQ ID NO: 1350203 - RNA, 17 nt, Human
cauguaagcugaaaaua

SEQ ID NO: 1350204 - RNA, 18 nt, Human
cauguaagcugaaaauau

SEQ ID NO: 1350205 - RNA, 23 nt, Human
cauguaagcugaaaauauggcaa

SEQ ID NO: 1350206 - RNA, 14 nt, Human
cauguaauccucaa

SEQ ID NO: 1350207 - RNA, 21 nt, Human
cauguuucuuuguaaugaaaa

SEQ ID NO: 1350208 - RNA, 15 nt, Human
cauguuuaucugcuu

SEQ ID NO: 1350209 - RNA, 23 nt, Human
cauguguguccacgacugucucc

SEQ ID NO: 1350210 - RNA, 12 nt, Human
cauguguggaag

SEQ ID NO: 1350211 - RNA, 19 nt, Human
cauguuuagacuuuaacau

SEQ ID NO: 1350212 - RNA, 21 nt, Human
caugugugguacaugguguuu

SEQ ID NO: 1350213 - RNA, 13 nt, Human
cauguguggaagu

SEQ ID NO: 1350214 - RNA, 12 nt, Human
caugugugucca

SEQ ID NO: 1350215 - RNA, 21 nt, Human
cauguguguccacgacugucu

SEQ ID NO: 1350216 - RNA, 22 nt, Human
cauguguguccacgacugucuc

SEQ ID NO: 1350217 - RNA, 22 nt, Human
cauguuucuuuguaaugaaaac

SEQ ID NO: 1350218 - RNA, 21 nt, Human
cauguuuucugaaaauauaac

SEQ ID NO: 1350219 - RNA, 13 nt, Human
caugugacauuua

SEQ ID NO: 1350220 - RNA, 14 nt, Human
caugugacauuuau

SEQ ID NO: 1350221 - RNA, 16 nt, Human
caugugacauuuauau

SEQ ID NO: 1350222 - RNA, 16 nt, Human
caugugaccacucugu

SEQ ID NO: 1350223 - RNA, 12 nt, Human
caugugacauuu

SEQ ID NO: 1350224 - RNA, 18 nt, Human
caugugaccacucugucu

SEQ ID NO: 1350225 - RNA, 18 nt, Human
caugugcauuauuuucca

SEQ ID NO: 1350226 - RNA, 19 nt, Human
caugugcauuauuuuccag

SEQ ID NO: 1350227 - RNA, 22 nt, Human
caugugccagggcaaugaugaa

SEQ ID NO: 1350228 - RNA, 24 nt, Human
caugugccagggcaaugaugaaug

SEQ ID NO: 1350229 - RNA, 24 nt, Human
caugugcugcccuacagcacccug

SEQ ID NO: 1350230 - RNA, 12 nt, Human
cauguggcugga

SEQ ID NO: 1350231 - RNA, 13 nt, Human
cauguggcuggaa

SEQ ID NO: 1350232 - RNA, 15 nt, Human
cauguggcuggaaga

SEQ ID NO: 1350233 - RNA, 14 nt, Human
cauguggggccagg

SEQ ID NO: 1350234 - RNA, 15 nt, Human
cauguggggccaggu

SEQ ID NO: 1350235 - RNA, 17 nt, Human
cauguggggccagguca

SEQ ID NO: 1350236 - RNA, 23 nt, Human
cauguggggccaggucacccuuu

SEQ ID NO: 1350237 - RNA, 18 nt, Human
cauguggggccaggucac

SEQ ID NO: 1350238 - RNA, 22 nt, Human
caugugguggcacaggcccccu

SEQ ID NO: 1350239 - RNA, 23 nt, Human
caugugguggcacaggcccccuu

SEQ ID NO: 1350240 - RNA, 18 nt, Human
caugugugcaacagggua

SEQ ID NO: 1350241 - RNA, 23 nt, Human
cauggacacuacacccagcaaua

SEQ ID NO: 1350242 - RNA, 22 nt, Human
cauggacacuacacccagcaau

SEQ ID NO: 1350243 - RNA, 13 nt, Human
cauggaaggcaag

SEQ ID NO: 1350244 - RNA, 14 nt, Human
cauggaaggcaaga

SEQ ID NO: 1350245 - RNA, 23 nt, Human
cauggaaggcaagauuguguccc

SEQ ID NO: 1350246 - RNA, 14 nt, Human
cauggacaggcugg

SEQ ID NO: 1350247 - RNA, 15 nt, Human
cauggacaggcuggc

SEQ ID NO: 1350248 - RNA, 16 nt, Human
cauggacaggcuggcu

SEQ ID NO: 1350249 - RNA, 18 nt, Human
cauggacaggcuggcucc

SEQ ID NO: 1350250 - RNA, 15 nt, Human
caugcuucccuuucc

SEQ ID NO: 1350251 - RNA, 21 nt, Human
caugcuuauuccaugacugcu

SEQ ID NO: 1350252 - RNA, 16 nt, Human
caugcuuauuccauga

SEQ ID NO: 1350253 - RNA, 17 nt, Human
caugcuuauuccaugac

SEQ ID NO: 1350254 - RNA, 19 nt, Human
caugcuuauuccaugacug

SEQ ID NO: 1350255 - RNA, 16 nt, Human
caugcuucacaauguu

SEQ ID NO: 1350256 - RNA, 17 nt, Human
caugcuuagcagucccc

SEQ ID NO: 1350257 - RNA, 23 nt, Human
caugcuuagcaguccccuucccu

SEQ ID NO: 1350258 - RNA, 20 nt, Human
caugcuucccuuuccugagu

SEQ ID NO: 1350259 - RNA, 15 nt, Human
cauggaacacuucga

SEQ ID NO: 1350260 - RNA, 23 nt, Human
caugcugucuacacuaagagaga

SEQ ID NO: 1350261 - RNA, 19 nt, Human
caugcuaagagaaguagaa

SEQ ID NO: 1350262 - RNA, 20 nt, Human
caugcugugcgcccagggcu

SEQ ID NO: 1350263 - RNA, 22 nt, Human
caugcgcucagggccaugcuga

SEQ ID NO: 1350264 - RNA, 15 nt, Human
caugcgcucagggcc

SEQ ID NO: 1350265 - RNA, 13 nt, Human
caugcgguagcca

SEQ ID NO: 1350266 - RNA, 14 nt, Human
caugcgguagccag

SEQ ID NO: 1350267 - RNA, 15 nt, Human
caugcgguagccagc

SEQ ID NO: 1350268 - RNA, 16 nt, Human
caugcgguagccagca

SEQ ID NO: 1350269 - RNA, 17 nt, Human
caugcgguagccagcac

SEQ ID NO: 1350270 - RNA, 19 nt, Human
caugcgguagccagcacac

SEQ ID NO: 1350271 - RNA, 21 nt, Human
caugcgguagccagcacacag

SEQ ID NO: 1350272 - RNA, 16 nt, Human
caugcguguuucugac

SEQ ID NO: 1350273 - RNA, 17 nt, Human
caugcguguuucugacu

SEQ ID NO: 1350274 - RNA, 13 nt, Human
caugcuaagagaa

SEQ ID NO: 1350275 - RNA, 16 nt, Human
caugcuaagagaagua

SEQ ID NO: 1350276 - RNA, 17 nt, Human
caugcuaagagaaguag

SEQ ID NO: 1350277 - RNA, 21 nt, Human
caugcuaagagaaguagaaau

SEQ ID NO: 1350278 - RNA, 21 nt, Human
caugcgcccccuccgcccugc

SEQ ID NO: 1350279 - RNA, 23 nt, Human
caugcgcccccuccgcccugcca

SEQ ID NO: 1350280 - RNA, 14 nt, Human
caugcgcucagggc

SEQ ID NO: 1350281 - RNA, 17 nt, Human
cauggagauucucauaa

SEQ ID NO: 1350282 - RNA, 17 nt, Human
cauggagguucuaaggc

SEQ ID NO: 1350283 - RNA, 18 nt, Human
cauggagguucuaaggcc

SEQ ID NO: 1350284 - RNA, 13 nt, Human
cauggaguggcag

SEQ ID NO: 1350285 - RNA, 14 nt, Human
cauggaguggcagc

SEQ ID NO: 1350286 - RNA, 15 nt, Human
cauggaguggcagcc

SEQ ID NO: 1350287 - RNA, 17 nt, Human
cauggaguggcagccca

SEQ ID NO: 1350288 - RNA, 19 nt, Human
cauggaguggcagcccagc

SEQ ID NO: 1350289 - RNA, 20 nt, Human
cauggaguggcagcccagcc

SEQ ID NO: 1350290 - RNA, 21 nt, Human
cauggaguggcagcccagcca

SEQ ID NO: 1350291 - RNA, 23 nt, Human
cauggaguggcagcccagccagc

SEQ ID NO: 1350292 - RNA, 22 nt, Human
cauggaguggcagcccagccag

SEQ ID NO: 1350293 - RNA, 18 nt, Human
cauggauauaguuuuacu

SEQ ID NO: 1350294 - RNA, 13 nt, Human
cauggcagaaggc

SEQ ID NO: 1350295 - RNA, 19 nt, Human
cauggaugggggaacucag

SEQ ID NO: 1350296 - RNA, 12 nt, Human
cauggauuucuu

SEQ ID NO: 1350297 - RNA, 13 nt, Human
cauggauuucuuu

SEQ ID NO: 1350298 - RNA, 14 nt, Human
cauggauuuuccag

SEQ ID NO: 1350299 - RNA, 22 nt, Human
cauggcacagagauucugaacu

SEQ ID NO: 1350300 - RNA, 13 nt, Human
cauggagaaagcu

SEQ ID NO: 1350301 - RNA, 14 nt, Human
cauggagaaagcug

SEQ ID NO: 1350302 - RNA, 15 nt, Human
cauggagaaagcuga

SEQ ID NO: 1350303 - RNA, 17 nt, Human
cauggagaaagcugacu

SEQ ID NO: 1350304 - RNA, 18 nt, Human
cauggagaaagcugacuu

SEQ ID NO: 1350305 - RNA, 19 nt, Human
cauggagaaagcugacuug

SEQ ID NO: 1350306 - RNA, 20 nt, Human
cauggagaaagcugacuugg

SEQ ID NO: 1350307 - RNA, 21 nt, Human
cauggagaaagcugacuuggc

SEQ ID NO: 1350308 - RNA, 18 nt, Human
cauggagauugaccugga

SEQ ID NO: 1350309 - RNA, 23 nt, Human
cauggagaaagcugacuuggcug

SEQ ID NO: 1350310 - RNA, 22 nt, Human
cauggagaaagcugacuuggcu

SEQ ID NO: 1350311 - RNA, 17 nt, Human
caugggggagggggcag

SEQ ID NO: 1350312 - RNA, 19 nt, Human
caugggggagggggcagaa

SEQ ID NO: 1350313 - RNA, 21 nt, Human
caugggggagggggcagaagu

SEQ ID NO: 1350314 - RNA, 17 nt, Human
cauggucacacacugau

SEQ ID NO: 1350315 - RNA, 21 nt, Human
cauggucacacacugaugcuu

SEQ ID NO: 1350316 - RNA, 16 nt, Human
cauggucagcccuagg

SEQ ID NO: 1350317 - RNA, 19 nt, Human
cauggucagcccuagggug

SEQ ID NO: 1350318 - RNA, 15 nt, Human
cauggucccacaucc

SEQ ID NO: 1350319 - RNA, 17 nt, Human
caugggacagggaggac

SEQ ID NO: 1350320 - RNA, 23 nt, Human
caugggacagggaggacgcucuc

SEQ ID NO: 1350321 - RNA, 23 nt, Human
cauggggagggauucugguucca

SEQ ID NO: 1350322 - RNA, 13 nt, Human
caugggggagggg

SEQ ID NO: 1350323 - RNA, 11 nt, Human
cauggggaggg

SEQ ID NO: 1350324 - RNA, 20 nt, Human
cauggggagggauucugguu

SEQ ID NO: 1350325 - RNA, 20 nt, Human
caugggcccaggccucacca

SEQ ID NO: 1350326 - RNA, 20 nt, Human
caugggccccaggggaacac

SEQ ID NO: 1350327 - RNA, 23 nt, Human
caugcccugugcaaccucuuggc

SEQ ID NO: 1350328 - RNA, 16 nt, Human
caugccucagaagugc

SEQ ID NO: 1350329 - RNA, 18 nt, Human
caugccucagaagugcau

SEQ ID NO: 1350330 - RNA, 15 nt, Human
caugccccuggcugg

SEQ ID NO: 1350331 - RNA, 16 nt, Human
caugccccuggcuggg

SEQ ID NO: 1350332 - RNA, 21 nt, Human
caugcccggcuaauuuuugua

SEQ ID NO: 1350333 - RNA, 14 nt, Human
caugcccugugcaa

SEQ ID NO: 1350334 - RNA, 18 nt, Human
caugcccugugcaaccuc

SEQ ID NO: 1350335 - RNA, 19 nt, Human
caugcccugugcaaccucu

SEQ ID NO: 1350336 - RNA, 23 nt, Human
caugccucugaggccagccuggc

SEQ ID NO: 1350337 - RNA, 22 nt, Human
caugccucugaggccagccugg

SEQ ID NO: 1350338 - RNA, 13 nt, Human
caugccucugagg

SEQ ID NO: 1350339 - RNA, 14 nt, Human
caugccucugaggc

SEQ ID NO: 1350340 - RNA, 15 nt, Human
caugccucugaggcc

SEQ ID NO: 1350341 - RNA, 16 nt, Human
caugccucugaggcca

SEQ ID NO: 1350342 - RNA, 17 nt, Human
caugccucugaggccag

SEQ ID NO: 1350343 - RNA, 18 nt, Human
caugccucugaggccagc

SEQ ID NO: 1350344 - RNA, 19 nt, Human
caugccucugaggccagcc

SEQ ID NO: 1350345 - RNA, 20 nt, Human
caugccucugaggccagccu

SEQ ID NO: 1350346 - RNA, 21 nt, Human
caugccucugaggccagccug

SEQ ID NO: 1350347 - RNA, 14 nt, Human
caugccccuggcug

SEQ ID NO: 1350348 - RNA, 17 nt, Human
caugcauggaaauuccc

SEQ ID NO: 1350349 - RNA, 16 nt, Human
caugcauguccuguaa

SEQ ID NO: 1350350 - RNA, 15 nt, Human
caugcauggaaauuc

SEQ ID NO: 1350351 - RNA, 17 nt, Human
caugcauguccuguaaa

SEQ ID NO: 1350352 - RNA, 18 nt, Human
caugcauguccuguaaag

SEQ ID NO: 1350353 - RNA, 21 nt, Human
caugcauguccuguaaagguu

SEQ ID NO: 1350354 - RNA, 15 nt, Human
caugcauuacugcau

SEQ ID NO: 1350355 - RNA, 17 nt, Human
caugcauuacugcaugc

SEQ ID NO: 1350356 - RNA, 20 nt, Human
caugcauuacugcaugcacu

SEQ ID NO: 1350357 - RNA, 15 nt, Human
caugcauuguccucu

SEQ ID NO: 1350358 - RNA, 17 nt, Human
caugccacaaggacuuc

SEQ ID NO: 1350359 - RNA, 21 nt, Human
caugccacaaggacuuccugu

SEQ ID NO: 1350360 - RNA, 21 nt, Human
caugccagcuacuuccuccuc

SEQ ID NO: 1350361 - RNA, 14 nt, Human
caugcccagagacc

SEQ ID NO: 1350362 - RNA, 16 nt, Human
caugcccagagaccca

SEQ ID NO: 1350363 - RNA, 17 nt, Human
caugcccagagacccag

SEQ ID NO: 1350364 - RNA, 19 nt, Human
caugcccagagacccagcg

SEQ ID NO: 1350365 - RNA, 18 nt, Human
caugccccaucccaugcu

SEQ ID NO: 1350366 - RNA, 18 nt, Human
caugcccagagacccagc

SEQ ID NO: 1350367 - RNA, 16 nt, Human
caugccaggcuaauuu

SEQ ID NO: 1350368 - RNA, 18 nt, Human
caugccaggcuaauuuuu

SEQ ID NO: 1350369 - RNA, 19 nt, Human
caugccaguaacaggcuca

SEQ ID NO: 1350370 - RNA, 17 nt, Human
caugccaguaacaggcu

SEQ ID NO: 1350371 - RNA, 17 nt, Human
caugccauuuguacuga

SEQ ID NO: 1350372 - RNA, 18 nt, Human
caugccauuuguacugac

SEQ ID NO: 1350373 - RNA, 19 nt, Human
caugccauuuguacugacc

SEQ ID NO: 1350374 - RNA, 15 nt, Human
caugcauacacucuc

SEQ ID NO: 1350375 - RNA, 14 nt, Human
caugcaucaucuca

SEQ ID NO: 1350376 - RNA, 13 nt, Human
caugcaucuguuu

SEQ ID NO: 1350377 - RNA, 15 nt, Human
caugcaucuguuuau

SEQ ID NO: 1350378 - RNA, 22 nt, Human
caugcaucuguuuauucuauag

SEQ ID NO: 1350379 - RNA, 21 nt, Human
cauugaccuauuuccagaaau

SEQ ID NO: 1350380 - RNA, 15 nt, Human
cauugaccuauuucc

SEQ ID NO: 1350381 - RNA, 14 nt, Human
cauugaacacaaac

SEQ ID NO: 1350382 - RNA, 15 nt, Human
cauugaacacaaacu

SEQ ID NO: 1350383 - RNA, 16 nt, Human
cauugaacacaaacug

SEQ ID NO: 1350384 - RNA, 17 nt, Human
cauugaacacaaacugu

SEQ ID NO: 1350385 - RNA, 18 nt, Human
cauugaacacaaacugua

SEQ ID NO: 1350386 - RNA, 21 nt, Human
cauugaccgcgacuaauuuca

SEQ ID NO: 1350387 - RNA, 22 nt, Human
cauugaccgcgacuaauuucaa

SEQ ID NO: 1350388 - RNA, 15 nt, Human
cauuuccuaaauaua

SEQ ID NO: 1350389 - RNA, 15 nt, Human
cauuuccccuccuuc

SEQ ID NO: 1350390 - RNA, 19 nt, Human
cauuucuauuucuccucca

SEQ ID NO: 1350391 - RNA, 12 nt, Human
cauuucucaucc

SEQ ID NO: 1350392 - RNA, 15 nt, Human
cauuucucuaagaga

SEQ ID NO: 1350393 - RNA, 13 nt, Human
cauuucugaggug

SEQ ID NO: 1350394 - RNA, 21 nt, Human
cauuucugaggugcacuggga

SEQ ID NO: 1350395 - RNA, 18 nt, Human
cauuucugaggugcacug

SEQ ID NO: 1350396 - RNA, 23 nt, Human
cauuucuucuacaacucauacac

SEQ ID NO: 1350397 - RNA, 19 nt, Human
cauuuaaacagauguccau

SEQ ID NO: 1350398 - RNA, 16 nt, Human
cauuuaaacagauguc

SEQ ID NO: 1350399 - RNA, 14 nt, Human
cauuuaaacagaug

SEQ ID NO: 1350400 - RNA, 21 nt, Human
cauuuaaacagauguccauca

SEQ ID NO: 1350401 - RNA, 17 nt, Human
cauuuaaauacagucuu

SEQ ID NO: 1350402 - RNA, 18 nt, Human
cauuucccaacacaaaga

SEQ ID NO: 1350403 - RNA, 13 nt, Human
cauuuaaacagau

SEQ ID NO: 1350404 - RNA, 16 nt, Human
cauugcaucaaagcau

SEQ ID NO: 1350405 - RNA, 21 nt, Human
cauugacuuuccccaccagau

SEQ ID NO: 1350406 - RNA, 16 nt, Human
cauugacuuuccccac

SEQ ID NO: 1350407 - RNA, 15 nt, Human
cauuugcucauggaa

SEQ ID NO: 1350408 - RNA, 16 nt, Human
cauuugcucauggaau

SEQ ID NO: 1350409 - RNA, 18 nt, Human
cauuugcucauggaauug

SEQ ID NO: 1350410 - RNA, 17 nt, Human
cauuuuaaaguuaguau

SEQ ID NO: 1350411 - RNA, 16 nt, Human
cauuuuaacaucugag

SEQ ID NO: 1350412 - RNA, 17 nt, Human
cauuuuaauuauuauuc

SEQ ID NO: 1350413 - RNA, 14 nt, Human
cauuuuauggugcc

SEQ ID NO: 1350414 - RNA, 17 nt, Human
cauuuuauggugccuag

SEQ ID NO: 1350415 - RNA, 12 nt, Human
cauuuuauggug

SEQ ID NO: 1350416 - RNA, 23 nt, Human
cauuuucuggccaguguuuaaaa

SEQ ID NO: 1350417 - RNA, 22 nt, Human
cauuuucuggccaguguuuaaa

SEQ ID NO: 1350418 - RNA, 12 nt, Human
cauuuugaaagu

SEQ ID NO: 1350419 - RNA, 19 nt, Human
cauuuugaaagucuguccu

SEQ ID NO: 1350420 - RNA, 21 nt, Human
cauuuugaaagucuguccuug

SEQ ID NO: 1350421 - RNA, 23 nt, Human
cauuuugaaucacaugaauuauu

SEQ ID NO: 1350422 - RNA, 15 nt, Human
cauuuugaaucacau

SEQ ID NO: 1350423 - RNA, 20 nt, Human
cauuuuggagaguuuccuga

SEQ ID NO: 1350424 - RNA, 22 nt, Human
cauuuuggagaguuuccugaaa

SEQ ID NO: 1350425 - RNA, 16 nt, Human
cauuuugguacuuugg

SEQ ID NO: 1350426 - RNA, 14 nt, Human
cauuuugguacuuu

SEQ ID NO: 1350427 - RNA, 20 nt, Human
ccaaaaguuacauguuugca

SEQ ID NO: 1350428 - RNA, 23 nt, Human
ccaaaauaaauaaggaaaagcuu

SEQ ID NO: 1350429 - RNA, 20 nt, Human
ccaaaaucauaagauauuuu

SEQ ID NO: 1350430 - RNA, 13 nt, Human
ccaaaccucacca

SEQ ID NO: 1350431 - RNA, 15 nt, Human
ccaaaccucaccaac

SEQ ID NO: 1350432 - RNA, 16 nt, Human
ccaaaccucaccaacu

SEQ ID NO: 1350433 - RNA, 21 nt, Human
ccaaacgcccuuuccuccuca

SEQ ID NO: 1350434 - RNA, 14 nt, Human
ccaaacuaauuuuu

SEQ ID NO: 1350435 - RNA, 22 nt, Human
ccaaacgcccuuuccuccucag

SEQ ID NO: 1350436 - RNA, 14 nt, Human
ccaaagaacagccu

SEQ ID NO: 1350437 - RNA, 19 nt, Human
ccaaagaaccaaagaagaa

SEQ ID NO: 1350438 - RNA, 15 nt, Human
ccaaagaaccaaaga

SEQ ID NO: 1350439 - RNA, 12 nt, Human
ccaaagaggcug

SEQ ID NO: 1350440 - RNA, 13 nt, Human
ccaaagaggcugc

SEQ ID NO: 1350441 - RNA, 14 nt, Human
ccaaagaggcugcc

SEQ ID NO: 1350442 - RNA, 16 nt, Human
ccaaagaggcugcccc

SEQ ID NO: 1350443 - RNA, 15 nt, Human
ccaaagagugauagu

SEQ ID NO: 1350444 - RNA, 19 nt, Human
cauuugacccuugcuguga

SEQ ID NO: 1350445 - RNA, 17 nt, Human
ccacaacuauuuucaga

SEQ ID NO: 1350446 - RNA, 12 nt, Human
ccacaagccucu

SEQ ID NO: 1350447 - RNA, 21 nt, Human
ccacaagccucugcccaggca

SEQ ID NO: 1350448 - RNA, 14 nt, Human
ccacaagccugagg

SEQ ID NO: 1350449 - RNA, 21 nt, Human
ccacaagccugagggaaaggc

SEQ ID NO: 1350450 - RNA, 20 nt, Human
ccacaagccugagggaaagg

SEQ ID NO: 1350451 - RNA, 17 nt, Human
ccacaaggacuuccugu

SEQ ID NO: 1350452 - RNA, 21 nt, Human
ccacaaggacuuccuguccag

SEQ ID NO: 1350453 - RNA, 16 nt, Human
ccacaagugcccucca

SEQ ID NO: 1350454 - RNA, 20 nt, Human
ccacaagugcccuccaggcu

SEQ ID NO: 1350455 - RNA, 22 nt, Human
ccacacaaggauagaugcuggc

SEQ ID NO: 1350456 - RNA, 20 nt, Human
ccacacaaggauagaugcug

SEQ ID NO: 1350457 - RNA, 19 nt, Human
ccaaggcugauuaaaccaa

SEQ ID NO: 1350458 - RNA, 16 nt, Human
ccaaggcucugagcaa

SEQ ID NO: 1350459 - RNA, 13 nt, Human
ccaagguguccua

SEQ ID NO: 1350460 - RNA, 15 nt, Human
ccaagguguccuaca

SEQ ID NO: 1350461 - RNA, 16 nt, Human
ccaagguguccuacag

SEQ ID NO: 1350462 - RNA, 17 nt, Human
ccaagguguccuacaga

SEQ ID NO: 1350463 - RNA, 18 nt, Human
ccaagguguccuacagaa

SEQ ID NO: 1350464 - RNA, 19 nt, Human
ccaagguguccuacagaaa

SEQ ID NO: 1350465 - RNA, 20 nt, Human
ccaagguguccuacagaaaa

SEQ ID NO: 1350466 - RNA, 21 nt, Human
ccaagguguccuacagaaaaa

SEQ ID NO: 1350467 - RNA, 22 nt, Human
ccaagguguccuacagaaaaac

SEQ ID NO: 1350468 - RNA, 16 nt, Human
ccaagguucuccaaca

SEQ ID NO: 1350469 - RNA, 16 nt, Human
ccaagguuacuuaauu

SEQ ID NO: 1350470 - RNA, 19 nt, Human
ccaagguuuaaagagucua

SEQ ID NO: 1350471 - RNA, 20 nt, Human
ccaagguuuaaagagucuag

SEQ ID NO: 1350472 - RNA, 23 nt, Human
ccaagguuuaaagagucuagauu

SEQ ID NO: 1350473 - RNA, 20 nt, Human
ccaauauucauagcagcuua

SEQ ID NO: 1350474 - RNA, 16 nt, Human
ccaaguuaaauguaga

SEQ ID NO: 1350475 - RNA, 16 nt, Human
ccaaguggcucccaca

SEQ ID NO: 1350476 - RNA, 13 nt, Human
ccaaguggcuccc

SEQ ID NO: 1350477 - RNA, 22 nt, Human
ccaagguuuaaagagucuagau

SEQ ID NO: 1350478 - RNA, 20 nt, Human
ccaagugagucucucugggc

SEQ ID NO: 1350479 - RNA, 22 nt, Human
ccaagugaccuauaccuguguu

SEQ ID NO: 1350480 - RNA, 22 nt, Human
ccacaaaugggaaaaccagacu

SEQ ID NO: 1350481 - RNA, 13 nt, Human
ccacaacacacag

SEQ ID NO: 1350482 - RNA, 12 nt, Human
ccacaacaugag

SEQ ID NO: 1350483 - RNA, 17 nt, Human
ccacaacaugaggccac

SEQ ID NO: 1350484 - RNA, 16 nt, Human
ccacaacaugaggcca

SEQ ID NO: 1350485 - RNA, 15 nt, Human
ccacaacuauuuuca

SEQ ID NO: 1350486 - RNA, 22 nt, Human
ccacaagaaaugaaagcaggga

SEQ ID NO: 1350487 - RNA, 16 nt, Human
ccacaagaaaugaaag

SEQ ID NO: 1350488 - RNA, 19 nt, Human
ccaauuucaaguuccaagu

SEQ ID NO: 1350489 - RNA, 16 nt, Human
ccaauuucagacuccc

SEQ ID NO: 1350490 - RNA, 20 nt, Human
ccaauuucggauuuuuucca

SEQ ID NO: 1350491 - RNA, 21 nt, Human
ccaauuucggauuuuuuccaa

SEQ ID NO: 1350492 - RNA, 23 nt, Human
ccaauuucggauuuuuuccaaaa

SEQ ID NO: 1350493 - RNA, 22 nt, Human
ccaauuucggauuuuuuccaaa

SEQ ID NO: 1350494 - RNA, 23 nt, Human
ccaauuuuuuaagugaaaauaua

SEQ ID NO: 1350495 - RNA, 22 nt, Human
ccacaaaaacagguauauacuu

SEQ ID NO: 1350496 - RNA, 16 nt, Human
ccacaaaacaaagcaa

SEQ ID NO: 1350497 - RNA, 23 nt, Human
ccacaaaauaaccaauccuggac

SEQ ID NO: 1350498 - RNA, 14 nt, Human
ccacaaacuguaau

SEQ ID NO: 1350499 - RNA, 13 nt, Human
ccacaaaaacagg

SEQ ID NO: 1350500 - RNA, 23 nt, Human
ccaagccguggcuucccgcucag

SEQ ID NO: 1350501 - RNA, 13 nt, Human
ccaagcuccaagc

SEQ ID NO: 1350502 - RNA, 15 nt, Human
ccaagcuccaagccc

SEQ ID NO: 1350503 - RNA, 17 nt, Human
ccaagcuccaagcccca

SEQ ID NO: 1350504 - RNA, 13 nt, Human
ccaaggccagguu

SEQ ID NO: 1350505 - RNA, 14 nt, Human
ccaagcuccaucuc

SEQ ID NO: 1350506 - RNA, 18 nt, Human
ccaaggcuagaaccaccu

SEQ ID NO: 1350507 - RNA, 15 nt, Human
ccaagccguggcuuc

SEQ ID NO: 1350508 - RNA, 16 nt, Human
ccaagccguggcuucc

SEQ ID NO: 1350509 - RNA, 17 nt, Human
ccaagccguggcuuccc

SEQ ID NO: 1350510 - RNA, 21 nt, Human
ccaagccguggcuucccgcuc

SEQ ID NO: 1350511 - RNA, 22 nt, Human
ccaagagcuacguauuuaauag

SEQ ID NO: 1350512 - RNA, 18 nt, Human
ccaagcaggaaaugaaaa

SEQ ID NO: 1350513 - RNA, 17 nt, Human
ccaaagaggcugccccu

SEQ ID NO: 1350514 - RNA, 20 nt, Human
ccaaagaggcugccccucuc

SEQ ID NO: 1350515 - RNA, 21 nt, Human
ccaaagaggcugccccucuca

SEQ ID NO: 1350516 - RNA, 22 nt, Human
ccaaagaggcugccccucucac

SEQ ID NO: 1350517 - RNA, 23 nt, Human
ccaaagaggcugccccucucacc

SEQ ID NO: 1350518 - RNA, 9 nt, Human
ccaaagagu

SEQ ID NO: 1350519 - RNA, 23 nt, Human
ccaacaugcacugauguuguguu

SEQ ID NO: 1350520 - RNA, 18 nt, Human
ccaacaucuacaaaacau

SEQ ID NO: 1350521 - RNA, 13 nt, Human
ccaacaugcacug

SEQ ID NO: 1350522 - RNA, 17 nt, Human
ccaacaugcacugaugu

SEQ ID NO: 1350523 - RNA, 21 nt, Human
ccaacaugcacugauguugug

SEQ ID NO: 1350524 - RNA, 18 nt, Human
ccaacccuggcacccagg

SEQ ID NO: 1350525 - RNA, 16 nt, Human
ccaacccuguccuccc

SEQ ID NO: 1350526 - RNA, 21 nt, Human
ccaagacaugucuguucuaca

SEQ ID NO: 1350527 - RNA, 23 nt, Human
ccaagacaugucuguucuacaua

SEQ ID NO: 1350528 - RNA, 18 nt, Human
ccaaccuguucaagucua

SEQ ID NO: 1350529 - RNA, 15 nt, Human
ccaaccuguuaccua

SEQ ID NO: 1350530 - RNA, 23 nt, Human
ccaaccuuagauguucuaagucu

SEQ ID NO: 1350531 - RNA, 17 nt, Human
ccaaccugcaaagaucu

SEQ ID NO: 1350532 - RNA, 18 nt, Human
ccaaccugcaaagaucug

SEQ ID NO: 1350533 - RNA, 19 nt, Human
ccaaccugcaaagaucugu

SEQ ID NO: 1350534 - RNA, 12 nt, Human
ccaaccugcucu

SEQ ID NO: 1350535 - RNA, 13 nt, Human
ccaaccugcucuc

SEQ ID NO: 1350536 - RNA, 15 nt, Human
ccaaccugcucuccu

SEQ ID NO: 1350537 - RNA, 16 nt, Human
ccaaccugcucuccuc

SEQ ID NO: 1350538 - RNA, 17 nt, Human
ccaaccugcucuccucu

SEQ ID NO: 1350539 - RNA, 20 nt, Human
ccaaccugcucuccucuucu

SEQ ID NO: 1350540 - RNA, 18 nt, Human
ccaaccugcucuccucuu

SEQ ID NO: 1350541 - RNA, 22 nt, Human
ccaaagaguagaauugcauuga

SEQ ID NO: 1350542 - RNA, 16 nt, Human
ccaaagcaagcaagag

SEQ ID NO: 1350543 - RNA, 17 nt, Human
ccaaagcaagcaagagg

SEQ ID NO: 1350544 - RNA, 13 nt, Human
ccaaagcagacag

SEQ ID NO: 1350545 - RNA, 14 nt, Human
ccaaagcagacagc

SEQ ID NO: 1350546 - RNA, 13 nt, Human
ccaaagcacauuu

SEQ ID NO: 1350547 - RNA, 18 nt, Human
ccaaauuuaaaacuguug

SEQ ID NO: 1350548 - RNA, 11 nt, Human
ccaaauuuaaa

SEQ ID NO: 1350549 - RNA, 22 nt, Human
ccaacaguuuaaugaagaucua

SEQ ID NO: 1350550 - RNA, 15 nt, Human
ccaacauaaaaauga

SEQ ID NO: 1350551 - RNA, 17 nt, Human
ccaacaucacagcccag

SEQ ID NO: 1350552 - RNA, 18 nt, Human
ccaacaucacagcccagc

SEQ ID NO: 1350553 - RNA, 16 nt, Human
ccaacacgcaccugcc

SEQ ID NO: 1350554 - RNA, 17 nt, Human
ccaacacgcaccugccu

SEQ ID NO: 1350555 - RNA, 19 nt, Human
ccaagagcaucaugccucu

SEQ ID NO: 1350556 - RNA, 21 nt, Human
ccaagagcaucaugccucuga

SEQ ID NO: 1350557 - RNA, 22 nt, Human
ccaagagcaucaugccucugag

SEQ ID NO: 1350558 - RNA, 23 nt, Human
ccaagagcaucaugccucugagg

SEQ ID NO: 1350559 - RNA, 16 nt, Human
ccaagagcaucaugcc

SEQ ID NO: 1350560 - RNA, 17 nt, Human
ccaagagcaucaugccu

SEQ ID NO: 1350561 - RNA, 18 nt, Human
ccaagagcaucaugccuc

SEQ ID NO: 1350562 - RNA, 13 nt, Human
ccaagacucuaga

SEQ ID NO: 1350563 - RNA, 18 nt, Human
ccaucagaaacacccuca

SEQ ID NO: 1350564 - RNA, 22 nt, Human
ccaucagaaacacccucacacu

SEQ ID NO: 1350565 - RNA, 20 nt, Human
ccaucagaaacacccucaca

SEQ ID NO: 1350566 - RNA, 15 nt, Human
ccauccugaggcucc

SEQ ID NO: 1350567 - RNA, 16 nt, Human
ccauccugaggcucca

SEQ ID NO: 1350568 - RNA, 12 nt, Human
ccauccugacca

SEQ ID NO: 1350569 - RNA, 11 nt, Human
ccaucucaggc

SEQ ID NO: 1350570 - RNA, 18 nt, Human
ccaucucaggccagagcc

SEQ ID NO: 1350571 - RNA, 20 nt, Human
ccaucucaugccccuggcug

SEQ ID NO: 1350572 - RNA, 21 nt, Human
ccaucucaugccccuggcugg

SEQ ID NO: 1350573 - RNA, 14 nt, Human
ccaucucaggccag

SEQ ID NO: 1350574 - RNA, 16 nt, Human
ccaucgcugucaucuc

SEQ ID NO: 1350575 - RNA, 13 nt, Human
ccauccugugugu

SEQ ID NO: 1350576 - RNA, 14 nt, Human
ccauccuguguguu

SEQ ID NO: 1350577 - RNA, 22 nt, Human
ccauccuguguguuaagcucug

SEQ ID NO: 1350578 - RNA, 18 nt, Human
ccaucaacaaaaauuguc

SEQ ID NO: 1350579 - RNA, 13 nt, Human
ccaucaaccucug

SEQ ID NO: 1350580 - RNA, 19 nt, Human
ccaucaccuacucacacag

SEQ ID NO: 1350581 - RNA, 21 nt, Human
ccaucaccuacucacacaggc

SEQ ID NO: 1350582 - RNA, 16 nt, Human
ccaucaccucagaugg

SEQ ID NO: 1350583 - RNA, 17 nt, Human
ccaucaccucagauggc

SEQ ID NO: 1350584 - RNA, 18 nt, Human
ccaucaccuuagaccacc

SEQ ID NO: 1350585 - RNA, 23 nt, Human
ccaucaccuuagaccaccaagcc

SEQ ID NO: 1350586 - RNA, 19 nt, Human
ccaucaccuuagaccacca

SEQ ID NO: 1350587 - RNA, 18 nt, Human
ccaucacugaguuuucca

SEQ ID NO: 1350588 - RNA, 18 nt, Human
ccauauuuaccucagccu

SEQ ID NO: 1350589 - RNA, 19 nt, Human
ccauauuuaccucagccug

SEQ ID NO: 1350590 - RNA, 21 nt, Human
ccauauuuaccucagccuggg

SEQ ID NO: 1350591 - RNA, 20 nt, Human
ccauauuuaccucagccugg

SEQ ID NO: 1350592 - RNA, 12 nt, Human
ccauauuuguaa

SEQ ID NO: 1350593 - RNA, 13 nt, Human
ccauauuuguaaa

SEQ ID NO: 1350594 - RNA, 14 nt, Human
ccauauuuguaaaa

SEQ ID NO: 1350595 - RNA, 15 nt, Human
ccauauuuguaaaau

SEQ ID NO: 1350596 - RNA, 16 nt, Human
ccauauuuguaaaaug

SEQ ID NO: 1350597 - RNA, 17 nt, Human
ccauauuuguaaaauga

SEQ ID NO: 1350598 - RNA, 19 nt, Human
ccauauuuguaaaaugaca

SEQ ID NO: 1350599 - RNA, 22 nt, Human
ccauauuuguaaaaugacaauc

SEQ ID NO: 1350600 - RNA, 20 nt, Human
ccauauuuguaaaaugacaa

SEQ ID NO: 1350601 - RNA, 16 nt, Human
ccaucaaaaugcuuuu

SEQ ID NO: 1350602 - RNA, 19 nt, Human
ccaucaaaaugcuuuuuau

SEQ ID NO: 1350603 - RNA, 17 nt, Human
ccaucaacaaaaauugu

SEQ ID NO: 1350604 - RNA, 23 nt, Human
ccagugggaggugagaccaccuc

SEQ ID NO: 1350605 - RNA, 20 nt, Human
ccagugggaggugagaccac

SEQ ID NO: 1350606 - RNA, 14 nt, Human
ccaguggauuccca

SEQ ID NO: 1350607 - RNA, 22 nt, Human
ccagugcugaauuucccucucu

SEQ ID NO: 1350608 - RNA, 12 nt, Human
ccagugcugaau

SEQ ID NO: 1350609 - RNA, 14 nt, Human
ccagggaccggcgg

SEQ ID NO: 1350610 - RNA, 13 nt, Human
ccagggagaagcu

SEQ ID NO: 1350611 - RNA, 14 nt, Human
ccagggagaagcuc

SEQ ID NO: 1350612 - RNA, 15 nt, Human
ccagggagaagcucc

SEQ ID NO: 1350613 - RNA, 15 nt, Human
ccagggacucugccg

SEQ ID NO: 1350614 - RNA, 21 nt, Human
ccagggacagaggccccagcc

SEQ ID NO: 1350615 - RNA, 22 nt, Human
ccagggacagaggccccagccu

SEQ ID NO: 1350616 - RNA, 23 nt, Human
ccagggacagaggccccagccuc

SEQ ID NO: 1350617 - RNA, 20 nt, Human
ccagggacaccugggagaaa

SEQ ID NO: 1350618 - RNA, 18 nt, Human
ccagggacaccugggaga

SEQ ID NO: 1350619 - RNA, 13 nt, Human
ccagggacagagg

SEQ ID NO: 1350620 - RNA, 18 nt, Human
ccagggacagaggcccca

SEQ ID NO: 1350621 - RNA, 20 nt, Human
ccagggacagaggccccagc

SEQ ID NO: 1350622 - RNA, 12 nt, Human
ccaggccugccu

SEQ ID NO: 1350623 - RNA, 19 nt, Human
ccaggccugaaagaggcug

SEQ ID NO: 1350624 - RNA, 23 nt, Human
ccaggccucucccuccuccagga

SEQ ID NO: 1350625 - RNA, 13 nt, Human
ccagcugcacuga

SEQ ID NO: 1350626 - RNA, 12 nt, Human
ccagcuggccgg

SEQ ID NO: 1350627 - RNA, 14 nt, Human
ccagcuggccggga

SEQ ID NO: 1350628 - RNA, 20 nt, Human
ccagcuggccgggagccuga

SEQ ID NO: 1350629 - RNA, 14 nt, Human
ccagcugcacugau

SEQ ID NO: 1350630 - RNA, 18 nt, Human
ccagcugggucaggcagg

SEQ ID NO: 1350631 - RNA, 15 nt, Human
ccagcugucccccca

SEQ ID NO: 1350632 - RNA, 18 nt, Human
ccagcuguccccccacuc

SEQ ID NO: 1350633 - RNA, 19 nt, Human
ccagcuguccccccacucc

SEQ ID NO: 1350634 - RNA, 16 nt, Human
ccagcuggguuggaaa

SEQ ID NO: 1350635 - RNA, 17 nt, Human
ccagcuggguuggaaaa

SEQ ID NO: 1350636 - RNA, 14 nt, Human
ccagcugggcucug

SEQ ID NO: 1350637 - RNA, 16 nt, Human
ccagcugggucaggca

SEQ ID NO: 1350638 - RNA, 17 nt, Human
ccagcugggucaggcag

SEQ ID NO: 1350639 - RNA, 19 nt, Human
ccagccugagcgacaguga

SEQ ID NO: 1350640 - RNA, 12 nt, Human
ccagccuggccc

SEQ ID NO: 1350641 - RNA, 13 nt, Human
ccagccuggccca

SEQ ID NO: 1350642 - RNA, 12 nt, Human
ccagccuggccu

SEQ ID NO: 1350643 - RNA, 13 nt, Human
ccagccuggccuc

SEQ ID NO: 1350644 - RNA, 14 nt, Human
ccagccuggccucc

SEQ ID NO: 1350645 - RNA, 15 nt, Human
ccagccuggccuccu

SEQ ID NO: 1350646 - RNA, 16 nt, Human
ccagccuggccuccug

SEQ ID NO: 1350647 - RNA, 17 nt, Human
ccagccuggccuccugc

SEQ ID NO: 1350648 - RNA, 18 nt, Human
ccagccuggccuccugcc

SEQ ID NO: 1350649 - RNA, 19 nt, Human
ccagccuggccuccugccu

SEQ ID NO: 1350650 - RNA, 20 nt, Human
ccagccuggccuccugccuc

SEQ ID NO: 1350651 - RNA, 15 nt, Human
ccagcucugaaacca

SEQ ID NO: 1350652 - RNA, 20 nt, Human
ccagcucugaaaccaguguu

SEQ ID NO: 1350653 - RNA, 21 nt, Human
ccagcucugaaaccaguguua

SEQ ID NO: 1350654 - RNA, 14 nt, Human
ccagcucuggaggg

SEQ ID NO: 1350655 - RNA, 14 nt, Human
ccagcucuguauca

SEQ ID NO: 1350656 - RNA, 18 nt, Human
ccagcucuguaucaggac

SEQ ID NO: 1350657 - RNA, 21 nt, Human
ccagcucuguaucaggaccca

SEQ ID NO: 1350658 - RNA, 12 nt, Human
ccagcucuguuc

SEQ ID NO: 1350659 - RNA, 13 nt, Human
ccagcucuguucu

SEQ ID NO: 1350660 - RNA, 14 nt, Human
ccagcucuguucuu

SEQ ID NO: 1350661 - RNA, 16 nt, Human
ccagcucuguucuucc

SEQ ID NO: 1350662 - RNA, 17 nt, Human
ccagcucuguucuuccu

SEQ ID NO: 1350663 - RNA, 20 nt, Human
ccagcucuguucuuccucag

SEQ ID NO: 1350664 - RNA, 21 nt, Human
ccagcucuguucuuccucagc

SEQ ID NO: 1350665 - RNA, 22 nt, Human
ccagcucuguucuuccucagcc

SEQ ID NO: 1350666 - RNA, 23 nt, Human
ccagcucuguucuuccucagcca

SEQ ID NO: 1350667 - RNA, 14 nt, Human
ccagcugacuaaac

SEQ ID NO: 1350668 - RNA, 17 nt, Human
ccagcugacuaaacuuu

SEQ ID NO: 1350669 - RNA, 23 nt, Human
ccagcugacuaaacuuuuuuucu

SEQ ID NO: 1350670 - RNA, 15 nt, Human
ccagcugagcgccag

SEQ ID NO: 1350671 - RNA, 17 nt, Human
ccagcugagcgccagga

SEQ ID NO: 1350672 - RNA, 20 nt, Human
ccagcugagcgccaggaugg

SEQ ID NO: 1350673 - RNA, 23 nt, Human
ccagccucgcccauccccuugag

SEQ ID NO: 1350674 - RNA, 15 nt, Human
ccagccucuggcauu

SEQ ID NO: 1350675 - RNA, 14 nt, Human
ccagcugugcuuau

SEQ ID NO: 1350676 - RNA, 15 nt, Human
ccagcugugcuuaug

SEQ ID NO: 1350677 - RNA, 21 nt, Human
ccagcugugcuuaugguacca

SEQ ID NO: 1350678 - RNA, 13 nt, Human
ccagcugugguuu

SEQ ID NO: 1350679 - RNA, 14 nt, Human
ccagcugugguuuu

SEQ ID NO: 1350680 - RNA, 15 nt, Human
ccagcugugguuuuc

SEQ ID NO: 1350681 - RNA, 23 nt, Human
ccagcugugguuuucuuuugcca

SEQ ID NO: 1350682 - RNA, 13 nt, Human
ccagcugugucca

SEQ ID NO: 1350683 - RNA, 14 nt, Human
ccagcuguguccaa

SEQ ID NO: 1350684 - RNA, 16 nt, Human
ccaggaccacaggcuc

SEQ ID NO: 1350685 - RNA, 17 nt, Human
ccaggaccacaggcuca

SEQ ID NO: 1350686 - RNA, 18 nt, Human
ccaggaccacaggcucag

SEQ ID NO: 1350687 - RNA, 19 nt, Human
ccaggaccacaggcucagg

SEQ ID NO: 1350688 - RNA, 13 nt, Human
ccaggaccagcuc

SEQ ID NO: 1350689 - RNA, 14 nt, Human
ccaggaccagcuca

SEQ ID NO: 1350690 - RNA, 15 nt, Human
ccaggaccagcucag

SEQ ID NO: 1350691 - RNA, 16 nt, Human
ccaggaccagcucagg

SEQ ID NO: 1350692 - RNA, 17 nt, Human
ccaggaccagcucagga

SEQ ID NO: 1350693 - RNA, 20 nt, Human
ccaggaccagcucaggacag

SEQ ID NO: 1350694 - RNA, 21 nt, Human
ccaggaccacaggcucaggca

SEQ ID NO: 1350695 - RNA, 23 nt, Human
ccaggaccagucaaccugggcaa

SEQ ID NO: 1350696 - RNA, 14 nt, Human
ccaggacccugaag

SEQ ID NO: 1350697 - RNA, 16 nt, Human
ccaggacccugaaggg

SEQ ID NO: 1350698 - RNA, 18 nt, Human
ccaggacccugaaggggc

SEQ ID NO: 1350699 - RNA, 19 nt, Human
ccaggacccugaaggggcc

SEQ ID NO: 1350700 - RNA, 23 nt, Human
ccaggacccugaaggggccauga

SEQ ID NO: 1350701 - RNA, 11 nt, Human
ccaggacccca

SEQ ID NO: 1350702 - RNA, 18 nt, Human
ccaggacccuggacccag

SEQ ID NO: 1350703 - RNA, 19 nt, Human
ccaggacccuggacccagc

SEQ ID NO: 1350704 - RNA, 15 nt, Human
ccaggaccuggcugc

SEQ ID NO: 1350705 - RNA, 17 nt, Human
ccaggaccuggcugcca

SEQ ID NO: 1350706 - RNA, 18 nt, Human
ccaggaccuggcugccau

SEQ ID NO: 1350707 - RNA, 15 nt, Human
ccaggagaagaaaga

SEQ ID NO: 1350708 - RNA, 20 nt, Human
ccaggagaagaaagagguga

SEQ ID NO: 1350709 - RNA, 11 nt, Human
ccaggagaagc

SEQ ID NO: 1350710 - RNA, 14 nt, Human
ccaggagaagcuca

SEQ ID NO: 1350711 - RNA, 13 nt, Human
ccaggagaagcuc

SEQ ID NO: 1350712 - RNA, 15 nt, Human
ccaggacucugcagc

SEQ ID NO: 1350713 - RNA, 16 nt, Human
ccaggacucugcagcc

SEQ ID NO: 1350714 - RNA, 17 nt, Human
ccaggacucugcagccu

SEQ ID NO: 1350715 - RNA, 18 nt, Human
ccaggacucugcagccuc

SEQ ID NO: 1350716 - RNA, 19 nt, Human
ccaggacucugcagccuca

SEQ ID NO: 1350717 - RNA, 20 nt, Human
ccaggacucugcagccucag

SEQ ID NO: 1350718 - RNA, 21 nt, Human
ccaggacucugcagccucaga

SEQ ID NO: 1350719 - RNA, 22 nt, Human
ccaggacucugcagccucagag

SEQ ID NO: 1350720 - RNA, 14 nt, Human
ccaggacuguuuca

SEQ ID NO: 1350721 - RNA, 16 nt, Human
ccaggacuguuucaaa

SEQ ID NO: 1350722 - RNA, 21 nt, Human
ccaggacuuauuuaaacucug

SEQ ID NO: 1350723 - RNA, 16 nt, Human
ccaggagcacggcucu

SEQ ID NO: 1350724 - RNA, 17 nt, Human
ccaggagcacggcucug

SEQ ID NO: 1350725 - RNA, 18 nt, Human
ccaggagcacggcucugu

SEQ ID NO: 1350726 - RNA, 19 nt, Human
ccaggagcacggcucuguc

SEQ ID NO: 1350727 - RNA, 22 nt, Human
ccaggagcacggcucugucccc

SEQ ID NO: 1350728 - RNA, 10 nt, Human
cccaggacag

SEQ ID NO: 1350729 - RNA, 14 nt, Human
cccagcucugaaac

SEQ ID NO: 1350730 - RNA, 22 nt, Human
cccagcucugaaaccaguguua

SEQ ID NO: 1350731 - RNA, 22 nt, Human
cccagccugucagauccaggag

SEQ ID NO: 1350732 - RNA, 22 nt, Human
cccagccuuuguuccccacugg

SEQ ID NO: 1350733 - RNA, 11 nt, Human
cccagccuggg

SEQ ID NO: 1350734 - RNA, 13 nt, Human
cccagccugggcc

SEQ ID NO: 1350735 - RNA, 12 nt, Human
cccagccugggc

SEQ ID NO: 1350736 - RNA, 14 nt, Human
cccagccugggccu

SEQ ID NO: 1350737 - RNA, 15 nt, Human
cccagccugggccua

SEQ ID NO: 1350738 - RNA, 16 nt, Human
cccagccugggccuau

SEQ ID NO: 1350739 - RNA, 18 nt, Human
cccagccugggccuaugg

SEQ ID NO: 1350740 - RNA, 19 nt, Human
cccagccugggccuaugga

SEQ ID NO: 1350741 - RNA, 10 nt, Human
cccagccugu

SEQ ID NO: 1350742 - RNA, 11 nt, Human
cccagccuguc

SEQ ID NO: 1350743 - RNA, 12 nt, Human
cccagccuguca

SEQ ID NO: 1350744 - RNA, 14 nt, Human
cccagccugucaga

SEQ ID NO: 1350745 - RNA, 18 nt, Human
cccagccugucagaucca

SEQ ID NO: 1350746 - RNA, 19 nt, Human
cccagccugucagauccag

SEQ ID NO: 1350747 - RNA, 11 nt, Human
cccagcucaau

SEQ ID NO: 1350748 - RNA, 12 nt, Human
cccagcucugaa

SEQ ID NO: 1350749 - RNA, 13 nt, Human
cccagcuaggaag

SEQ ID NO: 1350750 - RNA, 18 nt, Human
cccagcuaggaagagcag

SEQ ID NO: 1350751 - RNA, 22 nt, Human
cccagcuaggaagagcaggacu

SEQ ID NO: 1350752 - RNA, 23 nt, Human
cccagcuaggaagagcaggacuc

SEQ ID NO: 1350753 - RNA, 17 nt, Human
cccaggacaggauccag

SEQ ID NO: 1350754 - RNA, 16 nt, Human
cccaggaccacaggcu

SEQ ID NO: 1350755 - RNA, 17 nt, Human
cccaggaccacaggcuc

SEQ ID NO: 1350756 - RNA, 21 nt, Human
cccaggaccacaggcucaggc

SEQ ID NO: 1350757 - RNA, 22 nt, Human
cccaggaccacaggcucaggca

SEQ ID NO: 1350758 - RNA, 23 nt, Human
cccaggaccacaggcucaggcag

SEQ ID NO: 1350759 - RNA, 12 nt, Human
cccaggaccaga

SEQ ID NO: 1350760 - RNA, 15 nt, Human
cccaggaccagaagc

SEQ ID NO: 1350761 - RNA, 22 nt, Human
cccaggaccagaagcuccccca

SEQ ID NO: 1350762 - RNA, 12 nt, Human
cccaggaccagc

SEQ ID NO: 1350763 - RNA, 23 nt, Human
cccaggaccagaagcucccccag

SEQ ID NO: 1350764 - RNA, 14 nt, Human
cccaggaccagcuc

SEQ ID NO: 1350765 - RNA, 15 nt, Human
cccaggaccagcuca

SEQ ID NO: 1350766 - RNA, 16 nt, Human
cccaggaccagcucag

SEQ ID NO: 1350767 - RNA, 17 nt, Human
cccaggaccagcucagg

SEQ ID NO: 1350768 - RNA, 20 nt, Human
cccaggaccagcucaggaca

SEQ ID NO: 1350769 - RNA, 21 nt, Human
cccaggaccagcucaggacag

SEQ ID NO: 1350770 - RNA, 22 nt, Human
cccaggaccagcucaggacaga

SEQ ID NO: 1350771 - RNA, 12 nt, Human
cccaggacccca

SEQ ID NO: 1350772 - RNA, 11 nt, Human
cccaggacccu

SEQ ID NO: 1350773 - RNA, 12 nt, Human
cccaggacccug

SEQ ID NO: 1350774 - RNA, 13 nt, Human
cccaggacccuga

SEQ ID NO: 1350775 - RNA, 23 nt, Human
cccaggacccugaaggggccaug

SEQ ID NO: 1350776 - RNA, 20 nt, Human
cccaggaccccauggcagug

SEQ ID NO: 1350777 - RNA, 19 nt, Human
cccaggacccuggacccag

SEQ ID NO: 1350778 - RNA, 20 nt, Human
cccaggacccuggacccagc

SEQ ID NO: 1350779 - RNA, 23 nt, Human
cccaggacccuggacccagccag

SEQ ID NO: 1350780 - RNA, 18 nt, Human
cccaggaccuggcugcca

SEQ ID NO: 1350781 - RNA, 16 nt, Human
cccaggaccuggcugc

SEQ ID NO: 1350782 - RNA, 15 nt, Human
cccaggagacaguuc

SEQ ID NO: 1350783 - RNA, 17 nt, Human
cccaggagacaguucaa

SEQ ID NO: 1350784 - RNA, 15 nt, Human
cccagcaaagccccc

SEQ ID NO: 1350785 - RNA, 17 nt, Human
cccagcaaagcccccag

SEQ ID NO: 1350786 - RNA, 23 nt, Human
cccagcaaagcccccagagccca

SEQ ID NO: 1350787 - RNA, 16 nt, Human
cccagccccacuccuc

SEQ ID NO: 1350788 - RNA, 16 nt, Human
cccagaggcuggguga

SEQ ID NO: 1350789 - RNA, 16 nt, Human
cccagaggauugcugc

SEQ ID NO: 1350790 - RNA, 21 nt, Human
cccagaggaaggggccagagg

SEQ ID NO: 1350791 - RNA, 22 nt, Human
cccagaggaaggggccagaggc

SEQ ID NO: 1350792 - RNA, 23 nt, Human
cccagaggaaggggccagaggcu

SEQ ID NO: 1350793 - RNA, 24 nt, Human
cccagaggaaggggccagaggcuc

SEQ ID NO: 1350794 - RNA, 20 nt, Human
cccagaggacagcacagacu

SEQ ID NO: 1350795 - RNA, 20 nt, Human
cccagaggagccaccaguuc

SEQ ID NO: 1350796 - RNA, 13 nt, Human
cccagagccacag

SEQ ID NO: 1350797 - RNA, 14 nt, Human
cccagagccacagu

SEQ ID NO: 1350798 - RNA, 12 nt, Human
cccagagcccag

SEQ ID NO: 1350799 - RNA, 13 nt, Human
cccagagcccagc

SEQ ID NO: 1350800 - RNA, 15 nt, Human
cccagagcccagcuc

SEQ ID NO: 1350801 - RNA, 16 nt, Human
cccagagcccagcucc

SEQ ID NO: 1350802 - RNA, 17 nt, Human
cccagagcccagcucca

SEQ ID NO: 1350803 - RNA, 14 nt, Human
cccagagcccaggc

SEQ ID NO: 1350804 - RNA, 15 nt, Human
cccagagcccaggcu

SEQ ID NO: 1350805 - RNA, 19 nt, Human
cccagagcccaggcucggc

SEQ ID NO: 1350806 - RNA, 16 nt, Human
cccagagcccaggcuc

SEQ ID NO: 1350807 - RNA, 12 nt, Human
cccagccccagc

SEQ ID NO: 1350808 - RNA, 22 nt, Human
cccagccccacuccucugcuga

SEQ ID NO: 1350809 - RNA, 15 nt, Human
cccagccccagccag

SEQ ID NO: 1350810 - RNA, 17 nt, Human
cccagccccagccaggg

SEQ ID NO: 1350811 - RNA, 18 nt, Human
cccagcccccuaagagag

SEQ ID NO: 1350812 - RNA, 21 nt, Human
cccagcccccuaagagagcac

SEQ ID NO: 1350813 - RNA, 23 nt, Human
cccagcccuccuuaucaaaggac

SEQ ID NO: 1350814 - RNA, 15 nt, Human
cccagcccucauccc

SEQ ID NO: 1350815 - RNA, 16 nt, Human
cccagcccucaucccg

SEQ ID NO: 1350816 - RNA, 14 nt, Human
cccagcccucaucc

SEQ ID NO: 1350817 - RNA, 19 nt, Human
cccagcccucaucccgagc

SEQ ID NO: 1350818 - RNA, 18 nt, Human
cccagccuccaagcucca

SEQ ID NO: 1350819 - RNA, 20 nt, Human
cccagccuccaagcuccauc

SEQ ID NO: 1350820 - RNA, 16 nt, Human
cccagccucccugaag

SEQ ID NO: 1350821 - RNA, 17 nt, Human
cccagccucccugaagc

SEQ ID NO: 1350822 - RNA, 18 nt, Human
cccagccucccugaagcc

SEQ ID NO: 1350823 - RNA, 15 nt, Human
cccagccucuggcau

SEQ ID NO: 1350824 - RNA, 20 nt, Human
ccauucauuccauucuggaa

SEQ ID NO: 1350825 - RNA, 20 nt, Human
ccauguuggccaggaugguc

SEQ ID NO: 1350826 - RNA, 17 nt, Human
ccaugugguggcacagg

SEQ ID NO: 1350827 - RNA, 18 nt, Human
ccaugugguggcacaggc

SEQ ID NO: 1350828 - RNA, 16 nt, Human
ccauucccccagugcg

SEQ ID NO: 1350829 - RNA, 15 nt, Human
ccauucccccagugc

SEQ ID NO: 1350830 - RNA, 13 nt, Human
ccauuccugaaga

SEQ ID NO: 1350831 - RNA, 16 nt, Human
ccauuccugaagaacc

SEQ ID NO: 1350832 - RNA, 16 nt, Human
ccauguuggccaggcu

SEQ ID NO: 1350833 - RNA, 22 nt, Human
ccauuccugggaaauauucccu

SEQ ID NO: 1350834 - RNA, 15 nt, Human
cccacgagggcuggc

SEQ ID NO: 1350835 - RNA, 13 nt, Human
cccacgccacagc

SEQ ID NO: 1350836 - RNA, 14 nt, Human
cccacgccacagcc

SEQ ID NO: 1350837 - RNA, 15 nt, Human
cccacgccacagccc

SEQ ID NO: 1350838 - RNA, 16 nt, Human
cccacgccacagcccu

SEQ ID NO: 1350839 - RNA, 17 nt, Human
cccacgccacagcccuu

SEQ ID NO: 1350840 - RNA, 16 nt, Human
cccagacacugguuug

SEQ ID NO: 1350841 - RNA, 16 nt, Human
cccagacauaaaggaa

SEQ ID NO: 1350842 - RNA, 17 nt, Human
cccagacauaaaggaaa

SEQ ID NO: 1350843 - RNA, 19 nt, Human
cccagacauaaaggaaaag

SEQ ID NO: 1350844 - RNA, 21 nt, Human
cccagaccuguuagcagacag

SEQ ID NO: 1350845 - RNA, 22 nt, Human
cccagaccuguuagcagacagg

SEQ ID NO: 1350846 - RNA, 15 nt, Human
cccagacgccuggcu

SEQ ID NO: 1350847 - RNA, 19 nt, Human
cccagacgccuggcugcug

SEQ ID NO: 1350848 - RNA, 20 nt, Human
cccagacuagauguaguauu

SEQ ID NO: 1350849 - RNA, 23 nt, Human
cccagacuagauguaguauuuuu

SEQ ID NO: 1350850 - RNA, 12 nt, Human
cccagacucaga

SEQ ID NO: 1350851 - RNA, 13 nt, Human
cccagacucagac

SEQ ID NO: 1350852 - RNA, 16 nt, Human
cccagacucagacauu

SEQ ID NO: 1350853 - RNA, 20 nt, Human
cccagacucagacauuggca

SEQ ID NO: 1350854 - RNA, 10 nt, Human
cccagacuug

SEQ ID NO: 1350855 - RNA, 23 nt, Human
cccagacuuguuggcguaggcua

SEQ ID NO: 1350856 - RNA, 13 nt, Human
cccagagagcccg

SEQ ID NO: 1350857 - RNA, 15 nt, Human
cccagagagcccgag

SEQ ID NO: 1350858 - RNA, 14 nt, Human
cccagagcaccugc

SEQ ID NO: 1350859 - RNA, 20 nt, Human
cccagagcaccugcugucug

SEQ ID NO: 1350860 - RNA, 17 nt, Human
cccagagcaccugcugu

SEQ ID NO: 1350861 - RNA, 23 nt, Human
ccauggacacuacacccagcaau

SEQ ID NO: 1350862 - RNA, 22 nt, Human
ccauggacacuacacccagcaa

SEQ ID NO: 1350863 - RNA, 21 nt, Human
ccauggacacuacacccagca

SEQ ID NO: 1350864 - RNA, 20 nt, Human
ccauggacacuacacccagc

SEQ ID NO: 1350865 - RNA, 19 nt, Human
ccauggacacuacacccag

SEQ ID NO: 1350866 - RNA, 14 nt, Human
ccauggacaggcug

SEQ ID NO: 1350867 - RNA, 15 nt, Human
ccauggacaggcugg

SEQ ID NO: 1350868 - RNA, 18 nt, Human
ccauggagaaagcugacu

SEQ ID NO: 1350869 - RNA, 19 nt, Human
ccauggagaaagcugacuu

SEQ ID NO: 1350870 - RNA, 20 nt, Human
ccauggagaaagcugacuug

SEQ ID NO: 1350871 - RNA, 23 nt, Human
ccauggagaaagcugacuuggcu

SEQ ID NO: 1350872 - RNA, 23 nt, Human
ccauggaggaaggcucuguucca

SEQ ID NO: 1350873 - RNA, 19 nt, Human
ccauggagggagggagugg

SEQ ID NO: 1350874 - RNA, 14 nt, Human
ccauggaguggcag

SEQ ID NO: 1350875 - RNA, 19 nt, Human
ccauggagauugaccugga

SEQ ID NO: 1350876 - RNA, 18 nt, Human
ccauggagauugaccugg

SEQ ID NO: 1350877 - RNA, 22 nt, Human
ccauggaguggcagcccagcca

SEQ ID NO: 1350878 - RNA, 14 nt, Human
ccauggcaggaagg

SEQ ID NO: 1350879 - RNA, 13 nt, Human
ccauggccagcag

SEQ ID NO: 1350880 - RNA, 16 nt, Human
ccauggccagcagcac

SEQ ID NO: 1350881 - RNA, 21 nt, Human
ccauggccagcagcaccugcc

SEQ ID NO: 1350882 - RNA, 20 nt, Human
ccauggccagcagcaccugc

SEQ ID NO: 1350883 - RNA, 23 nt, Human
ccauggcacucuauguucuaaga

SEQ ID NO: 1350884 - RNA, 15 nt, Human
ccauggaguggcagc

SEQ ID NO: 1350885 - RNA, 19 nt, Human
ccauggaguggcagcccag

SEQ ID NO: 1350886 - RNA, 20 nt, Human
ccauggaguggcagcccagc

SEQ ID NO: 1350887 - RNA, 21 nt, Human
ccauggaguggcagcccagcc

SEQ ID NO: 1350888 - RNA, 23 nt, Human
ccauggaguggcagcccagccag

SEQ ID NO: 1350889 - RNA, 13 nt, Human
ccaugugcccagu

SEQ ID NO: 1350890 - RNA, 14 nt, Human
ccaugcugccucca

SEQ ID NO: 1350891 - RNA, 14 nt, Human
ccaugcugcugggg

SEQ ID NO: 1350892 - RNA, 19 nt, Human
ccaugcugcuggggaagac

SEQ ID NO: 1350893 - RNA, 20 nt, Human
ccaugcugcuggggaagaca

SEQ ID NO: 1350894 - RNA, 21 nt, Human
ccaugcugcuggggaagacag

SEQ ID NO: 1350895 - RNA, 15 nt, Human
ccaugcugaggccug

SEQ ID NO: 1350896 - RNA, 16 nt, Human
ccaugcugaggccugg

SEQ ID NO: 1350897 - RNA, 17 nt, Human
ccaugcugaggccuggg

SEQ ID NO: 1350898 - RNA, 15 nt, Human
ccaugaaccaagacc

SEQ ID NO: 1350899 - RNA, 14 nt, Human
ccaugcgcccccuc

SEQ ID NO: 1350900 - RNA, 20 nt, Human
ccaugcgcccccuccgcccu

SEQ ID NO: 1350901 - RNA, 22 nt, Human
ccaugcgcccccuccgcccugc

SEQ ID NO: 1350902 - RNA, 15 nt, Human
cccauguucuguccc

SEQ ID NO: 1350903 - RNA, 21 nt, Human
cccauguguccugguucccgu

SEQ ID NO: 1350904 - RNA, 21 nt, Human
cccauguucugucccuugccc

SEQ ID NO: 1350905 - RNA, 13 nt, Human
cccauguuucaaa

SEQ ID NO: 1350906 - RNA, 16 nt, Human
cccaugucucgacuca

SEQ ID NO: 1350907 - RNA, 17 nt, Human
cccaugucucgacucau

SEQ ID NO: 1350908 - RNA, 17 nt, Human
cccaugucuacacagau

SEQ ID NO: 1350909 - RNA, 17 nt, Human
cccauggugcuaggaag

SEQ ID NO: 1350910 - RNA, 16 nt, Human
ccccaaagcuuuccug

SEQ ID NO: 1350911 - RNA, 18 nt, Human
ccccaaagcuuuccugcc

SEQ ID NO: 1350912 - RNA, 19 nt, Human
ccccaaagcuuuccugccc

SEQ ID NO: 1350913 - RNA, 21 nt, Human
ccccaaagcuuuccugcccca

SEQ ID NO: 1350914 - RNA, 22 nt, Human
ccccaaaggcuuugcccugcug

SEQ ID NO: 1350915 - RNA, 20 nt, Human
ccccaacccguggaggcugc

SEQ ID NO: 1350916 - RNA, 23 nt, Human
ccccaacccguggaggcugcucg

SEQ ID NO: 1350917 - RNA, 13 nt, Human
ccccaaccugcuc

SEQ ID NO: 1350918 - RNA, 14 nt, Human
ccccaaccugcucu

SEQ ID NO: 1350919 - RNA, 15 nt, Human
ccccaaccugcucuc

SEQ ID NO: 1350920 - RNA, 16 nt, Human
ccccaaccugcucucc

SEQ ID NO: 1350921 - RNA, 19 nt, Human
ccccaaccugcucuccucu

SEQ ID NO: 1350922 - RNA, 21 nt, Human
ccccaaccugcucuccucuuc

SEQ ID NO: 1350923 - RNA, 20 nt, Human
ccccaaccugcucuccucuu

SEQ ID NO: 1350924 - RNA, 20 nt, Human
ccccaacuacccccagcugu

SEQ ID NO: 1350925 - RNA, 19 nt, Human
cccaucgucucggccuuca

SEQ ID NO: 1350926 - RNA, 22 nt, Human
cccaucgucucggccuucacaa

SEQ ID NO: 1350927 - RNA, 20 nt, Human
cccaucguugcccccauuuc

SEQ ID NO: 1350928 - RNA, 22 nt, Human
cccaucguugcccccauuucug

SEQ ID NO: 1350929 - RNA, 11 nt, Human
cccaucucagg

SEQ ID NO: 1350930 - RNA, 16 nt, Human
cccaucucaggccaga

SEQ ID NO: 1350931 - RNA, 23 nt, Human
cccaucucaggccagagccaagg

SEQ ID NO: 1350932 - RNA, 20 nt, Human
cccaucucaugccccuggcu

SEQ ID NO: 1350933 - RNA, 14 nt, Human
cccaucucaugccc

SEQ ID NO: 1350934 - RNA, 12 nt, Human
cccaucuugcuu

SEQ ID NO: 1350935 - RNA, 19 nt, Human
cccauggggagggauucug

SEQ ID NO: 1350936 - RNA, 17 nt, Human
cccagguaggccaaggu

SEQ ID NO: 1350937 - RNA, 20 nt, Human
cccagguaggccaagguguc

SEQ ID NO: 1350938 - RNA, 17 nt, Human
cccagguaggggccccu

SEQ ID NO: 1350939 - RNA, 20 nt, Human
cccagguaggggccccucuc

SEQ ID NO: 1350940 - RNA, 21 nt, Human
cccagguaggggccccucuca

SEQ ID NO: 1350941 - RNA, 23 nt, Human
cccagguaggggccccucucagc

SEQ ID NO: 1350942 - RNA, 14 nt, Human
cccagguccagcuc

SEQ ID NO: 1350943 - RNA, 22 nt, Human
cccagguaggggccccucucag

SEQ ID NO: 1350944 - RNA, 15 nt, Human
cccaguaacucaucu

SEQ ID NO: 1350945 - RNA, 22 nt, Human
cccaguacacaggggcuugacu

SEQ ID NO: 1350946 - RNA, 21 nt, Human
cccaguaccuagcuggcucug

SEQ ID NO: 1350947 - RNA, 16 nt, Human
cccaguagaccuuguu

SEQ ID NO: 1350948 - RNA, 19 nt, Human
cccagggugggaagggcua

SEQ ID NO: 1350949 - RNA, 19 nt, Human
cccagugcccccacugacc

SEQ ID NO: 1350950 - RNA, 20 nt, Human
cccagugcccccacugacca

SEQ ID NO: 1350951 - RNA, 22 nt, Human
cccagugcccccacugaccaga

SEQ ID NO: 1350952 - RNA, 14 nt, Human
cccagugcccucuc

SEQ ID NO: 1350953 - RNA, 14 nt, Human
cccagugcccccac

SEQ ID NO: 1350954 - RNA, 18 nt, Human
cccagugcccucuccccu

SEQ ID NO: 1350955 - RNA, 14 nt, Human
cccaguuaaucuug

SEQ ID NO: 1350956 - RNA, 14 nt, Human
cccaguucacccug

SEQ ID NO: 1350957 - RNA, 12 nt, Human
cccaguguggcu

SEQ ID NO: 1350958 - RNA, 21 nt, Human
ccuccaggguggcagcaacaa

SEQ ID NO: 1350959 - RNA, 20 nt, Human
ccuccaggguggcagcaaca

SEQ ID NO: 1350960 - RNA, 17 nt, Human
ccuccagggugugugcu

SEQ ID NO: 1350961 - RNA, 17 nt, Human
ccuccauccuacccccu

SEQ ID NO: 1350962 - RNA, 12 nt, Human
ccuccaucccug

SEQ ID NO: 1350963 - RNA, 22 nt, Human
ccuccauccuacccccugugcc

SEQ ID NO: 1350964 - RNA, 23 nt, Human
ccuccauccuacccccugugccu

SEQ ID NO: 1350965 - RNA, 14 nt, Human
ccuccaucccuggc

SEQ ID NO: 1350966 - RNA, 16 nt, Human
ccuccaucccuggccc

SEQ ID NO: 1350967 - RNA, 17 nt, Human
ccuccaucccuggcccc

SEQ ID NO: 1350968 - RNA, 13 nt, Human
ccuccauccugag

SEQ ID NO: 1350969 - RNA, 12 nt, Human
ccuccauccuga

SEQ ID NO: 1350970 - RNA, 14 nt, Human
ccuccauccugagg

SEQ ID NO: 1350971 - RNA, 19 nt, Human
ccuccaugcugccuccaga

SEQ ID NO: 1350972 - RNA, 11 nt, Human
ccuccauggga

SEQ ID NO: 1350973 - RNA, 18 nt, Human
ccuccaugggccccaggg

SEQ ID NO: 1350974 - RNA, 15 nt, Human
ccuccacucuuucuu

SEQ ID NO: 1350975 - RNA, 20 nt, Human
ccuccacucuuucuuucaau

SEQ ID NO: 1350976 - RNA, 21 nt, Human
ccuccagcucccugugccccc

SEQ ID NO: 1350977 - RNA, 18 nt, Human
ccuccagcucccugugcc

SEQ ID NO: 1350978 - RNA, 12 nt, Human
ccuccagcuguu

SEQ ID NO: 1350979 - RNA, 11 nt, Human
ccuccagcugu

SEQ ID NO: 1350980 - RNA, 13 nt, Human
ccuccagcuuucc

SEQ ID NO: 1350981 - RNA, 14 nt, Human
ccuccagcuuuccu

SEQ ID NO: 1350982 - RNA, 17 nt, Human
ccuccagcuuuccugua

SEQ ID NO: 1350983 - RNA, 15 nt, Human
ccuccaggaagccuu

SEQ ID NO: 1350984 - RNA, 13 nt, Human
ccuccaggaagcc

SEQ ID NO: 1350985 - RNA, 19 nt, Human
ccucaguuuuaucauuuuc

SEQ ID NO: 1350986 - RNA, 12 nt, Human
ccuccccugcca

SEQ ID NO: 1350987 - RNA, 13 nt, Human
ccuccccugccac

SEQ ID NO: 1350988 - RNA, 14 nt, Human
ccuccccugccacc

SEQ ID NO: 1350989 - RNA, 17 nt, Human
ccuccccugccaccagg

SEQ ID NO: 1350990 - RNA, 13 nt, Human
ccuccccugccag

SEQ ID NO: 1350991 - RNA, 16 nt, Human
ccuccccugccagggc

SEQ ID NO: 1350992 - RNA, 18 nt, Human
ccuccccugccagggcag

SEQ ID NO: 1350993 - RNA, 15 nt, Human
ccuccccuccuccug

SEQ ID NO: 1350994 - RNA, 12 nt, Human
ccuccccuccag

SEQ ID NO: 1350995 - RNA, 13 nt, Human
ccuccccuccagc

SEQ ID NO: 1350996 - RNA, 14 nt, Human
ccuccccuccaucc

SEQ ID NO: 1350997 - RNA, 20 nt, Human
ccuccccuccaucccuggcc

SEQ ID NO: 1350998 - RNA, 16 nt, Human
ccuccccuccaucccu

SEQ ID NO: 1350999 - RNA, 12 nt, Human
ccuccaugggcc

SEQ ID NO: 1351000 - RNA, 15 nt, Human
ccucccccuccucuc

SEQ ID NO: 1351001 - RNA, 12 nt, Human
ccucccccugag

SEQ ID NO: 1351002 - RNA, 15 nt, Human
ccucccccccaugca

SEQ ID NO: 1351003 - RNA, 16 nt, Human
ccucccccccaugcac

SEQ ID NO: 1351004 - RNA, 17 nt, Human
ccucccccccaugcacu

SEQ ID NO: 1351005 - RNA, 19 nt, Human
ccucccccccaugcacugu

SEQ ID NO: 1351006 - RNA, 13 nt, Human
ccucccccugcca

SEQ ID NO: 1351007 - RNA, 14 nt, Human
ccucccccugccag

SEQ ID NO: 1351008 - RNA, 16 nt, Human
ccucccccugccagga

SEQ ID NO: 1351009 - RNA, 14 nt, Human
ccucccccuguccc

SEQ ID NO: 1351010 - RNA, 15 nt, Human
ccuccccgcaccccc

SEQ ID NO: 1351011 - RNA, 21 nt, Human
ccuccccgcaccccccaagcu

SEQ ID NO: 1351012 - RNA, 14 nt, Human
ccucccgagcuccu

SEQ ID NO: 1351013 - RNA, 19 nt, Human
ccucccgagcuccucuucc

SEQ ID NO: 1351014 - RNA, 20 nt, Human
ccucccgagcuccucuucca

SEQ ID NO: 1351015 - RNA, 22 nt, Human
ccucccucucguaagauuuccu

SEQ ID NO: 1351016 - RNA, 14 nt, Human
ccucccucugcugu

SEQ ID NO: 1351017 - RNA, 21 nt, Human
ccucccucugcugucaccuug

SEQ ID NO: 1351018 - RNA, 22 nt, Human
ccucguggacaccugcccugcc

SEQ ID NO: 1351019 - RNA, 21 nt, Human
ccucguggacaccugcccugc

SEQ ID NO: 1351020 - RNA, 20 nt, Human
ccucguggacaccugcccug

SEQ ID NO: 1351021 - RNA, 18 nt, Human
ccucguggacaccugccc

SEQ ID NO: 1351022 - RNA, 17 nt, Human
ccucguggacaccugcc

SEQ ID NO: 1351023 - RNA, 16 nt, Human
ccucguggacaccugc

SEQ ID NO: 1351024 - RNA, 15 nt, Human
ccucguggacaccug

SEQ ID NO: 1351025 - RNA, 17 nt, Human
ccucuaacuuggcucac

SEQ ID NO: 1351026 - RNA, 21 nt, Human
ccucuaacuuggcucacacuc

SEQ ID NO: 1351027 - RNA, 19 nt, Human
ccucuaagguugggcaggg

SEQ ID NO: 1351028 - RNA, 18 nt, Human
ccucuacagagcuucccu

SEQ ID NO: 1351029 - RNA, 14 nt, Human
ccuccuucugcugc

SEQ ID NO: 1351030 - RNA, 16 nt, Human
ccuccuuggugauucc

SEQ ID NO: 1351031 - RNA, 19 nt, Human
ccuccuuucaucacacugg

SEQ ID NO: 1351032 - RNA, 12 nt, Human
ccuccuccaggg

SEQ ID NO: 1351033 - RNA, 13 nt, Human
ccuccuccaggga

SEQ ID NO: 1351034 - RNA, 14 nt, Human
ccuccuccagggac

SEQ ID NO: 1351035 - RNA, 15 nt, Human
ccuccuccagggaca

SEQ ID NO: 1351036 - RNA, 16 nt, Human
ccuccuccagggacag

SEQ ID NO: 1351037 - RNA, 16 nt, Human
ccuccucccacccggc

SEQ ID NO: 1351038 - RNA, 19 nt, Human
ccuccucccacccggcugc

SEQ ID NO: 1351039 - RNA, 23 nt, Human
ccuccucccacccggcugcagag

SEQ ID NO: 1351040 - RNA, 18 nt, Human
ccuccuccagggacagca

SEQ ID NO: 1351041 - RNA, 19 nt, Human
ccuccucuaagguugggca

SEQ ID NO: 1351042 - RNA, 13 nt, Human
ccuccucucugcc

SEQ ID NO: 1351043 - RNA, 15 nt, Human
ccuccucucugcccu

SEQ ID NO: 1351044 - RNA, 15 nt, Human
ccuccucuccaccau

SEQ ID NO: 1351045 - RNA, 14 nt, Human
ccuccucuccacca

SEQ ID NO: 1351046 - RNA, 16 nt, Human
ccuccucucugcccua

SEQ ID NO: 1351047 - RNA, 17 nt, Human
ccuccuucugagcuccu

SEQ ID NO: 1351048 - RNA, 19 nt, Human
ccuccuucugagcuccugu

SEQ ID NO: 1351049 - RNA, 20 nt, Human
ccuccuucugagcuccuguc

SEQ ID NO: 1351050 - RNA, 21 nt, Human
ccuccuucugagcuccugucc

SEQ ID NO: 1351051 - RNA, 22 nt, Human
ccuccuucugagcuccuguccc

SEQ ID NO: 1351052 - RNA, 18 nt, Human
ccuccuucuucagggacu

SEQ ID NO: 1351053 - RNA, 12 nt, Human
ccucuccccagc

SEQ ID NO: 1351054 - RNA, 14 nt, Human
ccucuccccagccc

SEQ ID NO: 1351055 - RNA, 16 nt, Human
ccucuccccagcccag

SEQ ID NO: 1351056 - RNA, 17 nt, Human
ccucuccccagcccaga

SEQ ID NO: 1351057 - RNA, 18 nt, Human
ccucuccccugccugccc

SEQ ID NO: 1351058 - RNA, 18 nt, Human
ccucucccuccuccagga

SEQ ID NO: 1351059 - RNA, 23 nt, Human
ccucucccuccuccaggaagccu

SEQ ID NO: 1351060 - RNA, 16 nt, Human
ccucucccugcauggc

SEQ ID NO: 1351061 - RNA, 14 nt, Human
ccucucccugcaug

SEQ ID NO: 1351062 - RNA, 20 nt, Human
ccucucccacccucuuccua

SEQ ID NO: 1351063 - RNA, 12 nt, Human
ccucucccaggc

SEQ ID NO: 1351064 - RNA, 13 nt, Human
ccucucccacccu

SEQ ID NO: 1351065 - RNA, 14 nt, Human
ccucucccacccuc

SEQ ID NO: 1351066 - RNA, 15 nt, Human
ccucucccacccucu

SEQ ID NO: 1351067 - RNA, 16 nt, Human
ccucucccacccucuu

SEQ ID NO: 1351068 - RNA, 18 nt, Human
ccucucccacccucuucc

SEQ ID NO: 1351069 - RNA, 19 nt, Human
ccucucccacccucuuccu

SEQ ID NO: 1351070 - RNA, 20 nt, Human
ccucuacagagcuucccuga

SEQ ID NO: 1351071 - RNA, 21 nt, Human
ccucuacagagcuucccugac

SEQ ID NO: 1351072 - RNA, 24 nt, Human
ccucuacagagcuucccugacuca

SEQ ID NO: 1351073 - RNA, 11 nt, Human
ccucuacaggg

SEQ ID NO: 1351074 - RNA, 15 nt, Human
ccucuaccccaauuu

SEQ ID NO: 1351075 - RNA, 14 nt, Human
ccucuacugggaag

SEQ ID NO: 1351076 - RNA, 16 nt, Human
ccucuacugggaaggc

SEQ ID NO: 1351077 - RNA, 17 nt, Human
ccucuacugggaaggcu

SEQ ID NO: 1351078 - RNA, 22 nt, Human
ccucuacugggaaggcuacuuc

SEQ ID NO: 1351079 - RNA, 11 nt, Human
ccucugagccu

SEQ ID NO: 1351080 - RNA, 12 nt, Human
ccucugagccuu

SEQ ID NO: 1351081 - RNA, 16 nt, Human
ccucugagacuccaga

SEQ ID NO: 1351082 - RNA, 12 nt, Human
ccucugaggcca

SEQ ID NO: 1351083 - RNA, 14 nt, Human
ccucugaggccagc

SEQ ID NO: 1351084 - RNA, 15 nt, Human
ccucugaggccagcc

SEQ ID NO: 1351085 - RNA, 13 nt, Human
ccucugaggcuga

SEQ ID NO: 1351086 - RNA, 16 nt, Human
ccucugaggccagccu

SEQ ID NO: 1351087 - RNA, 17 nt, Human
ccucugaggccagccug

SEQ ID NO: 1351088 - RNA, 18 nt, Human
ccucugaggccagccugg

SEQ ID NO: 1351089 - RNA, 19 nt, Human
ccucugaggccagccuggc

SEQ ID NO: 1351090 - RNA, 20 nt, Human
ccucugaggccagccuggcc

SEQ ID NO: 1351091 - RNA, 21 nt, Human
ccucugaggccagccuggccu

SEQ ID NO: 1351092 - RNA, 22 nt, Human
ccucugaggccagccuggccuc

SEQ ID NO: 1351093 - RNA, 19 nt, Human
ccucucccuugggcucuga

SEQ ID NO: 1351094 - RNA, 20 nt, Human
ccucucccuugggcucugau

SEQ ID NO: 1351095 - RNA, 22 nt, Human
ccucucccuugggcucugauga

SEQ ID NO: 1351096 - RNA, 12 nt, Human
ccucugaaauac

SEQ ID NO: 1351097 - RNA, 12 nt, Human
ccucugacagca

SEQ ID NO: 1351098 - RNA, 13 nt, Human
ccucugacagcag

SEQ ID NO: 1351099 - RNA, 14 nt, Human
ccucugacagcagc

SEQ ID NO: 1351100 - RNA, 15 nt, Human
ccucugacagcagca

SEQ ID NO: 1351101 - RNA, 18 nt, Human
ccucugacagcagcaucu

SEQ ID NO: 1351102 - RNA, 20 nt, Human
ccucugacagcagcaucucu

SEQ ID NO: 1351103 - RNA, 19 nt, Human
ccucugacagcagcaucuc

SEQ ID NO: 1351104 - RNA, 14 nt, Human
ccucugaccugcac

SEQ ID NO: 1351105 - RNA, 16 nt, Human
ccucugaccugcacug

SEQ ID NO: 1351106 - RNA, 17 nt, Human
ccucugaccugcacugg

SEQ ID NO: 1351107 - RNA, 12 nt, Human
ccucugacucag

SEQ ID NO: 1351108 - RNA, 16 nt, Human
ccucugacucagggcu

SEQ ID NO: 1351109 - RNA, 17 nt, Human
ccucugacucagggcuc

SEQ ID NO: 1351110 - RNA, 19 nt, Human
ccucugacucagggcuccu

SEQ ID NO: 1351111 - RNA, 21 nt, Human
ccucugacucagggcuccugg

SEQ ID NO: 1351112 - RNA, 22 nt, Human
ccucugacucagggcuccuggg

SEQ ID NO: 1351113 - RNA, 20 nt, Human
ccucugagaagcucugaaga

SEQ ID NO: 1351114 - RNA, 15 nt, Human
ccucugagacuccag

SEQ ID NO: 1351115 - RNA, 19 nt, Human
ccucugagacuccagaccu

SEQ ID NO: 1351116 - RNA, 18 nt, Human
ccucaccagcccuggcaa

SEQ ID NO: 1351117 - RNA, 12 nt, Human
ccucaccauucc

SEQ ID NO: 1351118 - RNA, 14 nt, Human
ccucacccuggggc

SEQ ID NO: 1351119 - RNA, 18 nt, Human
ccucaccgagugggggca

SEQ ID NO: 1351120 - RNA, 14 nt, Human
ccucacccugccuu

SEQ ID NO: 1351121 - RNA, 15 nt, Human
ccucacccugccuua

SEQ ID NO: 1351122 - RNA, 22 nt, Human
ccucacccugccuuaucuugca

SEQ ID NO: 1351123 - RNA, 13 nt, Human
ccucaccuccucu

SEQ ID NO: 1351124 - RNA, 19 nt, Human
ccucacucgucucccccaa

SEQ ID NO: 1351125 - RNA, 16 nt, Human
ccucagagccaccccu

SEQ ID NO: 1351126 - RNA, 20 nt, Human
ccucagagacaucagcccuu

SEQ ID NO: 1351127 - RNA, 14 nt, Human
ccucagagaccagg

SEQ ID NO: 1351128 - RNA, 16 nt, Human
ccucagagaccagggc

SEQ ID NO: 1351129 - RNA, 17 nt, Human
ccucagagaccagggcu

SEQ ID NO: 1351130 - RNA, 19 nt, Human
ccucagagaccagggcucc

SEQ ID NO: 1351131 - RNA, 21 nt, Human
ccucagagaccagggcuccag

SEQ ID NO: 1351132 - RNA, 20 nt, Human
ccucacuguauccagguucc

SEQ ID NO: 1351133 - RNA, 15 nt, Human
ccucagacuggggca

SEQ ID NO: 1351134 - RNA, 16 nt, Human
ccucagagacaucagc

SEQ ID NO: 1351135 - RNA, 13 nt, Human
ccucacuggcucu

SEQ ID NO: 1351136 - RNA, 16 nt, Human
ccucacuggcucuccu

SEQ ID NO: 1351137 - RNA, 17 nt, Human
ccucacuggcucuccug

SEQ ID NO: 1351138 - RNA, 18 nt, Human
ccucacuggcucuccugg

SEQ ID NO: 1351139 - RNA, 19 nt, Human
ccucacuggcucuccuggc

SEQ ID NO: 1351140 - RNA, 15 nt, Human
ccucagggacucagg

SEQ ID NO: 1351141 - RNA, 16 nt, Human
ccucagggacucaggu

SEQ ID NO: 1351142 - RNA, 14 nt, Human
ccucagauggcagc

SEQ ID NO: 1351143 - RNA, 15 nt, Human
ccucagauggcagcu

SEQ ID NO: 1351144 - RNA, 16 nt, Human
ccucagauggcagcuu

SEQ ID NO: 1351145 - RNA, 17 nt, Human
ccucagauggcagcuuu

SEQ ID NO: 1351146 - RNA, 21 nt, Human
ccucagauggcagcuuuuaaa

SEQ ID NO: 1351147 - RNA, 23 nt, Human
ccucagauggcagcuuuuaaaag

SEQ ID NO: 1351148 - RNA, 16 nt, Human
ccucagauuccuuccc

SEQ ID NO: 1351149 - RNA, 17 nt, Human
ccucagauuccuuccca

SEQ ID NO: 1351150 - RNA, 22 nt, Human
ccucagauuccuucccauggag

SEQ ID NO: 1351151 - RNA, 21 nt, Human
ccucagauuccuucccaugga

SEQ ID NO: 1351152 - RNA, 12 nt, Human
ccucagccagcc

SEQ ID NO: 1351153 - RNA, 13 nt, Human
ccucagccagccu

SEQ ID NO: 1351154 - RNA, 14 nt, Human
ccucagccagccuc

SEQ ID NO: 1351155 - RNA, 18 nt, Human
ccucagccccgcguggaa

SEQ ID NO: 1351156 - RNA, 23 nt, Human
ccuauucaacacacacaugcuuc

SEQ ID NO: 1351157 - RNA, 21 nt, Human
ccuauucaacacacacaugcu

SEQ ID NO: 1351158 - RNA, 17 nt, Human
ccuauuaucccagcugc

SEQ ID NO: 1351159 - RNA, 18 nt, Human
ccuauuaucccagcugcc

SEQ ID NO: 1351160 - RNA, 17 nt, Human
ccuauuaucugucagcu

SEQ ID NO: 1351161 - RNA, 16 nt, Human
ccuauuaaccuagaga

SEQ ID NO: 1351162 - RNA, 12 nt, Human
ccuauuauccca

SEQ ID NO: 1351163 - RNA, 16 nt, Human
ccuauuaucccagcug

SEQ ID NO: 1351164 - RNA, 20 nt, Human
ccuaucugggcuuccuggag

SEQ ID NO: 1351165 - RNA, 22 nt, Human
ccuaucugggcuuccuggagca

SEQ ID NO: 1351166 - RNA, 22 nt, Human
ccuauguuuuuguucaaagcca

SEQ ID NO: 1351167 - RNA, 16 nt, Human
ccuaucugggcuuccu

SEQ ID NO: 1351168 - RNA, 17 nt, Human
ccuaucugggcuuccug

SEQ ID NO: 1351169 - RNA, 18 nt, Human
ccuaucugggcuuccugg

SEQ ID NO: 1351170 - RNA, 19 nt, Human
ccuaucugggcuuccugga

SEQ ID NO: 1351171 - RNA, 12 nt, Human
ccuaucugggcu

SEQ ID NO: 1351172 - RNA, 15 nt, Human
ccucacacugggacu

SEQ ID NO: 1351173 - RNA, 13 nt, Human
ccucacacuggga

SEQ ID NO: 1351174 - RNA, 12 nt, Human
ccucacacuggg

SEQ ID NO: 1351175 - RNA, 16 nt, Human
ccuauugcuagagcuc

SEQ ID NO: 1351176 - RNA, 18 nt, Human
ccuauugcuagagcuccu

SEQ ID NO: 1351177 - RNA, 22 nt, Human
ccuauugcuagagcuccucccu

SEQ ID NO: 1351178 - RNA, 13 nt, Human
ccucacagugaac

SEQ ID NO: 1351179 - RNA, 20 nt, Human
ccuagacucugucuaccugg

SEQ ID NO: 1351180 - RNA, 18 nt, Human
ccuagugaaggcuucucu

SEQ ID NO: 1351181 - RNA, 19 nt, Human
ccuagugaaggcuucucuc

SEQ ID NO: 1351182 - RNA, 21 nt, Human
ccuagugaaggcuucucucug

SEQ ID NO: 1351183 - RNA, 22 nt, Human
ccuagugaaggcuucucucugu

SEQ ID NO: 1351184 - RNA, 23 nt, Human
ccuagugaaggcuucucucugug

SEQ ID NO: 1351185 - RNA, 13 nt, Human
ccuaucccaccuc

SEQ ID NO: 1351186 - RNA, 20 nt, Human
ccuaucuccagcggcccugu

SEQ ID NO: 1351187 - RNA, 16 nt, Human
ccggaucugagggaga

SEQ ID NO: 1351188 - RNA, 21 nt, Human
ccggaggggccuggcagccgu

SEQ ID NO: 1351189 - RNA, 17 nt, Human
ccggcuuuguggcacug

SEQ ID NO: 1351190 - RNA, 19 nt, Human
ccggcuuuguggcacuggg

SEQ ID NO: 1351191 - RNA, 17 nt, Human
cccuuucccaccccaac

SEQ ID NO: 1351192 - RNA, 20 nt, Human
cccuuucccaccccaaccug

SEQ ID NO: 1351193 - RNA, 23 nt, Human
cccuuucccaccccaaccugcuc

SEQ ID NO: 1351194 - RNA, 20 nt, Human
ccggacucaagccccggacu

SEQ ID NO: 1351195 - RNA, 23 nt, Human
ccggacuuagaaaaccagcucag

SEQ ID NO: 1351196 - RNA, 15 nt, Human
ccggacuuuucugca

SEQ ID NO: 1351197 - RNA, 16 nt, Human
ccggacuuuucugcaa

SEQ ID NO: 1351198 - RNA, 13 nt, Human
ccggagagccagc

SEQ ID NO: 1351199 - RNA, 14 nt, Human
ccggagagccagcu

SEQ ID NO: 1351200 - RNA, 14 nt, Human
ccggagaggaccgg

SEQ ID NO: 1351201 - RNA, 16 nt, Human
ccggagagugggggug

SEQ ID NO: 1351202 - RNA, 14 nt, Human
ccggagaguggggg

SEQ ID NO: 1351203 - RNA, 16 nt, Human
ccgggagccugaucac

SEQ ID NO: 1351204 - RNA, 23 nt, Human
ccgggagccugaucaccugcccu

SEQ ID NO: 1351205 - RNA, 13 nt, Human
ccgggagcucagg

SEQ ID NO: 1351206 - RNA, 15 nt, Human
ccgggagcucaggaa

SEQ ID NO: 1351207 - RNA, 22 nt, Human
ccgggaggcagagguugcagug

SEQ ID NO: 1351208 - RNA, 15 nt, Human
ccggggaacuggcca

SEQ ID NO: 1351209 - RNA, 15 nt, Human
ccggggccugggcag

SEQ ID NO: 1351210 - RNA, 15 nt, Human
ccggggccagcacuu

SEQ ID NO: 1351211 - RNA, 19 nt, Human
ccggggccugggcaggagg

SEQ ID NO: 1351212 - RNA, 16 nt, Human
ccggggaacuggccaa

SEQ ID NO: 1351213 - RNA, 17 nt, Human
ccggggaacuggccaag

SEQ ID NO: 1351214 - RNA, 18 nt, Human
ccggggaacuggccaagc

SEQ ID NO: 1351215 - RNA, 19 nt, Human
ccggggaacuggccaagcu

SEQ ID NO: 1351216 - RNA, 20 nt, Human
ccggggaacuggccaagcug

SEQ ID NO: 1351217 - RNA, 14 nt, Human
ccggggcagccccc

SEQ ID NO: 1351218 - RNA, 18 nt, Human
ccggucgcccuuugcugc

SEQ ID NO: 1351219 - RNA, 23 nt, Human
ccggucgcccuuugcugcauggc

SEQ ID NO: 1351220 - RNA, 22 nt, Human
ccggucgcccuuugcugcaugg

SEQ ID NO: 1351221 - RNA, 12 nt, Human
ccgguguucuaa

SEQ ID NO: 1351222 - RNA, 13 nt, Human
ccgguguucuaag

SEQ ID NO: 1351223 - RNA, 14 nt, Human
ccgguguucuaaga

SEQ ID NO: 1351224 - RNA, 11 nt, Human
ccguggaggcu

SEQ ID NO: 1351225 - RNA, 12 nt, Human
ccguggaggcug

SEQ ID NO: 1351226 - RNA, 14 nt, Human
ccguggaggcugcu

SEQ ID NO: 1351227 - RNA, 15 nt, Human
ccguggaggcugcuc

SEQ ID NO: 1351228 - RNA, 22 nt, Human
ccguggaggcugcucggggugc

SEQ ID NO: 1351229 - RNA, 19 nt, Human
ccguggauugcacguggcc

SEQ ID NO: 1351230 - RNA, 20 nt, Human
ccguggauugcacguggccu

SEQ ID NO: 1351231 - RNA, 22 nt, Human
ccguggauugcacguggccucu

SEQ ID NO: 1351232 - RNA, 23 nt, Human
ccguggauugcacguggccucuu

SEQ ID NO: 1351233 - RNA, 16 nt, Human
ccguggaggcugcucg

SEQ ID NO: 1351234 - RNA, 16 nt, Human
cccuucaucuggaacc

SEQ ID NO: 1351235 - RNA, 14 nt, Human
cccuucaucuggaa

SEQ ID NO: 1351236 - RNA, 19 nt, Human
cccuucaguacccucucag

SEQ ID NO: 1351237 - RNA, 20 nt, Human
cccuucaguacccucucagc

SEQ ID NO: 1351238 - RNA, 21 nt, Human
cccuucaguacccucucagcu

SEQ ID NO: 1351239 - RNA, 14 nt, Human
cccuguucacucua

SEQ ID NO: 1351240 - RNA, 22 nt, Human
cccuguucacucuacuuagcau

SEQ ID NO: 1351241 - RNA, 23 nt, Human
cccuguguugucucuagagcagg

SEQ ID NO: 1351242 - RNA, 17 nt, Human
cccuucaguacccucuc

SEQ ID NO: 1351243 - RNA, 23 nt, Human
cccuggugggccaacaaagaaca

SEQ ID NO: 1351244 - RNA, 13 nt, Human
cccuguucacucu

SEQ ID NO: 1351245 - RNA, 18 nt, Human
cccuguguugucucuaga

SEQ ID NO: 1351246 - RNA, 21 nt, Human
cccuguguugucucuagagca

SEQ ID NO: 1351247 - RNA, 13 nt, Human
cccuguguugucu

SEQ ID NO: 1351248 - RNA, 15 nt, Human
cccuguguugucucu

SEQ ID NO: 1351249 - RNA, 16 nt, Human
cccuguguugucucua

SEQ ID NO: 1351250 - RNA, 17 nt, Human
cccuguguugucucuag

SEQ ID NO: 1351251 - RNA, 16 nt, Human
cccuucaugcauggaa

SEQ ID NO: 1351252 - RNA, 11 nt, Human
cccuucauuug

SEQ ID NO: 1351253 - RNA, 14 nt, Human
cccuucccacagga

SEQ ID NO: 1351254 - RNA, 23 nt, Human
cccuucccacaggacauuucucu

SEQ ID NO: 1351255 - RNA, 13 nt, Human
cccuuccuaauuc

SEQ ID NO: 1351256 - RNA, 14 nt, Human
cccuuccuaauucc

SEQ ID NO: 1351257 - RNA, 19 nt, Human
cccuuccuaauuccacagc

SEQ ID NO: 1351258 - RNA, 20 nt, Human
cccuuccuaauuccacagcu

SEQ ID NO: 1351259 - RNA, 15 nt, Human
cccuuccgccacugg

SEQ ID NO: 1351260 - RNA, 16 nt, Human
cccuuccgccacuggg

SEQ ID NO: 1351261 - RNA, 15 nt, Human
cccuugacaccugcu

SEQ ID NO: 1351262 - RNA, 19 nt, Human
cccuugacaacuggcaggc

SEQ ID NO: 1351263 - RNA, 16 nt, Human
cccuuggacacgcuca

SEQ ID NO: 1351264 - RNA, 14 nt, Human
cccuuggacacgcu

SEQ ID NO: 1351265 - RNA, 21 nt, Human
cccuuccuaauuccacagcug

SEQ ID NO: 1351266 - RNA, 11 nt, Human
cccuucuuuuu

SEQ ID NO: 1351267 - RNA, 19 nt, Human
cccuucuuuuucuucuuuu

SEQ ID NO: 1351268 - RNA, 18 nt, Human
cccuuccgccacuggggc

SEQ ID NO: 1351269 - RNA, 12 nt, Human
cccuugaacucu

SEQ ID NO: 1351270 - RNA, 17 nt, Human
cccuugacaacuggcag

SEQ ID NO: 1351271 - RNA, 18 nt, Human
cccuugacaacuggcagg

SEQ ID NO: 1351272 - RNA, 21 nt, Human
cccuugacaacuggcaggcag

SEQ ID NO: 1351273 - RNA, 17 nt, Human
cccuuguagcuccuccc

SEQ ID NO: 1351274 - RNA, 18 nt, Human
cccuuguagcuccucccc

SEQ ID NO: 1351275 - RNA, 18 nt, Human
cccuuguauccccugcag

SEQ ID NO: 1351276 - RNA, 21 nt, Human
cccuuguagcuccuccccugg

SEQ ID NO: 1351277 - RNA, 23 nt, Human
cccuuguagcuccuccccuggag

SEQ ID NO: 1351278 - RNA, 21 nt, Human
cccuugugaaucaagggucag

SEQ ID NO: 1351279 - RNA, 20 nt, Human
cccuuguuuggggcaggagu

SEQ ID NO: 1351280 - RNA, 18 nt, Human
cccuuuagaucucugaag

SEQ ID NO: 1351281 - RNA, 15 nt, Human
cccuuucacaggcag

SEQ ID NO: 1351282 - RNA, 20 nt, Human
cccuuucacaggcagccagu

SEQ ID NO: 1351283 - RNA, 12 nt, Human
cccuuucccacc

SEQ ID NO: 1351284 - RNA, 14 nt, Human
cccuuucccacccc

SEQ ID NO: 1351285 - RNA, 14 nt, Human
ccuaaauggccuca

SEQ ID NO: 1351286 - RNA, 18 nt, Human
ccuaaauggccucaugug

SEQ ID NO: 1351287 - RNA, 13 nt, Human
ccuaaauuuaaaa

SEQ ID NO: 1351288 - RNA, 15 nt, Human
ccuaaauuauuuacu

SEQ ID NO: 1351289 - RNA, 20 nt, Human
ccuaaauuuuccuguccucu

SEQ ID NO: 1351290 - RNA, 22 nt, Human
ccuaaauuuuccuguccucuuu

SEQ ID NO: 1351291 - RNA, 21 nt, Human
ccuaacaacauuguagccuca

SEQ ID NO: 1351292 - RNA, 22 nt, Human
ccuaacaacauuguagccucaa

SEQ ID NO: 1351293 - RNA, 20 nt, Human
ccuacagaacuucagaaaga

SEQ ID NO: 1351294 - RNA, 21 nt, Human
ccuacagaaaaaccuuggguu

SEQ ID NO: 1351295 - RNA, 18 nt, Human
ccguuagcuccuguggcc

SEQ ID NO: 1351296 - RNA, 13 nt, Human
ccuaaacauauga

SEQ ID NO: 1351297 - RNA, 13 nt, Human
ccguuagcuccug

SEQ ID NO: 1351298 - RNA, 14 nt, Human
ccguuagcuccugu

SEQ ID NO: 1351299 - RNA, 15 nt, Human
ccguuagcuccugug

SEQ ID NO: 1351300 - RNA, 17 nt, Human
ccguuagcuccuguggc

SEQ ID NO: 1351301 - RNA, 18 nt, Human
ccguguuggucuguacug

SEQ ID NO: 1351302 - RNA, 19 nt, Human
ccguguuggucuguacuga

SEQ ID NO: 1351303 - RNA, 21 nt, Human
ccgugugguaagcaacauggc

SEQ ID NO: 1351304 - RNA, 23 nt, Human
ccgugugguaagcaacauggcuu

SEQ ID NO: 1351305 - RNA, 22 nt, Human
ccgugugguaagcaacauggcu

SEQ ID NO: 1351306 - RNA, 22 nt, Human
ccuagguauaauucacauugua

SEQ ID NO: 1351307 - RNA, 13 nt, Human
ccuagaccagcag

SEQ ID NO: 1351308 - RNA, 23 nt, Human
ccuagaccagcagacagagccag

SEQ ID NO: 1351309 - RNA, 19 nt, Human
ccuagacuggugcuaaugu

SEQ ID NO: 1351310 - RNA, 19 nt, Human
ccuagacuguaaaccucuc

SEQ ID NO: 1351311 - RNA, 17 nt, Human
ccuagaaacaacacugu

SEQ ID NO: 1351312 - RNA, 18 nt, Human
ccuagaaacaacacugua

SEQ ID NO: 1351313 - RNA, 19 nt, Human
ccuagaaacaacacuguag

SEQ ID NO: 1351314 - RNA, 20 nt, Human
ccuagaaacaacacuguagu

SEQ ID NO: 1351315 - RNA, 13 nt, Human
ccuacuuccccuu

SEQ ID NO: 1351316 - RNA, 13 nt, Human
ccuacuguucuaa

SEQ ID NO: 1351317 - RNA, 15 nt, Human
ccuacuguucuaaag

SEQ ID NO: 1351318 - RNA, 16 nt, Human
ccuacuguucuaaagc

SEQ ID NO: 1351319 - RNA, 19 nt, Human
ccuacuguucuaaagcucu

SEQ ID NO: 1351320 - RNA, 16 nt, Human
ccuacuuccccuuccu

SEQ ID NO: 1351321 - RNA, 21 nt, Human
ccuacuuccccuuccuaauuc

SEQ ID NO: 1351322 - RNA, 22 nt, Human
ccuacuguucuaaagcucugac

SEQ ID NO: 1351323 - RNA, 23 nt, Human
ccuacuguucuaaagcucugaca

SEQ ID NO: 1351324 - RNA, 15 nt, Human
ccuacaguuuuaacu

SEQ ID NO: 1351325 - RNA, 17 nt, Human
ccuacaguuuuaacugu

SEQ ID NO: 1351326 - RNA, 19 nt, Human
ccuacaguuuuaacugugg

SEQ ID NO: 1351327 - RNA, 20 nt, Human
ccuacaguuuuaacugugga

SEQ ID NO: 1351328 - RNA, 21 nt, Human
ccuacaguuuuaacuguggau

SEQ ID NO: 1351329 - RNA, 22 nt, Human
ccuacaguuuuaacuguggaua

SEQ ID NO: 1351330 - RNA, 19 nt, Human
ccuacaugaaacagaaaca

SEQ ID NO: 1351331 - RNA, 20 nt, Human
ccuacugcccaggcacugca

SEQ ID NO: 1351332 - RNA, 16 nt, Human
ccuacugcccaggcac

SEQ ID NO: 1351333 - RNA, 16 nt, Human
ccuacuggucucucua

SEQ ID NO: 1351334 - RNA, 18 nt, Human
cccugccucucugcaggu

SEQ ID NO: 1351335 - RNA, 11 nt, Human
cccugccucuc

SEQ ID NO: 1351336 - RNA, 20 nt, Human
cccugcccacccucuggaga

SEQ ID NO: 1351337 - RNA, 14 nt, Human
cccugccagggcag

SEQ ID NO: 1351338 - RNA, 12 nt, Human
cccugccagggc

SEQ ID NO: 1351339 - RNA, 18 nt, Human
cccugccaccuccugccu

SEQ ID NO: 1351340 - RNA, 22 nt, Human
cccugccaggagcuuuggaccu

SEQ ID NO: 1351341 - RNA, 17 nt, Human
cccugccaccuccugcc

SEQ ID NO: 1351342 - RNA, 14 nt, Human
cccugccaccuccu

SEQ ID NO: 1351343 - RNA, 15 nt, Human
cccugccaccaggcc

SEQ ID NO: 1351344 - RNA, 21 nt, Human
cccugcauuggaacuggaggc

SEQ ID NO: 1351345 - RNA, 22 nt, Human
cccugcauuggaacuggaggca

SEQ ID NO: 1351346 - RNA, 23 nt, Human
cccugcauuggaacuggaggcag

SEQ ID NO: 1351347 - RNA, 14 nt, Human
cccugccaccaggc

SEQ ID NO: 1351348 - RNA, 18 nt, Human
cccugcaaaaggacucuc

SEQ ID NO: 1351349 - RNA, 20 nt, Human
cccugcaaaaggacucucag

SEQ ID NO: 1351350 - RNA, 23 nt, Human
cccugcagaaccggagagccagc

SEQ ID NO: 1351351 - RNA, 13 nt, Human
cccugcagacccu

SEQ ID NO: 1351352 - RNA, 14 nt, Human
cccugcagacccug

SEQ ID NO: 1351353 - RNA, 15 nt, Human
cccugcagacccugc

SEQ ID NO: 1351354 - RNA, 16 nt, Human
cccugcagacccugcc

SEQ ID NO: 1351355 - RNA, 17 nt, Human
cccugcagacccugccc

SEQ ID NO: 1351356 - RNA, 19 nt, Human
cccugcagacccugcccuu

SEQ ID NO: 1351357 - RNA, 13 nt, Human
cccuccgcccugc

SEQ ID NO: 1351358 - RNA, 18 nt, Human
cccucuacagagcuuccc

SEQ ID NO: 1351359 - RNA, 21 nt, Human
cccucuacagagcuucccuga

SEQ ID NO: 1351360 - RNA, 23 nt, Human
cccucuaguuuuuucuuccuuuu

SEQ ID NO: 1351361 - RNA, 13 nt, Human
cccucucaccaaa

SEQ ID NO: 1351362 - RNA, 17 nt, Human
cccucucaacacccagu

SEQ ID NO: 1351363 - RNA, 12 nt, Human
cccucucagccc

SEQ ID NO: 1351364 - RNA, 14 nt, Human
cccucucagcccuc

SEQ ID NO: 1351365 - RNA, 15 nt, Human
cccucucagcccuca

SEQ ID NO: 1351366 - RNA, 18 nt, Human
cccucucagcccucacac

SEQ ID NO: 1351367 - RNA, 13 nt, Human
cccucucagcucc

SEQ ID NO: 1351368 - RNA, 14 nt, Human
cccucucagcucca

SEQ ID NO: 1351369 - RNA, 17 nt, Human
cccucucagcuccaggu

SEQ ID NO: 1351370 - RNA, 14 nt, Human
cccugaucccagag

SEQ ID NO: 1351371 - RNA, 17 nt, Human
cccugaucccagagagc

SEQ ID NO: 1351372 - RNA, 20 nt, Human
cccugaucccagagagcccg

SEQ ID NO: 1351373 - RNA, 21 nt, Human
cccugauuuaggagaagccag

SEQ ID NO: 1351374 - RNA, 23 nt, Human
cccugauuuaggagaagccagga

SEQ ID NO: 1351375 - RNA, 22 nt, Human
cccugccucucugcaggucccu

SEQ ID NO: 1351376 - RNA, 21 nt, Human
cccugccucucugcagguccc

SEQ ID NO: 1351377 - RNA, 22 nt, Human
cccugccucucaucaacugaau

SEQ ID NO: 1351378 - RNA, 12 nt, Human
cccugccucuca

SEQ ID NO: 1351379 - RNA, 13 nt, Human
cccugccuggagg

SEQ ID NO: 1351380 - RNA, 14 nt, Human
cccugccuggagga

SEQ ID NO: 1351381 - RNA, 15 nt, Human
cccugccuggaggac

SEQ ID NO: 1351382 - RNA, 16 nt, Human
cccugccuggaggacc

SEQ ID NO: 1351383 - RNA, 17 nt, Human
cccugccuggaggaccu

SEQ ID NO: 1351384 - RNA, 18 nt, Human
cccugccuggaggaccug

SEQ ID NO: 1351385 - RNA, 19 nt, Human
cccugccuggaggaccuga

SEQ ID NO: 1351386 - RNA, 21 nt, Human
cccugccuggaggaccugagc

SEQ ID NO: 1351387 - RNA, 12 nt, Human
cccugccuggac

SEQ ID NO: 1351388 - RNA, 13 nt, Human
cccugccuggacc

SEQ ID NO: 1351389 - RNA, 18 nt, Human
cccugccuggaccagccu

SEQ ID NO: 1351390 - RNA, 10 nt, Human
cccugccugg

SEQ ID NO: 1351391 - RNA, 11 nt, Human
cccugccugga

SEQ ID NO: 1351392 - RNA, 12 nt, Human
cccugccuggag

SEQ ID NO: 1351393 - RNA, 22 nt, Human
cccuggaaaccuuccacccagu

SEQ ID NO: 1351394 - RNA, 15 nt, Human
cccuggaacugucuc

SEQ ID NO: 1351395 - RNA, 18 nt, Human
cccuggaacugucucuca

SEQ ID NO: 1351396 - RNA, 21 nt, Human
cccuggaaaccuuccacccag

SEQ ID NO: 1351397 - RNA, 19 nt, Human
cccuggaaaccuuccaccc

SEQ ID NO: 1351398 - RNA, 16 nt, Human
cccuggaaaccuucca

SEQ ID NO: 1351399 - RNA, 15 nt, Human
cccuggaaaccuucc

SEQ ID NO: 1351400 - RNA, 10 nt, Human
cccugcuuuu

SEQ ID NO: 1351401 - RNA, 17 nt, Human
cccuggacuugccucug

SEQ ID NO: 1351402 - RNA, 23 nt, Human
cccugcuuugggcugcccuggug

SEQ ID NO: 1351403 - RNA, 17 nt, Human
cccugcuuugggcuugg

SEQ ID NO: 1351404 - RNA, 18 nt, Human
cccugcuuugggcuuggg

SEQ ID NO: 1351405 - RNA, 22 nt, Human
cccugcuuugggcuugggccua

SEQ ID NO: 1351406 - RNA, 22 nt, Human
cccugccuggaggaccugagcc

SEQ ID NO: 1351407 - RNA, 23 nt, Human
cccugccuggaggaccugagccu

SEQ ID NO: 1351408 - RNA, 24 nt, Human
cccugccuggaggaccugagccug

SEQ ID NO: 1351409 - RNA, 18 nt, Human
cccugggaggcucuggag

SEQ ID NO: 1351410 - RNA, 17 nt, Human
cccugggaggcucugga

SEQ ID NO: 1351411 - RNA, 15 nt, Human
cccuggaggcaccug

SEQ ID NO: 1351412 - RNA, 21 nt, Human
cccuggagggggaauggcagc

SEQ ID NO: 1351413 - RNA, 23 nt, Human
cccugggagggacaugcuuagca

SEQ ID NO: 1351414 - RNA, 18 nt, Human
cccugggagggacaugcu

SEQ ID NO: 1351415 - RNA, 17 nt, Human
cccugggauucaggaaa

SEQ ID NO: 1351416 - RNA, 21 nt, Human
cccuggggccuguacugccug

SEQ ID NO: 1351417 - RNA, 22 nt, Human
cccuggggccuguacugccugc

SEQ ID NO: 1351418 - RNA, 16 nt, Human
cccugggaggcucugg

SEQ ID NO: 1351419 - RNA, 19 nt, Human
cccuggaggcacugaagug

SEQ ID NO: 1351420 - RNA, 20 nt, Human
cccugguggcccucuccccu

SEQ ID NO: 1351421 - RNA, 21 nt, Human
cccugguggcccucuccccug

SEQ ID NO: 1351422 - RNA, 22 nt, Human
cccugguggcccucuccccugc

SEQ ID NO: 1351423 - RNA, 16 nt, Human
cccuggugggccaaca

SEQ ID NO: 1351424 - RNA, 17 nt, Human
cccuggugcugccacac

SEQ ID NO: 1351425 - RNA, 21 nt, Human
cccuggugcugccacacuuca

SEQ ID NO: 1351426 - RNA, 23 nt, Human
cccuggggccuguacugccugcu

SEQ ID NO: 1351427 - RNA, 17 nt, Human
cccugggguggccacca

SEQ ID NO: 1351428 - RNA, 23 nt, Human
cccuggguagcgggggaggguag

SEQ ID NO: 1351429 - RNA, 12 nt, Human
cccucaugcugu

SEQ ID NO: 1351430 - RNA, 14 nt, Human
cccucaucuuucuu

SEQ ID NO: 1351431 - RNA, 17 nt, Human
cccucaucucucugccc

SEQ ID NO: 1351432 - RNA, 13 nt, Human
cccucaucugucc

SEQ ID NO: 1351433 - RNA, 14 nt, Human
cccucaucuguccc

SEQ ID NO: 1351434 - RNA, 22 nt, Human
cccucauuccaccuucccaugc

SEQ ID NO: 1351435 - RNA, 16 nt, Human
cccucauggccccucu

SEQ ID NO: 1351436 - RNA, 17 nt, Human
cccucauggccccucug

SEQ ID NO: 1351437 - RNA, 21 nt, Human
cccucauggccccucugaccu

SEQ ID NO: 1351438 - RNA, 13 nt, Human
cccucauagcccu

SEQ ID NO: 1351439 - RNA, 15 nt, Human
cccucauagcccuca

SEQ ID NO: 1351440 - RNA, 19 nt, Human
cccucagggcaaagccagg

SEQ ID NO: 1351441 - RNA, 20 nt, Human
cccucagggcaaagccaggu

SEQ ID NO: 1351442 - RNA, 21 nt, Human
cccucagggcaaagccagguc

SEQ ID NO: 1351443 - RNA, 19 nt, Human
cccucaguagucccugcac

SEQ ID NO: 1351444 - RNA, 19 nt, Human
cccucauagcccucacccu

SEQ ID NO: 1351445 - RNA, 16 nt, Human
cccucaucaaggacac

SEQ ID NO: 1351446 - RNA, 19 nt, Human
cccucaucaaggacacggg

SEQ ID NO: 1351447 - RNA, 17 nt, Human
cccucaucccgagcacc

SEQ ID NO: 1351448 - RNA, 15 nt, Human
cccuccagcucccug

SEQ ID NO: 1351449 - RNA, 12 nt, Human
cccuccaucccu

SEQ ID NO: 1351450 - RNA, 13 nt, Human
cccuccaucccug

SEQ ID NO: 1351451 - RNA, 14 nt, Human
cccuccaucccugg

SEQ ID NO: 1351452 - RNA, 13 nt, Human
cccuccacaccug

SEQ ID NO: 1351453 - RNA, 17 nt, Human
cccuccacaccugcggc

SEQ ID NO: 1351454 - RNA, 15 nt, Human
cccuccacaccugcg

SEQ ID NO: 1351455 - RNA, 19 nt, Human
cccuccaucuaaacugccc

SEQ ID NO: 1351456 - RNA, 17 nt, Human
cccuccaucccuggccc

SEQ ID NO: 1351457 - RNA, 22 nt, Human
cccuccaucccuggcccccucc

SEQ ID NO: 1351458 - RNA, 13 nt, Human
cccucccccugag

SEQ ID NO: 1351459 - RNA, 14 nt, Human
cccucccccugcca

SEQ ID NO: 1351460 - RNA, 12 nt, Human
cccucccccuug

SEQ ID NO: 1351461 - RNA, 13 nt, Human
cccucccccuugu

SEQ ID NO: 1351462 - RNA, 15 nt, Human
cccucccccuugucc

SEQ ID NO: 1351463 - RNA, 16 nt, Human
cccuccccgcaccccc

SEQ ID NO: 1351464 - RNA, 17 nt, Human
cccuccccgcacccccc

SEQ ID NO: 1351465 - RNA, 19 nt, Human
cccucccuguuccccagag

SEQ ID NO: 1351466 - RNA, 14 nt, Human
cccucccuucaacc

SEQ ID NO: 1351467 - RNA, 20 nt, Human
cccucccuguuccccagaga

SEQ ID NO: 1351468 - RNA, 18 nt, Human
cccuccccuccaucccug

SEQ ID NO: 1351469 - RNA, 18 nt, Human
cccuaauaaagcugugug

SEQ ID NO: 1351470 - RNA, 15 nt, Human
cccuaauaaagcugu

SEQ ID NO: 1351471 - RNA, 12 nt, Human
cccuaagccagc

SEQ ID NO: 1351472 - RNA, 18 nt, Human
cccuaagccagcugcccc

SEQ ID NO: 1351473 - RNA, 17 nt, Human
cccuaagccagcugccc

SEQ ID NO: 1351474 - RNA, 15 nt, Human
cccuaaucuaugguc

SEQ ID NO: 1351475 - RNA, 19 nt, Human
cccuacuucuuuugcucuu

SEQ ID NO: 1351476 - RNA, 18 nt, Human
cccuacuucuuuugcucu

SEQ ID NO: 1351477 - RNA, 17 nt, Human
cccuagaaacuuccaaa

SEQ ID NO: 1351478 - RNA, 14 nt, Human
cccuaauaaagcug

SEQ ID NO: 1351479 - RNA, 13 nt, Human
cccuaauaaagcu

SEQ ID NO: 1351480 - RNA, 12 nt, Human
cccuaauaaagc

SEQ ID NO: 1351481 - RNA, 14 nt, Human
cccuaacccuuugu

SEQ ID NO: 1351482 - RNA, 14 nt, Human
cccuaagagagcac

SEQ ID NO: 1351483 - RNA, 18 nt, Human
cccuaagagagcaccugg

SEQ ID NO: 1351484 - RNA, 16 nt, Human
cccuaagcagaaagug

SEQ ID NO: 1351485 - RNA, 20 nt, Human
cccuaagcagaaagugccuu

SEQ ID NO: 1351486 - RNA, 21 nt, Human
cccuaagcagaaagugccuuu

SEQ ID NO: 1351487 - RNA, 10 nt, Human
cccucagggc

SEQ ID NO: 1351488 - RNA, 16 nt, Human
cccucagggcaaagcc

SEQ ID NO: 1351489 - RNA, 18 nt, Human
cccucagggcaaagccag

SEQ ID NO: 1351490 - RNA, 14 nt, Human
cccuagagucccag

SEQ ID NO: 1351491 - RNA, 15 nt, Human
cccuaaccaaguucc

SEQ ID NO: 1351492 - RNA, 19 nt, Human
cccuaaauaauaaaaauaa

SEQ ID NO: 1351493 - RNA, 13 nt, Human
cccuaaagccuca

SEQ ID NO: 1351494 - RNA, 20 nt, Human
cccuaaaagaaacccugcac

SEQ ID NO: 1351495 - RNA, 13 nt, Human
cccguuuugucac

SEQ ID NO: 1351496 - RNA, 15 nt, Human
cccgugccaagucca

SEQ ID NO: 1351497 - RNA, 21 nt, Human
cccgugccaaguccagguccu

SEQ ID NO: 1351498 - RNA, 22 nt, Human
cccgugccaaguccagguccug

SEQ ID NO: 1351499 - RNA, 17 nt, Human
cccguggaggcugcucg

SEQ ID NO: 1351500 - RNA, 13 nt, Human
cccguggaggcug

SEQ ID NO: 1351501 - RNA, 12 nt, Human
cccguuucucca

SEQ ID NO: 1351502 - RNA, 16 nt, Human
cccguuucuccaccua

SEQ ID NO: 1351503 - RNA, 14 nt, Human
cccguuucuggugg

SEQ ID NO: 1351504 - RNA, 19 nt, Human
cccggcacccccugcagcu

SEQ ID NO: 1351505 - RNA, 18 nt, Human
cccggcacccccugcagc

SEQ ID NO: 1351506 - RNA, 12 nt, Human
cccggcagggcg

SEQ ID NO: 1351507 - RNA, 14 nt, Human
cccggcagggcggg

SEQ ID NO: 1351508 - RNA, 21 nt, Human
cccggcagggcgggcagaggg

SEQ ID NO: 1351509 - RNA, 17 nt, Human
cccggaggggccuggca

SEQ ID NO: 1351510 - RNA, 18 nt, Human
cccggaggggccuggcag

SEQ ID NO: 1351511 - RNA, 19 nt, Human
cccggaauuccgucaccac

SEQ ID NO: 1351512 - RNA, 20 nt, Human
cccggacgcccaggacccca

SEQ ID NO: 1351513 - RNA, 23 nt, Human
cccggagaagugugccuucucuc

SEQ ID NO: 1351514 - RNA, 18 nt, Human
cccggagguugggugggc

SEQ ID NO: 1351515 - RNA, 19 nt, Human
cccggaggcggugggccug

SEQ ID NO: 1351516 - RNA, 11 nt, Human
cccggcacccc

SEQ ID NO: 1351517 - RNA, 13 nt, Human
cccggcacccccu

SEQ ID NO: 1351518 - RNA, 15 nt, Human
cccggcacccccugc

SEQ ID NO: 1351519 - RNA, 16 nt, Human
cccggcacccccugca

SEQ ID NO: 1351520 - RNA, 17 nt, Human
cccggcacccccugcag

SEQ ID NO: 1351521 - RNA, 22 nt, Human
ccccagcuggggccaggcuggg

SEQ ID NO: 1351522 - RNA, 21 nt, Human
ccccagcuggggccaggcugg

SEQ ID NO: 1351523 - RNA, 15 nt, Human
ccccagccugggccu

SEQ ID NO: 1351524 - RNA, 11 nt, Human
ccccagccugg

SEQ ID NO: 1351525 - RNA, 12 nt, Human
ccccagccuggg

SEQ ID NO: 1351526 - RNA, 13 nt, Human
ccccagccugggc

SEQ ID NO: 1351527 - RNA, 16 nt, Human
ccccagccugggccua

SEQ ID NO: 1351528 - RNA, 16 nt, Human
ccccagcccccuaaga

SEQ ID NO: 1351529 - RNA, 19 nt, Human
ccccagcccuccuuaucaa

SEQ ID NO: 1351530 - RNA, 18 nt, Human
ccccaggaccagcucagg

SEQ ID NO: 1351531 - RNA, 19 nt, Human
ccccaggaccagcucagga

SEQ ID NO: 1351532 - RNA, 21 nt, Human
ccccaggaccagcucaggaca

SEQ ID NO: 1351533 - RNA, 15 nt, Human
ccccaggaccuggcu

SEQ ID NO: 1351534 - RNA, 17 nt, Human
ccccaggaccuggcugc

SEQ ID NO: 1351535 - RNA, 20 nt, Human
ccccaggaccuggcugccau

SEQ ID NO: 1351536 - RNA, 21 nt, Human
ccccaggaccuggcugccaua

SEQ ID NO: 1351537 - RNA, 22 nt, Human
ccccagcugucaucaauuaaag

SEQ ID NO: 1351538 - RNA, 12 nt, Human
ccccagggcagc

SEQ ID NO: 1351539 - RNA, 15 nt, Human
ccccagggcagccag

SEQ ID NO: 1351540 - RNA, 16 nt, Human
ccccagggcagccagg

SEQ ID NO: 1351541 - RNA, 22 nt, Human
ccccagggcagccagggagagc

SEQ ID NO: 1351542 - RNA, 22 nt, Human
ccccagggcuguaacugccagg

SEQ ID NO: 1351543 - RNA, 16 nt, Human
ccccaggguccuggga

SEQ ID NO: 1351544 - RNA, 17 nt, Human
ccccaggguccugggag

SEQ ID NO: 1351545 - RNA, 20 nt, Human
ccccaggguccugggaggag

SEQ ID NO: 1351546 - RNA, 18 nt, Human
ccccaggguccugggagg

SEQ ID NO: 1351547 - RNA, 20 nt, Human
ccccagguaggggccccucu

SEQ ID NO: 1351548 - RNA, 23 nt, Human
ccccagguaggggccccucucag

SEQ ID NO: 1351549 - RNA, 17 nt, Human
ccccagguccagcucug

SEQ ID NO: 1351550 - RNA, 21 nt, Human
ccccagguccagcucuggagg

SEQ ID NO: 1351551 - RNA, 22 nt, Human
ccccagguccagcucuggaggg

SEQ ID NO: 1351552 - RNA, 11 nt, Human
ccccuguacac

SEQ ID NO: 1351553 - RNA, 16 nt, Human
ccccuguacacaacuc

SEQ ID NO: 1351554 - RNA, 15 nt, Human
ccccuguaggccuca

SEQ ID NO: 1351555 - RNA, 23 nt, Human
ccccuggcuuuucacugcuggcu

SEQ ID NO: 1351556 - RNA, 14 nt, Human
ccccuuaccacugc

SEQ ID NO: 1351557 - RNA, 19 nt, Human
ccccuguuuauucauaugc

SEQ ID NO: 1351558 - RNA, 13 nt, Human
ccccuuagacaga

SEQ ID NO: 1351559 - RNA, 17 nt, Human
ccccuuagacagaggcc

SEQ ID NO: 1351560 - RNA, 24 nt, Human
ccccuuagacagaggcccucaagu

SEQ ID NO: 1351561 - RNA, 14 nt, Human
ccccuuauccuccc

SEQ ID NO: 1351562 - RNA, 15 nt, Human
ccccuuauccucccu

SEQ ID NO: 1351563 - RNA, 18 nt, Human
ccccuuauccucccugua

SEQ ID NO: 1351564 - RNA, 17 nt, Human
ccccuuauccucccugu

SEQ ID NO: 1351565 - RNA, 12 nt, Human
ccccuucccccu

SEQ ID NO: 1351566 - RNA, 14 nt, Human
ccccuuccgccacu

SEQ ID NO: 1351567 - RNA, 16 nt, Human
ccccuuccgccacugg

SEQ ID NO: 1351568 - RNA, 17 nt, Human
ccccuuccgccacuggg

SEQ ID NO: 1351569 - RNA, 20 nt, Human
ccccuuccuaauuccacagc

SEQ ID NO: 1351570 - RNA, 21 nt, Human
ccccuuccuaauuccacagcu

SEQ ID NO: 1351571 - RNA, 22 nt, Human
ccccuuccuaauuccacagcug

SEQ ID NO: 1351572 - RNA, 19 nt, Human
cccgcucagcccucccugc

SEQ ID NO: 1351573 - RNA, 17 nt, Human
cccgccugcccucaugg

SEQ ID NO: 1351574 - RNA, 12 nt, Human
cccgccuuggcc

SEQ ID NO: 1351575 - RNA, 13 nt, Human
cccgccuuggccu

SEQ ID NO: 1351576 - RNA, 14 nt, Human
cccgccuuggccug

SEQ ID NO: 1351577 - RNA, 17 nt, Human
cccgcgauguggaacug

SEQ ID NO: 1351578 - RNA, 22 nt, Human
cccgcgauguggaacugcugcc

SEQ ID NO: 1351579 - RNA, 23 nt, Human
cccgcgauguggaacugcugcca

SEQ ID NO: 1351580 - RNA, 23 nt, Human
cccgcucagcccucccugccccu

SEQ ID NO: 1351581 - RNA, 13 nt, Human
cccgcucaggcug

SEQ ID NO: 1351582 - RNA, 21 nt, Human
cccgcucuacaucuucugccu

SEQ ID NO: 1351583 - RNA, 19 nt, Human
cccgaggaggugucucagg

SEQ ID NO: 1351584 - RNA, 21 nt, Human
cccgaggaggugucucaggcu

SEQ ID NO: 1351585 - RNA, 14 nt, Human
cccgauuguaacuc

SEQ ID NO: 1351586 - RNA, 12 nt, Human
cccgcacaccug

SEQ ID NO: 1351587 - RNA, 13 nt, Human
cccgccugcccuc

SEQ ID NO: 1351588 - RNA, 14 nt, Human
cccgccugcccuca

SEQ ID NO: 1351589 - RNA, 19 nt, Human
cccgcaccccccaagcugu

SEQ ID NO: 1351590 - RNA, 15 nt, Human
ugggucugggaguca

SEQ ID NO: 1351591 - RNA, 19 nt, Human
ggcuuauaauaaaggacug

SEQ ID NO: 1351592 - RNA, 18 nt, Human
ggcuugaauaaggaaaug

SEQ ID NO: 1351593 - RNA, 13 nt, Human
uccugaagccaca

SEQ ID NO: 1351594 - RNA, 21 nt, Human
guggaacauaaaaaggacauc

SEQ ID NO: 1351595 - RNA, 20 nt, Human
gacuucaucccaaaggacag

SEQ ID NO: 1351596 - RNA, 15 nt, Human
gacuuauaguacaug

SEQ ID NO: 1351597 - RNA, 19 nt, Human
gcacucaggugacauccuc

SEQ ID NO: 1351598 - RNA, 16 nt, Human
gcugacuuacaucaug

SEQ ID NO: 1351599 - RNA, 22 nt, Human
ggaugaagggcccgagaacaug

SEQ ID NO: 1351600 - RNA, 23 nt, Human
ggcugaggcuggcacaggacaug

SEQ ID NO: 1351601 - RNA, 16 nt, Human
ggcuggagaggacaag

SEQ ID NO: 1351602 - RNA, 16 nt, Human
uccauguagaagccac

SEQ ID NO: 1351603 - RNA, 17 nt, Human
ggcugagucaggacuug

SEQ ID NO: 1351604 - RNA, 23 nt, Human
uggaggcccaggcugggaacuca

SEQ ID NO: 1351605 - RNA, 21 nt, Hepatitis C virus
cuucuuuaaugguggcuccau

SEQ ID NO: 1351606 - RNA, 22 nt, Hepatitis C virus
gcugugaaagguccgugagccg

SEQ ID NO: 1351607 - RNA, 16 nt, Hepatitis C virus
gagccgcaugacugca

SEQ ID NO: 1351608 - RNA, 21 nt, Hepatitis C virus
gagagugcugauacuggccuc

SEQ ID NO: 1351609 - RNA, 23 nt, Hepatitis C virus
gcagagagugcugauacuggccu

SEQ ID NO: 1351610 - RNA, 22 nt, Hepatitis C virus
uccuucuuuaaugguggcucca

SEQ ID NO: 1351611 - RNA, 23 nt, Hepatitis C virus
gcccuagucacggcuagcuguga

SEQ ID NO: 1351612 - RNA, 18 nt, Hepatitis C virus
ccuucuuuaaugguggcu

SEQ ID NO: 1351613 - RNA, 19 nt, Hepatitis C virus
gauacuggccucucugcag

SEQ ID NO: 1351614 - RNA, 16 nt, Hepatitis C virus
ugagccgcaugacugc

SEQ ID NO: 1351615 - RNA, 19 nt, Hepatitis C virus
guaaacacuccggccucuu

SEQ ID NO: 1351616 - RNA, 18 nt, Hepatitis C virus
acugcagagagugcugau

SEQ ID NO: 1351617 - RNA, 20 nt, Hepatitis C virus
gccucuuaggccauuuccug

SEQ ID NO: 1351618 - RNA, 20 nt, Hepatitis C virus
cugcagagagugcugauacu

SEQ ID NO: 1351619 - RNA, 15 nt, Hepatitis C virus
uuaaugguggcucca

SEQ ID NO: 1351620 - RNA, 20 nt, Hepatitis C virus
uuaggccauuuccuguuuuu

SEQ ID NO: 1351621 - RNA, 19 nt, Hepatitis C virus
ugaaagguccgugagccgc

SEQ ID NO: 1351622 - RNA, 13 nt, Hepatitis C virus
gccucucugcaga

SEQ ID NO: 1351623 - RNA, 12 nt, Hepatitis C virus
ggcuagcuguga

SEQ ID NO: 1351624 - RNA, 23 nt, Hepatitis C virus
agccgcaugacugcagagagugc

SEQ ID NO: 1351625 - RNA, 13 nt, Hepatitis C virus
auacuggccucuc

SEQ ID NO: 1351626 - RNA, 15 nt, Hepatitis C virus
gcuccaucuuagccc

SEQ ID NO: 1351627 - RNA, 13 nt, Hepatitis C virus
ccucucugcagau

SEQ ID NO: 1351628 - RNA, 18 nt, Hepatitis C virus
cuuucuuuuccuuccuuc

SEQ ID NO: 1351629 - RNA, 22 nt, Hepatitis C virus
cagagagugcugauacuggccu

SEQ ID NO: 1351630 - RNA, 23 nt, Hepatitis C virus
cugugaaagguccgugagccgca

SEQ ID NO: 1351631 - RNA, 16 nt, Hepatitis C virus
gugcugauacuggccu

SEQ ID NO: 1351632 - RNA, 12 nt, Hepatitis C virus
cuuuuccuuccu

SEQ ID NO: 1351633 - RNA, 13 nt, Hepatitis C virus
cuuuccuucuuuu

SEQ ID NO: 1351634 - RNA, 12 nt, Hepatitis C virus
aggccauuuccu

SEQ ID NO: 1351635 - RNA, 18 nt, Hepatitis C virus
aacacuccggccucuuag

SEQ ID NO: 1351636 - RNA, 19 nt, Hepatitis C virus
gugcugauacuggccucuc

SEQ ID NO: 1351637 - RNA, 13 nt, Hepatitis C virus
caugacugcagag

SEQ ID NO: 1351638 - RNA, 13 nt, Hepatitis C virus
gccgcaugacugc

SEQ ID NO: 1351639 - RNA, 15 nt, Hepatitis C virus
ccuuccuucuuuaau

SEQ ID NO: 1351640 - RNA, 22 nt, Hepatitis C virus
gagagugcugauacuggccucu

SEQ ID NO: 1351641 - RNA, 17 nt, Hepatitis C virus
agagugcugauacuggc

SEQ ID NO: 1351642 - RNA, 19 nt, Hepatitis C virus
agucacggcuagcugugaa

SEQ ID NO: 1351643 - RNA, 22 nt, Hepatitis C virus
gcugauacuggccucucugcag

SEQ ID NO: 1351644 - RNA, 19 nt, Hepatitis C virus
agagugcugauacuggccu

SEQ ID NO: 1351645 - RNA, 13 nt, Hepatitis C virus
ccuuccuucuuua

SEQ ID NO: 1351646 - RNA, 15 nt, Hepatitis C virus
acggcuagcugugaa

SEQ ID NO: 1351647 - RNA, 12 nt, Hepatitis C virus
gccauuuccugu

SEQ ID NO: 1351648 - RNA, 23 nt, Hepatitis C virus
ugagccgcaugacugcagagagu

SEQ ID NO: 1351649 - RNA, 20 nt, Hepatitis C virus
cugugaaagguccgugagcc

SEQ ID NO: 1351650 - RNA, 14 nt, Hepatitis C virus
aaacacuccggccu

SEQ ID NO: 1351651 - RNA, 16 nt, Hepatitis C virus
cuggccucucugcaga

SEQ ID NO: 1351652 - RNA, 19 nt, Hepatitis C virus
acuggccucucugcagauc

SEQ ID NO: 1351653 - RNA, 14 nt, Hepatitis C virus
gcuccaucuuagcc

SEQ ID NO: 1351654 - RNA, 14 nt, Hepatitis C virus
cacuccggccucuu

SEQ ID NO: 1351655 - RNA, 12 nt, Hepatitis C virus
cggcuagcugug

SEQ ID NO: 1351656 - RNA, 11 nt, Hepatitis C virus
ugguggcucca

SEQ ID NO: 1351657 - RNA, 19 nt, Hepatitis C virus
caugacugcagagagugcu

SEQ ID NO: 1351658 - RNA, 16 nt, Human
aaaaaauguauaugca

SEQ ID NO: 1351659 - RNA, 11 nt, Human
aaaaacuauuu

SEQ ID NO: 1351660 - RNA, 19 nt, Human
aaaaacuacaaccaaugga

SEQ ID NO: 1351661 - RNA, 17 nt, Human
aaaaacuaaaaacuaga

SEQ ID NO: 1351662 - RNA, 14 nt, Human
aaaaacuaaaaacu

SEQ ID NO: 1351663 - RNA, 13 nt, Human
aaaaaccuugggu

SEQ ID NO: 1351664 - RNA, 12 nt, Human
aaaaaccuuggg

SEQ ID NO: 1351665 - RNA, 23 nt, Human
aaaaaccugagauuuauuaaaga

SEQ ID NO: 1351666 - RNA, 22 nt, Human
aaaaaccugagauuuauuaaag

SEQ ID NO: 1351667 - RNA, 18 nt, Human
aaaaaccugagauuuauu

SEQ ID NO: 1351668 - RNA, 18 nt, Human
aaaaacagauuuggaaag

SEQ ID NO: 1351669 - RNA, 12 nt, Human
aaaaaaugguuc

SEQ ID NO: 1351670 - RNA, 14 nt, Human
aacuuuaucacuua

SEQ ID NO: 1351671 - RNA, 18 nt, Human
aacuuaaucuaaauggaa

SEQ ID NO: 1351672 - RNA, 15 nt, Human
aacuuaaucuaaaug

SEQ ID NO: 1351673 - RNA, 16 nt, Human
aacuuaaucuaaaugg

SEQ ID NO: 1351674 - RNA, 20 nt, Human
aacugaggaauuuucuuugu

SEQ ID NO: 1351675 - RNA, 18 nt, Human
aacugaggaauuuucuuu

SEQ ID NO: 1351676 - RNA, 18 nt, Human
aacugagauccuuccuuu

SEQ ID NO: 1351677 - RNA, 14 nt, Human
aacugauaaagaug

SEQ ID NO: 1351678 - RNA, 21 nt, Human
aacuuaaauguuauuaucugg

SEQ ID NO: 1351679 - RNA, 19 nt, Human
aacuuaaauguuauuaucu

SEQ ID NO: 1351680 - RNA, 15 nt, Human
aacuuaaauguuauu

SEQ ID NO: 1351681 - RNA, 19 nt, Human
aacuuaaauuuuaguucuu

SEQ ID NO: 1351682 - RNA, 23 nt, Human
aacugacuauucuugauguaaaa

SEQ ID NO: 1351683 - RNA, 22 nt, Human
aacugacuauucuugauguaaa

SEQ ID NO: 1351684 - RNA, 20 nt, Human
aacugacuauucuugaugua

SEQ ID NO: 1351685 - RNA, 20 nt, Human
aacugacucuuaagaagacu

SEQ ID NO: 1351686 - RNA, 19 nt, Human
aacugacucuuaagaagac

SEQ ID NO: 1351687 - RNA, 22 nt, Human
aacucagauccagggacagagg

SEQ ID NO: 1351688 - RNA, 15 nt, Human
aacucagauccaggg

SEQ ID NO: 1351689 - RNA, 14 nt, Human
aacucagauccagg

SEQ ID NO: 1351690 - RNA, 13 nt, Human
aacucagauccag

SEQ ID NO: 1351691 - RNA, 12 nt, Human
aacucagaucca

SEQ ID NO: 1351692 - RNA, 18 nt, Human
aacugacucuuaagaaga

SEQ ID NO: 1351693 - RNA, 15 nt, Human
aacugacucuuaaga

SEQ ID NO: 1351694 - RNA, 18 nt, Human
aacgauuuuuaaaaugua

SEQ ID NO: 1351695 - RNA, 19 nt, Human
aacgauuuuuaaaauguac

SEQ ID NO: 1351696 - RNA, 15 nt, Human
aacgauuuuuaaaau

SEQ ID NO: 1351697 - RNA, 14 nt, Human
aacgauuuuuaaaa

SEQ ID NO: 1351698 - RNA, 15 nt, Human
aacgcugauuuaaag

SEQ ID NO: 1351699 - RNA, 20 nt, Human
aacgcucuagguacgaugac

SEQ ID NO: 1351700 - RNA, 22 nt, Human
aacgcaaguucccaguuggagc

SEQ ID NO: 1351701 - RNA, 19 nt, Human
aacgcaaguucccaguugg

SEQ ID NO: 1351702 - RNA, 14 nt, Human
aacggaccaaagca

SEQ ID NO: 1351703 - RNA, 21 nt, Human
aacggaccaaagcaagacccu

SEQ ID NO: 1351704 - RNA, 14 nt, Human
aacggaagaagaga

SEQ ID NO: 1351705 - RNA, 12 nt, Human
aacggagucaaa

SEQ ID NO: 1351706 - RNA, 13 nt, Human
aacggaucagaaa

SEQ ID NO: 1351707 - RNA, 17 nt, Human
aacggaucagaaauaca

SEQ ID NO: 1351708 - RNA, 14 nt, Human
aacucacuuuccuc

SEQ ID NO: 1351709 - RNA, 20 nt, Human
aacucacuccuuuuaaagaa

SEQ ID NO: 1351710 - RNA, 17 nt, Human
aacucacuccuuuuaaa

SEQ ID NO: 1351711 - RNA, 16 nt, Human
aacucacuccuuuuaa

SEQ ID NO: 1351712 - RNA, 15 nt, Human
aacucaaaauauuug

SEQ ID NO: 1351713 - RNA, 16 nt, Human
aacuauuuucagaugu

SEQ ID NO: 1351714 - RNA, 20 nt, Human
aacuauuuucagaugugaac

SEQ ID NO: 1351715 - RNA, 14 nt, Human
aacuauuuucagau

SEQ ID NO: 1351716 - RNA, 13 nt, Human
aacuauuuucaga

SEQ ID NO: 1351717 - RNA, 12 nt, Human
aacuauuuucag

SEQ ID NO: 1351718 - RNA, 18 nt, Human
aacuauuuucaaagacuu

SEQ ID NO: 1351719 - RNA, 17 nt, Human
aacuauuuucaaagacu

SEQ ID NO: 1351720 - RNA, 15 nt, Human
aacggauuccaaaga

SEQ ID NO: 1351721 - RNA, 18 nt, Human
aacggaucagaaauacag

SEQ ID NO: 1351722 - RNA, 16 nt, Human
aacuauugcauuuaua

SEQ ID NO: 1351723 - RNA, 15 nt, Human
aacuauugcauuuau

SEQ ID NO: 1351724 - RNA, 21 nt, Human
aacuauugcauuuauauguac

SEQ ID NO: 1351725 - RNA, 22 nt, Human
aaauugaaccuuugugcccuau

SEQ ID NO: 1351726 - RNA, 15 nt, Human
aaauugaaccuuugu

SEQ ID NO: 1351727 - RNA, 12 nt, Human
aaauugaaccuu

SEQ ID NO: 1351728 - RNA, 20 nt, Human
aaauugaaauguaaggcugu

SEQ ID NO: 1351729 - RNA, 13 nt, Human
aaauugaaaugua

SEQ ID NO: 1351730 - RNA, 20 nt, Human
aaauucuuucccagucuguc

SEQ ID NO: 1351731 - RNA, 13 nt, Human
aaauucuuucauu

SEQ ID NO: 1351732 - RNA, 21 nt, Human
aaauucuugcaaaguaucccu

SEQ ID NO: 1351733 - RNA, 13 nt, Human
aaauuaaagcauu

SEQ ID NO: 1351734 - RNA, 19 nt, Human
aaauuaaacuuauuuacaa

SEQ ID NO: 1351735 - RNA, 19 nt, Human
aaauuaaaccggaccaucu

SEQ ID NO: 1351736 - RNA, 13 nt, Human
aaauugaaugcaa

SEQ ID NO: 1351737 - RNA, 20 nt, Human
aaauugaauacuuugaaugu

SEQ ID NO: 1351738 - RNA, 15 nt, Human
aaauugaaugcaaac

SEQ ID NO: 1351739 - RNA, 21 nt, Human
aaauugaauacuuugaaugug

SEQ ID NO: 1351740 - RNA, 19 nt, Human
aaauugaauacuuugaaug

SEQ ID NO: 1351741 - RNA, 18 nt, Human
aaauugaauacuuugaau

SEQ ID NO: 1351742 - RNA, 17 nt, Human
aaauugaauacuuugaa

SEQ ID NO: 1351743 - RNA, 14 nt, Human
aaauugaauacuuu

SEQ ID NO: 1351744 - RNA, 15 nt, Human
aaauugccauauugc

SEQ ID NO: 1351745 - RNA, 16 nt, Human
aaauugccauauugca

SEQ ID NO: 1351746 - RNA, 14 nt, Human
aaauugaaugcaaa

SEQ ID NO: 1351747 - RNA, 18 nt, Human
aaauugccauauugcaca

SEQ ID NO: 1351748 - RNA, 19 nt, Human
aaauugccauauugcacau

SEQ ID NO: 1351749 - RNA, 21 nt, Human
aaauugccauauugcacaugu

SEQ ID NO: 1351750 - RNA, 23 nt, Human
aaauugccauauugcacaugucu

SEQ ID NO: 1351751 - RNA, 23 nt, Human
aaauugcugacuguagcuuugga

SEQ ID NO: 1351752 - RNA, 19 nt, Human
aaauugcugacuguagcuu

SEQ ID NO: 1351753 - RNA, 15 nt, Human
aaauuuuuuuuacau

SEQ ID NO: 1351754 - RNA, 19 nt, Human
aaauguuggucauuuuaug

SEQ ID NO: 1351755 - RNA, 17 nt, Human
aaauguuggucauuuua

SEQ ID NO: 1351756 - RNA, 20 nt, Human
aaaucuuauaguucuaggca

SEQ ID NO: 1351757 - RNA, 19 nt, Human
aaaucuuauaguucuaggc

SEQ ID NO: 1351758 - RNA, 18 nt, Human
aaaucuuauaguucuagg

SEQ ID NO: 1351759 - RNA, 17 nt, Human
aaaucuuauaguucuag

SEQ ID NO: 1351760 - RNA, 16 nt, Human
aaaucuuauaguucua

SEQ ID NO: 1351761 - RNA, 17 nt, Human
aaaucuuauaauuuaaa

SEQ ID NO: 1351762 - RNA, 16 nt, Human
aaaugcgggguggggg

SEQ ID NO: 1351763 - RNA, 21 nt, Human
aaaugccuuuucccaaaaugu

SEQ ID NO: 1351764 - RNA, 16 nt, Human
aaaugccuuuucccaa

SEQ ID NO: 1351765 - RNA, 23 nt, Human
aaaugcgguuauaaaaaaugguu

SEQ ID NO: 1351766 - RNA, 22 nt, Human
aaaugcgguuauaaaaaauggu

SEQ ID NO: 1351767 - RNA, 15 nt, Human
aaaugcgguuauaaa

SEQ ID NO: 1351768 - RNA, 15 nt, Human
aaaugccuuuguacu

SEQ ID NO: 1351769 - RNA, 19 nt, Human
aacaccauugaaggcuuaa

SEQ ID NO: 1351770 - RNA, 20 nt, Human
aacacccagucuguucccca

SEQ ID NO: 1351771 - RNA, 17 nt, Human
aacaccauugaaggcuu

SEQ ID NO: 1351772 - RNA, 15 nt, Human
aacaccauugaaggc

SEQ ID NO: 1351773 - RNA, 20 nt, Human
aacaccaugauuccuuuaac

SEQ ID NO: 1351774 - RNA, 19 nt, Human
aacaccaugauuccuuuaa

SEQ ID NO: 1351775 - RNA, 18 nt, Human
aacaccaugauuccuuua

SEQ ID NO: 1351776 - RNA, 20 nt, Human
aacaccauagguagaaugua

SEQ ID NO: 1351777 - RNA, 18 nt, Human
aacaaccucaacugccua

SEQ ID NO: 1351778 - RNA, 14 nt, Human
aacaaccucaacug

SEQ ID NO: 1351779 - RNA, 20 nt, Human
aacaacauguuuccagcauu

SEQ ID NO: 1351780 - RNA, 14 nt, Human
aacaacacuguagu

SEQ ID NO: 1351781 - RNA, 19 nt, Human
aacaaaaacacuaaaaaua

SEQ ID NO: 1351782 - RNA, 16 nt, Human
aaauuuuuuuuacauu

SEQ ID NO: 1351783 - RNA, 17 nt, Human
aaauuuuuuuuacauuu

SEQ ID NO: 1351784 - RNA, 18 nt, Human
aaauuuuuuuuacauuuu

SEQ ID NO: 1351785 - RNA, 15 nt, Human
aacacuaaaaauaaa

SEQ ID NO: 1351786 - RNA, 14 nt, Human
aacacuaaaaauaa

SEQ ID NO: 1351787 - RNA, 21 nt, Human
aacacguaucccaccugacau

SEQ ID NO: 1351788 - RNA, 21 nt, Human
aacacggccacaucaaagagg

SEQ ID NO: 1351789 - RNA, 13 nt, Human
aacacggccacau

SEQ ID NO: 1351790 - RNA, 18 nt, Human
aacacuaacauauaaugu

SEQ ID NO: 1351791 - RNA, 17 nt, Human
aacacuaacaugauuug

SEQ ID NO: 1351792 - RNA, 15 nt, Human
aaccacgccucuuga

SEQ ID NO: 1351793 - RNA, 22 nt, Human
aaccacuuucuuauuuuuuucu

SEQ ID NO: 1351794 - RNA, 21 nt, Human
aaccacuuucuuauuuuuuuc

SEQ ID NO: 1351795 - RNA, 14 nt, Human
aaccacuuuuugca

SEQ ID NO: 1351796 - RNA, 15 nt, Human
aaccacuuuuugcag

SEQ ID NO: 1351797 - RNA, 17 nt, Human
aaccacuuuuugcagcu

SEQ ID NO: 1351798 - RNA, 14 nt, Human
aaccagacucuugc

SEQ ID NO: 1351799 - RNA, 15 nt, Human
aaccagagugcugaa

SEQ ID NO: 1351800 - RNA, 15 nt, Human
aacauccaaaaucuu

SEQ ID NO: 1351801 - RNA, 11 nt, Human
aacauccaaaa

SEQ ID NO: 1351802 - RNA, 22 nt, Human
aacagcugguguagcuacagag

SEQ ID NO: 1351803 - RNA, 15 nt, Human
aacaucccuccuggg

SEQ ID NO: 1351804 - RNA, 16 nt, Human
aaccaccccaucugca

SEQ ID NO: 1351805 - RNA, 20 nt, Human
aacccuugggccagaaguac

SEQ ID NO: 1351806 - RNA, 18 nt, Human
aacccuugggccagaagu

SEQ ID NO: 1351807 - RNA, 15 nt, Human
aacccuugggccaga

SEQ ID NO: 1351808 - RNA, 14 nt, Human
aacccuugggccag

SEQ ID NO: 1351809 - RNA, 20 nt, Human
aacccucacaucagagugac

SEQ ID NO: 1351810 - RNA, 20 nt, Human
aacccuuugugugcucucca

SEQ ID NO: 1351811 - RNA, 16 nt, Human
aacccuuugugugcuc

SEQ ID NO: 1351812 - RNA, 21 nt, Human
aaccgaacugauguaaguaaa

SEQ ID NO: 1351813 - RNA, 15 nt, Human
aacccguggaggcug

SEQ ID NO: 1351814 - RNA, 14 nt, Human
aacccguggaggcu

SEQ ID NO: 1351815 - RNA, 13 nt, Human
aacccguggaggc

SEQ ID NO: 1351816 - RNA, 14 nt, Human
aacccgugccaagu

SEQ ID NO: 1351817 - RNA, 15 nt, Human
aacccgucuggccca

SEQ ID NO: 1351818 - RNA, 16 nt, Human
aaccagauauauauuc

SEQ ID NO: 1351819 - RNA, 12 nt, Human
aaccagaucauu

SEQ ID NO: 1351820 - RNA, 21 nt, Human
aacccuauacuguaguauucu

SEQ ID NO: 1351821 - RNA, 19 nt, Human
aacccuagccuugcuuguu

SEQ ID NO: 1351822 - RNA, 18 nt, Human
aacccuagccuugcuugu

SEQ ID NO: 1351823 - RNA, 16 nt, Human
aacccuagccuugcuu

SEQ ID NO: 1351824 - RNA, 18 nt, Human
aacccguggaggcugcuc

SEQ ID NO: 1351825 - RNA, 23 nt, Human
aacccuaaauaauaaaaauaaac

SEQ ID NO: 1351826 - RNA, 13 nt, Human
aacccuagccuug

SEQ ID NO: 1351827 - RNA, 17 nt, Human
aacccguggaggcugcu

SEQ ID NO: 1351828 - RNA, 14 nt, Human
aacccuagcaaaag

SEQ ID NO: 1351829 - RNA, 11 nt, Human
aaccuagagau

SEQ ID NO: 1351830 - RNA, 20 nt, Human
aaccuacaguuuuaacugug

SEQ ID NO: 1351831 - RNA, 17 nt, Human
aaccuagggugauauua

SEQ ID NO: 1351832 - RNA, 20 nt, Human
aacagcagacucagcucuga

SEQ ID NO: 1351833 - RNA, 19 nt, Human
aacagcagacucagcucug

SEQ ID NO: 1351834 - RNA, 20 nt, Human
aacagcaccaaaucaaaauc

SEQ ID NO: 1351835 - RNA, 22 nt, Human
aacagcauguacggauuuucag

SEQ ID NO: 1351836 - RNA, 21 nt, Human
aacagcaucuccaagcagcuu

SEQ ID NO: 1351837 - RNA, 19 nt, Human
aacagcaucuccaagcagc

SEQ ID NO: 1351838 - RNA, 15 nt, Human
aacagcaucuccaag

SEQ ID NO: 1351839 - RNA, 10 nt, Human
aacagcaucu

SEQ ID NO: 1351840 - RNA, 23 nt, Human
aacagcugguguagcuacagaga

SEQ ID NO: 1351841 - RNA, 21 nt, Human
aacagcugguguagcuacaga

SEQ ID NO: 1351842 - RNA, 20 nt, Human
aacagcugguguagcuacag

SEQ ID NO: 1351843 - RNA, 17 nt, Human
aacagcugguguagcua

SEQ ID NO: 1351844 - RNA, 16 nt, Human
aacagcugguguagcu

SEQ ID NO: 1351845 - RNA, 13 nt, Human
aacagcuggugua

SEQ ID NO: 1351846 - RNA, 12 nt, Human
aacagcuggugu

SEQ ID NO: 1351847 - RNA, 17 nt, Human
aaacccuagccuugcuu

SEQ ID NO: 1351848 - RNA, 14 nt, Human
aaacccuagccuug

SEQ ID NO: 1351849 - RNA, 13 nt, Human
aaacccuagccuu

SEQ ID NO: 1351850 - RNA, 18 nt, Human
aaacccuagccuugcuug

SEQ ID NO: 1351851 - RNA, 16 nt, Human
aaacccuagccuugcu

SEQ ID NO: 1351852 - RNA, 15 nt, Human
aaacccuagccuugc

SEQ ID NO: 1351853 - RNA, 18 nt, Human
aaaccccuguaggccuca

SEQ ID NO: 1351854 - RNA, 13 nt, Human
aaaccauguagaa

SEQ ID NO: 1351855 - RNA, 15 nt, Human
aaaccaugcaaaugc

SEQ ID NO: 1351856 - RNA, 22 nt, Human
aaaccaucucccuggugcuuau

SEQ ID NO: 1351857 - RNA, 19 nt, Human
aaaccaucucccuggugcu

SEQ ID NO: 1351858 - RNA, 15 nt, Human
aaaccaucucccugg

SEQ ID NO: 1351859 - RNA, 13 nt, Human
aaaccaucucccu

SEQ ID NO: 1351860 - RNA, 22 nt, Human
aaaccaucaaguugugccaaau

SEQ ID NO: 1351861 - RNA, 23 nt, Human
aaaccaucucccuggugcuuaug

SEQ ID NO: 1351862 - RNA, 18 nt, Human
aaagauaaacacaagauu

SEQ ID NO: 1351863 - RNA, 17 nt, Human
aaagauaaacacaagau

SEQ ID NO: 1351864 - RNA, 16 nt, Human
aaagauaaacacaaga

SEQ ID NO: 1351865 - RNA, 12 nt, Human
aaagauaaacac

SEQ ID NO: 1351866 - RNA, 16 nt, Human
aaagaguucaagaaau

SEQ ID NO: 1351867 - RNA, 20 nt, Human
aaagaguucaagaaauaagu

SEQ ID NO: 1351868 - RNA, 14 nt, Human
aaagaguucaagaa

SEQ ID NO: 1351869 - RNA, 12 nt, Human
aaagauauuuug

SEQ ID NO: 1351870 - RNA, 16 nt, Human
aaagauauuuugcuuu

SEQ ID NO: 1351871 - RNA, 17 nt, Human
aaagauauuuugcuuug

SEQ ID NO: 1351872 - RNA, 20 nt, Human
aaagauauuuugcuuuguga

SEQ ID NO: 1351873 - RNA, 22 nt, Human
aaagaagagcgagagaucaaag

SEQ ID NO: 1351874 - RNA, 20 nt, Human
aaagaagaccugagaaugua

SEQ ID NO: 1351875 - RNA, 22 nt, Human
aaagaagaccugagaauguauc

SEQ ID NO: 1351876 - RNA, 18 nt, Human
aaagaagaccugagaaug

SEQ ID NO: 1351877 - RNA, 14 nt, Human
aaagaagaccugag

SEQ ID NO: 1351878 - RNA, 16 nt, Human
aaagaagcccccagcu

SEQ ID NO: 1351879 - RNA, 14 nt, Human
aaagagucuagauu

SEQ ID NO: 1351880 - RNA, 13 nt, Human
aaagagucuagau

SEQ ID NO: 1351881 - RNA, 15 nt, Human
aaagaaguaaaagca

SEQ ID NO: 1351882 - RNA, 21 nt, Human
aaagaagggcugguauuguuc

SEQ ID NO: 1351883 - RNA, 15 nt, Human
aaagagucuagauuc

SEQ ID NO: 1351884 - RNA, 21 nt, Human
aaagagucuagauucaaaggu

SEQ ID NO: 1351885 - RNA, 19 nt, Human
aaacugaggaauuuucuuu

SEQ ID NO: 1351886 - RNA, 18 nt, Human
aaacugaggaauuuucuu

SEQ ID NO: 1351887 - RNA, 19 nt, Human
aaacugaggaauuucaccu

SEQ ID NO: 1351888 - RNA, 14 nt, Human
aaacugaggaauuu

SEQ ID NO: 1351889 - RNA, 17 nt, Human
aaagaaauauaccuaaa

SEQ ID NO: 1351890 - RNA, 22 nt, Human
aaacugagauccuuccuuuuga

SEQ ID NO: 1351891 - RNA, 12 nt, Human
aaacagaacacu

SEQ ID NO: 1351892 - RNA, 21 nt, Human
aaacagaaacaaaaacacuaa

SEQ ID NO: 1351893 - RNA, 19 nt, Human
aaacagaaacaaaaacacu

SEQ ID NO: 1351894 - RNA, 13 nt, Human
aaacagaaacaaa

SEQ ID NO: 1351895 - RNA, 13 nt, Human
aaacagaaugucu

SEQ ID NO: 1351896 - RNA, 13 nt, Human
aaacagaacacuu

SEQ ID NO: 1351897 - RNA, 14 nt, Human
aaacagaacacuua

SEQ ID NO: 1351898 - RNA, 12 nt, Human
aaacagacacug

SEQ ID NO: 1351899 - RNA, 12 nt, Human
aaacagaagccu

SEQ ID NO: 1351900 - RNA, 17 nt, Human
aaaaucucaauauuuca

SEQ ID NO: 1351901 - RNA, 16 nt, Human
aaaaucucaauauuuc

SEQ ID NO: 1351902 - RNA, 19 nt, Human
aaaaucucaaauuucuaaa

SEQ ID NO: 1351903 - RNA, 22 nt, Human
aaaaucucaaauuucuaaaucu

SEQ ID NO: 1351904 - RNA, 15 nt, Human
aaaauugcaaaucuu

SEQ ID NO: 1351905 - RNA, 22 nt, Human
aaacaccuuccagcuccuguaa

SEQ ID NO: 1351906 - RNA, 12 nt, Human
aaaauugccaua

SEQ ID NO: 1351907 - RNA, 21 nt, Human
aaaauugaugggauuugguca

SEQ ID NO: 1351908 - RNA, 12 nt, Human
aaacacuuguaa

SEQ ID NO: 1351909 - RNA, 13 nt, Human
aaacacugugcac

SEQ ID NO: 1351910 - RNA, 22 nt, Human
aaacacugggagaaaugaaaaa

SEQ ID NO: 1351911 - RNA, 22 nt, Human
aaacacucaaguugauuagaaa

SEQ ID NO: 1351912 - RNA, 21 nt, Human
aaacacugggagaaaugaaaa

SEQ ID NO: 1351913 - RNA, 23 nt, Human
aaaaguggguuuuuuaguugaau

SEQ ID NO: 1351914 - RNA, 17 nt, Human
aaaagugggcuugauuc

SEQ ID NO: 1351915 - RNA, 18 nt, Human
aaaagugggcuugauucu

SEQ ID NO: 1351916 - RNA, 20 nt, Human
aaaagugccauuaacaaaug

SEQ ID NO: 1351917 - RNA, 23 nt, Human
aaaaagaaaggcuguuaaauaca

SEQ ID NO: 1351918 - RNA, 19 nt, Human
aaaaagaaaggcuguuaaa

SEQ ID NO: 1351919 - RNA, 14 nt, Human
aaaaagaagaaucu

SEQ ID NO: 1351920 - RNA, 16 nt, Human
aaaaagaaacauuugg

SEQ ID NO: 1351921 - RNA, 13 nt, Human
aaaaucaucagaa

SEQ ID NO: 1351922 - RNA, 15 nt, Human
aaaaucaucagaaag

SEQ ID NO: 1351923 - RNA, 21 nt, Human
aaaaucagguggcuuuugcgg

SEQ ID NO: 1351924 - RNA, 13 nt, Human
aaaauaaagaaug

SEQ ID NO: 1351925 - RNA, 18 nt, Human
aaaaucagcuauuuugug

SEQ ID NO: 1351926 - RNA, 12 nt, Human
aaaauaaagaau

SEQ ID NO: 1351927 - RNA, 21 nt, Human
aaaauaaagaaaagaugcacu

SEQ ID NO: 1351928 - RNA, 14 nt, Human
aaaauaaagaaaua

SEQ ID NO: 1351929 - RNA, 16 nt, Human
aaaauaaagaaaagau

SEQ ID NO: 1351930 - RNA, 20 nt, Human
aaaauccuugcuuaugacau

SEQ ID NO: 1351931 - RNA, 13 nt, Human
aaaauccuugcuu

SEQ ID NO: 1351932 - RNA, 12 nt, Human
aaaaguuauaac

SEQ ID NO: 1351933 - RNA, 19 nt, Human
aaaaguuacauguuugcac

SEQ ID NO: 1351934 - RNA, 18 nt, Human
aaaaguuacauguuugca

SEQ ID NO: 1351935 - RNA, 23 nt, Human
aaaaguuccaagagucuaaagau

SEQ ID NO: 1351936 - RNA, 22 nt, Human
aaaaguuccaagagucuaaaga

SEQ ID NO: 1351937 - RNA, 15 nt, Human
aaaaguuccaagagu

SEQ ID NO: 1351938 - RNA, 13 nt, Human
aaaaguuccaaga

SEQ ID NO: 1351939 - RNA, 14 nt, Human
aaaauaaacaaaua

SEQ ID NO: 1351940 - RNA, 12 nt, Human
aaaauaaacaaa

SEQ ID NO: 1351941 - RNA, 13 nt, Human
aaaaguugaauuu

SEQ ID NO: 1351942 - RNA, 17 nt, Human
aaaauaaaacuuuuuaa

SEQ ID NO: 1351943 - RNA, 14 nt, Human
aaagccaagggcaa

SEQ ID NO: 1351944 - RNA, 23 nt, Human
aaagccaaggagucacugagacc

SEQ ID NO: 1351945 - RNA, 22 nt, Human
aaagccaaggagucacugagac

SEQ ID NO: 1351946 - RNA, 21 nt, Human
aaagccagcguccuccucugu

SEQ ID NO: 1351947 - RNA, 19 nt, Human
aaagccaggucccucucau

SEQ ID NO: 1351948 - RNA, 19 nt, Human
aaagcccuuaggaagaauu

SEQ ID NO: 1351949 - RNA, 13 nt, Human
aaaggcaaggucc

SEQ ID NO: 1351950 - RNA, 14 nt, Human
aaaggcaagcacuu

SEQ ID NO: 1351951 - RNA, 12 nt, Human
aaaggcaaaggc

SEQ ID NO: 1351952 - RNA, 20 nt, Human
aaagccucaagguuuuaggu

SEQ ID NO: 1351953 - RNA, 15 nt, Human
aaagccaggucccuc

SEQ ID NO: 1351954 - RNA, 21 nt, Human
aaaggcacccccgucaagagu

SEQ ID NO: 1351955 - RNA, 13 nt, Human
aaaggccuggggu

SEQ ID NO: 1351956 - RNA, 12 nt, Human
aaaggccuuuaa

SEQ ID NO: 1351957 - RNA, 17 nt, Human
aaaggccuuuaaaauuu

SEQ ID NO: 1351958 - RNA, 12 nt, Human
aaaggccugggg

SEQ ID NO: 1351959 - RNA, 11 nt, Human
aaaggccuggg

SEQ ID NO: 1351960 - RNA, 10 nt, Human
aaaggccugg

SEQ ID NO: 1351961 - RNA, 21 nt, Human
aaaggccuaauucuaugccug

SEQ ID NO: 1351962 - RNA, 15 nt, Human
aaauaaauguaucau

SEQ ID NO: 1351963 - RNA, 22 nt, Human
aaaguccuuuuuuuccaucuuu

SEQ ID NO: 1351964 - RNA, 18 nt, Human
aaaguccuuuuuuuccau

SEQ ID NO: 1351965 - RNA, 16 nt, Human
aaaguccuuuuuuucc

SEQ ID NO: 1351966 - RNA, 23 nt, Human
aaagucauuggcuuuauccucuu

SEQ ID NO: 1351967 - RNA, 20 nt, Human
aaaguggaaaacaaggaagu

SEQ ID NO: 1351968 - RNA, 19 nt, Human
aaaguggaaaacaaggaag

SEQ ID NO: 1351969 - RNA, 13 nt, Human
aaagucauuggcu

SEQ ID NO: 1351970 - RNA, 14 nt, Human
aaagucauuggcuu

SEQ ID NO: 1351971 - RNA, 15 nt, Human
aaagucauuggcuuu

SEQ ID NO: 1351972 - RNA, 17 nt, Human
aaagucauuggcuuuau

SEQ ID NO: 1351973 - RNA, 21 nt, Human
aaagucauuggcuuuauccuc

SEQ ID NO: 1351974 - RNA, 19 nt, Human
aaaguggccaagaagcagu

SEQ ID NO: 1351975 - RNA, 20 nt, Human
aaaguggaacgaaaaugaaa

SEQ ID NO: 1351976 - RNA, 13 nt, Human
aaaguggaacgaa

SEQ ID NO: 1351977 - RNA, 13 nt, Human
aaauaaaacuuuu

SEQ ID NO: 1351978 - RNA, 16 nt, Human
aaauaaaacuuuuuaa

SEQ ID NO: 1351979 - RNA, 17 nt, Human
aaauaaaaggaagccaa

SEQ ID NO: 1351980 - RNA, 19 nt, Human
aaauaaaacuuuuuaaaau

SEQ ID NO: 1351981 - RNA, 19 nt, Human
aaauagcguucuuguaauu

SEQ ID NO: 1351982 - RNA, 18 nt, Human
aaauagcguucuuguaau

SEQ ID NO: 1351983 - RNA, 17 nt, Human
aaauagcguucuuguaa

SEQ ID NO: 1351984 - RNA, 15 nt, Human
aaauagcguucuugu

SEQ ID NO: 1351985 - RNA, 22 nt, Human
aaauaguuaagacaugauuucc

SEQ ID NO: 1351986 - RNA, 17 nt, Human
aaauaguuaagacauga

SEQ ID NO: 1351987 - RNA, 20 nt, Human
aaauaggguauauuuuccua

SEQ ID NO: 1351988 - RNA, 16 nt, Human
aaauagggucuaacuc

SEQ ID NO: 1351989 - RNA, 14 nt, Human
aaauaggcaggaag

SEQ ID NO: 1351990 - RNA, 15 nt, Human
aaauaggguauauuu

SEQ ID NO: 1351991 - RNA, 15 nt, Human
aaauagcuuaugaaa

SEQ ID NO: 1351992 - RNA, 20 nt, Human
aaauagcuuuuuucucugau

SEQ ID NO: 1351993 - RNA, 20 nt, Human
aaauagcguucuuguaauuu

SEQ ID NO: 1351994 - RNA, 21 nt, Human
aaauagcguucuuguaauuuu

SEQ ID NO: 1351995 - RNA, 16 nt, Human
aaauagcuuaugaaaa

SEQ ID NO: 1351996 - RNA, 17 nt, Human
aaauagcuuuuuucucu

SEQ ID NO: 1351997 - RNA, 14 nt, Human
aaauaguuuggaua

SEQ ID NO: 1351998 - RNA, 20 nt, Human
aaaucaaaaucucuccacuu

SEQ ID NO: 1351999 - RNA, 20 nt, Human
aaauauuuauuuuaauaaug

SEQ ID NO: 1352000 - RNA, 13 nt, Human
aaauauuuauuuu

SEQ ID NO: 1352001 - RNA, 15 nt, Human
aaauauuuauuuuaa

SEQ ID NO: 1352002 - RNA, 19 nt, Human
aaaucacauauuuuaaaau

SEQ ID NO: 1352003 - RNA, 23 nt, Human
aaaucaauuacugguccaaaaga

SEQ ID NO: 1352004 - RNA, 19 nt, Human
aaaucaauuacugguccaa

SEQ ID NO: 1352005 - RNA, 18 nt, Human
aaaucaaguauuugggaa

SEQ ID NO: 1352006 - RNA, 23 nt, Human
aaaucaaguauuugggaagugaa

SEQ ID NO: 1352007 - RNA, 20 nt, Human
aaaucaaucuguaaaacuaa

SEQ ID NO: 1352008 - RNA, 21 nt, Human
aaaucuggcuucuggccagga

SEQ ID NO: 1352009 - RNA, 18 nt, Human
aaaucuggcuucuggcca

SEQ ID NO: 1352010 - RNA, 14 nt, Human
aaaucuggcuucug

SEQ ID NO: 1352011 - RNA, 12 nt, Human
aaaucuggaagc

SEQ ID NO: 1352012 - RNA, 17 nt, Human
aagccaauucagacagg

SEQ ID NO: 1352013 - RNA, 20 nt, Human
aagcagcgaccgcccccucc

SEQ ID NO: 1352014 - RNA, 19 nt, Human
aagcagcgaccgcccccuc

SEQ ID NO: 1352015 - RNA, 21 nt, Human
aagcagcguuucuaugacaca

SEQ ID NO: 1352016 - RNA, 22 nt, Human
aagcagcguuucuaugacacau

SEQ ID NO: 1352017 - RNA, 21 nt, Human
aagcagcagccucgccccugg

SEQ ID NO: 1352018 - RNA, 16 nt, Human
aagcagcagccucgcc

SEQ ID NO: 1352019 - RNA, 14 nt, Human
aagcagcagccucg

SEQ ID NO: 1352020 - RNA, 12 nt, Human
aagcagcagccu

SEQ ID NO: 1352021 - RNA, 16 nt, Human
aagcagcacuuauaaa

SEQ ID NO: 1352022 - RNA, 19 nt, Human
aagcagcaacuuguccuag

SEQ ID NO: 1352023 - RNA, 20 nt, Human
aagauucuauaguucuagac

SEQ ID NO: 1352024 - RNA, 22 nt, Human
aagcagccucuccccaggucca

SEQ ID NO: 1352025 - RNA, 17 nt, Human
aagcagccucuccccag

SEQ ID NO: 1352026 - RNA, 16 nt, Human
aagcagccucucccca

SEQ ID NO: 1352027 - RNA, 14 nt, Human
aagcagcguuucua

SEQ ID NO: 1352028 - RNA, 17 nt, Human
aagcagcguuucuauga

SEQ ID NO: 1352029 - RNA, 20 nt, Human
aagcagcguuucuaugacac

SEQ ID NO: 1352030 - RNA, 17 nt, Human
aagccagcguccuccuc

SEQ ID NO: 1352031 - RNA, 14 nt, Human
aagccagcguccuc

SEQ ID NO: 1352032 - RNA, 19 nt, Human
aagccagcguccuccucug

SEQ ID NO: 1352033 - RNA, 22 nt, Human
aagaguuugaugaggcccucca

SEQ ID NO: 1352034 - RNA, 23 nt, Human
aagagugauagucuuuugcuuuu

SEQ ID NO: 1352035 - RNA, 18 nt, Human
aagagugaauucccucac

SEQ ID NO: 1352036 - RNA, 23 nt, Human
aagagucuagauucaaagguucu

SEQ ID NO: 1352037 - RNA, 20 nt, Human
aagagucuagauucaaaggu

SEQ ID NO: 1352038 - RNA, 14 nt, Human
aagagucuagauuc

SEQ ID NO: 1352039 - RNA, 19 nt, Human
aacuuucauuccuucagau

SEQ ID NO: 1352040 - RNA, 14 nt, Human
aacuuuccucgccu

SEQ ID NO: 1352041 - RNA, 16 nt, Human
aacuuuccaaacacca

SEQ ID NO: 1352042 - RNA, 23 nt, Human
aagaguuuugggaguuguaguua

SEQ ID NO: 1352043 - RNA, 13 nt, Human
aagaguuuuggga

SEQ ID NO: 1352044 - RNA, 17 nt, Human
aagauaaacacaagauu

SEQ ID NO: 1352045 - RNA, 14 nt, Human
aagaguuuugggag

SEQ ID NO: 1352046 - RNA, 22 nt, Human
aagauaaacacaagauuggugu

SEQ ID NO: 1352047 - RNA, 13 nt, Human
aagauacugaaau

SEQ ID NO: 1352048 - RNA, 19 nt, Human
aagauucuauaguucuaga

SEQ ID NO: 1352049 - RNA, 17 nt, Human
aagauucuauaguucua

SEQ ID NO: 1352050 - RNA, 15 nt, Human
aagauucuagaugau

SEQ ID NO: 1352051 - RNA, 14 nt, Human
aagauucuagauga

SEQ ID NO: 1352052 - RNA, 13 nt, Human
aagauucuagaug

SEQ ID NO: 1352053 - RNA, 20 nt, Human
aagauucuagaucagaugcu

SEQ ID NO: 1352054 - RNA, 13 nt, Human
aagauucuagauc

SEQ ID NO: 1352055 - RNA, 12 nt, Human
aagauucuagau

SEQ ID NO: 1352056 - RNA, 11 nt, Human
aagauucuaga

SEQ ID NO: 1352057 - RNA, 16 nt, Human
aagauucuaaugauga

SEQ ID NO: 1352058 - RNA, 14 nt, Human
aagauucuaaugau

SEQ ID NO: 1352059 - RNA, 13 nt, Human
aagauucuaaagg

SEQ ID NO: 1352060 - RNA, 12 nt, Human
aagauucuaaag

SEQ ID NO: 1352061 - RNA, 11 nt, Human
aagauucuaaa

SEQ ID NO: 1352062 - RNA, 24 nt, Human
aagauuccggauccuaagcaucua

SEQ ID NO: 1352063 - RNA, 21 nt, Human
aagauuccggauccuaagcau

SEQ ID NO: 1352064 - RNA, 20 nt, Human
aagauuacucaguaauuugu

SEQ ID NO: 1352065 - RNA, 21 nt, Human
aagauuacaaaucagaaguca

SEQ ID NO: 1352066 - RNA, 17 nt, Human
aagauuacuuuuucuuu

SEQ ID NO: 1352067 - RNA, 20 nt, Human
aagauuacaaaucagaaguc

SEQ ID NO: 1352068 - RNA, 20 nt, Human
aagauguuaugguguuuaga

SEQ ID NO: 1352069 - RNA, 20 nt, Human
aagauguucuggauaccauu

SEQ ID NO: 1352070 - RNA, 15 nt, Human
aagauguucuggaua

SEQ ID NO: 1352071 - RNA, 16 nt, Human
aagauguuaugguguu

SEQ ID NO: 1352072 - RNA, 21 nt, Human
aagaugugauauucuaagacu

SEQ ID NO: 1352073 - RNA, 20 nt, Human
aagauacuaaggacguuguu

SEQ ID NO: 1352074 - RNA, 20 nt, Human
aagaugugauauucuaagac

SEQ ID NO: 1352075 - RNA, 14 nt, Human
aagauacugaaaua

SEQ ID NO: 1352076 - RNA, 14 nt, Human
aagcgccuccaacc

SEQ ID NO: 1352077 - RNA, 15 nt, Human
aagcgccuccaaccc

SEQ ID NO: 1352078 - RNA, 14 nt, Human
aagcuaauuugcau

SEQ ID NO: 1352079 - RNA, 22 nt, Human
aagcgcuagaggaagcagccaa

SEQ ID NO: 1352080 - RNA, 16 nt, Human
aagcgccuccaacccu

SEQ ID NO: 1352081 - RNA, 20 nt, Human
aagcgccuccaacccuagca

SEQ ID NO: 1352082 - RNA, 23 nt, Human
aagcuaauuugcauuaaauucac

SEQ ID NO: 1352083 - RNA, 22 nt, Human
aagcuaauuugcauuaaauuca

SEQ ID NO: 1352084 - RNA, 15 nt, Human
aagcuaauuugcauu

SEQ ID NO: 1352085 - RNA, 20 nt, Human
aagcuacagaagaaacuggg

SEQ ID NO: 1352086 - RNA, 20 nt, Human
aaggcagcucuaaaugucaa

SEQ ID NO: 1352087 - RNA, 22 nt, Human
aaggcaggcagggcucuccugg

SEQ ID NO: 1352088 - RNA, 18 nt, Human
aaggcaggcagggcucuc

SEQ ID NO: 1352089 - RNA, 17 nt, Human
aaggcaggcagggcucu

SEQ ID NO: 1352090 - RNA, 16 nt, Human
aaggcaggcagggcuc

SEQ ID NO: 1352091 - RNA, 14 nt, Human
aaggcaggcagggc

SEQ ID NO: 1352092 - RNA, 21 nt, Human
aaggcaggcagggcucuccug

SEQ ID NO: 1352093 - RNA, 22 nt, Human
aaggauucugcuggccucugcg

SEQ ID NO: 1352094 - RNA, 20 nt, Human
aaggauucugcuggccucug

SEQ ID NO: 1352095 - RNA, 23 nt, Human
aaggacuuccuguccagcuccaa

SEQ ID NO: 1352096 - RNA, 19 nt, Human
aagcuacugugugugugaa

SEQ ID NO: 1352097 - RNA, 16 nt, Human
aagcugguuuaauguu

SEQ ID NO: 1352098 - RNA, 18 nt, Human
aagcuguguggcagucug

SEQ ID NO: 1352099 - RNA, 14 nt, Human
aaggacaucagcaa

SEQ ID NO: 1352100 - RNA, 15 nt, Human
aaggacaucagcaaa

SEQ ID NO: 1352101 - RNA, 22 nt, Human
aaggacuuccuguccagcucca

SEQ ID NO: 1352102 - RNA, 21 nt, Human
aaggacuuccuguccagcucc

SEQ ID NO: 1352103 - RNA, 20 nt, Human
aaggacuuccuguccagcuc

SEQ ID NO: 1352104 - RNA, 17 nt, Human
aaggacuuccuguccag

SEQ ID NO: 1352105 - RNA, 17 nt, Human
aaggacaucagcaaaca

SEQ ID NO: 1352106 - RNA, 18 nt, Human
aaguggacaaauuuugag

SEQ ID NO: 1352107 - RNA, 20 nt, Human
aaguggaacgaaaaugaaag

SEQ ID NO: 1352108 - RNA, 13 nt, Human
aagugcuuucuuc

SEQ ID NO: 1352109 - RNA, 14 nt, Human
aaguguacauaugu

SEQ ID NO: 1352110 - RNA, 14 nt, Human
aaguguaauugaga

SEQ ID NO: 1352111 - RNA, 16 nt, Human
aaguugacuuauagua

SEQ ID NO: 1352112 - RNA, 19 nt, Human
aaguugacuuauaguacau

SEQ ID NO: 1352113 - RNA, 20 nt, Human
aaguugacuuauaguacaug

SEQ ID NO: 1352114 - RNA, 21 nt, Human
aaguugacuuauaguacauga

SEQ ID NO: 1352115 - RNA, 19 nt, Human
aaguugagauaguuuucau

SEQ ID NO: 1352116 - RNA, 23 nt, Human
aaguugagauaguuuucauccau

SEQ ID NO: 1352117 - RNA, 18 nt, Human
aaguugagauaguuuuca

SEQ ID NO: 1352118 - RNA, 16 nt, Human
aaguugagauaguuuu

SEQ ID NO: 1352119 - RNA, 23 nt, Human
aaguugacuuauaguacaugaua

SEQ ID NO: 1352120 - RNA, 13 nt, Human
aaguugaggggcu

SEQ ID NO: 1352121 - RNA, 16 nt, Human
aagucuguuuacugca

SEQ ID NO: 1352122 - RNA, 14 nt, Human
aagucuguuuacug

SEQ ID NO: 1352123 - RNA, 13 nt, Human
aagucuguuuacu

SEQ ID NO: 1352124 - RNA, 20 nt, Human
aagucuguugauuaaagaug

SEQ ID NO: 1352125 - RNA, 18 nt, Human
aagucuguccuugaagga

SEQ ID NO: 1352126 - RNA, 21 nt, Human
aagucuguccuugaaggacua

SEQ ID NO: 1352127 - RNA, 16 nt, Human
aagucuguccuugaag

SEQ ID NO: 1352128 - RNA, 13 nt, Human
aagucuguccuug

SEQ ID NO: 1352129 - RNA, 17 nt, Human
aagucucaucuggggag

SEQ ID NO: 1352130 - RNA, 19 nt, Human
aagucucagcuaagcucac

SEQ ID NO: 1352131 - RNA, 15 nt, Human
aagucuccaaagucu

SEQ ID NO: 1352132 - RNA, 16 nt, Human
aagggaaaagucucuu

SEQ ID NO: 1352133 - RNA, 16 nt, Human
aagggccagagccagg

SEQ ID NO: 1352134 - RNA, 15 nt, Human
aagggccagagccag

SEQ ID NO: 1352135 - RNA, 14 nt, Human
aagggccagagcca

SEQ ID NO: 1352136 - RNA, 13 nt, Human
aagggccagagcc

SEQ ID NO: 1352137 - RNA, 12 nt, Human
aagggccagagc

SEQ ID NO: 1352138 - RNA, 11 nt, Human
aagggccagag

SEQ ID NO: 1352139 - RNA, 22 nt, Human
aagggccaaagaaccaaagaag

SEQ ID NO: 1352140 - RNA, 20 nt, Human
aagggccaaagaaccaaaga

SEQ ID NO: 1352141 - RNA, 12 nt, Human
aagggccaaaga

SEQ ID NO: 1352142 - RNA, 14 nt, Human
aagggagggcucug

SEQ ID NO: 1352143 - RNA, 13 nt, Human
aagggagggcucu

SEQ ID NO: 1352144 - RNA, 21 nt, Human
aagggagggcagagcuggugc

SEQ ID NO: 1352145 - RNA, 20 nt, Human
aagggagggcagagcuggug

SEQ ID NO: 1352146 - RNA, 19 nt, Human
aagggagggcagagcuggu

SEQ ID NO: 1352147 - RNA, 18 nt, Human
aagggagggcagagcugg

SEQ ID NO: 1352148 - RNA, 13 nt, Human
aagggagggcaga

SEQ ID NO: 1352149 - RNA, 16 nt, Human
aagggaggcugcugcu

SEQ ID NO: 1352150 - RNA, 19 nt, Human
aagggagggcucugaggcg

SEQ ID NO: 1352151 - RNA, 18 nt, Human
aagggagggcucugaggc

SEQ ID NO: 1352152 - RNA, 17 nt, Human
aagggagggcucugagg

SEQ ID NO: 1352153 - RNA, 16 nt, Human
aagggagggcucugag

SEQ ID NO: 1352154 - RNA, 21 nt, Human
aagggagggcucugaggcgcc

SEQ ID NO: 1352155 - RNA, 17 nt, Human
aagggccagagccaggg

SEQ ID NO: 1352156 - RNA, 19 nt, Human
aaggucauuuuuuuuaaga

SEQ ID NO: 1352157 - RNA, 15 nt, Human
aagggaaccuguguc

SEQ ID NO: 1352158 - RNA, 21 nt, Human
aagggagccaagggauggaca

SEQ ID NO: 1352159 - RNA, 19 nt, Human
aagggagccaagggaugga

SEQ ID NO: 1352160 - RNA, 18 nt, Human
aagggagccaagggaugg

SEQ ID NO: 1352161 - RNA, 14 nt, Human
aagggagccaaggg

SEQ ID NO: 1352162 - RNA, 13 nt, Human
aagggagccaagg

SEQ ID NO: 1352163 - RNA, 12 nt, Human
aagggagccaag

SEQ ID NO: 1352164 - RNA, 11 nt, Human
aagggagccaa

SEQ ID NO: 1352165 - RNA, 9 nt, Human
aagggagcc

SEQ ID NO: 1352166 - RNA, 21 nt, Human
aagucguccuuacuccugugg

SEQ ID NO: 1352167 - RNA, 20 nt, Human
aagucguccuuacuccugug

SEQ ID NO: 1352168 - RNA, 19 nt, Human
aagucguccuuacuccugu

SEQ ID NO: 1352169 - RNA, 14 nt, Human
aagucgguuagugg

SEQ ID NO: 1352170 - RNA, 21 nt, Human
aaguccuuuuuuuccaucuuu

SEQ ID NO: 1352171 - RNA, 22 nt, Human
aagucguccuuacuccuguggg

SEQ ID NO: 1352172 - RNA, 24 nt, Human
aagucguccuuacuccugugggag

SEQ ID NO: 1352173 - RNA, 12 nt, Human
aagucucagcua

SEQ ID NO: 1352174 - RNA, 11 nt, Human
aagucucagcu

SEQ ID NO: 1352175 - RNA, 14 nt, Human
aagucuccaaaguc

SEQ ID NO: 1352176 - RNA, 18 nt, Human
aaguccggccccaguaca

SEQ ID NO: 1352177 - RNA, 17 nt, Human
aaguccuacaagcuaaa

SEQ ID NO: 1352178 - RNA, 12 nt, Human
aaguccaaugug

SEQ ID NO: 1352179 - RNA, 18 nt, Human
aaguccaagcauuuagau

SEQ ID NO: 1352180 - RNA, 14 nt, Human
aaguaguccuguga

SEQ ID NO: 1352181 - RNA, 18 nt, Human
aaguaucccuacuguaau

SEQ ID NO: 1352182 - RNA, 23 nt, Human
aaguaucccuacuguaauuugug

SEQ ID NO: 1352183 - RNA, 20 nt, Human
aaggugacaucggaaaaaua

SEQ ID NO: 1352184 - RNA, 21 nt, Human
aaggugacaucggaaaaauaa

SEQ ID NO: 1352185 - RNA, 18 nt, Human
aaggucguuuuuuucauu

SEQ ID NO: 1352186 - RNA, 20 nt, Human
aaggucguuuuuuucauucc

SEQ ID NO: 1352187 - RNA, 20 nt, Human
aagguccucugucagucaca

SEQ ID NO: 1352188 - RNA, 19 nt, Human
aagguccgguguucuaaga

SEQ ID NO: 1352189 - RNA, 19 nt, Human
aagguccacaggucuagac

SEQ ID NO: 1352190 - RNA, 21 nt, Human
aagguccgguguucuaagaug

SEQ ID NO: 1352191 - RNA, 14 nt, Human
aaggucggaccagc

SEQ ID NO: 1352192 - RNA, 20 nt, Human
aaggugaggagcuugaaacc

SEQ ID NO: 1352193 - RNA, 18 nt, Human
aaugaaagcuacucauag

SEQ ID NO: 1352194 - RNA, 20 nt, Human
aaucucuuuuugcuuucgaa

SEQ ID NO: 1352195 - RNA, 13 nt, Human
aaucucugugccu

SEQ ID NO: 1352196 - RNA, 13 nt, Human
aaucucuguaaag

SEQ ID NO: 1352197 - RNA, 12 nt, Human
aaucucuguaaa

SEQ ID NO: 1352198 - RNA, 13 nt, Human
aaucucugggggc

SEQ ID NO: 1352199 - RNA, 22 nt, Human
aaucucuccacuuucagcuguc

SEQ ID NO: 1352200 - RNA, 20 nt, Human
aaucucuccacuuucagcug

SEQ ID NO: 1352201 - RNA, 19 nt, Human
aaucucuccacuuucagcu

SEQ ID NO: 1352202 - RNA, 23 nt, Human
aaucucuccacuuucagcugucu

SEQ ID NO: 1352203 - RNA, 18 nt, Human
aaucucuccacuuucagc

SEQ ID NO: 1352204 - RNA, 16 nt, Human
aaucucuccacuuuca

SEQ ID NO: 1352205 - RNA, 18 nt, Human
aauccaggcagauccagg

SEQ ID NO: 1352206 - RNA, 17 nt, Human
aauccaggcagauccag

SEQ ID NO: 1352207 - RNA, 17 nt, Human
aaucucaaauuucuaaa

SEQ ID NO: 1352208 - RNA, 18 nt, Human
aaucucaaauuucuaaau

SEQ ID NO: 1352209 - RNA, 15 nt, Human
aauccaaugaaauga

SEQ ID NO: 1352210 - RNA, 16 nt, Human
aaucucaaauuucuaa

SEQ ID NO: 1352211 - RNA, 23 nt, Human
aauccaaguagauaggaagaaag

SEQ ID NO: 1352212 - RNA, 13 nt, Human
aauccagccugcu

SEQ ID NO: 1352213 - RNA, 17 nt, Human
aaugaaguuguagguaa

SEQ ID NO: 1352214 - RNA, 12 nt, Human
aaugaaguuuga

SEQ ID NO: 1352215 - RNA, 13 nt, Human
aaugaaguuugaa

SEQ ID NO: 1352216 - RNA, 14 nt, Human
aaugaaguuugaau

SEQ ID NO: 1352217 - RNA, 15 nt, Human
aaugaaguuugaaug

SEQ ID NO: 1352218 - RNA, 16 nt, Human
aaugaaguuugaaugu

SEQ ID NO: 1352219 - RNA, 21 nt, Human
aaugaaauccugcuucagugu

SEQ ID NO: 1352220 - RNA, 23 nt, Human
aaugauccuguauucagacagau

SEQ ID NO: 1352221 - RNA, 21 nt, Human
aaugauccuguauucagacag

SEQ ID NO: 1352222 - RNA, 19 nt, Human
aaugauccuguauucagac

SEQ ID NO: 1352223 - RNA, 15 nt, Human
aaugauuaugaauua

SEQ ID NO: 1352224 - RNA, 23 nt, Human
aaugauuaugaauuacauuugua

SEQ ID NO: 1352225 - RNA, 21 nt, Human
aaugauuaugaauuacauuug

SEQ ID NO: 1352226 - RNA, 17 nt, Human
aauccaagcaaauguga

SEQ ID NO: 1352227 - RNA, 18 nt, Human
aauccaagcaaaugugaa

SEQ ID NO: 1352228 - RNA, 20 nt, Human
aauauaucuaccccagacua

SEQ ID NO: 1352229 - RNA, 18 nt, Human
aauauauauuaucuuuuc

SEQ ID NO: 1352230 - RNA, 19 nt, Human
aauauauauuaucuuuuca

SEQ ID NO: 1352231 - RNA, 16 nt, Human
aauauauauuaucuuu

SEQ ID NO: 1352232 - RNA, 15 nt, Human
aauauauauuaucuu

SEQ ID NO: 1352233 - RNA, 13 nt, Human
aauauauauuauc

SEQ ID NO: 1352234 - RNA, 23 nt, Human
aauauauauuauacuuguaauua

SEQ ID NO: 1352235 - RNA, 21 nt, Human
aauauauauuauacuuguaau

SEQ ID NO: 1352236 - RNA, 19 nt, Human
aauauauauuauacuugua

SEQ ID NO: 1352237 - RNA, 16 nt, Human
aauauauauuauacuu

SEQ ID NO: 1352238 - RNA, 14 nt, Human
aauauauauuauac

SEQ ID NO: 1352239 - RNA, 13 nt, Human
aauauauauuaua

SEQ ID NO: 1352240 - RNA, 16 nt, Human
aauauacuuguggacu

SEQ ID NO: 1352241 - RNA, 13 nt, Human
aauauacuugugg

SEQ ID NO: 1352242 - RNA, 15 nt, Human
aauauacuuguggac

SEQ ID NO: 1352243 - RNA, 22 nt, Human
aauagacaaauagaaaaugguc

SEQ ID NO: 1352244 - RNA, 17 nt, Human
aauauacuauauuuaug

SEQ ID NO: 1352245 - RNA, 14 nt, Human
aauagaaggugaug

SEQ ID NO: 1352246 - RNA, 16 nt, Human
aauagaauaaaggcag

SEQ ID NO: 1352247 - RNA, 15 nt, Human
aauagaauaaaggca

SEQ ID NO: 1352248 - RNA, 13 nt, Human
aauagaaggugau

SEQ ID NO: 1352249 - RNA, 19 nt, Human
aauagacaaauagaaaaug

SEQ ID NO: 1352250 - RNA, 14 nt, Human
aauagacaaauaga

SEQ ID NO: 1352251 - RNA, 16 nt, Human
aauagaauuauaacug

SEQ ID NO: 1352252 - RNA, 13 nt, Human
aauagacaauuua

SEQ ID NO: 1352253 - RNA, 17 nt, Human
aaucaagucuguuuacu

SEQ ID NO: 1352254 - RNA, 15 nt, Human
aaucaagucuguuua

SEQ ID NO: 1352255 - RNA, 18 nt, Human
aaucaagggucaggccuu

SEQ ID NO: 1352256 - RNA, 15 nt, Human
aaucaagggucaggc

SEQ ID NO: 1352257 - RNA, 14 nt, Human
aaucaagggucagg

SEQ ID NO: 1352258 - RNA, 18 nt, Human
aaucacaugaauuauuac

SEQ ID NO: 1352259 - RNA, 21 nt, Human
aaucaagucuguuuacugcaa

SEQ ID NO: 1352260 - RNA, 18 nt, Human
aaucaccacaaacuguaa

SEQ ID NO: 1352261 - RNA, 16 nt, Human
aauacuguauuuugua

SEQ ID NO: 1352262 - RNA, 21 nt, Human
aauacugcugagauacauaca

SEQ ID NO: 1352263 - RNA, 18 nt, Human
aauacugcugagauacau

SEQ ID NO: 1352264 - RNA, 15 nt, Human
aauacugcugagaua

SEQ ID NO: 1352265 - RNA, 13 nt, Human
aauacugcugaga

SEQ ID NO: 1352266 - RNA, 23 nt, Human
aauacugcuacagcaauuucuaa

SEQ ID NO: 1352267 - RNA, 14 nt, Human
aauacugcaaauca

SEQ ID NO: 1352268 - RNA, 10 nt, Human
aauacuuuuu

SEQ ID NO: 1352269 - RNA, 15 nt, Human
aauacuuuuuacaau

SEQ ID NO: 1352270 - RNA, 11 nt, Human
aauacuuuugc

SEQ ID NO: 1352271 - RNA, 20 nt, Human
aauacuuuuacucugccuac

SEQ ID NO: 1352272 - RNA, 18 nt, Human
aauacuuuuacucugccu

SEQ ID NO: 1352273 - RNA, 15 nt, Human
aauacuuuuacucug

SEQ ID NO: 1352274 - RNA, 20 nt, Human
aauacuuugaauguguuuca

SEQ ID NO: 1352275 - RNA, 17 nt, Human
aauacuuugaauguguu

SEQ ID NO: 1352276 - RNA, 23 nt, Human
aauacuuugcagcacagcugaga

SEQ ID NO: 1352277 - RNA, 16 nt, Human
aauacuuugaaugugu

SEQ ID NO: 1352278 - RNA, 15 nt, Human
aauacuuugaaugug

SEQ ID NO: 1352279 - RNA, 14 nt, Human
aauacuuugaaugu

SEQ ID NO: 1352280 - RNA, 13 nt, Human
aauacucaaauga

SEQ ID NO: 1352281 - RNA, 20 nt, Human
aauacucaaaugaguaacau

SEQ ID NO: 1352282 - RNA, 21 nt, Human
aauacuaccuugaaaauaaga

SEQ ID NO: 1352283 - RNA, 18 nt, Human
aauacuaccuugaaaaua

SEQ ID NO: 1352284 - RNA, 17 nt, Human
aauacuaccuugaaaau

SEQ ID NO: 1352285 - RNA, 15 nt, Human
aauacugaacaucug

SEQ ID NO: 1352286 - RNA, 13 nt, Human
aauacucuuauau

SEQ ID NO: 1352287 - RNA, 23 nt, Human
aaguugcugcuucucccaggcaa

SEQ ID NO: 1352288 - RNA, 21 nt, Human
aaguugcugcuucucccaggc

SEQ ID NO: 1352289 - RNA, 14 nt, Human
aaguugcugcuucu

SEQ ID NO: 1352290 - RNA, 12 nt, Human
aaguugcugcuu

SEQ ID NO: 1352291 - RNA, 15 nt, Human
aaugccuuuucccaa

SEQ ID NO: 1352292 - RNA, 23 nt, Human
aaugcgguuauaaaaaaugguuc

SEQ ID NO: 1352293 - RNA, 22 nt, Human
aaugcgguuauaaaaaaugguu

SEQ ID NO: 1352294 - RNA, 21 nt, Human
aaugcgguuauaaaaaauggu

SEQ ID NO: 1352295 - RNA, 18 nt, Human
aaugcgggugagaguaau

SEQ ID NO: 1352296 - RNA, 18 nt, Human
aaugcgugcauaccacuu

SEQ ID NO: 1352297 - RNA, 19 nt, Human
aaugcgugcauaccacuuu

SEQ ID NO: 1352298 - RNA, 23 nt, Human
aaugccuuacccucauguucuua

SEQ ID NO: 1352299 - RNA, 19 nt, Human
aaugucacuuuuugaggca

SEQ ID NO: 1352300 - RNA, 20 nt, Human
aaugucacuuuuugaggcaa

SEQ ID NO: 1352301 - RNA, 15 nt, Human
aaugguuguauuaga

SEQ ID NO: 1352302 - RNA, 16 nt, Human
aaugguuguauuagau

SEQ ID NO: 1352303 - RNA, 18 nt, Human
aaugguuguauuagaugu

SEQ ID NO: 1352304 - RNA, 15 nt, Human
aaugguucagaauua

SEQ ID NO: 1352305 - RNA, 22 nt, Human
aaugguucagaauuaaacuuuu

SEQ ID NO: 1352306 - RNA, 12 nt, Human
aaugguuguauu

SEQ ID NO: 1352307 - RNA, 13 nt, Human
aaugguuguauua

SEQ ID NO: 1352308 - RNA, 19 nt, Human
aaugucauuuugguacuuu

SEQ ID NO: 1352309 - RNA, 14 nt, Human
aaugucauuuuggu

SEQ ID NO: 1352310 - RNA, 19 nt, Human
aaugucauugaaaaacuaa

SEQ ID NO: 1352311 - RNA, 14 nt, Human
aaugucauugaaaa

SEQ ID NO: 1352312 - RNA, 17 nt, Human
aaugucaugcugccuua

SEQ ID NO: 1352313 - RNA, 19 nt, Human
aaugucaugcugccuuauu

SEQ ID NO: 1352314 - RNA, 16 nt, Human
aaugucaugcugccuu

SEQ ID NO: 1352315 - RNA, 15 nt, Human
aaugucaugcugccu

SEQ ID NO: 1352316 - RNA, 17 nt, Human
aaugcuagguucuaccu

SEQ ID NO: 1352317 - RNA, 15 nt, Human
aaugcuagguucuac

SEQ ID NO: 1352318 - RNA, 14 nt, Human
aaugcuagguucua

SEQ ID NO: 1352319 - RNA, 13 nt, Human
aaugcuagguucu

SEQ ID NO: 1352320 - RNA, 14 nt, Human
aauggugugggaga

SEQ ID NO: 1352321 - RNA, 15 nt, Human
aaugguguagaacac

SEQ ID NO: 1352322 - RNA, 23 nt, Human
aaugcuggcuauagaugucuuuu

SEQ ID NO: 1352323 - RNA, 19 nt, Human
aaugguguagaacacuaau

SEQ ID NO: 1352324 - RNA, 22 nt, Human
aaugcuggcuauagaugucuuu

SEQ ID NO: 1352325 - RNA, 21 nt, Human
aaugucuuuaaugcaauauac

SEQ ID NO: 1352326 - RNA, 20 nt, Human
aaugucuuuaaugcaauaua

SEQ ID NO: 1352327 - RNA, 17 nt, Human
aaugucuuuaaugcaau

SEQ ID NO: 1352328 - RNA, 23 nt, Human
aauguuuacacucuuuguaagag

SEQ ID NO: 1352329 - RNA, 20 nt, Human
aauguuuacacucuuuguaa

SEQ ID NO: 1352330 - RNA, 15 nt, Human
aauguuuaaaccuuu

SEQ ID NO: 1352331 - RNA, 23 nt, Human
aauguuucuucuagguucuaaaa

SEQ ID NO: 1352332 - RNA, 22 nt, Human
aauguuucuucuagguucuaaa

SEQ ID NO: 1352333 - RNA, 23 nt, Human
aauguuucaaacauauauaacaa

SEQ ID NO: 1352334 - RNA, 24 nt, Human
aauuaaaaaagauaaacacaagau

SEQ ID NO: 1352335 - RNA, 20 nt, Human
aauuaaaaaagauaaacaca

SEQ ID NO: 1352336 - RNA, 19 nt, Human
aauuaaaaaagauaaacac

SEQ ID NO: 1352337 - RNA, 18 nt, Human
aauuaaaaaagauaaaca

SEQ ID NO: 1352338 - RNA, 17 nt, Human
aauuaaaaaagauaaac

SEQ ID NO: 1352339 - RNA, 16 nt, Human
aauuaaaaaagauaaa

SEQ ID NO: 1352340 - RNA, 15 nt, Human
aauuaaaaaagauaa

SEQ ID NO: 1352341 - RNA, 13 nt, Human
aauuaaaaaagau

SEQ ID NO: 1352342 - RNA, 21 nt, Human
aauuaaaaaaaaagaucuguu

SEQ ID NO: 1352343 - RNA, 16 nt, Human
aauguuucuggauuuc

SEQ ID NO: 1352344 - RNA, 22 nt, Human
aauguuuuuuuuuaaagacuuu

SEQ ID NO: 1352345 - RNA, 15 nt, Human
aauguuuuuuuuuaa

SEQ ID NO: 1352346 - RNA, 20 nt, Human
aauguuuuuuuuuaaagacu

SEQ ID NO: 1352347 - RNA, 22 nt, Human
agaaaaugcgguuauaaaaaau

SEQ ID NO: 1352348 - RNA, 14 nt, Human
agaaaggccuuuaa

SEQ ID NO: 1352349 - RNA, 15 nt, Human
agaaaggccuuuaaa

SEQ ID NO: 1352350 - RNA, 16 nt, Human
agaaaaugauacagca

SEQ ID NO: 1352351 - RNA, 15 nt, Human
agaaaaucuuuauaa

SEQ ID NO: 1352352 - RNA, 13 nt, Human
agaaaaucacuua

SEQ ID NO: 1352353 - RNA, 17 nt, Human
agaaaggggagcccacu

SEQ ID NO: 1352354 - RNA, 16 nt, Human
agaaaggggagcccac

SEQ ID NO: 1352355 - RNA, 15 nt, Human
agaaaggggagccca

SEQ ID NO: 1352356 - RNA, 14 nt, Human
agaaaggggagccc

SEQ ID NO: 1352357 - RNA, 22 nt, Human
agaaagggcccugggccugccu

SEQ ID NO: 1352358 - RNA, 20 nt, Human
agaaagggcccugggccugc

SEQ ID NO: 1352359 - RNA, 16 nt, Human
agaaagggcccugggc

SEQ ID NO: 1352360 - RNA, 20 nt, Human
agaaagggagggcucugagg

SEQ ID NO: 1352361 - RNA, 21 nt, Human
agaaagggagggcucugaggc

SEQ ID NO: 1352362 - RNA, 19 nt, Human
agaaagggagggcucugag

SEQ ID NO: 1352363 - RNA, 18 nt, Human
agaaagggagggcucuga

SEQ ID NO: 1352364 - RNA, 17 nt, Human
agaaagggagggcucug

SEQ ID NO: 1352365 - RNA, 16 nt, Human
agaaagggagggcucu

SEQ ID NO: 1352366 - RNA, 15 nt, Human
agaaagggagggcuc

SEQ ID NO: 1352367 - RNA, 14 nt, Human
agaaagggagggcu

SEQ ID NO: 1352368 - RNA, 13 nt, Human
agaaagggagggc

SEQ ID NO: 1352369 - RNA, 22 nt, Human
agaaaggcuguuaaauacagga

SEQ ID NO: 1352370 - RNA, 21 nt, Human
agaaaggcuguuaaauacagg

SEQ ID NO: 1352371 - RNA, 16 nt, Human
agaaaggcuguuaaau

SEQ ID NO: 1352372 - RNA, 15 nt, Human
agaaaggcuguuaaa

SEQ ID NO: 1352373 - RNA, 19 nt, Human
agaaaggccuuuaaaauuu

SEQ ID NO: 1352374 - RNA, 16 nt, Human
agaaaggccuuuaaaa

SEQ ID NO: 1352375 - RNA, 17 nt, Human
agaaaggccuuuaaaau

SEQ ID NO: 1352376 - RNA, 23 nt, Human
agaaaguggaaaacaaggaaguc

SEQ ID NO: 1352377 - RNA, 20 nt, Human
agaaaguggaaaacaaggaa

SEQ ID NO: 1352378 - RNA, 19 nt, Human
agaaaguggaaaacaagga

SEQ ID NO: 1352379 - RNA, 22 nt, Human
agaaagugccuuucaggaucua

SEQ ID NO: 1352380 - RNA, 21 nt, Human
agaaagugccuuucaggaucu

SEQ ID NO: 1352381 - RNA, 18 nt, Human
agaaagugccuuucagga

SEQ ID NO: 1352382 - RNA, 17 nt, Human
agaaagugccuuucagg

SEQ ID NO: 1352383 - RNA, 16 nt, Human
agaaagugccuuucag

SEQ ID NO: 1352384 - RNA, 14 nt, Human
agaaagugccuuuc

SEQ ID NO: 1352385 - RNA, 22 nt, Human
agaaagugccugacacacuaac

SEQ ID NO: 1352386 - RNA, 19 nt, Human
agaaagugccugacacacu

SEQ ID NO: 1352387 - RNA, 15 nt, Human
agaaagugccugaca

SEQ ID NO: 1352388 - RNA, 16 nt, Human
agaaagguuaguauca

SEQ ID NO: 1352389 - RNA, 23 nt, Human
agaaagggcccugggccugccuc

SEQ ID NO: 1352390 - RNA, 17 nt, Human
agaaaguguauuuggaa

SEQ ID NO: 1352391 - RNA, 16 nt, Human
agaaaguguauuugga

SEQ ID NO: 1352392 - RNA, 13 nt, Human
agaaaguguauuu

SEQ ID NO: 1352393 - RNA, 11 nt, Human
agaaaguguau

SEQ ID NO: 1352394 - RNA, 18 nt, Human
agaaauaaaaggaagcca

SEQ ID NO: 1352395 - RNA, 17 nt, Human
agaaauaaaaggaagcc

SEQ ID NO: 1352396 - RNA, 12 nt, Human
agaaaguugauu

SEQ ID NO: 1352397 - RNA, 23 nt, Human
agaaauaaguuuuuguuucacag

SEQ ID NO: 1352398 - RNA, 16 nt, Human
agaaauaaguuuuugu

SEQ ID NO: 1352399 - RNA, 14 nt, Human
agaaauaaguuuuu

SEQ ID NO: 1352400 - RNA, 13 nt, Human
agaaauaaguuuu

SEQ ID NO: 1352401 - RNA, 19 nt, Human
agaaauaagugcccucucc

SEQ ID NO: 1352402 - RNA, 17 nt, Human
agaaauaaauuuauuuc

SEQ ID NO: 1352403 - RNA, 22 nt, Human
acuuuauuuucuauaauuuaaa

SEQ ID NO: 1352404 - RNA, 13 nt, Human
acuuuaucacuua

SEQ ID NO: 1352405 - RNA, 15 nt, Human
acuuuaucacuuaaa

SEQ ID NO: 1352406 - RNA, 22 nt, Human
acuuuaucuugaauaauguaag

SEQ ID NO: 1352407 - RNA, 13 nt, Human
acuuuuaauucau

SEQ ID NO: 1352408 - RNA, 18 nt, Human
acuuuuaaugaacaaaug

SEQ ID NO: 1352409 - RNA, 20 nt, Human
acuuuuaaacuguguacaua

SEQ ID NO: 1352410 - RNA, 21 nt, Human
acuuuuacucugccuacagaa

SEQ ID NO: 1352411 - RNA, 19 nt, Human
acuuuuacucugccuacag

SEQ ID NO: 1352412 - RNA, 16 nt, Human
acuuuuacucugccua

SEQ ID NO: 1352413 - RNA, 15 nt, Human
acuuuuacucugccu

SEQ ID NO: 1352414 - RNA, 21 nt, Human
acuuuuacaaguaacaaaaau

SEQ ID NO: 1352415 - RNA, 14 nt, Human
acuuuuacaaguaa

SEQ ID NO: 1352416 - RNA, 13 nt, Human
acuuuuacaagua

SEQ ID NO: 1352417 - RNA, 13 nt, Human
acuuuuauaaacu

SEQ ID NO: 1352418 - RNA, 12 nt, Human
acuuuuaugaua

SEQ ID NO: 1352419 - RNA, 16 nt, Human
acuuuuaugauacuug

SEQ ID NO: 1352420 - RNA, 15 nt, Human
acuuuucccacucca

SEQ ID NO: 1352421 - RNA, 14 nt, Human
acuuuucccacucc

SEQ ID NO: 1352422 - RNA, 16 nt, Human
acuuuuaguaaaguca

SEQ ID NO: 1352423 - RNA, 15 nt, Human
acuuuuauaaacuuu

SEQ ID NO: 1352424 - RNA, 23 nt, Human
acuuuuaugauacuugaaaauua

SEQ ID NO: 1352425 - RNA, 19 nt, Human
agaaaauaguggugugauu

SEQ ID NO: 1352426 - RNA, 15 nt, Human
acuuuugcccuuuga

SEQ ID NO: 1352427 - RNA, 12 nt, Human
acuuuugacaaa

SEQ ID NO: 1352428 - RNA, 22 nt, Human
agaaaauaaggcacccaucugu

SEQ ID NO: 1352429 - RNA, 22 nt, Human
acuuuugcuguaauguuaauau

SEQ ID NO: 1352430 - RNA, 14 nt, Human
acuuuuggaaggua

SEQ ID NO: 1352431 - RNA, 22 nt, Human
acuuauuuuugacaguguugaa

SEQ ID NO: 1352432 - RNA, 19 nt, Human
acuuauuuuugacaguguu

SEQ ID NO: 1352433 - RNA, 16 nt, Human
acuuauuuuugacagu

SEQ ID NO: 1352434 - RNA, 14 nt, Human
acuuauuuuugaca

SEQ ID NO: 1352435 - RNA, 19 nt, Human
acuguuuggaaauaaaucu

SEQ ID NO: 1352436 - RNA, 17 nt, Human
acuuauuuaugaaccug

SEQ ID NO: 1352437 - RNA, 23 nt, Human
acuguuuggaaauugauuuugaa

SEQ ID NO: 1352438 - RNA, 22 nt, Human
acuguuugccuucuacuuuuaa

SEQ ID NO: 1352439 - RNA, 21 nt, Human
acuguuugccuucuacuuuua

SEQ ID NO: 1352440 - RNA, 15 nt, Human
acuucaaaaguuugu

SEQ ID NO: 1352441 - RNA, 16 nt, Human
acuucagaaagacuug

SEQ ID NO: 1352442 - RNA, 12 nt, Human
acuucagaaaga

SEQ ID NO: 1352443 - RNA, 21 nt, Human
acuucuguaauuguguggauu

SEQ ID NO: 1352444 - RNA, 15 nt, Human
acuucuguaauugug

SEQ ID NO: 1352445 - RNA, 22 nt, Human
acuucugggcuucaucuggcaa

SEQ ID NO: 1352446 - RNA, 19 nt, Human
acuucugggcuucaucugg

SEQ ID NO: 1352447 - RNA, 17 nt, Human
acuucugggcuucaucu

SEQ ID NO: 1352448 - RNA, 12 nt, Human
acuucuugaagg

SEQ ID NO: 1352449 - RNA, 23 nt, Human
acuucuuauggaauugauuugca

SEQ ID NO: 1352450 - RNA, 21 nt, Human
acuucuuauggaauugauuug

SEQ ID NO: 1352451 - RNA, 20 nt, Human
acuucuuauggaauugauuu

SEQ ID NO: 1352452 - RNA, 17 nt, Human
acuucuuauggaauuga

SEQ ID NO: 1352453 - RNA, 16 nt, Human
acuucuuauggaauug

SEQ ID NO: 1352454 - RNA, 21 nt, Human
acuuggggaguuaagaccugg

SEQ ID NO: 1352455 - RNA, 23 nt, Human
acuugggcacccccagccugggc

SEQ ID NO: 1352456 - RNA, 22 nt, Human
acuugggcacccccagccuggg

SEQ ID NO: 1352457 - RNA, 21 nt, Human
acuugggcacccccagccugg

SEQ ID NO: 1352458 - RNA, 20 nt, Human
acuugggcacccccagccug

SEQ ID NO: 1352459 - RNA, 17 nt, Human
acuugggcacccccagc

SEQ ID NO: 1352460 - RNA, 13 nt, Human
acuugggcacccc

SEQ ID NO: 1352461 - RNA, 16 nt, Human
acuucuugaaggugcu

SEQ ID NO: 1352462 - RNA, 13 nt, Human
acuucuugaaggu

SEQ ID NO: 1352463 - RNA, 14 nt, Human
acuugguuuugcua

SEQ ID NO: 1352464 - RNA, 20 nt, Human
acuugguugguaggguggga

SEQ ID NO: 1352465 - RNA, 23 nt, Human
acuuggggaguuaagaccuggca

SEQ ID NO: 1352466 - RNA, 18 nt, Human
acuuguaaaggaauuuaa

SEQ ID NO: 1352467 - RNA, 23 nt, Human
acucuguccugaaggccugaggu

SEQ ID NO: 1352468 - RNA, 20 nt, Human
acucuguccugaaggccuga

SEQ ID NO: 1352469 - RNA, 19 nt, Human
acucuguccugaaggccug

SEQ ID NO: 1352470 - RNA, 13 nt, Human
acucuguccugaa

SEQ ID NO: 1352471 - RNA, 12 nt, Human
acucuguccuga

SEQ ID NO: 1352472 - RNA, 11 nt, Human
acucugugcca

SEQ ID NO: 1352473 - RNA, 15 nt, Human
acucugucuuguguu

SEQ ID NO: 1352474 - RNA, 22 nt, Human
acucuguccugaaggccugagg

SEQ ID NO: 1352475 - RNA, 12 nt, Human
acugccagcauu

SEQ ID NO: 1352476 - RNA, 15 nt, Human
acuggucuguaggga

SEQ ID NO: 1352477 - RNA, 12 nt, Human
acuggucucucu

SEQ ID NO: 1352478 - RNA, 22 nt, Human
acuggucacggauuugugucug

SEQ ID NO: 1352479 - RNA, 22 nt, Human
acugguccaaaagauugcugaa

SEQ ID NO: 1352480 - RNA, 21 nt, Human
acugguccaaaagauugcuga

SEQ ID NO: 1352481 - RNA, 18 nt, Human
acugguauguaaaagaaa

SEQ ID NO: 1352482 - RNA, 15 nt, Human
acugguaggaccaag

SEQ ID NO: 1352483 - RNA, 18 nt, Human
acugguaggaaacuaggu

SEQ ID NO: 1352484 - RNA, 15 nt, Human
acuggagcagaaggg

SEQ ID NO: 1352485 - RNA, 12 nt, Human
acuggagcacaa

SEQ ID NO: 1352486 - RNA, 21 nt, Human
acuggagacugugugugcccu

SEQ ID NO: 1352487 - RNA, 13 nt, Human
acuggagacugug

SEQ ID NO: 1352488 - RNA, 19 nt, Human
acuggaagcuaauuugcau

SEQ ID NO: 1352489 - RNA, 14 nt, Human
acugccaggaggga

SEQ ID NO: 1352490 - RNA, 13 nt, Human
acugccaggaggg

SEQ ID NO: 1352491 - RNA, 12 nt, Human
acugccaggagg

SEQ ID NO: 1352492 - RNA, 15 nt, Human
acugccaggagggac

SEQ ID NO: 1352493 - RNA, 21 nt, Human
acugccaggagggacaaagga

SEQ ID NO: 1352494 - RNA, 19 nt, Human
acugcccauggacaggcug

SEQ ID NO: 1352495 - RNA, 21 nt, Human
acugcccauggacaggcuggc

SEQ ID NO: 1352496 - RNA, 16 nt, Human
acuggaagcuaauuug

SEQ ID NO: 1352497 - RNA, 23 nt, Human
acugugccucagagaccagggcu

SEQ ID NO: 1352498 - RNA, 22 nt, Human
acugugccucagagaccagggc

SEQ ID NO: 1352499 - RNA, 20 nt, Human
acugugccucagagaccagg

SEQ ID NO: 1352500 - RNA, 19 nt, Human
acugugccucagagaccag

SEQ ID NO: 1352501 - RNA, 21 nt, Human
acugugacccccagcuccggc

SEQ ID NO: 1352502 - RNA, 19 nt, Human
acugugacccccagcuccg

SEQ ID NO: 1352503 - RNA, 16 nt, Human
acugugaaggacccuu

SEQ ID NO: 1352504 - RNA, 15 nt, Human
acugugaaggacccu

SEQ ID NO: 1352505 - RNA, 18 nt, Human
acugucucucaugaaccu

SEQ ID NO: 1352506 - RNA, 17 nt, Human
acugucucucaugaacc

SEQ ID NO: 1352507 - RNA, 15 nt, Human
acugucucucaugaa

SEQ ID NO: 1352508 - RNA, 21 nt, Human
acugucucgaugcaaugaaca

SEQ ID NO: 1352509 - RNA, 22 nt, Human
acugucuccauggcccugcaaa

SEQ ID NO: 1352510 - RNA, 17 nt, Human
acugguuugaagaaugu

SEQ ID NO: 1352511 - RNA, 20 nt, Human
acugguuugaagaauguuaa

SEQ ID NO: 1352512 - RNA, 13 nt, Human
acuggucugcugu

SEQ ID NO: 1352513 - RNA, 18 nt, Human
acugguuccauggccucu

SEQ ID NO: 1352514 - RNA, 22 nt, Human
acuguaagaaaauaucacuugu

SEQ ID NO: 1352515 - RNA, 13 nt, Human
acuguaagaaaau

SEQ ID NO: 1352516 - RNA, 19 nt, Human
acuguaagaaaauaucacu

SEQ ID NO: 1352517 - RNA, 12 nt, Human
acucuguaauug

SEQ ID NO: 1352518 - RNA, 17 nt, Human
acucuggugccuccaga

SEQ ID NO: 1352519 - RNA, 16 nt, Human
acucuggugccuccag

SEQ ID NO: 1352520 - RNA, 14 nt, Human
acucuggugccucc

SEQ ID NO: 1352521 - RNA, 19 nt, Human
acucugguggcacaggagu

SEQ ID NO: 1352522 - RNA, 20 nt, Human
acucuggugagucaccacuu

SEQ ID NO: 1352523 - RNA, 12 nt, Human
acucuauucuuu

SEQ ID NO: 1352524 - RNA, 15 nt, Human
acucuagucaaugac

SEQ ID NO: 1352525 - RNA, 13 nt, Human
acucuagucaaug

SEQ ID NO: 1352526 - RNA, 11 nt, Human
acucuguccug

SEQ ID NO: 1352527 - RNA, 15 nt, Human
acucuguaauugcaa

SEQ ID NO: 1352528 - RNA, 14 nt, Human
acucuguaauugca

SEQ ID NO: 1352529 - RNA, 13 nt, Human
acucuguaauugc

SEQ ID NO: 1352530 - RNA, 17 nt, Human
acucuagucaaugacau

SEQ ID NO: 1352531 - RNA, 23 nt, Human
acucuaucaaguauuauaccuuu

SEQ ID NO: 1352532 - RNA, 23 nt, Human
acucauauaauuauauguuguaa

SEQ ID NO: 1352533 - RNA, 19 nt, Human
acucauauaauuauauguu

SEQ ID NO: 1352534 - RNA, 18 nt, Human
acucauauaauuauaugu

SEQ ID NO: 1352535 - RNA, 17 nt, Human
acucauauaauuauaug

SEQ ID NO: 1352536 - RNA, 23 nt, Human
acucauacacucguaugauacuu

SEQ ID NO: 1352537 - RNA, 20 nt, Human
acucaucaauggggccaguc

SEQ ID NO: 1352538 - RNA, 15 nt, Human
acucauauuuucaug

SEQ ID NO: 1352539 - RNA, 17 nt, Human
acuagauguaguauuuu

SEQ ID NO: 1352540 - RNA, 16 nt, Human
acuagauguaguauuu

SEQ ID NO: 1352541 - RNA, 13 nt, Human
acuagcauaucug

SEQ ID NO: 1352542 - RNA, 13 nt, Human
acuagauguagua

SEQ ID NO: 1352543 - RNA, 12 nt, Human
acuagauguagu

SEQ ID NO: 1352544 - RNA, 18 nt, Human
acuagauggaccugccug

SEQ ID NO: 1352545 - RNA, 20 nt, Human
acuagauggaccugccugca

SEQ ID NO: 1352546 - RNA, 23 nt, Human
acucaaauggggccagauccagc

SEQ ID NO: 1352547 - RNA, 22 nt, Human
acucaaauggggccagauccag

SEQ ID NO: 1352548 - RNA, 21 nt, Human
acucaaauggggccagaucca

SEQ ID NO: 1352549 - RNA, 20 nt, Human
acucaaauggggccagaucc

SEQ ID NO: 1352550 - RNA, 17 nt, Human
acucaaauggggccaga

SEQ ID NO: 1352551 - RNA, 16 nt, Human
acucaaaugaguaaca

SEQ ID NO: 1352552 - RNA, 14 nt, Human
acucaaaugaguaa

SEQ ID NO: 1352553 - RNA, 17 nt, Human
acucaaaugaguaacau

SEQ ID NO: 1352554 - RNA, 17 nt, Human
acucaaauguucuaagu

SEQ ID NO: 1352555 - RNA, 16 nt, Human
acucaaauguucuaag

SEQ ID NO: 1352556 - RNA, 20 nt, Human
acucaaaugugaguguuuuu

SEQ ID NO: 1352557 - RNA, 18 nt, Human
acucagccacccugaguu

SEQ ID NO: 1352558 - RNA, 17 nt, Human
acucagccacccugagu

SEQ ID NO: 1352559 - RNA, 16 nt, Human
acucaggagccuguga

SEQ ID NO: 1352560 - RNA, 20 nt, Human
acucagcuuucuuuaaaguu

SEQ ID NO: 1352561 - RNA, 15 nt, Human
acucagguggcccua

SEQ ID NO: 1352562 - RNA, 16 nt, Human
acucagggcuccuggg

SEQ ID NO: 1352563 - RNA, 14 nt, Human
acucaguaauuugu

SEQ ID NO: 1352564 - RNA, 17 nt, Human
acucagucucucuucuc

SEQ ID NO: 1352565 - RNA, 17 nt, Human
acuauuuaacugacuau

SEQ ID NO: 1352566 - RNA, 16 nt, Human
acuauuuaacugacua

SEQ ID NO: 1352567 - RNA, 15 nt, Human
acuauuuaacugacu

SEQ ID NO: 1352568 - RNA, 14 nt, Human
acuauuuaacugac

SEQ ID NO: 1352569 - RNA, 13 nt, Human
acuauuuaacuga

SEQ ID NO: 1352570 - RNA, 12 nt, Human
acuauuuaacug

SEQ ID NO: 1352571 - RNA, 20 nt, Human
acuauuuaaagccuccucau

SEQ ID NO: 1352572 - RNA, 11 nt, Human
acuauuuaaag

SEQ ID NO: 1352573 - RNA, 18 nt, Human
acuauuuuucagaaucuc

SEQ ID NO: 1352574 - RNA, 16 nt, Human
acuagccaaaccucac

SEQ ID NO: 1352575 - RNA, 15 nt, Human
acuagccaaaccuca

SEQ ID NO: 1352576 - RNA, 19 nt, Human
acuagcauaucugccuuua

SEQ ID NO: 1352577 - RNA, 15 nt, Human
acuagcauaucugcc

SEQ ID NO: 1352578 - RNA, 17 nt, Human
acuagcauaucugccuu

SEQ ID NO: 1352579 - RNA, 20 nt, Human
acuaguauuucuaugaaaua

SEQ ID NO: 1352580 - RNA, 14 nt, Human
acuaauuucaaaau

SEQ ID NO: 1352581 - RNA, 23 nt, Human
acuaauuccacaccuuuuauuga

SEQ ID NO: 1352582 - RNA, 19 nt, Human
acuaauuucaaaaugcuuu

SEQ ID NO: 1352583 - RNA, 16 nt, Human
acuaauuucaaaaugc

SEQ ID NO: 1352584 - RNA, 20 nt, Human
acuaauuucaaaaugcuuuu

SEQ ID NO: 1352585 - RNA, 18 nt, Human
acuaagccagcaccggac

SEQ ID NO: 1352586 - RNA, 15 nt, Human
acuaauuccacaccu

SEQ ID NO: 1352587 - RNA, 15 nt, Human
acuaaguuuuuaugg

SEQ ID NO: 1352588 - RNA, 21 nt, Human
acgugaccggacuuuucugca

SEQ ID NO: 1352589 - RNA, 21 nt, Human
acgugacacaaacacacacaa

SEQ ID NO: 1352590 - RNA, 20 nt, Human
acgugacacaaacacacaca

SEQ ID NO: 1352591 - RNA, 17 nt, Human
acuaagagaaguuguaa

SEQ ID NO: 1352592 - RNA, 16 nt, Human
acuaagagaaguugua

SEQ ID NO: 1352593 - RNA, 15 nt, Human
acuaagagagaauga

SEQ ID NO: 1352594 - RNA, 13 nt, Human
acuaagagagaau

SEQ ID NO: 1352595 - RNA, 21 nt, Human
acgcaugcaguguuggggaug

SEQ ID NO: 1352596 - RNA, 16 nt, Human
acgcuuugauucauag

SEQ ID NO: 1352597 - RNA, 14 nt, Human
acgcuuugauucau

SEQ ID NO: 1352598 - RNA, 13 nt, Human
acgcuuugauuca

SEQ ID NO: 1352599 - RNA, 12 nt, Human
acgcuuugauuc

SEQ ID NO: 1352600 - RNA, 23 nt, Human
acgcuuuugugauggagugcugu

SEQ ID NO: 1352601 - RNA, 14 nt, Human
acgcuuuugugaug

SEQ ID NO: 1352602 - RNA, 17 nt, Human
acgcuuuuugaaaaagc

SEQ ID NO: 1352603 - RNA, 15 nt, Human
acggaaagugcuguc

SEQ ID NO: 1352604 - RNA, 11 nt, Human
acgcuuugauu

SEQ ID NO: 1352605 - RNA, 18 nt, Human
acgcuuuccugaauccaa

SEQ ID NO: 1352606 - RNA, 14 nt, Human
acggaacucaaaua

SEQ ID NO: 1352607 - RNA, 22 nt, Human
acggaagaagagaucaggaaga

SEQ ID NO: 1352608 - RNA, 17 nt, Human
accuuggguuagaccua

SEQ ID NO: 1352609 - RNA, 23 nt, Human
accuuggguuagaccuacagggg

SEQ ID NO: 1352610 - RNA, 22 nt, Human
accuguugagcaucacagaaug

SEQ ID NO: 1352611 - RNA, 20 nt, Human
accuguugagcaucacagaa

SEQ ID NO: 1352612 - RNA, 19 nt, Human
accuguugagcaucacaga

SEQ ID NO: 1352613 - RNA, 14 nt, Human
accuguugagcauc

SEQ ID NO: 1352614 - RNA, 17 nt, Human
accuguuagcagacagg

SEQ ID NO: 1352615 - RNA, 18 nt, Human
accuguuaccuacuuuga

SEQ ID NO: 1352616 - RNA, 17 nt, Human
accuguuaccuacuuug

SEQ ID NO: 1352617 - RNA, 21 nt, Human
accuguugagcaucacagaau

SEQ ID NO: 1352618 - RNA, 14 nt, Human
accuuuagguucuu

SEQ ID NO: 1352619 - RNA, 15 nt, Human
accuuucuaguugaa

SEQ ID NO: 1352620 - RNA, 11 nt, Human
accuuucuagu

SEQ ID NO: 1352621 - RNA, 18 nt, Human
accuuuccaccacagcca

SEQ ID NO: 1352622 - RNA, 11 nt, Human
accuuucauac

SEQ ID NO: 1352623 - RNA, 15 nt, Human
accucugcugccucc

SEQ ID NO: 1352624 - RNA, 18 nt, Human
accucuggguugggauca

SEQ ID NO: 1352625 - RNA, 21 nt, Human
accucuguauuugaaucagcc

SEQ ID NO: 1352626 - RNA, 13 nt, Human
accugccucagga

SEQ ID NO: 1352627 - RNA, 23 nt, Human
accugccgagaguccaucagccu

SEQ ID NO: 1352628 - RNA, 16 nt, Human
accugccgagagucca

SEQ ID NO: 1352629 - RNA, 11 nt, Human
accuguccaau

SEQ ID NO: 1352630 - RNA, 18 nt, Human
accugucucaccuggacu

SEQ ID NO: 1352631 - RNA, 13 nt, Human
accugucucacca

SEQ ID NO: 1352632 - RNA, 11 nt, Human
accugucuguc

SEQ ID NO: 1352633 - RNA, 12 nt, Human
accugucugucu

SEQ ID NO: 1352634 - RNA, 21 nt, Human
accuguguuucuugccucauu

SEQ ID NO: 1352635 - RNA, 20 nt, Human
accuguguuucuugccucau

SEQ ID NO: 1352636 - RNA, 19 nt, Human
accuguguuucuugccuca

SEQ ID NO: 1352637 - RNA, 18 nt, Human
accuguguuucuugccuc

SEQ ID NO: 1352638 - RNA, 17 nt, Human
accuguguuucuugccu

SEQ ID NO: 1352639 - RNA, 21 nt, Human
accucugcagcaauaaagcag

SEQ ID NO: 1352640 - RNA, 18 nt, Human
accucugcagcaauaaag

SEQ ID NO: 1352641 - RNA, 20 nt, Human
accucugcagcaauaaagca

SEQ ID NO: 1352642 - RNA, 22 nt, Human
acacgcgguuugguuugcagcg

SEQ ID NO: 1352643 - RNA, 18 nt, Human
acaccaacauaaaaauga

SEQ ID NO: 1352644 - RNA, 15 nt, Human
acaccaaaguucuaa

SEQ ID NO: 1352645 - RNA, 14 nt, Human
acaccaaaguucua

SEQ ID NO: 1352646 - RNA, 19 nt, Human
acacauuuuuuaggaaaug

SEQ ID NO: 1352647 - RNA, 16 nt, Human
acacauuuuuuaggaa

SEQ ID NO: 1352648 - RNA, 15 nt, Human
acacauuuuuuagga

SEQ ID NO: 1352649 - RNA, 14 nt, Human
acaccaagcacagc

SEQ ID NO: 1352650 - RNA, 17 nt, Human
acaccaacauaaaaaug

SEQ ID NO: 1352651 - RNA, 21 nt, Human
acaauuguguagccuuuuugu

SEQ ID NO: 1352652 - RNA, 23 nt, Human
acaauuguguagccuuuuuguau

SEQ ID NO: 1352653 - RNA, 18 nt, Human
acaauuguguagccuuuu

SEQ ID NO: 1352654 - RNA, 17 nt, Human
acaauuguguagccuuu

SEQ ID NO: 1352655 - RNA, 16 nt, Human
acaauuguguagccuu

SEQ ID NO: 1352656 - RNA, 14 nt, Human
acaauuguguagcc

SEQ ID NO: 1352657 - RNA, 13 nt, Human
acaauugaaguaa

SEQ ID NO: 1352658 - RNA, 22 nt, Human
acaauugaaguaaacuuuuugu

SEQ ID NO: 1352659 - RNA, 19 nt, Human
acaauugaaguaaacuuuu

SEQ ID NO: 1352660 - RNA, 16 nt, Human
acaauugaaguaaacu

SEQ ID NO: 1352661 - RNA, 22 nt, Human
acaauugagguaaguuuuuuga

SEQ ID NO: 1352662 - RNA, 22 nt, Human
acacauuuuauuuuauuaugca

SEQ ID NO: 1352663 - RNA, 12 nt, Human
acacauuuuucu

SEQ ID NO: 1352664 - RNA, 20 nt, Human
acacauuuuuuaaaugcacc

SEQ ID NO: 1352665 - RNA, 22 nt, Human
acacauuuuuuaaaugcaccug

SEQ ID NO: 1352666 - RNA, 18 nt, Human
acaaggccaucugggcuc

SEQ ID NO: 1352667 - RNA, 21 nt, Human
acaaggcagcaaggcccgagc

SEQ ID NO: 1352668 - RNA, 22 nt, Human
acaaggcagcaaggcccgagca

SEQ ID NO: 1352669 - RNA, 18 nt, Human
acaaggcagcaaggcccg

SEQ ID NO: 1352670 - RNA, 16 nt, Human
acaaggcagcaaggcc

SEQ ID NO: 1352671 - RNA, 15 nt, Human
acaaggcagcaaggc

SEQ ID NO: 1352672 - RNA, 23 nt, Human
acaagaaaauaagagcucaggau

SEQ ID NO: 1352673 - RNA, 23 nt, Human
acaagaaaaauaaagaaaagaug

SEQ ID NO: 1352674 - RNA, 20 nt, Human
acaagaaaaauaaagaaaag

SEQ ID NO: 1352675 - RNA, 18 nt, Human
acaagaaaaauaaagaaa

SEQ ID NO: 1352676 - RNA, 17 nt, Human
acaagaaaaauaaagaa

SEQ ID NO: 1352677 - RNA, 16 nt, Human
acaagaaaaauaaaga

SEQ ID NO: 1352678 - RNA, 19 nt, Human
acaagaaaauaagagcuca

SEQ ID NO: 1352679 - RNA, 18 nt, Human
acaacgugcucuuuguuu

SEQ ID NO: 1352680 - RNA, 10 nt, Human
acaacuaagu

SEQ ID NO: 1352681 - RNA, 22 nt, Human
acaacgugcucuuuguuuugug

SEQ ID NO: 1352682 - RNA, 22 nt, Human
acaacuaagugauuuguauguc

SEQ ID NO: 1352683 - RNA, 16 nt, Human
acaaaauguaugucug

SEQ ID NO: 1352684 - RNA, 14 nt, Human
acaacggagucaaa

SEQ ID NO: 1352685 - RNA, 20 nt, Human
acaacggagucaaaaauuaa

SEQ ID NO: 1352686 - RNA, 22 nt, Human
acaacggagucaaaaauuaaac

SEQ ID NO: 1352687 - RNA, 13 nt, Human
acaacgugcauug

SEQ ID NO: 1352688 - RNA, 14 nt, Human
acaacgugcauugu

SEQ ID NO: 1352689 - RNA, 15 nt, Human
acaacgugcauugug

SEQ ID NO: 1352690 - RNA, 16 nt, Human
acaacgugcauugugc

SEQ ID NO: 1352691 - RNA, 17 nt, Human
acaacgugcauugugcu

SEQ ID NO: 1352692 - RNA, 18 nt, Human
acaacgugcauugugcuu

SEQ ID NO: 1352693 - RNA, 22 nt, Human
aauuuucuggaauacaugaaau

SEQ ID NO: 1352694 - RNA, 23 nt, Human
aauuuuccuguccucuuucagcu

SEQ ID NO: 1352695 - RNA, 19 nt, Human
aauuuuccuaauaaaguuc

SEQ ID NO: 1352696 - RNA, 22 nt, Human
aauuuuccuguccucuuucagc

SEQ ID NO: 1352697 - RNA, 18 nt, Human
aauuuuguaauguaucaa

SEQ ID NO: 1352698 - RNA, 15 nt, Human
aauuuuguaacgaag

SEQ ID NO: 1352699 - RNA, 17 nt, Human
aauuuuguguaagaaau

SEQ ID NO: 1352700 - RNA, 15 nt, Human
aauuuuguguaagaa

SEQ ID NO: 1352701 - RNA, 14 nt, Human
aauuuuguguaaga

SEQ ID NO: 1352702 - RNA, 18 nt, Human
aauuuugugguuuucgag

SEQ ID NO: 1352703 - RNA, 13 nt, Human
aauuuugugaagc

SEQ ID NO: 1352704 - RNA, 22 nt, Human
aauuuuguguaagaaauacaga

SEQ ID NO: 1352705 - RNA, 18 nt, Human
aauuuuguguaagaaaua

SEQ ID NO: 1352706 - RNA, 13 nt, Human
aauuuuguugcug

SEQ ID NO: 1352707 - RNA, 21 nt, Human
acagccaacuagccccugggg

SEQ ID NO: 1352708 - RNA, 19 nt, Human
acaggcaaaauccuugcuu

SEQ ID NO: 1352709 - RNA, 22 nt, Human
acaggaugguucccuugaugaa

SEQ ID NO: 1352710 - RNA, 18 nt, Human
acaggauccaggccggcu

SEQ ID NO: 1352711 - RNA, 19 nt, Human
acaggaucaguuaacuauu

SEQ ID NO: 1352712 - RNA, 12 nt, Human
acaggauccagg

SEQ ID NO: 1352713 - RNA, 13 nt, Human
acaggauccaggc

SEQ ID NO: 1352714 - RNA, 21 nt, Human
acaggaugaugacuauggaaa

SEQ ID NO: 1352715 - RNA, 23 nt, Human
acacugcacaauaacuccuccca

SEQ ID NO: 1352716 - RNA, 20 nt, Human
acacugggugguggccuggu

SEQ ID NO: 1352717 - RNA, 23 nt, Human
acacugggugguggccugguccc

SEQ ID NO: 1352718 - RNA, 19 nt, Human
acacugggugguggccugg

SEQ ID NO: 1352719 - RNA, 18 nt, Human
acacugggugguggccug

SEQ ID NO: 1352720 - RNA, 13 nt, Human
acacuggguggug

SEQ ID NO: 1352721 - RNA, 14 nt, Human
acacuggccccuca

SEQ ID NO: 1352722 - RNA, 13 nt, Human
acacuggccccuc

SEQ ID NO: 1352723 - RNA, 16 nt, Human
acacugcacaauaacu

SEQ ID NO: 1352724 - RNA, 18 nt, Human
acacugcagccccaccca

SEQ ID NO: 1352725 - RNA, 11 nt, Human
acacugccagc

SEQ ID NO: 1352726 - RNA, 14 nt, Human
acacugcauguuug

SEQ ID NO: 1352727 - RNA, 15 nt, Human
acacugcauguuugu

SEQ ID NO: 1352728 - RNA, 20 nt, Human
acagaggcccucaagucuuu

SEQ ID NO: 1352729 - RNA, 22 nt, Human
acagaggccccagccucccuga

SEQ ID NO: 1352730 - RNA, 18 nt, Human
acagaggccccagccucc

SEQ ID NO: 1352731 - RNA, 17 nt, Human
acagaggccccagccuc

SEQ ID NO: 1352732 - RNA, 16 nt, Human
acagaggccccagccu

SEQ ID NO: 1352733 - RNA, 15 nt, Human
acagaggccccagcc

SEQ ID NO: 1352734 - RNA, 18 nt, Human
acagaauuuuauggugca

SEQ ID NO: 1352735 - RNA, 16 nt, Human
acagaauugcuuguuu

SEQ ID NO: 1352736 - RNA, 18 nt, Human
acagaaugugauaaggaa

SEQ ID NO: 1352737 - RNA, 22 nt, Human
acagaauuacuguaacugauua

SEQ ID NO: 1352738 - RNA, 22 nt, Human
acacuguaguaaauaaugcuuu

SEQ ID NO: 1352739 - RNA, 19 nt, Human
acacuguaguaaauaaugc

SEQ ID NO: 1352740 - RNA, 16 nt, Human
acacuggucugcuguc

SEQ ID NO: 1352741 - RNA, 20 nt, Human
acacuggucugcuguuccag

SEQ ID NO: 1352742 - RNA, 15 nt, Human
acacuggucugcugu

SEQ ID NO: 1352743 - RNA, 15 nt, Human
acagaggcccucaag

SEQ ID NO: 1352744 - RNA, 14 nt, Human
acagagucuuccuc

SEQ ID NO: 1352745 - RNA, 22 nt, Human
acagccaacacgcaccugccuc

SEQ ID NO: 1352746 - RNA, 21 nt, Human
acagccaacacgcaccugccu

SEQ ID NO: 1352747 - RNA, 20 nt, Human
acagccaacacgcaccugcc

SEQ ID NO: 1352748 - RNA, 14 nt, Human
acagccaaauuuaa

SEQ ID NO: 1352749 - RNA, 13 nt, Human
acagcaucagggu

SEQ ID NO: 1352750 - RNA, 19 nt, Human
acagagucuuccucugucu

SEQ ID NO: 1352751 - RNA, 18 nt, Human
acagccaacuagccccug

SEQ ID NO: 1352752 - RNA, 17 nt, Human
acagccaacuagccccu

SEQ ID NO: 1352753 - RNA, 16 nt, Human
acagccaacuagcccc

SEQ ID NO: 1352754 - RNA, 15 nt, Human
acagccaaauuuaaa

SEQ ID NO: 1352755 - RNA, 24 nt, Human
acagccaacacgcaccugccucag

SEQ ID NO: 1352756 - RNA, 17 nt, Human
acagccaacuauggccu

SEQ ID NO: 1352757 - RNA, 20 nt, Human
acagccaacuagccccuggg

SEQ ID NO: 1352758 - RNA, 19 nt, Human
acagccaacuagccccugg

SEQ ID NO: 1352759 - RNA, 19 nt, Human
acagccaacuauggccugu

SEQ ID NO: 1352760 - RNA, 17 nt, Human
acaugauuuccuugaau

SEQ ID NO: 1352761 - RNA, 16 nt, Human
acaugauuuccuugaa

SEQ ID NO: 1352762 - RNA, 16 nt, Human
acaugcauuacugcau

SEQ ID NO: 1352763 - RNA, 16 nt, Human
acaugugacauuuaua

SEQ ID NO: 1352764 - RNA, 15 nt, Human
acaugugacauuuau

SEQ ID NO: 1352765 - RNA, 14 nt, Human
acaugugacauuua

SEQ ID NO: 1352766 - RNA, 13 nt, Human
acaugugacauuu

SEQ ID NO: 1352767 - RNA, 20 nt, Human
acaugcauuacugcaugcac

SEQ ID NO: 1352768 - RNA, 13 nt, Human
acaugauuuccuu

SEQ ID NO: 1352769 - RNA, 13 nt, Human
acaugauucauuu

SEQ ID NO: 1352770 - RNA, 13 nt, Human
acaucagcaaaca

SEQ ID NO: 1352771 - RNA, 15 nt, Human
acaucagcacgauuu

SEQ ID NO: 1352772 - RNA, 17 nt, Human
acaucagcacgauuucu

SEQ ID NO: 1352773 - RNA, 18 nt, Human
acaucagcacgauuucug

SEQ ID NO: 1352774 - RNA, 19 nt, Human
acaucagcacgauuucugu

SEQ ID NO: 1352775 - RNA, 16 nt, Human
acauguuuccucuagu

SEQ ID NO: 1352776 - RNA, 23 nt, Human
acauguuuccagcauucccaggu

SEQ ID NO: 1352777 - RNA, 23 nt, Human
acauguuucuuuguaaugaaaac

SEQ ID NO: 1352778 - RNA, 11 nt, Human
acauguuuccu

SEQ ID NO: 1352779 - RNA, 22 nt, Human
acauguuuccagcauucccagg

SEQ ID NO: 1352780 - RNA, 21 nt, Human
acauguuuccagcauucccag

SEQ ID NO: 1352781 - RNA, 14 nt, Human
acauguuuccagca

SEQ ID NO: 1352782 - RNA, 13 nt, Human
acauguuuccagc

SEQ ID NO: 1352783 - RNA, 21 nt, Human
acaugugacauuuauauauug

SEQ ID NO: 1352784 - RNA, 19 nt, Human
acauguuucuuuguaauga

SEQ ID NO: 1352785 - RNA, 22 nt, Human
acauguuucuuuguaaugaaaa

SEQ ID NO: 1352786 - RNA, 15 nt, Human
acaggguuucaccau

SEQ ID NO: 1352787 - RNA, 24 nt, Human
acagggucugcucuuucucugcca

SEQ ID NO: 1352788 - RNA, 23 nt, Human
acagggucugcucuuucucugcc

SEQ ID NO: 1352789 - RNA, 22 nt, Human
acagggucugcucuuucucugc

SEQ ID NO: 1352790 - RNA, 15 nt, Human
acagggucugcucuu

SEQ ID NO: 1352791 - RNA, 14 nt, Human
acagggucugcucu

SEQ ID NO: 1352792 - RNA, 17 nt, Human
acaggcacacaccacca

SEQ ID NO: 1352793 - RNA, 23 nt, Human
acauaaugcgugcauaccacuuu

SEQ ID NO: 1352794 - RNA, 22 nt, Human
acauaaugcgugcauaccacuu

SEQ ID NO: 1352795 - RNA, 16 nt, Human
acauuuauuuugacau

SEQ ID NO: 1352796 - RNA, 15 nt, Human
acauuuauuuccucc

SEQ ID NO: 1352797 - RNA, 14 nt, Human
acauuuauuuccuc

SEQ ID NO: 1352798 - RNA, 13 nt, Human
acauuuauuuccu

SEQ ID NO: 1352799 - RNA, 19 nt, Human
acauuuguucuauagcuuu

SEQ ID NO: 1352800 - RNA, 19 nt, Human
accaagauuggccugaggc

SEQ ID NO: 1352801 - RNA, 19 nt, Human
accaagauggcccauccug

SEQ ID NO: 1352802 - RNA, 19 nt, Human
acauuuuaaaagugccauu

SEQ ID NO: 1352803 - RNA, 16 nt, Human
acauuuuaaacacauu

SEQ ID NO: 1352804 - RNA, 16 nt, Human
acauuuuaaaagugcc

SEQ ID NO: 1352805 - RNA, 20 nt, Human
acauuuuaaaaaauggucac

SEQ ID NO: 1352806 - RNA, 14 nt, Human
accaagcaucuugg

SEQ ID NO: 1352807 - RNA, 13 nt, Human
accaagcaggaaa

SEQ ID NO: 1352808 - RNA, 17 nt, Human
accaagcacagcagccu

SEQ ID NO: 1352809 - RNA, 16 nt, Human
accaagcacagcagcc

SEQ ID NO: 1352810 - RNA, 14 nt, Human
accaagcacagcag

SEQ ID NO: 1352811 - RNA, 23 nt, Human
accaaggcuuucucuacugauuc

SEQ ID NO: 1352812 - RNA, 17 nt, Human
accaaggcuuucucuac

SEQ ID NO: 1352813 - RNA, 23 nt, Human
accaagccaagggaaccuguguc

SEQ ID NO: 1352814 - RNA, 20 nt, Human
accaagccaagggaaccugu

SEQ ID NO: 1352815 - RNA, 23 nt, Human
accaaguuggaacauccuuggaa

SEQ ID NO: 1352816 - RNA, 17 nt, Human
accaauaaaauaauuuu

SEQ ID NO: 1352817 - RNA, 14 nt, Human
accacccugcucau

SEQ ID NO: 1352818 - RNA, 21 nt, Human
accacccugagccggccccag

SEQ ID NO: 1352819 - RNA, 23 nt, Human
accaauagggcugagcucucugu

SEQ ID NO: 1352820 - RNA, 11 nt, Human
accaauaaagu

SEQ ID NO: 1352821 - RNA, 12 nt, Human
accaauaaagug

SEQ ID NO: 1352822 - RNA, 17 nt, Human
accaauaaagugacccu

SEQ ID NO: 1352823 - RNA, 21 nt, Human
accagccauuggcuauuuaaa

SEQ ID NO: 1352824 - RNA, 17 nt, Human
accagccaguaaauggg

SEQ ID NO: 1352825 - RNA, 14 nt, Human
accagaugcugaaa

SEQ ID NO: 1352826 - RNA, 12 nt, Human
accagaugcuga

SEQ ID NO: 1352827 - RNA, 11 nt, Human
accagaugcug

SEQ ID NO: 1352828 - RNA, 10 nt, Human
accagaugcu

SEQ ID NO: 1352829 - RNA, 14 nt, Human
accagaugcagcuc

SEQ ID NO: 1352830 - RNA, 13 nt, Human
accagcagaaaug

SEQ ID NO: 1352831 - RNA, 21 nt, Human
accaccgcgcccagccuuuuu

SEQ ID NO: 1352832 - RNA, 17 nt, Human
accaccucuccagaggc

SEQ ID NO: 1352833 - RNA, 15 nt, Human
accaccucucaauau

SEQ ID NO: 1352834 - RNA, 23 nt, Human
accaccucucaauauucaauaaa

SEQ ID NO: 1352835 - RNA, 22 nt, Human
accagagugcugaaggaaugga

SEQ ID NO: 1352836 - RNA, 13 nt, Human
accagauaacuuu

SEQ ID NO: 1352837 - RNA, 14 nt, Human
accagauaacuuuu

SEQ ID NO: 1352838 - RNA, 13 nt, Human
accagaucauugu

SEQ ID NO: 1352839 - RNA, 23 nt, Human
acccaccgggccacuccuuccug

SEQ ID NO: 1352840 - RNA, 18 nt, Human
accaucucccuggugcuu

SEQ ID NO: 1352841 - RNA, 17 nt, Human
accaucucccuggugcu

SEQ ID NO: 1352842 - RNA, 16 nt, Human
accaucucccuggugc

SEQ ID NO: 1352843 - RNA, 14 nt, Human
accaucucccuggu

SEQ ID NO: 1352844 - RNA, 13 nt, Human
accaucucccugg

SEQ ID NO: 1352845 - RNA, 12 nt, Human
accaucucccug

SEQ ID NO: 1352846 - RNA, 11 nt, Human
accaucucccu

SEQ ID NO: 1352847 - RNA, 20 nt, Human
accaucucccuggugcuuau

SEQ ID NO: 1352848 - RNA, 15 nt, Human
accaucgcuuuauug

SEQ ID NO: 1352849 - RNA, 18 nt, Human
accauccuaggcugacac

SEQ ID NO: 1352850 - RNA, 20 nt, Human
accauauuaccacagacaua

SEQ ID NO: 1352851 - RNA, 12 nt, Human
acccccugcagc

SEQ ID NO: 1352852 - RNA, 16 nt, Human
acccauuccuucccag

SEQ ID NO: 1352853 - RNA, 23 nt, Human
acccauuccuucccagaggggcc

SEQ ID NO: 1352854 - RNA, 15 nt, Human
acccauuccuuccca

SEQ ID NO: 1352855 - RNA, 13 nt, Human
acccauuccuucc

SEQ ID NO: 1352856 - RNA, 20 nt, Human
acccauuuaaauuuuuuucc

SEQ ID NO: 1352857 - RNA, 23 nt, Human
acccauuuaaauuuuuuuccuua

SEQ ID NO: 1352858 - RNA, 22 nt, Human
acccauuagcagucccuccaca

SEQ ID NO: 1352859 - RNA, 21 nt, Human
acccaccugcuagugugaauu

SEQ ID NO: 1352860 - RNA, 22 nt, Human
acccagugcccccacugaccag

SEQ ID NO: 1352861 - RNA, 21 nt, Human
acccaguuucuaaacuggaga

SEQ ID NO: 1352862 - RNA, 20 nt, Human
acccaguuucuaaacuggag

SEQ ID NO: 1352863 - RNA, 17 nt, Human
acccaguuuccuuggga

SEQ ID NO: 1352864 - RNA, 18 nt, Human
acccaguugccaucugcg

SEQ ID NO: 1352865 - RNA, 17 nt, Human
acccaguugccaucugc

SEQ ID NO: 1352866 - RNA, 22 nt, Human
acccaguguuuuaggagcauga

SEQ ID NO: 1352867 - RNA, 22 nt, Human
acccagugcccucuccccucag

SEQ ID NO: 1352868 - RNA, 15 nt, Human
acccagugcccucuc

SEQ ID NO: 1352869 - RNA, 14 nt, Human
acccagugcccucu

SEQ ID NO: 1352870 - RNA, 14 nt, Human
acccagugcugaau

SEQ ID NO: 1352871 - RNA, 19 nt, Human
acccaguguuuuaggagca

SEQ ID NO: 1352872 - RNA, 14 nt, Human
accauauuaccaca

SEQ ID NO: 1352873 - RNA, 16 nt, Human
accauauuaccacaga

SEQ ID NO: 1352874 - RNA, 19 nt, Human
acccccuucuccauccaca

SEQ ID NO: 1352875 - RNA, 18 nt, Human
acccccuucuccauccac

SEQ ID NO: 1352876 - RNA, 13 nt, Human
acccccugcagcu

SEQ ID NO: 1352877 - RNA, 15 nt, Human
acccccugcagcuug

SEQ ID NO: 1352878 - RNA, 13 nt, Human
acccccugugccu

SEQ ID NO: 1352879 - RNA, 17 nt, Human
accccuccacucuuucu

SEQ ID NO: 1352880 - RNA, 20 nt, Human
accccuccccuccaucccug

SEQ ID NO: 1352881 - RNA, 19 nt, Human
accccuccccuccaucccu

SEQ ID NO: 1352882 - RNA, 14 nt, Human
accccuccccucca

SEQ ID NO: 1352883 - RNA, 13 nt, Human
accccuccccucc

SEQ ID NO: 1352884 - RNA, 12 nt, Human
accccuccccuc

SEQ ID NO: 1352885 - RNA, 13 nt, Human
accccuccacucu

SEQ ID NO: 1352886 - RNA, 22 nt, Human
aggcccuuauuuucaagaaacu

SEQ ID NO: 1352887 - RNA, 20 nt, Human
aggcccuuauuuucaagaaa

SEQ ID NO: 1352888 - RNA, 16 nt, Human
aggcccuuauuuucaa

SEQ ID NO: 1352889 - RNA, 23 nt, Human
aggccgaagcuaacagggaaggc

SEQ ID NO: 1352890 - RNA, 18 nt, Human
aggcgugagccaccaugc

SEQ ID NO: 1352891 - RNA, 17 nt, Human
aggcgugagccaccucg

SEQ ID NO: 1352892 - RNA, 18 nt, Human
aggcgugagccaccucgc

SEQ ID NO: 1352893 - RNA, 22 nt, Human
aggcuacuucggggcugggaag

SEQ ID NO: 1352894 - RNA, 20 nt, Human
aggcuacuucggggcuggga

SEQ ID NO: 1352895 - RNA, 17 nt, Human
aggcuacuucggggcug

SEQ ID NO: 1352896 - RNA, 18 nt, Human
aggcuaaagcccagagac

SEQ ID NO: 1352897 - RNA, 23 nt, Human
aggcuacuguaaggcaaucaugg

SEQ ID NO: 1352898 - RNA, 23 nt, Human
agggacgccugggggugccagga

SEQ ID NO: 1352899 - RNA, 15 nt, Human
agggacgccuggggg

SEQ ID NO: 1352900 - RNA, 13 nt, Human
agggacgccuggg

SEQ ID NO: 1352901 - RNA, 22 nt, Human
agggacgccugggggugccagg

SEQ ID NO: 1352902 - RNA, 18 nt, Human
agggacgccugggggugc

SEQ ID NO: 1352903 - RNA, 12 nt, Human
aggcuguaacua

SEQ ID NO: 1352904 - RNA, 17 nt, Human
aggcuagauguauguac

SEQ ID NO: 1352905 - RNA, 16 nt, Human
aggcuagauguaugua

SEQ ID NO: 1352906 - RNA, 15 nt, Human
aggcuagauguaugu

SEQ ID NO: 1352907 - RNA, 21 nt, Human
aggcuguccuguacauugugg

SEQ ID NO: 1352908 - RNA, 16 nt, Human
aggcuguccuguacau

SEQ ID NO: 1352909 - RNA, 15 nt, Human
aggcuguccuguaca

SEQ ID NO: 1352910 - RNA, 15 nt, Human
aggcuguaacuacuu

SEQ ID NO: 1352911 - RNA, 22 nt, Human
agggacagaugaaugccgugga

SEQ ID NO: 1352912 - RNA, 22 nt, Human
agggaccggcggaccccagcca

SEQ ID NO: 1352913 - RNA, 17 nt, Human
aggguccaacauagagc

SEQ ID NO: 1352914 - RNA, 22 nt, Human
agggucaggccuuugagcucag

SEQ ID NO: 1352915 - RNA, 14 nt, Human
agggucaggccuuu

SEQ ID NO: 1352916 - RNA, 13 nt, Human
agggucaggccuu

SEQ ID NO: 1352917 - RNA, 12 nt, Human
agggucaggccu

SEQ ID NO: 1352918 - RNA, 22 nt, Human
aggggccuccaugggccccagg

SEQ ID NO: 1352919 - RNA, 16 nt, Human
aggggccuccaugggc

SEQ ID NO: 1352920 - RNA, 21 nt, Human
agggucagacgccugaggaac

SEQ ID NO: 1352921 - RNA, 13 nt, Human
aggguccugggag

SEQ ID NO: 1352922 - RNA, 12 nt, Human
agggucccucug

SEQ ID NO: 1352923 - RNA, 23 nt, Human
agggucccccacucuaaagcaaa

SEQ ID NO: 1352924 - RNA, 20 nt, Human
agggucccucuguguauuug

SEQ ID NO: 1352925 - RNA, 18 nt, Human
agggucccucuguguauu

SEQ ID NO: 1352926 - RNA, 15 nt, Human
agggucccucugugu

SEQ ID NO: 1352927 - RNA, 14 nt, Human
agggucccucugug

SEQ ID NO: 1352928 - RNA, 21 nt, Human
aggugcuacacccuuuuccag

SEQ ID NO: 1352929 - RNA, 20 nt, Human
aggugcuacacccuuuucca

SEQ ID NO: 1352930 - RNA, 18 nt, Human
agguguuuuguucaccau

SEQ ID NO: 1352931 - RNA, 15 nt, Human
agguggauggcccca

SEQ ID NO: 1352932 - RNA, 16 nt, Human
agguggaucuauuuca

SEQ ID NO: 1352933 - RNA, 15 nt, Human
agguggaucuauuuc

SEQ ID NO: 1352934 - RNA, 22 nt, Human
agguguuuuguucaccauuaua

SEQ ID NO: 1352935 - RNA, 21 nt, Human
agguuacaagccugcacaaua

SEQ ID NO: 1352936 - RNA, 15 nt, Human
agguuacaagccugc

SEQ ID NO: 1352937 - RNA, 23 nt, Human
agguuccgcuuggagcagagggg

SEQ ID NO: 1352938 - RNA, 21 nt, Human
agguuccgcuuggagcagagg

SEQ ID NO: 1352939 - RNA, 18 nt, Human
agguuccgcuuggagcag

SEQ ID NO: 1352940 - RNA, 15 nt, Human
agguuaucagugcuu

SEQ ID NO: 1352941 - RNA, 14 nt, Human
agguucaaagauau

SEQ ID NO: 1352942 - RNA, 15 nt, Human
agguucaaagauauu

SEQ ID NO: 1352943 - RNA, 13 nt, Human
aggucugaaauuu

SEQ ID NO: 1352944 - RNA, 23 nt, Human
aggucugaaauuuuucuucuuga

SEQ ID NO: 1352945 - RNA, 18 nt, Human
aggucuguucuuuccaaa

SEQ ID NO: 1352946 - RNA, 13 nt, Human
aggucccuaauaa

SEQ ID NO: 1352947 - RNA, 15 nt, Human
aggucccuaauaaag

SEQ ID NO: 1352948 - RNA, 16 nt, Human
agguacaagaagcauu

SEQ ID NO: 1352949 - RNA, 16 nt, Human
agguacacagcucuag

SEQ ID NO: 1352950 - RNA, 16 nt, Human
aggucccuaauaaagc

SEQ ID NO: 1352951 - RNA, 22 nt, Human
aggucuguucuuuccaaaguac

SEQ ID NO: 1352952 - RNA, 23 nt, Human
aggucuguucuuuccaaaguaca

SEQ ID NO: 1352953 - RNA, 20 nt, Human
agguaaaagcaucacaugaa

SEQ ID NO: 1352954 - RNA, 22 nt, Human
agguaaaaugccaugaugccuc

SEQ ID NO: 1352955 - RNA, 13 nt, Human
agguaaaaugcca

SEQ ID NO: 1352956 - RNA, 16 nt, Human
agguaaaaugccauga

SEQ ID NO: 1352957 - RNA, 15 nt, Human
agguaaaaugccaug

SEQ ID NO: 1352958 - RNA, 14 nt, Human
agguaaaaugccau

SEQ ID NO: 1352959 - RNA, 18 nt, Human
agguaaaucagacuauga

SEQ ID NO: 1352960 - RNA, 20 nt, Human
agguaaauaaaaagaaaggc

SEQ ID NO: 1352961 - RNA, 14 nt, Human
agguaaauaaaaag

SEQ ID NO: 1352962 - RNA, 23 nt, Human
agguaaaucagacuaugaaguuu

SEQ ID NO: 1352963 - RNA, 17 nt, Human
agguaauuuuuuucacc

SEQ ID NO: 1352964 - RNA, 12 nt, Human
aggucccuaaua

SEQ ID NO: 1352965 - RNA, 11 nt, Human
aggucccuaau

SEQ ID NO: 1352966 - RNA, 22 nt, Human
agcuuccaugauucuauuuaua

SEQ ID NO: 1352967 - RNA, 14 nt, Human
agcuuccuucagag

SEQ ID NO: 1352968 - RNA, 15 nt, Human
agcuuccuucagaga

SEQ ID NO: 1352969 - RNA, 13 nt, Human
agcuuccuucaga

SEQ ID NO: 1352970 - RNA, 12 nt, Human
agcuuccuucag

SEQ ID NO: 1352971 - RNA, 17 nt, Human
agcugcuccccacguca

SEQ ID NO: 1352972 - RNA, 14 nt, Human
agcugcuccccacg

SEQ ID NO: 1352973 - RNA, 15 nt, Human
agcugagcagggccg

SEQ ID NO: 1352974 - RNA, 14 nt, Human
agcugagcagggcc

SEQ ID NO: 1352975 - RNA, 16 nt, Human
agcucccuucuucccu

SEQ ID NO: 1352976 - RNA, 19 nt, Human
agcucccugugcccccagg

SEQ ID NO: 1352977 - RNA, 21 nt, Human
agcucccugugcccccagggu

SEQ ID NO: 1352978 - RNA, 16 nt, Human
agcucccugugccccc

SEQ ID NO: 1352979 - RNA, 17 nt, Human
agcucuuugucagggag

SEQ ID NO: 1352980 - RNA, 16 nt, Human
agcucuuugucaggga

SEQ ID NO: 1352981 - RNA, 13 nt, Human
agcugagcagggc

SEQ ID NO: 1352982 - RNA, 15 nt, Human
agcugagcaggccac

SEQ ID NO: 1352983 - RNA, 20 nt, Human
agcugagcaaaucaccacaa

SEQ ID NO: 1352984 - RNA, 16 nt, Human
agcugagcaaaucacc

SEQ ID NO: 1352985 - RNA, 22 nt, Human
agcuccuuaaggcucuuuugua

SEQ ID NO: 1352986 - RNA, 15 nt, Human
agcucuuugucaggg

SEQ ID NO: 1352987 - RNA, 14 nt, Human
agcucuuugucagg

SEQ ID NO: 1352988 - RNA, 19 nt, Human
agcuccuuccuggagacug

SEQ ID NO: 1352989 - RNA, 15 nt, Human
agcuccuuccuggag

SEQ ID NO: 1352990 - RNA, 13 nt, Human
agcuccuuccugg

SEQ ID NO: 1352991 - RNA, 19 nt, Human
agcuuuuuccagaggcuau

SEQ ID NO: 1352992 - RNA, 22 nt, Human
agcuuuuuauuccuccugcuca

SEQ ID NO: 1352993 - RNA, 24 nt, Human
agcuuuugugggggacuguaaguu

SEQ ID NO: 1352994 - RNA, 22 nt, Human
agcuuuugugggggacuguaag

SEQ ID NO: 1352995 - RNA, 21 nt, Human
agcuuuugugggggacuguaa

SEQ ID NO: 1352996 - RNA, 13 nt, Human
agcuuuugucuac

SEQ ID NO: 1352997 - RNA, 17 nt, Human
agcuuuucuauuuuaau

SEQ ID NO: 1352998 - RNA, 21 nt, Human
agcuuuucccuuuuuuuaagu

SEQ ID NO: 1352999 - RNA, 15 nt, Human
aggacccagaggaag

SEQ ID NO: 1353000 - RNA, 13 nt, Human
aggacccagagga

SEQ ID NO: 1353001 - RNA, 17 nt, Human
aggacccuggacccagc

SEQ ID NO: 1353002 - RNA, 14 nt, Human
aggacccuggaccu

SEQ ID NO: 1353003 - RNA, 12 nt, Human
aggacccuuccc

SEQ ID NO: 1353004 - RNA, 13 nt, Human
aggacccuucccu

SEQ ID NO: 1353005 - RNA, 20 nt, Human
aggacccuucccuugagccc

SEQ ID NO: 1353006 - RNA, 17 nt, Human
aggacccagggcucugu

SEQ ID NO: 1353007 - RNA, 14 nt, Human
aggacccaggaaag

SEQ ID NO: 1353008 - RNA, 12 nt, Human
aggacccaggac

SEQ ID NO: 1353009 - RNA, 13 nt, Human
aggacccaggaca

SEQ ID NO: 1353010 - RNA, 14 nt, Human
aggacccaggacag

SEQ ID NO: 1353011 - RNA, 15 nt, Human
aggacccagggcucu

SEQ ID NO: 1353012 - RNA, 14 nt, Human
aggacccagggcuc

SEQ ID NO: 1353013 - RNA, 13 nt, Human
aggacccagggcu

SEQ ID NO: 1353014 - RNA, 12 nt, Human
aggacccagggc

SEQ ID NO: 1353015 - RNA, 18 nt, Human
aggacccaggacaggauc

SEQ ID NO: 1353016 - RNA, 23 nt, Human
aggacccaggacaggauccaggc

SEQ ID NO: 1353017 - RNA, 22 nt, Human
aggaguggguggggaguggggg

SEQ ID NO: 1353018 - RNA, 21 nt, Human
aggagucugagguccugagca

SEQ ID NO: 1353019 - RNA, 20 nt, Human
aggagucugagguccugagc

SEQ ID NO: 1353020 - RNA, 19 nt, Human
aggagucugagguccugag

SEQ ID NO: 1353021 - RNA, 18 nt, Human
aggagucugagguccuga

SEQ ID NO: 1353022 - RNA, 17 nt, Human
aggagucugagguccug

SEQ ID NO: 1353023 - RNA, 16 nt, Human
aggagucugagguccu

SEQ ID NO: 1353024 - RNA, 15 nt, Human
aggagucugaggucc

SEQ ID NO: 1353025 - RNA, 13 nt, Human
aggagucugaggu

SEQ ID NO: 1353026 - RNA, 22 nt, Human
aggaguuaguggauuacugcca

SEQ ID NO: 1353027 - RNA, 13 nt, Human
aggagugugugug

SEQ ID NO: 1353028 - RNA, 15 nt, Human
aggagugggugggga

SEQ ID NO: 1353029 - RNA, 14 nt, Human
aggaguguccucuu

SEQ ID NO: 1353030 - RNA, 21 nt, Human
aggaugcuuguacauaaugcg

SEQ ID NO: 1353031 - RNA, 23 nt, Human
aggaugcuuguacauaaugcgug

SEQ ID NO: 1353032 - RNA, 16 nt, Human
aggagucacugagacc

SEQ ID NO: 1353033 - RNA, 20 nt, Human
aggaguccacuuuguuucgu

SEQ ID NO: 1353034 - RNA, 17 nt, Human
aggagucacugagacca

SEQ ID NO: 1353035 - RNA, 15 nt, Human
aggagucacugagac

SEQ ID NO: 1353036 - RNA, 14 nt, Human
aggagucacugaga

SEQ ID NO: 1353037 - RNA, 18 nt, Human
aggaguaugcagggagcu

SEQ ID NO: 1353038 - RNA, 16 nt, Human
aggaguagcugagcuc

SEQ ID NO: 1353039 - RNA, 15 nt, Human
aggaguagcugagcu

SEQ ID NO: 1353040 - RNA, 18 nt, Human
aggagacacaccugaggc

SEQ ID NO: 1353041 - RNA, 15 nt, Human
aggagaaugagccuc

SEQ ID NO: 1353042 - RNA, 20 nt, Human
aggagaaucacuugaaccug

SEQ ID NO: 1353043 - RNA, 18 nt, Human
aggagaaucaucaggacc

SEQ ID NO: 1353044 - RNA, 16 nt, Human
aggaccuaaaacaucu

SEQ ID NO: 1353045 - RNA, 14 nt, Human
aggaccuaaaacau

SEQ ID NO: 1353046 - RNA, 13 nt, Human
aggacccuggacc

SEQ ID NO: 1353047 - RNA, 22 nt, Human
aggacccuucccuugagcccuc

SEQ ID NO: 1353048 - RNA, 16 nt, Human
aggaccggcggcucgg

SEQ ID NO: 1353049 - RNA, 19 nt, Human
aggauggaacacggccaca

SEQ ID NO: 1353050 - RNA, 14 nt, Human
aggauggaacacgg

SEQ ID NO: 1353051 - RNA, 19 nt, Human
aggauguaaagaucaauaa

SEQ ID NO: 1353052 - RNA, 17 nt, Human
aggauggagccagcucu

SEQ ID NO: 1353053 - RNA, 23 nt, Human
aggaugguucccuugaugaagaa

SEQ ID NO: 1353054 - RNA, 19 nt, Human
agccgcugagcgaggagau

SEQ ID NO: 1353055 - RNA, 15 nt, Human
agccgcugagcgagg

SEQ ID NO: 1353056 - RNA, 14 nt, Human
agccgggagccuga

SEQ ID NO: 1353057 - RNA, 19 nt, Human
agcccucacacacccuguc

SEQ ID NO: 1353058 - RNA, 16 nt, Human
agcccucaucccgagc

SEQ ID NO: 1353059 - RNA, 23 nt, Human
agcccuccgccauucucaagccc

SEQ ID NO: 1353060 - RNA, 24 nt, Human
agcccuccgccauucucaagcccu

SEQ ID NO: 1353061 - RNA, 17 nt, Human
agcccuccucugcacuc

SEQ ID NO: 1353062 - RNA, 18 nt, Human
agccucccauccagggcc

SEQ ID NO: 1353063 - RNA, 20 nt, Human
agccuccucaucccguguuc

SEQ ID NO: 1353064 - RNA, 17 nt, Human
agccucccauccagggc

SEQ ID NO: 1353065 - RNA, 13 nt, Human
agccguccuggcg

SEQ ID NO: 1353066 - RNA, 13 nt, Human
agccgugagcaug

SEQ ID NO: 1353067 - RNA, 23 nt, Human
agccguccuggcgccuggcaguc

SEQ ID NO: 1353068 - RNA, 12 nt, Human
agccguccuggc

SEQ ID NO: 1353069 - RNA, 18 nt, Human
agccgugcucgccccagc

SEQ ID NO: 1353070 - RNA, 13 nt, Human
agccccauuccug

SEQ ID NO: 1353071 - RNA, 17 nt, Human
agccccagugacagcua

SEQ ID NO: 1353072 - RNA, 15 nt, Human
agcccuaaacaucau

SEQ ID NO: 1353073 - RNA, 14 nt, Human
agcccuaaacauca

SEQ ID NO: 1353074 - RNA, 13 nt, Human
agcccuaaacauc

SEQ ID NO: 1353075 - RNA, 15 nt, Human
agcccgucucagugu

SEQ ID NO: 1353076 - RNA, 14 nt, Human
agcccgucucagug

SEQ ID NO: 1353077 - RNA, 22 nt, Human
agcccgguaagagcaaaagaau

SEQ ID NO: 1353078 - RNA, 21 nt, Human
agcccgguaagagcaaaagaa

SEQ ID NO: 1353079 - RNA, 21 nt, Human
agcccuaaacaucauucuuga

SEQ ID NO: 1353080 - RNA, 23 nt, Human
agcccucacacacccugucugcc

SEQ ID NO: 1353081 - RNA, 16 nt, Human
agcccucacacacccu

SEQ ID NO: 1353082 - RNA, 16 nt, Human
agcccgguaagagcaa

SEQ ID NO: 1353083 - RNA, 15 nt, Human
agcccgguaagagca

SEQ ID NO: 1353084 - RNA, 16 nt, Human
agccccauuccuggga

SEQ ID NO: 1353085 - RNA, 24 nt, Human
agaugggggaaagcaaagcacaga

SEQ ID NO: 1353086 - RNA, 23 nt, Human
agaugggggaaagcaaagcacag

SEQ ID NO: 1353087 - RNA, 21 nt, Human
agaugggggaaagcaaagcac

SEQ ID NO: 1353088 - RNA, 16 nt, Human
agaugggggaaagcaa

SEQ ID NO: 1353089 - RNA, 19 nt, Human
agauggggaccagcagccc

SEQ ID NO: 1353090 - RNA, 24 nt, Human
agcacucgcuagcaguggcaggca

SEQ ID NO: 1353091 - RNA, 23 nt, Human
agcacucgcuagcaguggcaggc

SEQ ID NO: 1353092 - RNA, 20 nt, Human
agcacucgcuagcaguggca

SEQ ID NO: 1353093 - RNA, 18 nt, Human
agcagcuuagacuaaggc

SEQ ID NO: 1353094 - RNA, 21 nt, Human
agcagcugccaggagcacggc

SEQ ID NO: 1353095 - RNA, 18 nt, Human
agcagcugccaggagcac

SEQ ID NO: 1353096 - RNA, 19 nt, Human
agcagcugagcagggccgg

SEQ ID NO: 1353097 - RNA, 18 nt, Human
agcagcugagcagggccg

SEQ ID NO: 1353098 - RNA, 17 nt, Human
agcagcugagcagggcc

SEQ ID NO: 1353099 - RNA, 16 nt, Human
agcagcugagcagggc

SEQ ID NO: 1353100 - RNA, 14 nt, Human
agcagcugagcagg

SEQ ID NO: 1353101 - RNA, 13 nt, Human
agcagcugagcag

SEQ ID NO: 1353102 - RNA, 12 nt, Human
agcagcugagca

SEQ ID NO: 1353103 - RNA, 11 nt, Human
agcagcugagc

SEQ ID NO: 1353104 - RNA, 22 nt, Human
agcacugucccuugccucaaug

SEQ ID NO: 1353105 - RNA, 19 nt, Human
agcacugucccuugccuca

SEQ ID NO: 1353106 - RNA, 16 nt, Human
agcacugucccuugcc

SEQ ID NO: 1353107 - RNA, 15 nt, Human
agcacugucccuugc

SEQ ID NO: 1353108 - RNA, 13 nt, Human
agcacugucccuu

SEQ ID NO: 1353109 - RNA, 12 nt, Human
agcacugucccu

SEQ ID NO: 1353110 - RNA, 22 nt, Human
agcagccuuucucucuuuauac

SEQ ID NO: 1353111 - RNA, 11 nt, Human
agcagccuuuc

SEQ ID NO: 1353112 - RNA, 14 nt, Human
agcagcgagccugc

SEQ ID NO: 1353113 - RNA, 15 nt, Human
agcagcgagccugcu

SEQ ID NO: 1353114 - RNA, 13 nt, Human
agcagcgagccug

SEQ ID NO: 1353115 - RNA, 23 nt, Human
agcagcgaccgcccccuccucua

SEQ ID NO: 1353116 - RNA, 18 nt, Human
agcagcgaccgcccccuc

SEQ ID NO: 1353117 - RNA, 13 nt, Human
agcagcguuucua

SEQ ID NO: 1353118 - RNA, 18 nt, Human
agcagcguuucuaugaca

SEQ ID NO: 1353119 - RNA, 17 nt, Human
agcaguucugcagagga

SEQ ID NO: 1353120 - RNA, 16 nt, Human
agcaguucugcagagg

SEQ ID NO: 1353121 - RNA, 21 nt, Human
agcagugugaggccagggcag

SEQ ID NO: 1353122 - RNA, 15 nt, Human
agcagugugaggcca

SEQ ID NO: 1353123 - RNA, 16 nt, Human
agcaugaauuuguaau

SEQ ID NO: 1353124 - RNA, 22 nt, Human
agccaacacgcaccugccucag

SEQ ID NO: 1353125 - RNA, 19 nt, Human
agccaacacgcaccugccu

SEQ ID NO: 1353126 - RNA, 18 nt, Human
agccaacacgcaccugcc

SEQ ID NO: 1353127 - RNA, 13 nt, Human
agccaaauuuaaa

SEQ ID NO: 1353128 - RNA, 19 nt, Human
agccaaauuuaaaacuguu

SEQ ID NO: 1353129 - RNA, 12 nt, Human
agccaaauuuaa

SEQ ID NO: 1353130 - RNA, 20 nt, Human
agcaugagagggaugaggca

SEQ ID NO: 1353131 - RNA, 17 nt, Human
agcauggaacacuucga

SEQ ID NO: 1353132 - RNA, 19 nt, Human
agcauggaacacuucgagu

SEQ ID NO: 1353133 - RNA, 17 nt, Human
agcaugagaggaggcag

SEQ ID NO: 1353134 - RNA, 15 nt, Human
agcaugccuucaaau

SEQ ID NO: 1353135 - RNA, 22 nt, Human
agccagcacuuguccagcugag

SEQ ID NO: 1353136 - RNA, 21 nt, Human
agccagcacuuguccagcuga

SEQ ID NO: 1353137 - RNA, 20 nt, Human
agccagcacuuguccagcug

SEQ ID NO: 1353138 - RNA, 24 nt, Human
agccagcaccggaccagccuggcc

SEQ ID NO: 1353139 - RNA, 23 nt, Human
agccagcaccuggcaucgcacca

SEQ ID NO: 1353140 - RNA, 15 nt, Human
agccagcaccuggca

SEQ ID NO: 1353141 - RNA, 14 nt, Human
agccagcaccuggc

SEQ ID NO: 1353142 - RNA, 13 nt, Human
agccagcaccugg

SEQ ID NO: 1353143 - RNA, 23 nt, Human
agccagcaccggaccagccuggc

SEQ ID NO: 1353144 - RNA, 22 nt, Human
agccagcaccggaccagccugg

SEQ ID NO: 1353145 - RNA, 21 nt, Human
agccagcaccggaccagccug

SEQ ID NO: 1353146 - RNA, 20 nt, Human
agccagcaccggaccagccu

SEQ ID NO: 1353147 - RNA, 16 nt, Human
agccagcaccggacca

SEQ ID NO: 1353148 - RNA, 19 nt, Human
agccagcacacagggcagu

SEQ ID NO: 1353149 - RNA, 18 nt, Human
agccagcacacagggcag

SEQ ID NO: 1353150 - RNA, 17 nt, Human
agccagcacacagggca

SEQ ID NO: 1353151 - RNA, 15 nt, Human
agccagcacacaggg

SEQ ID NO: 1353152 - RNA, 12 nt, Human
agccaauauaac

SEQ ID NO: 1353153 - RNA, 13 nt, Human
agccaagugcagg

SEQ ID NO: 1353154 - RNA, 23 nt, Human
agacugcgauuugucccaggucc

SEQ ID NO: 1353155 - RNA, 21 nt, Human
agacugccauauuaaauuuuu

SEQ ID NO: 1353156 - RNA, 20 nt, Human
agacugccauauuaaauuuu

SEQ ID NO: 1353157 - RNA, 20 nt, Human
agacuggaagcuaauuugca

SEQ ID NO: 1353158 - RNA, 20 nt, Human
agagaaaaagcagaggccaa

SEQ ID NO: 1353159 - RNA, 19 nt, Human
agacuggaagcuaauuugc

SEQ ID NO: 1353160 - RNA, 14 nt, Human
agacuggaagcuaa

SEQ ID NO: 1353161 - RNA, 13 nt, Human
agagcccaggagc

SEQ ID NO: 1353162 - RNA, 15 nt, Human
agagcccagcuccaa

SEQ ID NO: 1353163 - RNA, 15 nt, Human
agagagccugcagga

SEQ ID NO: 1353164 - RNA, 14 nt, Human
agagagccugcagg

SEQ ID NO: 1353165 - RNA, 18 nt, Human
agagagccugcaggaucu

SEQ ID NO: 1353166 - RNA, 18 nt, Human
agagagcccgaggaggug

SEQ ID NO: 1353167 - RNA, 13 nt, Human
agagagcccgagg

SEQ ID NO: 1353168 - RNA, 17 nt, Human
agagagcagugcuuuug

SEQ ID NO: 1353169 - RNA, 16 nt, Human
agagagcagugcuuuu

SEQ ID NO: 1353170 - RNA, 15 nt, Human
agagagcagugcuuu

SEQ ID NO: 1353171 - RNA, 16 nt, Human
agagaagacaggcugg

SEQ ID NO: 1353172 - RNA, 15 nt, Human
agagaagacaggcug

SEQ ID NO: 1353173 - RNA, 14 nt, Human
agagaagacaggcu

SEQ ID NO: 1353174 - RNA, 17 nt, Human
agagaacuuccagaucc

SEQ ID NO: 1353175 - RNA, 13 nt, Human
agagaagaaagaa

SEQ ID NO: 1353176 - RNA, 17 nt, Human
agagaagaaagaacgga

SEQ ID NO: 1353177 - RNA, 17 nt, Human
agacccauuccuuccca

SEQ ID NO: 1353178 - RNA, 22 nt, Human
agacccauuccuucccagaggg

SEQ ID NO: 1353179 - RNA, 15 nt, Human
agacccauuccuucc

SEQ ID NO: 1353180 - RNA, 19 nt, Human
agacgugaugccaggacca

SEQ ID NO: 1353181 - RNA, 21 nt, Human
agacgugcacgcacacugucu

SEQ ID NO: 1353182 - RNA, 22 nt, Human
agacgugcacgcacacugucug

SEQ ID NO: 1353183 - RNA, 20 nt, Human
agacggaaggguaaacaaua

SEQ ID NO: 1353184 - RNA, 22 nt, Human
agacggagcccuggcaugucaa

SEQ ID NO: 1353185 - RNA, 18 nt, Human
agacggaaggguaaacaa

SEQ ID NO: 1353186 - RNA, 21 nt, Human
agacaacgugcucuuuguuuu

SEQ ID NO: 1353187 - RNA, 23 nt, Human
agacaacgugcucuuuguuuugu

SEQ ID NO: 1353188 - RNA, 20 nt, Human
agacaacgugcucuuuguuu

SEQ ID NO: 1353189 - RNA, 19 nt, Human
agacaacgugcucuuuguu

SEQ ID NO: 1353190 - RNA, 16 nt, Human
agacaacgugcucuuu

SEQ ID NO: 1353191 - RNA, 21 nt, Human
agacagcuccacccuggccga

SEQ ID NO: 1353192 - RNA, 20 nt, Human
agacagagucuuccucuguc

SEQ ID NO: 1353193 - RNA, 19 nt, Human
agacagagucuuacucugu

SEQ ID NO: 1353194 - RNA, 20 nt, Human
agacagagucuuacucuguu

SEQ ID NO: 1353195 - RNA, 23 nt, Human
agacagagucuuccucugucucc

SEQ ID NO: 1353196 - RNA, 16 nt, Human
agaucuuuuauuuugc

SEQ ID NO: 1353197 - RNA, 18 nt, Human
agaucuuuuauuuugcca

SEQ ID NO: 1353198 - RNA, 15 nt, Human
agaugaaagagcagu

SEQ ID NO: 1353199 - RNA, 14 nt, Human
agaugaaagagcag

SEQ ID NO: 1353200 - RNA, 14 nt, Human
agauggcacuuuga

SEQ ID NO: 1353201 - RNA, 15 nt, Human
agauggcccauccug

SEQ ID NO: 1353202 - RNA, 20 nt, Human
agauggccagccccuuagac

SEQ ID NO: 1353203 - RNA, 20 nt, Human
agauggcaucaaaaaagaua

SEQ ID NO: 1353204 - RNA, 21 nt, Human
agauggcauaaccugucucac

SEQ ID NO: 1353205 - RNA, 21 nt, Human
agauggcagcuuuuaaaagau

SEQ ID NO: 1353206 - RNA, 14 nt, Human
agauggcagcuuuu

SEQ ID NO: 1353207 - RNA, 13 nt, Human
agauggcagcuuu

SEQ ID NO: 1353208 - RNA, 12 nt, Human
agauggcagcuu

SEQ ID NO: 1353209 - RNA, 17 nt, Human
agaugggcuucccaagg

SEQ ID NO: 1353210 - RNA, 22 nt, Human
agaugggcuucccaagggcugc

SEQ ID NO: 1353211 - RNA, 22 nt, Human
agaugggcaucuuuuguauuaa

SEQ ID NO: 1353212 - RNA, 21 nt, Human
agaugggcaucuuuuguauua

SEQ ID NO: 1353213 - RNA, 20 nt, Human
agaugggcaucuuuuguauu

SEQ ID NO: 1353214 - RNA, 18 nt, Human
agaugggcaucuuuugua

SEQ ID NO: 1353215 - RNA, 16 nt, Human
agaugggcaucuuuug

SEQ ID NO: 1353216 - RNA, 17 nt, Human
agauggcucccaggggc

SEQ ID NO: 1353217 - RNA, 23 nt, Human
agauggcucccaggggcucccuc

SEQ ID NO: 1353218 - RNA, 14 nt, Human
agauggcucccagg

SEQ ID NO: 1353219 - RNA, 13 nt, Human
agauggcucccag

SEQ ID NO: 1353220 - RNA, 16 nt, Human
agauaucgacuuguuu

SEQ ID NO: 1353221 - RNA, 21 nt, Human
agaguucaagaaauaaguuuu

SEQ ID NO: 1353222 - RNA, 18 nt, Human
agaguucaagaaauaagu

SEQ ID NO: 1353223 - RNA, 15 nt, Human
agaguucaagaaaua

SEQ ID NO: 1353224 - RNA, 14 nt, Human
agaguucaagaaau

SEQ ID NO: 1353225 - RNA, 12 nt, Human
agaguuagacug

SEQ ID NO: 1353226 - RNA, 13 nt, Human
agaguuagacugu

SEQ ID NO: 1353227 - RNA, 14 nt, Human
agaguuagacuguu

SEQ ID NO: 1353228 - RNA, 15 nt, Human
agaguuagacuguug

SEQ ID NO: 1353229 - RNA, 17 nt, Human
agaguuagacuguuggg

SEQ ID NO: 1353230 - RNA, 23 nt, Human
agauaucaucuaccuagauuuaa

SEQ ID NO: 1353231 - RNA, 17 nt, Human
agauauauuuucuuucu

SEQ ID NO: 1353232 - RNA, 19 nt, Human
agagcccaggagcuccccu

SEQ ID NO: 1353233 - RNA, 17 nt, Human
agagcccaggagcuccc

SEQ ID NO: 1353234 - RNA, 16 nt, Human
agagcccaggagcucc

SEQ ID NO: 1353235 - RNA, 15 nt, Human
agagcccaggagcuc

SEQ ID NO: 1353236 - RNA, 20 nt, Human
agagcccaggcucggccugc

SEQ ID NO: 1353237 - RNA, 13 nt, Human
agagcccaggcuc

SEQ ID NO: 1353238 - RNA, 14 nt, Human
agaggacgggaggc

SEQ ID NO: 1353239 - RNA, 15 nt, Human
agaggaccggcggcu

SEQ ID NO: 1353240 - RNA, 15 nt, Human
agaggaaggggccag

SEQ ID NO: 1353241 - RNA, 22 nt, Human
agaggacuguagggagggcggc

SEQ ID NO: 1353242 - RNA, 16 nt, Human
agagggcacucugcuu

SEQ ID NO: 1353243 - RNA, 14 nt, Human
agagugugaccaaa

SEQ ID NO: 1353244 - RNA, 11 nt, Human
agagugugacc

SEQ ID NO: 1353245 - RNA, 15 nt, Human
agagugucuuuccac

SEQ ID NO: 1353246 - RNA, 14 nt, Human
agagugucuuucca

SEQ ID NO: 1353247 - RNA, 21 nt, Human
agagugugaccaaaaguuaca

SEQ ID NO: 1353248 - RNA, 12 nt, Human
augcugccccuc

SEQ ID NO: 1353249 - RNA, 23 nt, Human
augcugaaaauguccuugugaug

SEQ ID NO: 1353250 - RNA, 12 nt, Human
augcugaaaaug

SEQ ID NO: 1353251 - RNA, 12 nt, Human
augcuugggaag

SEQ ID NO: 1353252 - RNA, 12 nt, Human
augcuuguacau

SEQ ID NO: 1353253 - RNA, 13 nt, Human
augcuuguacaua

SEQ ID NO: 1353254 - RNA, 14 nt, Human
augcuuguacauaa

SEQ ID NO: 1353255 - RNA, 19 nt, Human
auggaaagcuucagugcug

SEQ ID NO: 1353256 - RNA, 18 nt, Human
augcuugggaagacuccu

SEQ ID NO: 1353257 - RNA, 23 nt, Human
augcuugggaagacuccuagcug

SEQ ID NO: 1353258 - RNA, 15 nt, Human
augcuuguacauaau

SEQ ID NO: 1353259 - RNA, 16 nt, Human
auggaaauauauauua

SEQ ID NO: 1353260 - RNA, 15 nt, Human
auggaaauauauauu

SEQ ID NO: 1353261 - RNA, 13 nt, Human
auggaaaggaugg

SEQ ID NO: 1353262 - RNA, 18 nt, Human
auggauucuaaaaugccu

SEQ ID NO: 1353263 - RNA, 15 nt, Human
auggauucuaaaaug

SEQ ID NO: 1353264 - RNA, 14 nt, Human
auggauucuaaaau

SEQ ID NO: 1353265 - RNA, 13 nt, Human
auggauucuaaaa

SEQ ID NO: 1353266 - RNA, 19 nt, Human
augccucugucuucuggac

SEQ ID NO: 1353267 - RNA, 18 nt, Human
augccucugccaaaggau

SEQ ID NO: 1353268 - RNA, 22 nt, Human
augccucugccaaaggauguga

SEQ ID NO: 1353269 - RNA, 23 nt, Human
augccucugaggccagccuggcc

SEQ ID NO: 1353270 - RNA, 22 nt, Human
augccucugaggccagccuggc

SEQ ID NO: 1353271 - RNA, 21 nt, Human
augccucugaggccagccugg

SEQ ID NO: 1353272 - RNA, 20 nt, Human
augccucugaggccagccug

SEQ ID NO: 1353273 - RNA, 19 nt, Human
augccucugaggccagccu

SEQ ID NO: 1353274 - RNA, 18 nt, Human
augccucugaggccagcc

SEQ ID NO: 1353275 - RNA, 17 nt, Human
augccucugaggccagc

SEQ ID NO: 1353276 - RNA, 17 nt, Human
augauuaaauaagauuc

SEQ ID NO: 1353277 - RNA, 18 nt, Human
augauuaaauaagauucu

SEQ ID NO: 1353278 - RNA, 13 nt, Human
augcaauuuuuau

SEQ ID NO: 1353279 - RNA, 17 nt, Human
augcaauuuccuuuuuu

SEQ ID NO: 1353280 - RNA, 22 nt, Human
augaugccucugucuucuggac

SEQ ID NO: 1353281 - RNA, 21 nt, Human
augauguuaaaaaaauaagaa

SEQ ID NO: 1353282 - RNA, 22 nt, Human
augauguuaaaaaaauaagaag

SEQ ID NO: 1353283 - RNA, 14 nt, Human
augauguuaaaaaa

SEQ ID NO: 1353284 - RNA, 11 nt, Human
augcauauacu

SEQ ID NO: 1353285 - RNA, 17 nt, Human
augcacagaguuguuac

SEQ ID NO: 1353286 - RNA, 18 nt, Human
augcacagaguuguuaca

SEQ ID NO: 1353287 - RNA, 16 nt, Human
augcacagaguuguua

SEQ ID NO: 1353288 - RNA, 14 nt, Human
augccucugaggcc

SEQ ID NO: 1353289 - RNA, 13 nt, Human
augccucugaggc

SEQ ID NO: 1353290 - RNA, 12 nt, Human
augccucugagg

SEQ ID NO: 1353291 - RNA, 16 nt, Human
augcaugaaguaauau

SEQ ID NO: 1353292 - RNA, 20 nt, Human
augcaugaaguaauaugcac

SEQ ID NO: 1353293 - RNA, 20 nt, Human
augcaucuguuuauucuaua

SEQ ID NO: 1353294 - RNA, 12 nt, Human
augcaucuguuu

SEQ ID NO: 1353295 - RNA, 16 nt, Human
augcauauuauuuuau

SEQ ID NO: 1353296 - RNA, 20 nt, Human
augcauauuauuuuauguug

SEQ ID NO: 1353297 - RNA, 21 nt, Human
auguggcuugagaaauaugga

SEQ ID NO: 1353298 - RNA, 16 nt, Human
auguggcuugagaaau

SEQ ID NO: 1353299 - RNA, 14 nt, Human
augugggauuaugg

SEQ ID NO: 1353300 - RNA, 13 nt, Human
augugggauuaug

SEQ ID NO: 1353301 - RNA, 23 nt, Human
auguucuaaguuucuaagauucu

SEQ ID NO: 1353302 - RNA, 21 nt, Human
auguucuaaguuucuaagauu

SEQ ID NO: 1353303 - RNA, 20 nt, Human
auguucuaaguuucuaagau

SEQ ID NO: 1353304 - RNA, 19 nt, Human
auguucuaaguuucuaaga

SEQ ID NO: 1353305 - RNA, 16 nt, Human
auguucuaaguuucua

SEQ ID NO: 1353306 - RNA, 14 nt, Human
auguucucuaucau

SEQ ID NO: 1353307 - RNA, 15 nt, Human
auguucucuaucauu

SEQ ID NO: 1353308 - RNA, 16 nt, Human
auguucucuaucauuu

SEQ ID NO: 1353309 - RNA, 15 nt, Human
auguucuaaguuucu

SEQ ID NO: 1353310 - RNA, 13 nt, Human
auguucuaaguuu

SEQ ID NO: 1353311 - RNA, 12 nt, Human
auguucuaaguu

SEQ ID NO: 1353312 - RNA, 22 nt, Human
auguucuaaggcucugagaguc

SEQ ID NO: 1353313 - RNA, 19 nt, Human
auguucuaagucuuuccau

SEQ ID NO: 1353314 - RNA, 18 nt, Human
auguucuaagucuuucca

SEQ ID NO: 1353315 - RNA, 20 nt, Human
auguucuaaggcucugagag

SEQ ID NO: 1353316 - RNA, 19 nt, Human
auguucuaaggcucugaga

SEQ ID NO: 1353317 - RNA, 18 nt, Human
auguucuaaggcucugag

SEQ ID NO: 1353318 - RNA, 17 nt, Human
auguucuaaggcucuga

SEQ ID NO: 1353319 - RNA, 16 nt, Human
auguucuaaggcucug

SEQ ID NO: 1353320 - RNA, 15 nt, Human
auguucuaaggcucu

SEQ ID NO: 1353321 - RNA, 14 nt, Human
auguucuaaggcuc

SEQ ID NO: 1353322 - RNA, 13 nt, Human
auguucuaaggcu

SEQ ID NO: 1353323 - RNA, 20 nt, Human
auguucuauuuuuuguuuug

SEQ ID NO: 1353324 - RNA, 18 nt, Human
auguucucuaucauuuaa

SEQ ID NO: 1353325 - RNA, 19 nt, Human
auguucucuaucauuuaau

SEQ ID NO: 1353326 - RNA, 20 nt, Human
auguucucuaucauuuaaua

SEQ ID NO: 1353327 - RNA, 21 nt, Human
auguucucuaucauuuaauaa

SEQ ID NO: 1353328 - RNA, 12 nt, Human
auguucuaaggc

SEQ ID NO: 1353329 - RNA, 17 nt, Human
auguucuaaccuuuaca

SEQ ID NO: 1353330 - RNA, 11 nt, Human
auguuccuucc

SEQ ID NO: 1353331 - RNA, 12 nt, Human
auguuccuucca

SEQ ID NO: 1353332 - RNA, 22 nt, Human
augugugcaacaggguauggac

SEQ ID NO: 1353333 - RNA, 22 nt, Human
augugggauuaugggucacagg

SEQ ID NO: 1353334 - RNA, 20 nt, Human
augugggauuaugggucaca

SEQ ID NO: 1353335 - RNA, 18 nt, Human
augugggauuauggguca

SEQ ID NO: 1353336 - RNA, 12 nt, Human
auguuuccagca

SEQ ID NO: 1353337 - RNA, 21 nt, Human
auguuucaagaggagccccca

SEQ ID NO: 1353338 - RNA, 15 nt, Human
auguuucaagaggag

SEQ ID NO: 1353339 - RNA, 17 nt, Human
auguuucacaaggucuu

SEQ ID NO: 1353340 - RNA, 22 nt, Human
auguuugcucagcuucuccaac

SEQ ID NO: 1353341 - RNA, 15 nt, Human
auguuuucaggcuag

SEQ ID NO: 1353342 - RNA, 18 nt, Human
auguauuuuauguuauau

SEQ ID NO: 1353343 - RNA, 16 nt, Human
auguauuuuauguuau

SEQ ID NO: 1353344 - RNA, 14 nt, Human
auguauuuuauguu

SEQ ID NO: 1353345 - RNA, 13 nt, Human
auguauuuuaugu

SEQ ID NO: 1353346 - RNA, 22 nt, Human
auguauugcacauuguaaaaag

SEQ ID NO: 1353347 - RNA, 17 nt, Human
auguauugcacauugua

SEQ ID NO: 1353348 - RNA, 16 nt, Human
auguauugcacauugu

SEQ ID NO: 1353349 - RNA, 17 nt, Human
auguaauggcaguuaua

SEQ ID NO: 1353350 - RNA, 16 nt, Human
auguaauggcaguuau

SEQ ID NO: 1353351 - RNA, 18 nt, Human
auguaauggcaguuauau

SEQ ID NO: 1353352 - RNA, 23 nt, Human
auguaaggcuguguaagauuugu

SEQ ID NO: 1353353 - RNA, 23 nt, Human
auggucgagaaagaggcaccagg

SEQ ID NO: 1353354 - RNA, 15 nt, Human
auggucggaaaacau

SEQ ID NO: 1353355 - RNA, 14 nt, Human
auggucacacacug

SEQ ID NO: 1353356 - RNA, 19 nt, Human
augguaguuuuuucaucuu

SEQ ID NO: 1353357 - RNA, 23 nt, Human
augguaucaauaaauagaccauu

SEQ ID NO: 1353358 - RNA, 18 nt, Human
augguaguuuuuucaucu

SEQ ID NO: 1353359 - RNA, 17 nt, Human
augguaguuuuuucauc

SEQ ID NO: 1353360 - RNA, 14 nt, Human
augguaguuuuuuc

SEQ ID NO: 1353361 - RNA, 19 nt, Human
auggucacacacugaugcu

SEQ ID NO: 1353362 - RNA, 18 nt, Human
auggucacacacugaugc

SEQ ID NO: 1353363 - RNA, 16 nt, Human
auggucacacacugau

SEQ ID NO: 1353364 - RNA, 15 nt, Human
auggucacacacuga

SEQ ID NO: 1353365 - RNA, 20 nt, Human
auggucacacacugaugcuu

SEQ ID NO: 1353366 - RNA, 20 nt, Human
auggucacguuuggugcuuc

SEQ ID NO: 1353367 - RNA, 21 nt, Human
auggucacguuuggugcuucu

SEQ ID NO: 1353368 - RNA, 18 nt, Human
auggucagcccuagggug

SEQ ID NO: 1353369 - RNA, 24 nt, Human
auggucacguuuggugcuucucag

SEQ ID NO: 1353370 - RNA, 19 nt, Human
augguccaauuaguuuccu

SEQ ID NO: 1353371 - RNA, 15 nt, Human
augugaagccuuccc

SEQ ID NO: 1353372 - RNA, 17 nt, Human
augugaagccuuccccu

SEQ ID NO: 1353373 - RNA, 14 nt, Human
augugaagccuucc

SEQ ID NO: 1353374 - RNA, 13 nt, Human
augugaagccuuc

SEQ ID NO: 1353375 - RNA, 14 nt, Human
augucaaacaaaua

SEQ ID NO: 1353376 - RNA, 13 nt, Human
augucaaacaaau

SEQ ID NO: 1353377 - RNA, 20 nt, Human
augucuuaaugaaguuugaa

SEQ ID NO: 1353378 - RNA, 21 nt, Human
augucuuaaugaaguuugaau

SEQ ID NO: 1353379 - RNA, 23 nt, Human
augucuuaaugaaguuugaaugu

SEQ ID NO: 1353380 - RNA, 16 nt, Human
augucuuuaaugcaau

SEQ ID NO: 1353381 - RNA, 11 nt, Human
augucuugugu

SEQ ID NO: 1353382 - RNA, 10 nt, Human
augucuugug

SEQ ID NO: 1353383 - RNA, 14 nt, Human
augucuucucccug

SEQ ID NO: 1353384 - RNA, 21 nt, Human
augucuuuucccauuuaucua

SEQ ID NO: 1353385 - RNA, 17 nt, Human
augucuuuucccauuua

SEQ ID NO: 1353386 - RNA, 16 nt, Human
augucuuuucccauuu

SEQ ID NO: 1353387 - RNA, 14 nt, Human
augugaaaucauuc

SEQ ID NO: 1353388 - RNA, 22 nt, Human
augugaaacuggauuaaacuua

SEQ ID NO: 1353389 - RNA, 12 nt, Human
augugaagccuu

SEQ ID NO: 1353390 - RNA, 22 nt, Human
augugaagccaauucagacagg

SEQ ID NO: 1353391 - RNA, 21 nt, Human
augugaagccaauucagacag

SEQ ID NO: 1353392 - RNA, 12 nt, Human
augugaagccaa

SEQ ID NO: 1353393 - RNA, 12 nt, Human
augugaaccauu

SEQ ID NO: 1353394 - RNA, 22 nt, Human
augugaaccauuaaccagaucu

SEQ ID NO: 1353395 - RNA, 23 nt, Human
augugaacaguuguguuugaagc

SEQ ID NO: 1353396 - RNA, 21 nt, Human
augugaacaguuguguuugaa

SEQ ID NO: 1353397 - RNA, 11 nt, Human
augugaacagu

SEQ ID NO: 1353398 - RNA, 14 nt, Human
aucuucugccuucu

SEQ ID NO: 1353399 - RNA, 21 nt, Human
aucuucugccuuagucucagu

SEQ ID NO: 1353400 - RNA, 15 nt, Human
aucugggaagcuauu

SEQ ID NO: 1353401 - RNA, 20 nt, Human
aucuggcuucuggccaggaa

SEQ ID NO: 1353402 - RNA, 22 nt, Human
aucuggcuucuggccaggaagc

SEQ ID NO: 1353403 - RNA, 12 nt, Human
aucuggcuucug

SEQ ID NO: 1353404 - RNA, 19 nt, Human
aucuggccuggccagugcc

SEQ ID NO: 1353405 - RNA, 16 nt, Human
aucuggccuggccagu

SEQ ID NO: 1353406 - RNA, 21 nt, Human
aucuggccuggccagugcccu

SEQ ID NO: 1353407 - RNA, 14 nt, Human
aucuucuucaccau

SEQ ID NO: 1353408 - RNA, 20 nt, Human
aucuucuuaugcaauuuccu

SEQ ID NO: 1353409 - RNA, 17 nt, Human
aucuucuuaugcaauuu

SEQ ID NO: 1353410 - RNA, 18 nt, Human
aucuucugccuucucaug

SEQ ID NO: 1353411 - RNA, 16 nt, Human
aucuucugccuucuca

SEQ ID NO: 1353412 - RNA, 16 nt, Human
aucuugaauuguaacu

SEQ ID NO: 1353413 - RNA, 18 nt, Human
aucuugaauaauguaaga

SEQ ID NO: 1353414 - RNA, 19 nt, Human
aucucugugugcacaaaua

SEQ ID NO: 1353415 - RNA, 17 nt, Human
aucucugugugcacaaa

SEQ ID NO: 1353416 - RNA, 15 nt, Human
aucucugugugcaca

SEQ ID NO: 1353417 - RNA, 18 nt, Human
aucucugugccuucgucu

SEQ ID NO: 1353418 - RNA, 15 nt, Human
aucucugugccuucg

SEQ ID NO: 1353419 - RNA, 14 nt, Human
aucucugugccuuc

SEQ ID NO: 1353420 - RNA, 13 nt, Human
aucucugugccuu

SEQ ID NO: 1353421 - RNA, 17 nt, Human
aucucuguaaagcuaaa

SEQ ID NO: 1353422 - RNA, 13 nt, Human
aucucuguaaagc

SEQ ID NO: 1353423 - RNA, 21 nt, Human
aucucugggggcugaggagca

SEQ ID NO: 1353424 - RNA, 18 nt, Human
aucucuguaaagcuaaaa

SEQ ID NO: 1353425 - RNA, 23 nt, Human
aucucugggcuggaugagcuccc

SEQ ID NO: 1353426 - RNA, 22 nt, Human
aucucugggcuggaugagcucc

SEQ ID NO: 1353427 - RNA, 21 nt, Human
aucucccuuuuccaugacugu

SEQ ID NO: 1353428 - RNA, 23 nt, Human
aucucccuggugcuuaugcucuu

SEQ ID NO: 1353429 - RNA, 21 nt, Human
aucucccuggugcuuaugcuc

SEQ ID NO: 1353430 - RNA, 18 nt, Human
aucucccuggugcuuaug

SEQ ID NO: 1353431 - RNA, 14 nt, Human
aucuggccuggcca

SEQ ID NO: 1353432 - RNA, 17 nt, Human
aucuggcaacaucuuua

SEQ ID NO: 1353433 - RNA, 21 nt, Human
aucugcuuaggaguuuaggga

SEQ ID NO: 1353434 - RNA, 18 nt, Human
aucuggaacccagacuca

SEQ ID NO: 1353435 - RNA, 17 nt, Human
aucuggaacccagacuc

SEQ ID NO: 1353436 - RNA, 16 nt, Human
aucuggaacccagacu

SEQ ID NO: 1353437 - RNA, 15 nt, Human
aucuggaacccagac

SEQ ID NO: 1353438 - RNA, 14 nt, Human
aucuggaacccaga

SEQ ID NO: 1353439 - RNA, 11 nt, Human
aucuggaaccc

SEQ ID NO: 1353440 - RNA, 18 nt, Human
aucuggaaccaucagaaa

SEQ ID NO: 1353441 - RNA, 15 nt, Human
aucucccuggugcuu

SEQ ID NO: 1353442 - RNA, 14 nt, Human
aucucccuggugcu

SEQ ID NO: 1353443 - RNA, 10 nt, Human
aucucccugg

SEQ ID NO: 1353444 - RNA, 16 nt, Human
aucucccugccuccug

SEQ ID NO: 1353445 - RNA, 19 nt, Human
aucucccugccuccugccg

SEQ ID NO: 1353446 - RNA, 14 nt, Human
aucucccugccucc

SEQ ID NO: 1353447 - RNA, 13 nt, Human
aucucccugccuc

SEQ ID NO: 1353448 - RNA, 20 nt, Human
aucucccugagaugggcuuc

SEQ ID NO: 1353449 - RNA, 17 nt, Human
aucuauggucgggagac

SEQ ID NO: 1353450 - RNA, 18 nt, Human
aucuaugcauuuucugga

SEQ ID NO: 1353451 - RNA, 16 nt, Human
aucuaugcauuuucug

SEQ ID NO: 1353452 - RNA, 22 nt, Human
aucuaucuuaauacuaaggaac

SEQ ID NO: 1353453 - RNA, 21 nt, Human
aucuauauuuuacauaaauuu

SEQ ID NO: 1353454 - RNA, 17 nt, Human
aucuauauuuuacauaa

SEQ ID NO: 1353455 - RNA, 18 nt, Human
augaaaaauugcugacug

SEQ ID NO: 1353456 - RNA, 16 nt, Human
augaaaaagaagaauc

SEQ ID NO: 1353457 - RNA, 17 nt, Human
augaaaaagaagaaucu

SEQ ID NO: 1353458 - RNA, 15 nt, Human
augaaaaagaagaau

SEQ ID NO: 1353459 - RNA, 14 nt, Human
augaaaaagaagaa

SEQ ID NO: 1353460 - RNA, 16 nt, Human
augaaaaaauguauau

SEQ ID NO: 1353461 - RNA, 18 nt, Human
augaaggugucauacaga

SEQ ID NO: 1353462 - RNA, 17 nt, Human
augaagguaaauaaaaa

SEQ ID NO: 1353463 - RNA, 15 nt, Human
augaagguaaauaaa

SEQ ID NO: 1353464 - RNA, 15 nt, Human
augaagggcccgaga

SEQ ID NO: 1353465 - RNA, 21 nt, Human
augaaggagaggcaacaucca

SEQ ID NO: 1353466 - RNA, 22 nt, Human
augaagcuuuuaugugaaacau

SEQ ID NO: 1353467 - RNA, 16 nt, Human
augaaguuuuacauug

SEQ ID NO: 1353468 - RNA, 14 nt, Human
augaaguuuuacau

SEQ ID NO: 1353469 - RNA, 19 nt, Human
augaaguuugaauguuaaa

SEQ ID NO: 1353470 - RNA, 20 nt, Human
augaaguuugaauguuaaau

SEQ ID NO: 1353471 - RNA, 19 nt, Human
augaaguuuuuuuuauaca

SEQ ID NO: 1353472 - RNA, 13 nt, Human
augaaguuugaau

SEQ ID NO: 1353473 - RNA, 14 nt, Human
augaaguuugaaug

SEQ ID NO: 1353474 - RNA, 15 nt, Human
augaaguuugaaugu

SEQ ID NO: 1353475 - RNA, 16 nt, Human
augaaguuugaauguu

SEQ ID NO: 1353476 - RNA, 18 nt, Human
augaaguuugaauguuaa

SEQ ID NO: 1353477 - RNA, 19 nt, Human
augaggacucuauucuuua

SEQ ID NO: 1353478 - RNA, 21 nt, Human
augagcucccacaagccugag

SEQ ID NO: 1353479 - RNA, 22 nt, Human
augagcucccacaagccugagg

SEQ ID NO: 1353480 - RNA, 20 nt, Human
augagcucccacaagccuga

SEQ ID NO: 1353481 - RNA, 10 nt, Human
augagcuccc

SEQ ID NO: 1353482 - RNA, 19 nt, Human
augagcuccuuaaggcucu

SEQ ID NO: 1353483 - RNA, 23 nt, Human
augaaguuuuuuuuauacaggau

SEQ ID NO: 1353484 - RNA, 15 nt, Human
aucggaaaaauaauc

SEQ ID NO: 1353485 - RNA, 15 nt, Human
aucggagccuccucu

SEQ ID NO: 1353486 - RNA, 16 nt, Human
aucggagccuccucuc

SEQ ID NO: 1353487 - RNA, 13 nt, Human
aucggaaaaauaa

SEQ ID NO: 1353488 - RNA, 13 nt, Human
auccucccagaaa

SEQ ID NO: 1353489 - RNA, 21 nt, Human
aucgcugggaaaugagaugac

SEQ ID NO: 1353490 - RNA, 15 nt, Human
aucggcauuuguuuc

SEQ ID NO: 1353491 - RNA, 20 nt, Human
auccucccacuucagccucc

SEQ ID NO: 1353492 - RNA, 19 nt, Human
auccuccacguucugcuca

SEQ ID NO: 1353493 - RNA, 21 nt, Human
auccucaaagaaaguguauug

SEQ ID NO: 1353494 - RNA, 20 nt, Human
auccucaaagaaaguguauu

SEQ ID NO: 1353495 - RNA, 19 nt, Human
auccucaaagaaaguguau

SEQ ID NO: 1353496 - RNA, 18 nt, Human
auccucaaagaaagugua

SEQ ID NO: 1353497 - RNA, 16 nt, Human
auccucaaagaaagug

SEQ ID NO: 1353498 - RNA, 15 nt, Human
auccucaaagaaagu

SEQ ID NO: 1353499 - RNA, 20 nt, Human
auccuauguuuuuguucaaa

SEQ ID NO: 1353500 - RNA, 12 nt, Human
auccuauguuuu

SEQ ID NO: 1353501 - RNA, 13 nt, Human
auccccuucuccc

SEQ ID NO: 1353502 - RNA, 20 nt, Human
auccccaacaugcacugaug

SEQ ID NO: 1353503 - RNA, 21 nt, Human
auccaggagcuccaguguccu

SEQ ID NO: 1353504 - RNA, 16 nt, Human
auccaggagcuccagu

SEQ ID NO: 1353505 - RNA, 15 nt, Human
auccaggagcuccag

SEQ ID NO: 1353506 - RNA, 14 nt, Human
auccaggagcucca

SEQ ID NO: 1353507 - RNA, 12 nt, Human
auccaggagcuc

SEQ ID NO: 1353508 - RNA, 23 nt, Human
auccaggacuauauuugggccug

SEQ ID NO: 1353509 - RNA, 22 nt, Human
auccaggacuauauuugggccu

SEQ ID NO: 1353510 - RNA, 14 nt, Human
auccagcucacuca

SEQ ID NO: 1353511 - RNA, 15 nt, Human
auccagcuauguuau

SEQ ID NO: 1353512 - RNA, 16 nt, Human
auccaggcagauccag

SEQ ID NO: 1353513 - RNA, 15 nt, Human
auccaggcagaucca

SEQ ID NO: 1353514 - RNA, 14 nt, Human
auccaggcagaucc

SEQ ID NO: 1353515 - RNA, 19 nt, Human
auccaggcagauccaggac

SEQ ID NO: 1353516 - RNA, 18 nt, Human
auccagaaagaaaacuug

SEQ ID NO: 1353517 - RNA, 16 nt, Human
auccagaaagaaaacu

SEQ ID NO: 1353518 - RNA, 17 nt, Human
aucagcuccuuccugga

SEQ ID NO: 1353519 - RNA, 15 nt, Human
aucaugugaaaucau

SEQ ID NO: 1353520 - RNA, 16 nt, Human
aucaugugaaaucauu

SEQ ID NO: 1353521 - RNA, 15 nt, Human
aucagcuccuuccug

SEQ ID NO: 1353522 - RNA, 13 nt, Human
aucagcuccuucc

SEQ ID NO: 1353523 - RNA, 17 nt, Human
aucagcuauuuugugaa

SEQ ID NO: 1353524 - RNA, 21 nt, Human
aucagcguggccuuguucugu

SEQ ID NO: 1353525 - RNA, 16 nt, Human
aucagcguggccuugu

SEQ ID NO: 1353526 - RNA, 15 nt, Human
aucagcguggccuug

SEQ ID NO: 1353527 - RNA, 13 nt, Human
aucagcguggccu

SEQ ID NO: 1353528 - RNA, 12 nt, Human
aucagcguggcc

SEQ ID NO: 1353529 - RNA, 14 nt, Human
aucagccaauuaug

SEQ ID NO: 1353530 - RNA, 19 nt, Human
aucagcacgauuucuguuu

SEQ ID NO: 1353531 - RNA, 20 nt, Human
aucagcacgauuucuguuua

SEQ ID NO: 1353532 - RNA, 23 nt, Human
aucagcacgauuucuguuuagau

SEQ ID NO: 1353533 - RNA, 12 nt, Human
aucagccaauua

SEQ ID NO: 1353534 - RNA, 14 nt, Human
aucacagcuucagc

SEQ ID NO: 1353535 - RNA, 18 nt, Human
aucacagcuucagccagg

SEQ ID NO: 1353536 - RNA, 21 nt, Human
aucacagcuucagccaggagc

SEQ ID NO: 1353537 - RNA, 22 nt, Human
aucacagcuucagccaggagcu

SEQ ID NO: 1353538 - RNA, 15 nt, Human
auauuuauuuuaaua

SEQ ID NO: 1353539 - RNA, 14 nt, Human
auauuuauuuuaau

SEQ ID NO: 1353540 - RNA, 17 nt, Human
auauuuauuuuaauaau

SEQ ID NO: 1353541 - RNA, 17 nt, Human
auaaagaaauagaacaa

SEQ ID NO: 1353542 - RNA, 18 nt, Human
auaaagaaauagaacaag

SEQ ID NO: 1353543 - RNA, 11 nt, Human
auaaagaaugg

SEQ ID NO: 1353544 - RNA, 13 nt, Human
auaaagcagcguu

SEQ ID NO: 1353545 - RNA, 14 nt, Human
auaaagcagcguuu

SEQ ID NO: 1353546 - RNA, 18 nt, Human
auaaagcagcguuucuau

SEQ ID NO: 1353547 - RNA, 19 nt, Human
auaaagcagcguuucuaug

SEQ ID NO: 1353548 - RNA, 20 nt, Human
auaaagcagcguuucuauga

SEQ ID NO: 1353549 - RNA, 22 nt, Human
auaaagccucaagguuuuaggu

SEQ ID NO: 1353550 - RNA, 21 nt, Human
auaaagccucaagguuuuagg

SEQ ID NO: 1353551 - RNA, 18 nt, Human
auaaagccucaagguuuu

SEQ ID NO: 1353552 - RNA, 14 nt, Human
auaaagcauuuaac

SEQ ID NO: 1353553 - RNA, 13 nt, Human
auaaagcauuuaa

SEQ ID NO: 1353554 - RNA, 12 nt, Human
auaaagcauuua

SEQ ID NO: 1353555 - RNA, 14 nt, Human
auaaagcaguauuu

SEQ ID NO: 1353556 - RNA, 16 nt, Human
auaaagcaguauuuuu

SEQ ID NO: 1353557 - RNA, 15 nt, Human
auaaagcaggcagaa

SEQ ID NO: 1353558 - RNA, 12 nt, Human
auaaaggaaaag

SEQ ID NO: 1353559 - RNA, 18 nt, Human
auaaagcuguguggcagu

SEQ ID NO: 1353560 - RNA, 22 nt, Human
auaaaggaugugauuguggaau

SEQ ID NO: 1353561 - RNA, 21 nt, Human
auaaaggaugugauuguggaa

SEQ ID NO: 1353562 - RNA, 17 nt, Human
auaaaggaugugauugu

SEQ ID NO: 1353563 - RNA, 14 nt, Human
auaaaggaugugau

SEQ ID NO: 1353564 - RNA, 18 nt, Human
auaaaggaaaagacacau

SEQ ID NO: 1353565 - RNA, 16 nt, Human
auaaaggaaaagacac

SEQ ID NO: 1353566 - RNA, 15 nt, Human
auaaaggaaaagaca

SEQ ID NO: 1353567 - RNA, 13 nt, Human
auaaaggauguga

SEQ ID NO: 1353568 - RNA, 14 nt, Human
auaaaggacuguaa

SEQ ID NO: 1353569 - RNA, 12 nt, Human
auaaaaaggugu

SEQ ID NO: 1353570 - RNA, 16 nt, Human
auaaaaagugcuuuug

SEQ ID NO: 1353571 - RNA, 14 nt, Human
auaaaaauaaaaaa

SEQ ID NO: 1353572 - RNA, 19 nt, Human
auaaaaauaaaaaagaucc

SEQ ID NO: 1353573 - RNA, 15 nt, Human
auaaaacuuuuuaaa

SEQ ID NO: 1353574 - RNA, 11 nt, Human
auaaaacuuuu

SEQ ID NO: 1353575 - RNA, 16 nt, Human
auaaaagaaaauuaca

SEQ ID NO: 1353576 - RNA, 13 nt, Human
auaaaagaaaauu

SEQ ID NO: 1353577 - RNA, 12 nt, Human
auaaaagaaaau

SEQ ID NO: 1353578 - RNA, 17 nt, Human
auaaaacuuuuuaaaau

SEQ ID NO: 1353579 - RNA, 21 nt, Human
auaaacuuuaccuuuuuuaua

SEQ ID NO: 1353580 - RNA, 13 nt, Human
auaaagaaaauga

SEQ ID NO: 1353581 - RNA, 19 nt, Human
auaaagaaaagaugcacuu

SEQ ID NO: 1353582 - RNA, 17 nt, Human
auaaagaaaagaugcac

SEQ ID NO: 1353583 - RNA, 16 nt, Human
auaaagaaaagaugca

SEQ ID NO: 1353584 - RNA, 15 nt, Human
auaaagaaaagaugc

SEQ ID NO: 1353585 - RNA, 14 nt, Human
auaaagaaaagaug

SEQ ID NO: 1353586 - RNA, 13 nt, Human
auaaagaaaagau

SEQ ID NO: 1353587 - RNA, 14 nt, Human
auaaaagaaaauua

SEQ ID NO: 1353588 - RNA, 20 nt, Human
auaaacuuuuuucuuacugu

SEQ ID NO: 1353589 - RNA, 24 nt, Human
auaaacuuuaccuuuuuuauacau

SEQ ID NO: 1353590 - RNA, 18 nt, Human
auaaaggcaguuuucuaa

SEQ ID NO: 1353591 - RNA, 17 nt, Human
auaaaggcaguuuucua

SEQ ID NO: 1353592 - RNA, 16 nt, Human
auaaaggcaguuuucu

SEQ ID NO: 1353593 - RNA, 18 nt, Human
auaaaggauuaaugucaa

SEQ ID NO: 1353594 - RNA, 14 nt, Human
auaacaacuucaua

SEQ ID NO: 1353595 - RNA, 21 nt, Human
auaacaaaugccaaauuaaaa

SEQ ID NO: 1353596 - RNA, 20 nt, Human
auaacaaaugccaaauuaaa

SEQ ID NO: 1353597 - RNA, 17 nt, Human
auaacaaaugccaaauu

SEQ ID NO: 1353598 - RNA, 15 nt, Human
auaaauuuuuuauaa

SEQ ID NO: 1353599 - RNA, 21 nt, Human
auaccuguguuucuugccuca

SEQ ID NO: 1353600 - RNA, 22 nt, Human
auaccuguguuucuugccucau

SEQ ID NO: 1353601 - RNA, 20 nt, Human
auaccuguguuucuugccuc

SEQ ID NO: 1353602 - RNA, 19 nt, Human
auaccuguguuucuugccu

SEQ ID NO: 1353603 - RNA, 12 nt, Human
auaccucacuuu

SEQ ID NO: 1353604 - RNA, 13 nt, Human
auacccacccaga

SEQ ID NO: 1353605 - RNA, 14 nt, Human
auacccacccagaa

SEQ ID NO: 1353606 - RNA, 21 nt, Human
auaaugggauuuucuuuucuu

SEQ ID NO: 1353607 - RNA, 21 nt, Human
auaaugcgugcauaccacuuu

SEQ ID NO: 1353608 - RNA, 11 nt, Human
auaaggcaggg

SEQ ID NO: 1353609 - RNA, 19 nt, Human
auaaggccauaaaacaggu

SEQ ID NO: 1353610 - RNA, 24 nt, Human
auaaggaaaucaacuugcuuauca

SEQ ID NO: 1353611 - RNA, 22 nt, Human
auaaggaaaucaacuugcuuau

SEQ ID NO: 1353612 - RNA, 20 nt, Human
auaaggaaaucaacuugcuu

SEQ ID NO: 1353613 - RNA, 13 nt, Human
auaagcuuuucuu

SEQ ID NO: 1353614 - RNA, 13 nt, Human
auaaggaaaagcu

SEQ ID NO: 1353615 - RNA, 14 nt, Human
auaagcuuuucuuu

SEQ ID NO: 1353616 - RNA, 23 nt, Human
auaccauuauauguucccccugu

SEQ ID NO: 1353617 - RNA, 21 nt, Human
auacaccacuacauucuguua

SEQ ID NO: 1353618 - RNA, 19 nt, Human
auacaccacuacauucugu

SEQ ID NO: 1353619 - RNA, 20 nt, Human
auacaccacuacauucuguu

SEQ ID NO: 1353620 - RNA, 15 nt, Human
auaaugucccuucac

SEQ ID NO: 1353621 - RNA, 23 nt, Human
auaauguuucaaacauauauaac

SEQ ID NO: 1353622 - RNA, 22 nt, Human
auaugcuucuguuuuauaauuu

SEQ ID NO: 1353623 - RNA, 20 nt, Human
auaugcuucuguuuuauaau

SEQ ID NO: 1353624 - RNA, 17 nt, Human
auauuacgguuugcccc

SEQ ID NO: 1353625 - RNA, 20 nt, Human
auaugcucugauuuaucuga

SEQ ID NO: 1353626 - RNA, 23 nt, Human
auaugcuucuguuuuauaauuuu

SEQ ID NO: 1353627 - RNA, 22 nt, Human
auauuaccacagacauacuaac

SEQ ID NO: 1353628 - RNA, 22 nt, Human
auauccuaaacaucauucauuu

SEQ ID NO: 1353629 - RNA, 19 nt, Human
auauccaaaagcuuuuuau

SEQ ID NO: 1353630 - RNA, 12 nt, Human
auauccaaaagc

SEQ ID NO: 1353631 - RNA, 15 nt, Human
auauccuaaacauca

SEQ ID NO: 1353632 - RNA, 13 nt, Human
auauccuaaacau

SEQ ID NO: 1353633 - RNA, 18 nt, Human
auauuuaccucagccugg

SEQ ID NO: 1353634 - RNA, 13 nt, Human
auauuuauuuuaa

SEQ ID NO: 1353635 - RNA, 14 nt, Human
auauuauuuuaugu

SEQ ID NO: 1353636 - RNA, 19 nt, Human
auauuuaccucagccuggg

SEQ ID NO: 1353637 - RNA, 17 nt, Human
auauuuaccucagccug

SEQ ID NO: 1353638 - RNA, 16 nt, Human
auauuuaccucagccu

SEQ ID NO: 1353639 - RNA, 15 nt, Human
auauuuaccucagcc

SEQ ID NO: 1353640 - RNA, 21 nt, Human
auauuuacaugaauugcauuu

SEQ ID NO: 1353641 - RNA, 19 nt, Human
auauuauuccucaaaaaau

SEQ ID NO: 1353642 - RNA, 23 nt, Human
auauuauuauaaucuuauaauug

SEQ ID NO: 1353643 - RNA, 21 nt, Human
auauuauuauaaucuuauaau

SEQ ID NO: 1353644 - RNA, 19 nt, Human
auauuauuauaaucuuaua

SEQ ID NO: 1353645 - RNA, 18 nt, Human
auauuauuauaaucuuau

SEQ ID NO: 1353646 - RNA, 22 nt, Human
auauuauuaguuuugauuuaau

SEQ ID NO: 1353647 - RNA, 19 nt, Human
auauuauuaguuuugauuu

SEQ ID NO: 1353648 - RNA, 19 nt, Human
auauuauuacuuguaaaua

SEQ ID NO: 1353649 - RNA, 17 nt, Human
auauuauuacuuguaaa

SEQ ID NO: 1353650 - RNA, 15 nt, Human
auauuauuacuugua

SEQ ID NO: 1353651 - RNA, 12 nt, Human
auauuauuacuu

SEQ ID NO: 1353652 - RNA, 15 nt, Human
auauuaugagaugcu

SEQ ID NO: 1353653 - RNA, 14 nt, Human
auauuaugagaugc

SEQ ID NO: 1353654 - RNA, 16 nt, Human
auauuaugagaugcug

SEQ ID NO: 1353655 - RNA, 20 nt, Human
auauuauauggaaauauaua

SEQ ID NO: 1353656 - RNA, 19 nt, Human
auauuauauggaaauauau

SEQ ID NO: 1353657 - RNA, 18 nt, Human
auauuauauggaaauaua

SEQ ID NO: 1353658 - RNA, 13 nt, Human
auauuauauggaa

SEQ ID NO: 1353659 - RNA, 12 nt, Human
auauuauaugga

SEQ ID NO: 1353660 - RNA, 13 nt, Human
auauuaucuuuuc

SEQ ID NO: 1353661 - RNA, 23 nt, Human
auauuaugaagcuuuuaugugaa

SEQ ID NO: 1353662 - RNA, 21 nt, Human
auaucaucuaccuagauuuaa

SEQ ID NO: 1353663 - RNA, 21 nt, Human
auaucaugagugaauaaaugu

SEQ ID NO: 1353664 - RNA, 20 nt, Human
auaucaucuaccuagauuua

SEQ ID NO: 1353665 - RNA, 16 nt, Human
auaucaucuaccuaga

SEQ ID NO: 1353666 - RNA, 24 nt, Human
auaucauccacacaugaaucugca

SEQ ID NO: 1353667 - RNA, 18 nt, Human
auaucauccacacaugaa

SEQ ID NO: 1353668 - RNA, 16 nt, Human
auaucauccacacaug

SEQ ID NO: 1353669 - RNA, 23 nt, Human
auauauuuuuuuuuaagcucuga

SEQ ID NO: 1353670 - RNA, 19 nt, Human
auauauuuuuuucugaaau

SEQ ID NO: 1353671 - RNA, 16 nt, Human
auaucaaauauauuca

SEQ ID NO: 1353672 - RNA, 19 nt, Human
auagcccacuuacauuuac

SEQ ID NO: 1353673 - RNA, 15 nt, Human
auagcccacuuacau

SEQ ID NO: 1353674 - RNA, 13 nt, Human
auagcccacuuac

SEQ ID NO: 1353675 - RNA, 23 nt, Human
auagccauauuuguaaaaugaca

SEQ ID NO: 1353676 - RNA, 22 nt, Human
auagccauauuuguaaaaugac

SEQ ID NO: 1353677 - RNA, 20 nt, Human
auagccauauuuguaaaaug

SEQ ID NO: 1353678 - RNA, 16 nt, Human
auagccauauuuguaa

SEQ ID NO: 1353679 - RNA, 12 nt, Human
auagccauauuu

SEQ ID NO: 1353680 - RNA, 23 nt, Human
auagccacuaaccuugccuggua

SEQ ID NO: 1353681 - RNA, 22 nt, Human
auagccacuaaccuugccuggu

SEQ ID NO: 1353682 - RNA, 21 nt, Human
auagccacuaaccuugccugg

SEQ ID NO: 1353683 - RNA, 20 nt, Human
auagccacuaaccuugccug

SEQ ID NO: 1353684 - RNA, 15 nt, Human
auagccacuaaccuu

SEQ ID NO: 1353685 - RNA, 13 nt, Human
auagccacuaacc

SEQ ID NO: 1353686 - RNA, 23 nt, Human
auagccacauuuggaauacuuuu

SEQ ID NO: 1353687 - RNA, 22 nt, Human
auagccacauuuggaauacuuu

SEQ ID NO: 1353688 - RNA, 21 nt, Human
auagccacauuuggaauacuu

SEQ ID NO: 1353689 - RNA, 16 nt, Human
auagccacauuuggaa

SEQ ID NO: 1353690 - RNA, 13 nt, Human
auagccacauuug

SEQ ID NO: 1353691 - RNA, 18 nt, Human
auagccaaaaauagcuaa

SEQ ID NO: 1353692 - RNA, 16 nt, Human
auagccaaaaauagcu

SEQ ID NO: 1353693 - RNA, 15 nt, Human
auagccaaaaauagc

SEQ ID NO: 1353694 - RNA, 14 nt, Human
auagccaaaaauag

SEQ ID NO: 1353695 - RNA, 13 nt, Human
auagccaaaaaua

SEQ ID NO: 1353696 - RNA, 23 nt, Human
auaggugauccauguaacugccu

SEQ ID NO: 1353697 - RNA, 20 nt, Human
auaggugauccauguaacug

SEQ ID NO: 1353698 - RNA, 15 nt, Human
auaggucugaaauuu

SEQ ID NO: 1353699 - RNA, 14 nt, Human
auaggucugaaauu

SEQ ID NO: 1353700 - RNA, 13 nt, Human
auaggucugaaau

SEQ ID NO: 1353701 - RNA, 23 nt, Human
auagguagaauguaaagcuuguc

SEQ ID NO: 1353702 - RNA, 12 nt, Human
auagguuuagag

SEQ ID NO: 1353703 - RNA, 12 nt, Human
auagguuauuuu

SEQ ID NO: 1353704 - RNA, 18 nt, Human
auagguuuggacaaaaug

SEQ ID NO: 1353705 - RNA, 14 nt, Human
auagguuuggacaa

SEQ ID NO: 1353706 - RNA, 15 nt, Human
auagguuuaauaauu

SEQ ID NO: 1353707 - RNA, 17 nt, Human
auauagaaguauaaaga

SEQ ID NO: 1353708 - RNA, 20 nt, Human
auauagaaguauaaagaauu

SEQ ID NO: 1353709 - RNA, 20 nt, Human
auauacuuuuuuuucuuuaa

SEQ ID NO: 1353710 - RNA, 11 nt, Human
auauacuuuuu

SEQ ID NO: 1353711 - RNA, 18 nt, Human
auauacuuuuacaaguaa

SEQ ID NO: 1353712 - RNA, 23 nt, Human
auauagaucaguuauaaguagca

SEQ ID NO: 1353713 - RNA, 20 nt, Human
auauacuuugaaaggagaug

SEQ ID NO: 1353714 - RNA, 21 nt, Human
auauacuuguggacuaaaaga

SEQ ID NO: 1353715 - RNA, 14 nt, Human
auauacuuguggac

SEQ ID NO: 1353716 - RNA, 15 nt, Human
auauacuuguggacu

SEQ ID NO: 1353717 - RNA, 22 nt, Human
auauacucuagaugaaguuuua

SEQ ID NO: 1353718 - RNA, 17 nt, Human
auagucaaauuguguga

SEQ ID NO: 1353719 - RNA, 18 nt, Human
auaguauuuuuauauuua

SEQ ID NO: 1353720 - RNA, 14 nt, Human
auagucaaauugug

SEQ ID NO: 1353721 - RNA, 12 nt, Human
agugacagcuag

SEQ ID NO: 1353722 - RNA, 20 nt, Human
agugacagcuaggaugugca

SEQ ID NO: 1353723 - RNA, 16 nt, Human
agugaaguugcugcuu

SEQ ID NO: 1353724 - RNA, 23 nt, Human
agugaaguugcugcuucucccag

SEQ ID NO: 1353725 - RNA, 15 nt, Human
agugaaguugcugcu

SEQ ID NO: 1353726 - RNA, 14 nt, Human
agugaaguugcugc

SEQ ID NO: 1353727 - RNA, 21 nt, Human
agugaaggcuucucucugugg

SEQ ID NO: 1353728 - RNA, 15 nt, Human
agugaaggcuucucu

SEQ ID NO: 1353729 - RNA, 16 nt, Human
agugaagacuggaagc

SEQ ID NO: 1353730 - RNA, 15 nt, Human
agugaagacagaagu

SEQ ID NO: 1353731 - RNA, 21 nt, Human
agugaagacuagaaaauuaga

SEQ ID NO: 1353732 - RNA, 14 nt, Human
agugaagacagaag

SEQ ID NO: 1353733 - RNA, 20 nt, Human
agugaagacagaaccacagg

SEQ ID NO: 1353734 - RNA, 13 nt, Human
agugaagacagaa

SEQ ID NO: 1353735 - RNA, 12 nt, Human
agugaagacaga

SEQ ID NO: 1353736 - RNA, 16 nt, Human
agugaagacaaugacu

SEQ ID NO: 1353737 - RNA, 22 nt, Human
agugaagaauacuucucauuuu

SEQ ID NO: 1353738 - RNA, 14 nt, Human
agugaagaauacuu

SEQ ID NO: 1353739 - RNA, 12 nt, Human
agugaagaauac

SEQ ID NO: 1353740 - RNA, 14 nt, Human
agugaagacaauga

SEQ ID NO: 1353741 - RNA, 22 nt, Human
agucugccagggccccucuccc

SEQ ID NO: 1353742 - RNA, 13 nt, Human
agucugccagggc

SEQ ID NO: 1353743 - RNA, 11 nt, Human
agucugccagg

SEQ ID NO: 1353744 - RNA, 14 nt, Human
agucugccacccag

SEQ ID NO: 1353745 - RNA, 21 nt, Human
aguccugugaaugccacugcc

SEQ ID NO: 1353746 - RNA, 12 nt, Human
aguccuguaaug

SEQ ID NO: 1353747 - RNA, 20 nt, Human
aguccugugaaugccacugc

SEQ ID NO: 1353748 - RNA, 19 nt, Human
aguccugugaaugccacug

SEQ ID NO: 1353749 - RNA, 18 nt, Human
aguccugugaaugccacu

SEQ ID NO: 1353750 - RNA, 13 nt, Human
aguccugugaaug

SEQ ID NO: 1353751 - RNA, 19 nt, Human
aguccugggauuacaggug

SEQ ID NO: 1353752 - RNA, 17 nt, Human
agugacccacaugccau

SEQ ID NO: 1353753 - RNA, 16 nt, Human
agucaacaguaaacca

SEQ ID NO: 1353754 - RNA, 15 nt, Human
agucaacaguaaacc

SEQ ID NO: 1353755 - RNA, 14 nt, Human
agucaacaguaaac

SEQ ID NO: 1353756 - RNA, 13 nt, Human
agucaacaguaaa

SEQ ID NO: 1353757 - RNA, 21 nt, Human
agucaacaguaaaccacugaa

SEQ ID NO: 1353758 - RNA, 20 nt, Human
agucaacaguaaaccacuga

SEQ ID NO: 1353759 - RNA, 18 nt, Human
agucaacaguaaaccacu

SEQ ID NO: 1353760 - RNA, 17 nt, Human
agucaacaguaaaccac

SEQ ID NO: 1353761 - RNA, 22 nt, Human
agucaacaguaaaccacugaaa

SEQ ID NO: 1353762 - RNA, 19 nt, Human
aguauggggguuguaaauu

SEQ ID NO: 1353763 - RNA, 18 nt, Human
aguauggggguuguaaau

SEQ ID NO: 1353764 - RNA, 18 nt, Human
aguauggguuagggaaaa

SEQ ID NO: 1353765 - RNA, 14 nt, Human
agucaaauaacucc

SEQ ID NO: 1353766 - RNA, 23 nt, Human
agucaaaugguaggcauuuccua

SEQ ID NO: 1353767 - RNA, 22 nt, Human
agucaaaugguaggcauuuccu

SEQ ID NO: 1353768 - RNA, 23 nt, Human
agucaaauugugugaaagguacu

SEQ ID NO: 1353769 - RNA, 16 nt, Human
aguauggccuguguca

SEQ ID NO: 1353770 - RNA, 15 nt, Human
aguauggccuguguc

SEQ ID NO: 1353771 - RNA, 17 nt, Human
aguaugaauuauucaau

SEQ ID NO: 1353772 - RNA, 20 nt, Human
aguaugcuuggacugaaggg

SEQ ID NO: 1353773 - RNA, 22 nt, Human
aguaugaauuauucaauuuauu

SEQ ID NO: 1353774 - RNA, 17 nt, Human
aguaugaggcauuuguu

SEQ ID NO: 1353775 - RNA, 15 nt, Human
aguaugaggcauuug

SEQ ID NO: 1353776 - RNA, 16 nt, Human
aguaugaggcauuugu

SEQ ID NO: 1353777 - RNA, 12 nt, Human
aguaucuuuuga

SEQ ID NO: 1353778 - RNA, 16 nt, Human
aguaucuuuuuauuca

SEQ ID NO: 1353779 - RNA, 18 nt, Human
aguaucucuucagucucu

SEQ ID NO: 1353780 - RNA, 16 nt, Human
aguaucucuucagucu

SEQ ID NO: 1353781 - RNA, 18 nt, Human
aguuguucuuuuuagaaa

SEQ ID NO: 1353782 - RNA, 23 nt, Human
aguuguucgggccaaggaccuga

SEQ ID NO: 1353783 - RNA, 23 nt, Human
aguuguguuucaacggaaagugc

SEQ ID NO: 1353784 - RNA, 14 nt, Human
aguuguguuucaac

SEQ ID NO: 1353785 - RNA, 12 nt, Human
aguuguuguaac

SEQ ID NO: 1353786 - RNA, 16 nt, Human
aguuguuguaaccugc

SEQ ID NO: 1353787 - RNA, 21 nt, Human
aguugugucuggcaguuuaua

SEQ ID NO: 1353788 - RNA, 16 nt, Human
aguuguguuugaagca

SEQ ID NO: 1353789 - RNA, 19 nt, Human
aguugaaaauaaaguguau

SEQ ID NO: 1353790 - RNA, 18 nt, Human
aguugaaaauaaagugua

SEQ ID NO: 1353791 - RNA, 16 nt, Human
aguugaaaauaaagug

SEQ ID NO: 1353792 - RNA, 23 nt, Human
aguugaaaaucuuauaauuuaaa

SEQ ID NO: 1353793 - RNA, 18 nt, Human
aguuaaucuugcuuucuu

SEQ ID NO: 1353794 - RNA, 16 nt, Human
aguuaaucuugcuuuc

SEQ ID NO: 1353795 - RNA, 15 nt, Human
aguuaaucuugcuuu

SEQ ID NO: 1353796 - RNA, 14 nt, Human
aguuaaucuugcuu

SEQ ID NO: 1353797 - RNA, 18 nt, Human
aguuaaucaucaagagaa

SEQ ID NO: 1353798 - RNA, 19 nt, Human
aguuaaucaucaagagaau

SEQ ID NO: 1353799 - RNA, 15 nt, Human
aguuaaucaucaaga

SEQ ID NO: 1353800 - RNA, 19 nt, Human
aguuacagaaaugauuacu

SEQ ID NO: 1353801 - RNA, 18 nt, Human
aguucauuagaaauauuu

SEQ ID NO: 1353802 - RNA, 23 nt, Human
aguucauuagaaauauuuuaaaa

SEQ ID NO: 1353803 - RNA, 16 nt, Human
aguucauuagaaauau

SEQ ID NO: 1353804 - RNA, 15 nt, Human
aguucauuagaaaua

SEQ ID NO: 1353805 - RNA, 16 nt, Human
aguucaugucugcuau

SEQ ID NO: 1353806 - RNA, 17 nt, Human
aguucaugucugcuauc

SEQ ID NO: 1353807 - RNA, 17 nt, Human
aguucauguaaauaaua

SEQ ID NO: 1353808 - RNA, 16 nt, Human
aguucauguaaauaau

SEQ ID NO: 1353809 - RNA, 14 nt, Human
aguucauguaaaua

SEQ ID NO: 1353810 - RNA, 13 nt, Human
aguucauguaaau

SEQ ID NO: 1353811 - RNA, 22 nt, Human
aguucaugcagcuguggcagag

SEQ ID NO: 1353812 - RNA, 13 nt, Human
aguucaugcagcu

SEQ ID NO: 1353813 - RNA, 21 nt, Human
aguucaugagaaucuauauuu

SEQ ID NO: 1353814 - RNA, 13 nt, Human
aguucaugagaau

SEQ ID NO: 1353815 - RNA, 19 nt, Human
aguuccaagagucuaaaga

SEQ ID NO: 1353816 - RNA, 14 nt, Human
aguuccaagagucu

SEQ ID NO: 1353817 - RNA, 13 nt, Human
aguuccaagaguc

SEQ ID NO: 1353818 - RNA, 22 nt, Human
aguugaaaaucuuauaauuuaa

SEQ ID NO: 1353819 - RNA, 21 nt, Human
aguguccugagcucagcgugg

SEQ ID NO: 1353820 - RNA, 17 nt, Human
aguguccugagcucagc

SEQ ID NO: 1353821 - RNA, 15 nt, Human
aguguccugagcuca

SEQ ID NO: 1353822 - RNA, 20 nt, Human
aguguccugagcucagcgug

SEQ ID NO: 1353823 - RNA, 16 nt, Human
agugucuguguuuuga

SEQ ID NO: 1353824 - RNA, 22 nt, Human
agugucuguguuuugaaagaau

SEQ ID NO: 1353825 - RNA, 13 nt, Human
aguguccugagcu

SEQ ID NO: 1353826 - RNA, 18 nt, Human
aguguccugagccccagg

SEQ ID NO: 1353827 - RNA, 22 nt, Human
aguguccucuucccucucugca

SEQ ID NO: 1353828 - RNA, 14 nt, Human
aguguccucagggg

SEQ ID NO: 1353829 - RNA, 17 nt, Human
aguguauuuuuuuacua

SEQ ID NO: 1353830 - RNA, 18 nt, Human
aguguauuuuuuuacuaa

SEQ ID NO: 1353831 - RNA, 23 nt, Human
aguguauuuggaaauaaagucag

SEQ ID NO: 1353832 - RNA, 14 nt, Human
aguguauuuggaaa

SEQ ID NO: 1353833 - RNA, 22 nt, Human
aguguauggaaauaaauguauc

SEQ ID NO: 1353834 - RNA, 21 nt, Human
aguguauggaaauaaauguau

SEQ ID NO: 1353835 - RNA, 20 nt, Human
aguguauggaaauaaaugua

SEQ ID NO: 1353836 - RNA, 16 nt, Human
aguguauggaaauaaa

SEQ ID NO: 1353837 - RNA, 19 nt, Human
aguguaugauuacuggccu

SEQ ID NO: 1353838 - RNA, 15 nt, Human
aguguaugauuacug

SEQ ID NO: 1353839 - RNA, 14 nt, Human
aguguaugauuacu

SEQ ID NO: 1353840 - RNA, 18 nt, Human
aguguaugacugcacaug

SEQ ID NO: 1353841 - RNA, 17 nt, Human
aguggcuuuaaugaaua

SEQ ID NO: 1353842 - RNA, 14 nt, Human
agugggagccaggg

SEQ ID NO: 1353843 - RNA, 17 nt, Human
aguggcugguccagggc

SEQ ID NO: 1353844 - RNA, 15 nt, Human
aguggcugguccagg

SEQ ID NO: 1353845 - RNA, 19 nt, Human
aguggcugguccagggcua

SEQ ID NO: 1353846 - RNA, 18 nt, Human
aguggcugguccagggcu

SEQ ID NO: 1353847 - RNA, 19 nt, Human
aguggcgcgaucucagcuc

SEQ ID NO: 1353848 - RNA, 20 nt, Human
aguggcgcgaucucagcuca

SEQ ID NO: 1353849 - RNA, 19 nt, Human
aguggcgugaucucagcuc

SEQ ID NO: 1353850 - RNA, 14 nt, Human
aguggcucaacauu

SEQ ID NO: 1353851 - RNA, 20 nt, Human
aguggcgugaucucagcuca

SEQ ID NO: 1353852 - RNA, 17 nt, Human
ggagagacacugguggg

SEQ ID NO: 1353853 - RNA, 15 nt, Human
ggagacugcccagcu

SEQ ID NO: 1353854 - RNA, 13 nt, Human
ggcacucuagauu

SEQ ID NO: 1353855 - RNA, 13 nt, Human
ggcacaucagcac

SEQ ID NO: 1353856 - RNA, 19 nt, Human
ggcacagggucugcucuuu

SEQ ID NO: 1353857 - RNA, 18 nt, Human
ggcacagggucugcucuu

SEQ ID NO: 1353858 - RNA, 17 nt, Human
ggcacagggucugcucu

SEQ ID NO: 1353859 - RNA, 12 nt, Human
ggcacagggucu

SEQ ID NO: 1353860 - RNA, 22 nt, Human
ggcacuuugaaggggccucacc

SEQ ID NO: 1353861 - RNA, 18 nt, Human
ggcacuuggcagccuugu

SEQ ID NO: 1353862 - RNA, 17 nt, Human
ggcacuuggcagccuug

SEQ ID NO: 1353863 - RNA, 20 nt, Human
ggcacuguaguucuaagacu

SEQ ID NO: 1353864 - RNA, 14 nt, Human
ggcacuuaaagcuu

SEQ ID NO: 1353865 - RNA, 18 nt, Human
ggcacuguaguucuaaga

SEQ ID NO: 1353866 - RNA, 17 nt, Human
ggcacuguaguucuaag

SEQ ID NO: 1353867 - RNA, 24 nt, Human
ggcacugcccugguggcccucucc

SEQ ID NO: 1353868 - RNA, 14 nt, Human
ggcacugcccuggu

SEQ ID NO: 1353869 - RNA, 12 nt, Human
ggcacugcccug

SEQ ID NO: 1353870 - RNA, 20 nt, Human
ggcacugcccugguggcccu

SEQ ID NO: 1353871 - RNA, 18 nt, Human
ggcagcagggcuacccug

SEQ ID NO: 1353872 - RNA, 13 nt, Human
ggcagcagggcua

SEQ ID NO: 1353873 - RNA, 23 nt, Human
ggcagcagcccccagcucccacc

SEQ ID NO: 1353874 - RNA, 15 nt, Human
ggcagcagcccccag

SEQ ID NO: 1353875 - RNA, 14 nt, Human
ggcagcagccccca

SEQ ID NO: 1353876 - RNA, 12 nt, Human
ggcagcagcccc

SEQ ID NO: 1353877 - RNA, 22 nt, Human
ggcagcagccagcccugccugg

SEQ ID NO: 1353878 - RNA, 23 nt, Human
ggcagcagccagcccugccugga

SEQ ID NO: 1353879 - RNA, 21 nt, Human
ggcagcagccagcccugccug

SEQ ID NO: 1353880 - RNA, 20 nt, Human
ggcagcagccagcccugccu

SEQ ID NO: 1353881 - RNA, 19 nt, Human
ggcagcagccagcccugcc

SEQ ID NO: 1353882 - RNA, 18 nt, Human
ggcagcagccagcccugc

SEQ ID NO: 1353883 - RNA, 17 nt, Human
ggcagcagccagcccug

SEQ ID NO: 1353884 - RNA, 16 nt, Human
ggcagcagccagcccu

SEQ ID NO: 1353885 - RNA, 15 nt, Human
ggcagcagccagccc

SEQ ID NO: 1353886 - RNA, 14 nt, Human
ggcagcagccagcc

SEQ ID NO: 1353887 - RNA, 13 nt, Human
ggcagcagccagc

SEQ ID NO: 1353888 - RNA, 18 nt, Human
ggcagacucuuuaugcuu

SEQ ID NO: 1353889 - RNA, 20 nt, Human
ggcagcagugugaggccagg

SEQ ID NO: 1353890 - RNA, 19 nt, Human
ggcagcagugugaggccag

SEQ ID NO: 1353891 - RNA, 14 nt, Human
ggcagcagugugag

SEQ ID NO: 1353892 - RNA, 13 nt, Human
ggcagcaguguga

SEQ ID NO: 1353893 - RNA, 15 nt, Human
ggcagcagggguugg

SEQ ID NO: 1353894 - RNA, 22 nt, Human
ggcagcagggguuggggaaaca

SEQ ID NO: 1353895 - RNA, 21 nt, Human
ggcagcagggcuacccugagc

SEQ ID NO: 1353896 - RNA, 10 nt, Human
ggcaguuuuu

SEQ ID NO: 1353897 - RNA, 23 nt, Human
ggcaguucgcagccacccugagg

SEQ ID NO: 1353898 - RNA, 22 nt, Human
ggcaguucgcagccacccugag

SEQ ID NO: 1353899 - RNA, 21 nt, Human
ggcaguucgcagccacccuga

SEQ ID NO: 1353900 - RNA, 20 nt, Human
ggcaguucgcagccacccug

SEQ ID NO: 1353901 - RNA, 19 nt, Human
ggcaguucgcagccacccu

SEQ ID NO: 1353902 - RNA, 18 nt, Human
ggcaguucgcagccaccc

SEQ ID NO: 1353903 - RNA, 17 nt, Human
ggcaguucgcagccacc

SEQ ID NO: 1353904 - RNA, 16 nt, Human
ggcaguucgcagccac

SEQ ID NO: 1353905 - RNA, 15 nt, Human
ggcaguucgcagcca

SEQ ID NO: 1353906 - RNA, 16 nt, Human
ggcaguuauauuuugc

SEQ ID NO: 1353907 - RNA, 14 nt, Human
ggcaguuauauuuu

SEQ ID NO: 1353908 - RNA, 12 nt, Human
ggcaguuauauu

SEQ ID NO: 1353909 - RNA, 23 nt, Human
ggcaguuaccauuaaaccaucuc

SEQ ID NO: 1353910 - RNA, 24 nt, Human
ggcaguuaccauuaaaccaucucc

SEQ ID NO: 1353911 - RNA, 22 nt, Human
ggcaguuaccauuaaaccaucu

SEQ ID NO: 1353912 - RNA, 16 nt, Human
ggcaguuaccauuaaa

SEQ ID NO: 1353913 - RNA, 20 nt, Human
ggcaguggugguuuucuguu

SEQ ID NO: 1353914 - RNA, 21 nt, Human
ggcaguggugguuuucuguuc

SEQ ID NO: 1353915 - RNA, 14 nt, Human
ggcaggggacagga

SEQ ID NO: 1353916 - RNA, 20 nt, Human
ggcagggcucuccuggcuuc

SEQ ID NO: 1353917 - RNA, 18 nt, Human
ggcagggcucuccuggcu

SEQ ID NO: 1353918 - RNA, 17 nt, Human
ggcagggcucuccuggc

SEQ ID NO: 1353919 - RNA, 16 nt, Human
ggcagggcucuccugg

SEQ ID NO: 1353920 - RNA, 13 nt, Human
ggcagggcucucc

SEQ ID NO: 1353921 - RNA, 12 nt, Human
ggcagggcucuc

SEQ ID NO: 1353922 - RNA, 19 nt, Human
ggcagggcucuccuggcuu

SEQ ID NO: 1353923 - RNA, 22 nt, Human
ggcagggcgggcagagggcugg

SEQ ID NO: 1353924 - RNA, 23 nt, Human
ggcagggcgggcagagggcugga

SEQ ID NO: 1353925 - RNA, 21 nt, Human
ggcagggcgggcagagggcug

SEQ ID NO: 1353926 - RNA, 19 nt, Human
ggcagggcgggcagagggc

SEQ ID NO: 1353927 - RNA, 23 nt, Human
ggcccucgcugccagcucuguau

SEQ ID NO: 1353928 - RNA, 22 nt, Human
ggcccucgcugccagcucugua

SEQ ID NO: 1353929 - RNA, 21 nt, Human
ggcccucgcugccagcucugu

SEQ ID NO: 1353930 - RNA, 19 nt, Human
ggcccucgcugccagcucu

SEQ ID NO: 1353931 - RNA, 16 nt, Human
ggcccucgcugccagc

SEQ ID NO: 1353932 - RNA, 15 nt, Human
ggcccucgcugccag

SEQ ID NO: 1353933 - RNA, 18 nt, Human
ggcccggcagggcgggca

SEQ ID NO: 1353934 - RNA, 14 nt, Human
ggcccggcagggcg

SEQ ID NO: 1353935 - RNA, 13 nt, Human
ggcccggcagggc

SEQ ID NO: 1353936 - RNA, 18 nt, Human
ggccucagcucccacaag

SEQ ID NO: 1353937 - RNA, 19 nt, Human
ggccucaccgagugggggc

SEQ ID NO: 1353938 - RNA, 20 nt, Human
ggccgaagcuaacagggaag

SEQ ID NO: 1353939 - RNA, 18 nt, Human
ggccucaccgaguggggg

SEQ ID NO: 1353940 - RNA, 18 nt, Human
ggccucacccaccccugc

SEQ ID NO: 1353941 - RNA, 17 nt, Human
ggccucacccaccccug

SEQ ID NO: 1353942 - RNA, 13 nt, Human
ggccucacccacc

SEQ ID NO: 1353943 - RNA, 12 nt, Human
ggccucacccac

SEQ ID NO: 1353944 - RNA, 18 nt, Human
ggccgaagcuaacaggga

SEQ ID NO: 1353945 - RNA, 19 nt, Human
ggcccuugaguccccauug

SEQ ID NO: 1353946 - RNA, 19 nt, Human
ggccaguguuuaaaacuuc

SEQ ID NO: 1353947 - RNA, 14 nt, Human
ggccaguguuuaaa

SEQ ID NO: 1353948 - RNA, 14 nt, Human
ggccagucugugga

SEQ ID NO: 1353949 - RNA, 13 nt, Human
ggccagucugugg

SEQ ID NO: 1353950 - RNA, 23 nt, Human
ggccagucuguggaucagagaug

SEQ ID NO: 1353951 - RNA, 18 nt, Human
ggccagucuguggaucag

SEQ ID NO: 1353952 - RNA, 15 nt, Human
ggccagucuguggau

SEQ ID NO: 1353953 - RNA, 17 nt, Human
ggcauacuauguggaug

SEQ ID NO: 1353954 - RNA, 22 nt, Human
ggcauacgagagcagaggucuc

SEQ ID NO: 1353955 - RNA, 17 nt, Human
aaaaccaucaaguugug

SEQ ID NO: 1353956 - RNA, 22 nt, Human
aaaaccugagauuuauuaaaga

SEQ ID NO: 1353957 - RNA, 14 nt, Human
aaaaccuuuugaaa

SEQ ID NO: 1353958 - RNA, 12 nt, Human
aaaacucuuuga

SEQ ID NO: 1353959 - RNA, 15 nt, Human
aaaacucuuucggua

SEQ ID NO: 1353960 - RNA, 19 nt, Human
aaaacucuuauaaauuucu

SEQ ID NO: 1353961 - RNA, 21 nt, Human
aaaacucuacuuaauccaaug

SEQ ID NO: 1353962 - RNA, 16 nt, Human
aaaagcaaaaaagaaa

SEQ ID NO: 1353963 - RNA, 21 nt, Human
aaaagauugcugaaauuuuau

SEQ ID NO: 1353964 - RNA, 18 nt, Human
aaaagauugcugaaauuu

SEQ ID NO: 1353965 - RNA, 16 nt, Human
aaaagauugcugaaau

SEQ ID NO: 1353966 - RNA, 14 nt, Human
aaaagauugcugaa

SEQ ID NO: 1353967 - RNA, 21 nt, Human
aaaagauugaaguauuuugcu

SEQ ID NO: 1353968 - RNA, 21 nt, Human
aaaacuucaguuucacagaaa

SEQ ID NO: 1353969 - RNA, 21 nt, Human
aaaacuuaugcugauuuauuu

SEQ ID NO: 1353970 - RNA, 12 nt, Human
aaaaauguauuu

SEQ ID NO: 1353971 - RNA, 18 nt, Human
aaaaauguaggagacugu

SEQ ID NO: 1353972 - RNA, 16 nt, Human
aaaaauguauaugcac

SEQ ID NO: 1353973 - RNA, 12 nt, Human
aaaaauguagga

SEQ ID NO: 1353974 - RNA, 11 nt, Human
aaaaauguagg

SEQ ID NO: 1353975 - RNA, 13 nt, Human
aaaacaugcuaca

SEQ ID NO: 1353976 - RNA, 14 nt, Human
aaaacaugcuacac

SEQ ID NO: 1353977 - RNA, 20 nt, Human
aaaaccacauggcacagaga

SEQ ID NO: 1353978 - RNA, 24 nt, Human
aaaacaucuuugaaauuauguaaa

SEQ ID NO: 1353979 - RNA, 16 nt, Human
aaaacaucuuugaaau

SEQ ID NO: 1353980 - RNA, 14 nt, Human
aaaacaucuuugaa

SEQ ID NO: 1353981 - RNA, 15 nt, Human
aaaacaugcuacaca

SEQ ID NO: 1353982 - RNA, 13 nt, Human
aaaaaugguaauu

SEQ ID NO: 1353983 - RNA, 12 nt, Human
gggaccaggagu

SEQ ID NO: 1353984 - RNA, 18 nt, Human
gggaccaggagugggugg

SEQ ID NO: 1353985 - RNA, 19 nt, Human
gggaccacccugagccggc

SEQ ID NO: 1353986 - RNA, 20 nt, Human
gggaccagcagccccacacc

SEQ ID NO: 1353987 - RNA, 17 nt, Human
gggaccacccugagccg

SEQ ID NO: 1353988 - RNA, 20 nt, Human
gggacauuccaaagaacagc

SEQ ID NO: 1353989 - RNA, 19 nt, Human
gggacaugcuuagcagucc

SEQ ID NO: 1353990 - RNA, 19 nt, Human
gggacauuugcucauggaa

SEQ ID NO: 1353991 - RNA, 14 nt, Human
gggaggucauuuug

SEQ ID NO: 1353992 - RNA, 15 nt, Human
gggaggguaccagca

SEQ ID NO: 1353993 - RNA, 16 nt, Human
gggaggguaggcagga

SEQ ID NO: 1353994 - RNA, 20 nt, Human
gggaugacuaaaauauuuau

SEQ ID NO: 1353995 - RNA, 19 nt, Human
gggaugacuaaaauauuua

SEQ ID NO: 1353996 - RNA, 15 nt, Human
gggagggggcagaag

SEQ ID NO: 1353997 - RNA, 14 nt, Human
gggagggggcagaa

SEQ ID NO: 1353998 - RNA, 13 nt, Human
gggagggggcaga

SEQ ID NO: 1353999 - RNA, 22 nt, Human
gggagggauucugguuccaggg

SEQ ID NO: 1354000 - RNA, 18 nt, Human
gggagggaagggagccaa

SEQ ID NO: 1354001 - RNA, 15 nt, Human
gggagggaagggagc

SEQ ID NO: 1354002 - RNA, 20 nt, Human
gggaggcuggaagcugggag

SEQ ID NO: 1354003 - RNA, 10 nt, Human
gggagcccac

SEQ ID NO: 1354004 - RNA, 15 nt, Human
gggagccauuugaga

SEQ ID NO: 1354005 - RNA, 19 nt, Human
gggagccaugcgcccccuc

SEQ ID NO: 1354006 - RNA, 15 nt, Human
gggagccaagggaug

SEQ ID NO: 1354007 - RNA, 14 nt, Human
gggagccaagggau

SEQ ID NO: 1354008 - RNA, 12 nt, Human
gggagccagggc

SEQ ID NO: 1354009 - RNA, 13 nt, Human
gggagccaaggga

SEQ ID NO: 1354010 - RNA, 12 nt, Human
gggagccaaggg

SEQ ID NO: 1354011 - RNA, 11 nt, Human
gggagccaagg

SEQ ID NO: 1354012 - RNA, 9 nt, Human
gggagccaa

SEQ ID NO: 1354013 - RNA, 17 nt, Human
gggagcaugagaggagg

SEQ ID NO: 1354014 - RNA, 21 nt, Human
gggagcaugagaggaggcagc

SEQ ID NO: 1354015 - RNA, 14 nt, Human
gggagagggcgcag

SEQ ID NO: 1354016 - RNA, 12 nt, Human
gggagaggcagc

SEQ ID NO: 1354017 - RNA, 21 nt, Human
gggagaggcagcccaggaagu

SEQ ID NO: 1354018 - RNA, 20 nt, Human
gggagagcccaggagcuccc

SEQ ID NO: 1354019 - RNA, 18 nt, Human
gggagagcccaggagcuc

SEQ ID NO: 1354020 - RNA, 17 nt, Human
gggagagcccaggagcu

SEQ ID NO: 1354021 - RNA, 16 nt, Human
gggagagcccaggagc

SEQ ID NO: 1354022 - RNA, 13 nt, Human
gggagagcccagg

SEQ ID NO: 1354023 - RNA, 23 nt, Human
gggagaaauagucggugaagaaa

SEQ ID NO: 1354024 - RNA, 19 nt, Human
aaaagcccaccauuuggca

SEQ ID NO: 1354025 - RNA, 23 nt, Human
aaaagccagguuccacagaggac

SEQ ID NO: 1354026 - RNA, 15 nt, Human
aaaagcauuuuguaa

SEQ ID NO: 1354027 - RNA, 14 nt, Human
aaaagcauuuugua

SEQ ID NO: 1354028 - RNA, 16 nt, Human
aaaagcauuuuguaau

SEQ ID NO: 1354029 - RNA, 21 nt, Human
aaaagcuuugaacccugggac

SEQ ID NO: 1354030 - RNA, 13 nt, Human
aaaagcuuuuguc

SEQ ID NO: 1354031 - RNA, 14 nt, Human
aaaagcuuuuuauu

SEQ ID NO: 1354032 - RNA, 14 nt, Human
aaaaggaaagaaaa

SEQ ID NO: 1354033 - RNA, 18 nt, Human
aaaaggaagccaaagagu

SEQ ID NO: 1354034 - RNA, 13 nt, Human
aaaaggaaagaaa

SEQ ID NO: 1354035 - RNA, 16 nt, Human
aaaaauaagaagaaug

SEQ ID NO: 1354036 - RNA, 14 nt, Human
aaaaauaagaagaa

SEQ ID NO: 1354037 - RNA, 24 nt, Human
aaaaauaaauauaucuaccccaga

SEQ ID NO: 1354038 - RNA, 18 nt, Human
aaaaauaaauauaucuac

SEQ ID NO: 1354039 - RNA, 14 nt, Human
aaaaauaacaauga

SEQ ID NO: 1354040 - RNA, 21 nt, Human
ggcuggggucccagcagcugc

SEQ ID NO: 1354041 - RNA, 18 nt, Human
ggcuggggucccagcagc

SEQ ID NO: 1354042 - RNA, 17 nt, Human
ggcuggggucccagcag

SEQ ID NO: 1354043 - RNA, 16 nt, Human
ggcuggggucccagca

SEQ ID NO: 1354044 - RNA, 18 nt, Human
aaaaauaagucaacagua

SEQ ID NO: 1354045 - RNA, 12 nt, Human
aaaaauaauaau

SEQ ID NO: 1354046 - RNA, 21 nt, Human
aaaaauaagucaacaguaaac

SEQ ID NO: 1354047 - RNA, 22 nt, Human
aaaaauaagaagaaugcuuaau

SEQ ID NO: 1354048 - RNA, 14 nt, Human
ggcugggucgcccu

SEQ ID NO: 1354049 - RNA, 17 nt, Human
ggcugggucgcccugga

SEQ ID NO: 1354050 - RNA, 20 nt, Human
ggcugggucgcccuggacug

SEQ ID NO: 1354051 - RNA, 17 nt, Human
ggcuguaacugccaggc

SEQ ID NO: 1354052 - RNA, 16 nt, Human
ggcuguaacugccagg

SEQ ID NO: 1354053 - RNA, 15 nt, Human
ggcuguaacugccag

SEQ ID NO: 1354054 - RNA, 15 nt, Human
ggcuguaaggcucua

SEQ ID NO: 1354055 - RNA, 14 nt, Human
ggcuguaaggcucu

SEQ ID NO: 1354056 - RNA, 18 nt, Human
ggcuguaacugccaggcu

SEQ ID NO: 1354057 - RNA, 23 nt, Human
gggaacccugcccacucccagga

SEQ ID NO: 1354058 - RNA, 19 nt, Human
gggaacccugcccacuccc

SEQ ID NO: 1354059 - RNA, 17 nt, Human
gggaaccccuuucccac

SEQ ID NO: 1354060 - RNA, 14 nt, Human
gggaaccccuuucc

SEQ ID NO: 1354061 - RNA, 15 nt, Human
gggaaccuguguccg

SEQ ID NO: 1354062 - RNA, 14 nt, Human
gggaaccugugucc

SEQ ID NO: 1354063 - RNA, 13 nt, Human
gggaaccuguguc

SEQ ID NO: 1354064 - RNA, 16 nt, Human
gggaacucagauccag

SEQ ID NO: 1354065 - RNA, 19 nt, Human
gggaacuggccaagcugag

SEQ ID NO: 1354066 - RNA, 18 nt, Human
gggaacuggccaagcuga

SEQ ID NO: 1354067 - RNA, 16 nt, Human
gggaacuggccaagcu

SEQ ID NO: 1354068 - RNA, 15 nt, Human
gggaacuggccaagc

SEQ ID NO: 1354069 - RNA, 13 nt, Human
gggaacuggccaa

SEQ ID NO: 1354070 - RNA, 12 nt, Human
gggaacuggcca

SEQ ID NO: 1354071 - RNA, 14 nt, Human
gggaacauggggag

SEQ ID NO: 1354072 - RNA, 16 nt, Human
gggaacauggggagga

SEQ ID NO: 1354073 - RNA, 12 nt, Human
gggaacaugggg

SEQ ID NO: 1354074 - RNA, 20 nt, Human
gggaacagugugcaaggcag

SEQ ID NO: 1354075 - RNA, 20 nt, Human
ggcuucugcuggggccuggg

SEQ ID NO: 1354076 - RNA, 18 nt, Human
ggcuucuggccaggaagc

SEQ ID NO: 1354077 - RNA, 21 nt, Human
ggcuucugcuggggccuggga

SEQ ID NO: 1354078 - RNA, 19 nt, Human
ggcuucugcuggggccugg

SEQ ID NO: 1354079 - RNA, 15 nt, Human
ggcuucugcuggggc

SEQ ID NO: 1354080 - RNA, 12 nt, Human
ggcuucugcugg

SEQ ID NO: 1354081 - RNA, 14 nt, Human
ggcuucugagcagc

SEQ ID NO: 1354082 - RNA, 13 nt, Human
ggcuucugagcag

SEQ ID NO: 1354083 - RNA, 22 nt, Human
ggcuucugagcagcgagccugc

SEQ ID NO: 1354084 - RNA, 14 nt, Human
ggcuucucucugug

SEQ ID NO: 1354085 - RNA, 22 nt, Human
gggaagacuccuagcuguccuu

SEQ ID NO: 1354086 - RNA, 16 nt, Human
gggaagacaguggccc

SEQ ID NO: 1354087 - RNA, 22 nt, Human
gggaagacccauuccuucccag

SEQ ID NO: 1354088 - RNA, 22 nt, Human
gggacaccuaggcuaggguggg

SEQ ID NO: 1354089 - RNA, 14 nt, Human
gggaagacaguggc

SEQ ID NO: 1354090 - RNA, 12 nt, Human
gggaagacagug

SEQ ID NO: 1354091 - RNA, 11 nt, Human
gggaagacagu

SEQ ID NO: 1354092 - RNA, 20 nt, Human
gggaacuggccaagcugagg

SEQ ID NO: 1354093 - RNA, 21 nt, Human
gggaacuggccaagcugaggu

SEQ ID NO: 1354094 - RNA, 21 nt, Human
gggacagaggccccagccucc

SEQ ID NO: 1354095 - RNA, 20 nt, Human
gggacagaggccccagccuc

SEQ ID NO: 1354096 - RNA, 19 nt, Human
gggacagaggccccagccu

SEQ ID NO: 1354097 - RNA, 18 nt, Human
gggacagaggccccagcc

SEQ ID NO: 1354098 - RNA, 17 nt, Human
gggacagaggccccagc

SEQ ID NO: 1354099 - RNA, 17 nt, Human
gggacagguccucagug

SEQ ID NO: 1354100 - RNA, 22 nt, Human
gggacagucaccucauggaauu

SEQ ID NO: 1354101 - RNA, 21 nt, Human
gggacagucaccucauggaau

SEQ ID NO: 1354102 - RNA, 20 nt, Human
gggacagucaccucauggaa

SEQ ID NO: 1354103 - RNA, 20 nt, Human
ggcucagaggguguccugca

SEQ ID NO: 1354104 - RNA, 18 nt, Human
ggcucagagccggggugg

SEQ ID NO: 1354105 - RNA, 20 nt, Human
ggcucagugaaguugcugcu

SEQ ID NO: 1354106 - RNA, 21 nt, Human
ggcucagugaaguugcugcuu

SEQ ID NO: 1354107 - RNA, 19 nt, Human
ggcucagugaaguugcugc

SEQ ID NO: 1354108 - RNA, 18 nt, Human
ggcucagugaaguugcug

SEQ ID NO: 1354109 - RNA, 16 nt, Human
ggcucaggucacauaa

SEQ ID NO: 1354110 - RNA, 21 nt, Human
ggcucaggcaggggccuccau

SEQ ID NO: 1354111 - RNA, 17 nt, Human
ggcucaggcaggggccu

SEQ ID NO: 1354112 - RNA, 15 nt, Human
ggcucaggcaggggc

SEQ ID NO: 1354113 - RNA, 16 nt, Human
ggcucagauuguaaua

SEQ ID NO: 1354114 - RNA, 14 nt, Human
ggcuccuggacccc

SEQ ID NO: 1354115 - RNA, 12 nt, Human
ggcuccuggacc

SEQ ID NO: 1354116 - RNA, 11 nt, Human
ggcuccuggac

SEQ ID NO: 1354117 - RNA, 17 nt, Human
ggcuccuugguucuuga

SEQ ID NO: 1354118 - RNA, 20 nt, Human
ggcuccuucccaucgcuguc

SEQ ID NO: 1354119 - RNA, 15 nt, Human
ggcuccuguuuugca

SEQ ID NO: 1354120 - RNA, 14 nt, Human
ggcuccuguuuugc

SEQ ID NO: 1354121 - RNA, 23 nt, Human
ggcuccuggucaccuaggaagcc

SEQ ID NO: 1354122 - RNA, 10 nt, Human
ggcuccuggu

SEQ ID NO: 1354123 - RNA, 22 nt, Human
ggcucuagaucauaaggcuuca

SEQ ID NO: 1354124 - RNA, 11 nt, Human
ggcucuagauc

SEQ ID NO: 1354125 - RNA, 17 nt, Human
ggcucuacuuccccaug

SEQ ID NO: 1354126 - RNA, 19 nt, Human
ggcuccuugugggccuggg

SEQ ID NO: 1354127 - RNA, 17 nt, Human
ggcuccuugugggccug

SEQ ID NO: 1354128 - RNA, 19 nt, Human
ggcuccuugugccagagaa

SEQ ID NO: 1354129 - RNA, 16 nt, Human
ggcuccuugugccaga

SEQ ID NO: 1354130 - RNA, 23 nt, Human
ggcucuguccccagccugggaaa

SEQ ID NO: 1354131 - RNA, 18 nt, Human
ggcucuguccccagccug

SEQ ID NO: 1354132 - RNA, 17 nt, Human
ggcucuguccccagccu

SEQ ID NO: 1354133 - RNA, 23 nt, Human
ggcucuaugagucuagauguuua

SEQ ID NO: 1354134 - RNA, 18 nt, Human
ggcucuaugagucuagau

SEQ ID NO: 1354135 - RNA, 20 nt, Human
ggcucuuagcagcuuccaga

SEQ ID NO: 1354136 - RNA, 19 nt, Human
ggcucuuagcagcuuccag

SEQ ID NO: 1354137 - RNA, 18 nt, Human
ggcucuuagcagcuucca

SEQ ID NO: 1354138 - RNA, 21 nt, Human
ggcucuuagcagcuuccagau

SEQ ID NO: 1354139 - RNA, 12 nt, Human
ggcugccugagu

SEQ ID NO: 1354140 - RNA, 20 nt, Human
ggcugccucccuuguggcag

SEQ ID NO: 1354141 - RNA, 23 nt, Human
ggcugccugagucgugaccugcu

SEQ ID NO: 1354142 - RNA, 20 nt, Human
ggcugcauugaaaagagcug

SEQ ID NO: 1354143 - RNA, 21 nt, Human
ggcugcauugaaaagagcuga

SEQ ID NO: 1354144 - RNA, 19 nt, Human
ggcugaccacagcacagcc

SEQ ID NO: 1354145 - RNA, 16 nt, Human
ggcugaauagcagaag

SEQ ID NO: 1354146 - RNA, 22 nt, Human
ggcugaccacagcacagccaac

SEQ ID NO: 1354147 - RNA, 18 nt, Human
ggcugaccacagcacagc

SEQ ID NO: 1354148 - RNA, 17 nt, Human
ggcugaccacagcacag

SEQ ID NO: 1354149 - RNA, 16 nt, Human
ggcugaccacagcaca

SEQ ID NO: 1354150 - RNA, 15 nt, Human
ggcugaccacagcac

SEQ ID NO: 1354151 - RNA, 13 nt, Human
ggcugaccacagc

SEQ ID NO: 1354152 - RNA, 22 nt, Human
ggcugacaugaagcuguugugu

SEQ ID NO: 1354153 - RNA, 21 nt, Human
ggcugcucggggugcacagga

SEQ ID NO: 1354154 - RNA, 22 nt, Human
ggcugcucggggugcacaggag

SEQ ID NO: 1354155 - RNA, 14 nt, Human
ggcugcgcacugug

SEQ ID NO: 1354156 - RNA, 15 nt, Human
ggcugcgcacugugu

SEQ ID NO: 1354157 - RNA, 15 nt, Human
ggcugcucagggcug

SEQ ID NO: 1354158 - RNA, 22 nt, Human
aaacaacaauuucuacuuugaa

SEQ ID NO: 1354159 - RNA, 16 nt, Human
aaacaacaauuucuac

SEQ ID NO: 1354160 - RNA, 14 nt, Human
aaacaauauagucu

SEQ ID NO: 1354161 - RNA, 14 nt, Human
aaacaauguuuaaa

SEQ ID NO: 1354162 - RNA, 21 nt, Human
aaacagguauauacuuugaaa

SEQ ID NO: 1354163 - RNA, 18 nt, Human
aaacagguauauacuuug

SEQ ID NO: 1354164 - RNA, 17 nt, Human
aaacacauuaggaaaag

SEQ ID NO: 1354165 - RNA, 12 nt, Human
aaacacauuuuu

SEQ ID NO: 1354166 - RNA, 11 nt, Human
aaacacauuuu

SEQ ID NO: 1354167 - RNA, 22 nt, Human
aaaauguuuuuggucuuuuaua

SEQ ID NO: 1354168 - RNA, 21 nt, Human
aaaauguuggucauuuuaugu

SEQ ID NO: 1354169 - RNA, 17 nt, Human
aaaauguugaaauauga

SEQ ID NO: 1354170 - RNA, 17 nt, Human
aaaauguugcugaaaaa

SEQ ID NO: 1354171 - RNA, 14 nt, Human
aaaauguugagaau

SEQ ID NO: 1354172 - RNA, 13 nt, Human
aaaauguugaaau

SEQ ID NO: 1354173 - RNA, 12 nt, Human
aaaauguucuuu

SEQ ID NO: 1354174 - RNA, 15 nt, Human
aaaauguucuuugga

SEQ ID NO: 1354175 - RNA, 15 nt, Human
aaaauguucuguuug

SEQ ID NO: 1354176 - RNA, 16 nt, Human
aaaauguucagaaggu

SEQ ID NO: 1354177 - RNA, 22 nt, Human
aaaauguuaucuucucaaguuc

SEQ ID NO: 1354178 - RNA, 15 nt, Human
gggaugagaguuuug

SEQ ID NO: 1354179 - RNA, 20 nt, Human
aaaauuuauauuguaaauau

SEQ ID NO: 1354180 - RNA, 12 nt, Human
aaaauuuauaac

SEQ ID NO: 1354181 - RNA, 17 nt, Human
aaacaaagguugagaug

SEQ ID NO: 1354182 - RNA, 20 nt, Human
aaacaaaggccuaauucuau

SEQ ID NO: 1354183 - RNA, 15 nt, Human
aaaauuuuuaaucuu

SEQ ID NO: 1354184 - RNA, 20 nt, Human
aaaauuuugauguuuuaagg

SEQ ID NO: 1354185 - RNA, 17 nt, Human
ggggccgggggcagucu

SEQ ID NO: 1354186 - RNA, 21 nt, Human
ggggccgaugcccagagacac

SEQ ID NO: 1354187 - RNA, 19 nt, Human
ggggccgaugcccagagac

SEQ ID NO: 1354188 - RNA, 18 nt, Human
ggggacuuggccucucuc

SEQ ID NO: 1354189 - RNA, 15 nt, Human
ggggacuuggccucu

SEQ ID NO: 1354190 - RNA, 19 nt, Human
ggggacuuacaugauucau

SEQ ID NO: 1354191 - RNA, 21 nt, Human
ggggacuguaaguugggcuug

SEQ ID NO: 1354192 - RNA, 13 nt, Human
ggggaccaggagu

SEQ ID NO: 1354193 - RNA, 12 nt, Human
ggggaccaggag

SEQ ID NO: 1354194 - RNA, 17 nt, Human
ggggacacauguauuug

SEQ ID NO: 1354195 - RNA, 21 nt, Human
ggggaccaggagugggugggg

SEQ ID NO: 1354196 - RNA, 16 nt, Human
ggggaccuggaaggga

SEQ ID NO: 1354197 - RNA, 23 nt, Human
aaacagguauauacuuugaaagg

SEQ ID NO: 1354198 - RNA, 20 nt, Human
ggggaagagagccugcagga

SEQ ID NO: 1354199 - RNA, 22 nt, Human
ggggaagacccauuccuuccca

SEQ ID NO: 1354200 - RNA, 21 nt, Human
ggggaagacccauuccuuccc

SEQ ID NO: 1354201 - RNA, 17 nt, Human
ggggaagacaguggccc

SEQ ID NO: 1354202 - RNA, 19 nt, Human
ggggaagagagccugcagg

SEQ ID NO: 1354203 - RNA, 14 nt, Human
ggggaccagcagcc

SEQ ID NO: 1354204 - RNA, 19 nt, Human
ggggacacauguauuuggu

SEQ ID NO: 1354205 - RNA, 19 nt, Human
ggggaauugaggacacuga

SEQ ID NO: 1354206 - RNA, 18 nt, Human
aaacuguguauuccaaga

SEQ ID NO: 1354207 - RNA, 16 nt, Human
aaacuguguauuccaa

SEQ ID NO: 1354208 - RNA, 21 nt, Human
aaacuguguacauaacugaaa

SEQ ID NO: 1354209 - RNA, 20 nt, Human
aaacuguguacauaacugaa

SEQ ID NO: 1354210 - RNA, 20 nt, Human
aaacuguguaacugcccaaa

SEQ ID NO: 1354211 - RNA, 17 nt, Human
aaacuguguaacugccc

SEQ ID NO: 1354212 - RNA, 14 nt, Human
aaacuguguaacug

SEQ ID NO: 1354213 - RNA, 10 nt, Human
aaacugugua

SEQ ID NO: 1354214 - RNA, 12 nt, Human
aaacugugcacc

SEQ ID NO: 1354215 - RNA, 16 nt, Human
aaacucguuuuuuaca

SEQ ID NO: 1354216 - RNA, 19 nt, Human
aaacuguguauuccaagac

SEQ ID NO: 1354217 - RNA, 19 nt, Human
aaacuuaaucuaaauggaa

SEQ ID NO: 1354218 - RNA, 21 nt, Human
ggguggccgcugaguggcagg

SEQ ID NO: 1354219 - RNA, 17 nt, Human
ggguggccgcugagugg

SEQ ID NO: 1354220 - RNA, 20 nt, Human
ggguggccaggccgggaaaa

SEQ ID NO: 1354221 - RNA, 18 nt, Human
ggguggccaggccgggaa

SEQ ID NO: 1354222 - RNA, 14 nt, Human
ggguggccaggccg

SEQ ID NO: 1354223 - RNA, 13 nt, Human
ggguggccaggcc

SEQ ID NO: 1354224 - RNA, 12 nt, Human
ggguggccaggc

SEQ ID NO: 1354225 - RNA, 13 nt, Human
ggguggcagcaac

SEQ ID NO: 1354226 - RNA, 16 nt, Human
aaacuuaaucuaaaug

SEQ ID NO: 1354227 - RNA, 17 nt, Human
aaacuuaaucuaaaugg

SEQ ID NO: 1354228 - RNA, 18 nt, Human
aaacuuaaucuaaaugga

SEQ ID NO: 1354229 - RNA, 15 nt, Human
aaacgucuuaaauau

SEQ ID NO: 1354230 - RNA, 14 nt, Human
aaacgucuuaaaua

SEQ ID NO: 1354231 - RNA, 18 nt, Human
aaacuaggugcauauuua

SEQ ID NO: 1354232 - RNA, 13 nt, Human
aaacgucuuaaau

SEQ ID NO: 1354233 - RNA, 16 nt, Human
aaacuaucuuggugaa

SEQ ID NO: 1354234 - RNA, 22 nt, Human
aaacuauaagcaagaaggcaaa

SEQ ID NO: 1354235 - RNA, 18 nt, Human
aaacuagggccaagccca

SEQ ID NO: 1354236 - RNA, 22 nt, Human
aaacuaggugcauauuuauaaa

SEQ ID NO: 1354237 - RNA, 21 nt, Human
aaacucaaaauauuuguacau

SEQ ID NO: 1354238 - RNA, 13 nt, Human
aaacucaaaauau

SEQ ID NO: 1354239 - RNA, 21 nt, Human
aaacucauucauuagucaugu

SEQ ID NO: 1354240 - RNA, 15 nt, Human
aaacucguuaauuug

SEQ ID NO: 1354241 - RNA, 21 nt, Human
aaacauuaauagcagccuuuc

SEQ ID NO: 1354242 - RNA, 22 nt, Human
aaacauuaauagcagccuuucu

SEQ ID NO: 1354243 - RNA, 20 nt, Human
aaacauuaauagcagccuuu

SEQ ID NO: 1354244 - RNA, 14 nt, Human
aaaccucaccaacu

SEQ ID NO: 1354245 - RNA, 17 nt, Human
aaaccaauccuaugcau

SEQ ID NO: 1354246 - RNA, 16 nt, Human
aaaccaauugcugcua

SEQ ID NO: 1354247 - RNA, 22 nt, Human
aaaccugagauuuauuaaagaa

SEQ ID NO: 1354248 - RNA, 21 nt, Human
aaaccugagauuuauuaaaga

SEQ ID NO: 1354249 - RNA, 16 nt, Human
aaaccugagauuuauu

SEQ ID NO: 1354250 - RNA, 18 nt, Human
aaaccugaccccugcuca

SEQ ID NO: 1354251 - RNA, 13 nt, Human
aaaccuuuugaaa

SEQ ID NO: 1354252 - RNA, 17 nt, Human
aaaccuuucuucaccaa

SEQ ID NO: 1354253 - RNA, 18 nt, Human
aaaccuuuguuugcaucu

SEQ ID NO: 1354254 - RNA, 18 nt, Human
aaaccuuuuauauuuagu

SEQ ID NO: 1354255 - RNA, 19 nt, Human
ggggguccuccuccaggga

SEQ ID NO: 1354256 - RNA, 18 nt, Human
ggggguccuccuccaggg

SEQ ID NO: 1354257 - RNA, 16 nt, Human
ggggguccuccuccag

SEQ ID NO: 1354258 - RNA, 15 nt, Human
gggggcggccuauga

SEQ ID NO: 1354259 - RNA, 17 nt, Human
gggggccuggcuggcug

SEQ ID NO: 1354260 - RNA, 15 nt, Human
gggggccuggcuggc

SEQ ID NO: 1354261 - RNA, 14 nt, Human
gggggccuggcugg

SEQ ID NO: 1354262 - RNA, 13 nt, Human
gggggccuggcug

SEQ ID NO: 1354263 - RNA, 12 nt, Human
gggggccuggcu

SEQ ID NO: 1354264 - RNA, 11 nt, Human
gggggccuggc

SEQ ID NO: 1354265 - RNA, 15 nt, Human
gggggcgccuguggu

SEQ ID NO: 1354266 - RNA, 20 nt, Human
gggggccuggcuggcugagg

SEQ ID NO: 1354267 - RNA, 18 nt, Human
gggggcgcggcugggagg

SEQ ID NO: 1354268 - RNA, 12 nt, Human
ggguccaggagg

SEQ ID NO: 1354269 - RNA, 11 nt, Human
ggguccaggag

SEQ ID NO: 1354270 - RNA, 13 nt, Human
ggggguggccgcu

SEQ ID NO: 1354271 - RNA, 20 nt, Human
ggggguggccaggccgggaa

SEQ ID NO: 1354272 - RNA, 13 nt, Human
ggggguggccagg

SEQ ID NO: 1354273 - RNA, 22 nt, Human
gggggugaugagggcagcagcc

SEQ ID NO: 1354274 - RNA, 20 nt, Human
gggggugaugagggcagcag

SEQ ID NO: 1354275 - RNA, 18 nt, Human
gggggugaugagggcagc

SEQ ID NO: 1354276 - RNA, 22 nt, Human
gggggucuggcugguguuaaca

SEQ ID NO: 1354277 - RNA, 17 nt, Human
gggggucuggcuggugu

SEQ ID NO: 1354278 - RNA, 16 nt, Human
gggggucuggcuggug

SEQ ID NO: 1354279 - RNA, 12 nt, Human
gggggucuggcu

SEQ ID NO: 1354280 - RNA, 20 nt, Human
ggggguccuccuccagggac

SEQ ID NO: 1354281 - RNA, 19 nt, Human
gggggugcugggccccugc

SEQ ID NO: 1354282 - RNA, 16 nt, Human
gggucgaaagcucuag

SEQ ID NO: 1354283 - RNA, 14 nt, Human
gggucgaaagcucu

SEQ ID NO: 1354284 - RNA, 22 nt, Human
ggguccuuuugacacugcucua

SEQ ID NO: 1354285 - RNA, 19 nt, Human
ggguccuuuugacacugcu

SEQ ID NO: 1354286 - RNA, 13 nt, Human
gggucccagcagc

SEQ ID NO: 1354287 - RNA, 12 nt, Human
ggguccaugggc

SEQ ID NO: 1354288 - RNA, 20 nt, Human
gggucggcugaccaugcuca

SEQ ID NO: 1354289 - RNA, 15 nt, Human
gggucggcugaccau

SEQ ID NO: 1354290 - RNA, 14 nt, Human
gggucggcugacca

SEQ ID NO: 1354291 - RNA, 13 nt, Human
gggucgcccugga

SEQ ID NO: 1354292 - RNA, 15 nt, Human
gggucgcccuggacu

SEQ ID NO: 1354293 - RNA, 14 nt, Human
aaagagauacagag

SEQ ID NO: 1354294 - RNA, 23 nt, Human
aaagacuggcuuuuauuaaugca

SEQ ID NO: 1354295 - RNA, 21 nt, Human
aaagacuggcuuuuauuaaug

SEQ ID NO: 1354296 - RNA, 13 nt, Human
aaagacuggcuuu

SEQ ID NO: 1354297 - RNA, 12 nt, Human
aaagacuggcuu

SEQ ID NO: 1354298 - RNA, 15 nt, Human
aaagacguuuuauaa

SEQ ID NO: 1354299 - RNA, 23 nt, Human
aaagacgcacuuuggcuuauaau

SEQ ID NO: 1354300 - RNA, 23 nt, Human
aaagacugaguacguugugcauu

SEQ ID NO: 1354301 - RNA, 13 nt, Human
aaagaugcuuuua

SEQ ID NO: 1354302 - RNA, 12 nt, Human
aaagaugcuuuu

SEQ ID NO: 1354303 - RNA, 19 nt, Human
aaagaggcaccaggaagcc

SEQ ID NO: 1354304 - RNA, 14 nt, Human
aaagcaauaugcau

SEQ ID NO: 1354305 - RNA, 20 nt, Human
aaagcaaggaaacuauguaa

SEQ ID NO: 1354306 - RNA, 14 nt, Human
aaagcaaggaaacu

SEQ ID NO: 1354307 - RNA, 20 nt, Human
aaagcaagcugauuaaauga

SEQ ID NO: 1354308 - RNA, 19 nt, Human
aaagcaagcugauuaaaug

SEQ ID NO: 1354309 - RNA, 17 nt, Human
aaagauggggucuguaa

SEQ ID NO: 1354310 - RNA, 18 nt, Human
aaagauggggucuguaaa

SEQ ID NO: 1354311 - RNA, 19 nt, Human
aaagauggggucuguaaaa

SEQ ID NO: 1354312 - RNA, 21 nt, Human
aaagauggggucuguaaaauc

SEQ ID NO: 1354313 - RNA, 22 nt, Human
aaagauggggucuguaaaaucu

SEQ ID NO: 1354314 - RNA, 22 nt, Human
aaagcaagcauucagaagaaaa

SEQ ID NO: 1354315 - RNA, 21 nt, Human
aaagauggaguuucuaagguc

SEQ ID NO: 1354316 - RNA, 19 nt, Human
aaagauggaguuucuaagg

SEQ ID NO: 1354317 - RNA, 18 nt, Human
aaagauggaguuucuaag

SEQ ID NO: 1354318 - RNA, 17 nt, Human
aaagauggaguuucuaa

SEQ ID NO: 1354319 - RNA, 16 nt, Human
aaagauggaguuucua

SEQ ID NO: 1354320 - RNA, 15 nt, Human
aaagauggaguuucu

SEQ ID NO: 1354321 - RNA, 19 nt, Human
aaagaugcuuuuaacagag

SEQ ID NO: 1354322 - RNA, 10 nt, Human
gguccuucaa

SEQ ID NO: 1354323 - RNA, 21 nt, Human
gguccugguggggcagcuccu

SEQ ID NO: 1354324 - RNA, 23 nt, Human
gguccugagcacugccaggaggg

SEQ ID NO: 1354325 - RNA, 22 nt, Human
gguccugagcacugccaggagg

SEQ ID NO: 1354326 - RNA, 21 nt, Human
gguccugagcacugccaggag

SEQ ID NO: 1354327 - RNA, 20 nt, Human
gguccugagcacugccagga

SEQ ID NO: 1354328 - RNA, 14 nt, Human
gggugggggcagca

SEQ ID NO: 1354329 - RNA, 18 nt, Human
ggguggggagagacgggc

SEQ ID NO: 1354330 - RNA, 14 nt, Human
ggguggggagagac

SEQ ID NO: 1354331 - RNA, 13 nt, Human
ggguggggagaga

SEQ ID NO: 1354332 - RNA, 15 nt, Human
ggguggggggggugc

SEQ ID NO: 1354333 - RNA, 20 nt, Human
aaacuucaguuucacagaaa

SEQ ID NO: 1354334 - RNA, 22 nt, Human
aaacuucaguuucacagaaaau

SEQ ID NO: 1354335 - RNA, 23 nt, Human
aaacuucagcgguuuauauaagc

SEQ ID NO: 1354336 - RNA, 19 nt, Human
aaacuuggauacuuggauu

SEQ ID NO: 1354337 - RNA, 24 nt, Human
aaacuuggcucgaaucucugugcc

SEQ ID NO: 1354338 - RNA, 20 nt, Human
aaacuuggauacuuggauuu

SEQ ID NO: 1354339 - RNA, 18 nt, Human
aaacuuggauacuuggau

SEQ ID NO: 1354340 - RNA, 17 nt, Human
aaacuuggauacuugga

SEQ ID NO: 1354341 - RNA, 13 nt, Human
aaacuuggauacu

SEQ ID NO: 1354342 - RNA, 19 nt, Human
aaacuugcaucacuuaacg

SEQ ID NO: 1354343 - RNA, 16 nt, Human
aaacuuguaauuuuuu

SEQ ID NO: 1354344 - RNA, 16 nt, Human
aaacuuguauuaugug

SEQ ID NO: 1354345 - RNA, 16 nt, Human
aaacuuuuaauucauu

SEQ ID NO: 1354346 - RNA, 12 nt, Human
aaacuuuguagu

SEQ ID NO: 1354347 - RNA, 19 nt, Human
aaacuuuggaaccagacuc

SEQ ID NO: 1354348 - RNA, 16 nt, Human
aaacuuugaaguuagc

SEQ ID NO: 1354349 - RNA, 20 nt, Human
aaacuuucauuccuucagau

SEQ ID NO: 1354350 - RNA, 18 nt, Human
aaacuuuccucgccugac

SEQ ID NO: 1354351 - RNA, 20 nt, Human
aaacuuguaauuuuuuuaau

SEQ ID NO: 1354352 - RNA, 18 nt, Human
aaagacguuuuauaagca

SEQ ID NO: 1354353 - RNA, 18 nt, Human
aaagacccuggcuuucau

SEQ ID NO: 1354354 - RNA, 14 nt, Human
aaagacccuggcuu

SEQ ID NO: 1354355 - RNA, 14 nt, Human
aaagaccaggccaa

SEQ ID NO: 1354356 - RNA, 19 nt, Human
aaagacauucaggacugcu

SEQ ID NO: 1354357 - RNA, 16 nt, Human
aaagacaugaagccac

SEQ ID NO: 1354358 - RNA, 13 nt, Human
aaagacagugaaa

SEQ ID NO: 1354359 - RNA, 17 nt, Human
aaagcacgacaguggau

SEQ ID NO: 1354360 - RNA, 19 nt, Human
aaagcacgaaauguuauuu

SEQ ID NO: 1354361 - RNA, 14 nt, Human
aaagcucuagaauc

SEQ ID NO: 1354362 - RNA, 23 nt, Human
aaagcucaaagguuuggaaggag

SEQ ID NO: 1354363 - RNA, 17 nt, Human
aaagcucaaagguuugg

SEQ ID NO: 1354364 - RNA, 23 nt, Human
aaagcuuuccugccccaggccug

SEQ ID NO: 1354365 - RNA, 22 nt, Human
aaagcuuuccugccccaggccu

SEQ ID NO: 1354366 - RNA, 14 nt, Human
aaagcuuuccugcc

SEQ ID NO: 1354367 - RNA, 13 nt, Human
aaagcuuuccugc

SEQ ID NO: 1354368 - RNA, 12 nt, Human
aaagcuuuccug

SEQ ID NO: 1354369 - RNA, 13 nt, Human
aaagcuuucagaa

SEQ ID NO: 1354370 - RNA, 15 nt, Human
aaagcugguuuaaug

SEQ ID NO: 1354371 - RNA, 10 nt, Human
aaagcugccu

SEQ ID NO: 1354372 - RNA, 23 nt, Human
aaagcugcugagaaucuagccuc

SEQ ID NO: 1354373 - RNA, 15 nt, Human
aaaggaagccaaaga

SEQ ID NO: 1354374 - RNA, 14 nt, Human
aaaggaagccaaag

SEQ ID NO: 1354375 - RNA, 12 nt, Human
aaaggaagccaa

SEQ ID NO: 1354376 - RNA, 20 nt, Human
aaaggaagcauuguaaaaua

SEQ ID NO: 1354377 - RNA, 17 nt, Human
aaaggaagcauuguaaa

SEQ ID NO: 1354378 - RNA, 17 nt, Human
aaaggaaaucaaaugaa

SEQ ID NO: 1354379 - RNA, 15 nt, Human
aaaggaaaucaaaug

SEQ ID NO: 1354380 - RNA, 22 nt, Human
aaaggaagcauuguaaaauaau

SEQ ID NO: 1354381 - RNA, 22 nt, Human
aaagggagggcucugaggcgcc

SEQ ID NO: 1354382 - RNA, 19 nt, Human
aaagggagggcucugaggc

SEQ ID NO: 1354383 - RNA, 18 nt, Human
aaagggagggcucugagg

SEQ ID NO: 1354384 - RNA, 17 nt, Human
aaagggagggcucugag

SEQ ID NO: 1354385 - RNA, 11 nt, Human
aaaggagccug

SEQ ID NO: 1354386 - RNA, 21 nt, Human
aaagggagaagugacauugca

SEQ ID NO: 1354387 - RNA, 12 nt, Human
aaaggagccugu

SEQ ID NO: 1354388 - RNA, 17 nt, Human
aaagggagucugccagg

SEQ ID NO: 1354389 - RNA, 14 nt, Human
aaagguacuucaaa

SEQ ID NO: 1354390 - RNA, 14 nt, Human
aaagguaaaucaga

SEQ ID NO: 1354391 - RNA, 19 nt, Human
ggugaacaaagcagccacg

SEQ ID NO: 1354392 - RNA, 18 nt, Human
ggugaacaaagcagccac

SEQ ID NO: 1354393 - RNA, 18 nt, Human
gguccuuuugacacugcu

SEQ ID NO: 1354394 - RNA, 16 nt, Human
gguccuuuugacacug

SEQ ID NO: 1354395 - RNA, 15 nt, Human
gguccuuugggguga

SEQ ID NO: 1354396 - RNA, 16 nt, Human
ggucgaggaguaacaa

SEQ ID NO: 1354397 - RNA, 14 nt, Human
ggucgcccuggacu

SEQ ID NO: 1354398 - RNA, 13 nt, Human
ggugaaaggaaau

SEQ ID NO: 1354399 - RNA, 22 nt, Human
ggucgaggaguaacaauacaaa

SEQ ID NO: 1354400 - RNA, 20 nt, Human
ggucgcccuggacugugugc

SEQ ID NO: 1354401 - RNA, 16 nt, Human
ggugcagggauguggg

SEQ ID NO: 1354402 - RNA, 21 nt, Human
ggugcauauuuauaaaaauaa

SEQ ID NO: 1354403 - RNA, 21 nt, Human
ggugcauuugaggucuguucu

SEQ ID NO: 1354404 - RNA, 11 nt, Human
ggugcugggcc

SEQ ID NO: 1354405 - RNA, 13 nt, Human
ggugcugggcccc

SEQ ID NO: 1354406 - RNA, 15 nt, Human
ggugcugggccccug

SEQ ID NO: 1354407 - RNA, 16 nt, Human
ggugcugggccccugc

SEQ ID NO: 1354408 - RNA, 23 nt, Human
gguggagggccacaugggaggcu

SEQ ID NO: 1354409 - RNA, 13 nt, Human
gguggagggccac

SEQ ID NO: 1354410 - RNA, 19 nt, Human
gguggaagcuuggggaaga

SEQ ID NO: 1354411 - RNA, 21 nt, Human
gguggaaaggugugagacugg

SEQ ID NO: 1354412 - RNA, 15 nt, Human
gguggaacaagcaca

SEQ ID NO: 1354413 - RNA, 14 nt, Human
ggugcuucuccucu

SEQ ID NO: 1354414 - RNA, 22 nt, Human
ggugcuucuaguucugccagga

SEQ ID NO: 1354415 - RNA, 19 nt, Human
ggugcugggccccugccuc

SEQ ID NO: 1354416 - RNA, 20 nt, Human
aaagguccacaggucuagac

SEQ ID NO: 1354417 - RNA, 19 nt, Human
aaagguccacaggucuaga

SEQ ID NO: 1354418 - RNA, 20 nt, Human
aaaguacacuguuucaaacu

SEQ ID NO: 1354419 - RNA, 21 nt, Human
aaagguccacaggucuagacu

SEQ ID NO: 1354420 - RNA, 16 nt, Human
aaaguaguccugugaa

SEQ ID NO: 1354421 - RNA, 18 nt, Human
aaaguauguuagugcaaa

SEQ ID NO: 1354422 - RNA, 18 nt, Human
aaaguaucccuacuguaa

SEQ ID NO: 1354423 - RNA, 17 nt, Human
aaaguucuaagauucug

SEQ ID NO: 1354424 - RNA, 16 nt, Human
aaaguucuaagauucu

SEQ ID NO: 1354425 - RNA, 15 nt, Human
aaaguucuaagauuc

SEQ ID NO: 1354426 - RNA, 20 nt, Human
aaaguuaguaucuuuugaua

SEQ ID NO: 1354427 - RNA, 21 nt, Human
aaaguuaguaucuuuugauau

SEQ ID NO: 1354428 - RNA, 18 nt, Human
aaaguuaguaucuuuuga

SEQ ID NO: 1354429 - RNA, 14 nt, Human
aaaguucuguacuc

SEQ ID NO: 1354430 - RNA, 21 nt, Human
aaaguucuaauaauuucuaau

SEQ ID NO: 1354431 - RNA, 20 nt, Human
aaaguucuaauaauuucuaa

SEQ ID NO: 1354432 - RNA, 19 nt, Human
aaaguucuaauaauuucua

SEQ ID NO: 1354433 - RNA, 18 nt, Human
aaaguucuaauaauuucu

SEQ ID NO: 1354434 - RNA, 21 nt, Human
aaaguucuguacucaaaugua

SEQ ID NO: 1354435 - RNA, 23 nt, Human
aaaguugcagcuguuuuguugac

SEQ ID NO: 1354436 - RNA, 22 nt, Human
aaaguuaccagugccuuaaacu

SEQ ID NO: 1354437 - RNA, 16 nt, Human
aaaguuaccagugccu

SEQ ID NO: 1354438 - RNA, 21 nt, Human
aaaguauuuaauuagugcuaa

SEQ ID NO: 1354439 - RNA, 23 nt, Human
aaaguauuuaauuagugcuaagu

SEQ ID NO: 1354440 - RNA, 17 nt, Human
aaaguauuuaauuagug

SEQ ID NO: 1354441 - RNA, 18 nt, Human
aaaguauuuaauuagugc

SEQ ID NO: 1354442 - RNA, 19 nt, Human
aaaguauuuaauuagugcu

SEQ ID NO: 1354443 - RNA, 20 nt, Human
aaaguauuuaauuagugcua

SEQ ID NO: 1354444 - RNA, 22 nt, Human
aaaguauucuucucuuccuuuu

SEQ ID NO: 1354445 - RNA, 12 nt, Human
aaaguauucuuc

SEQ ID NO: 1354446 - RNA, 19 nt, Human
aaaguauguucuaaccuuu

SEQ ID NO: 1354447 - RNA, 12 nt, Human
aaaguauguucu

SEQ ID NO: 1354448 - RNA, 20 nt, Human
aaauaauuuuaaacaaaggu

SEQ ID NO: 1354449 - RNA, 18 nt, Human
aaauaauuuuaaacaaag

SEQ ID NO: 1354450 - RNA, 14 nt, Human
aaauaauuuuaaac

SEQ ID NO: 1354451 - RNA, 17 nt, Human
aaauaauuguuguucug

SEQ ID NO: 1354452 - RNA, 12 nt, Human
aaauaauuuuaa

SEQ ID NO: 1354453 - RNA, 15 nt, Human
aaauaauuguuguuc

SEQ ID NO: 1354454 - RNA, 13 nt, Human
aaauaauuguugu

SEQ ID NO: 1354455 - RNA, 14 nt, Human
aaauaauuuuguaa

SEQ ID NO: 1354456 - RNA, 13 nt, Human
aaauaauuuugua

SEQ ID NO: 1354457 - RNA, 20 nt, Human
guaaacagauggcacuuuga

SEQ ID NO: 1354458 - RNA, 15 nt, Human
aaauaauuuuuauau

SEQ ID NO: 1354459 - RNA, 12 nt, Human
aaauaauuuugu

SEQ ID NO: 1354460 - RNA, 19 nt, Human
aaauaauuuuaucucuuuc

SEQ ID NO: 1354461 - RNA, 16 nt, Human
guaaaccacugaaaaa

SEQ ID NO: 1354462 - RNA, 14 nt, Human
guaaaccacugaaa

SEQ ID NO: 1354463 - RNA, 13 nt, Human
guaaaccacugaa

SEQ ID NO: 1354464 - RNA, 12 nt, Human
guaaaccacuga

SEQ ID NO: 1354465 - RNA, 23 nt, Human
guaaaccaauccuaugcaugguu

SEQ ID NO: 1354466 - RNA, 22 nt, Human
guaaaccacugaaaaaauauau

SEQ ID NO: 1354467 - RNA, 19 nt, Human
guaaaccacugaaaaaaua

SEQ ID NO: 1354468 - RNA, 18 nt, Human
guaaaccacugaaaaaau

SEQ ID NO: 1354469 - RNA, 20 nt, Human
guaaaccacugaaaaaauau

SEQ ID NO: 1354470 - RNA, 12 nt, Human
aaauaagauucu

SEQ ID NO: 1354471 - RNA, 17 nt, Human
aaauaagagcucaggau

SEQ ID NO: 1354472 - RNA, 17 nt, Human
aaauaagaauagaaaua

SEQ ID NO: 1354473 - RNA, 14 nt, Human
aaauaagaauagaa

SEQ ID NO: 1354474 - RNA, 20 nt, Human
aaauaagaagaaugcuuaau

SEQ ID NO: 1354475 - RNA, 15 nt, Human
aaauaagaagaaugc

SEQ ID NO: 1354476 - RNA, 14 nt, Human
aaauaagaagaaug

SEQ ID NO: 1354477 - RNA, 15 nt, Human
aaauaagaaacuuuu

SEQ ID NO: 1354478 - RNA, 21 nt, Human
aaauaagaaacuuuuuuauuu

SEQ ID NO: 1354479 - RNA, 14 nt, Human
aaauaagaaacuuu

SEQ ID NO: 1354480 - RNA, 12 nt, Human
aaauaagaaacu

SEQ ID NO: 1354481 - RNA, 24 nt, Human
aaauaagaaacaacucuuugagaa

SEQ ID NO: 1354482 - RNA, 15 nt, Human
aaauaaucaaaagcu

SEQ ID NO: 1354483 - RNA, 14 nt, Human
aaauaaucaaaagc

SEQ ID NO: 1354484 - RNA, 16 nt, Human
aaauaaguuuuuguuu

SEQ ID NO: 1354485 - RNA, 13 nt, Human
aaauaaguuuuug

SEQ ID NO: 1354486 - RNA, 17 nt, Human
aaauaauacugcugaga

SEQ ID NO: 1354487 - RNA, 13 nt, Human
aaauaauacauua

SEQ ID NO: 1354488 - RNA, 13 nt, Human
aaauaauaauuuu

SEQ ID NO: 1354489 - RNA, 21 nt, Human
aaauaacuggaaaacagaaca

SEQ ID NO: 1354490 - RNA, 20 nt, Human
aaauaacuggaaaacagaac

SEQ ID NO: 1354491 - RNA, 19 nt, Human
aaauaacuggaaaacagaa

SEQ ID NO: 1354492 - RNA, 16 nt, Human
aaauaacuggaaaaca

SEQ ID NO: 1354493 - RNA, 13 nt, Human
aaauaacuggaaa

SEQ ID NO: 1354494 - RNA, 19 nt, Human
aaauaaccaauccuggaca

SEQ ID NO: 1354495 - RNA, 20 nt, Human
aaauaaaaagaaaggcuguu

SEQ ID NO: 1354496 - RNA, 19 nt, Human
aaauaaaaagaaaggcugu

SEQ ID NO: 1354497 - RNA, 13 nt, Human
aaauaaaaagaaa

SEQ ID NO: 1354498 - RNA, 16 nt, Human
aaauaaaaagugcuuu

SEQ ID NO: 1354499 - RNA, 20 nt, Human
aaaguuuaaaacagaagccu

SEQ ID NO: 1354500 - RNA, 15 nt, Human
aaaguuuaauaaauu

SEQ ID NO: 1354501 - RNA, 12 nt, Human
aaaguuuaauaa

SEQ ID NO: 1354502 - RNA, 13 nt, Human
aaaguuguuguaa

SEQ ID NO: 1354503 - RNA, 16 nt, Human
aaaguugguaaaccuu

SEQ ID NO: 1354504 - RNA, 17 nt, Human
aaaguugguaaaccuuu

SEQ ID NO: 1354505 - RNA, 22 nt, Human
aaaguugcuauuugaacuuuuu

SEQ ID NO: 1354506 - RNA, 16 nt, Human
guaauuuuguguaaga

SEQ ID NO: 1354507 - RNA, 14 nt, Human
guaauuuuguguaa

SEQ ID NO: 1354508 - RNA, 17 nt, Human
guaauuuuggauuuugc

SEQ ID NO: 1354509 - RNA, 14 nt, Human
guaauuuuggauuu

SEQ ID NO: 1354510 - RNA, 20 nt, Human
guaauuuuacacgcuuuugu

SEQ ID NO: 1354511 - RNA, 22 nt, Human
guaauuuuacacgcuuuuguga

SEQ ID NO: 1354512 - RNA, 21 nt, Human
guaauuuuuuuaauuuacaaa

SEQ ID NO: 1354513 - RNA, 20 nt, Human
guaauuuuguguaagaaaua

SEQ ID NO: 1354514 - RNA, 20 nt, Human
guacacagcucuagacacug

SEQ ID NO: 1354515 - RNA, 18 nt, Human
guacacagcaccagaaug

SEQ ID NO: 1354516 - RNA, 21 nt, Human
guaauuuuuuuaucgucacug

SEQ ID NO: 1354517 - RNA, 14 nt, Human
guacacucugcugu

SEQ ID NO: 1354518 - RNA, 18 nt, Human
guacacucugcuguuuga

SEQ ID NO: 1354519 - RNA, 13 nt, Human
guacacucugcug

SEQ ID NO: 1354520 - RNA, 14 nt, Human
guacaccccaccuc

SEQ ID NO: 1354521 - RNA, 15 nt, Human
guacaccccaccucu

SEQ ID NO: 1354522 - RNA, 17 nt, Human
guacaccccaccucuuc

SEQ ID NO: 1354523 - RNA, 23 nt, Human
guacacugccuucucaacuccaa

SEQ ID NO: 1354524 - RNA, 23 nt, Human
aaauaauuuuuauauuugaaaua

SEQ ID NO: 1354525 - RNA, 22 nt, Human
aaauaauuuuuauauuugaaau

SEQ ID NO: 1354526 - RNA, 11 nt, Human
aaauacaaaaa

SEQ ID NO: 1354527 - RNA, 15 nt, Human
aaauacaaaaauacu

SEQ ID NO: 1354528 - RNA, 14 nt, Human
aaauacaagacugc

SEQ ID NO: 1354529 - RNA, 13 nt, Human
aaauacaugacau

SEQ ID NO: 1354530 - RNA, 23 nt, Human
aaauacagucuuccauuugcaag

SEQ ID NO: 1354531 - RNA, 22 nt, Human
aaauacagucuuccauuugcaa

SEQ ID NO: 1354532 - RNA, 16 nt, Human
aaauacaggaaacagu

SEQ ID NO: 1354533 - RNA, 14 nt, Human
aaauacaggaaaca

SEQ ID NO: 1354534 - RNA, 13 nt, Human
aaauacaggaaac

SEQ ID NO: 1354535 - RNA, 17 nt, Human
aaauacagauuuugaua

SEQ ID NO: 1354536 - RNA, 23 nt, Human
aaauacagauuuugauagcaaag

SEQ ID NO: 1354537 - RNA, 15 nt, Human
aaauacagacuggau

SEQ ID NO: 1354538 - RNA, 15 nt, Human
aaauacagauuuuga

SEQ ID NO: 1354539 - RNA, 13 nt, Human
aaauacaauuuuu

SEQ ID NO: 1354540 - RNA, 13 nt, Human
aaauacaagacug

SEQ ID NO: 1354541 - RNA, 15 nt, Human
aaauacugcaaauca

SEQ ID NO: 1354542 - RNA, 20 nt, Human
aaauacuauuuaaagccucc

SEQ ID NO: 1354543 - RNA, 23 nt, Human
aaauacuaaugaaaacagaaugu

SEQ ID NO: 1354544 - RNA, 17 nt, Human
aaauacauuuaaaacau

SEQ ID NO: 1354545 - RNA, 18 nt, Human
aaauacaugcuaagagaa

SEQ ID NO: 1354546 - RNA, 13 nt, Human
aaauacaugcuaa

SEQ ID NO: 1354547 - RNA, 18 nt, Human
aaauacauuguauauaug

SEQ ID NO: 1354548 - RNA, 18 nt, Human
aaauaccagccaguaaau

SEQ ID NO: 1354549 - RNA, 23 nt, Human
guaauuugagagaaauaugaaga

SEQ ID NO: 1354550 - RNA, 16 nt, Human
guaauuugaggacaac

SEQ ID NO: 1354551 - RNA, 18 nt, Human
guaauuuagaaaucauuu

SEQ ID NO: 1354552 - RNA, 12 nt, Human
guaauuuaacuu

SEQ ID NO: 1354553 - RNA, 21 nt, Human
guaauuuaaaauaauuauaua

SEQ ID NO: 1354554 - RNA, 21 nt, Human
guaauuguguggauucuuuaa

SEQ ID NO: 1354555 - RNA, 15 nt, Human
guaauuguguggauu

SEQ ID NO: 1354556 - RNA, 21 nt, Human
guaauuguugcuaaucuucuu

SEQ ID NO: 1354557 - RNA, 21 nt, Human
guaauccaagcaaaugugaau

SEQ ID NO: 1354558 - RNA, 14 nt, Human
guaauaugcacaca

SEQ ID NO: 1354559 - RNA, 16 nt, Human
guaauaugcacacauu

SEQ ID NO: 1354560 - RNA, 17 nt, Human
guaauaugcacacauuu

SEQ ID NO: 1354561 - RNA, 18 nt, Human
guaauaugcacacauuuu

SEQ ID NO: 1354562 - RNA, 17 nt, Human
guaaacuuuaucacuua

SEQ ID NO: 1354563 - RNA, 19 nt, Human
guaaacuuuaucacuuaaa

SEQ ID NO: 1354564 - RNA, 20 nt, Human
guaaacuguguauuccaaga

SEQ ID NO: 1354565 - RNA, 16 nt, Human
guaaacuuuuugugcu

SEQ ID NO: 1354566 - RNA, 14 nt, Human
guaacugcuuucug

SEQ ID NO: 1354567 - RNA, 17 nt, Human
guaacugccuagaaaca

SEQ ID NO: 1354568 - RNA, 20 nt, Human
guaacugccuagaaacaaca

SEQ ID NO: 1354569 - RNA, 16 nt, Human
guaacugccuagaaac

SEQ ID NO: 1354570 - RNA, 14 nt, Human
guaacugccuagaa

SEQ ID NO: 1354571 - RNA, 12 nt, Human
guaacugccagg

SEQ ID NO: 1354572 - RNA, 15 nt, Human
guaacucaucuguca

SEQ ID NO: 1354573 - RNA, 22 nt, Human
guaacugcuuucuguuccaaau

SEQ ID NO: 1354574 - RNA, 20 nt, Human
guaacugcuuucuguuccaa

SEQ ID NO: 1354575 - RNA, 19 nt, Human
guaacugcuuucuguucca

SEQ ID NO: 1354576 - RNA, 17 nt, Human
guaacugcuuucuguuc

SEQ ID NO: 1354577 - RNA, 15 nt, Human
guaacugcuuucugu

SEQ ID NO: 1354578 - RNA, 15 nt, Human
guaauaaacuuuaau

SEQ ID NO: 1354579 - RNA, 20 nt, Human
guaauaggcguaacuaauuu

SEQ ID NO: 1354580 - RNA, 16 nt, Human
aaaucaguaagaggug

SEQ ID NO: 1354581 - RNA, 19 nt, Human
aaaucaguaagagguguua

SEQ ID NO: 1354582 - RNA, 15 nt, Human
aaaucaguaagaggu

SEQ ID NO: 1354583 - RNA, 13 nt, Human
aaaucaguaagag

SEQ ID NO: 1354584 - RNA, 11 nt, Human
aaaucaguaag

SEQ ID NO: 1354585 - RNA, 23 nt, Human
aaaucaggcuuuuguuuccuuuu

SEQ ID NO: 1354586 - RNA, 22 nt, Human
aaaucaggcuuuuguuuccuuu

SEQ ID NO: 1354587 - RNA, 12 nt, Human
aaaucauuuguu

SEQ ID NO: 1354588 - RNA, 14 nt, Human
aaaucauuuugcaa

SEQ ID NO: 1354589 - RNA, 15 nt, Human
aaauccacuuuaucu

SEQ ID NO: 1354590 - RNA, 16 nt, Human
aaauauuaugagaugc

SEQ ID NO: 1354591 - RNA, 17 nt, Human
aaauauuauguuaaaac

SEQ ID NO: 1354592 - RNA, 17 nt, Human
aaauauuaugagaugcu

SEQ ID NO: 1354593 - RNA, 12 nt, Human
aaaucagaaguc

SEQ ID NO: 1354594 - RNA, 20 nt, Human
aaaucacgcuuuuugaaaaa

SEQ ID NO: 1354595 - RNA, 20 nt, Human
aaaucaccacaaacuguaau

SEQ ID NO: 1354596 - RNA, 19 nt, Human
aaaucaccacaaacuguaa

SEQ ID NO: 1354597 - RNA, 19 nt, Human
aaauauucccuagaaacuu

SEQ ID NO: 1354598 - RNA, 18 nt, Human
aaauauucccuagaaacu

SEQ ID NO: 1354599 - RNA, 17 nt, Human
aaaucacgcuuuuugaa

SEQ ID NO: 1354600 - RNA, 17 nt, Human
aaaucagccaauuaugu

SEQ ID NO: 1354601 - RNA, 21 nt, Human
aaaucagaagucaucuugcua

SEQ ID NO: 1354602 - RNA, 18 nt, Human
aaaucagaagucaucuug

SEQ ID NO: 1354603 - RNA, 18 nt, Human
aaaucagccaauuauguu

SEQ ID NO: 1354604 - RNA, 20 nt, Human
aaaucagccaauuauguuaa

SEQ ID NO: 1354605 - RNA, 21 nt, Human
aaaucagccaauuauguuaaa

SEQ ID NO: 1354606 - RNA, 23 nt, Human
aaaucagccaauuauguuaaacu

SEQ ID NO: 1354607 - RNA, 14 nt, Human
aaaucagacuauga

SEQ ID NO: 1354608 - RNA, 21 nt, Human
aaaucagacuaugaaguuuuu

SEQ ID NO: 1354609 - RNA, 20 nt, Human
guaccaguuaauuuuuccaa

SEQ ID NO: 1354610 - RNA, 16 nt, Human
guaccaguuaauuuuu

SEQ ID NO: 1354611 - RNA, 11 nt, Human
guaccaguuaa

SEQ ID NO: 1354612 - RNA, 10 nt, Human
guaccaguua

SEQ ID NO: 1354613 - RNA, 17 nt, Human
guaccagauaacuuuuu

SEQ ID NO: 1354614 - RNA, 17 nt, Human
guaccagaugcagcuca

SEQ ID NO: 1354615 - RNA, 16 nt, Human
guaccagauaacuuuu

SEQ ID NO: 1354616 - RNA, 15 nt, Human
guaccagauaacuuu

SEQ ID NO: 1354617 - RNA, 22 nt, Human
guaccauuuaauggggaggaca

SEQ ID NO: 1354618 - RNA, 23 nt, Human
guaccaguuaauuuuuccaacua

SEQ ID NO: 1354619 - RNA, 22 nt, Human
guaccaguuaauuuuuccaacu

SEQ ID NO: 1354620 - RNA, 13 nt, Human
guaccauuuuaaa

SEQ ID NO: 1354621 - RNA, 23 nt, Human
guaccauuuaauggggaggacaa

SEQ ID NO: 1354622 - RNA, 15 nt, Human
guacauuuuguaaca

SEQ ID NO: 1354623 - RNA, 22 nt, Human
guacauuugggaguuuuuauga

SEQ ID NO: 1354624 - RNA, 21 nt, Human
guaccaaucauuuuaauuauu

SEQ ID NO: 1354625 - RNA, 15 nt, Human
guaccaaucauuuua

SEQ ID NO: 1354626 - RNA, 14 nt, Human
guaccaaucauuuu

SEQ ID NO: 1354627 - RNA, 21 nt, Human
guaccaagaaucuugguuugc

SEQ ID NO: 1354628 - RNA, 20 nt, Human
guaccaagacuacuagggaa

SEQ ID NO: 1354629 - RNA, 23 nt, Human
guaccaagacuacuagggaaaug

SEQ ID NO: 1354630 - RNA, 17 nt, Human
guacauggugcugggag

SEQ ID NO: 1354631 - RNA, 11 nt, Human
guacaugagaa

SEQ ID NO: 1354632 - RNA, 17 nt, Human
guacaugaaaacacauu

SEQ ID NO: 1354633 - RNA, 18 nt, Human
guacaugaaaacacauuu

SEQ ID NO: 1354634 - RNA, 19 nt, Human
guacaugaaaacacauuuu

SEQ ID NO: 1354635 - RNA, 20 nt, Human
guacaugaaaacacauuuuu

SEQ ID NO: 1354636 - RNA, 20 nt, Human
guacaucuauuuuggauugu

SEQ ID NO: 1354637 - RNA, 18 nt, Human
guacaucuauuuuggauu

SEQ ID NO: 1354638 - RNA, 14 nt, Human
guacaugaaaacac

SEQ ID NO: 1354639 - RNA, 15 nt, Human
guacaugaaaacaca

SEQ ID NO: 1354640 - RNA, 16 nt, Human
guacaugaaaacacau

SEQ ID NO: 1354641 - RNA, 18 nt, Human
aaauccauacauuugugu

SEQ ID NO: 1354642 - RNA, 15 nt, Human
aaauccauacauuug

SEQ ID NO: 1354643 - RNA, 21 nt, Human
guagccucaaucgagugagac

SEQ ID NO: 1354644 - RNA, 22 nt, Human
guagaccuuguuacuucugagg

SEQ ID NO: 1354645 - RNA, 21 nt, Human
guagaccuuguuacuucugag

SEQ ID NO: 1354646 - RNA, 20 nt, Human
guagaccuuguuacuucuga

SEQ ID NO: 1354647 - RNA, 19 nt, Human
guagaccuuguuacuucug

SEQ ID NO: 1354648 - RNA, 15 nt, Human
guagaccacugccau

SEQ ID NO: 1354649 - RNA, 16 nt, Human
guagaccaaaauaaaa

SEQ ID NO: 1354650 - RNA, 15 nt, Human
guagaccaaaauaaa

SEQ ID NO: 1354651 - RNA, 14 nt, Human
guagaccaaaauaa

SEQ ID NO: 1354652 - RNA, 18 nt, Human
guagacaguauauaacua

SEQ ID NO: 1354653 - RNA, 21 nt, Human
guagacggcucaguauagaua

SEQ ID NO: 1354654 - RNA, 20 nt, Human
guagacgugcacgcacacug

SEQ ID NO: 1354655 - RNA, 23 nt, Human
guagacgugcacgcacacugucu

SEQ ID NO: 1354656 - RNA, 15 nt, Human
guagaauugcauuga

SEQ ID NO: 1354657 - RNA, 14 nt, Human
guagaauugcauug

SEQ ID NO: 1354658 - RNA, 22 nt, Human
guagaauuaucuaauuuauaaa

SEQ ID NO: 1354659 - RNA, 17 nt, Human
guagaauuaucuaauuu

SEQ ID NO: 1354660 - RNA, 19 nt, Human
guagaauguaaagcuuguc

SEQ ID NO: 1354661 - RNA, 21 nt, Human
guagaauguaaagcuugucug

SEQ ID NO: 1354662 - RNA, 16 nt, Human
guagaauguaaagcuu

SEQ ID NO: 1354663 - RNA, 18 nt, Human
guagaagggaaagcccau

SEQ ID NO: 1354664 - RNA, 14 nt, Human
guagaagggaaagc

SEQ ID NO: 1354665 - RNA, 18 nt, Human
guagaacacuaauucaua

SEQ ID NO: 1354666 - RNA, 17 nt, Human
guagaacacuaauucau

SEQ ID NO: 1354667 - RNA, 15 nt, Human
guagaacacuaauuc

SEQ ID NO: 1354668 - RNA, 17 nt, Human
guagaaaugguuguauu

SEQ ID NO: 1354669 - RNA, 18 nt, Human
guagaaaugguuguauua

SEQ ID NO: 1354670 - RNA, 20 nt, Human
guagaaaugguuguauuaga

SEQ ID NO: 1354671 - RNA, 22 nt, Human
guagaaaugguuguauuagaug

SEQ ID NO: 1354672 - RNA, 21 nt, Human
guagaaaggccuuuaaaauuu

SEQ ID NO: 1354673 - RNA, 19 nt, Human
guacccaccgggccacucc

SEQ ID NO: 1354674 - RNA, 19 nt, Human
guacuccacauauuucagu

SEQ ID NO: 1354675 - RNA, 21 nt, Human
guacuccacacugcacaauaa

SEQ ID NO: 1354676 - RNA, 19 nt, Human
guacuccacacugcacaau

SEQ ID NO: 1354677 - RNA, 18 nt, Human
guacuccacacugcacaa

SEQ ID NO: 1354678 - RNA, 15 nt, Human
guacuauuuaacuga

SEQ ID NO: 1354679 - RNA, 20 nt, Human
guacucccucucaggaucca

SEQ ID NO: 1354680 - RNA, 16 nt, Human
guacucccucucagga

SEQ ID NO: 1354681 - RNA, 15 nt, Human
guacucccucucagg

SEQ ID NO: 1354682 - RNA, 15 nt, Human
guacucaaauguagc

SEQ ID NO: 1354683 - RNA, 18 nt, Human
guacuauuuaacugacua

SEQ ID NO: 1354684 - RNA, 14 nt, Human
guacuauuuaacug

SEQ ID NO: 1354685 - RNA, 16 nt, Human
guacugagccuuguaa

SEQ ID NO: 1354686 - RNA, 18 nt, Human
guacugacuuugcuugcu

SEQ ID NO: 1354687 - RNA, 20 nt, Human
guacugacuuugcuugcuuu

SEQ ID NO: 1354688 - RNA, 17 nt, Human
guacugacuuugcuugc

SEQ ID NO: 1354689 - RNA, 14 nt, Human
guacugacuuugcu

SEQ ID NO: 1354690 - RNA, 19 nt, Human
guacugaccccaucaccua

SEQ ID NO: 1354691 - RNA, 13 nt, Human
guacugcagccuc

SEQ ID NO: 1354692 - RNA, 16 nt, Human
guacugccugcuuggg

SEQ ID NO: 1354693 - RNA, 13 nt, Human
guacugccugcuu

SEQ ID NO: 1354694 - RNA, 11 nt, Human
guacugccugc

SEQ ID NO: 1354695 - RNA, 20 nt, Human
guacugggauuacaggcgug

SEQ ID NO: 1354696 - RNA, 20 nt, Human
guacuguacagcuggcucua

SEQ ID NO: 1354697 - RNA, 19 nt, Human
guacuguacagcuggcucu

SEQ ID NO: 1354698 - RNA, 15 nt, Human
guacuguacagcugg

SEQ ID NO: 1354699 - RNA, 19 nt, Human
guacuggcugauggaguaa

SEQ ID NO: 1354700 - RNA, 17 nt, Human
guacuguucugugucuu

SEQ ID NO: 1354701 - RNA, 18 nt, Human
guacuguucugugucuuu

SEQ ID NO: 1354702 - RNA, 15 nt, Human
guacuguucuguguc

SEQ ID NO: 1354703 - RNA, 14 nt, Human
guacuguucugugu

SEQ ID NO: 1354704 - RNA, 15 nt, Human
guacuucaugcuguc

SEQ ID NO: 1354705 - RNA, 22 nt, Human
guacuucaaauccuugaagauu

SEQ ID NO: 1354706 - RNA, 21 nt, Human
guacuucaaauccuugaagau

SEQ ID NO: 1354707 - RNA, 12 nt, Human
gcuggcuggccu

SEQ ID NO: 1354708 - RNA, 12 nt, Human
gcuggcucugag

SEQ ID NO: 1354709 - RNA, 23 nt, Human
gcuggcuccagaugcagggcagu

SEQ ID NO: 1354710 - RNA, 22 nt, Human
gcuggcuccagaugcagggcag

SEQ ID NO: 1354711 - RNA, 21 nt, Human
gcuggcuccagaugcagggca

SEQ ID NO: 1354712 - RNA, 17 nt, Human
gcuggcuccagaugcag

SEQ ID NO: 1354713 - RNA, 14 nt, Human
gcuggcuccagaug

SEQ ID NO: 1354714 - RNA, 14 nt, Human
gcuggcuggccuca

SEQ ID NO: 1354715 - RNA, 15 nt, Human
gcugggucaggcagg

SEQ ID NO: 1354716 - RNA, 14 nt, Human
gcugggucaggcag

SEQ ID NO: 1354717 - RNA, 13 nt, Human
gcugggucaggca

SEQ ID NO: 1354718 - RNA, 23 nt, Human
gcuggguccauaucacacacauu

SEQ ID NO: 1354719 - RNA, 19 nt, Human
gcuggguccaauuguggca

SEQ ID NO: 1354720 - RNA, 16 nt, Human
gcugggucaggcaggg

SEQ ID NO: 1354721 - RNA, 12 nt, Human
gcugggucgccc

SEQ ID NO: 1354722 - RNA, 21 nt, Human
gcugggccccugccucucugc

SEQ ID NO: 1354723 - RNA, 22 nt, Human
gcugggccccugccucucugca

SEQ ID NO: 1354724 - RNA, 14 nt, Human
gcugggcucaguga

SEQ ID NO: 1354725 - RNA, 22 nt, Human
gcugggccuggucucacccugg

SEQ ID NO: 1354726 - RNA, 13 nt, Human
gcugggccugguc

SEQ ID NO: 1354727 - RNA, 12 nt, Human
gcugggccuggu

SEQ ID NO: 1354728 - RNA, 23 nt, Human
gcugggccccugccucucugcag

SEQ ID NO: 1354729 - RNA, 17 nt, Human
gcugcugcugggcucag

SEQ ID NO: 1354730 - RNA, 16 nt, Human
gcugcugcugggcuca

SEQ ID NO: 1354731 - RNA, 15 nt, Human
gcugcugcugggcuc

SEQ ID NO: 1354732 - RNA, 13 nt, Human
gcugcugcugggc

SEQ ID NO: 1354733 - RNA, 21 nt, Human
gcucuggggugggcaguuuuu

SEQ ID NO: 1354734 - RNA, 19 nt, Human
gcucuggggugggcaguuu

SEQ ID NO: 1354735 - RNA, 23 nt, Human
gcucugggccauucuccacagca

SEQ ID NO: 1354736 - RNA, 20 nt, Human
gcucugggccauucuccaca

SEQ ID NO: 1354737 - RNA, 14 nt, Human
gcucugggccauuc

SEQ ID NO: 1354738 - RNA, 15 nt, Human
gcuggagugcagugg

SEQ ID NO: 1354739 - RNA, 16 nt, Human
gcuggaggcccaggcu

SEQ ID NO: 1354740 - RNA, 20 nt, Human
gcuggaggcccaggcuggga

SEQ ID NO: 1354741 - RNA, 15 nt, Human
gcuggaggcccaggc

SEQ ID NO: 1354742 - RNA, 14 nt, Human
gcuggaggcccagg

SEQ ID NO: 1354743 - RNA, 13 nt, Human
gcuggaggcccag

SEQ ID NO: 1354744 - RNA, 12 nt, Human
gcuggaggccca

SEQ ID NO: 1354745 - RNA, 23 nt, Human
gcuggaggcaggggcuuccuggu

SEQ ID NO: 1354746 - RNA, 22 nt, Human
gcuggaggcaggggcuuccugg

SEQ ID NO: 1354747 - RNA, 21 nt, Human
gcuggaggcaggggcuuccug

SEQ ID NO: 1354748 - RNA, 20 nt, Human
gcuggaggcaggggcuuccu

SEQ ID NO: 1354749 - RNA, 15 nt, Human
gcuucagcugccagu

SEQ ID NO: 1354750 - RNA, 17 nt, Human
gcuuauuuauuguauuc

SEQ ID NO: 1354751 - RNA, 19 nt, Human
gcuucagccaggagcuggg

SEQ ID NO: 1354752 - RNA, 20 nt, Human
gcuuauuuauuguauucugg

SEQ ID NO: 1354753 - RNA, 17 nt, Human
gcuuauuuccucauuuu

SEQ ID NO: 1354754 - RNA, 15 nt, Human
gcuucagccaggagc

SEQ ID NO: 1354755 - RNA, 19 nt, Human
gcuuauuccaugacugcuu

SEQ ID NO: 1354756 - RNA, 18 nt, Human
gcuuauuccaugacugcu

SEQ ID NO: 1354757 - RNA, 17 nt, Human
gcuuauuccaugacugc

SEQ ID NO: 1354758 - RNA, 15 nt, Human
gcuuauuccaugacu

SEQ ID NO: 1354759 - RNA, 15 nt, Human
gcuuauuuauuguau

SEQ ID NO: 1354760 - RNA, 20 nt, Human
gcuuaugguaccagaugcag

SEQ ID NO: 1354761 - RNA, 16 nt, Human
gcuuaugguaccagau

SEQ ID NO: 1354762 - RNA, 22 nt, Human
gcuucuaaguaaauacaauuuu

SEQ ID NO: 1354763 - RNA, 21 nt, Human
gcuucuaaguaaauacaauuu

SEQ ID NO: 1354764 - RNA, 20 nt, Human
gcuucuaaguaaauacaauu

SEQ ID NO: 1354765 - RNA, 19 nt, Human
gcuucuaaguaaauacaau

SEQ ID NO: 1354766 - RNA, 18 nt, Human
gcuucuaaguaaauacaa

SEQ ID NO: 1354767 - RNA, 16 nt, Human
gcuucuaaguaaauac

SEQ ID NO: 1354768 - RNA, 17 nt, Human
gcuucguuuauuuucaa

SEQ ID NO: 1354769 - RNA, 16 nt, Human
gcuucguuuauuuuca

SEQ ID NO: 1354770 - RNA, 14 nt, Human
gcuucguuuauuuu

SEQ ID NO: 1354771 - RNA, 16 nt, Human
gcuuccuccuggaaau

SEQ ID NO: 1354772 - RNA, 13 nt, Human
gcuuccuccugga

SEQ ID NO: 1354773 - RNA, 12 nt, Human
gcuuccuccugg

SEQ ID NO: 1354774 - RNA, 21 nt, Human
gcuuccuccuccccaacugug

SEQ ID NO: 1354775 - RNA, 17 nt, Human
gcuucuaguucugccag

SEQ ID NO: 1354776 - RNA, 16 nt, Human
gcuucuaguucugcca

SEQ ID NO: 1354777 - RNA, 17 nt, Human
gcuuugaaauugaaccu

SEQ ID NO: 1354778 - RNA, 19 nt, Human
gcuuugaaauugaaccuuu

SEQ ID NO: 1354779 - RNA, 15 nt, Human
gcuuugaaacagaaa

SEQ ID NO: 1354780 - RNA, 14 nt, Human
gcuuguagccagcc

SEQ ID NO: 1354781 - RNA, 17 nt, Human
gcuuguagccagccggg

SEQ ID NO: 1354782 - RNA, 21 nt, Human
gcuuguccaacccgaggcccg

SEQ ID NO: 1354783 - RNA, 22 nt, Human
gcuuguaggggaggggcuccuu

SEQ ID NO: 1354784 - RNA, 22 nt, Human
gcuuguagccagccggggcgag

SEQ ID NO: 1354785 - RNA, 16 nt, Human
gcuuguagccagccgg

SEQ ID NO: 1354786 - RNA, 15 nt, Human
gcuuguagccagccg

SEQ ID NO: 1354787 - RNA, 12 nt, Human
gcuuguacauaa

SEQ ID NO: 1354788 - RNA, 20 nt, Human
gcuugagaaauauggacacu

SEQ ID NO: 1354789 - RNA, 18 nt, Human
gcuucuugccucugugcu

SEQ ID NO: 1354790 - RNA, 17 nt, Human
gcuucuugccucugugc

SEQ ID NO: 1354791 - RNA, 16 nt, Human
gcuucuugccucugug

SEQ ID NO: 1354792 - RNA, 15 nt, Human
gcuucuugccucugu

SEQ ID NO: 1354793 - RNA, 14 nt, Human
gcuucuugccucug

SEQ ID NO: 1354794 - RNA, 13 nt, Human
gcuucuugccucu

SEQ ID NO: 1354795 - RNA, 12 nt, Human
gcuucuugccuc

SEQ ID NO: 1354796 - RNA, 23 nt, Human
gcuuguaacuaaaauaauuuugu

SEQ ID NO: 1354797 - RNA, 22 nt, Human
gcuuguaacuaaaauaauuuug

SEQ ID NO: 1354798 - RNA, 17 nt, Human
gcuuguaacuaaaauaa

SEQ ID NO: 1354799 - RNA, 20 nt, Human
gcuuugacucaggagccugu

SEQ ID NO: 1354800 - RNA, 24 nt, Human
gcuuugacucaggagccugugaca

SEQ ID NO: 1354801 - RNA, 16 nt, Human
gcuuugacucaggagc

SEQ ID NO: 1354802 - RNA, 15 nt, Human
gcuuugacucaggag

SEQ ID NO: 1354803 - RNA, 16 nt, Human
gcuuugagagagaaag

SEQ ID NO: 1354804 - RNA, 19 nt, Human
ggaacuggccaagcugagg

SEQ ID NO: 1354805 - RNA, 22 nt, Human
ggaacuggccaagcugaggugc

SEQ ID NO: 1354806 - RNA, 17 nt, Human
ggaacuggccaagcuga

SEQ ID NO: 1354807 - RNA, 16 nt, Human
ggaacuggccaagcug

SEQ ID NO: 1354808 - RNA, 14 nt, Human
ggaacuggccaagc

SEQ ID NO: 1354809 - RNA, 15 nt, Human
ggaacuggaggcagg

SEQ ID NO: 1354810 - RNA, 12 nt, Human
ggaacuggaggc

SEQ ID NO: 1354811 - RNA, 11 nt, Human
ggaacuggagg

SEQ ID NO: 1354812 - RNA, 17 nt, Human
ggaacuggaauccuuuc

SEQ ID NO: 1354813 - RNA, 21 nt, Human
ggaacacuggggacuuggccu

SEQ ID NO: 1354814 - RNA, 15 nt, Human
ggaagacaguggccc

SEQ ID NO: 1354815 - RNA, 14 nt, Human
ggaagacaguggcc

SEQ ID NO: 1354816 - RNA, 20 nt, Human
ggaacuugccugccuuucca

SEQ ID NO: 1354817 - RNA, 22 nt, Human
ggaacuuggggaguuaagaccu

SEQ ID NO: 1354818 - RNA, 17 nt, Human
ggaacuugccugccuuu

SEQ ID NO: 1354819 - RNA, 18 nt, Human
ggaacuugaacugauuca

SEQ ID NO: 1354820 - RNA, 16 nt, Human
ggaacuugaacugauu

SEQ ID NO: 1354821 - RNA, 14 nt, Human
ggaacuugaacuga

SEQ ID NO: 1354822 - RNA, 18 nt, Human
ggaagagagccugcagga

SEQ ID NO: 1354823 - RNA, 21 nt, Human
ggaagagagccugcaggaucu

SEQ ID NO: 1354824 - RNA, 12 nt, Human
ggaagagaagga

SEQ ID NO: 1354825 - RNA, 17 nt, Human
ggaagagaaggagcaga

SEQ ID NO: 1354826 - RNA, 20 nt, Human
ggacagcugugccucgcucc

SEQ ID NO: 1354827 - RNA, 22 nt, Human
ggacagcuuguggcaagugaau

SEQ ID NO: 1354828 - RNA, 17 nt, Human
ggacagcugugccucgc

SEQ ID NO: 1354829 - RNA, 15 nt, Human
ggacagcugugccuc

SEQ ID NO: 1354830 - RNA, 14 nt, Human
ggacagcugugccu

SEQ ID NO: 1354831 - RNA, 12 nt, Human
ggacagcugugc

SEQ ID NO: 1354832 - RNA, 11 nt, Human
ggacagcugug

SEQ ID NO: 1354833 - RNA, 21 nt, Human
ggacacgggccuguccacagg

SEQ ID NO: 1354834 - RNA, 23 nt, Human
ggacacgggccuguccacaggcu

SEQ ID NO: 1354835 - RNA, 23 nt, Human
ggacacgcucaguggggcagagg

SEQ ID NO: 1354836 - RNA, 22 nt, Human
ggacacgcucaguggggcagag

SEQ ID NO: 1354837 - RNA, 16 nt, Human
ggacacgcucaguggg

SEQ ID NO: 1354838 - RNA, 16 nt, Human
ggacaauggaccggag

SEQ ID NO: 1354839 - RNA, 20 nt, Human
ggacaaguggacucagggca

SEQ ID NO: 1354840 - RNA, 18 nt, Human
ggacaagcuucugagacg

SEQ ID NO: 1354841 - RNA, 19 nt, Human
ggacaccugggagaaaucu

SEQ ID NO: 1354842 - RNA, 17 nt, Human
ggacaccugcccugccc

SEQ ID NO: 1354843 - RNA, 19 nt, Human
ggaauaagguacaagaagc

SEQ ID NO: 1354844 - RNA, 24 nt, Human
ggaaucauuucuauuucuccucca

SEQ ID NO: 1354845 - RNA, 13 nt, Human
ggaauaauaccua

SEQ ID NO: 1354846 - RNA, 18 nt, Human
ggaauaagcucccagggc

SEQ ID NO: 1354847 - RNA, 13 nt, Human
ggacaagcauggu

SEQ ID NO: 1354848 - RNA, 16 nt, Human
ggacaagacccccagc

SEQ ID NO: 1354849 - RNA, 23 nt, Human
ggacaacugcucccaccuccuga

SEQ ID NO: 1354850 - RNA, 22 nt, Human
ggacaacugcucccaccuccug

SEQ ID NO: 1354851 - RNA, 21 nt, Human
ggacaacugcucccaccuccu

SEQ ID NO: 1354852 - RNA, 19 nt, Human
ggaaugaagauacugaaau

SEQ ID NO: 1354853 - RNA, 18 nt, Human
ggaaugaagcaaugcuuc

SEQ ID NO: 1354854 - RNA, 20 nt, Human
ggaagcucuuggagcuguga

SEQ ID NO: 1354855 - RNA, 17 nt, Human
ggaagcugcccugccca

SEQ ID NO: 1354856 - RNA, 21 nt, Human
ggaagcucuuggagcugugag

SEQ ID NO: 1354857 - RNA, 14 nt, Human
ggaagcuuggggaa

SEQ ID NO: 1354858 - RNA, 23 nt, Human
ggaagcuagucuuuugcuuuugc

SEQ ID NO: 1354859 - RNA, 20 nt, Human
ggaagcuuuggugagaaccu

SEQ ID NO: 1354860 - RNA, 21 nt, Human
ggaagcuuuggugagaaccug

SEQ ID NO: 1354861 - RNA, 17 nt, Human
ggaaguuuagcucugag

SEQ ID NO: 1354862 - RNA, 18 nt, Human
ggaaguuuagcucugaga

SEQ ID NO: 1354863 - RNA, 16 nt, Human
ggaaguuuagcucuga

SEQ ID NO: 1354864 - RNA, 15 nt, Human
ggaaguuuagcucug

SEQ ID NO: 1354865 - RNA, 18 nt, Human
ggaaguugacuuauagua

SEQ ID NO: 1354866 - RNA, 22 nt, Human
ggaagcccccaccgugggcagg

SEQ ID NO: 1354867 - RNA, 21 nt, Human
ggaagcccccaccgugggcag

SEQ ID NO: 1354868 - RNA, 13 nt, Human
ggaagcccccacc

SEQ ID NO: 1354869 - RNA, 20 nt, Human
ggaagcccauccugaccagc

SEQ ID NO: 1354870 - RNA, 18 nt, Human
ggaagcccauccugacca

SEQ ID NO: 1354871 - RNA, 19 nt, Human
ggaagcuagucuuuugcuu

SEQ ID NO: 1354872 - RNA, 17 nt, Human
ggaagcuagucuuuugc

SEQ ID NO: 1354873 - RNA, 16 nt, Human
ggaagcuagucuuuug

SEQ ID NO: 1354874 - RNA, 15 nt, Human
ggaagcuagucuuuu

SEQ ID NO: 1354875 - RNA, 19 nt, Human
ggaagcuagacacaugaag

SEQ ID NO: 1354876 - RNA, 22 nt, Human
ggaagcuagacacaugaaggua

SEQ ID NO: 1354877 - RNA, 18 nt, Human
ggaagcuagacacaugaa

SEQ ID NO: 1354878 - RNA, 16 nt, Human
ggaagcuaauuugcau

SEQ ID NO: 1354879 - RNA, 23 nt, Human
ggaccccccuuucacaggcagcc

SEQ ID NO: 1354880 - RNA, 21 nt, Human
ggacccuccgcucuguagugc

SEQ ID NO: 1354881 - RNA, 21 nt, Human
ggacguacguaauaagguuuu

SEQ ID NO: 1354882 - RNA, 21 nt, Human
ggacggugcccaagccagagg

SEQ ID NO: 1354883 - RNA, 19 nt, Human
ggacggugcccaagccaga

SEQ ID NO: 1354884 - RNA, 17 nt, Human
ggacggugcccaagcca

SEQ ID NO: 1354885 - RNA, 18 nt, Human
ggacguggcucagccagc

SEQ ID NO: 1354886 - RNA, 22 nt, Human
ggaccccccuuucacaggcagc

SEQ ID NO: 1354887 - RNA, 13 nt, Human
ggacccugugagc

SEQ ID NO: 1354888 - RNA, 15 nt, Human
ggacccugugagccg

SEQ ID NO: 1354889 - RNA, 13 nt, Human
ggacccuguugcu

SEQ ID NO: 1354890 - RNA, 17 nt, Human
ggacccuguugcuaagc

SEQ ID NO: 1354891 - RNA, 21 nt, Human
ggacccuucccuugagcccuc

SEQ ID NO: 1354892 - RNA, 11 nt, Human
ggacccugacc

SEQ ID NO: 1354893 - RNA, 13 nt, Human
ggacccugaaggg

SEQ ID NO: 1354894 - RNA, 15 nt, Human
ggacuccaggcccaa

SEQ ID NO: 1354895 - RNA, 14 nt, Human
ggacuccaggccca

SEQ ID NO: 1354896 - RNA, 20 nt, Human
ggacucagguggcccuacug

SEQ ID NO: 1354897 - RNA, 22 nt, Human
ggacucagggcagcgccaggcu

SEQ ID NO: 1354898 - RNA, 15 nt, Human
ggacucagggcagcg

SEQ ID NO: 1354899 - RNA, 13 nt, Human
ggacucagggcag

SEQ ID NO: 1354900 - RNA, 21 nt, Human
ggacucagccuucagacagag

SEQ ID NO: 1354901 - RNA, 17 nt, Human
ggacucagccuucagac

SEQ ID NO: 1354902 - RNA, 18 nt, Human
ggacucaagccccggacu

SEQ ID NO: 1354903 - RNA, 19 nt, Human
ggacuaugaaaagcuagaa

SEQ ID NO: 1354904 - RNA, 23 nt, Human
ggacuauauuugggccugcucca

SEQ ID NO: 1354905 - RNA, 14 nt, Human
ggacguuguuuugg

SEQ ID NO: 1354906 - RNA, 12 nt, Human
ggacuaaaagau

SEQ ID NO: 1354907 - RNA, 14 nt, Human
ggacuaaaagauau

SEQ ID NO: 1354908 - RNA, 19 nt, Human
ggacuaaaagauauaagug

SEQ ID NO: 1354909 - RNA, 19 nt, Human
ggacguggcucagccagca

SEQ ID NO: 1354910 - RNA, 23 nt, Human
ggacuaacacucagaagccuggg

SEQ ID NO: 1354911 - RNA, 22 nt, Human
ggacuaacacucagaagccugg

SEQ ID NO: 1354912 - RNA, 21 nt, Human
ggacuaacacucagaagccug

SEQ ID NO: 1354913 - RNA, 20 nt, Human
ggacuaacacucagaagccu

SEQ ID NO: 1354914 - RNA, 19 nt, Human
ggacuaacacucagaagcc

SEQ ID NO: 1354915 - RNA, 18 nt, Human
ggacuaacacucagaagc

SEQ ID NO: 1354916 - RNA, 15 nt, Human
ggacuugaacccagg

SEQ ID NO: 1354917 - RNA, 20 nt, Human
ggacuuuauagaucagccag

SEQ ID NO: 1354918 - RNA, 19 nt, Human
ggacuugcaaaaaggguca

SEQ ID NO: 1354919 - RNA, 22 nt, Human
ggacuccaggcccaaggcuccc

SEQ ID NO: 1354920 - RNA, 23 nt, Human
ggacuccaggcccaaggcucccg

SEQ ID NO: 1354921 - RNA, 17 nt, Human
ggacuuugcagccggca

SEQ ID NO: 1354922 - RNA, 16 nt, Human
ggacuuugcagccggc

SEQ ID NO: 1354923 - RNA, 22 nt, Human
ggacuuugcagccggcacaggg

SEQ ID NO: 1354924 - RNA, 16 nt, Human
ggagaaagggcccugg

SEQ ID NO: 1354925 - RNA, 23 nt, Human
ggagaaagcugacuuggcuggug

SEQ ID NO: 1354926 - RNA, 22 nt, Human
ggagaaagcugacuuggcuggu

SEQ ID NO: 1354927 - RNA, 15 nt, Human
ggagaaagcugacuu

SEQ ID NO: 1354928 - RNA, 14 nt, Human
ggagaaagcugacu

SEQ ID NO: 1354929 - RNA, 22 nt, Human
ggagaaaucuggcuucuggcca

SEQ ID NO: 1354930 - RNA, 18 nt, Human
ggagaaaugaaaaaauau

SEQ ID NO: 1354931 - RNA, 20 nt, Human
ggacaggauguguuugcuuu

SEQ ID NO: 1354932 - RNA, 19 nt, Human
ggacaggacuaacacucag

SEQ ID NO: 1354933 - RNA, 18 nt, Human
ggacaggauguguuugcu

SEQ ID NO: 1354934 - RNA, 17 nt, Human
ggacaggauguguuugc

SEQ ID NO: 1354935 - RNA, 12 nt, Human
ggacagcuugug

SEQ ID NO: 1354936 - RNA, 15 nt, Human
ggacaggauccaggc

SEQ ID NO: 1354937 - RNA, 18 nt, Human
gccugcccccaccccauu

SEQ ID NO: 1354938 - RNA, 19 nt, Human
gccugcccccaccccauuc

SEQ ID NO: 1354939 - RNA, 12 nt, Human
gccugcccccac

SEQ ID NO: 1354940 - RNA, 19 nt, Human
gccugcccaguugcacuca

SEQ ID NO: 1354941 - RNA, 16 nt, Human
gccugaaagaggcuga

SEQ ID NO: 1354942 - RNA, 23 nt, Human
gccucuuucaagcagucgugccu

SEQ ID NO: 1354943 - RNA, 21 nt, Human
gccucuuccagucuuccugac

SEQ ID NO: 1354944 - RNA, 13 nt, Human
gccucuucccucu

SEQ ID NO: 1354945 - RNA, 24 nt, Human
gccuccuuccucuuuuccuuccca

SEQ ID NO: 1354946 - RNA, 19 nt, Human
gccucuuaaauaaaccuuu

SEQ ID NO: 1354947 - RNA, 14 nt, Human
gccuccuuccucuu

SEQ ID NO: 1354948 - RNA, 13 nt, Human
gccuccuuccucu

SEQ ID NO: 1354949 - RNA, 15 nt, Human
gccucuuagaugcag

SEQ ID NO: 1354950 - RNA, 15 nt, Human
gccuccauccaaggc

SEQ ID NO: 1354951 - RNA, 23 nt, Human
gccuccauccuacccccugugcc

SEQ ID NO: 1354952 - RNA, 19 nt, Human
gccuccaugggccccaggg

SEQ ID NO: 1354953 - RNA, 15 nt, Human
gccuccaugggcccc

SEQ ID NO: 1354954 - RNA, 13 nt, Human
gccuccaugggcc

SEQ ID NO: 1354955 - RNA, 16 nt, Human
gccuccauccaaggcc

SEQ ID NO: 1354956 - RNA, 16 nt, Human
gccucccaaagugcug

SEQ ID NO: 1354957 - RNA, 13 nt, Human
gccucccaaagug

SEQ ID NO: 1354958 - RNA, 19 nt, Human
gccuccuuagaaaaaaaau

SEQ ID NO: 1354959 - RNA, 18 nt, Human
gccuugcggcuccucagg

SEQ ID NO: 1354960 - RNA, 20 nt, Human
gccuugcggcuccucaggga

SEQ ID NO: 1354961 - RNA, 17 nt, Human
gccuugcggcuccucag

SEQ ID NO: 1354962 - RNA, 16 nt, Human
gccuugcggcuccuca

SEQ ID NO: 1354963 - RNA, 17 nt, Human
gccuugccagagaucca

SEQ ID NO: 1354964 - RNA, 14 nt, Human
gccuugccagagau

SEQ ID NO: 1354965 - RNA, 18 nt, Human
gcgaggaggcuccagagg

SEQ ID NO: 1354966 - RNA, 17 nt, Human
gcgaggaggcuccagag

SEQ ID NO: 1354967 - RNA, 16 nt, Human
gcgaggaggcuccaga

SEQ ID NO: 1354968 - RNA, 15 nt, Human
gcgaggaggcuccag

SEQ ID NO: 1354969 - RNA, 20 nt, Human
gcgaggagaugcuccuuggg

SEQ ID NO: 1354970 - RNA, 19 nt, Human
gcgaggagaugcuccuugg

SEQ ID NO: 1354971 - RNA, 13 nt, Human
gcgagccugcuag

SEQ ID NO: 1354972 - RNA, 22 nt, Human
gcgcacugugacccccagcucc

SEQ ID NO: 1354973 - RNA, 19 nt, Human
gcgauucccucucccaggc

SEQ ID NO: 1354974 - RNA, 18 nt, Human
gcgauucccucucccagg

SEQ ID NO: 1354975 - RNA, 14 nt, Human
gcgauucccucucc

SEQ ID NO: 1354976 - RNA, 22 nt, Human
gcgauguggaacugcugccacu

SEQ ID NO: 1354977 - RNA, 23 nt, Human
gcgauguggaacugcugccacug

SEQ ID NO: 1354978 - RNA, 21 nt, Human
gcgauguggaacugcugccac

SEQ ID NO: 1354979 - RNA, 20 nt, Human
gcgauguggaacugcugcca

SEQ ID NO: 1354980 - RNA, 19 nt, Human
gcgauguggaacugcugcc

SEQ ID NO: 1354981 - RNA, 13 nt, Human
gcgauguggaacu

SEQ ID NO: 1354982 - RNA, 14 nt, Human
gcgaugccagccaa

SEQ ID NO: 1354983 - RNA, 13 nt, Human
gcgaugccagcca

SEQ ID NO: 1354984 - RNA, 12 nt, Human
gcgagccugcua

SEQ ID NO: 1354985 - RNA, 17 nt, Human
gcgaucucggcucacug

SEQ ID NO: 1354986 - RNA, 14 nt, Human
gcgaucucagcuca

SEQ ID NO: 1354987 - RNA, 21 nt, Human
gccuguguagcugugaccugc

SEQ ID NO: 1354988 - RNA, 20 nt, Human
gccuguguagcugugaccug

SEQ ID NO: 1354989 - RNA, 16 nt, Human
gccuguguagcuguga

SEQ ID NO: 1354990 - RNA, 15 nt, Human
gccuguguagcugug

SEQ ID NO: 1354991 - RNA, 14 nt, Human
gccuguguccaugc

SEQ ID NO: 1354992 - RNA, 12 nt, Human
gccuguguccau

SEQ ID NO: 1354993 - RNA, 19 nt, Human
gccuguguccaugcgcuca

SEQ ID NO: 1354994 - RNA, 22 nt, Human
gccuguguagcugugaccugcu

SEQ ID NO: 1354995 - RNA, 21 nt, Human
gccugugguucugagauggcu

SEQ ID NO: 1354996 - RNA, 16 nt, Human
gccugugguucugaga

SEQ ID NO: 1354997 - RNA, 12 nt, Human
gccugugguucu

SEQ ID NO: 1354998 - RNA, 23 nt, Human
gccuguggcgccgucuccagggg

SEQ ID NO: 1354999 - RNA, 21 nt, Human
gccuguggcgccgucuccagg

SEQ ID NO: 1355000 - RNA, 19 nt, Human
gccugugccuccucacccc

SEQ ID NO: 1355001 - RNA, 22 nt, Human
gccugugccaggugaggucagc

SEQ ID NO: 1355002 - RNA, 19 nt, Human
gccugugccaggugagguc

SEQ ID NO: 1355003 - RNA, 19 nt, Human
gccuguggcgccgucucca

SEQ ID NO: 1355004 - RNA, 15 nt, Human
gccugugccagguga

SEQ ID NO: 1355005 - RNA, 14 nt, Human
gccugugccaggug

SEQ ID NO: 1355006 - RNA, 13 nt, Human
gccuggccuggcc

SEQ ID NO: 1355007 - RNA, 23 nt, Human
gccuagugaaggcuucucucugu

SEQ ID NO: 1355008 - RNA, 22 nt, Human
gccuagugaaggcuucucucug

SEQ ID NO: 1355009 - RNA, 19 nt, Human
gccuagugaaggcuucucu

SEQ ID NO: 1355010 - RNA, 14 nt, Human
gccuaggcugcauu

SEQ ID NO: 1355011 - RNA, 17 nt, Human
gccuaggccuaguccug

SEQ ID NO: 1355012 - RNA, 16 nt, Human
gccuaggauucuaaaa

SEQ ID NO: 1355013 - RNA, 15 nt, Human
gccuaggauucuaaa

SEQ ID NO: 1355014 - RNA, 14 nt, Human
gccuaggauucuaa

SEQ ID NO: 1355015 - RNA, 13 nt, Human
gccuaggauucua

SEQ ID NO: 1355016 - RNA, 12 nt, Human
gccuaggauucu

SEQ ID NO: 1355017 - RNA, 16 nt, Human
gccuaggaggguccuc

SEQ ID NO: 1355018 - RNA, 15 nt, Human
gccuaggaggguccu

SEQ ID NO: 1355019 - RNA, 12 nt, Human
gccuaggcugca

SEQ ID NO: 1355020 - RNA, 19 nt, Human
gccuaggccugggcagugg

SEQ ID NO: 1355021 - RNA, 17 nt, Human
gccuaggccugggcagu

SEQ ID NO: 1355022 - RNA, 16 nt, Human
gccuaggccugggcag

SEQ ID NO: 1355023 - RNA, 12 nt, Human
gccuaggccugg

SEQ ID NO: 1355024 - RNA, 13 nt, Human
gccgccgccucuu

SEQ ID NO: 1355025 - RNA, 20 nt, Human
gccuagcauacguacacauu

SEQ ID NO: 1355026 - RNA, 21 nt, Human
gccuagcauacguacacauuu

SEQ ID NO: 1355027 - RNA, 22 nt, Human
gccuagcauacguacacauuuu

SEQ ID NO: 1355028 - RNA, 23 nt, Human
gccuagcauacguacacauuuua

SEQ ID NO: 1355029 - RNA, 18 nt, Human
gccgcccugcgggugaac

SEQ ID NO: 1355030 - RNA, 23 nt, Human
gccgcccccugccccccagccuc

SEQ ID NO: 1355031 - RNA, 17 nt, Human
gccgcccccugcccccc

SEQ ID NO: 1355032 - RNA, 20 nt, Human
gcccugugccccuugacaac

SEQ ID NO: 1355033 - RNA, 19 nt, Human
gcccugugaggcugggucc

SEQ ID NO: 1355034 - RNA, 22 nt, Human
gcccuguccuggugguauuuuc

SEQ ID NO: 1355035 - RNA, 17 nt, Human
gcccuguccugguggua

SEQ ID NO: 1355036 - RNA, 13 nt, Human
gcccuguccuggu

SEQ ID NO: 1355037 - RNA, 22 nt, Human
gcccugugccccuugacaacug

SEQ ID NO: 1355038 - RNA, 21 nt, Human
gcccugugcaaccucuuggcc

SEQ ID NO: 1355039 - RNA, 13 nt, Human
gcccugcccugcc

SEQ ID NO: 1355040 - RNA, 17 nt, Human
gcccugcccugccaccu

SEQ ID NO: 1355041 - RNA, 13 nt, Human
gcccugccaccug

SEQ ID NO: 1355042 - RNA, 14 nt, Human
gcccugccaccugu

SEQ ID NO: 1355043 - RNA, 15 nt, Human
gcccugccaccuguc

SEQ ID NO: 1355044 - RNA, 16 nt, Human
gcccugccaccugucu

SEQ ID NO: 1355045 - RNA, 17 nt, Human
gcccugccaccugucug

SEQ ID NO: 1355046 - RNA, 14 nt, Human
gcccucacccgccc

SEQ ID NO: 1355047 - RNA, 16 nt, Human
gcccucacacacccug

SEQ ID NO: 1355048 - RNA, 14 nt, Human
gcccucaagucuuu

SEQ ID NO: 1355049 - RNA, 23 nt, Human
gcccucaagacccuuuuggguuu

SEQ ID NO: 1355050 - RNA, 21 nt, Human
gcccuaagcagaaagugccuu

SEQ ID NO: 1355051 - RNA, 18 nt, Human
gcccuaagcagaaagugc

SEQ ID NO: 1355052 - RNA, 17 nt, Human
gcccuaagcagaaagug

SEQ ID NO: 1355053 - RNA, 16 nt, Human
gcccuaagcagaaagu

SEQ ID NO: 1355054 - RNA, 15 nt, Human
gcccuaagcagaaag

SEQ ID NO: 1355055 - RNA, 12 nt, Human
gcccuaagcaga

SEQ ID NO: 1355056 - RNA, 14 nt, Human
gcccguccugccug

SEQ ID NO: 1355057 - RNA, 13 nt, Human
gcccguccugccu

SEQ ID NO: 1355058 - RNA, 17 nt, Human
gcccgguaagagcaaaa

SEQ ID NO: 1355059 - RNA, 21 nt, Human
gccccugccauuguagcgucu

SEQ ID NO: 1355060 - RNA, 14 nt, Human
gcccccacccuguu

SEQ ID NO: 1355061 - RNA, 20 nt, Human
gccccugccucucugcaggu

SEQ ID NO: 1355062 - RNA, 23 nt, Human
gccccugccucucugcagguccc

SEQ ID NO: 1355063 - RNA, 23 nt, Human
gccccugccaccuccugccucag

SEQ ID NO: 1355064 - RNA, 16 nt, Human
gccccccagccucugg

SEQ ID NO: 1355065 - RNA, 19 nt, Human
gcccccacugccuuugacc

SEQ ID NO: 1355066 - RNA, 22 nt, Human
gcccccaccgugggcagggagc

SEQ ID NO: 1355067 - RNA, 20 nt, Human
gcccccaccgugggcaggga

SEQ ID NO: 1355068 - RNA, 18 nt, Human
gcccccaccgugggcagg

SEQ ID NO: 1355069 - RNA, 17 nt, Human
gcccccaccgugggcag

SEQ ID NO: 1355070 - RNA, 23 nt, Human
gcccccacccuguuccugcugcu

SEQ ID NO: 1355071 - RNA, 22 nt, Human
gcccccacccuguuccugcugc

SEQ ID NO: 1355072 - RNA, 18 nt, Human
gcccccacccuguuccug

SEQ ID NO: 1355073 - RNA, 17 nt, Human
gcccccacugaccagaa

SEQ ID NO: 1355074 - RNA, 12 nt, Human
gcccccacugac

SEQ ID NO: 1355075 - RNA, 16 nt, Human
gcccccaccuggcuca

SEQ ID NO: 1355076 - RNA, 16 nt, Human
gcuaauucuacucaca

SEQ ID NO: 1355077 - RNA, 22 nt, Human
gcuaauucaaggaauuucuuaa

SEQ ID NO: 1355078 - RNA, 17 nt, Human
gcuaauucaaggaauuu

SEQ ID NO: 1355079 - RNA, 15 nt, Human
gcuaauaacugaucu

SEQ ID NO: 1355080 - RNA, 23 nt, Human
gcuaauauuuuccuccugagugc

SEQ ID NO: 1355081 - RNA, 17 nt, Human
gcuaaaauaaagaaaua

SEQ ID NO: 1355082 - RNA, 16 nt, Human
gcuaaaagaaacuuuc

SEQ ID NO: 1355083 - RNA, 15 nt, Human
gcuaaaagaaacuuu

SEQ ID NO: 1355084 - RNA, 12 nt, Human
gcuaaaagaaac

SEQ ID NO: 1355085 - RNA, 17 nt, Human
gcuaaaacaaugaauaa

SEQ ID NO: 1355086 - RNA, 21 nt, Human
gcuaauaaaaagcuuuugucu

SEQ ID NO: 1355087 - RNA, 13 nt, Human
gcuaagugugaac

SEQ ID NO: 1355088 - RNA, 17 nt, Human
gcgugguggucccuggg

SEQ ID NO: 1355089 - RNA, 15 nt, Human
gcgugugcaggagcg

SEQ ID NO: 1355090 - RNA, 17 nt, Human
gcgugucaccugugcuu

SEQ ID NO: 1355091 - RNA, 18 nt, Human
gcgugguggucccugggu

SEQ ID NO: 1355092 - RNA, 16 nt, Human
gcgggauggggcuccc

SEQ ID NO: 1355093 - RNA, 11 nt, Human
gcgugcagaug

SEQ ID NO: 1355094 - RNA, 22 nt, Human
gcguuugaccuuuuauguagua

SEQ ID NO: 1355095 - RNA, 19 nt, Human
gcguuuuuuaaauguauac

SEQ ID NO: 1355096 - RNA, 18 nt, Human
gcguuucuaugacacaug

SEQ ID NO: 1355097 - RNA, 22 nt, Human
gcuacucugugccagagccugg

SEQ ID NO: 1355098 - RNA, 23 nt, Human
gcuacucugugccagagccuggg

SEQ ID NO: 1355099 - RNA, 21 nt, Human
gcuacucugugccagagccug

SEQ ID NO: 1355100 - RNA, 20 nt, Human
gcuacucugugccagagccu

SEQ ID NO: 1355101 - RNA, 19 nt, Human
gcuacucugugccagagcc

SEQ ID NO: 1355102 - RNA, 18 nt, Human
gcuacucugugccagagc

SEQ ID NO: 1355103 - RNA, 17 nt, Human
gcuacucugugccagag

SEQ ID NO: 1355104 - RNA, 16 nt, Human
gcuacucugugccaga

SEQ ID NO: 1355105 - RNA, 15 nt, Human
gcuacucugugccag

SEQ ID NO: 1355106 - RNA, 14 nt, Human
gcuacucugugcca

SEQ ID NO: 1355107 - RNA, 13 nt, Human
gcuacucugugcc

SEQ ID NO: 1355108 - RNA, 23 nt, Human
gcuacucuccccacgagggcugg

SEQ ID NO: 1355109 - RNA, 22 nt, Human
gcuacucuccccacgagggcug

SEQ ID NO: 1355110 - RNA, 21 nt, Human
gcuacucuaguauuccagacc

SEQ ID NO: 1355111 - RNA, 20 nt, Human
gcuacucuaguauuccagac

SEQ ID NO: 1355112 - RNA, 19 nt, Human
gcuacucuaguauuccaga

SEQ ID NO: 1355113 - RNA, 20 nt, Human
gcucaggacagaugccacac

SEQ ID NO: 1355114 - RNA, 17 nt, Human
gcucaggacagaugcca

SEQ ID NO: 1355115 - RNA, 21 nt, Human
gcucaggaaccgaggcaggga

SEQ ID NO: 1355116 - RNA, 20 nt, Human
gcucaggaaccgaggcaggg

SEQ ID NO: 1355117 - RNA, 19 nt, Human
gcucaggaaccgaggcagg

SEQ ID NO: 1355118 - RNA, 16 nt, Human
gcucaggaaccgaggc

SEQ ID NO: 1355119 - RNA, 19 nt, Human
gcucacugaccugccugua

SEQ ID NO: 1355120 - RNA, 19 nt, Human
gcucagggccaugcugagg

SEQ ID NO: 1355121 - RNA, 22 nt, Human
gcucaggcaggggccuccaugg

SEQ ID NO: 1355122 - RNA, 24 nt, Human
gcucaggcaggggccuccaugggc

SEQ ID NO: 1355123 - RNA, 19 nt, Human
gcucaggcaggggccucca

SEQ ID NO: 1355124 - RNA, 16 nt, Human
gcucaggcaggggccu

SEQ ID NO: 1355125 - RNA, 12 nt, Human
gcucaggcaggg

SEQ ID NO: 1355126 - RNA, 20 nt, Human
gcucaggaugagggaaaaga

SEQ ID NO: 1355127 - RNA, 18 nt, Human
gcucagggaccauggcuu

SEQ ID NO: 1355128 - RNA, 20 nt, Human
gcucagggccaugcugaggc

SEQ ID NO: 1355129 - RNA, 20 nt, Human
gcucacucagccacccugag

SEQ ID NO: 1355130 - RNA, 15 nt, Human
gcucacucagccacc

SEQ ID NO: 1355131 - RNA, 14 nt, Human
gcucacucagcacu

SEQ ID NO: 1355132 - RNA, 13 nt, Human
gcuauuuuucuaa

SEQ ID NO: 1355133 - RNA, 21 nt, Human
gcuauuuuucuaacuacaaag

SEQ ID NO: 1355134 - RNA, 13 nt, Human
gcuauuuugugaa

SEQ ID NO: 1355135 - RNA, 24 nt, Human
gcuauuuuccaggcuucugcuggg

SEQ ID NO: 1355136 - RNA, 15 nt, Human
gcuauuuuccaggcu

SEQ ID NO: 1355137 - RNA, 13 nt, Human
gcuauuuuccagg

SEQ ID NO: 1355138 - RNA, 23 nt, Human
gcuauuuuauauuacacuacaca

SEQ ID NO: 1355139 - RNA, 18 nt, Human
gcuauuuuauauuacacu

SEQ ID NO: 1355140 - RNA, 19 nt, Human
gcuauuuguaaaucugcca

SEQ ID NO: 1355141 - RNA, 14 nt, Human
gcuauuugucaucu

SEQ ID NO: 1355142 - RNA, 17 nt, Human
gcuauuuguaaaucugc

SEQ ID NO: 1355143 - RNA, 15 nt, Human
gcuauuuguaaaucu

SEQ ID NO: 1355144 - RNA, 17 nt, Human
gcuauuugauguaauac

SEQ ID NO: 1355145 - RNA, 19 nt, Human
gcuauuugauguaauacuu

SEQ ID NO: 1355146 - RNA, 15 nt, Human
gcuauuugauguaau

SEQ ID NO: 1355147 - RNA, 14 nt, Human
gcuauuugaagugu

SEQ ID NO: 1355148 - RNA, 16 nt, Human
gcuauucugucccuag

SEQ ID NO: 1355149 - RNA, 19 nt, Human
gcuauucugucccuaggug

SEQ ID NO: 1355150 - RNA, 14 nt, Human
gcuauucugucccu

SEQ ID NO: 1355151 - RNA, 19 nt, Human
gcuauuccagcuguccccc

SEQ ID NO: 1355152 - RNA, 23 nt, Human
gcucacucaucaauggggccagu

SEQ ID NO: 1355153 - RNA, 20 nt, Human
gcucacugcaaccucugccu

SEQ ID NO: 1355154 - RNA, 21 nt, Human
gcuagugacuugugucccaug

SEQ ID NO: 1355155 - RNA, 12 nt, Human
gcuaugcauuug

SEQ ID NO: 1355156 - RNA, 22 nt, Human
gcuagucuuuugcuuuugccca

SEQ ID NO: 1355157 - RNA, 14 nt, Human
gcuagugacuugug

SEQ ID NO: 1355158 - RNA, 16 nt, Human
gcuaugcucaggggcc

SEQ ID NO: 1355159 - RNA, 20 nt, Human
gcuaugcucaggggcccugg

SEQ ID NO: 1355160 - RNA, 13 nt, Human
gcuaugcauuuga

SEQ ID NO: 1355161 - RNA, 17 nt, Human
gcuagucuuuugcuuuu

SEQ ID NO: 1355162 - RNA, 15 nt, Human
gcuagucuuuugcuu

SEQ ID NO: 1355163 - RNA, 12 nt, Human
gcuagucuuuug

SEQ ID NO: 1355164 - RNA, 15 nt, Human
gcucuaacagcccuc

SEQ ID NO: 1355165 - RNA, 22 nt, Human
gcucguggacugagugggaagc

SEQ ID NO: 1355166 - RNA, 19 nt, Human
gcucguccccaagugaccu

SEQ ID NO: 1355167 - RNA, 21 nt, Human
gcucggggugcacaggagggg

SEQ ID NO: 1355168 - RNA, 20 nt, Human
gcucggggugcacaggaggg

SEQ ID NO: 1355169 - RNA, 19 nt, Human
gcucggggugcacaggagg

SEQ ID NO: 1355170 - RNA, 18 nt, Human
gcucggggugcacaggag

SEQ ID NO: 1355171 - RNA, 17 nt, Human
gcucuaacgccugagcc

SEQ ID NO: 1355172 - RNA, 16 nt, Human
gcucuaacgccugagc

SEQ ID NO: 1355173 - RNA, 15 nt, Human
gcucuaacgccugag

SEQ ID NO: 1355174 - RNA, 14 nt, Human
gcucuaacgccuga

SEQ ID NO: 1355175 - RNA, 13 nt, Human
gcucuaacgccug

SEQ ID NO: 1355176 - RNA, 22 nt, Human
gcucugaguaccccugcuuugg

SEQ ID NO: 1355177 - RNA, 17 nt, Human
gcucugagggaaagggc

SEQ ID NO: 1355178 - RNA, 13 nt, Human
gcucugagggaaa

SEQ ID NO: 1355179 - RNA, 11 nt, Human
gcucugaggga

SEQ ID NO: 1355180 - RNA, 20 nt, Human
gcucugaggcgccccaaccc

SEQ ID NO: 1355181 - RNA, 23 nt, Human
gcucugaggcgccccaacccgug

SEQ ID NO: 1355182 - RNA, 10 nt, Human
gcucugaggc

SEQ ID NO: 1355183 - RNA, 9 nt, Human
gcucugagg

SEQ ID NO: 1355184 - RNA, 14 nt, Human
gcucugagcuguca

SEQ ID NO: 1355185 - RNA, 13 nt, Human
gcucugagcuguc

SEQ ID NO: 1355186 - RNA, 12 nt, Human
gcucugagcugu

SEQ ID NO: 1355187 - RNA, 18 nt, Human
gcucugagcgccuccauc

SEQ ID NO: 1355188 - RNA, 17 nt, Human
gcucugagcgccuccau

SEQ ID NO: 1355189 - RNA, 14 nt, Human
gcucugagcgccuc

SEQ ID NO: 1355190 - RNA, 17 nt, Human
gcucugcaauuccccuc

SEQ ID NO: 1355191 - RNA, 20 nt, Human
gcucugaugcaucagaaagg

SEQ ID NO: 1355192 - RNA, 19 nt, Human
gcucugaugcaucagaaag

SEQ ID NO: 1355193 - RNA, 16 nt, Human
gcucugaugcaucaga

SEQ ID NO: 1355194 - RNA, 11 nt, Human
gcucugaugca

SEQ ID NO: 1355195 - RNA, 23 nt, Human
gcucugaugaaaaauugcugacu

SEQ ID NO: 1355196 - RNA, 13 nt, Human
gcucugaugaaaa

SEQ ID NO: 1355197 - RNA, 23 nt, Human
gcucugaucccucuacagagcuu

SEQ ID NO: 1355198 - RNA, 22 nt, Human
gcucugaucccucuacagagcu

SEQ ID NO: 1355199 - RNA, 13 nt, Human
gcucugaucccuc

SEQ ID NO: 1355200 - RNA, 20 nt, Human
gcuccugcacuuacuugcuu

SEQ ID NO: 1355201 - RNA, 12 nt, Human
gcuccugcacuu

SEQ ID NO: 1355202 - RNA, 19 nt, Human
gcuccuggcccagccuuug

SEQ ID NO: 1355203 - RNA, 17 nt, Human
gcuccuggcccagccuu

SEQ ID NO: 1355204 - RNA, 16 nt, Human
gcuccuggcccagccu

SEQ ID NO: 1355205 - RNA, 15 nt, Human
gcuccuggcccagcc

SEQ ID NO: 1355206 - RNA, 19 nt, Human
gcuccuggaccccccuuuc

SEQ ID NO: 1355207 - RNA, 11 nt, Human
gcuccuggacc

SEQ ID NO: 1355208 - RNA, 11 nt, Human
gcuccugcagc

SEQ ID NO: 1355209 - RNA, 16 nt, Human
gcucccaggaccacag

SEQ ID NO: 1355210 - RNA, 16 nt, Human
gcucccaccuccugac

SEQ ID NO: 1355211 - RNA, 22 nt, Human
gcucccaccuccugacacccuu

SEQ ID NO: 1355212 - RNA, 15 nt, Human
gcucccaccuccuga

SEQ ID NO: 1355213 - RNA, 22 nt, Human
gcucccacagucccaucugcuu

SEQ ID NO: 1355214 - RNA, 21 nt, Human
gcuccccccagcccccuaaga

SEQ ID NO: 1355215 - RNA, 22 nt, Human
gcucccccagcaaagcccccag

SEQ ID NO: 1355216 - RNA, 14 nt, Human
gcuccccauguguc

SEQ ID NO: 1355217 - RNA, 12 nt, Human
gcuccccaugug

SEQ ID NO: 1355218 - RNA, 23 nt, Human
gcuccacucugcuucucugacuu

SEQ ID NO: 1355219 - RNA, 19 nt, Human
gcuccacccuggccgaguc

SEQ ID NO: 1355220 - RNA, 16 nt, Human
gcuccacccuggccga

SEQ ID NO: 1355221 - RNA, 16 nt, Human
gcuccacucugcuucu

SEQ ID NO: 1355222 - RNA, 15 nt, Human
gcuccacucugcuuc

SEQ ID NO: 1355223 - RNA, 13 nt, Human
gcuccacucugcu

SEQ ID NO: 1355224 - RNA, 19 nt, Human
gcuccaccuugcagcucuc

SEQ ID NO: 1355225 - RNA, 21 nt, Human
gcuccacucugcuucucugac

SEQ ID NO: 1355226 - RNA, 20 nt, Human
gcuccacucugcuucucuga

SEQ ID NO: 1355227 - RNA, 19 nt, Human
gcuccacucugcuucucug

SEQ ID NO: 1355228 - RNA, 17 nt, Human
gcuccacucugcuucuc

SEQ ID NO: 1355229 - RNA, 17 nt, Human
cuggaucagcguggccu

SEQ ID NO: 1355230 - RNA, 16 nt, Human
cuggaucagcguggcc

SEQ ID NO: 1355231 - RNA, 14 nt, Human
cuggaucagcgugg

SEQ ID NO: 1355232 - RNA, 13 nt, Human
cuggaucagcgug

SEQ ID NO: 1355233 - RNA, 15 nt, Human
cuggaucagaacagg

SEQ ID NO: 1355234 - RNA, 18 nt, Human
cuggauaacuuccacagg

SEQ ID NO: 1355235 - RNA, 22 nt, Human
cuggauaacuuccacagggucc

SEQ ID NO: 1355236 - RNA, 17 nt, Human
cuggauaacuuccacag

SEQ ID NO: 1355237 - RNA, 18 nt, Human
cuggauaguccgucucug

SEQ ID NO: 1355238 - RNA, 19 nt, Human
cuggauaguccgucucugc

SEQ ID NO: 1355239 - RNA, 18 nt, Human
cuggaguuucauguacaa

SEQ ID NO: 1355240 - RNA, 22 nt, Human
cuggaguuucauguacaagaug

SEQ ID NO: 1355241 - RNA, 13 nt, Human
cuggaguuucaug

SEQ ID NO: 1355242 - RNA, 14 nt, Human
cuggaagaugggga

SEQ ID NO: 1355243 - RNA, 13 nt, Human
cuggaagaugggg

SEQ ID NO: 1355244 - RNA, 18 nt, Human
cuggaagauccugcgggu

SEQ ID NO: 1355245 - RNA, 14 nt, Human
cuggaagauccugc

SEQ ID NO: 1355246 - RNA, 19 nt, Human
cuggaagauagcugugacu

SEQ ID NO: 1355247 - RNA, 16 nt, Human
cuggaagauagcugug

SEQ ID NO: 1355248 - RNA, 15 nt, Human
cuggaagauagcugu

SEQ ID NO: 1355249 - RNA, 16 nt, Human
cuggaagagcagcccu

SEQ ID NO: 1355250 - RNA, 23 nt, Human
cuggaagauggggaccagcagcc

SEQ ID NO: 1355251 - RNA, 21 nt, Human
cuggaagacgcaagggccuga

SEQ ID NO: 1355252 - RNA, 20 nt, Human
cuggaacuugaacugauuca

SEQ ID NO: 1355253 - RNA, 14 nt, Human
cuggaacuugggga

SEQ ID NO: 1355254 - RNA, 22 nt, Human
cuggaguugaucuggaacccag

SEQ ID NO: 1355255 - RNA, 20 nt, Human
cuggaguugaucuggaaccc

SEQ ID NO: 1355256 - RNA, 18 nt, Human
cuggacuuuccugcaacu

SEQ ID NO: 1355257 - RNA, 16 nt, Human
cuggacuuuccugcaa

SEQ ID NO: 1355258 - RNA, 15 nt, Human
cuggacuuuccugca

SEQ ID NO: 1355259 - RNA, 14 nt, Human
cuggacuuuccugc

SEQ ID NO: 1355260 - RNA, 17 nt, Human
cuggacuuggccccugc

SEQ ID NO: 1355261 - RNA, 18 nt, Human
cuggacuuggccccugcc

SEQ ID NO: 1355262 - RNA, 13 nt, Human
cuggacuuuccug

SEQ ID NO: 1355263 - RNA, 19 nt, Human
cuggacuuggccccugcca

SEQ ID NO: 1355264 - RNA, 13 nt, Human
cugcucauccacu

SEQ ID NO: 1355265 - RNA, 22 nt, Human
cugcucaucauucucugucuca

SEQ ID NO: 1355266 - RNA, 18 nt, Human
cugcucaucauucucugu

SEQ ID NO: 1355267 - RNA, 17 nt, Human
cugcucaucauucucug

SEQ ID NO: 1355268 - RNA, 16 nt, Human
cugcucaucauucucu

SEQ ID NO: 1355269 - RNA, 19 nt, Human
cugcucauauugugauucu

SEQ ID NO: 1355270 - RNA, 15 nt, Human
cugcucauauuguga

SEQ ID NO: 1355271 - RNA, 19 nt, Human
cugcucaguaaagcacuug

SEQ ID NO: 1355272 - RNA, 18 nt, Human
cugcucaguaaagcacuu

SEQ ID NO: 1355273 - RNA, 13 nt, Human
cugcugagaaccu

SEQ ID NO: 1355274 - RNA, 14 nt, Human
cugcugagaaccug

SEQ ID NO: 1355275 - RNA, 12 nt, Human
cugcugagaacc

SEQ ID NO: 1355276 - RNA, 16 nt, Human
cugcugaccugugcac

SEQ ID NO: 1355277 - RNA, 15 nt, Human
cugcugaccugugca

SEQ ID NO: 1355278 - RNA, 21 nt, Human
cugcugaccugcugaccugug

SEQ ID NO: 1355279 - RNA, 15 nt, Human
cugcugaccugcuga

SEQ ID NO: 1355280 - RNA, 14 nt, Human
cugcugaccugcug

SEQ ID NO: 1355281 - RNA, 13 nt, Human
cugcugaccugcu

SEQ ID NO: 1355282 - RNA, 21 nt, Human
cugcuaggccagagcccacuc

SEQ ID NO: 1355283 - RNA, 20 nt, Human
cugcuaggccagagcccacu

SEQ ID NO: 1355284 - RNA, 19 nt, Human
cugcuaggccagagcccac

SEQ ID NO: 1355285 - RNA, 18 nt, Human
cugcuaggccagagccca

SEQ ID NO: 1355286 - RNA, 16 nt, Human
cugcuaggccagagcc

SEQ ID NO: 1355287 - RNA, 17 nt, Human
cugcucaggaaacgaga

SEQ ID NO: 1355288 - RNA, 15 nt, Human
cugcuaggccagagc

SEQ ID NO: 1355289 - RNA, 12 nt, Human
cugcuaggccag

SEQ ID NO: 1355290 - RNA, 21 nt, Human
cugccucucccaggcaggggc

SEQ ID NO: 1355291 - RNA, 20 nt, Human
cugccuggugcccagcacau

SEQ ID NO: 1355292 - RNA, 20 nt, Human
cugccucucccaggcagggg

SEQ ID NO: 1355293 - RNA, 19 nt, Human
cugccucucccaggcaggg

SEQ ID NO: 1355294 - RNA, 18 nt, Human
cugccucucccaggcagg

SEQ ID NO: 1355295 - RNA, 21 nt, Human
cugccucccuuguggcagcaa

SEQ ID NO: 1355296 - RNA, 16 nt, Human
cugccucccuuguggc

SEQ ID NO: 1355297 - RNA, 15 nt, Human
cugccucccuucaug

SEQ ID NO: 1355298 - RNA, 17 nt, Human
cugccucccuucaugca

SEQ ID NO: 1355299 - RNA, 18 nt, Human
cugccucccuucaugcau

SEQ ID NO: 1355300 - RNA, 19 nt, Human
cugccucccuucaugcaug

SEQ ID NO: 1355301 - RNA, 21 nt, Human
cugccucccuucaugcaugga

SEQ ID NO: 1355302 - RNA, 23 nt, Human
cugccucccuucaugcauggaaa

SEQ ID NO: 1355303 - RNA, 21 nt, Human
cugaugaacucuuaaucaaau

SEQ ID NO: 1355304 - RNA, 20 nt, Human
cugaugaaaauaaagaaugg

SEQ ID NO: 1355305 - RNA, 19 nt, Human
cugaugaaaauaaagaaug

SEQ ID NO: 1355306 - RNA, 18 nt, Human
cugaugaaaauaaagaau

SEQ ID NO: 1355307 - RNA, 17 nt, Human
cugaugaaaauaaagaa

SEQ ID NO: 1355308 - RNA, 16 nt, Human
cugaugaaaauaaaga

SEQ ID NO: 1355309 - RNA, 14 nt, Human
cugaugaaaauaaa

SEQ ID NO: 1355310 - RNA, 13 nt, Human
cugaugaaaauaa

SEQ ID NO: 1355311 - RNA, 12 nt, Human
cugaugaaaaua

SEQ ID NO: 1355312 - RNA, 22 nt, Human
cugaugaaaaauugcugacugu

SEQ ID NO: 1355313 - RNA, 20 nt, Human
cugccuccccucuccuuccu

SEQ ID NO: 1355314 - RNA, 22 nt, Human
cugccuccccuuaaaggggaga

SEQ ID NO: 1355315 - RNA, 14 nt, Human
cugccucccuucau

SEQ ID NO: 1355316 - RNA, 17 nt, Human
cuggcagagaugccucc

SEQ ID NO: 1355317 - RNA, 14 nt, Human
cuggcagagaugcc

SEQ ID NO: 1355318 - RNA, 15 nt, Human
cuggcagccucccau

SEQ ID NO: 1355319 - RNA, 14 nt, Human
cuggcagccuccca

SEQ ID NO: 1355320 - RNA, 12 nt, Human
cuggcagccucc

SEQ ID NO: 1355321 - RNA, 23 nt, Human
cuggcagccacacuucucaggac

SEQ ID NO: 1355322 - RNA, 22 nt, Human
cuggcagccacacuucucagga

SEQ ID NO: 1355323 - RNA, 15 nt, Human
cuggcagccacacuu

SEQ ID NO: 1355324 - RNA, 14 nt, Human
cuggcagccacacu

SEQ ID NO: 1355325 - RNA, 12 nt, Human
cuggcagccaca

SEQ ID NO: 1355326 - RNA, 20 nt, Human
cuggcagagaugccucccug

SEQ ID NO: 1355327 - RNA, 18 nt, Human
cuggcagagaugccuccc

SEQ ID NO: 1355328 - RNA, 24 nt, Human
cuggccccucucccuugggcucug

SEQ ID NO: 1355329 - RNA, 15 nt, Human
cuggccccucucccu

SEQ ID NO: 1355330 - RNA, 14 nt, Human
cuggccccucuccc

SEQ ID NO: 1355331 - RNA, 13 nt, Human
cuggccccucucc

SEQ ID NO: 1355332 - RNA, 23 nt, Human
cuggcagccucccauccagggcc

SEQ ID NO: 1355333 - RNA, 22 nt, Human
cuggcagccucccauccagggc

SEQ ID NO: 1355334 - RNA, 20 nt, Human
cuggcagccucccauccagg

SEQ ID NO: 1355335 - RNA, 21 nt, Human
cuggcucugagcgccuccauc

SEQ ID NO: 1355336 - RNA, 20 nt, Human
cuggcucugagcgccuccau

SEQ ID NO: 1355337 - RNA, 13 nt, Human
cuggcucugagcg

SEQ ID NO: 1355338 - RNA, 12 nt, Human
cuggcucugagc

SEQ ID NO: 1355339 - RNA, 15 nt, Human
cuggcucuccuggcc

SEQ ID NO: 1355340 - RNA, 17 nt, Human
cuggcucuccuggcccu

SEQ ID NO: 1355341 - RNA, 13 nt, Human
cuggcucuccugg

SEQ ID NO: 1355342 - RNA, 22 nt, Human
cuggccuagaccagcagacaga

SEQ ID NO: 1355343 - RNA, 20 nt, Human
cuggccuagaccagcagaca

SEQ ID NO: 1355344 - RNA, 19 nt, Human
cuggccuagaccagcagac

SEQ ID NO: 1355345 - RNA, 14 nt, Human
cuggccuagcauac

SEQ ID NO: 1355346 - RNA, 24 nt, Human
cuggcucugagcgccuccauccaa

SEQ ID NO: 1355347 - RNA, 23 nt, Human
cugggaagucguccuuacuccug

SEQ ID NO: 1355348 - RNA, 13 nt, Human
cugggaauggagg

SEQ ID NO: 1355349 - RNA, 20 nt, Human
cugggaauggaggggcagag

SEQ ID NO: 1355350 - RNA, 23 nt, Human
cugggaauggaggggcagagcca

SEQ ID NO: 1355351 - RNA, 21 nt, Human
cugggacucagccuucagaca

SEQ ID NO: 1355352 - RNA, 18 nt, Human
cugggacucagccuucag

SEQ ID NO: 1355353 - RNA, 17 nt, Human
cugggacucagccuuca

SEQ ID NO: 1355354 - RNA, 16 nt, Human
cugggacucagccuuc

SEQ ID NO: 1355355 - RNA, 15 nt, Human
cugggacucagccuu

SEQ ID NO: 1355356 - RNA, 14 nt, Human
cugggacucagccu

SEQ ID NO: 1355357 - RNA, 22 nt, Human
cugggacaacugcucccaccuc

SEQ ID NO: 1355358 - RNA, 18 nt, Human
cugggacaacugcuccca

SEQ ID NO: 1355359 - RNA, 13 nt, Human
cugggacucagcc

SEQ ID NO: 1355360 - RNA, 23 nt, Human
cugggacuauaggcaugcgccac

SEQ ID NO: 1355361 - RNA, 18 nt, Human
cugggacuugcaaaaagg

SEQ ID NO: 1355362 - RNA, 17 nt, Human
cuggguggcucacucag

SEQ ID NO: 1355363 - RNA, 15 nt, Human
cuggguggcucacuc

SEQ ID NO: 1355364 - RNA, 22 nt, Human
cuggguggcuacucugugccag

SEQ ID NO: 1355365 - RNA, 21 nt, Human
cuggguggcuacucugugcca

SEQ ID NO: 1355366 - RNA, 20 nt, Human
cuggguggcuacucugugcc

SEQ ID NO: 1355367 - RNA, 19 nt, Human
cuggguggcuacucugugc

SEQ ID NO: 1355368 - RNA, 17 nt, Human
cuggguggcuacucugu

SEQ ID NO: 1355369 - RNA, 15 nt, Human
cuggguggcuacucu

SEQ ID NO: 1355370 - RNA, 21 nt, Human
cuggggcaggcugggccaugu

SEQ ID NO: 1355371 - RNA, 19 nt, Human
cuggggcaggcugggccau

SEQ ID NO: 1355372 - RNA, 18 nt, Human
cuggggcaggcugggcca

SEQ ID NO: 1355373 - RNA, 17 nt, Human
cuggggcaggcugggcc

SEQ ID NO: 1355374 - RNA, 16 nt, Human
cuggggcaggcugggc

SEQ ID NO: 1355375 - RNA, 15 nt, Human
cuggggccaggcugg

SEQ ID NO: 1355376 - RNA, 12 nt, Human
cuggggcucaga

SEQ ID NO: 1355377 - RNA, 18 nt, Human
cuggggcuagggggagcc

SEQ ID NO: 1355378 - RNA, 23 nt, Human
cuggggcucuaacgccugagccc

SEQ ID NO: 1355379 - RNA, 22 nt, Human
cuggggcucuaacgccugagcc

SEQ ID NO: 1355380 - RNA, 21 nt, Human
cuggggcucuaacgccugagc

SEQ ID NO: 1355381 - RNA, 20 nt, Human
cuggggcucuaacgccugag

SEQ ID NO: 1355382 - RNA, 19 nt, Human
cuggggcucuaacgccuga

SEQ ID NO: 1355383 - RNA, 16 nt, Human
cuggggcucagagccg

SEQ ID NO: 1355384 - RNA, 17 nt, Human
cuggggcucagagccgg

SEQ ID NO: 1355385 - RNA, 14 nt, Human
cuggggcucagagc

SEQ ID NO: 1355386 - RNA, 13 nt, Human
cuggggcucagag

SEQ ID NO: 1355387 - RNA, 20 nt, Human
cuggggcugaggcugaggca

SEQ ID NO: 1355388 - RNA, 11 nt, Human
cuggggagcag

SEQ ID NO: 1355389 - RNA, 19 nt, Human
cugggccaacucaccugag

SEQ ID NO: 1355390 - RNA, 14 nt, Human
cuggggagcggguc

SEQ ID NO: 1355391 - RNA, 22 nt, Human
cuggggagcgggucugcuccca

SEQ ID NO: 1355392 - RNA, 20 nt, Human
cuggggagcccgucucagug

SEQ ID NO: 1355393 - RNA, 15 nt, Human
cuggggagcccgucu

SEQ ID NO: 1355394 - RNA, 12 nt, Human
cuggggagcccg

SEQ ID NO: 1355395 - RNA, 21 nt, Human
cuggggagcaggcagccagca

SEQ ID NO: 1355396 - RNA, 17 nt, Human
cuggggagcaggcagcc

SEQ ID NO: 1355397 - RNA, 16 nt, Human
cuggggagcaggcagc

SEQ ID NO: 1355398 - RNA, 15 nt, Human
cuggggagcaggcag

SEQ ID NO: 1355399 - RNA, 15 nt, Human
cuggggcaggcuggg

SEQ ID NO: 1355400 - RNA, 14 nt, Human
cuggggcaggcugg

SEQ ID NO: 1355401 - RNA, 12 nt, Human
cuggggcaggcu

SEQ ID NO: 1355402 - RNA, 17 nt, Human
cugugaccucuccccug

SEQ ID NO: 1355403 - RNA, 21 nt, Human
cugugacccccagcuccggcc

SEQ ID NO: 1355404 - RNA, 18 nt, Human
cugugacccccagcuccg

SEQ ID NO: 1355405 - RNA, 17 nt, Human
cugugacccccagcucc

SEQ ID NO: 1355406 - RNA, 16 nt, Human
cugugacccccagcuc

SEQ ID NO: 1355407 - RNA, 15 nt, Human
cugugacccccagcu

SEQ ID NO: 1355408 - RNA, 13 nt, Human
cugugacccccag

SEQ ID NO: 1355409 - RNA, 22 nt, Human
cugugaccugcugagcucugag

SEQ ID NO: 1355410 - RNA, 21 nt, Human
cugugaccugcugagcucuga

SEQ ID NO: 1355411 - RNA, 20 nt, Human
cugugaccugcugagcucug

SEQ ID NO: 1355412 - RNA, 19 nt, Human
cugugaccugcugagcucu

SEQ ID NO: 1355413 - RNA, 18 nt, Human
cugugaccugcugagcuc

SEQ ID NO: 1355414 - RNA, 17 nt, Human
cugugaccugcugagcu

SEQ ID NO: 1355415 - RNA, 16 nt, Human
cugugaccugcugagc

SEQ ID NO: 1355416 - RNA, 15 nt, Human
cugugaccugcugag

SEQ ID NO: 1355417 - RNA, 14 nt, Human
cugugaccugcuga

SEQ ID NO: 1355418 - RNA, 15 nt, Human
cugugccugaauauu

SEQ ID NO: 1355419 - RNA, 20 nt, Human
cugugccuugucacgccaga

SEQ ID NO: 1355420 - RNA, 17 nt, Human
cugugcgcccagggcug

SEQ ID NO: 1355421 - RNA, 23 nt, Human
cugugccuuguuuuuuguuuguu

SEQ ID NO: 1355422 - RNA, 14 nt, Human
cugugucacccagg

SEQ ID NO: 1355423 - RNA, 14 nt, Human
cugugcgcccaggg

SEQ ID NO: 1355424 - RNA, 18 nt, Human
cuguuagucauuugcuga

SEQ ID NO: 1355425 - RNA, 15 nt, Human
cuguuagucauuugc

SEQ ID NO: 1355426 - RNA, 14 nt, Human
cuguuagucauuug

SEQ ID NO: 1355427 - RNA, 13 nt, Human
cuguuagucauuu

SEQ ID NO: 1355428 - RNA, 13 nt, Human
cugugucuaagau

SEQ ID NO: 1355429 - RNA, 12 nt, Human
cugugucuaaga

SEQ ID NO: 1355430 - RNA, 19 nt, Human
cuguuauaaucuuucacag

SEQ ID NO: 1355431 - RNA, 13 nt, Human
cuguuauaaucuu

SEQ ID NO: 1355432 - RNA, 17 nt, Human
cugucgcugcuucgugg

SEQ ID NO: 1355433 - RNA, 17 nt, Human
cugucggagcccugucu

SEQ ID NO: 1355434 - RNA, 14 nt, Human
cugucgcugcuucg

SEQ ID NO: 1355435 - RNA, 13 nt, Human
cugucgcugcuuc

SEQ ID NO: 1355436 - RNA, 23 nt, Human
cugucggagcccugucuccucuc

SEQ ID NO: 1355437 - RNA, 14 nt, Human
cuguccuguacauu

SEQ ID NO: 1355438 - RNA, 23 nt, Human
cuguccuggugguauuuucaaua

SEQ ID NO: 1355439 - RNA, 20 nt, Human
cuguccuggugguauuuuca

SEQ ID NO: 1355440 - RNA, 19 nt, Human
cuguccuggugguauuuuc

SEQ ID NO: 1355441 - RNA, 17 nt, Human
cuguccuggugguauuu

SEQ ID NO: 1355442 - RNA, 14 nt, Human
cuguccugguggua

SEQ ID NO: 1355443 - RNA, 16 nt, Human
cugucgcucucaguuc

SEQ ID NO: 1355444 - RNA, 15 nt, Human
cugucgcucucaguu

SEQ ID NO: 1355445 - RNA, 21 nt, Human
cuguccuggugguauuuucaa

SEQ ID NO: 1355446 - RNA, 22 nt, Human
cuguccuguacauugugggaug

SEQ ID NO: 1355447 - RNA, 18 nt, Human
cuguccugggccugcaga

SEQ ID NO: 1355448 - RNA, 14 nt, Human
cuguccugggccug

SEQ ID NO: 1355449 - RNA, 13 nt, Human
cuguccugggccu

SEQ ID NO: 1355450 - RNA, 21 nt, Human
cuguccucuuucagcuccuga

SEQ ID NO: 1355451 - RNA, 20 nt, Human
cuguccucuuucagcuccug

SEQ ID NO: 1355452 - RNA, 19 nt, Human
cuguccucuuucagcuccu

SEQ ID NO: 1355453 - RNA, 18 nt, Human
cuguccucuuucagcucc

SEQ ID NO: 1355454 - RNA, 17 nt, Human
cuguccucuuucagcuc

SEQ ID NO: 1355455 - RNA, 16 nt, Human
cuguccucuuucagcu

SEQ ID NO: 1355456 - RNA, 15 nt, Human
cuguccucuuucagc

SEQ ID NO: 1355457 - RNA, 13 nt, Human
cuguccucuuuca

SEQ ID NO: 1355458 - RNA, 21 nt, Human
cuguccucccgagcuccucuu

SEQ ID NO: 1355459 - RNA, 19 nt, Human
cuguccucccgagcuccuc

SEQ ID NO: 1355460 - RNA, 23 nt, Human
cugucauccucaaagaaagugua

SEQ ID NO: 1355461 - RNA, 22 nt, Human
cugucauccucaaagaaagugu

SEQ ID NO: 1355462 - RNA, 21 nt, Human
cugucauccucaaagaaagug

SEQ ID NO: 1355463 - RNA, 20 nt, Human
cugucauccucaaagaaagu

SEQ ID NO: 1355464 - RNA, 17 nt, Human
cugucauccagcucacu

SEQ ID NO: 1355465 - RNA, 21 nt, Human
cugucaucaucauggccagcu

SEQ ID NO: 1355466 - RNA, 20 nt, Human
cugucaucaucauggccagc

SEQ ID NO: 1355467 - RNA, 19 nt, Human
cugucaucaucauggccag

SEQ ID NO: 1355468 - RNA, 17 nt, Human
cugucaucaucauggcc

SEQ ID NO: 1355469 - RNA, 16 nt, Human
cugucaucaucauggc

SEQ ID NO: 1355470 - RNA, 23 nt, Human
cugucaucaauuaaaggcaaagg

SEQ ID NO: 1355471 - RNA, 16 nt, Human
cugucaucaauuaaag

SEQ ID NO: 1355472 - RNA, 22 nt, Human
cugucauaugcucugauuuauc

SEQ ID NO: 1355473 - RNA, 16 nt, Human
cugucauagaaauuac

SEQ ID NO: 1355474 - RNA, 14 nt, Human
cugucauagaaauu

SEQ ID NO: 1355475 - RNA, 19 nt, Human
cugucaguucuaaccuccu

SEQ ID NO: 1355476 - RNA, 15 nt, Human
cugucacaaccaaga

SEQ ID NO: 1355477 - RNA, 16 nt, Human
cugucacaaccaagaa

SEQ ID NO: 1355478 - RNA, 21 nt, Human
cugguuguuucuguuccaaau

SEQ ID NO: 1355479 - RNA, 14 nt, Human
cugguuuaauguuu

SEQ ID NO: 1355480 - RNA, 19 nt, Human
cugguuguuucuguuccaa

SEQ ID NO: 1355481 - RNA, 16 nt, Human
cugguuguuucuguuc

SEQ ID NO: 1355482 - RNA, 16 nt, Human
cugguuguuaugugau

SEQ ID NO: 1355483 - RNA, 13 nt, Human
cuguaaacugugu

SEQ ID NO: 1355484 - RNA, 12 nt, Human
cuguaaacugug

SEQ ID NO: 1355485 - RNA, 20 nt, Human
cuguaaacuguguauuccaa

SEQ ID NO: 1355486 - RNA, 14 nt, Human
cuguaaacugugua

SEQ ID NO: 1355487 - RNA, 18 nt, Human
cuguaaacuuuaucacuu

SEQ ID NO: 1355488 - RNA, 19 nt, Human
cuguaaacuuuaucacuua

SEQ ID NO: 1355489 - RNA, 20 nt, Human
cuggugaagcucacuucugg

SEQ ID NO: 1355490 - RNA, 20 nt, Human
cuggucuuguggaauuggga

SEQ ID NO: 1355491 - RNA, 18 nt, Human
cuggucuuguggaauugg

SEQ ID NO: 1355492 - RNA, 20 nt, Human
cuggugacaucagguuuuuc

SEQ ID NO: 1355493 - RNA, 15 nt, Human
cuggugaagcucacu

SEQ ID NO: 1355494 - RNA, 13 nt, Human
cuguaacugucac

SEQ ID NO: 1355495 - RNA, 16 nt, Human
cuguaacugccaggcu

SEQ ID NO: 1355496 - RNA, 15 nt, Human
cuguaacugccaggc

SEQ ID NO: 1355497 - RNA, 14 nt, Human
cuguaacugccagg

SEQ ID NO: 1355498 - RNA, 19 nt, Human
cuguaacuacuuuauaacu

SEQ ID NO: 1355499 - RNA, 17 nt, Human
cuguaacuacuuuauaa

SEQ ID NO: 1355500 - RNA, 16 nt, Human
cuguaacuacuuuaua

SEQ ID NO: 1355501 - RNA, 15 nt, Human
cuguaacauucagga

SEQ ID NO: 1355502 - RNA, 23 nt, Human
cuguaaccucuucagaggcccuc

SEQ ID NO: 1355503 - RNA, 22 nt, Human
cuguaaccucuucagaggcccu

SEQ ID NO: 1355504 - RNA, 20 nt, Human
cuguaaccucuucagaggcc

SEQ ID NO: 1355505 - RNA, 19 nt, Human
cuguaaccucuucagaggc

SEQ ID NO: 1355506 - RNA, 15 nt, Human
cuguaaccucuucag

SEQ ID NO: 1355507 - RNA, 19 nt, Human
cuguaacauacuggccugg

SEQ ID NO: 1355508 - RNA, 20 nt, Human
cuguacuguucugugucuuu

SEQ ID NO: 1355509 - RNA, 17 nt, Human
cuguacuguucuguguc

SEQ ID NO: 1355510 - RNA, 19 nt, Human
cuguacugccugcuugggg

SEQ ID NO: 1355511 - RNA, 18 nt, Human
cuguacugccugcuuggg

SEQ ID NO: 1355512 - RNA, 17 nt, Human
cuguacugccugcuugg

SEQ ID NO: 1355513 - RNA, 16 nt, Human
cuguacugccugcuug

SEQ ID NO: 1355514 - RNA, 15 nt, Human
cuguacugccugcuu

SEQ ID NO: 1355515 - RNA, 14 nt, Human
cuguacugccugcu

SEQ ID NO: 1355516 - RNA, 13 nt, Human
cuguacugccugc

SEQ ID NO: 1355517 - RNA, 12 nt, Human
cuguacugccug

SEQ ID NO: 1355518 - RNA, 18 nt, Human
cuguaguaggcauuuuua

SEQ ID NO: 1355519 - RNA, 22 nt, Human
cuguaguaggcauuuuuaccau

SEQ ID NO: 1355520 - RNA, 20 nt, Human
cuguaguaaauaaugcuuug

SEQ ID NO: 1355521 - RNA, 19 nt, Human
cuguaguaaauaaugcuuu

SEQ ID NO: 1355522 - RNA, 18 nt, Human
cuguaguaaauaaugcuu

SEQ ID NO: 1355523 - RNA, 22 nt, Human
cuguaguaaauaaugcuuugaa

SEQ ID NO: 1355524 - RNA, 17 nt, Human
cuguaguaaauaaugcu

SEQ ID NO: 1355525 - RNA, 20 nt, Human
cuguagguugcacacuuugg

SEQ ID NO: 1355526 - RNA, 22 nt, Human
cuguagguugcacacuuuggua

SEQ ID NO: 1355527 - RNA, 19 nt, Human
cuguagguugcacacuuug

SEQ ID NO: 1355528 - RNA, 17 nt, Human
cuguagguugcacacuu

SEQ ID NO: 1355529 - RNA, 24 nt, Human
cuguaggguaauuaguaacaugug

SEQ ID NO: 1355530 - RNA, 16 nt, Human
cuguagguugcacacu

SEQ ID NO: 1355531 - RNA, 15 nt, Human
cuguagguugcacac

SEQ ID NO: 1355532 - RNA, 18 nt, Human
cuguagaacucaaccucu

SEQ ID NO: 1355533 - RNA, 17 nt, Human
cuguagaaaugguugua

SEQ ID NO: 1355534 - RNA, 19 nt, Human
cuguagaaaugguuguauu

SEQ ID NO: 1355535 - RNA, 23 nt, Human
cuguagaaaaaaaaauucacaug

SEQ ID NO: 1355536 - RNA, 13 nt, Human
cuguagaaauggu

SEQ ID NO: 1355537 - RNA, 18 nt, Human
cuguagacggcucaguau

SEQ ID NO: 1355538 - RNA, 20 nt, Human
cuguagaaaugguuguauua

SEQ ID NO: 1355539 - RNA, 22 nt, Human
cuuacauuuacaaacugaagag

SEQ ID NO: 1355540 - RNA, 18 nt, Human
cuuacaagccuaagaauc

SEQ ID NO: 1355541 - RNA, 21 nt, Human
cuuaaaaauuaaauuggaaag

SEQ ID NO: 1355542 - RNA, 14 nt, Human
cuuacaaaugaaaa

SEQ ID NO: 1355543 - RNA, 16 nt, Human
cuuaaauaagaaacuu

SEQ ID NO: 1355544 - RNA, 13 nt, Human
cuuaaauaaugug

SEQ ID NO: 1355545 - RNA, 13 nt, Human
cuuaaauaagaaa

SEQ ID NO: 1355546 - RNA, 17 nt, Human
cuuaaauaagaaacuuu

SEQ ID NO: 1355547 - RNA, 12 nt, Human
cuguugggagag

SEQ ID NO: 1355548 - RNA, 22 nt, Human
cuguugggguggguauaaaaga

SEQ ID NO: 1355549 - RNA, 23 nt, Human
cuguugggguggguauaaaagau

SEQ ID NO: 1355550 - RNA, 18 nt, Human
cuguuuaaaaaaccacau

SEQ ID NO: 1355551 - RNA, 20 nt, Human
cuguuuaaaaaaccacaugg

SEQ ID NO: 1355552 - RNA, 16 nt, Human
cuguuuaaaaaaccac

SEQ ID NO: 1355553 - RNA, 15 nt, Human
cuguuguagaagaca

SEQ ID NO: 1355554 - RNA, 12 nt, Human
cuguuuaagaga

SEQ ID NO: 1355555 - RNA, 14 nt, Human
cuguuuaagagaca

SEQ ID NO: 1355556 - RNA, 16 nt, Human
cuguucaaagcugccu

SEQ ID NO: 1355557 - RNA, 15 nt, Human
cuuagggcaccaggg

SEQ ID NO: 1355558 - RNA, 21 nt, Human
cuuagggacagucaaaaccaa

SEQ ID NO: 1355559 - RNA, 23 nt, Human
cuuaggaagagccuuccacccag

SEQ ID NO: 1355560 - RNA, 20 nt, Human
cuuaggaagagccuuccacc

SEQ ID NO: 1355561 - RNA, 16 nt, Human
cuuaggaagagccuuc

SEQ ID NO: 1355562 - RNA, 15 nt, Human
cuuaggaagaauuuu

SEQ ID NO: 1355563 - RNA, 19 nt, Human
cuuagggaaggauacaaaa

SEQ ID NO: 1355564 - RNA, 21 nt, Human
cuuagggaaggauacaaaagc

SEQ ID NO: 1355565 - RNA, 17 nt, Human
cuuagcaguccccuucc

SEQ ID NO: 1355566 - RNA, 12 nt, Human
cuuagcaguccc

SEQ ID NO: 1355567 - RNA, 18 nt, Human
cuuagcaguccccuuccc

SEQ ID NO: 1355568 - RNA, 20 nt, Human
cuuaccaggcaccaaaagaa

SEQ ID NO: 1355569 - RNA, 19 nt, Human
cuuaccaggcaccaaaaga

SEQ ID NO: 1355570 - RNA, 20 nt, Human
cuuagccuggaccucugaca

SEQ ID NO: 1355571 - RNA, 21 nt, Human
cuuagccuggaccucugacag

SEQ ID NO: 1355572 - RNA, 19 nt, Human
cuuagccuggaccucugac

SEQ ID NO: 1355573 - RNA, 18 nt, Human
cuuagccuggaccucuga

SEQ ID NO: 1355574 - RNA, 17 nt, Human
cuuagccuggaccucug

SEQ ID NO: 1355575 - RNA, 13 nt, Human
cuuagccuggacc

SEQ ID NO: 1355576 - RNA, 22 nt, Human
cuuagcucauucuccuuguguu

SEQ ID NO: 1355577 - RNA, 16 nt, Human
cuuagcuuuagaaaca

SEQ ID NO: 1355578 - RNA, 20 nt, Human
cuuagcuuuagaaacagugc

SEQ ID NO: 1355579 - RNA, 17 nt, Human
cuuagcugucugcucag

SEQ ID NO: 1355580 - RNA, 22 nt, Human
cuuagcucaaugagcauguuua

SEQ ID NO: 1355581 - RNA, 19 nt, Human
cuuagcucucccaacucuu

SEQ ID NO: 1355582 - RNA, 14 nt, Human
cuuagcugucugcu

SEQ ID NO: 1355583 - RNA, 20 nt, Human
cuuagcucaaugagcauguu

SEQ ID NO: 1355584 - RNA, 19 nt, Human
cuuagcucaaugagcaugu

SEQ ID NO: 1355585 - RNA, 18 nt, Human
cuuagcucaaugagcaug

SEQ ID NO: 1355586 - RNA, 16 nt, Human
cuuagcucaaugagca

SEQ ID NO: 1355587 - RNA, 19 nt, Human
cuuagcuaguuuuauucuu

SEQ ID NO: 1355588 - RNA, 23 nt, Human
cuuagcucauucuccuuguguua

SEQ ID NO: 1355589 - RNA, 20 nt, Human
cuuucagcaagacuucucuu

SEQ ID NO: 1355590 - RNA, 18 nt, Human
cuuuaauucuguaucugu

SEQ ID NO: 1355591 - RNA, 14 nt, Human
cuuuaauucuguau

SEQ ID NO: 1355592 - RNA, 21 nt, Human
cuuuaauguuuuuugccacag

SEQ ID NO: 1355593 - RNA, 19 nt, Human
cuuuaauuaccaaccuguu

SEQ ID NO: 1355594 - RNA, 18 nt, Human
cuuuaauuaccaaccugu

SEQ ID NO: 1355595 - RNA, 23 nt, Human
cuuuaauguuuuuugccacagcu

SEQ ID NO: 1355596 - RNA, 17 nt, Human
cuuuaauguuuuuugcc

SEQ ID NO: 1355597 - RNA, 13 nt, Human
cuuuaauguuuuu

SEQ ID NO: 1355598 - RNA, 18 nt, Human
cuuguggaauugggagcu

SEQ ID NO: 1355599 - RNA, 20 nt, Human
cuugugcccucccuguccuu

SEQ ID NO: 1355600 - RNA, 15 nt, Human
cuugugcaguguuga

SEQ ID NO: 1355601 - RNA, 17 nt, Human
cuugugcccucccuguc

SEQ ID NO: 1355602 - RNA, 16 nt, Human
cuuuaccaaagaugaa

SEQ ID NO: 1355603 - RNA, 19 nt, Human
cuuuaccaaagaugaauga

SEQ ID NO: 1355604 - RNA, 17 nt, Human
cuuuacaugaggacucu

SEQ ID NO: 1355605 - RNA, 20 nt, Human
cuuucacuaaaacacacagg

SEQ ID NO: 1355606 - RNA, 16 nt, Human
cuuuacccauuugggu

SEQ ID NO: 1355607 - RNA, 23 nt, Human
cuuggggguucaggcccggcagg

SEQ ID NO: 1355608 - RNA, 18 nt, Human
cuuggggguucaggcccg

SEQ ID NO: 1355609 - RNA, 19 nt, Human
cuuggguuagaccuacagg

SEQ ID NO: 1355610 - RNA, 22 nt, Human
cuuggguuagaccuacaggggg

SEQ ID NO: 1355611 - RNA, 18 nt, Human
cuuggguuagaccuacag

SEQ ID NO: 1355612 - RNA, 16 nt, Human
cuuggguuagaccuac

SEQ ID NO: 1355613 - RNA, 15 nt, Human
cuuggguuagaccua

SEQ ID NO: 1355614 - RNA, 22 nt, Human
cuuggugaauuuuuuuuuccua

SEQ ID NO: 1355615 - RNA, 20 nt, Human
cuuggugaauuuuuuuuucc

SEQ ID NO: 1355616 - RNA, 20 nt, Human
cuugucuauaaagcauuuaa

SEQ ID NO: 1355617 - RNA, 17 nt, Human
cuugucuauaaagcauu

SEQ ID NO: 1355618 - RNA, 16 nt, Human
cuugucuauaaagcau

SEQ ID NO: 1355619 - RNA, 14 nt, Human
cuugucucaaugcu

SEQ ID NO: 1355620 - RNA, 16 nt, Human
cuugucucaaugcuca

SEQ ID NO: 1355621 - RNA, 17 nt, Human
cuugucucaaugcucau

SEQ ID NO: 1355622 - RNA, 18 nt, Human
cuugucucaaugcucaua

SEQ ID NO: 1355623 - RNA, 19 nt, Human
cuugucucaaugcucauaa

SEQ ID NO: 1355624 - RNA, 23 nt, Human
cuugucucaaugcucauaacgga

SEQ ID NO: 1355625 - RNA, 22 nt, Human
cuugugaaucaagggucaggcc

SEQ ID NO: 1355626 - RNA, 20 nt, Human
cuugugaaucaagggucagg

SEQ ID NO: 1355627 - RNA, 19 nt, Human
cuugugaaucaagggucag

SEQ ID NO: 1355628 - RNA, 13 nt, Human
cuugucuuuauuu

SEQ ID NO: 1355629 - RNA, 14 nt, Human
cuuugguucagcua

SEQ ID NO: 1355630 - RNA, 14 nt, Human
cuuugcacgugcug

SEQ ID NO: 1355631 - RNA, 18 nt, Human
cuuugcacagcucuccgg

SEQ ID NO: 1355632 - RNA, 18 nt, Human
cuuugagagagaaaggac

SEQ ID NO: 1355633 - RNA, 15 nt, Human
cuuugagagagaaag

SEQ ID NO: 1355634 - RNA, 12 nt, Human
cuuugagagaga

SEQ ID NO: 1355635 - RNA, 17 nt, Human
cuuugacuuuuugcauu

SEQ ID NO: 1355636 - RNA, 15 nt, Human
cuuugacuuuuugca

SEQ ID NO: 1355637 - RNA, 14 nt, Human
cuuugacuuuuugc

SEQ ID NO: 1355638 - RNA, 17 nt, Human
cuuuguauucucuccug

SEQ ID NO: 1355639 - RNA, 16 nt, Human
cuuuguaaugaaaacc

SEQ ID NO: 1355640 - RNA, 16 nt, Human
cuuugguucuaaggac

SEQ ID NO: 1355641 - RNA, 15 nt, Human
cuuugguucuaagga

SEQ ID NO: 1355642 - RNA, 14 nt, Human
cuuugguucuaagg

SEQ ID NO: 1355643 - RNA, 13 nt, Human
cuuugguucuaag

SEQ ID NO: 1355644 - RNA, 22 nt, Human
cuuugcacgugcuguuugcugu

SEQ ID NO: 1355645 - RNA, 14 nt, Human
cuuuguaaugaaaa

SEQ ID NO: 1355646 - RNA, 15 nt, Human
cuuuguaaugaaaac

SEQ ID NO: 1355647 - RNA, 21 nt, Human
cuuuuauaauucucauuaaaa

SEQ ID NO: 1355648 - RNA, 12 nt, Human
cuuuuauaauuc

SEQ ID NO: 1355649 - RNA, 13 nt, Human
cuuuguauucaaa

SEQ ID NO: 1355650 - RNA, 22 nt, Human
cuuuguauuguauauuacaaug

SEQ ID NO: 1355651 - RNA, 22 nt, Human
cuuuguauucucuccuguaccu

SEQ ID NO: 1355652 - RNA, 20 nt, Human
cuuuuauaaacuuuaccuuu

SEQ ID NO: 1355653 - RNA, 21 nt, Human
cuuuuauaaacuuuaccuuuu

SEQ ID NO: 1355654 - RNA, 18 nt, Human
cuuucucaauaagccuca

SEQ ID NO: 1355655 - RNA, 21 nt, Human
cuuugacucuuuugccauuaa

SEQ ID NO: 1355656 - RNA, 23 nt, Human
cuuugacucaggagccugugaca

SEQ ID NO: 1355657 - RNA, 13 nt, Human
cuuugacucagga

SEQ ID NO: 1355658 - RNA, 23 nt, Human
cuuugaccugccucccuucaugc

SEQ ID NO: 1355659 - RNA, 20 nt, Human
cuuucucaguuuucauaagu

SEQ ID NO: 1355660 - RNA, 17 nt, Human
cuuucucaguuuucaua

SEQ ID NO: 1355661 - RNA, 16 nt, Human
cuuucucaguuuucau

SEQ ID NO: 1355662 - RNA, 15 nt, Human
cuuucucaguuuuca

SEQ ID NO: 1355663 - RNA, 22 nt, Human
cuuucucacuaaaucuuuuaua

SEQ ID NO: 1355664 - RNA, 17 nt, Human
cuuucucacuaaaucuu

SEQ ID NO: 1355665 - RNA, 20 nt, Human
cuuugaccugccucccuuca

SEQ ID NO: 1355666 - RNA, 21 nt, Human
cuuccucucgcggcccucagu

SEQ ID NO: 1355667 - RNA, 20 nt, Human
cuuccucucgcggcccucag

SEQ ID NO: 1355668 - RNA, 19 nt, Human
cuuccucuuuuccuuccca

SEQ ID NO: 1355669 - RNA, 18 nt, Human
cuuccugacacuuuaauu

SEQ ID NO: 1355670 - RNA, 17 nt, Human
cuuccugacacuuuaau

SEQ ID NO: 1355671 - RNA, 16 nt, Human
cuuccugacacuuuaa

SEQ ID NO: 1355672 - RNA, 15 nt, Human
cuuccugacacuuua

SEQ ID NO: 1355673 - RNA, 23 nt, Human
cuucuaaauggcaaaggaaggug

SEQ ID NO: 1355674 - RNA, 18 nt, Human
cuucuaguucugccagga

SEQ ID NO: 1355675 - RNA, 17 nt, Human
cuucuaguucugccagg

SEQ ID NO: 1355676 - RNA, 16 nt, Human
cuucuagguucuaaaa

SEQ ID NO: 1355677 - RNA, 16 nt, Human
cuucuaguucugccag

SEQ ID NO: 1355678 - RNA, 17 nt, Human
cuucucuguucauuucc

SEQ ID NO: 1355679 - RNA, 14 nt, Human
cuucucuguucauu

SEQ ID NO: 1355680 - RNA, 13 nt, Human
cuucucuguucau

SEQ ID NO: 1355681 - RNA, 19 nt, Human
cuucuaguucugccaggag

SEQ ID NO: 1355682 - RNA, 13 nt, Human
cuucucacauuua

SEQ ID NO: 1355683 - RNA, 20 nt, Human
cuucucacauuuauauuuuu

SEQ ID NO: 1355684 - RNA, 13 nt, Human
cuucuucaccauu

SEQ ID NO: 1355685 - RNA, 21 nt, Human
cuucuuacaauaauucuauga

SEQ ID NO: 1355686 - RNA, 19 nt, Human
cuucugacagccucaguga

SEQ ID NO: 1355687 - RNA, 22 nt, Human
cuucucuuccuuuuaucaguag

SEQ ID NO: 1355688 - RNA, 16 nt, Human
cuucucuuguuaggua

SEQ ID NO: 1355689 - RNA, 15 nt, Human
cuucugaauaaagca

SEQ ID NO: 1355690 - RNA, 16 nt, Human
cuucugaauaaagcaa

SEQ ID NO: 1355691 - RNA, 18 nt, Human
cuucugaauaaagcaauu

SEQ ID NO: 1355692 - RNA, 22 nt, Human
cuucugaauaaagcaauuagca

SEQ ID NO: 1355693 - RNA, 15 nt, Human
cuucugacagccuca

SEQ ID NO: 1355694 - RNA, 14 nt, Human
cuucugacagccuc

SEQ ID NO: 1355695 - RNA, 19 nt, Human
cuucugacauaauccagua

SEQ ID NO: 1355696 - RNA, 18 nt, Human
cuuggcgaugccagccaa

SEQ ID NO: 1355697 - RNA, 17 nt, Human
cuuggcgaugccagcca

SEQ ID NO: 1355698 - RNA, 15 nt, Human
cuuggcgaugccagc

SEQ ID NO: 1355699 - RNA, 14 nt, Human
cuuggcgaugccag

SEQ ID NO: 1355700 - RNA, 15 nt, Human
cuuggccuggagcac

SEQ ID NO: 1355701 - RNA, 14 nt, Human
cuuggccuggagca

SEQ ID NO: 1355702 - RNA, 13 nt, Human
cuuggccuggagc

SEQ ID NO: 1355703 - RNA, 17 nt, Human
cuuggccugaucagacc

SEQ ID NO: 1355704 - RNA, 16 nt, Human
cuuggccucucucuag

SEQ ID NO: 1355705 - RNA, 14 nt, Human
cuuggccucucucu

SEQ ID NO: 1355706 - RNA, 14 nt, Human
cuuggccucccaag

SEQ ID NO: 1355707 - RNA, 16 nt, Human
cuuggauuuaguuuca

SEQ ID NO: 1355708 - RNA, 20 nt, Human
cuugcuauucugucccuagg

SEQ ID NO: 1355709 - RNA, 23 nt, Human
cuugcuauucugucccuaggugu

SEQ ID NO: 1355710 - RNA, 17 nt, Human
cuugcuauucugucccu

SEQ ID NO: 1355711 - RNA, 15 nt, Human
cuugcuauucugucc

SEQ ID NO: 1355712 - RNA, 14 nt, Human
cuugcuauucuguc

SEQ ID NO: 1355713 - RNA, 13 nt, Human
cuugcuauucugu

SEQ ID NO: 1355714 - RNA, 20 nt, Human
cuugcuaccaguauuuagaa

SEQ ID NO: 1355715 - RNA, 18 nt, Human
cuugcuaccaguauuuag

SEQ ID NO: 1355716 - RNA, 17 nt, Human
cuugcuaccaguauuua

SEQ ID NO: 1355717 - RNA, 13 nt, Human
cuugcuaccagua

SEQ ID NO: 1355718 - RNA, 20 nt, Human
cuugcgguuccggcauggac

SEQ ID NO: 1355719 - RNA, 12 nt, Human
cuugcaaaguau

SEQ ID NO: 1355720 - RNA, 21 nt, Human
cuugauuuuagccuucucugu

SEQ ID NO: 1355721 - RNA, 20 nt, Human
cuugauuuuagccuucucug

SEQ ID NO: 1355722 - RNA, 19 nt, Human
cuugauuuuagccuucucu

SEQ ID NO: 1355723 - RNA, 16 nt, Human
cuugcaaaaaggguca

SEQ ID NO: 1355724 - RNA, 12 nt, Human
cuugauuuuugc

SEQ ID NO: 1355725 - RNA, 15 nt, Human
cuugcaaaaaggguc

SEQ ID NO: 1355726 - RNA, 16 nt, Human
cuugauuauccauauu

SEQ ID NO: 1355727 - RNA, 17 nt, Human
cuugauccauuucuaau

SEQ ID NO: 1355728 - RNA, 16 nt, Human
cuugauccauuucuaa

SEQ ID NO: 1355729 - RNA, 22 nt, Human
cuugaucaguuaagaaauuuca

SEQ ID NO: 1355730 - RNA, 18 nt, Human
cuugaucaguuaagaaau

SEQ ID NO: 1355731 - RNA, 23 nt, Human
cuugaucagccccacccuggccu

SEQ ID NO: 1355732 - RNA, 20 nt, Human
cuugaauuguaacuguucuu

SEQ ID NO: 1355733 - RNA, 17 nt, Human
cuugaauuguaacuguu

SEQ ID NO: 1355734 - RNA, 20 nt, Human
cuugaauguggcuugagaaa

SEQ ID NO: 1355735 - RNA, 22 nt, Human
cuugaauguggcuugagaaaua

SEQ ID NO: 1355736 - RNA, 19 nt, Human
cuugaauguggcuugagaa

SEQ ID NO: 1355737 - RNA, 22 nt, Human
cuugaaggugcugacggccagg

SEQ ID NO: 1355738 - RNA, 14 nt, Human
cuugaaggugcuga

SEQ ID NO: 1355739 - RNA, 20 nt, Human
cuugaagggccagagccagg

SEQ ID NO: 1355740 - RNA, 20 nt, Human
cuugacaguggaacuacauu

SEQ ID NO: 1355741 - RNA, 22 nt, Human
cuugaauuguaacuguucuuga

SEQ ID NO: 1355742 - RNA, 21 nt, Human
cuugaauuguaacuguucuug

SEQ ID NO: 1355743 - RNA, 21 nt, Human
cuugaagggccagagccaggg

SEQ ID NO: 1355744 - RNA, 19 nt, Human
cuugaagggccagagccag

SEQ ID NO: 1355745 - RNA, 18 nt, Human
cuugaagggccagagcca

SEQ ID NO: 1355746 - RNA, 17 nt, Human
cuugaagggccagagcc

SEQ ID NO: 1355747 - RNA, 16 nt, Human
cuugaagggccagagc

SEQ ID NO: 1355748 - RNA, 15 nt, Human
cuugaagggccagag

SEQ ID NO: 1355749 - RNA, 14 nt, Human
cuugaagggccaga

SEQ ID NO: 1355750 - RNA, 13 nt, Human
cuugaagggccag

SEQ ID NO: 1355751 - RNA, 16 nt, Human
cuugaaggacuaauag

SEQ ID NO: 1355752 - RNA, 13 nt, Human
cuugaaggagaau

SEQ ID NO: 1355753 - RNA, 15 nt, Human
gaaaauuauuugcau

SEQ ID NO: 1355754 - RNA, 23 nt, Human
gaaaauuauuuaaaccgcuaaaa

SEQ ID NO: 1355755 - RNA, 13 nt, Human
gaaaauuauuuaa

SEQ ID NO: 1355756 - RNA, 15 nt, Human
gaaaauguucuguuu

SEQ ID NO: 1355757 - RNA, 20 nt, Human
gaaaauguugagaaucccaa

SEQ ID NO: 1355758 - RNA, 17 nt, Human
gaaaauguugagaaucc

SEQ ID NO: 1355759 - RNA, 15 nt, Human
gaaaauguugagaau

SEQ ID NO: 1355760 - RNA, 21 nt, Human
gaaaauguucuguuugcugug

SEQ ID NO: 1355761 - RNA, 15 nt, Human
gaaaauguccaggaa

SEQ ID NO: 1355762 - RNA, 17 nt, Human
gaaaauguccuugugau

SEQ ID NO: 1355763 - RNA, 16 nt, Human
gaaaagcaacauucau

SEQ ID NO: 1355764 - RNA, 14 nt, Human
gaaaaugucuugug

SEQ ID NO: 1355765 - RNA, 14 nt, Human
gaaaauguccagga

SEQ ID NO: 1355766 - RNA, 20 nt, Human
gaaaagcaacauucauaguc

SEQ ID NO: 1355767 - RNA, 22 nt, Human
gaaaagaugcacuuugcuuuaa

SEQ ID NO: 1355768 - RNA, 11 nt, Human
gaaaagaugca

SEQ ID NO: 1355769 - RNA, 21 nt, Human
gaaaagacacauuuuuuagga

SEQ ID NO: 1355770 - RNA, 22 nt, Human
gaaaagaauuguuggggguuuu

SEQ ID NO: 1355771 - RNA, 14 nt, Human
gaaaagaauagaag

SEQ ID NO: 1355772 - RNA, 18 nt, Human
gaaaaaaauugaaaugua

SEQ ID NO: 1355773 - RNA, 19 nt, Human
gaaaaaaauugaaauguaa

SEQ ID NO: 1355774 - RNA, 16 nt, Human
gaaaaaaauugaaaug

SEQ ID NO: 1355775 - RNA, 15 nt, Human
gaaaaaaauugaaau

SEQ ID NO: 1355776 - RNA, 14 nt, Human
gaaaaaaauugaaa

SEQ ID NO: 1355777 - RNA, 12 nt, Human
gaaaaaaauuga

SEQ ID NO: 1355778 - RNA, 19 nt, Human
gaaaaaaauguauuuuaug

SEQ ID NO: 1355779 - RNA, 20 nt, Human
gaaaaaaauguauuuuaugu

SEQ ID NO: 1355780 - RNA, 15 nt, Human
gaaaaaaauguauuu

SEQ ID NO: 1355781 - RNA, 14 nt, Human
gaaaaaaauguauu

SEQ ID NO: 1355782 - RNA, 13 nt, Human
gaaaaaaauguau

SEQ ID NO: 1355783 - RNA, 12 nt, Human
gaaaacuuuaaa

SEQ ID NO: 1355784 - RNA, 16 nt, Human
gaaaacuuuaaagcgu

SEQ ID NO: 1355785 - RNA, 21 nt, Human
gaaaagaaaauuuuuguagua

SEQ ID NO: 1355786 - RNA, 15 nt, Human
gaaaagaaagcuaca

SEQ ID NO: 1355787 - RNA, 19 nt, Human
gaaaacuuguauuaugugu

SEQ ID NO: 1355788 - RNA, 22 nt, Human
gaaaacuuguauuauguguguu

SEQ ID NO: 1355789 - RNA, 17 nt, Human
gaaacaacacuguagua

SEQ ID NO: 1355790 - RNA, 12 nt, Human
gaaacaaagaug

SEQ ID NO: 1355791 - RNA, 23 nt, Human
gaaacaaagaguucaagaaauaa

SEQ ID NO: 1355792 - RNA, 16 nt, Human
gaaaauuauuugcaua

SEQ ID NO: 1355793 - RNA, 20 nt, Human
gaaacaacucuuugagaaac

SEQ ID NO: 1355794 - RNA, 17 nt, Human
gaaacaacucuuugaga

SEQ ID NO: 1355795 - RNA, 16 nt, Human
gaaacaaccaugucau

SEQ ID NO: 1355796 - RNA, 16 nt, Human
gaaacaacacuguagu

SEQ ID NO: 1355797 - RNA, 15 nt, Human
gaaacaacacuguag

SEQ ID NO: 1355798 - RNA, 14 nt, Human
gaaacaacacugua

SEQ ID NO: 1355799 - RNA, 14 nt, Human
gaaacaacuuggaa

SEQ ID NO: 1355800 - RNA, 21 nt, Human
gaaacaagucagucauucaga

SEQ ID NO: 1355801 - RNA, 20 nt, Human
gaacacagcaguucugcaga

SEQ ID NO: 1355802 - RNA, 17 nt, Human
gaacacaggcaaaaucc

SEQ ID NO: 1355803 - RNA, 19 nt, Human
gaacacaaacuguaaauaa

SEQ ID NO: 1355804 - RNA, 16 nt, Human
gaacaccauugaaggc

SEQ ID NO: 1355805 - RNA, 20 nt, Human
gaacaccauagguagaaugu

SEQ ID NO: 1355806 - RNA, 21 nt, Human
gaacaccagagaccucaaauu

SEQ ID NO: 1355807 - RNA, 17 nt, Human
gaacacaaacuguaaau

SEQ ID NO: 1355808 - RNA, 20 nt, Human
gaacaauuuggcaauuuugu

SEQ ID NO: 1355809 - RNA, 19 nt, Human
gaacaauuuggcaauuuug

SEQ ID NO: 1355810 - RNA, 15 nt, Human
gaacaauuuggcaau

SEQ ID NO: 1355811 - RNA, 20 nt, Human
gaacaauugaaguaaacuuu

SEQ ID NO: 1355812 - RNA, 17 nt, Human
gaacaauugaaguaaac

SEQ ID NO: 1355813 - RNA, 13 nt, Human
gaacaauugaagu

SEQ ID NO: 1355814 - RNA, 21 nt, Human
gaacaaugugcuaugugaaga

SEQ ID NO: 1355815 - RNA, 23 nt, Human
gaacaaauguuuauuaagcauca

SEQ ID NO: 1355816 - RNA, 15 nt, Human
gaacaaauggccuuu

SEQ ID NO: 1355817 - RNA, 20 nt, Human
gaacacuagacaagccagaa

SEQ ID NO: 1355818 - RNA, 18 nt, Human
gaacacuagacaagccag

SEQ ID NO: 1355819 - RNA, 17 nt, Human
gaacacuagacaagcca

SEQ ID NO: 1355820 - RNA, 15 nt, Human
gaacacuagacaagc

SEQ ID NO: 1355821 - RNA, 18 nt, Human
gaacacuaauucauaauc

SEQ ID NO: 1355822 - RNA, 15 nt, Human
gaacacuaauucaua

SEQ ID NO: 1355823 - RNA, 22 nt, Human
gaacacggccacaucaaagagg

SEQ ID NO: 1355824 - RNA, 14 nt, Human
gaacacggccacau

SEQ ID NO: 1355825 - RNA, 21 nt, Human
gaacaccuaugcaaagaugaa

SEQ ID NO: 1355826 - RNA, 18 nt, Human
gaacaccuaugcaaagau

SEQ ID NO: 1355827 - RNA, 16 nt, Human
gaacacccuauauuuu

SEQ ID NO: 1355828 - RNA, 20 nt, Human
gaacaccauugaaggcuuaa

SEQ ID NO: 1355829 - RNA, 19 nt, Human
gaacaccauugaaggcuua

SEQ ID NO: 1355830 - RNA, 19 nt, Human
gaacacuagacaagccaga

SEQ ID NO: 1355831 - RNA, 20 nt, Human
gaaaucccuucauacuugaa

SEQ ID NO: 1355832 - RNA, 19 nt, Human
gaaaucccuucauacuuga

SEQ ID NO: 1355833 - RNA, 15 nt, Human
gaaaucccuucauac

SEQ ID NO: 1355834 - RNA, 14 nt, Human
gaaaucccuucaua

SEQ ID NO: 1355835 - RNA, 13 nt, Human
gaaaucccuucau

SEQ ID NO: 1355836 - RNA, 21 nt, Human
gaaaucuaguuauuuacagga

SEQ ID NO: 1355837 - RNA, 16 nt, Human
gaaaggggagcccacu

SEQ ID NO: 1355838 - RNA, 15 nt, Human
gaaaggggagcccac

SEQ ID NO: 1355839 - RNA, 13 nt, Human
gaaaggggagccc

SEQ ID NO: 1355840 - RNA, 21 nt, Human
gaaagggcccugggccugccu

SEQ ID NO: 1355841 - RNA, 20 nt, Human
gaaagggcccuccuuccuaa

SEQ ID NO: 1355842 - RNA, 21 nt, Human
gaaagggagggcucugaggcg

SEQ ID NO: 1355843 - RNA, 20 nt, Human
gaaagggagggcucugaggc

SEQ ID NO: 1355844 - RNA, 19 nt, Human
gaaagggagggcucugagg

SEQ ID NO: 1355845 - RNA, 19 nt, Human
gaacaaagcagccacgagg

SEQ ID NO: 1355846 - RNA, 16 nt, Human
gaacaaagcagccacg

SEQ ID NO: 1355847 - RNA, 15 nt, Human
gaacaaagcagccac

SEQ ID NO: 1355848 - RNA, 14 nt, Human
gaacaaagcagcca

SEQ ID NO: 1355849 - RNA, 17 nt, Human
gaaauuuuucuucuuga

SEQ ID NO: 1355850 - RNA, 23 nt, Human
gaaaucuggcuucuggccaggaa

SEQ ID NO: 1355851 - RNA, 22 nt, Human
gaaaucuggcuucuggccagga

SEQ ID NO: 1355852 - RNA, 20 nt, Human
gaaaucuggcuucuggccag

SEQ ID NO: 1355853 - RNA, 20 nt, Human
gaaaucugugccugagaaca

SEQ ID NO: 1355854 - RNA, 11 nt, Human
gaaaugaaaaa

SEQ ID NO: 1355855 - RNA, 21 nt, Human
gaaacuggccauggccugcaa

SEQ ID NO: 1355856 - RNA, 20 nt, Human
gaaacuggccauggccugca

SEQ ID NO: 1355857 - RNA, 19 nt, Human
gaaacuggccauggccugc

SEQ ID NO: 1355858 - RNA, 18 nt, Human
gaaacuggccauggccug

SEQ ID NO: 1355859 - RNA, 14 nt, Human
gaaacuggccaugg

SEQ ID NO: 1355860 - RNA, 13 nt, Human
gaaacuggauuaa

SEQ ID NO: 1355861 - RNA, 17 nt, Human
gaaacuggauuaaacuu

SEQ ID NO: 1355862 - RNA, 18 nt, Human
gaaagggagggcucugag

SEQ ID NO: 1355863 - RNA, 17 nt, Human
gaaagggagggcucuga

SEQ ID NO: 1355864 - RNA, 16 nt, Human
gaaagggagggcucug

SEQ ID NO: 1355865 - RNA, 15 nt, Human
gaaagggagggcucu

SEQ ID NO: 1355866 - RNA, 14 nt, Human
gaaagggagggcuc

SEQ ID NO: 1355867 - RNA, 13 nt, Human
gaaagggagggcu

SEQ ID NO: 1355868 - RNA, 20 nt, Human
gaaagaacgcugauuuaaag

SEQ ID NO: 1355869 - RNA, 12 nt, Human
gaaagggauuuu

SEQ ID NO: 1355870 - RNA, 20 nt, Human
gaaagggauuuucagcccuc

SEQ ID NO: 1355871 - RNA, 20 nt, Human
gaacucuuaaucaaauagca

SEQ ID NO: 1355872 - RNA, 13 nt, Human
gaacucuuaauca

SEQ ID NO: 1355873 - RNA, 19 nt, Human
gaacucugguggcacagga

SEQ ID NO: 1355874 - RNA, 18 nt, Human
gaacucugguggcacagg

SEQ ID NO: 1355875 - RNA, 14 nt, Human
gaacucugguggca

SEQ ID NO: 1355876 - RNA, 17 nt, Human
gaacuccugccauaguc

SEQ ID NO: 1355877 - RNA, 15 nt, Human
gaacuccugaccuca

SEQ ID NO: 1355878 - RNA, 14 nt, Human
gaaccccuuuccca

SEQ ID NO: 1355879 - RNA, 23 nt, Human
gaacugcaggcccuggccucccc

SEQ ID NO: 1355880 - RNA, 21 nt, Human
gaacugcaggcccuggccucc

SEQ ID NO: 1355881 - RNA, 19 nt, Human
gaacugcaggcccuggccu

SEQ ID NO: 1355882 - RNA, 18 nt, Human
gaacugcaggcccuggcc

SEQ ID NO: 1355883 - RNA, 17 nt, Human
gaacugcaggcccuggc

SEQ ID NO: 1355884 - RNA, 16 nt, Human
gaacugcaggcccugg

SEQ ID NO: 1355885 - RNA, 14 nt, Human
gaacugcaggcccu

SEQ ID NO: 1355886 - RNA, 12 nt, Human
gaacugcaggcc

SEQ ID NO: 1355887 - RNA, 21 nt, Human
gaacugauucacaucucauuu

SEQ ID NO: 1355888 - RNA, 23 nt, Human
gaacugauucacaucucauuuuu

SEQ ID NO: 1355889 - RNA, 17 nt, Human
gaacugauguaaguaaa

SEQ ID NO: 1355890 - RNA, 13 nt, Human
gaacugaaaucau

SEQ ID NO: 1355891 - RNA, 17 nt, Human
gaacccagcccaccccc

SEQ ID NO: 1355892 - RNA, 16 nt, Human
gaacccagcccacccc

SEQ ID NO: 1355893 - RNA, 19 nt, Human
gaacccagacucagacauu

SEQ ID NO: 1355894 - RNA, 17 nt, Human
gaacccagacucagaca

SEQ ID NO: 1355895 - RNA, 16 nt, Human
gaacccagacucagac

SEQ ID NO: 1355896 - RNA, 13 nt, Human
gaacccagacuca

SEQ ID NO: 1355897 - RNA, 16 nt, Human
gaaccauuaaccagau

SEQ ID NO: 1355898 - RNA, 16 nt, Human
gaacccaggacaagca

SEQ ID NO: 1355899 - RNA, 19 nt, Human
gaacccaggacaagcaugg

SEQ ID NO: 1355900 - RNA, 13 nt, Human
gaacccaggacaa

SEQ ID NO: 1355901 - RNA, 12 nt, Human
gaacccaggaca

SEQ ID NO: 1355902 - RNA, 11 nt, Human
gaacccaggac

SEQ ID NO: 1355903 - RNA, 18 nt, Human
gaacccagcccacccccg

SEQ ID NO: 1355904 - RNA, 20 nt, Human
gaaccccggggugcccacag

SEQ ID NO: 1355905 - RNA, 17 nt, Human
gaaccccuucauccucu

SEQ ID NO: 1355906 - RNA, 21 nt, Human
gaaccccuacaugaaacagaa

SEQ ID NO: 1355907 - RNA, 17 nt, Human
gaaccagacucuugccu

SEQ ID NO: 1355908 - RNA, 16 nt, Human
gaaccagacucuugcc

SEQ ID NO: 1355909 - RNA, 11 nt, Human
gaaccagacuc

SEQ ID NO: 1355910 - RNA, 20 nt, Human
gaaccacuuucuuauuuuuu

SEQ ID NO: 1355911 - RNA, 15 nt, Human
gaaccacuuucuuau

SEQ ID NO: 1355912 - RNA, 13 nt, Human
gaaccacuuucuu

SEQ ID NO: 1355913 - RNA, 19 nt, Human
gaaccaguccccccacccu

SEQ ID NO: 1355914 - RNA, 12 nt, Human
gaaccaucagaa

SEQ ID NO: 1355915 - RNA, 22 nt, Human
gaaccauggucggaaaacaugc

SEQ ID NO: 1355916 - RNA, 17 nt, Human
gaagacagaaguuugca

SEQ ID NO: 1355917 - RNA, 18 nt, Human
gaagacagaaccacaggg

SEQ ID NO: 1355918 - RNA, 16 nt, Human
gaagacagaaccacag

SEQ ID NO: 1355919 - RNA, 14 nt, Human
gaagacccuccccg

SEQ ID NO: 1355920 - RNA, 22 nt, Human
gaagacccauuccuucccagag

SEQ ID NO: 1355921 - RNA, 20 nt, Human
gaagacccauuccuucccag

SEQ ID NO: 1355922 - RNA, 17 nt, Human
gaagaccugagaaugua

SEQ ID NO: 1355923 - RNA, 14 nt, Human
gaagaccugagaau

SEQ ID NO: 1355924 - RNA, 13 nt, Human
gaagacaguggcc

SEQ ID NO: 1355925 - RNA, 15 nt, Human
gaagacaguggcccc

SEQ ID NO: 1355926 - RNA, 12 nt, Human
gaagacaguggc

SEQ ID NO: 1355927 - RNA, 10 nt, Human
gaagacagug

SEQ ID NO: 1355928 - RNA, 19 nt, Human
gaagcagguucccaagcuc

SEQ ID NO: 1355929 - RNA, 12 nt, Human
gaagcagguucc

SEQ ID NO: 1355930 - RNA, 13 nt, Human
gaagcagcagccu

SEQ ID NO: 1355931 - RNA, 22 nt, Human
gaagcagccucuccccaggucc

SEQ ID NO: 1355932 - RNA, 12 nt, Human
gaagcagccucu

SEQ ID NO: 1355933 - RNA, 19 nt, Human
gaagcagcaacuuguccua

SEQ ID NO: 1355934 - RNA, 18 nt, Human
gaagcagcaacuuguccu

SEQ ID NO: 1355935 - RNA, 19 nt, Human
gaagcacgugguaaaacac

SEQ ID NO: 1355936 - RNA, 23 nt, Human
gaagacuaucuuacuauuucaca

SEQ ID NO: 1355937 - RNA, 21 nt, Human
gaagacgugaugccaggacca

SEQ ID NO: 1355938 - RNA, 17 nt, Human
gaagcacagugaucaag

SEQ ID NO: 1355939 - RNA, 20 nt, Human
gacccggcacccccugcagc

SEQ ID NO: 1355940 - RNA, 19 nt, Human
gacccucaucuuucuucca

SEQ ID NO: 1355941 - RNA, 15 nt, Human
gacccucaucuuucu

SEQ ID NO: 1355942 - RNA, 20 nt, Human
gacccucaucuuucuuccaa

SEQ ID NO: 1355943 - RNA, 19 nt, Human
gacccuccaccgcagaagg

SEQ ID NO: 1355944 - RNA, 17 nt, Human
gacccuccccgcacccc

SEQ ID NO: 1355945 - RNA, 15 nt, Human
gacccuccccgcacc

SEQ ID NO: 1355946 - RNA, 21 nt, Human
gacccuccaccgcagaaggaa

SEQ ID NO: 1355947 - RNA, 22 nt, Human
gacccuccaccgcagaaggaag

SEQ ID NO: 1355948 - RNA, 21 nt, Human
gacuauauuugggccugcucc

SEQ ID NO: 1355949 - RNA, 19 nt, Human
gacuauauuugggccugcu

SEQ ID NO: 1355950 - RNA, 19 nt, Human
gacucaagaagugaagaau

SEQ ID NO: 1355951 - RNA, 20 nt, Human
gacucaagaagugaagaaug

SEQ ID NO: 1355952 - RNA, 18 nt, Human
gacucaagaagugaagaa

SEQ ID NO: 1355953 - RNA, 23 nt, Human
gacucaaauguucuaaguuucua

SEQ ID NO: 1355954 - RNA, 19 nt, Human
gacucaaauguucuaaguu

SEQ ID NO: 1355955 - RNA, 18 nt, Human
gacucaaauguucuaagu

SEQ ID NO: 1355956 - RNA, 17 nt, Human
gacucaaauguucuaag

SEQ ID NO: 1355957 - RNA, 16 nt, Human
gacucaaauguucuaa

SEQ ID NO: 1355958 - RNA, 15 nt, Human
gacucaaauguucua

SEQ ID NO: 1355959 - RNA, 22 nt, Human
gacuauuaggugcaauuucaag

SEQ ID NO: 1355960 - RNA, 15 nt, Human
gacucaagccccgga

SEQ ID NO: 1355961 - RNA, 14 nt, Human
gacucaagccccgg

SEQ ID NO: 1355962 - RNA, 17 nt, Human
gacuguaaguugggcuu

SEQ ID NO: 1355963 - RNA, 13 nt, Human
gacuguaaguugg

SEQ ID NO: 1355964 - RNA, 18 nt, Human
gacuguaaacacagacag

SEQ ID NO: 1355965 - RNA, 17 nt, Human
gacuguaaacacagaca

SEQ ID NO: 1355966 - RNA, 19 nt, Human
gacucacaccacuagccuc

SEQ ID NO: 1355967 - RNA, 23 nt, Human
gacucacaccugaacugaacacc

SEQ ID NO: 1355968 - RNA, 22 nt, Human
gacugguguuaucaccgugggc

SEQ ID NO: 1355969 - RNA, 14 nt, Human
gacucacaccugaa

SEQ ID NO: 1355970 - RNA, 18 nt, Human
gacugucuccauggcccu

SEQ ID NO: 1355971 - RNA, 15 nt, Human
gacugucauagaaau

SEQ ID NO: 1355972 - RNA, 21 nt, Human
gacuguaaguugggcuugcua

SEQ ID NO: 1355973 - RNA, 20 nt, Human
gacuguaaguugggcuugcu

SEQ ID NO: 1355974 - RNA, 14 nt, Human
gacugugugcucag

SEQ ID NO: 1355975 - RNA, 16 nt, Human
gacugugugcucagga

SEQ ID NO: 1355976 - RNA, 17 nt, Human
gacugugugcucaggag

SEQ ID NO: 1355977 - RNA, 20 nt, Human
gacugugugcucaggagccc

SEQ ID NO: 1355978 - RNA, 21 nt, Human
gacuuugcagccggcacaggg

SEQ ID NO: 1355979 - RNA, 22 nt, Human
gacuuucuuuuuugauauagaa

SEQ ID NO: 1355980 - RNA, 23 nt, Human
gacuuucuuuuuugauauagaag

SEQ ID NO: 1355981 - RNA, 21 nt, Human
gacuuucuuuuuugauauaga

SEQ ID NO: 1355982 - RNA, 18 nt, Human
gacuuucuuuuuugauau

SEQ ID NO: 1355983 - RNA, 23 nt, Human
gacuuucuuuuuguagcuggggc

SEQ ID NO: 1355984 - RNA, 19 nt, Human
gacuuucuuuuuguagcug

SEQ ID NO: 1355985 - RNA, 18 nt, Human
gacuuucugccuggagug

SEQ ID NO: 1355986 - RNA, 16 nt, Human
gacuuucugccuggag

SEQ ID NO: 1355987 - RNA, 19 nt, Human
gacuguuuuucggacaguu

SEQ ID NO: 1355988 - RNA, 18 nt, Human
gacuguuuuucggacagu

SEQ ID NO: 1355989 - RNA, 21 nt, Human
gacuguuuucucucggcuccc

SEQ ID NO: 1355990 - RNA, 19 nt, Human
gacuguuuucucucggcuc

SEQ ID NO: 1355991 - RNA, 18 nt, Human
gacuuuucuguaauucag

SEQ ID NO: 1355992 - RNA, 13 nt, Human
gacuuuucuguaa

SEQ ID NO: 1355993 - RNA, 12 nt, Human
gacuuuucugua

SEQ ID NO: 1355994 - RNA, 14 nt, Human
gacuuuucugcaaa

SEQ ID NO: 1355995 - RNA, 13 nt, Human
gacuuuucugcaa

SEQ ID NO: 1355996 - RNA, 19 nt, Human
gacuuuggcugcaugcgag

SEQ ID NO: 1355997 - RNA, 14 nt, Human
gacuuugcuugcuu

SEQ ID NO: 1355998 - RNA, 12 nt, Human
gacuuugcuugc

SEQ ID NO: 1355999 - RNA, 17 nt, Human
gacuuugcuugcuuuga

SEQ ID NO: 1356000 - RNA, 15 nt, Human
gacuuugcuugcuuu

SEQ ID NO: 1356001 - RNA, 16 nt, Human
gacuuuggcugcaugc

SEQ ID NO: 1356002 - RNA, 17 nt, Human
gaccagucccagagcag

SEQ ID NO: 1356003 - RNA, 18 nt, Human
gaccagucaaccugggca

SEQ ID NO: 1356004 - RNA, 17 nt, Human
gaccagucaaccugggc

SEQ ID NO: 1356005 - RNA, 21 nt, Human
gaccagggcuccagccccucu

SEQ ID NO: 1356006 - RNA, 15 nt, Human
gaccaggcuguagga

SEQ ID NO: 1356007 - RNA, 13 nt, Human
gaccaggcuguag

SEQ ID NO: 1356008 - RNA, 15 nt, Human
gaccaggcugccucc

SEQ ID NO: 1356009 - RNA, 16 nt, Human
gaccaggcaccaggca

SEQ ID NO: 1356010 - RNA, 23 nt, Human
gaccaggcauccuccacaauagc

SEQ ID NO: 1356011 - RNA, 18 nt, Human
gaccaggagugggugggg

SEQ ID NO: 1356012 - RNA, 11 nt, Human
gaccaggagug

SEQ ID NO: 1356013 - RNA, 10 nt, Human
gaccaggagu

SEQ ID NO: 1356014 - RNA, 19 nt, Human
gaccaguugcagucacucu

SEQ ID NO: 1356015 - RNA, 22 nt, Human
gaccaguugcagucacucuagu

SEQ ID NO: 1356016 - RNA, 14 nt, Human
gaccaguugcaguc

SEQ ID NO: 1356017 - RNA, 16 nt, Human
gaccagucccagagca

SEQ ID NO: 1356018 - RNA, 19 nt, Human
gacccguucaugggggagg

SEQ ID NO: 1356019 - RNA, 16 nt, Human
gacccuaaaucuugac

SEQ ID NO: 1356020 - RNA, 23 nt, Human
gacccguucaugggggagggggc

SEQ ID NO: 1356021 - RNA, 22 nt, Human
gacccguucaacuuuuccuuug

SEQ ID NO: 1356022 - RNA, 21 nt, Human
gacccggcacccccugcagcu

SEQ ID NO: 1356023 - RNA, 16 nt, Human
gaccccuguucaugcc

SEQ ID NO: 1356024 - RNA, 23 nt, Human
gaccccugcucaguaaagcacuu

SEQ ID NO: 1356025 - RNA, 22 nt, Human
gaccaugguuaagaguccaaga

SEQ ID NO: 1356026 - RNA, 22 nt, Human
gaccauggaguggcagcccagc

SEQ ID NO: 1356027 - RNA, 21 nt, Human
gaccauggaguggcagcccag

SEQ ID NO: 1356028 - RNA, 20 nt, Human
gaccauggaguggcagccca

SEQ ID NO: 1356029 - RNA, 18 nt, Human
gaccauggaguggcagcc

SEQ ID NO: 1356030 - RNA, 23 nt, Human
gaccauggacacuacacccagca

SEQ ID NO: 1356031 - RNA, 22 nt, Human
gaccaugcucaucugcuggucc

SEQ ID NO: 1356032 - RNA, 21 nt, Human
gaccaugcucaucugcugguc

SEQ ID NO: 1356033 - RNA, 15 nt, Human
gaccauaauguuaca

SEQ ID NO: 1356034 - RNA, 16 nt, Human
gaccauggacacuaca

SEQ ID NO: 1356035 - RNA, 21 nt, Human
gaccauggacacuacacccag

SEQ ID NO: 1356036 - RNA, 12 nt, Human
gacaggguuuca

SEQ ID NO: 1356037 - RNA, 17 nt, Human
gacaggguuucaccaug

SEQ ID NO: 1356038 - RNA, 14 nt, Human
gacaguauauaacu

SEQ ID NO: 1356039 - RNA, 19 nt, Human
gacagggcggggguggcgg

SEQ ID NO: 1356040 - RNA, 20 nt, Human
gacagccucccccugucccc

SEQ ID NO: 1356041 - RNA, 21 nt, Human
gacacucccuugggcucccug

SEQ ID NO: 1356042 - RNA, 15 nt, Human
gacacucccuugggc

SEQ ID NO: 1356043 - RNA, 21 nt, Human
gacacuccccgaagucuuuug

SEQ ID NO: 1356044 - RNA, 16 nt, Human
gacacuccccgaaguc

SEQ ID NO: 1356045 - RNA, 16 nt, Human
gacagaaaacauguuu

SEQ ID NO: 1356046 - RNA, 18 nt, Human
gacagccucccccugucc

SEQ ID NO: 1356047 - RNA, 19 nt, Human
gacagccucagugacccug

SEQ ID NO: 1356048 - RNA, 15 nt, Human
gacagccgccuggag

SEQ ID NO: 1356049 - RNA, 21 nt, Human
gacagcccuucuuuccacaga

SEQ ID NO: 1356050 - RNA, 16 nt, Human
gacacucauauaauua

SEQ ID NO: 1356051 - RNA, 15 nt, Human
gacacucagaccuga

SEQ ID NO: 1356052 - RNA, 13 nt, Human
gacacucagaccu

SEQ ID NO: 1356053 - RNA, 14 nt, Human
gaagcaguggccuu

SEQ ID NO: 1356054 - RNA, 16 nt, Human
gaggggaccaggagug

SEQ ID NO: 1356055 - RNA, 15 nt, Human
gaggggaccaggagu

SEQ ID NO: 1356056 - RNA, 14 nt, Human
gaggggaccaggag

SEQ ID NO: 1356057 - RNA, 13 nt, Human
gaggggaccagga

SEQ ID NO: 1356058 - RNA, 12 nt, Human
gaggggaccagg

SEQ ID NO: 1356059 - RNA, 14 nt, Human
gaggccagccuggc

SEQ ID NO: 1356060 - RNA, 13 nt, Human
gaggccagccugg

SEQ ID NO: 1356061 - RNA, 11 nt, Human
gaggccagccu

SEQ ID NO: 1356062 - RNA, 21 nt, Human
gaggccagaggcccccagccc

SEQ ID NO: 1356063 - RNA, 17 nt, Human
gaggcuccagagggcac

SEQ ID NO: 1356064 - RNA, 16 nt, Human
gaggccagccuggccu

SEQ ID NO: 1356065 - RNA, 15 nt, Human
gaggccagccuggcc

SEQ ID NO: 1356066 - RNA, 14 nt, Human
gaggcucuggagcc

SEQ ID NO: 1356067 - RNA, 19 nt, Human
gaggcucuggagcccacug

SEQ ID NO: 1356068 - RNA, 11 nt, Human
gagggcucuga

SEQ ID NO: 1356069 - RNA, 21 nt, Human
gagggcucgaggggugggcug

SEQ ID NO: 1356070 - RNA, 19 nt, Human
gagggcucgaggggugggc

SEQ ID NO: 1356071 - RNA, 17 nt, Human
gagggcucacucagcca

SEQ ID NO: 1356072 - RNA, 14 nt, Human
gagggcucacucag

SEQ ID NO: 1356073 - RNA, 15 nt, Human
gaggggaagaggccu

SEQ ID NO: 1356074 - RNA, 16 nt, Human
gaggggaagaggccug

SEQ ID NO: 1356075 - RNA, 12 nt, Human
gaggggaagagg

SEQ ID NO: 1356076 - RNA, 12 nt, Human
gagggcgugucu

SEQ ID NO: 1356077 - RNA, 23 nt, Human
gagggcggcaggggccuggagau

SEQ ID NO: 1356078 - RNA, 19 nt, Human
gagggcggcaggggccugg

SEQ ID NO: 1356079 - RNA, 13 nt, Human
gagggcggcaggg

SEQ ID NO: 1356080 - RNA, 15 nt, Human
gagggcgcaggccgu

SEQ ID NO: 1356081 - RNA, 23 nt, Human
gaggcugcccuccugugcucagc

SEQ ID NO: 1356082 - RNA, 15 nt, Human
gaggcugcccuccug

SEQ ID NO: 1356083 - RNA, 14 nt, Human
gaggcugcccuccu

SEQ ID NO: 1356084 - RNA, 13 nt, Human
gaggcugcccucc

SEQ ID NO: 1356085 - RNA, 19 nt, Human
gaggcugccccucucacca

SEQ ID NO: 1356086 - RNA, 18 nt, Human
gaggcugccccucucacc

SEQ ID NO: 1356087 - RNA, 15 nt, Human
gaggcugccccucuc

SEQ ID NO: 1356088 - RNA, 14 nt, Human
gaggcugccccucu

SEQ ID NO: 1356089 - RNA, 20 nt, Human
gaggcucuggagcccacugu

SEQ ID NO: 1356090 - RNA, 15 nt, Human
gagucacugagacca

SEQ ID NO: 1356091 - RNA, 14 nt, Human
gagucacugagacc

SEQ ID NO: 1356092 - RNA, 14 nt, Human
gagguggcuggguu

SEQ ID NO: 1356093 - RNA, 16 nt, Human
gaguugaggccacugu

SEQ ID NO: 1356094 - RNA, 12 nt, Human
gaguugaggcca

SEQ ID NO: 1356095 - RNA, 19 nt, Human
gaguugauacuacaguuug

SEQ ID NO: 1356096 - RNA, 22 nt, Human
gaguugauacuacaguuuguua

SEQ ID NO: 1356097 - RNA, 15 nt, Human
gaguccaagaaucca

SEQ ID NO: 1356098 - RNA, 23 nt, Human
gagugagacccagcccucauccc

SEQ ID NO: 1356099 - RNA, 22 nt, Human
gagugagacccagcccucaucc

SEQ ID NO: 1356100 - RNA, 14 nt, Human
gagugagacagacu

SEQ ID NO: 1356101 - RNA, 14 nt, Human
gaguccaagcuggg

SEQ ID NO: 1356102 - RNA, 12 nt, Human
gaguccaagcug

SEQ ID NO: 1356103 - RNA, 14 nt, Human
gagucauuuuuaca

SEQ ID NO: 1356104 - RNA, 18 nt, Human
gagucauucguucugugg

SEQ ID NO: 1356105 - RNA, 18 nt, Human
gagcugugcaggugggga

SEQ ID NO: 1356106 - RNA, 23 nt, Human
gagccugugacauacccccuccc

SEQ ID NO: 1356107 - RNA, 18 nt, Human
gagcuguauuaagccacu

SEQ ID NO: 1356108 - RNA, 20 nt, Human
gagcuggugcggcuggccau

SEQ ID NO: 1356109 - RNA, 21 nt, Human
gagcugugaguucucccugua

SEQ ID NO: 1356110 - RNA, 20 nt, Human
gagcugugaguucucccugu

SEQ ID NO: 1356111 - RNA, 19 nt, Human
gagccugugccuccucacc

SEQ ID NO: 1356112 - RNA, 22 nt, Human
gagcccgaggaggugucucagg

SEQ ID NO: 1356113 - RNA, 24 nt, Human
gagcccgaggaggugucucaggcu

SEQ ID NO: 1356114 - RNA, 20 nt, Human
gagcccgaggaggugucuca

SEQ ID NO: 1356115 - RNA, 15 nt, Human
gagcccgaggaggug

SEQ ID NO: 1356116 - RNA, 24 nt, Human
gagcaucaugccucugaggccagc

SEQ ID NO: 1356117 - RNA, 23 nt, Human
gagcaucaugccucugaggccag

SEQ ID NO: 1356118 - RNA, 22 nt, Human
gagcaucaugccucugaggcca

SEQ ID NO: 1356119 - RNA, 21 nt, Human
gagcaucaugccucugaggcc

SEQ ID NO: 1356120 - RNA, 20 nt, Human
gagcaucaugccucugaggc

SEQ ID NO: 1356121 - RNA, 19 nt, Human
gagcaucaugccucugagg

SEQ ID NO: 1356122 - RNA, 18 nt, Human
gagcaucaugccucugag

SEQ ID NO: 1356123 - RNA, 17 nt, Human
gagcaucaugccucuga

SEQ ID NO: 1356124 - RNA, 16 nt, Human
gagcaucaugccucug

SEQ ID NO: 1356125 - RNA, 14 nt, Human
gagcaucaugccuc

SEQ ID NO: 1356126 - RNA, 13 nt, Human
gagcaucaugccu

SEQ ID NO: 1356127 - RNA, 21 nt, Human
gagcgaggagaugcuccuugg

SEQ ID NO: 1356128 - RNA, 18 nt, Human
gagcgaggagaugcuccu

SEQ ID NO: 1356129 - RNA, 20 nt, Human
gagcgagagaucaaagauga

SEQ ID NO: 1356130 - RNA, 19 nt, Human
gagcgagagaucaaagaug

SEQ ID NO: 1356131 - RNA, 17 nt, Human
gagcgagagaucaaaga

SEQ ID NO: 1356132 - RNA, 15 nt, Human
gagccuuccacccag

SEQ ID NO: 1356133 - RNA, 14 nt, Human
gagccuuccaccca

SEQ ID NO: 1356134 - RNA, 22 nt, Human
gagaagcuccucuccccagccc

SEQ ID NO: 1356135 - RNA, 19 nt, Human
gagaagcuccucuccccag

SEQ ID NO: 1356136 - RNA, 17 nt, Human
gagaagcucagcugcau

SEQ ID NO: 1356137 - RNA, 23 nt, Human
gagcaguggcugguccagggcua

SEQ ID NO: 1356138 - RNA, 14 nt, Human
gagcaguggcuggu

SEQ ID NO: 1356139 - RNA, 23 nt, Human
gagcagugcuuuuggcggggagg

SEQ ID NO: 1356140 - RNA, 21 nt, Human
gagcagugcuuuuggcgggga

SEQ ID NO: 1356141 - RNA, 15 nt, Human
gagcagugcuuuugg

SEQ ID NO: 1356142 - RNA, 13 nt, Human
gagcagugcuuuu

SEQ ID NO: 1356143 - RNA, 23 nt, Human
gagcaguccuuggccugcuaagg

SEQ ID NO: 1356144 - RNA, 21 nt, Human
gagcagugaaugauucagugu

SEQ ID NO: 1356145 - RNA, 22 nt, Human
gagcaguccuuggccugcuaag

SEQ ID NO: 1356146 - RNA, 18 nt, Human
gagcaguccuuggccugc

SEQ ID NO: 1356147 - RNA, 21 nt, Human
gagcagugggaggguaccagc

SEQ ID NO: 1356148 - RNA, 17 nt, Human
gagcaguccuuggccug

SEQ ID NO: 1356149 - RNA, 15 nt, Human
gccaaggaccugaga

SEQ ID NO: 1356150 - RNA, 14 nt, Human
gccaaggaaaggca

SEQ ID NO: 1356151 - RNA, 22 nt, Human
gccaagcugaggugcccaggag

SEQ ID NO: 1356152 - RNA, 23 nt, Human
gccaagcugaggugcccaggaga

SEQ ID NO: 1356153 - RNA, 21 nt, Human
gccaagcugaggugcccagga

SEQ ID NO: 1356154 - RNA, 18 nt, Human
gccaagcugaggugccca

SEQ ID NO: 1356155 - RNA, 15 nt, Human
gccaagcugaggugc

SEQ ID NO: 1356156 - RNA, 14 nt, Human
gccaagcugaggug

SEQ ID NO: 1356157 - RNA, 16 nt, Human
gccaagcuccaagccc

SEQ ID NO: 1356158 - RNA, 16 nt, Human
gccaaggcagaggccu

SEQ ID NO: 1356159 - RNA, 15 nt, Human
gccaaggcagaggcc

SEQ ID NO: 1356160 - RNA, 14 nt, Human
gccaaggcagaggc

SEQ ID NO: 1356161 - RNA, 21 nt, Human
gccaaggagucacugagacca

SEQ ID NO: 1356162 - RNA, 21 nt, Human
gccaaggcagaggccugggcu

SEQ ID NO: 1356163 - RNA, 20 nt, Human
gcauggcagggggcugcugc

SEQ ID NO: 1356164 - RNA, 19 nt, Human
gcauggcagggggcugcug

SEQ ID NO: 1356165 - RNA, 18 nt, Human
gcauggcagggggcugcu

SEQ ID NO: 1356166 - RNA, 21 nt, Human
gcauggcagggggcugcugcu

SEQ ID NO: 1356167 - RNA, 22 nt, Human
gcaucggacaagacccccagca

SEQ ID NO: 1356168 - RNA, 20 nt, Human
gcaucgcaccauucugacuc

SEQ ID NO: 1356169 - RNA, 21 nt, Human
gcauggcauccuccagccccu

SEQ ID NO: 1356170 - RNA, 18 nt, Human
gcauggcauccuccagcc

SEQ ID NO: 1356171 - RNA, 17 nt, Human
gcauggcauccuccagc

SEQ ID NO: 1356172 - RNA, 18 nt, Human
gcaucgcaccauucugac

SEQ ID NO: 1356173 - RNA, 23 nt, Human
gcauguaguaacacuaauauauu

SEQ ID NO: 1356174 - RNA, 24 nt, Human
gcauguaguaacacuaauauauuu

SEQ ID NO: 1356175 - RNA, 22 nt, Human
gcauguaguaacacuaauauau

SEQ ID NO: 1356176 - RNA, 21 nt, Human
gcauguaguaacacuaauaua

SEQ ID NO: 1356177 - RNA, 17 nt, Human
gcauguaguaacacuaa

SEQ ID NO: 1356178 - RNA, 16 nt, Human
gcauguaguaacacua

SEQ ID NO: 1356179 - RNA, 13 nt, Human
gcauguaguaaca

SEQ ID NO: 1356180 - RNA, 21 nt, Human
gcauguacggauuuucaguua

SEQ ID NO: 1356181 - RNA, 19 nt, Human
gcauggcauccuccagccc

SEQ ID NO: 1356182 - RNA, 16 nt, Human
gcauuguaaaauaauu

SEQ ID NO: 1356183 - RNA, 20 nt, Human
gcauuguaaaagcauuuugu

SEQ ID NO: 1356184 - RNA, 10 nt, Human
gcauuguaaa

SEQ ID NO: 1356185 - RNA, 19 nt, Human
gcauguccuguaaagguua

SEQ ID NO: 1356186 - RNA, 22 nt, Human
gcauuucacuuucccgguguuc

SEQ ID NO: 1356187 - RNA, 18 nt, Human
gcauuuaaaacagacacu

SEQ ID NO: 1356188 - RNA, 21 nt, Human
gcauuuccuaucaccuauuuc

SEQ ID NO: 1356189 - RNA, 18 nt, Human
gcauuucccuuccuuccu

SEQ ID NO: 1356190 - RNA, 22 nt, Human
gcauugugauuggccuguagag

SEQ ID NO: 1356191 - RNA, 17 nt, Human
gcauugugauuggccug

SEQ ID NO: 1356192 - RNA, 12 nt, Human
gcauuuaaaaga

SEQ ID NO: 1356193 - RNA, 15 nt, Human
gcauuuaaaagauac

SEQ ID NO: 1356194 - RNA, 15 nt, Human
gccaaccuaaaacuc

SEQ ID NO: 1356195 - RNA, 15 nt, Human
gcauuugaaugcauu

SEQ ID NO: 1356196 - RNA, 16 nt, Human
gcauuugaaugcauuu

SEQ ID NO: 1356197 - RNA, 21 nt, Human
gcauuuccuggguggcuacuc

SEQ ID NO: 1356198 - RNA, 14 nt, Human
gcauuuccugggug

SEQ ID NO: 1356199 - RNA, 13 nt, Human
gcauuuccugggu

SEQ ID NO: 1356200 - RNA, 12 nt, Human
gcauuuccuggg

SEQ ID NO: 1356201 - RNA, 14 nt, Human
gcauuugaaaauuu

SEQ ID NO: 1356202 - RNA, 16 nt, Human
gcauuugaaaauuuug

SEQ ID NO: 1356203 - RNA, 10 nt, Human
gcauuugaau

SEQ ID NO: 1356204 - RNA, 12 nt, Human
gcauuugaaugc

SEQ ID NO: 1356205 - RNA, 13 nt, Human
gcauuugaaugca

SEQ ID NO: 1356206 - RNA, 23 nt, Human
gccaagacugcuguggccaggag

SEQ ID NO: 1356207 - RNA, 22 nt, Human
gccaagacugcuguggccagga

SEQ ID NO: 1356208 - RNA, 21 nt, Human
gccaagacugcuguggccagg

SEQ ID NO: 1356209 - RNA, 20 nt, Human
gccaagacugcuguggccag

SEQ ID NO: 1356210 - RNA, 15 nt, Human
gccaagacugcugug

SEQ ID NO: 1356211 - RNA, 14 nt, Human
gccaagacugcugu

SEQ ID NO: 1356212 - RNA, 20 nt, Human
gccaagaagcaguggccuua

SEQ ID NO: 1356213 - RNA, 19 nt, Human
gccaagaagcaguggccuu

SEQ ID NO: 1356214 - RNA, 16 nt, Human
gccaagaagcaguggc

SEQ ID NO: 1356215 - RNA, 15 nt, Human
gccaagaagcagugg

SEQ ID NO: 1356216 - RNA, 22 nt, Human
gccaagaaacgucuucuaaacu

SEQ ID NO: 1356217 - RNA, 21 nt, Human
gccaagaaacgucuucuaaac

SEQ ID NO: 1356218 - RNA, 15 nt, Human
gccaagaaacgucuu

SEQ ID NO: 1356219 - RNA, 21 nt, Human
gccaacuuuccccacguuaaa

SEQ ID NO: 1356220 - RNA, 15 nt, Human
gccaacuagccccug

SEQ ID NO: 1356221 - RNA, 14 nt, Human
gccaacuauggccu

SEQ ID NO: 1356222 - RNA, 15 nt, Human
gccaacuauggccug

SEQ ID NO: 1356223 - RNA, 20 nt, Human
gccaacuagccccuggggug

SEQ ID NO: 1356224 - RNA, 18 nt, Human
gccaacuaugauuauuaa

SEQ ID NO: 1356225 - RNA, 17 nt, Human
gccaacuagccccuggg

SEQ ID NO: 1356226 - RNA, 16 nt, Human
gccaacuagccccugg

SEQ ID NO: 1356227 - RNA, 19 nt, Human
gccaacuauggccugugga

SEQ ID NO: 1356228 - RNA, 17 nt, Human
gcaguugagacaagaaa

SEQ ID NO: 1356229 - RNA, 23 nt, Human
gcagguucccacuuaaaaauuaa

SEQ ID NO: 1356230 - RNA, 12 nt, Human
gcagguucccac

SEQ ID NO: 1356231 - RNA, 19 nt, Human
gcagguucccaagcucaga

SEQ ID NO: 1356232 - RNA, 18 nt, Human
gcagguucccaagcucag

SEQ ID NO: 1356233 - RNA, 16 nt, Human
gcagguucccaagcuc

SEQ ID NO: 1356234 - RNA, 15 nt, Human
gcagguucccaagcu

SEQ ID NO: 1356235 - RNA, 13 nt, Human
gcagguucccaag

SEQ ID NO: 1356236 - RNA, 20 nt, Human
gcagggacuguaaacacaga

SEQ ID NO: 1356237 - RNA, 15 nt, Human
gcauaaaagaugaaa

SEQ ID NO: 1356238 - RNA, 23 nt, Human
gcaguuuuuuuuuucuugucuau

SEQ ID NO: 1356239 - RNA, 20 nt, Human
gcauacaaguuucauucucc

SEQ ID NO: 1356240 - RNA, 17 nt, Human
gcauaacaauuccucua

SEQ ID NO: 1356241 - RNA, 16 nt, Human
gcauaacaauuccucu

SEQ ID NO: 1356242 - RNA, 13 nt, Human
gcauaaauuauug

SEQ ID NO: 1356243 - RNA, 15 nt, Human
gcauaccacuuuugu

SEQ ID NO: 1356244 - RNA, 16 nt, Human
gcauaccacuuuuguu

SEQ ID NO: 1356245 - RNA, 19 nt, Human
gcagcuuagaguuggccau

SEQ ID NO: 1356246 - RNA, 17 nt, Human
gcagcuguuuuguugac

SEQ ID NO: 1356247 - RNA, 12 nt, Human
gcagcuuccaga

SEQ ID NO: 1356248 - RNA, 20 nt, Human
gcagcuguuuuguugacauu

SEQ ID NO: 1356249 - RNA, 22 nt, Human
gcagcuucugcccccugcagaa

SEQ ID NO: 1356250 - RNA, 20 nt, Human
gcagcuucugcccccugcag

SEQ ID NO: 1356251 - RNA, 17 nt, Human
gcagcuucugcccccug

SEQ ID NO: 1356252 - RNA, 16 nt, Human
gcagcuucugcccccu

SEQ ID NO: 1356253 - RNA, 17 nt, Human
gcaggcugauuucuagg

SEQ ID NO: 1356254 - RNA, 12 nt, Human
gcaggcugauuu

SEQ ID NO: 1356255 - RNA, 19 nt, Human
gcaggcugagugcauuugg

SEQ ID NO: 1356256 - RNA, 21 nt, Human
gcagcuucugcccccugcaga

SEQ ID NO: 1356257 - RNA, 23 nt, Human
gcaggcucccagggacaccuggg

SEQ ID NO: 1356258 - RNA, 14 nt, Human
gcaggcuggccagu

SEQ ID NO: 1356259 - RNA, 12 nt, Human
gcaggcuggcca

SEQ ID NO: 1356260 - RNA, 18 nt, Human
gcagggaacauggggagg

SEQ ID NO: 1356261 - RNA, 17 nt, Human
gcagggaacauggggag

SEQ ID NO: 1356262 - RNA, 22 nt, Human
gcaggcuggccaguccaggcug

SEQ ID NO: 1356263 - RNA, 15 nt, Human
gcacucuagauucca

SEQ ID NO: 1356264 - RNA, 20 nt, Human
gcacuuucuauccucuguaa

SEQ ID NO: 1356265 - RNA, 17 nt, Human
gcacugaagugcuuagu

SEQ ID NO: 1356266 - RNA, 22 nt, Human
gcacugaaagucacggcugcgc

SEQ ID NO: 1356267 - RNA, 20 nt, Human
gcacuuuggcuuauaauucu

SEQ ID NO: 1356268 - RNA, 21 nt, Human
gcacuuuggcuuauaauucuu

SEQ ID NO: 1356269 - RNA, 17 nt, Human
gcacuuuggcuuauaau

SEQ ID NO: 1356270 - RNA, 16 nt, Human
gcacuuuggcuuauaa

SEQ ID NO: 1356271 - RNA, 21 nt, Human
gcacuuugcuuuaauauaaau

SEQ ID NO: 1356272 - RNA, 20 nt, Human
gcacuuugcuuuaauauaaa

SEQ ID NO: 1356273 - RNA, 19 nt, Human
gcacuuugcuuuaauauaa

SEQ ID NO: 1356274 - RNA, 17 nt, Human
gcacuuugcuuuaauau

SEQ ID NO: 1356275 - RNA, 15 nt, Human
gcaacccgugccaag

SEQ ID NO: 1356276 - RNA, 23 nt, Human
gcaaaacucuacuuaauccaaug

SEQ ID NO: 1356277 - RNA, 22 nt, Human
gcaaaacucuacuuaauccaau

SEQ ID NO: 1356278 - RNA, 17 nt, Human
gcaaaacucuacuuaau

SEQ ID NO: 1356279 - RNA, 19 nt, Human
gcaaaagaauggcagaaaa

SEQ ID NO: 1356280 - RNA, 15 nt, Human
gcaaaagaagaaguu

SEQ ID NO: 1356281 - RNA, 11 nt, Human
gcaaaagaaga

SEQ ID NO: 1356282 - RNA, 23 nt, Human
gcaaccgucuguuaugcugugac

SEQ ID NO: 1356283 - RNA, 22 nt, Human
gcaacccgugccaaguccaggu

SEQ ID NO: 1356284 - RNA, 19 nt, Human
gcaacccgugccaagucca

SEQ ID NO: 1356285 - RNA, 18 nt, Human
gcaacccgugccaagucc

SEQ ID NO: 1356286 - RNA, 24 nt, Human
gcaaccguggcccuuccuggacag

SEQ ID NO: 1356287 - RNA, 22 nt, Human
gcaaccguggcccuuccuggac

SEQ ID NO: 1356288 - RNA, 21 nt, Human
gcaaccguggcccuuccugga

SEQ ID NO: 1356289 - RNA, 20 nt, Human
gcaaccguggcccuuccugg

SEQ ID NO: 1356290 - RNA, 19 nt, Human
gcaaccguggcccuuccug

SEQ ID NO: 1356291 - RNA, 18 nt, Human
gcaaccguggcccuuccu

SEQ ID NO: 1356292 - RNA, 17 nt, Human
gcaaccuccaccuccug

SEQ ID NO: 1356293 - RNA, 16 nt, Human
gcaaccuccaccuccu

SEQ ID NO: 1356294 - RNA, 19 nt, Human
gcaaccucaguaauuuaga

SEQ ID NO: 1356295 - RNA, 19 nt, Human
gcaaccuaccuguugagca

SEQ ID NO: 1356296 - RNA, 23 nt, Human
gcaaccguggcccuuccuggaca

SEQ ID NO: 1356297 - RNA, 13 nt, Human
gcaaccuccaccu

SEQ ID NO: 1356298 - RNA, 18 nt, Human
gcaaguuuccaucaucua

SEQ ID NO: 1356299 - RNA, 11 nt, Human
gcaauaaagca

SEQ ID NO: 1356300 - RNA, 13 nt, Human
gcaauacauacca

SEQ ID NO: 1356301 - RNA, 18 nt, Human
gcaauagucaaauugugu

SEQ ID NO: 1356302 - RNA, 21 nt, Human
gcaauaaagcagcguuucuau

SEQ ID NO: 1356303 - RNA, 22 nt, Human
gcaauagucaaauugugugaaa

SEQ ID NO: 1356304 - RNA, 22 nt, Human
gcacacaccaccacgccuggcu

SEQ ID NO: 1356305 - RNA, 11 nt, Human
gcaauagagac

SEQ ID NO: 1356306 - RNA, 23 nt, Human
gcaccuaauccaggcagauccag

SEQ ID NO: 1356307 - RNA, 22 nt, Human
gcaccuaauccaggcagaucca

SEQ ID NO: 1356308 - RNA, 18 nt, Human
gcaccuccacauccucca

SEQ ID NO: 1356309 - RNA, 18 nt, Human
gcaccuaauccaggcaga

SEQ ID NO: 1356310 - RNA, 17 nt, Human
gcaccuaauccaggcag

SEQ ID NO: 1356311 - RNA, 21 nt, Human
gcaccggaccagccuggccca

SEQ ID NO: 1356312 - RNA, 19 nt, Human
gcaccggaccagccuggcc

SEQ ID NO: 1356313 - RNA, 17 nt, Human
gcaccggaccagccugg

SEQ ID NO: 1356314 - RNA, 16 nt, Human
gcaccggaccagccug

SEQ ID NO: 1356315 - RNA, 15 nt, Human
gcaccggaccagccu

SEQ ID NO: 1356316 - RNA, 14 nt, Human
gcaccggaccagcc

SEQ ID NO: 1356317 - RNA, 14 nt, Human
gcacacauuuuuua

SEQ ID NO: 1356318 - RNA, 12 nt, Human
gcacacauuuuu

SEQ ID NO: 1356319 - RNA, 13 nt, Human
gcacacagggcag

SEQ ID NO: 1356320 - RNA, 13 nt, Human
gcacacagcuacu

SEQ ID NO: 1356321 - RNA, 11 nt, Human
gcacacauuuu

SEQ ID NO: 1356322 - RNA, 18 nt, Human
gcacacagcuacucuccc

SEQ ID NO: 1356323 - RNA, 16 nt, Human
gcaccuccucagccug

SEQ ID NO: 1356324 - RNA, 17 nt, Human
gcaccuccucagccuga

SEQ ID NO: 1356325 - RNA, 15 nt, Human
gcaccuccucagccu

SEQ ID NO: 1356326 - RNA, 14 nt, Human
gcaccuccucagcc

SEQ ID NO: 1356327 - RNA, 12 nt, Human
gcaccuccucag

SEQ ID NO: 1356328 - RNA, 19 nt, Human
gcacucaaccuuaagaccu

SEQ ID NO: 1356329 - RNA, 19 nt, Human
gcacuaucuuucagcucca

SEQ ID NO: 1356330 - RNA, 18 nt, Human
gcacuaucuuucagcucc

SEQ ID NO: 1356331 - RNA, 13 nt, Human
gcacucuagauuc

SEQ ID NO: 1356332 - RNA, 12 nt, Human
gcacucuagauu

SEQ ID NO: 1356333 - RNA, 11 nt, Human
gcacucuagau

SEQ ID NO: 1356334 - RNA, 22 nt, Human
gcacucccaccugacacaccag

SEQ ID NO: 1356335 - RNA, 18 nt, Human
gcacucccaccugacaca

SEQ ID NO: 1356336 - RNA, 17 nt, Human
gcacucccaccugacac

SEQ ID NO: 1356337 - RNA, 20 nt, Human
gauuuaagggcccaggucag

SEQ ID NO: 1356338 - RNA, 18 nt, Human
gauuuaacauuaucuagu

SEQ ID NO: 1356339 - RNA, 22 nt, Human
gauucuuuccauuugcauuugu

SEQ ID NO: 1356340 - RNA, 20 nt, Human
gauucuuucccaauucacau

SEQ ID NO: 1356341 - RNA, 21 nt, Human
gauuuuuuuuuuuucucucaa

SEQ ID NO: 1356342 - RNA, 16 nt, Human
gauuuuuuuuuuuucu

SEQ ID NO: 1356343 - RNA, 17 nt, Human
gauuucauaguucagaa

SEQ ID NO: 1356344 - RNA, 18 nt, Human
gauuucauaguucagaau

SEQ ID NO: 1356345 - RNA, 15 nt, Human
gauuucauaguucag

SEQ ID NO: 1356346 - RNA, 15 nt, Human
gauuucauacuguaa

SEQ ID NO: 1356347 - RNA, 19 nt, Human
gauuucaguucuaggaaaa

SEQ ID NO: 1356348 - RNA, 21 nt, Human
gauuuuuuuuuuuuuuuccuu

SEQ ID NO: 1356349 - RNA, 20 nt, Human
gauuuuuuuuuuuuuuuccu

SEQ ID NO: 1356350 - RNA, 13 nt, Human
gcaaaaaagaaaa

SEQ ID NO: 1356351 - RNA, 14 nt, Human
gcaaaaaagaaaac

SEQ ID NO: 1356352 - RNA, 19 nt, Human
gauucuuuccauuugcauu

SEQ ID NO: 1356353 - RNA, 18 nt, Human
gauucuuuccauuugcau

SEQ ID NO: 1356354 - RNA, 17 nt, Human
gauucuuuccauuugca

SEQ ID NO: 1356355 - RNA, 20 nt, Human
gauuuaacagaaauguacag

SEQ ID NO: 1356356 - RNA, 23 nt, Human
gauuuaacagaaauguacagcaa

SEQ ID NO: 1356357 - RNA, 12 nt, Human
gauucuguacau

SEQ ID NO: 1356358 - RNA, 11 nt, Human
gaugugcauuc

SEQ ID NO: 1356359 - RNA, 19 nt, Human
gaugugcacguaaaguacu

SEQ ID NO: 1356360 - RNA, 18 nt, Human
gaugugauuguggaaugg

SEQ ID NO: 1356361 - RNA, 16 nt, Human
gaugugauuguggaau

SEQ ID NO: 1356362 - RNA, 15 nt, Human
gaugugauuguggaa

SEQ ID NO: 1356363 - RNA, 15 nt, Human
gaugugauauucuaa

SEQ ID NO: 1356364 - RNA, 18 nt, Human
gaugugauauauaagugu

SEQ ID NO: 1356365 - RNA, 11 nt, Human
gaugugauaua

SEQ ID NO: 1356366 - RNA, 19 nt, Human
gaugugaguugcacagcua

SEQ ID NO: 1356367 - RNA, 12 nt, Human
gaugucuuuguu

SEQ ID NO: 1356368 - RNA, 16 nt, Human
gaugucuuuguuaaga

SEQ ID NO: 1356369 - RNA, 22 nt, Human
gaugucuuggaacauuggaaug

SEQ ID NO: 1356370 - RNA, 21 nt, Human
gaugucuuggaacauuggaau

SEQ ID NO: 1356371 - RNA, 13 nt, Human
gaugucuuggaac

SEQ ID NO: 1356372 - RNA, 15 nt, Human
gaugucuccuaagca

SEQ ID NO: 1356373 - RNA, 19 nt, Human
gaugucuccuaagcaccug

SEQ ID NO: 1356374 - RNA, 15 nt, Human
gauguccccagcaga

SEQ ID NO: 1356375 - RNA, 13 nt, Human
gauguccccagca

SEQ ID NO: 1356376 - RNA, 11 nt, Human
gauguccccag

SEQ ID NO: 1356377 - RNA, 20 nt, Human
gaugucauacagagaaguca

SEQ ID NO: 1356378 - RNA, 18 nt, Human
gaugucauacagagaagu

SEQ ID NO: 1356379 - RNA, 17 nt, Human
gaugucauacagagaag

SEQ ID NO: 1356380 - RNA, 16 nt, Human
gaugucauacagagaa

SEQ ID NO: 1356381 - RNA, 15 nt, Human
gaugucauacagaga

SEQ ID NO: 1356382 - RNA, 13 nt, Human
gauguaauuuugu

SEQ ID NO: 1356383 - RNA, 15 nt, Human
gauguaauacuucuu

SEQ ID NO: 1356384 - RNA, 14 nt, Human
gauguaauacuucu

SEQ ID NO: 1356385 - RNA, 22 nt, Human
gauguaauacuucuugugugua

SEQ ID NO: 1356386 - RNA, 13 nt, Human
gauguaauacuuc

SEQ ID NO: 1356387 - RNA, 17 nt, Human
gauguaaggaugggcau

SEQ ID NO: 1356388 - RNA, 19 nt, Human
gauguaauuuuguguaaga

SEQ ID NO: 1356389 - RNA, 14 nt, Human
gauguaaagauguu

SEQ ID NO: 1356390 - RNA, 17 nt, Human
gauggaguuucuaaggu

SEQ ID NO: 1356391 - RNA, 15 nt, Human
gauggaguuucuaag

SEQ ID NO: 1356392 - RNA, 13 nt, Human
gauggaguuucua

SEQ ID NO: 1356393 - RNA, 15 nt, Human
gauggagugcuguuu

SEQ ID NO: 1356394 - RNA, 14 nt, Human
gaugcuuuuaacag

SEQ ID NO: 1356395 - RNA, 15 nt, Human
gaugcuuuuaacaga

SEQ ID NO: 1356396 - RNA, 16 nt, Human
gaugcuugggaagacu

SEQ ID NO: 1356397 - RNA, 14 nt, Human
gaugcuuguacaua

SEQ ID NO: 1356398 - RNA, 16 nt, Human
gaugcuuguacauaau

SEQ ID NO: 1356399 - RNA, 23 nt, Human
gaugauuaaauaagauucuaacg

SEQ ID NO: 1356400 - RNA, 21 nt, Human
gaugcugucuucguacuggga

SEQ ID NO: 1356401 - RNA, 21 nt, Human
gaugagggaaaagaaaaagau

SEQ ID NO: 1356402 - RNA, 14 nt, Human
gaugaugacuaugg

SEQ ID NO: 1356403 - RNA, 13 nt, Human
gaugaggcaaccc

SEQ ID NO: 1356404 - RNA, 23 nt, Human
gaugagcucccacaagccugagg

SEQ ID NO: 1356405 - RNA, 21 nt, Human
gaugagcucccacaagccuga

SEQ ID NO: 1356406 - RNA, 20 nt, Human
gaugagcucccacaagccug

SEQ ID NO: 1356407 - RNA, 18 nt, Human
gaugagcucccacaagcc

SEQ ID NO: 1356408 - RNA, 21 nt, Human
gaugaggcccuccacaccugc

SEQ ID NO: 1356409 - RNA, 22 nt, Human
gaugaggcccuccacaccugcg

SEQ ID NO: 1356410 - RNA, 20 nt, Human
gaugaggcccuccacaccug

SEQ ID NO: 1356411 - RNA, 19 nt, Human
gaugaggcccuccacaccu

SEQ ID NO: 1356412 - RNA, 13 nt, Human
gaugaggccagac

SEQ ID NO: 1356413 - RNA, 15 nt, Human
gaugaggccagacca

SEQ ID NO: 1356414 - RNA, 15 nt, Human
gaugaggcccuccac

SEQ ID NO: 1356415 - RNA, 22 nt, Human
gaugaggccagaccauggacac

SEQ ID NO: 1356416 - RNA, 12 nt, Human
gaucuggcaugu

SEQ ID NO: 1356417 - RNA, 23 nt, Human
gaucuggaaccucagccuggcca

SEQ ID NO: 1356418 - RNA, 18 nt, Human
cagagcuucccugacuca

SEQ ID NO: 1356419 - RNA, 14 nt, Human
cagagcuucccuga

SEQ ID NO: 1356420 - RNA, 13 nt, Human
cagagcuucccug

SEQ ID NO: 1356421 - RNA, 23 nt, Human
cagagcuggugcggcuggccaug

SEQ ID NO: 1356422 - RNA, 22 nt, Human
cagagcuggugcggcuggccau

SEQ ID NO: 1356423 - RNA, 21 nt, Human
cagagcuggugcggcuggcca

SEQ ID NO: 1356424 - RNA, 20 nt, Human
cagagcuggugcggcuggcc

SEQ ID NO: 1356425 - RNA, 19 nt, Human
cagagcuggugcggcuggc

SEQ ID NO: 1356426 - RNA, 18 nt, Human
cagagcuggugcggcugg

SEQ ID NO: 1356427 - RNA, 13 nt, Human
cagagcuggugcg

SEQ ID NO: 1356428 - RNA, 12 nt, Human
cagagcuggugc

SEQ ID NO: 1356429 - RNA, 11 nt, Human
cagagcuggug

SEQ ID NO: 1356430 - RNA, 21 nt, Human
cagagggcuggaggcccaggc

SEQ ID NO: 1356431 - RNA, 16 nt, Human
cagaggggcagaggcc

SEQ ID NO: 1356432 - RNA, 20 nt, Human
cagagggcuggaggcccagg

SEQ ID NO: 1356433 - RNA, 19 nt, Human
cagagggcuggaggcccag

SEQ ID NO: 1356434 - RNA, 18 nt, Human
cagagggcuggaggccca

SEQ ID NO: 1356435 - RNA, 17 nt, Human
cagagggcuggaggccc

SEQ ID NO: 1356436 - RNA, 15 nt, Human
cagagggcuggaggc

SEQ ID NO: 1356437 - RNA, 14 nt, Human
cagagggcuggagg

SEQ ID NO: 1356438 - RNA, 13 nt, Human
cagagggcuggag

SEQ ID NO: 1356439 - RNA, 12 nt, Human
cagagggcugga

SEQ ID NO: 1356440 - RNA, 11 nt, Human
cagagggcugg

SEQ ID NO: 1356441 - RNA, 10 nt, Human
cagagggcug

SEQ ID NO: 1356442 - RNA, 23 nt, Human
cagagcuucccugacucauucug

SEQ ID NO: 1356443 - RNA, 20 nt, Human
cagaggggccugccaccugg

SEQ ID NO: 1356444 - RNA, 17 nt, Human
cagaggggccugccacc

SEQ ID NO: 1356445 - RNA, 14 nt, Human
cagaggggccugcc

SEQ ID NO: 1356446 - RNA, 21 nt, Human
cagaggggccugccaccugga

SEQ ID NO: 1356447 - RNA, 15 nt, Human
cagauauuugucaug

SEQ ID NO: 1356448 - RNA, 19 nt, Human
cagauaugauucaaauguc

SEQ ID NO: 1356449 - RNA, 17 nt, Human
cagauaugauucaaaug

SEQ ID NO: 1356450 - RNA, 16 nt, Human
cagauaugauucaaau

SEQ ID NO: 1356451 - RNA, 18 nt, Human
cagcaccguucugugcac

SEQ ID NO: 1356452 - RNA, 17 nt, Human
cagcaccguucugugca

SEQ ID NO: 1356453 - RNA, 16 nt, Human
cagcaccguucugugc

SEQ ID NO: 1356454 - RNA, 21 nt, Human
cagcaccggaccagccuggcc

SEQ ID NO: 1356455 - RNA, 20 nt, Human
cagcaccggaccagccuggc

SEQ ID NO: 1356456 - RNA, 19 nt, Human
cagcaccggaccagccugg

SEQ ID NO: 1356457 - RNA, 18 nt, Human
cagcaccggaccagccug

SEQ ID NO: 1356458 - RNA, 17 nt, Human
cagcaccggaccagccu

SEQ ID NO: 1356459 - RNA, 15 nt, Human
cagcaccggaccagc

SEQ ID NO: 1356460 - RNA, 13 nt, Human
cagcacagccaac

SEQ ID NO: 1356461 - RNA, 22 nt, Human
cagcaccggaccagccuggccc

SEQ ID NO: 1356462 - RNA, 19 nt, Human
cagcacacagggcagugag

SEQ ID NO: 1356463 - RNA, 22 nt, Human
cagcacagccucuuagaugcag

SEQ ID NO: 1356464 - RNA, 15 nt, Human
cagccaggagcuggg

SEQ ID NO: 1356465 - RNA, 16 nt, Human
cagccaggagcugggc

SEQ ID NO: 1356466 - RNA, 22 nt, Human
cagccaggagcugggcagaagg

SEQ ID NO: 1356467 - RNA, 12 nt, Human
cagccaggagcu

SEQ ID NO: 1356468 - RNA, 14 nt, Human
cagccaggagcugg

SEQ ID NO: 1356469 - RNA, 18 nt, Human
cagcgucggucugugccc

SEQ ID NO: 1356470 - RNA, 18 nt, Human
cagcguccuccucuguga

SEQ ID NO: 1356471 - RNA, 16 nt, Human
cagcguccuccucugu

SEQ ID NO: 1356472 - RNA, 15 nt, Human
cagcguccuccucug

SEQ ID NO: 1356473 - RNA, 19 nt, Human
cagcggugggaccuaggga

SEQ ID NO: 1356474 - RNA, 22 nt, Human
cagcggugggaccuagggaggc

SEQ ID NO: 1356475 - RNA, 21 nt, Human
cagccugagcaacucuugauu

SEQ ID NO: 1356476 - RNA, 15 nt, Human
cagcgugcuuuaaaa

SEQ ID NO: 1356477 - RNA, 19 nt, Human
cagcgucggucugugcccc

SEQ ID NO: 1356478 - RNA, 20 nt, Human
cagccugaaccccagggcug

SEQ ID NO: 1356479 - RNA, 22 nt, Human
cagccugaaccccagggcugua

SEQ ID NO: 1356480 - RNA, 20 nt, Human
cagccugagcaacucuugau

SEQ ID NO: 1356481 - RNA, 16 nt, Human
cagccugagcaacucu

SEQ ID NO: 1356482 - RNA, 23 nt, Human
cagccucugggggguggccaggc

SEQ ID NO: 1356483 - RNA, 22 nt, Human
cagccucugggggguggccagg

SEQ ID NO: 1356484 - RNA, 23 nt, Human
cagccgcuuggcgaugccagcca

SEQ ID NO: 1356485 - RNA, 23 nt, Human
cagccggcacagggucugcucuu

SEQ ID NO: 1356486 - RNA, 18 nt, Human
cagccggcacagggucug

SEQ ID NO: 1356487 - RNA, 17 nt, Human
cagccggcacagggucu

SEQ ID NO: 1356488 - RNA, 15 nt, Human
cagccggcacagggu

SEQ ID NO: 1356489 - RNA, 13 nt, Human
cagccggcacagg

SEQ ID NO: 1356490 - RNA, 21 nt, Human
cagccgcuuggcgaugccagc

SEQ ID NO: 1356491 - RNA, 12 nt, Human
cagccgcuuggc

SEQ ID NO: 1356492 - RNA, 11 nt, Human
cagccgcuugg

SEQ ID NO: 1356493 - RNA, 21 nt, Human
cagccgagcaggaggccuagg

SEQ ID NO: 1356494 - RNA, 23 nt, Human
cagccgagcaggaggccuaggag

SEQ ID NO: 1356495 - RNA, 19 nt, Human
cagccgagcaggaggccua

SEQ ID NO: 1356496 - RNA, 18 nt, Human
cagccgagcaggaggccu

SEQ ID NO: 1356497 - RNA, 17 nt, Human
cagccgagcaggaggcc

SEQ ID NO: 1356498 - RNA, 16 nt, Human
cagccgagcaggaggc

SEQ ID NO: 1356499 - RNA, 20 nt, Human
cagcccuucuuuccacagaa

SEQ ID NO: 1356500 - RNA, 19 nt, Human
cagcccuucuuuccacaga

SEQ ID NO: 1356501 - RNA, 16 nt, Human
cagcccuuccaaacuc

SEQ ID NO: 1356502 - RNA, 23 nt, Human
cagcccuuaugcgguuaauuuug

SEQ ID NO: 1356503 - RNA, 15 nt, Human
cagcccuucuuucca

SEQ ID NO: 1356504 - RNA, 20 nt, Human
cagcugugccucgcucccca

SEQ ID NO: 1356505 - RNA, 17 nt, Human
cagcugugccucgcucc

SEQ ID NO: 1356506 - RNA, 15 nt, Human
cagcuucagccagga

SEQ ID NO: 1356507 - RNA, 17 nt, Human
cagcuucagccaggagc

SEQ ID NO: 1356508 - RNA, 17 nt, Human
cagcugucuuuuggagg

SEQ ID NO: 1356509 - RNA, 18 nt, Human
cagcugucuuuuggagga

SEQ ID NO: 1356510 - RNA, 16 nt, Human
cagcugucuuuuggag

SEQ ID NO: 1356511 - RNA, 14 nt, Human
cagcugugccucgc

SEQ ID NO: 1356512 - RNA, 13 nt, Human
cagcugugccucg

SEQ ID NO: 1356513 - RNA, 12 nt, Human
cagcugugccuc

SEQ ID NO: 1356514 - RNA, 11 nt, Human
cagcugugccu

SEQ ID NO: 1356515 - RNA, 21 nt, Human
caggaaaugaaaaugucuugu

SEQ ID NO: 1356516 - RNA, 20 nt, Human
caggaaaugaaaaugucuug

SEQ ID NO: 1356517 - RNA, 13 nt, Human
caggaaaugaaaa

SEQ ID NO: 1356518 - RNA, 19 nt, Human
caggaaaggaaucauuucu

SEQ ID NO: 1356519 - RNA, 13 nt, Human
cagcuucagugau

SEQ ID NO: 1356520 - RNA, 20 nt, Human
caggaaagcgccuccaaccc

SEQ ID NO: 1356521 - RNA, 18 nt, Human
caggaaaggcccagccac

SEQ ID NO: 1356522 - RNA, 15 nt, Human
caggaaaggaaucau

SEQ ID NO: 1356523 - RNA, 19 nt, Human
caggaaagcgccuccaacc

SEQ ID NO: 1356524 - RNA, 22 nt, Human
cagcugcaagguacucugguga

SEQ ID NO: 1356525 - RNA, 20 nt, Human
cagcugcaagguacucuggu

SEQ ID NO: 1356526 - RNA, 19 nt, Human
cagcugcaagguacucugg

SEQ ID NO: 1356527 - RNA, 19 nt, Human
cagcucccacaagccucug

SEQ ID NO: 1356528 - RNA, 21 nt, Human
cagcucccacaagccucugcc

SEQ ID NO: 1356529 - RNA, 17 nt, Human
cagcugccccggccccu

SEQ ID NO: 1356530 - RNA, 15 nt, Human
cagcugccagugucc

SEQ ID NO: 1356531 - RNA, 11 nt, Human
cagcugccagu

SEQ ID NO: 1356532 - RNA, 19 nt, Human
cagcugccaggagcacggc

SEQ ID NO: 1356533 - RNA, 15 nt, Human
cagcugccaggagca

SEQ ID NO: 1356534 - RNA, 16 nt, Human
cagcugcauuccgcag

SEQ ID NO: 1356535 - RNA, 18 nt, Human
cagcugcacugaugcugc

SEQ ID NO: 1356536 - RNA, 12 nt, Human
cagcugcacuga

SEQ ID NO: 1356537 - RNA, 19 nt, Human
cagcugccccggccccucc

SEQ ID NO: 1356538 - RNA, 22 nt, Human
cagcugccccggccccuccccc

SEQ ID NO: 1356539 - RNA, 19 nt, Human
cagcugccucuucccucuu

SEQ ID NO: 1356540 - RNA, 21 nt, Human
cagcuccagguggcucugagg

SEQ ID NO: 1356541 - RNA, 17 nt, Human
cagcuccagguggcucu

SEQ ID NO: 1356542 - RNA, 17 nt, Human
cagcucccacaagccuc

SEQ ID NO: 1356543 - RNA, 12 nt, Human
cagcucccacaa

SEQ ID NO: 1356544 - RNA, 16 nt, Human
cagcuccaguuggagu

SEQ ID NO: 1356545 - RNA, 15 nt, Human
cagcuccacccuggc

SEQ ID NO: 1356546 - RNA, 13 nt, Human
cagcuccacccug

SEQ ID NO: 1356547 - RNA, 14 nt, Human
cagcuccagcugcu

SEQ ID NO: 1356548 - RNA, 23 nt, Human
cagcuccaaccugcaaagaucug

SEQ ID NO: 1356549 - RNA, 19 nt, Human
cagcuccaagaauuucuag

SEQ ID NO: 1356550 - RNA, 20 nt, Human
cagcuccaaccugcaaagau

SEQ ID NO: 1356551 - RNA, 17 nt, Human
cagcuccaaccugcaaa

SEQ ID NO: 1356552 - RNA, 16 nt, Human
cagcuccaagaauuuc

SEQ ID NO: 1356553 - RNA, 17 nt, Human
caggccucagggcuccu

SEQ ID NO: 1356554 - RNA, 23 nt, Human
caggccugaaagaggcugaggcc

SEQ ID NO: 1356555 - RNA, 16 nt, Human
caggccucagggcucc

SEQ ID NO: 1356556 - RNA, 14 nt, Human
caggccucagggcu

SEQ ID NO: 1356557 - RNA, 22 nt, Human
caggccugaaagaggcugaggc

SEQ ID NO: 1356558 - RNA, 13 nt, Human
cagggaggcuggu

SEQ ID NO: 1356559 - RNA, 23 nt, Human
cagggaggccgaagcuaacaggg

SEQ ID NO: 1356560 - RNA, 15 nt, Human
cagggaggccgaagc

SEQ ID NO: 1356561 - RNA, 12 nt, Human
cagggaggccga

SEQ ID NO: 1356562 - RNA, 17 nt, Human
cagggaggcccugugcc

SEQ ID NO: 1356563 - RNA, 17 nt, Human
cagggagcugggcuucc

SEQ ID NO: 1356564 - RNA, 15 nt, Human
caggcgcuaauucaa

SEQ ID NO: 1356565 - RNA, 22 nt, Human
cagggaggcugguccuauggcc

SEQ ID NO: 1356566 - RNA, 16 nt, Human
cagggaggcugguccu

SEQ ID NO: 1356567 - RNA, 14 nt, Human
cagggagguggcug

SEQ ID NO: 1356568 - RNA, 17 nt, Human
cagggagguggcugggu

SEQ ID NO: 1356569 - RNA, 18 nt, Human
caggcagauccaggacua

SEQ ID NO: 1356570 - RNA, 17 nt, Human
caggcagauccaggacu

SEQ ID NO: 1356571 - RNA, 15 nt, Human
caggcagauccagga

SEQ ID NO: 1356572 - RNA, 19 nt, Human
caggaggugccacuggagu

SEQ ID NO: 1356573 - RNA, 17 nt, Human
caggaggugccacugga

SEQ ID NO: 1356574 - RNA, 20 nt, Human
caggaggugccacuggagug

SEQ ID NO: 1356575 - RNA, 23 nt, Human
caggagggggucguggagagcua

SEQ ID NO: 1356576 - RNA, 21 nt, Human
caggagggggucguggagagc

SEQ ID NO: 1356577 - RNA, 20 nt, Human
caggagggggucguggagag

SEQ ID NO: 1356578 - RNA, 19 nt, Human
caggagggggucguggaga

SEQ ID NO: 1356579 - RNA, 18 nt, Human
caggagggggucguggag

SEQ ID NO: 1356580 - RNA, 16 nt, Human
caggagggggucgugg

SEQ ID NO: 1356581 - RNA, 23 nt, Human
caggaggggggagggaagggagc

SEQ ID NO: 1356582 - RNA, 15 nt, Human
caggaggggggaggg

SEQ ID NO: 1356583 - RNA, 22 nt, Human
caggagggcggccuccuucuga

SEQ ID NO: 1356584 - RNA, 21 nt, Human
caggagggcggccuccuucug

SEQ ID NO: 1356585 - RNA, 23 nt, Human
caggagggacaaaggagccugug

SEQ ID NO: 1356586 - RNA, 24 nt, Human
caggagggacaaaggagccuguga

SEQ ID NO: 1356587 - RNA, 22 nt, Human
caggagggacaaaggagccugu

SEQ ID NO: 1356588 - RNA, 21 nt, Human
caggagggacaaaggagccug

SEQ ID NO: 1356589 - RNA, 20 nt, Human
caggagggacaaaggagccu

SEQ ID NO: 1356590 - RNA, 19 nt, Human
caggagggacaaaggagcc

SEQ ID NO: 1356591 - RNA, 18 nt, Human
caggagggacaaaggagc

SEQ ID NO: 1356592 - RNA, 13 nt, Human
caggacccugaag

SEQ ID NO: 1356593 - RNA, 16 nt, Human
caggacccugaagggg

SEQ ID NO: 1356594 - RNA, 22 nt, Human
caggagcuccccuccccaacug

SEQ ID NO: 1356595 - RNA, 15 nt, Human
caggacccugaaggg

SEQ ID NO: 1356596 - RNA, 14 nt, Human
caggacccugaagg

SEQ ID NO: 1356597 - RNA, 12 nt, Human
caggagcugggc

SEQ ID NO: 1356598 - RNA, 15 nt, Human
caggagcugggcaga

SEQ ID NO: 1356599 - RNA, 23 nt, Human
caggagcugggcagaaggccaag

SEQ ID NO: 1356600 - RNA, 17 nt, Human
caggagcuuuggaccua

SEQ ID NO: 1356601 - RNA, 16 nt, Human
caggcagccagcaucu

SEQ ID NO: 1356602 - RNA, 14 nt, Human
caggcagccagcau

SEQ ID NO: 1356603 - RNA, 13 nt, Human
caggcagccagca

SEQ ID NO: 1356604 - RNA, 17 nt, Human
caggcagccagcaucug

SEQ ID NO: 1356605 - RNA, 20 nt, Human
caggguugaccccagaggau

SEQ ID NO: 1356606 - RNA, 19 nt, Human
caggguugaccccagagga

SEQ ID NO: 1356607 - RNA, 15 nt, Human
caggguuaagaagac

SEQ ID NO: 1356608 - RNA, 13 nt, Human
cagggugugugcu

SEQ ID NO: 1356609 - RNA, 23 nt, Human
cagggucugcucuuucucugcca

SEQ ID NO: 1356610 - RNA, 22 nt, Human
cagggucugcucuuucucugcc

SEQ ID NO: 1356611 - RNA, 21 nt, Human
cagggucugcucuuucucugc

SEQ ID NO: 1356612 - RNA, 16 nt, Human
cagggugggcuugugg

SEQ ID NO: 1356613 - RNA, 20 nt, Human
cagggucugcucuuucucug

SEQ ID NO: 1356614 - RNA, 17 nt, Human
cagggucugcucuuucu

SEQ ID NO: 1356615 - RNA, 14 nt, Human
cagggucugcucuu

SEQ ID NO: 1356616 - RNA, 13 nt, Human
cagggucugcucu

SEQ ID NO: 1356617 - RNA, 21 nt, Human
caggugaggucuguuccuuuu

SEQ ID NO: 1356618 - RNA, 16 nt, Human
caggugaggucuguuc

SEQ ID NO: 1356619 - RNA, 21 nt, Human
caggugaggucagcacaucuc

SEQ ID NO: 1356620 - RNA, 18 nt, Human
caggugcagcccccacug

SEQ ID NO: 1356621 - RNA, 20 nt, Human
caggugcagcccccacugcc

SEQ ID NO: 1356622 - RNA, 21 nt, Human
caggugcuacacccuuuucca

SEQ ID NO: 1356623 - RNA, 20 nt, Human
caggugcuaauuuguuuugg

SEQ ID NO: 1356624 - RNA, 22 nt, Human
cagguuggcucugccaguccug

SEQ ID NO: 1356625 - RNA, 23 nt, Human
cagguuggcucugccaguccugu

SEQ ID NO: 1356626 - RNA, 21 nt, Human
cagguuggcucugccaguccu

SEQ ID NO: 1356627 - RNA, 18 nt, Human
cagguuggcucugccagu

SEQ ID NO: 1356628 - RNA, 17 nt, Human
cagguuggcucugccag

SEQ ID NO: 1356629 - RNA, 16 nt, Human
cagguuggcucugcca

SEQ ID NO: 1356630 - RNA, 23 nt, Human
caggugcagcccccacugccuuu

SEQ ID NO: 1356631 - RNA, 21 nt, Human
cagucaaccugggcaaagccu

SEQ ID NO: 1356632 - RNA, 15 nt, Human
cagucaccucaugga

SEQ ID NO: 1356633 - RNA, 22 nt, Human
cagucaaccugggcaaagccua

SEQ ID NO: 1356634 - RNA, 16 nt, Human
cagucaaccugggcaa

SEQ ID NO: 1356635 - RNA, 15 nt, Human
cagucaaccugggca

SEQ ID NO: 1356636 - RNA, 14 nt, Human
cagucaaccugggc

SEQ ID NO: 1356637 - RNA, 24 nt, Human
cagucaaaaccaagucacuuaggu

SEQ ID NO: 1356638 - RNA, 17 nt, Human
caguauuuuuuuuuuua

SEQ ID NO: 1356639 - RNA, 21 nt, Human
caguauugcucacccagugcc

SEQ ID NO: 1356640 - RNA, 22 nt, Human
cagguuucuaagcauaaaagau

SEQ ID NO: 1356641 - RNA, 15 nt, Human
caguauugcucaccc

SEQ ID NO: 1356642 - RNA, 16 nt, Human
cagucgauagagcugu

SEQ ID NO: 1356643 - RNA, 15 nt, Human
cagucgauagagcug

SEQ ID NO: 1356644 - RNA, 19 nt, Human
caguccuuggccugcuaag

SEQ ID NO: 1356645 - RNA, 16 nt, Human
caguccuuggccugcu

SEQ ID NO: 1356646 - RNA, 15 nt, Human
caguccuuggccugc

SEQ ID NO: 1356647 - RNA, 13 nt, Human
caguccuuggccu

SEQ ID NO: 1356648 - RNA, 21 nt, Human
cagucucagaaugucauuuug

SEQ ID NO: 1356649 - RNA, 14 nt, Human
cagucgugccugug

SEQ ID NO: 1356650 - RNA, 13 nt, Human
cagucgugccugu

SEQ ID NO: 1356651 - RNA, 19 nt, Human
cagucucagaaugucauuu

SEQ ID NO: 1356652 - RNA, 22 nt, Human
cagucugaugagaacucugagc

SEQ ID NO: 1356653 - RNA, 18 nt, Human
cagucugagagaggccau

SEQ ID NO: 1356654 - RNA, 22 nt, Human
cagugggagcaaacugcaugcc

SEQ ID NO: 1356655 - RNA, 13 nt, Human
cagugggagccag

SEQ ID NO: 1356656 - RNA, 17 nt, Human
cagugggagccagggcu

SEQ ID NO: 1356657 - RNA, 18 nt, Human
cagugggagccagggcug

SEQ ID NO: 1356658 - RNA, 17 nt, Human
cagugcaccugucauau

SEQ ID NO: 1356659 - RNA, 14 nt, Human
cagugcacugaaag

SEQ ID NO: 1356660 - RNA, 22 nt, Human
cagugcacuaauguguaagaca

SEQ ID NO: 1356661 - RNA, 15 nt, Human
ccacuccucugcuga

SEQ ID NO: 1356662 - RNA, 14 nt, Human
ccacuccucugcug

SEQ ID NO: 1356663 - RNA, 20 nt, Human
ccacuccucugacucagggc

SEQ ID NO: 1356664 - RNA, 14 nt, Human
ccacuccucugacu

SEQ ID NO: 1356665 - RNA, 20 nt, Human
ccacgagggcuggcuggccu

SEQ ID NO: 1356666 - RNA, 22 nt, Human
ccacgagggcuggcuggccuca

SEQ ID NO: 1356667 - RNA, 19 nt, Human
ccacgagggcuggcuggcc

SEQ ID NO: 1356668 - RNA, 17 nt, Human
ccacgagggcuggcugg

SEQ ID NO: 1356669 - RNA, 15 nt, Human
ccacgagggcuggcu

SEQ ID NO: 1356670 - RNA, 14 nt, Human
ccacgagggcuggc

SEQ ID NO: 1356671 - RNA, 12 nt, Human
ccacgagggcug

SEQ ID NO: 1356672 - RNA, 18 nt, Human
ccaccucagaccccgggg

SEQ ID NO: 1356673 - RNA, 16 nt, Human
ccacgcuccagcugcc

SEQ ID NO: 1356674 - RNA, 13 nt, Human
ccacgcuccagcu

SEQ ID NO: 1356675 - RNA, 12 nt, Human
ccacgcuccagc

SEQ ID NO: 1356676 - RNA, 15 nt, Human
ccacgcucacccccu

SEQ ID NO: 1356677 - RNA, 18 nt, Human
ccacgcuagggcuggcuc

SEQ ID NO: 1356678 - RNA, 21 nt, Human
ccacgccucuugaccaggcug

SEQ ID NO: 1356679 - RNA, 19 nt, Human
ccacgccucuugaccaggc

SEQ ID NO: 1356680 - RNA, 18 nt, Human
ccacgccucuugaccagg

SEQ ID NO: 1356681 - RNA, 23 nt, Human
ccaccuagcagcaccguucugug

SEQ ID NO: 1356682 - RNA, 14 nt, Human
ccaccuagcagcac

SEQ ID NO: 1356683 - RNA, 13 nt, Human
ccaccuagcagca

SEQ ID NO: 1356684 - RNA, 21 nt, Human
ccaccuagacuguaaaccucu

SEQ ID NO: 1356685 - RNA, 22 nt, Human
ccaccgggccacuccuuccugc

SEQ ID NO: 1356686 - RNA, 21 nt, Human
ccaccgggccacuccuuccug

SEQ ID NO: 1356687 - RNA, 14 nt, Human
ccaccgggccacuc

SEQ ID NO: 1356688 - RNA, 13 nt, Human
ccaccgggccacu

SEQ ID NO: 1356689 - RNA, 20 nt, Human
ccaccgggccacuccuuccu

SEQ ID NO: 1356690 - RNA, 19 nt, Human
ccaccgggccacuccuucc

SEQ ID NO: 1356691 - RNA, 18 nt, Human
ccaccgggccacuccuuc

SEQ ID NO: 1356692 - RNA, 15 nt, Human
ccaccgggccacucc

SEQ ID NO: 1356693 - RNA, 20 nt, Human
ccaccagggcaucucugggc

SEQ ID NO: 1356694 - RNA, 15 nt, Human
ccacagcccugucag

SEQ ID NO: 1356695 - RNA, 14 nt, Human
ccacagcccuguca

SEQ ID NO: 1356696 - RNA, 12 nt, Human
ccacagcccugu

SEQ ID NO: 1356697 - RNA, 13 nt, Human
ccacagaggacac

SEQ ID NO: 1356698 - RNA, 23 nt, Human
ccacagacggaaggguaaacaau

SEQ ID NO: 1356699 - RNA, 18 nt, Human
ccacagauaacugaaaau

SEQ ID NO: 1356700 - RNA, 16 nt, Human
ccacagauaacugaaa

SEQ ID NO: 1356701 - RNA, 13 nt, Human
ccacagccagggg

SEQ ID NO: 1356702 - RNA, 11 nt, Human
ccacagccagg

SEQ ID NO: 1356703 - RNA, 22 nt, Human
ccacagacggaaggguaaacaa

SEQ ID NO: 1356704 - RNA, 21 nt, Human
ccacagacggaaggguaaaca

SEQ ID NO: 1356705 - RNA, 18 nt, Human
ccacagacggaaggguaa

SEQ ID NO: 1356706 - RNA, 16 nt, Human
ccacagaagugcuuuc

SEQ ID NO: 1356707 - RNA, 18 nt, Human
ccacagaagcuccaggua

SEQ ID NO: 1356708 - RNA, 19 nt, Human
ccacagcccugucagcaug

SEQ ID NO: 1356709 - RNA, 20 nt, Human
ccacagcccugucagcauga

SEQ ID NO: 1356710 - RNA, 17 nt, Human
ccacagcccugucagca

SEQ ID NO: 1356711 - RNA, 16 nt, Human
ccacagcccugucagc

SEQ ID NO: 1356712 - RNA, 21 nt, Human
ccaccagggcaucucugggcu

SEQ ID NO: 1356713 - RNA, 19 nt, Human
ccaccagggcaucucuggg

SEQ ID NO: 1356714 - RNA, 16 nt, Human
ccaccagggcaucucu

SEQ ID NO: 1356715 - RNA, 18 nt, Human
ccaccagucugacuguuu

SEQ ID NO: 1356716 - RNA, 22 nt, Human
ccaccaggcugcucagggcugg

SEQ ID NO: 1356717 - RNA, 18 nt, Human
ccacacuucaaacuacuu

SEQ ID NO: 1356718 - RNA, 17 nt, Human
ccacacuucaaacuacu

SEQ ID NO: 1356719 - RNA, 14 nt, Human
ccacacuucaaacu

SEQ ID NO: 1356720 - RNA, 16 nt, Human
ccacagaagcuccagg

SEQ ID NO: 1356721 - RNA, 15 nt, Human
ccaaugaaaaaaugu

SEQ ID NO: 1356722 - RNA, 23 nt, Human
ccaaugaaaaaauguauaugcac

SEQ ID NO: 1356723 - RNA, 16 nt, Human
ccaauccucccagaaa

SEQ ID NO: 1356724 - RNA, 23 nt, Human
ccaauccuaugcaugguuucagc

SEQ ID NO: 1356725 - RNA, 14 nt, Human
ccaauccuauguuu

SEQ ID NO: 1356726 - RNA, 13 nt, Human
ccaauccuauguu

SEQ ID NO: 1356727 - RNA, 22 nt, Human
ccaaggcagaggccugggcugg

SEQ ID NO: 1356728 - RNA, 21 nt, Human
ccaaggcagaggccugggcug

SEQ ID NO: 1356729 - RNA, 19 nt, Human
ccaaaguuguuguaaccug

SEQ ID NO: 1356730 - RNA, 23 nt, Human
ccaaaguuguuguaaccugcugu

SEQ ID NO: 1356731 - RNA, 15 nt, Human
ccaaaguuguuguaa

SEQ ID NO: 1356732 - RNA, 23 nt, Human
ccaaaguucuaauaauuucuaau

SEQ ID NO: 1356733 - RNA, 20 nt, Human
ccaaaguucuaauaauuucu

SEQ ID NO: 1356734 - RNA, 19 nt, Human
ccaaaguucuaauaauuuc

SEQ ID NO: 1356735 - RNA, 14 nt, Human
ccaaaguucuaaua

SEQ ID NO: 1356736 - RNA, 12 nt, Human
ccaaaguucuaa

SEQ ID NO: 1356737 - RNA, 11 nt, Human
ccaaaguucua

SEQ ID NO: 1356738 - RNA, 15 nt, Human
ccaaauauguccugg

SEQ ID NO: 1356739 - RNA, 13 nt, Human
ccaaauauguccu

SEQ ID NO: 1356740 - RNA, 19 nt, Human
ccaaauacuaaugaaaaca

SEQ ID NO: 1356741 - RNA, 14 nt, Human
ccaagaagcagugg

SEQ ID NO: 1356742 - RNA, 14 nt, Human
ccaagaaacgucuu

SEQ ID NO: 1356743 - RNA, 14 nt, Human
ccaacuuuucuauu

SEQ ID NO: 1356744 - RNA, 11 nt, Human
ccaacuuuucu

SEQ ID NO: 1356745 - RNA, 24 nt, Human
ccaacggcaagggaacaaguacuu

SEQ ID NO: 1356746 - RNA, 15 nt, Human
ccaacgcuccaaagu

SEQ ID NO: 1356747 - RNA, 18 nt, Human
ccaagaagcaguggccuu

SEQ ID NO: 1356748 - RNA, 20 nt, Human
ccaaggcagaggccugggcu

SEQ ID NO: 1356749 - RNA, 16 nt, Human
ccaaggcagaggccug

SEQ ID NO: 1356750 - RNA, 15 nt, Human
ccaaggcagaggccu

SEQ ID NO: 1356751 - RNA, 16 nt, Human
cauuguaaaauaauuc

SEQ ID NO: 1356752 - RNA, 15 nt, Human
cauuguaaaauaauu

SEQ ID NO: 1356753 - RNA, 14 nt, Human
cauuguaaaauaau

SEQ ID NO: 1356754 - RNA, 13 nt, Human
cauuguaaaauaa

SEQ ID NO: 1356755 - RNA, 23 nt, Human
cauuguaaaagcauuuuguaaua

SEQ ID NO: 1356756 - RNA, 22 nt, Human
cauuguaaaagcauuuuguaau

SEQ ID NO: 1356757 - RNA, 21 nt, Human
cauuguaaaagcauuuuguaa

SEQ ID NO: 1356758 - RNA, 20 nt, Human
cauuguaaaagcauuuugua

SEQ ID NO: 1356759 - RNA, 15 nt, Human
cauuguaaaagcauu

SEQ ID NO: 1356760 - RNA, 19 nt, Human
cauuggaacuggaggcagg

SEQ ID NO: 1356761 - RNA, 16 nt, Human
cauuggaacuggaggc

SEQ ID NO: 1356762 - RNA, 15 nt, Human
cauuggaacuggagg

SEQ ID NO: 1356763 - RNA, 14 nt, Human
cauuggaacuggag

SEQ ID NO: 1356764 - RNA, 21 nt, Human
cauuggaaauuuagcauugua

SEQ ID NO: 1356765 - RNA, 20 nt, Human
cauuggaaauuuagcauugu

SEQ ID NO: 1356766 - RNA, 19 nt, Human
cauuggaaauuuagcauug

SEQ ID NO: 1356767 - RNA, 13 nt, Human
cauuuauauauug

SEQ ID NO: 1356768 - RNA, 12 nt, Human
cauuuauauauu

SEQ ID NO: 1356769 - RNA, 15 nt, Human
cauuguaaacaaacu

SEQ ID NO: 1356770 - RNA, 23 nt, Human
cauuuaguuugauuauucagugu

SEQ ID NO: 1356771 - RNA, 18 nt, Human
cauuggaaauuuagcauu

SEQ ID NO: 1356772 - RNA, 11 nt, Human
cauugcuuuuc

SEQ ID NO: 1356773 - RNA, 15 nt, Human
cauuuggaauacuuu

SEQ ID NO: 1356774 - RNA, 17 nt, Human
cauuuggaauacuuuuu

SEQ ID NO: 1356775 - RNA, 20 nt, Human
cauuuggcaaugccaucauc

SEQ ID NO: 1356776 - RNA, 21 nt, Human
cauuuggauccuguguggaga

SEQ ID NO: 1356777 - RNA, 23 nt, Human
cauuuggaguguuccccuuccac

SEQ ID NO: 1356778 - RNA, 21 nt, Human
cauuucaucuaccauuuucug

SEQ ID NO: 1356779 - RNA, 23 nt, Human
cauuucagaaguuaguuuguaua

SEQ ID NO: 1356780 - RNA, 22 nt, Human
cauuucagaguucuuuuugaag

SEQ ID NO: 1356781 - RNA, 22 nt, Human
cauuuauauauugaauuaauau

SEQ ID NO: 1356782 - RNA, 15 nt, Human
cauuuauauauugaa

SEQ ID NO: 1356783 - RNA, 13 nt, Human
cauuuauauugau

SEQ ID NO: 1356784 - RNA, 13 nt, Human
cauuuauauguac

SEQ ID NO: 1356785 - RNA, 19 nt, Human
cauuuuuuaaaugcaccug

SEQ ID NO: 1356786 - RNA, 15 nt, Human
cauuuuuuaaaugca

SEQ ID NO: 1356787 - RNA, 16 nt, Human
cauuuuuuaaaugcac

SEQ ID NO: 1356788 - RNA, 23 nt, Human
cauguaguaacacuaauauauuu

SEQ ID NO: 1356789 - RNA, 22 nt, Human
cauguaguaacacuaauauauu

SEQ ID NO: 1356790 - RNA, 21 nt, Human
cauguaguaacacuaauauau

SEQ ID NO: 1356791 - RNA, 19 nt, Human
cauguaguaacacuaauau

SEQ ID NO: 1356792 - RNA, 17 nt, Human
cauguaguaacacuaau

SEQ ID NO: 1356793 - RNA, 16 nt, Human
cauguaguaacacuaa

SEQ ID NO: 1356794 - RNA, 22 nt, Human
caugucaacagcguuccuagag

SEQ ID NO: 1356795 - RNA, 20 nt, Human
cauguaucuaugcauuuucu

SEQ ID NO: 1356796 - RNA, 23 nt, Human
cauguaucuaugcauuuucugga

SEQ ID NO: 1356797 - RNA, 20 nt, Human
caugucaaggguucaagauu

SEQ ID NO: 1356798 - RNA, 18 nt, Human
caugucaaggguucaaga

SEQ ID NO: 1356799 - RNA, 22 nt, Human
cauuagucucagugaagacuau

SEQ ID NO: 1356800 - RNA, 22 nt, Human
cauuagucauguuuaucugcuu

SEQ ID NO: 1356801 - RNA, 21 nt, Human
cauuagucauguuuaucugcu

SEQ ID NO: 1356802 - RNA, 24 nt, Human
cauuaucuaguucauugaaucauu

SEQ ID NO: 1356803 - RNA, 23 nt, Human
cauuaucuagauacuguaucaug

SEQ ID NO: 1356804 - RNA, 21 nt, Human
cauuaguacacagcaccagaa

SEQ ID NO: 1356805 - RNA, 22 nt, Human
cauguugcccccgugagccaau

SEQ ID NO: 1356806 - RNA, 22 nt, Human
cauuaggugugacugaauuucu

SEQ ID NO: 1356807 - RNA, 20 nt, Human
cauucucacaggucccaaau

SEQ ID NO: 1356808 - RNA, 14 nt, Human
cauucucaagcccu

SEQ ID NO: 1356809 - RNA, 16 nt, Human
cauucucaagcccugc

SEQ ID NO: 1356810 - RNA, 17 nt, Human
cauucucaagcccugca

SEQ ID NO: 1356811 - RNA, 15 nt, Human
cauuccuucccagag

SEQ ID NO: 1356812 - RNA, 22 nt, Human
cauucgcuacuaugauuuaauu

SEQ ID NO: 1356813 - RNA, 22 nt, Human
cauuccuucccagaggggccug

SEQ ID NO: 1356814 - RNA, 12 nt, Human
cauuccuuccca

SEQ ID NO: 1356815 - RNA, 22 nt, Human
cauggcauccuccagccccugu

SEQ ID NO: 1356816 - RNA, 18 nt, Human
cauggcauccuccagccc

SEQ ID NO: 1356817 - RNA, 16 nt, Human
cauggcauccuccagc

SEQ ID NO: 1356818 - RNA, 15 nt, Human
cauggcauccuccag

SEQ ID NO: 1356819 - RNA, 14 nt, Human
cauggcauccucca

SEQ ID NO: 1356820 - RNA, 15 nt, Human
cauggcauccaagac

SEQ ID NO: 1356821 - RNA, 19 nt, Human
caugcuccucuuccccaga

SEQ ID NO: 1356822 - RNA, 21 nt, Human
cauggccagcuggaggcaggg

SEQ ID NO: 1356823 - RNA, 23 nt, Human
cauggccagcagcaccugcccua

SEQ ID NO: 1356824 - RNA, 22 nt, Human
cauggccagcagcaccugcccu

SEQ ID NO: 1356825 - RNA, 20 nt, Human
cauggccagcagcaccugcc

SEQ ID NO: 1356826 - RNA, 14 nt, Human
cauggccagcagca

SEQ ID NO: 1356827 - RNA, 13 nt, Human
cauggccagcagc

SEQ ID NO: 1356828 - RNA, 22 nt, Human
cauggccacuugggucuucccu

SEQ ID NO: 1356829 - RNA, 19 nt, Human
cauggcauccuccagcccc

SEQ ID NO: 1356830 - RNA, 20 nt, Human
cauggccagcuggaggcagg

SEQ ID NO: 1356831 - RNA, 14 nt, Human
cauggccagcugga

SEQ ID NO: 1356832 - RNA, 16 nt, Human
cauggccagcuaauuu

SEQ ID NO: 1356833 - RNA, 21 nt, Human
caugaagguaaauaaaaagaa

SEQ ID NO: 1356834 - RNA, 20 nt, Human
caugaagguaaauaaaaaga

SEQ ID NO: 1356835 - RNA, 17 nt, Human
caugaagguaaauaaaa

SEQ ID NO: 1356836 - RNA, 16 nt, Human
caugaagguaaauaaa

SEQ ID NO: 1356837 - RNA, 14 nt, Human
caugaagguaaaua

SEQ ID NO: 1356838 - RNA, 15 nt, Human
caugaagcuguugug

SEQ ID NO: 1356839 - RNA, 14 nt, Human
caugaaguauuuuu

SEQ ID NO: 1356840 - RNA, 21 nt, Human
caugaaguauuuuuucaguau

SEQ ID NO: 1356841 - RNA, 13 nt, Human
caugaaguauuuu

SEQ ID NO: 1356842 - RNA, 22 nt, Human
caugaagguaaauaaaaagaaa

SEQ ID NO: 1356843 - RNA, 16 nt, Human
caugaaggugucauac

SEQ ID NO: 1356844 - RNA, 15 nt, Human
caugaaguaauaugc

SEQ ID NO: 1356845 - RNA, 19 nt, Human
caugaaguaauaugcacac

SEQ ID NO: 1356846 - RNA, 22 nt, Human
caugaaguaauaugcacacauu

SEQ ID NO: 1356847 - RNA, 23 nt, Human
caugaaguaauaugcacacauuu

SEQ ID NO: 1356848 - RNA, 18 nt, Human
caugcuccucuuccccag

SEQ ID NO: 1356849 - RNA, 17 nt, Human
caugcuccucuucccca

SEQ ID NO: 1356850 - RNA, 16 nt, Human
caugcuccucuucccc

SEQ ID NO: 1356851 - RNA, 14 nt, Human
caugcuccucuucc

SEQ ID NO: 1356852 - RNA, 22 nt, Human
caugcuccagauuagagccugu

SEQ ID NO: 1356853 - RNA, 19 nt, Human
caugcucaucugcuggucc

SEQ ID NO: 1356854 - RNA, 18 nt, Human
caugcucaucugcugguc

SEQ ID NO: 1356855 - RNA, 17 nt, Human
caugcucaucugcuggu

SEQ ID NO: 1356856 - RNA, 16 nt, Human
caugcucaucugcugg

SEQ ID NO: 1356857 - RNA, 22 nt, Human
caugcacaguauuuguaauuaa

SEQ ID NO: 1356858 - RNA, 20 nt, Human
caugcacccucauacacaga

SEQ ID NO: 1356859 - RNA, 16 nt, Human
caugcacccucauaca

SEQ ID NO: 1356860 - RNA, 14 nt, Human
caugacagccucca

SEQ ID NO: 1356861 - RNA, 13 nt, Human
caugacagccucc

SEQ ID NO: 1356862 - RNA, 20 nt, Human
caugcacaguauuuguaauu

SEQ ID NO: 1356863 - RNA, 19 nt, Human
caugcacaguauuuguaau

SEQ ID NO: 1356864 - RNA, 18 nt, Human
caugcacaguauuuguaa

SEQ ID NO: 1356865 - RNA, 17 nt, Human
caugcacaguauuugua

SEQ ID NO: 1356866 - RNA, 14 nt, Human
caugcacaguauuu

SEQ ID NO: 1356867 - RNA, 12 nt, Human
caugcacaaauu

SEQ ID NO: 1356868 - RNA, 20 nt, Human
cauagcucuggggugggcag

SEQ ID NO: 1356869 - RNA, 13 nt, Human
cauagcucugggg

SEQ ID NO: 1356870 - RNA, 12 nt, Human
cauagcucuggg

SEQ ID NO: 1356871 - RNA, 22 nt, Human
cauagcaccuaacaacauugua

SEQ ID NO: 1356872 - RNA, 17 nt, Human
cauacagagaagucaca

SEQ ID NO: 1356873 - RNA, 15 nt, Human
cauacagagaaguca

SEQ ID NO: 1356874 - RNA, 13 nt, Human
cauacagagaagu

SEQ ID NO: 1356875 - RNA, 12 nt, Human
cauacagagaag

SEQ ID NO: 1356876 - RNA, 11 nt, Human
cauacagagaa

SEQ ID NO: 1356877 - RNA, 23 nt, Human
cauacagaauuacuguaacugau

SEQ ID NO: 1356878 - RNA, 14 nt, Human
cauacacuuuuucu

SEQ ID NO: 1356879 - RNA, 23 nt, Human
cauacacuuauuggaacucugcu

SEQ ID NO: 1356880 - RNA, 20 nt, Human
cauacaccuaugucauuuca

SEQ ID NO: 1356881 - RNA, 15 nt, Human
cauaauuuggaggga

SEQ ID NO: 1356882 - RNA, 18 nt, Human
cauaauugcauugacuuu

SEQ ID NO: 1356883 - RNA, 22 nt, Human
cauaauuuaguuucauauaaag

SEQ ID NO: 1356884 - RNA, 21 nt, Human
cauaauugugauuagacagaa

SEQ ID NO: 1356885 - RNA, 12 nt, Human
cauaauugcauu

SEQ ID NO: 1356886 - RNA, 19 nt, Human
cauaugcuaccaccagcug

SEQ ID NO: 1356887 - RNA, 18 nt, Human
cauaugcuaccaccagcu

SEQ ID NO: 1356888 - RNA, 17 nt, Human
cauaugcuaccaccagc

SEQ ID NO: 1356889 - RNA, 16 nt, Human
cauaugcuaccaccag

SEQ ID NO: 1356890 - RNA, 20 nt, Human
cauagcuugauaaagggcca

SEQ ID NO: 1356891 - RNA, 21 nt, Human
cauagcuugauaaagggccaa

SEQ ID NO: 1356892 - RNA, 19 nt, Human
caucuggggagcaggcagc

SEQ ID NO: 1356893 - RNA, 23 nt, Human
caucuggggagcaggcagccagc

SEQ ID NO: 1356894 - RNA, 18 nt, Human
caucuggggagcaggcag

SEQ ID NO: 1356895 - RNA, 20 nt, Human
caucugggcuccuccagggu

SEQ ID NO: 1356896 - RNA, 17 nt, Human
caucugggcuccuccag

SEQ ID NO: 1356897 - RNA, 16 nt, Human
caucugggcuccucca

SEQ ID NO: 1356898 - RNA, 23 nt, Human
caucugggccuuggccuggagca

SEQ ID NO: 1356899 - RNA, 20 nt, Human
caucugggccuuggccugga

SEQ ID NO: 1356900 - RNA, 18 nt, Human
caucugggccuuggccug

SEQ ID NO: 1356901 - RNA, 19 nt, Human
cauccauguuccgagaaga

SEQ ID NO: 1356902 - RNA, 18 nt, Human
cauccauguuccgagaag

SEQ ID NO: 1356903 - RNA, 18 nt, Human
cauccauguccaaccccc

SEQ ID NO: 1356904 - RNA, 22 nt, Human
cauccauggccagcagcaccug

SEQ ID NO: 1356905 - RNA, 21 nt, Human
cauccauggccagcagcaccu

SEQ ID NO: 1356906 - RNA, 18 nt, Human
cauccauggccagcagca

SEQ ID NO: 1356907 - RNA, 15 nt, Human
cauccauggccagca

SEQ ID NO: 1356908 - RNA, 14 nt, Human
cauccauggccagc

SEQ ID NO: 1356909 - RNA, 23 nt, Human
cauccaugccucagaagugcauc

SEQ ID NO: 1356910 - RNA, 17 nt, Human
cauccaugccucagaag

SEQ ID NO: 1356911 - RNA, 15 nt, Human
caucugggccuuggc

SEQ ID NO: 1356912 - RNA, 14 nt, Human
caucugcuccugga

SEQ ID NO: 1356913 - RNA, 22 nt, Human
caucugcuccuggaucucccug

SEQ ID NO: 1356914 - RNA, 11 nt, Human
caucugcuccu

SEQ ID NO: 1356915 - RNA, 10 nt, Human
caucugcucc

SEQ ID NO: 1356916 - RNA, 23 nt, Human
caucugcgugacaauaaaacauu

SEQ ID NO: 1356917 - RNA, 22 nt, Human
caucugcgugacaauaaaacau

SEQ ID NO: 1356918 - RNA, 19 nt, Human
caucugcgugacaauaaaa

SEQ ID NO: 1356919 - RNA, 18 nt, Human
caucugcgugacaauaaa

SEQ ID NO: 1356920 - RNA, 16 nt, Human
caucugcgugacaaua

SEQ ID NO: 1356921 - RNA, 18 nt, Human
cauccuuccucacaccag

SEQ ID NO: 1356922 - RNA, 23 nt, Human
cauccuucaucuggauuccagag

SEQ ID NO: 1356923 - RNA, 23 nt, Human
cauccuguguguuaagcucugcu

SEQ ID NO: 1356924 - RNA, 17 nt, Human
caaagauaucucaucuc

SEQ ID NO: 1356925 - RNA, 18 nt, Human
caaagaguuugaugaggc

SEQ ID NO: 1356926 - RNA, 21 nt, Human
caaagaguucaagaaauaagu

SEQ ID NO: 1356927 - RNA, 17 nt, Human
caaagaguucaagaaau

SEQ ID NO: 1356928 - RNA, 23 nt, Human
caaacauuuucuggccaguguuu

SEQ ID NO: 1356929 - RNA, 18 nt, Human
caaacauuuucuggccag

SEQ ID NO: 1356930 - RNA, 20 nt, Human
caaacauuuugaaagucugu

SEQ ID NO: 1356931 - RNA, 15 nt, Human
caaacccuagccuug

SEQ ID NO: 1356932 - RNA, 20 nt, Human
caaacccuagccuugcuugu

SEQ ID NO: 1356933 - RNA, 18 nt, Human
caaacccuagccuugcuu

SEQ ID NO: 1356934 - RNA, 15 nt, Human
caaacauuuugaaag

SEQ ID NO: 1356935 - RNA, 12 nt, Human
caaacauuuuga

SEQ ID NO: 1356936 - RNA, 17 nt, Human
caaacauauauaacaau

SEQ ID NO: 1356937 - RNA, 13 nt, Human
caaaagcuuuuua

SEQ ID NO: 1356938 - RNA, 21 nt, Human
caaaaggauaaugaauacuuu

SEQ ID NO: 1356939 - RNA, 14 nt, Human
auuuuuauauuuaa

SEQ ID NO: 1356940 - RNA, 16 nt, Human
auuuuuauauuugaaa

SEQ ID NO: 1356941 - RNA, 15 nt, Human
auuuuuauauuugaa

SEQ ID NO: 1356942 - RNA, 23 nt, Human
auuuuuauauuaaccagauauau

SEQ ID NO: 1356943 - RNA, 18 nt, Human
caaaagcuuacaaauacu

SEQ ID NO: 1356944 - RNA, 20 nt, Human
caaaagaauggcagaaaagu

SEQ ID NO: 1356945 - RNA, 19 nt, Human
caaaagaauggcagaaaag

SEQ ID NO: 1356946 - RNA, 18 nt, Human
caaaagaaguaaaagcaa

SEQ ID NO: 1356947 - RNA, 17 nt, Human
caaaagaaguaaaagca

SEQ ID NO: 1356948 - RNA, 19 nt, Human
caaaagaaguaaaagcaaa

SEQ ID NO: 1356949 - RNA, 12 nt, Human
caaaagaaguaa

SEQ ID NO: 1356950 - RNA, 22 nt, Human
caaaagaagcccggcuccuggu

SEQ ID NO: 1356951 - RNA, 20 nt, Human
caaaagaagcccggcuccug

SEQ ID NO: 1356952 - RNA, 19 nt, Human
caaaagaagcccccagcua

SEQ ID NO: 1356953 - RNA, 18 nt, Human
caaaagaagcccccagcu

SEQ ID NO: 1356954 - RNA, 17 nt, Human
caaaagaagcccccagc

SEQ ID NO: 1356955 - RNA, 16 nt, Human
caaaagaagcccccag

SEQ ID NO: 1356956 - RNA, 13 nt, Human
caaaagaagcccc

SEQ ID NO: 1356957 - RNA, 16 nt, Human
auuuuuauaaauacug

SEQ ID NO: 1356958 - RNA, 21 nt, Human
auuuuuagauaguuagaaccu

SEQ ID NO: 1356959 - RNA, 19 nt, Human
auuuuuaagugcugcauuu

SEQ ID NO: 1356960 - RNA, 16 nt, Human
auuuuuaagugcugca

SEQ ID NO: 1356961 - RNA, 18 nt, Human
auuuuuaagugcugcauu

SEQ ID NO: 1356962 - RNA, 22 nt, Human
auuuugaagugcuguuuauuaa

SEQ ID NO: 1356963 - RNA, 19 nt, Human
auuuugaagugcuguuuau

SEQ ID NO: 1356964 - RNA, 13 nt, Human
auuuugaagugcu

SEQ ID NO: 1356965 - RNA, 22 nt, Human
auuuugaaccugaugaaaauaa

SEQ ID NO: 1356966 - RNA, 20 nt, Human
auuuugaaccugaugaaaau

SEQ ID NO: 1356967 - RNA, 21 nt, Human
auuuucugugccugaauauuu

SEQ ID NO: 1356968 - RNA, 17 nt, Human
auuuugaaucaauaaua

SEQ ID NO: 1356969 - RNA, 15 nt, Human
auuuugaaucaauaa

SEQ ID NO: 1356970 - RNA, 14 nt, Human
auuuugaaucaaua

SEQ ID NO: 1356971 - RNA, 13 nt, Human
auuuugaaucaau

SEQ ID NO: 1356972 - RNA, 12 nt, Human
auuuugaaucaa

SEQ ID NO: 1356973 - RNA, 11 nt, Human
auuuugaauca

SEQ ID NO: 1356974 - RNA, 18 nt, Human
auuuugaaucaauaauau

SEQ ID NO: 1356975 - RNA, 13 nt, Human
auuuuagcuuuug

SEQ ID NO: 1356976 - RNA, 18 nt, Human
auuuuagcgugcucacug

SEQ ID NO: 1356977 - RNA, 22 nt, Human
auuuuaggagcuaaggcucuau

SEQ ID NO: 1356978 - RNA, 21 nt, Human
auuuuaggagcuaaggcucua

SEQ ID NO: 1356979 - RNA, 20 nt, Human
auuuuaggagcuaaggcucu

SEQ ID NO: 1356980 - RNA, 19 nt, Human
auuuuaggagcuaaggcuc

SEQ ID NO: 1356981 - RNA, 18 nt, Human
auuuuaggagcuaaggcu

SEQ ID NO: 1356982 - RNA, 19 nt, Human
auuuuagggguagcauuug

SEQ ID NO: 1356983 - RNA, 18 nt, Human
auuuuauaugcuuacuga

SEQ ID NO: 1356984 - RNA, 16 nt, Human
auuuuauaugcuuacu

SEQ ID NO: 1356985 - RNA, 15 nt, Human
auuuuauaugcuuac

SEQ ID NO: 1356986 - RNA, 12 nt, Human
auuuuauguuau

SEQ ID NO: 1356987 - RNA, 16 nt, Human
auuuuauggugcauua

SEQ ID NO: 1356988 - RNA, 22 nt, Human
auuuuauguuaagggaagaauu

SEQ ID NO: 1356989 - RNA, 14 nt, Human
auuuuauggugcau

SEQ ID NO: 1356990 - RNA, 20 nt, Human
auuuucugugccugaauauu

SEQ ID NO: 1356991 - RNA, 18 nt, Human
auuuucugugccugaaua

SEQ ID NO: 1356992 - RNA, 16 nt, Human
auuuucugugccugaa

SEQ ID NO: 1356993 - RNA, 17 nt, Human
auuuucugguucuaaca

SEQ ID NO: 1356994 - RNA, 15 nt, Human
auuuucugguucuaa

SEQ ID NO: 1356995 - RNA, 19 nt, Human
auuuucugguucuaacauu

SEQ ID NO: 1356996 - RNA, 14 nt, Human
auuuucugguucua

SEQ ID NO: 1356997 - RNA, 19 nt, Human
auuuucugguaggaauagc

SEQ ID NO: 1356998 - RNA, 18 nt, Human
auuuuauguuauauauaa

SEQ ID NO: 1356999 - RNA, 23 nt, Human
auuuuauguuauauauaaauaua

SEQ ID NO: 1357000 - RNA, 17 nt, Human
auuuuauguuauauaua

SEQ ID NO: 1357001 - RNA, 15 nt, Human
auuuuauguuauaua

SEQ ID NO: 1357002 - RNA, 14 nt, Human
auuuuauguuauau

SEQ ID NO: 1357003 - RNA, 13 nt, Human
auuuuauguuaua

SEQ ID NO: 1357004 - RNA, 14 nt, Human
auuuuauguugcau

SEQ ID NO: 1357005 - RNA, 21 nt, Human
caaaugccaaauuaaaaaaga

SEQ ID NO: 1357006 - RNA, 13 nt, Human
caaaugagccaug

SEQ ID NO: 1357007 - RNA, 12 nt, Human
caaaugagccau

SEQ ID NO: 1357008 - RNA, 14 nt, Human
caacaaagaacacu

SEQ ID NO: 1357009 - RNA, 20 nt, Human
caacaaagaaacaaagaugu

SEQ ID NO: 1357010 - RNA, 22 nt, Human
caaaucuugguugaugccaaaa

SEQ ID NO: 1357011 - RNA, 13 nt, Human
caaaucuugaaau

SEQ ID NO: 1357012 - RNA, 19 nt, Human
caaaucuugaaauuaagaa

SEQ ID NO: 1357013 - RNA, 12 nt, Human
caaaucuugaaa

SEQ ID NO: 1357014 - RNA, 13 nt, Human
caaaucuggaagc

SEQ ID NO: 1357015 - RNA, 23 nt, Human
caaaguccuuuuuuuccaucuuu

SEQ ID NO: 1357016 - RNA, 19 nt, Human
caaaguccuuuuuuuccau

SEQ ID NO: 1357017 - RNA, 17 nt, Human
caaaguccuuuuuuucc

SEQ ID NO: 1357018 - RNA, 14 nt, Human
caaaguccuuuuuu

SEQ ID NO: 1357019 - RNA, 19 nt, Human
caaaguccugggauuacag

SEQ ID NO: 1357020 - RNA, 16 nt, Human
caaagcaugaaaugga

SEQ ID NO: 1357021 - RNA, 23 nt, Human
caaagcaucuugcauuaugcaau

SEQ ID NO: 1357022 - RNA, 18 nt, Human
caaagauauuuugcuuug

SEQ ID NO: 1357023 - RNA, 14 nt, Human
caaagauauuuugc

SEQ ID NO: 1357024 - RNA, 16 nt, Human
caaagauauuuugcuu

SEQ ID NO: 1357025 - RNA, 23 nt, Human
caaagucauaauugcauugacuu

SEQ ID NO: 1357026 - RNA, 18 nt, Human
caaagucauaauugcauu

SEQ ID NO: 1357027 - RNA, 19 nt, Human
caaaguaucccuacuguaa

SEQ ID NO: 1357028 - RNA, 21 nt, Human
caaaguaucccuacuguaauu

SEQ ID NO: 1357029 - RNA, 14 nt, Human
caaagguaaaucag

SEQ ID NO: 1357030 - RNA, 13 nt, Human
caaaggguggaau

SEQ ID NO: 1357031 - RNA, 22 nt, Human
caaagguaaaucagacuaugaa

SEQ ID NO: 1357032 - RNA, 20 nt, Human
caacaagaagggacugagag

SEQ ID NO: 1357033 - RNA, 21 nt, Human
caacaagaagggacugagaga

SEQ ID NO: 1357034 - RNA, 18 nt, Human
caacaaccucaacugccu

SEQ ID NO: 1357035 - RNA, 19 nt, Human
caacaaccucaacugccua

SEQ ID NO: 1357036 - RNA, 15 nt, Human
caacacacacaugcu

SEQ ID NO: 1357037 - RNA, 23 nt, Human
caacacacacaugcuucccuuuc

SEQ ID NO: 1357038 - RNA, 13 nt, Human
caacaccaagcac

SEQ ID NO: 1357039 - RNA, 14 nt, Human
caacacagaggcag

SEQ ID NO: 1357040 - RNA, 18 nt, Human
caacacacacaugcuucc

SEQ ID NO: 1357041 - RNA, 13 nt, Human
caagaauggauca

SEQ ID NO: 1357042 - RNA, 24 nt, Human
caacucuccccugaccugugagcc

SEQ ID NO: 1357043 - RNA, 18 nt, Human
caacucuccccugaccug

SEQ ID NO: 1357044 - RNA, 19 nt, Human
caacucguauagcaugcau

SEQ ID NO: 1357045 - RNA, 21 nt, Human
caagaauuggaagcugcccug

SEQ ID NO: 1357046 - RNA, 22 nt, Human
caagaauggaucacaagaugga

SEQ ID NO: 1357047 - RNA, 21 nt, Human
caagaauggaucacaagaugg

SEQ ID NO: 1357048 - RNA, 14 nt, Human
caagaauggaucac

SEQ ID NO: 1357049 - RNA, 23 nt, Human
caacuccuaguucuagaaaaaca

SEQ ID NO: 1357050 - RNA, 22 nt, Human
caacuccuaguucuagaaaaac

SEQ ID NO: 1357051 - RNA, 20 nt, Human
caacuccuaguucuagaaaa

SEQ ID NO: 1357052 - RNA, 19 nt, Human
caacuccuaguucuagaaa

SEQ ID NO: 1357053 - RNA, 16 nt, Human
caacuccuaguucuag

SEQ ID NO: 1357054 - RNA, 22 nt, Human
caacucacuccuuuuaaagaaa

SEQ ID NO: 1357055 - RNA, 16 nt, Human
caacucguauagcaug

SEQ ID NO: 1357056 - RNA, 17 nt, Human
caacuccuuccagcuag

SEQ ID NO: 1357057 - RNA, 19 nt, Human
caacucgcuuuaggucagc

SEQ ID NO: 1357058 - RNA, 14 nt, Human
caacucgcuuuagg

SEQ ID NO: 1357059 - RNA, 20 nt, Human
caagaauuucuaggacugaa

SEQ ID NO: 1357060 - RNA, 17 nt, Human
caagaccacguuucuaa

SEQ ID NO: 1357061 - RNA, 18 nt, Human
caagaccacguuucuaaa

SEQ ID NO: 1357062 - RNA, 21 nt, Human
caagaugggcaucuuuuguau

SEQ ID NO: 1357063 - RNA, 20 nt, Human
caagaugggcaucuuuugua

SEQ ID NO: 1357064 - RNA, 19 nt, Human
caagauggaauuuaucaaa

SEQ ID NO: 1357065 - RNA, 18 nt, Human
caagaugggcaucuuuug

SEQ ID NO: 1357066 - RNA, 17 nt, Human
caagaugggcaucuuuu

SEQ ID NO: 1357067 - RNA, 16 nt, Human
caagaugggcaucuuu

SEQ ID NO: 1357068 - RNA, 15 nt, Human
caagauggcccaucc

SEQ ID NO: 1357069 - RNA, 22 nt, Human
caagauggggagugagaggcug

SEQ ID NO: 1357070 - RNA, 22 nt, Human
caaccccuccccuccaucccug

SEQ ID NO: 1357071 - RNA, 21 nt, Human
caaccccuccccuccaucccu

SEQ ID NO: 1357072 - RNA, 20 nt, Human
caaccagauugucagcuccu

SEQ ID NO: 1357073 - RNA, 19 nt, Human
caaccagauugucagcucc

SEQ ID NO: 1357074 - RNA, 21 nt, Human
caaccagaccauugucucaga

SEQ ID NO: 1357075 - RNA, 23 nt, Human
caaccaugagaccacuguuauca

SEQ ID NO: 1357076 - RNA, 18 nt, Human
caaccaugagaccacugu

SEQ ID NO: 1357077 - RNA, 13 nt, Human
caaccaucgcuuu

SEQ ID NO: 1357078 - RNA, 19 nt, Human
caacuacuaccuguaauga

SEQ ID NO: 1357079 - RNA, 21 nt, Human
caacuacuaauagaauaaagg

SEQ ID NO: 1357080 - RNA, 15 nt, Human
caacuacuaauagaa

SEQ ID NO: 1357081 - RNA, 13 nt, Human
caacuacuaauag

SEQ ID NO: 1357082 - RNA, 20 nt, Human
caacuacccccagcugugcu

SEQ ID NO: 1357083 - RNA, 19 nt, Human
caacuacccccagcugugc

SEQ ID NO: 1357084 - RNA, 17 nt, Human
caacuacccccagcugu

SEQ ID NO: 1357085 - RNA, 15 nt, Human
caacuacagucuaaa

SEQ ID NO: 1357086 - RNA, 19 nt, Human
caacuacagucuaaagcug

SEQ ID NO: 1357087 - RNA, 18 nt, Human
caacuagccccuggggug

SEQ ID NO: 1357088 - RNA, 17 nt, Human
caacuacuguguuaugc

SEQ ID NO: 1357089 - RNA, 18 nt, Human
caacucacuccuuuuaaa

SEQ ID NO: 1357090 - RNA, 17 nt, Human
caacucacuccuuuuaa

SEQ ID NO: 1357091 - RNA, 16 nt, Human
caacucacuccuuuua

SEQ ID NO: 1357092 - RNA, 15 nt, Human
caacucacuccuuuu

SEQ ID NO: 1357093 - RNA, 23 nt, Human
caacucacuccuuuuaaagaaaa

SEQ ID NO: 1357094 - RNA, 21 nt, Human
caacucacuccuuuuaaagaa

SEQ ID NO: 1357095 - RNA, 20 nt, Human
caacucacuccuuuuaaaga

SEQ ID NO: 1357096 - RNA, 17 nt, Human
caacucauauuuucaug

SEQ ID NO: 1357097 - RNA, 15 nt, Human
auuuaauaaucugua

SEQ ID NO: 1357098 - RNA, 19 nt, Human
auuuaauaauauacuugug

SEQ ID NO: 1357099 - RNA, 16 nt, Human
auuuaauaauauacuu

SEQ ID NO: 1357100 - RNA, 18 nt, Human
auuuaauaauauacuugu

SEQ ID NO: 1357101 - RNA, 13 nt, Human
auuuaauaauaua

SEQ ID NO: 1357102 - RNA, 15 nt, Human
auuuaauaauauacu

SEQ ID NO: 1357103 - RNA, 17 nt, Human
auuuaugagcucuucau

SEQ ID NO: 1357104 - RNA, 23 nt, Human
auuuaugaauugaauuaucuugg

SEQ ID NO: 1357105 - RNA, 22 nt, Human
auuuaucuuuacuuuuaaacag

SEQ ID NO: 1357106 - RNA, 19 nt, Human
auuuaucugagucaacucc

SEQ ID NO: 1357107 - RNA, 17 nt, Human
auuuauauguacaugag

SEQ ID NO: 1357108 - RNA, 16 nt, Human
auuuauauguacauga

SEQ ID NO: 1357109 - RNA, 15 nt, Human
auuuauauguacaug

SEQ ID NO: 1357110 - RNA, 15 nt, Human
auuuauaucacaugu

SEQ ID NO: 1357111 - RNA, 15 nt, Human
auuuauauuguaaau

SEQ ID NO: 1357112 - RNA, 22 nt, Human
auuuauauugauaagaucuuuu

SEQ ID NO: 1357113 - RNA, 21 nt, Human
auuuauauugauaagaucuuu

SEQ ID NO: 1357114 - RNA, 20 nt, Human
auuuauauugauaagaucuu

SEQ ID NO: 1357115 - RNA, 13 nt, Human
auuuauauugaua

SEQ ID NO: 1357116 - RNA, 19 nt, Human
auuucagaaguuaguuugu

SEQ ID NO: 1357117 - RNA, 12 nt, Human
auuucagaaguu

SEQ ID NO: 1357118 - RNA, 12 nt, Human
auuucacuuguc

SEQ ID NO: 1357119 - RNA, 23 nt, Human
auuucacugucuuuaauucugua

SEQ ID NO: 1357120 - RNA, 22 nt, Human
auuucacugucuuuaauucugu

SEQ ID NO: 1357121 - RNA, 13 nt, Human
auuucacugucuu

SEQ ID NO: 1357122 - RNA, 19 nt, Human
auuucacuggagcacaaua

SEQ ID NO: 1357123 - RNA, 17 nt, Human
auuucacuggagcacaa

SEQ ID NO: 1357124 - RNA, 16 nt, Human
auuucacuggagcaca

SEQ ID NO: 1357125 - RNA, 14 nt, Human
auuucacuggagca

SEQ ID NO: 1357126 - RNA, 12 nt, Human
auuucacuggag

SEQ ID NO: 1357127 - RNA, 20 nt, Human
auuuaugccucuguauuuaa

SEQ ID NO: 1357128 - RNA, 16 nt, Human
auuuaugcauauuauu

SEQ ID NO: 1357129 - RNA, 22 nt, Human
auuuaugcauauuauuuuaugu

SEQ ID NO: 1357130 - RNA, 11 nt, Human
auuucuguguu

SEQ ID NO: 1357131 - RNA, 17 nt, Human
auuucauaguucagaau

SEQ ID NO: 1357132 - RNA, 16 nt, Human
auuucauaguucagaa

SEQ ID NO: 1357133 - RNA, 15 nt, Human
auuucauaguucaga

SEQ ID NO: 1357134 - RNA, 14 nt, Human
auuucauaguucag

SEQ ID NO: 1357135 - RNA, 13 nt, Human
auuucauaguuca

SEQ ID NO: 1357136 - RNA, 23 nt, Human
auuucauacuguaacauucagga

SEQ ID NO: 1357137 - RNA, 19 nt, Human
auuucaguucuaggaaaau

SEQ ID NO: 1357138 - RNA, 18 nt, Human
auuucaguucuaggaaaa

SEQ ID NO: 1357139 - RNA, 17 nt, Human
auuucaguucuaggaaa

SEQ ID NO: 1357140 - RNA, 16 nt, Human
auuucaguucuaggaa

SEQ ID NO: 1357141 - RNA, 12 nt, Human
auuucagacucc

SEQ ID NO: 1357142 - RNA, 21 nt, Human
auuucagaaguuaguuuguau

SEQ ID NO: 1357143 - RNA, 14 nt, Human
auuucuaugaaaua

SEQ ID NO: 1357144 - RNA, 23 nt, Human
auuucuauagccaaaaauagcua

SEQ ID NO: 1357145 - RNA, 19 nt, Human
auuucauaguucagaauuu

SEQ ID NO: 1357146 - RNA, 16 nt, Human
auuucugccuccccuu

SEQ ID NO: 1357147 - RNA, 13 nt, Human
auuucugccuccc

SEQ ID NO: 1357148 - RNA, 23 nt, Human
auuucugcauauguugaauacuu

SEQ ID NO: 1357149 - RNA, 22 nt, Human
auuucugcauauguugaauacu

SEQ ID NO: 1357150 - RNA, 18 nt, Human
auuucugcauauguugaa

SEQ ID NO: 1357151 - RNA, 20 nt, Human
auuucuauuucuccuccaug

SEQ ID NO: 1357152 - RNA, 18 nt, Human
auuucuauuucuccucca

SEQ ID NO: 1357153 - RNA, 15 nt, Human
auuucuauuucuccu

SEQ ID NO: 1357154 - RNA, 11 nt, Human
auuucuauuaa

SEQ ID NO: 1357155 - RNA, 18 nt, Human
auuguaacccugucugga

SEQ ID NO: 1357156 - RNA, 21 nt, Human
auugcuuacaagccuaagaau

SEQ ID NO: 1357157 - RNA, 14 nt, Human
auugcuugcacaaa

SEQ ID NO: 1357158 - RNA, 13 nt, Human
auuguguuugugu

SEQ ID NO: 1357159 - RNA, 22 nt, Human
auuguguuugucauuagccuga

SEQ ID NO: 1357160 - RNA, 15 nt, Human
auuguguuugucauu

SEQ ID NO: 1357161 - RNA, 16 nt, Human
auuguguuugucauua

SEQ ID NO: 1357162 - RNA, 18 nt, Human
auuguguuugucauuagc

SEQ ID NO: 1357163 - RNA, 19 nt, Human
auuguguuugucauuagcc

SEQ ID NO: 1357164 - RNA, 15 nt, Human
auuguguucccauuu

SEQ ID NO: 1357165 - RNA, 20 nt, Human
auuguguuaccuguagauuc

SEQ ID NO: 1357166 - RNA, 13 nt, Human
auuguguuuguca

SEQ ID NO: 1357167 - RNA, 19 nt, Human
auuguuguucuguuaacug

SEQ ID NO: 1357168 - RNA, 21 nt, Human
auuguuguucuguuaacugaa

SEQ ID NO: 1357169 - RNA, 18 nt, Human
auuguuguucuguuaacu

SEQ ID NO: 1357170 - RNA, 14 nt, Human
auuguuguucuguu

SEQ ID NO: 1357171 - RNA, 13 nt, Human
auuguuguucugu

SEQ ID NO: 1357172 - RNA, 15 nt, Human
auuguuacagaagcu

SEQ ID NO: 1357173 - RNA, 17 nt, Human
auuguuaauuuuuccua

SEQ ID NO: 1357174 - RNA, 14 nt, Human
auuguuaaaggcua

SEQ ID NO: 1357175 - RNA, 10 nt, Human
auuguaacuc

SEQ ID NO: 1357176 - RNA, 19 nt, Human
auuguaacuguucuugaau

SEQ ID NO: 1357177 - RNA, 15 nt, Human
auuguaacuguucuu

SEQ ID NO: 1357178 - RNA, 13 nt, Human
auuguaacuguuc

SEQ ID NO: 1357179 - RNA, 18 nt, Human
auuguaagcaugcacaaa

SEQ ID NO: 1357180 - RNA, 20 nt, Human
auuguguucccauuucagcu

SEQ ID NO: 1357181 - RNA, 20 nt, Human
auucucugugucuaagauuc

SEQ ID NO: 1357182 - RNA, 18 nt, Human
auucucugugucuaagau

SEQ ID NO: 1357183 - RNA, 17 nt, Human
auucucugugucuaaga

SEQ ID NO: 1357184 - RNA, 19 nt, Human
auucucugucucauccauc

SEQ ID NO: 1357185 - RNA, 18 nt, Human
auucucugucucauccau

SEQ ID NO: 1357186 - RNA, 17 nt, Human
auucucugucucaucca

SEQ ID NO: 1357187 - RNA, 16 nt, Human
auucucugucucaucc

SEQ ID NO: 1357188 - RNA, 14 nt, Human
auucucugucucau

SEQ ID NO: 1357189 - RNA, 13 nt, Human
auucucugucuca

SEQ ID NO: 1357190 - RNA, 12 nt, Human
auucucugucuc

SEQ ID NO: 1357191 - RNA, 22 nt, Human
auucucuggcuguaaggcucua

SEQ ID NO: 1357192 - RNA, 21 nt, Human
auucucuggcuguaaggcucu

SEQ ID NO: 1357193 - RNA, 20 nt, Human
auucucuggcuguaaggcuc

SEQ ID NO: 1357194 - RNA, 19 nt, Human
auucucuggcuguaaggcu

SEQ ID NO: 1357195 - RNA, 17 nt, Human
auucucuggcuguaagg

SEQ ID NO: 1357196 - RNA, 18 nt, Human
auucucugagcugugcag

SEQ ID NO: 1357197 - RNA, 17 nt, Human
auucucugagcugugca

SEQ ID NO: 1357198 - RNA, 13 nt, Human
auucucugagcug

SEQ ID NO: 1357199 - RNA, 19 nt, Human
auucucuaguuugauuaaa

SEQ ID NO: 1357200 - RNA, 20 nt, Human
auuccuuuaacaacauguuu

SEQ ID NO: 1357201 - RNA, 18 nt, Human
auucuccuuguguuacua

SEQ ID NO: 1357202 - RNA, 19 nt, Human
auucuccuuguguuacuaa

SEQ ID NO: 1357203 - RNA, 21 nt, Human
auucuccuuguguuacuaagu

SEQ ID NO: 1357204 - RNA, 22 nt, Human
auucuccuuguguuacuaaguu

SEQ ID NO: 1357205 - RNA, 17 nt, Human
auucucuaguuugauua

SEQ ID NO: 1357206 - RNA, 18 nt, Human
auucucuaguuugauuaa

SEQ ID NO: 1357207 - RNA, 17 nt, Human
auuccucaacguauugu

SEQ ID NO: 1357208 - RNA, 22 nt, Human
auuccuauugugcaauguaaau

SEQ ID NO: 1357209 - RNA, 22 nt, Human
auuccucaugaauguaaauuug

SEQ ID NO: 1357210 - RNA, 20 nt, Human
auuccuccugcucauauugu

SEQ ID NO: 1357211 - RNA, 16 nt, Human
auuccuccugcucaua

SEQ ID NO: 1357212 - RNA, 15 nt, Human
auuccuccugcucau

SEQ ID NO: 1357213 - RNA, 14 nt, Human
auuccuccugcuca

SEQ ID NO: 1357214 - RNA, 13 nt, Human
auuccuccugcuc

SEQ ID NO: 1357215 - RNA, 19 nt, Human
auuccucaugaauguaaau

SEQ ID NO: 1357216 - RNA, 18 nt, Human
auuccucaugaauguaaa

SEQ ID NO: 1357217 - RNA, 17 nt, Human
auuccucaugaauguaa

SEQ ID NO: 1357218 - RNA, 16 nt, Human
auuccucaugaaugua

SEQ ID NO: 1357219 - RNA, 23 nt, Human
auuccucaugaauguaaauuugu

SEQ ID NO: 1357220 - RNA, 11 nt, Human
auuccuccagg

SEQ ID NO: 1357221 - RNA, 22 nt, Human
auuccuuagacucuuuuccuuc

SEQ ID NO: 1357222 - RNA, 19 nt, Human
auuccuuagacucuuuucc

SEQ ID NO: 1357223 - RNA, 22 nt, Human
auuccugggaaauauucccuag

SEQ ID NO: 1357224 - RNA, 17 nt, Human
auuccugggaaauauuc

SEQ ID NO: 1357225 - RNA, 12 nt, Human
auuccuucccau

SEQ ID NO: 1357226 - RNA, 15 nt, Human
auuccuucagcacuu

SEQ ID NO: 1357227 - RNA, 16 nt, Human
auuccuucccagaggg

SEQ ID NO: 1357228 - RNA, 15 nt, Human
auuccuucagauuug

SEQ ID NO: 1357229 - RNA, 17 nt, Human
auuccuucagcacuuua

SEQ ID NO: 1357230 - RNA, 20 nt, Human
auucuugauguaaaaucuug

SEQ ID NO: 1357231 - RNA, 19 nt, Human
auucuugauguaaaaucuu

SEQ ID NO: 1357232 - RNA, 18 nt, Human
auucuugauguaaaaucu

SEQ ID NO: 1357233 - RNA, 21 nt, Human
auucucugugucuaagauucu

SEQ ID NO: 1357234 - RNA, 14 nt, Human
auucuugcaaagua

SEQ ID NO: 1357235 - RNA, 15 nt, Human
auucuugcaaaguau

SEQ ID NO: 1357236 - RNA, 16 nt, Human
auucuugcaaaguauc

SEQ ID NO: 1357237 - RNA, 17 nt, Human
auucuugccaaauauaa

SEQ ID NO: 1357238 - RNA, 13 nt, Human
auuaaauuacaga

SEQ ID NO: 1357239 - RNA, 15 nt, Human
auuaaaugacacuca

SEQ ID NO: 1357240 - RNA, 21 nt, Human
auuaggcuguaacuacuuuau

SEQ ID NO: 1357241 - RNA, 17 nt, Human
auuaggcuguaacuacu

SEQ ID NO: 1357242 - RNA, 15 nt, Human
auuaggcuguaacua

SEQ ID NO: 1357243 - RNA, 14 nt, Human
auuaggcuguaacu

SEQ ID NO: 1357244 - RNA, 21 nt, Human
auuaggcagacucuuuaugcu

SEQ ID NO: 1357245 - RNA, 14 nt, Human
auuaggcagacucu

SEQ ID NO: 1357246 - RNA, 16 nt, Human
auuaugcauuauauca

SEQ ID NO: 1357247 - RNA, 19 nt, Human
auuaguacacagcaccaga

SEQ ID NO: 1357248 - RNA, 22 nt, Human
auuaugaauuacauuuguauaa

SEQ ID NO: 1357249 - RNA, 20 nt, Human
auuaugaauuacauuuguau

SEQ ID NO: 1357250 - RNA, 19 nt, Human
auuaugaauuacauuugua

SEQ ID NO: 1357251 - RNA, 13 nt, Human
auuaguaacaugu

SEQ ID NO: 1357252 - RNA, 13 nt, Human
auuaggccagcaa

SEQ ID NO: 1357253 - RNA, 23 nt, Human
auuaggcuguaacuacuuuauaa

SEQ ID NO: 1357254 - RNA, 22 nt, Human
auuaggcuguaacuacuuuaua

SEQ ID NO: 1357255 - RNA, 17 nt, Human
auuaguaacauguguua

SEQ ID NO: 1357256 - RNA, 16 nt, Human
auuaguaacauguguu

SEQ ID NO: 1357257 - RNA, 18 nt, Human
auuaguaagcuagcaaau

SEQ ID NO: 1357258 - RNA, 20 nt, Human
auuaguacuccccuccuuga

SEQ ID NO: 1357259 - RNA, 16 nt, Human
auucaaucuguaaacu

SEQ ID NO: 1357260 - RNA, 15 nt, Human
auucaaucuguaaac

SEQ ID NO: 1357261 - RNA, 14 nt, Human
auucaaucuguaaa

SEQ ID NO: 1357262 - RNA, 18 nt, Human
auucaaucuguaaacugu

SEQ ID NO: 1357263 - RNA, 17 nt, Human
auucaaucuguaaacug

SEQ ID NO: 1357264 - RNA, 22 nt, Human
auucaaucuguaaacuguguau

SEQ ID NO: 1357265 - RNA, 21 nt, Human
auucaauaaaguauuuaauua

SEQ ID NO: 1357266 - RNA, 22 nt, Human
auucaauaaaguauuuaauuag

SEQ ID NO: 1357267 - RNA, 13 nt, Human
auucaacaaacau

SEQ ID NO: 1357268 - RNA, 12 nt, Human
auucaacaaaca

SEQ ID NO: 1357269 - RNA, 18 nt, Human
auucaauaaaguauuuaa

SEQ ID NO: 1357270 - RNA, 20 nt, Human
auucaauaaaguauuuaauu

SEQ ID NO: 1357271 - RNA, 16 nt, Human
auucaaaugucuauaa

SEQ ID NO: 1357272 - RNA, 19 nt, Human
auuaugccuuuuuugauca

SEQ ID NO: 1357273 - RNA, 16 nt, Human
auuaugggucacagga

SEQ ID NO: 1357274 - RNA, 15 nt, Human
auuaugggucacagg

SEQ ID NO: 1357275 - RNA, 22 nt, Human
auuauggagucauuuuuacaau

SEQ ID NO: 1357276 - RNA, 17 nt, Human
auuaugggucacaggaa

SEQ ID NO: 1357277 - RNA, 18 nt, Human
cacaggcuucugagcagc

SEQ ID NO: 1357278 - RNA, 16 nt, Human
cacaggcucaggcagg

SEQ ID NO: 1357279 - RNA, 19 nt, Human
cacaggcucaggcaggggc

SEQ ID NO: 1357280 - RNA, 15 nt, Human
cacaggcucaggcag

SEQ ID NO: 1357281 - RNA, 14 nt, Human
cacaggcucaggca

SEQ ID NO: 1357282 - RNA, 13 nt, Human
cacaggcucaggc

SEQ ID NO: 1357283 - RNA, 24 nt, Human
cacaggccuguguagcugugaccu

SEQ ID NO: 1357284 - RNA, 23 nt, Human
cacaggccuguguagcugugacc

SEQ ID NO: 1357285 - RNA, 22 nt, Human
cacaggccuguguagcugugac

SEQ ID NO: 1357286 - RNA, 21 nt, Human
cacaggccuguguagcuguga

SEQ ID NO: 1357287 - RNA, 18 nt, Human
cacaggccuguguagcug

SEQ ID NO: 1357288 - RNA, 17 nt, Human
cacaggcuucugagcag

SEQ ID NO: 1357289 - RNA, 21 nt, Human
cacagcucuccggucucucuc

SEQ ID NO: 1357290 - RNA, 20 nt, Human
cacagcucuccggucucucu

SEQ ID NO: 1357291 - RNA, 14 nt, Human
cacaggccugugua

SEQ ID NO: 1357292 - RNA, 15 nt, Human
cacagcuccucccac

SEQ ID NO: 1357293 - RNA, 10 nt, Human
cacagcuccu

SEQ ID NO: 1357294 - RNA, 23 nt, Human
cacagaaaauaaggcacccaucu

SEQ ID NO: 1357295 - RNA, 12 nt, Human
cacagaaaccuu

SEQ ID NO: 1357296 - RNA, 16 nt, Human
cacagaaaccaauuuu

SEQ ID NO: 1357297 - RNA, 12 nt, Human
cacacuuuggua

SEQ ID NO: 1357298 - RNA, 17 nt, Human
cacacuuugguaccaga

SEQ ID NO: 1357299 - RNA, 17 nt, Human
cacagaaaauaaggcac

SEQ ID NO: 1357300 - RNA, 14 nt, Human
cacagaaaauaagg

SEQ ID NO: 1357301 - RNA, 13 nt, Human
cacacauugcugu

SEQ ID NO: 1357302 - RNA, 10 nt, Human
cacacauuuu

SEQ ID NO: 1357303 - RNA, 11 nt, Human
cacacauuuuu

SEQ ID NO: 1357304 - RNA, 12 nt, Human
cacacauuuuuu

SEQ ID NO: 1357305 - RNA, 16 nt, Human
cacacauuuuuuaaau

SEQ ID NO: 1357306 - RNA, 19 nt, Human
cacacauuuuuuaaaugca

SEQ ID NO: 1357307 - RNA, 20 nt, Human
cacacauuuuuuaaaugcac

SEQ ID NO: 1357308 - RNA, 23 nt, Human
cacaucugugucuuguuuggaau

SEQ ID NO: 1357309 - RNA, 18 nt, Human
cacaucugugucuuguuu

SEQ ID NO: 1357310 - RNA, 17 nt, Human
cacaucugugucuuguu

SEQ ID NO: 1357311 - RNA, 16 nt, Human
cacaucugugucuugu

SEQ ID NO: 1357312 - RNA, 17 nt, Human
cacauuuuauuuuauua

SEQ ID NO: 1357313 - RNA, 12 nt, Human
cacaucuguguc

SEQ ID NO: 1357314 - RNA, 23 nt, Human
cacaucucaacaggccucagggc

SEQ ID NO: 1357315 - RNA, 21 nt, Human
cacaucucaacaggccucagg

SEQ ID NO: 1357316 - RNA, 20 nt, Human
cacaucucaacaggccucag

SEQ ID NO: 1357317 - RNA, 14 nt, Human
cacaucucaacagg

SEQ ID NO: 1357318 - RNA, 13 nt, Human
cacaucucaacag

SEQ ID NO: 1357319 - RNA, 15 nt, Human
caccaaaagaaguaa

SEQ ID NO: 1357320 - RNA, 21 nt, Human
cacauuuuauuuuauuaugca

SEQ ID NO: 1357321 - RNA, 19 nt, Human
cacauuuuauuuuauuaug

SEQ ID NO: 1357322 - RNA, 20 nt, Human
cacauuuuauuuuauuaugc

SEQ ID NO: 1357323 - RNA, 13 nt, Human
caccaaaguucua

SEQ ID NO: 1357324 - RNA, 12 nt, Human
caccaaaguucu

SEQ ID NO: 1357325 - RNA, 13 nt, Human
caccaaagagaau

SEQ ID NO: 1357326 - RNA, 17 nt, Human
caccaaagagaaugccc

SEQ ID NO: 1357327 - RNA, 21 nt, Human
caccaaaucaaaaucucucca

SEQ ID NO: 1357328 - RNA, 18 nt, Human
caccaaaucaaaaucucu

SEQ ID NO: 1357329 - RNA, 16 nt, Human
caccaaaucaaaaucu

SEQ ID NO: 1357330 - RNA, 14 nt, Human
caccaaaucaaaau

SEQ ID NO: 1357331 - RNA, 22 nt, Human
caccaaaguucuaauaauuucu

SEQ ID NO: 1357332 - RNA, 17 nt, Human
caccaaaguucuaauaa

SEQ ID NO: 1357333 - RNA, 16 nt, Human
caccaaaguucuaaua

SEQ ID NO: 1357334 - RNA, 14 nt, Human
caccaaaguucuaa

SEQ ID NO: 1357335 - RNA, 13 nt, Human
caccaaaugugcu

SEQ ID NO: 1357336 - RNA, 16 nt, Human
caccaacccucagggc

SEQ ID NO: 1357337 - RNA, 15 nt, Human
caccaacccucaggg

SEQ ID NO: 1357338 - RNA, 14 nt, Human
caccaacccucagg

SEQ ID NO: 1357339 - RNA, 22 nt, Human
caccccaaccugcucuccucuu

SEQ ID NO: 1357340 - RNA, 21 nt, Human
caccccaaccugcucuccucu

SEQ ID NO: 1357341 - RNA, 20 nt, Human
caccccaaccugcucuccuc

SEQ ID NO: 1357342 - RNA, 16 nt, Human
caccccaaccugcucu

SEQ ID NO: 1357343 - RNA, 15 nt, Human
caccccaaccugcuc

SEQ ID NO: 1357344 - RNA, 19 nt, Human
caccccaaagcuuuccugc

SEQ ID NO: 1357345 - RNA, 18 nt, Human
caccccaaagcuuuccug

SEQ ID NO: 1357346 - RNA, 18 nt, Human
cacccauuuuuccuuuug

SEQ ID NO: 1357347 - RNA, 15 nt, Human
cacccauuuuuccuu

SEQ ID NO: 1357348 - RNA, 19 nt, Human
caccccaauccucccagaa

SEQ ID NO: 1357349 - RNA, 21 nt, Human
caccccacccacuucugcacu

SEQ ID NO: 1357350 - RNA, 15 nt, Human
caccccaauccuccc

SEQ ID NO: 1357351 - RNA, 19 nt, Human
cacccagccccagccaggg

SEQ ID NO: 1357352 - RNA, 22 nt, Human
caccagggcaucucugggcugg

SEQ ID NO: 1357353 - RNA, 21 nt, Human
caccagggcaucucugggcug

SEQ ID NO: 1357354 - RNA, 20 nt, Human
caccagggcaucucugggcu

SEQ ID NO: 1357355 - RNA, 19 nt, Human
caccagggcaucucugggc

SEQ ID NO: 1357356 - RNA, 18 nt, Human
caccagggcaucucuggg

SEQ ID NO: 1357357 - RNA, 17 nt, Human
caccagggcaucucugg

SEQ ID NO: 1357358 - RNA, 16 nt, Human
caccagggcaucucug

SEQ ID NO: 1357359 - RNA, 20 nt, Human
caccaggcuugccugcaggc

SEQ ID NO: 1357360 - RNA, 22 nt, Human
cacaagauggaauuuaucaaac

SEQ ID NO: 1357361 - RNA, 20 nt, Human
caauccaguggacuucgcag

SEQ ID NO: 1357362 - RNA, 17 nt, Human
caaucauuuuaauuauu

SEQ ID NO: 1357363 - RNA, 20 nt, Human
caaucccucaccuucugagu

SEQ ID NO: 1357364 - RNA, 22 nt, Human
caaucccuuaauauccuaaaca

SEQ ID NO: 1357365 - RNA, 18 nt, Human
cacaagauggaauuuauc

SEQ ID NO: 1357366 - RNA, 20 nt, Human
caauuucuguguugccaagc

SEQ ID NO: 1357367 - RNA, 22 nt, Human
caauuucuguguugccaagcuc

SEQ ID NO: 1357368 - RNA, 15 nt, Human
caauuucuguguugc

SEQ ID NO: 1357369 - RNA, 13 nt, Human
caauuucugaaca

SEQ ID NO: 1357370 - RNA, 19 nt, Human
caauuucuaauuuuuaaga

SEQ ID NO: 1357371 - RNA, 21 nt, Human
caauuucuacuuugaagucau

SEQ ID NO: 1357372 - RNA, 20 nt, Human
caauuucuacuuugaaguca

SEQ ID NO: 1357373 - RNA, 16 nt, Human
caauuucuacuuugaa

SEQ ID NO: 1357374 - RNA, 14 nt, Human
caauugacaacagu

SEQ ID NO: 1357375 - RNA, 18 nt, Human
caauugaaguaaacuuuu

SEQ ID NO: 1357376 - RNA, 21 nt, Human
caauugaaguaaacuuuuugu

SEQ ID NO: 1357377 - RNA, 17 nt, Human
caauugaaguaaacuuu

SEQ ID NO: 1357378 - RNA, 15 nt, Human
caauugaaguaaacu

SEQ ID NO: 1357379 - RNA, 17 nt, Human
caauuucuaauuuuuaa

SEQ ID NO: 1357380 - RNA, 22 nt, Human
caauuucggauuuuuuccaaaa

SEQ ID NO: 1357381 - RNA, 21 nt, Human
caauuucggauuuuuuccaaa

SEQ ID NO: 1357382 - RNA, 17 nt, Human
caauuucggauuuuuuc

SEQ ID NO: 1357383 - RNA, 13 nt, Human
caauuucggauuu

SEQ ID NO: 1357384 - RNA, 17 nt, Human
caauugcugcuacuuau

SEQ ID NO: 1357385 - RNA, 23 nt, Human
caauugcacgcggagugaguuuu

SEQ ID NO: 1357386 - RNA, 17 nt, Human
caauugcaucucccaga

SEQ ID NO: 1357387 - RNA, 15 nt, Human
caauugcaucuccca

SEQ ID NO: 1357388 - RNA, 14 nt, Human
caauugcaucuccc

SEQ ID NO: 1357389 - RNA, 21 nt, Human
caauugcacgcggagugaguu

SEQ ID NO: 1357390 - RNA, 19 nt, Human
caauugacugucacuguuc

SEQ ID NO: 1357391 - RNA, 22 nt, Human
caauugacaacaguuacauaau

SEQ ID NO: 1357392 - RNA, 21 nt, Human
caauugacaacaguuacauaa

SEQ ID NO: 1357393 - RNA, 14 nt, Human
caauugagaaaaau

SEQ ID NO: 1357394 - RNA, 23 nt, Human
caauugagaaaaauauauacuaa

SEQ ID NO: 1357395 - RNA, 20 nt, Human
caaggcccgagcagcugagc

SEQ ID NO: 1357396 - RNA, 21 nt, Human
caaggcccgagcagcugagca

SEQ ID NO: 1357397 - RNA, 19 nt, Human
caaggcccgagcagcugag

SEQ ID NO: 1357398 - RNA, 18 nt, Human
caaggcccgagcagcuga

SEQ ID NO: 1357399 - RNA, 17 nt, Human
caaggcccgagcagcug

SEQ ID NO: 1357400 - RNA, 16 nt, Human
caaggcccgagcagcu

SEQ ID NO: 1357401 - RNA, 14 nt, Human
caaggcccgagcag

SEQ ID NO: 1357402 - RNA, 13 nt, Human
caaggcccgagca

SEQ ID NO: 1357403 - RNA, 19 nt, Human
caaggcacucuagauucca

SEQ ID NO: 1357404 - RNA, 17 nt, Human
caaggcacucuagauuc

SEQ ID NO: 1357405 - RNA, 16 nt, Human
caaggcacucuagauu

SEQ ID NO: 1357406 - RNA, 22 nt, Human
caagauugguguuuuuuucuau

SEQ ID NO: 1357407 - RNA, 12 nt, Human
caagauuucaga

SEQ ID NO: 1357408 - RNA, 21 nt, Human
caagauugguguuuuuuucua

SEQ ID NO: 1357409 - RNA, 20 nt, Human
caagauugguguuuuuuucu

SEQ ID NO: 1357410 - RNA, 23 nt, Human
caagauugagcucucugcccuug

SEQ ID NO: 1357411 - RNA, 20 nt, Human
caagauugagcucucugccc

SEQ ID NO: 1357412 - RNA, 19 nt, Human
caagauugagcucucugcc

SEQ ID NO: 1357413 - RNA, 17 nt, Human
caagauugagcucucug

SEQ ID NO: 1357414 - RNA, 16 nt, Human
caagauugagcucucu

SEQ ID NO: 1357415 - RNA, 18 nt, Human
caagauucuagaugauua

SEQ ID NO: 1357416 - RNA, 17 nt, Human
caagauucuagaugauu

SEQ ID NO: 1357417 - RNA, 14 nt, Human
caagauucuagaug

SEQ ID NO: 1357418 - RNA, 13 nt, Human
caagauucuagau

SEQ ID NO: 1357419 - RNA, 15 nt, Human
caaggcacucuagau

SEQ ID NO: 1357420 - RNA, 14 nt, Human
caaggcacucuaga

SEQ ID NO: 1357421 - RNA, 22 nt, Human
caagauuguuccugcuuuuccc

SEQ ID NO: 1357422 - RNA, 19 nt, Human
caagucaggcccuuauuuu

SEQ ID NO: 1357423 - RNA, 20 nt, Human
caagucauagguuaauauuu

SEQ ID NO: 1357424 - RNA, 23 nt, Human
caagucaguccaggaugcuaaca

SEQ ID NO: 1357425 - RNA, 21 nt, Human
caagucagucauucagauaug

SEQ ID NO: 1357426 - RNA, 16 nt, Human
caaggcggugcuugau

SEQ ID NO: 1357427 - RNA, 13 nt, Human
caaggcggugcuu

SEQ ID NO: 1357428 - RNA, 22 nt, Human
caaggccuuauuggaaagcagu

SEQ ID NO: 1357429 - RNA, 22 nt, Human
caaggccugguguuucuugaua

SEQ ID NO: 1357430 - RNA, 21 nt, Human
caaggccugguguuucuugau

SEQ ID NO: 1357431 - RNA, 20 nt, Human
caaguuuaucaguaaauaac

SEQ ID NO: 1357432 - RNA, 22 nt, Human
caaguuuaucaguaaauaacug

SEQ ID NO: 1357433 - RNA, 19 nt, Human
caaguuguucgggccaagg

SEQ ID NO: 1357434 - RNA, 15 nt, Human
caauaaaacauuaau

SEQ ID NO: 1357435 - RNA, 14 nt, Human
caauaaaacauuaa

SEQ ID NO: 1357436 - RNA, 20 nt, Human
caauaaaaauguuuaacggu

SEQ ID NO: 1357437 - RNA, 23 nt, Human
caauaaaauccauacauuugugu

SEQ ID NO: 1357438 - RNA, 20 nt, Human
caauaaaauccauacauuug

SEQ ID NO: 1357439 - RNA, 20 nt, Human
cagaaaugaggccauggacu

SEQ ID NO: 1357440 - RNA, 23 nt, Human
cagaaaugaggccauggacucug

SEQ ID NO: 1357441 - RNA, 21 nt, Human
cagaaaugaggagacacaccu

SEQ ID NO: 1357442 - RNA, 21 nt, Human
cagaaauauuugugacaaaaa

SEQ ID NO: 1357443 - RNA, 22 nt, Human
cagaaauauuugugacaaaaaa

SEQ ID NO: 1357444 - RNA, 16 nt, Human
cagaaauguacagcaa

SEQ ID NO: 1357445 - RNA, 17 nt, Human
cagaaauguguuaucac

SEQ ID NO: 1357446 - RNA, 23 nt, Human
cagaaagggagggcucugaggcg

SEQ ID NO: 1357447 - RNA, 21 nt, Human
cagaaagggagggcucugagg

SEQ ID NO: 1357448 - RNA, 20 nt, Human
cagaaagggagggcucugag

SEQ ID NO: 1357449 - RNA, 19 nt, Human
cagaaagggagggcucuga

SEQ ID NO: 1357450 - RNA, 18 nt, Human
cagaaagggagggcucug

SEQ ID NO: 1357451 - RNA, 17 nt, Human
cagaaagggagggcucu

SEQ ID NO: 1357452 - RNA, 16 nt, Human
cagaaagggagggcuc

SEQ ID NO: 1357453 - RNA, 20 nt, Human
cagaaaggacuccuccuuuu

SEQ ID NO: 1357454 - RNA, 15 nt, Human
cagaaagggagggcu

SEQ ID NO: 1357455 - RNA, 19 nt, Human
cagaaaggaaaaacaaacu

SEQ ID NO: 1357456 - RNA, 17 nt, Human
cagaaaggaaaaacaaa

SEQ ID NO: 1357457 - RNA, 16 nt, Human
cagaaaggaaaaacaa

SEQ ID NO: 1357458 - RNA, 23 nt, Human
cagaaagugccuuucaggaucua

SEQ ID NO: 1357459 - RNA, 22 nt, Human
cagaaagugccuuucaggaucu

SEQ ID NO: 1357460 - RNA, 19 nt, Human
cagaaagugccuuucagga

SEQ ID NO: 1357461 - RNA, 18 nt, Human
cagaaagugccuuucagg

SEQ ID NO: 1357462 - RNA, 17 nt, Human
cagaaagugccuuucag

SEQ ID NO: 1357463 - RNA, 16 nt, Human
cagaaagugccuuuca

SEQ ID NO: 1357464 - RNA, 15 nt, Human
cagaaagugccuuuc

SEQ ID NO: 1357465 - RNA, 23 nt, Human
cagaaagugccugacacacuaac

SEQ ID NO: 1357466 - RNA, 19 nt, Human
cagaaagugccugacacac

SEQ ID NO: 1357467 - RNA, 16 nt, Human
cagaaagugccugaca

SEQ ID NO: 1357468 - RNA, 15 nt, Human
cagaaagugccugac

SEQ ID NO: 1357469 - RNA, 14 nt, Human
cagaaagugccuga

SEQ ID NO: 1357470 - RNA, 12 nt, Human
cagaaagugccu

SEQ ID NO: 1357471 - RNA, 22 nt, Human
cagaaagggagggcucugaggc

SEQ ID NO: 1357472 - RNA, 14 nt, Human
cagaaauacuacug

SEQ ID NO: 1357473 - RNA, 23 nt, Human
cagaaauacagauuuugauagca

SEQ ID NO: 1357474 - RNA, 14 nt, Human
cagaaauacaauuu

SEQ ID NO: 1357475 - RNA, 15 nt, Human
cagaaauacagauuu

SEQ ID NO: 1357476 - RNA, 20 nt, Human
cagaaauacagauuuugaua

SEQ ID NO: 1357477 - RNA, 18 nt, Human
cacugccauaugauuuac

SEQ ID NO: 1357478 - RNA, 22 nt, Human
cacuguuuguuuacaaaaucag

SEQ ID NO: 1357479 - RNA, 11 nt, Human
cacuguuuaag

SEQ ID NO: 1357480 - RNA, 15 nt, Human
cacuuaaacuugcau

SEQ ID NO: 1357481 - RNA, 20 nt, Human
cacugguagaccaaaauaaa

SEQ ID NO: 1357482 - RNA, 20 nt, Human
cacugggugguggccugguc

SEQ ID NO: 1357483 - RNA, 22 nt, Human
cacugggugguggccugguccc

SEQ ID NO: 1357484 - RNA, 18 nt, Human
cacugggugguggccugg

SEQ ID NO: 1357485 - RNA, 17 nt, Human
cacugggugguggccug

SEQ ID NO: 1357486 - RNA, 15 nt, Human
cacugggugguggcc

SEQ ID NO: 1357487 - RNA, 14 nt, Human
cacugggugguggc

SEQ ID NO: 1357488 - RNA, 18 nt, Human
cacugggaggcuccccuu

SEQ ID NO: 1357489 - RNA, 20 nt, Human
cacugggaggcuccccuucu

SEQ ID NO: 1357490 - RNA, 19 nt, Human
cacugggagaaaugaaaaa

SEQ ID NO: 1357491 - RNA, 23 nt, Human
cacuuaaccaagacaaaaagcca

SEQ ID NO: 1357492 - RNA, 14 nt, Human
cacuuaauguaugu

SEQ ID NO: 1357493 - RNA, 12 nt, Human
cacuuaauguau

SEQ ID NO: 1357494 - RNA, 22 nt, Human
cacuuaaguuaguuccacugag

SEQ ID NO: 1357495 - RNA, 20 nt, Human
cacuuaaguuaguuccacug

SEQ ID NO: 1357496 - RNA, 22 nt, Human
cacuuguggguuuuuguuuugu

SEQ ID NO: 1357497 - RNA, 15 nt, Human
cacuuaauguauguu

SEQ ID NO: 1357498 - RNA, 19 nt, Human
cacuuuaaaauaucuacau

SEQ ID NO: 1357499 - RNA, 17 nt, Human
cacuuguguuuugcaag

SEQ ID NO: 1357500 - RNA, 22 nt, Human
cacuuuacacaauagaauuaua

SEQ ID NO: 1357501 - RNA, 20 nt, Human
cacuuuaauuaccaaccugu

SEQ ID NO: 1357502 - RNA, 18 nt, Human
cacuuuagaauaugccuu

SEQ ID NO: 1357503 - RNA, 19 nt, Human
caccuaggaagccucagau

SEQ ID NO: 1357504 - RNA, 24 nt, Human
caccuaggaagccucagauuccuu

SEQ ID NO: 1357505 - RNA, 18 nt, Human
caccuaggaagccucaga

SEQ ID NO: 1357506 - RNA, 17 nt, Human
caccuaggaagccucag

SEQ ID NO: 1357507 - RNA, 23 nt, Human
caccuagcugaauguuuuucuaa

SEQ ID NO: 1357508 - RNA, 22 nt, Human
caccuagcugaauguuuuucua

SEQ ID NO: 1357509 - RNA, 21 nt, Human
caccuagcugaauguuuuucu

SEQ ID NO: 1357510 - RNA, 19 nt, Human
caccuagcugaauguuuuu

SEQ ID NO: 1357511 - RNA, 18 nt, Human
caccuagcugaauguuuu

SEQ ID NO: 1357512 - RNA, 14 nt, Human
caccuagcugaaug

SEQ ID NO: 1357513 - RNA, 13 nt, Human
caccuagcugaau

SEQ ID NO: 1357514 - RNA, 14 nt, Human
caccuagcagcacc

SEQ ID NO: 1357515 - RNA, 17 nt, Human
caccuaggcuagggugg

SEQ ID NO: 1357516 - RNA, 13 nt, Human
caccucagauggc

SEQ ID NO: 1357517 - RNA, 12 nt, Human
caccucagaugg

SEQ ID NO: 1357518 - RNA, 20 nt, Human
caccucagagacauacaccu

SEQ ID NO: 1357519 - RNA, 17 nt, Human
caccuuuuuucaacagu

SEQ ID NO: 1357520 - RNA, 19 nt, Human
caccuuuguuucuccccca

SEQ ID NO: 1357521 - RNA, 16 nt, Human
cacgaaauguuauuuu

SEQ ID NO: 1357522 - RNA, 15 nt, Human
cacgaaauguuauuu

SEQ ID NO: 1357523 - RNA, 13 nt, Human
cacgaaauguuau

SEQ ID NO: 1357524 - RNA, 17 nt, Human
cacgaaauguuauuuuu

SEQ ID NO: 1357525 - RNA, 17 nt, Human
caccuuucuaguugaaa

SEQ ID NO: 1357526 - RNA, 13 nt, Human
caccuuucuaguu

SEQ ID NO: 1357527 - RNA, 12 nt, Human
caccuuucuagu

SEQ ID NO: 1357528 - RNA, 17 nt, Human
caccuuuguuucucccc

SEQ ID NO: 1357529 - RNA, 16 nt, Human
caccugccccaacucu

SEQ ID NO: 1357530 - RNA, 15 nt, Human
caccugccccaacuc

SEQ ID NO: 1357531 - RNA, 21 nt, Human
caccucagauggcagcuuuua

SEQ ID NO: 1357532 - RNA, 20 nt, Human
caccucagauggcagcuuuu

SEQ ID NO: 1357533 - RNA, 19 nt, Human
caccucagauggcagcuuu

SEQ ID NO: 1357534 - RNA, 18 nt, Human
caccucagauggcagcuu

SEQ ID NO: 1357535 - RNA, 17 nt, Human
caccucagauggcagcu

SEQ ID NO: 1357536 - RNA, 22 nt, Human
cacucuguucauuccuccaggu

SEQ ID NO: 1357537 - RNA, 19 nt, Human
cacggccacaucaaagagg

SEQ ID NO: 1357538 - RNA, 13 nt, Human
cacggccacauca

SEQ ID NO: 1357539 - RNA, 19 nt, Human
cacggccacacagcugccg

SEQ ID NO: 1357540 - RNA, 18 nt, Human
cacggccacacagcugcc

SEQ ID NO: 1357541 - RNA, 17 nt, Human
cacggccacacagcugc

SEQ ID NO: 1357542 - RNA, 16 nt, Human
cacggccacacagcug

SEQ ID NO: 1357543 - RNA, 20 nt, Human
cacggccacacagcugccgg

SEQ ID NO: 1357544 - RNA, 20 nt, Human
cacggccuuucuagccuggc

SEQ ID NO: 1357545 - RNA, 12 nt, Human
cacggccuuucu

SEQ ID NO: 1357546 - RNA, 21 nt, Human
cacuacacccagcaauagaga

SEQ ID NO: 1357547 - RNA, 21 nt, Human
cacuacauucuguuaaucauu

SEQ ID NO: 1357548 - RNA, 16 nt, Human
cacuacauucuguuaa

SEQ ID NO: 1357549 - RNA, 17 nt, Human
cacuacauucuguuaau

SEQ ID NO: 1357550 - RNA, 20 nt, Human
cacuaccgaaugugucuuua

SEQ ID NO: 1357551 - RNA, 23 nt, Human
cacuaccgaaugugucuuuagau

SEQ ID NO: 1357552 - RNA, 17 nt, Human
cacucuguucauuccuc

SEQ ID NO: 1357553 - RNA, 18 nt, Human
cacucuguucauuccucc

SEQ ID NO: 1357554 - RNA, 19 nt, Human
cacucuguucauuccucca

SEQ ID NO: 1357555 - RNA, 20 nt, Human
cacucuguucauuccuccag

SEQ ID NO: 1357556 - RNA, 21 nt, Human
cacucuguucauuccuccagg

SEQ ID NO: 1357557 - RNA, 12 nt, Human
cccccuuuccug

SEQ ID NO: 1357558 - RNA, 18 nt, Human
cccccuuucacaggcagc

SEQ ID NO: 1357559 - RNA, 22 nt, Human
cccccuuucacaggcagccagu

SEQ ID NO: 1357560 - RNA, 17 nt, Human
cccccuuucacaggcag

SEQ ID NO: 1357561 - RNA, 21 nt, Human
cccccuuuagaucucugaagc

SEQ ID NO: 1357562 - RNA, 20 nt, Human
cccccuuuagaucucugaag

SEQ ID NO: 1357563 - RNA, 14 nt, Human
cccccuugaguggg

SEQ ID NO: 1357564 - RNA, 20 nt, Human
cccccuuuccuggacacuca

SEQ ID NO: 1357565 - RNA, 14 nt, Human
ccccgcagacaccu

SEQ ID NO: 1357566 - RNA, 13 nt, Human
cccauuuuuccuu

SEQ ID NO: 1357567 - RNA, 12 nt, Human
cccauuuuuccu

SEQ ID NO: 1357568 - RNA, 17 nt, Human
cccauuuugaaucacau

SEQ ID NO: 1357569 - RNA, 13 nt, Human
cccauuucugagg

SEQ ID NO: 1357570 - RNA, 13 nt, Human
ccccauucccgca

SEQ ID NO: 1357571 - RNA, 15 nt, Human
ccccauguucugucc

SEQ ID NO: 1357572 - RNA, 23 nt, Human
ccccauguguccugguucccguu

SEQ ID NO: 1357573 - RNA, 18 nt, Human
ccccauguguccugguuc

SEQ ID NO: 1357574 - RNA, 16 nt, Human
ccccauguguccuggu

SEQ ID NO: 1357575 - RNA, 14 nt, Human
ccccauguguccug

SEQ ID NO: 1357576 - RNA, 20 nt, Human
ccccauggugcuaggaagag

SEQ ID NO: 1357577 - RNA, 21 nt, Human
ccccauggugcuaggaagagg

SEQ ID NO: 1357578 - RNA, 19 nt, Human
ccccauggucagcccuagg

SEQ ID NO: 1357579 - RNA, 17 nt, Human
ccccauggcccugagcg

SEQ ID NO: 1357580 - RNA, 16 nt, Human
ccccauggcccugagc

SEQ ID NO: 1357581 - RNA, 13 nt, Human
ccccauggcccug

SEQ ID NO: 1357582 - RNA, 19 nt, Human
ccccauggagcugggcuaa

SEQ ID NO: 1357583 - RNA, 13 nt, Human
ccccaugcuggcc

SEQ ID NO: 1357584 - RNA, 14 nt, Human
ccccaugcuggccu

SEQ ID NO: 1357585 - RNA, 18 nt, Human
ccccaugcuggccuugcc

SEQ ID NO: 1357586 - RNA, 15 nt, Human
ccccagcccagggcu

SEQ ID NO: 1357587 - RNA, 14 nt, Human
ccccagcccagggc

SEQ ID NO: 1357588 - RNA, 12 nt, Human
ccccagcccagg

SEQ ID NO: 1357589 - RNA, 16 nt, Human
ccccagcccagagaca

SEQ ID NO: 1357590 - RNA, 15 nt, Human
ccccagcccagagac

SEQ ID NO: 1357591 - RNA, 13 nt, Human
ccccagcccagag

SEQ ID NO: 1357592 - RNA, 12 nt, Human
ccccagcccaga

SEQ ID NO: 1357593 - RNA, 21 nt, Human
ccccagcccagggcuccugca

SEQ ID NO: 1357594 - RNA, 20 nt, Human
ccccagcccagggcuccugc

SEQ ID NO: 1357595 - RNA, 11 nt, Human
ccccagauauc

SEQ ID NO: 1357596 - RNA, 22 nt, Human
cccauccuguguguuaagcucu

SEQ ID NO: 1357597 - RNA, 18 nt, Human
cccauccuguggucacug

SEQ ID NO: 1357598 - RNA, 15 nt, Human
cccauccugaccagc

SEQ ID NO: 1357599 - RNA, 16 nt, Human
cccaucccuccccagu

SEQ ID NO: 1357600 - RNA, 15 nt, Human
cccaucccuccccag

SEQ ID NO: 1357601 - RNA, 14 nt, Human
cccaucaggguagg

SEQ ID NO: 1357602 - RNA, 23 nt, Human
cccaucagugcucccucacaugu

SEQ ID NO: 1357603 - RNA, 22 nt, Human
cccaucagugcucccucacaug

SEQ ID NO: 1357604 - RNA, 18 nt, Human
cccaucagcuccagcugc

SEQ ID NO: 1357605 - RNA, 23 nt, Human
cccaucaccuacucacacaggca

SEQ ID NO: 1357606 - RNA, 22 nt, Human
cccaucaccuacucacacaggc

SEQ ID NO: 1357607 - RNA, 21 nt, Human
cccaucaccuacucacacagg

SEQ ID NO: 1357608 - RNA, 20 nt, Human
cccaucaccuacucacacag

SEQ ID NO: 1357609 - RNA, 19 nt, Human
cccagggacaccugggaga

SEQ ID NO: 1357610 - RNA, 18 nt, Human
cccagggacaccugggag

SEQ ID NO: 1357611 - RNA, 23 nt, Human
cccagggaagcagcagccucgcc

SEQ ID NO: 1357612 - RNA, 22 nt, Human
cccaggcugccguccccuagag

SEQ ID NO: 1357613 - RNA, 15 nt, Human
cccaggcugccgucc

SEQ ID NO: 1357614 - RNA, 14 nt, Human
cccaggcugccguc

SEQ ID NO: 1357615 - RNA, 12 nt, Human
cccaggcugccg

SEQ ID NO: 1357616 - RNA, 20 nt, Human
cccagggaagcagcagccuc

SEQ ID NO: 1357617 - RNA, 19 nt, Human
cccagggaagcagcagccu

SEQ ID NO: 1357618 - RNA, 17 nt, Human
cccagggaagcagcagc

SEQ ID NO: 1357619 - RNA, 15 nt, Human
cccagggaagcagca

SEQ ID NO: 1357620 - RNA, 20 nt, Human
cccagcuggggccaggcugg

SEQ ID NO: 1357621 - RNA, 22 nt, Human
cccagccagggcucaaucucug

SEQ ID NO: 1357622 - RNA, 16 nt, Human
cccagccagggcucaa

SEQ ID NO: 1357623 - RNA, 16 nt, Human
cccagccaggcccagc

SEQ ID NO: 1357624 - RNA, 15 nt, Human
cccagccaggcccag

SEQ ID NO: 1357625 - RNA, 14 nt, Human
cccagccaggccca

SEQ ID NO: 1357626 - RNA, 21 nt, Human
cccagccagggcucaaucucu

SEQ ID NO: 1357627 - RNA, 19 nt, Human
cccagccagggcucaaucu

SEQ ID NO: 1357628 - RNA, 13 nt, Human
cccagccauccag

SEQ ID NO: 1357629 - RNA, 17 nt, Human
cccagccaggcccagcc

SEQ ID NO: 1357630 - RNA, 13 nt, Human
cccagccaggccc

SEQ ID NO: 1357631 - RNA, 11 nt, Human
cccagccagcg

SEQ ID NO: 1357632 - RNA, 23 nt, Human
cccagccagcgucggucugugcc

SEQ ID NO: 1357633 - RNA, 19 nt, Human
cccagcacaugugcugccc

SEQ ID NO: 1357634 - RNA, 22 nt, Human
cccacuggagcagaaggggaga

SEQ ID NO: 1357635 - RNA, 13 nt, Human
cccacuggagcag

SEQ ID NO: 1357636 - RNA, 12 nt, Human
cccacuggagca

SEQ ID NO: 1357637 - RNA, 19 nt, Human
cccagcacagcuugaccug

SEQ ID NO: 1357638 - RNA, 18 nt, Human
cccagcacagcuugaccu

SEQ ID NO: 1357639 - RNA, 19 nt, Human
cccuccugugcucagcccu

SEQ ID NO: 1357640 - RNA, 18 nt, Human
cccuccugugcucagccc

SEQ ID NO: 1357641 - RNA, 17 nt, Human
cccuccuggugccaccu

SEQ ID NO: 1357642 - RNA, 13 nt, Human
cccuccuggcucu

SEQ ID NO: 1357643 - RNA, 20 nt, Human
cccucagccucuccccugcc

SEQ ID NO: 1357644 - RNA, 17 nt, Human
cccucacucgucucccc

SEQ ID NO: 1357645 - RNA, 23 nt, Human
cccucaccuuggcaccagacacc

SEQ ID NO: 1357646 - RNA, 21 nt, Human
cccucaccuuggcaccagaca

SEQ ID NO: 1357647 - RNA, 20 nt, Human
cccucaccuuggcaccagac

SEQ ID NO: 1357648 - RNA, 16 nt, Human
cccucaccuucugagu

SEQ ID NO: 1357649 - RNA, 21 nt, Human
cccucaccuguagcagccagu

SEQ ID NO: 1357650 - RNA, 23 nt, Human
cccucagccucuccccugccugc

SEQ ID NO: 1357651 - RNA, 17 nt, Human
cccggcuaauuuuugua

SEQ ID NO: 1357652 - RNA, 14 nt, Human
cccucaccuccucu

SEQ ID NO: 1357653 - RNA, 18 nt, Human
cccucaaccucauccucu

SEQ ID NO: 1357654 - RNA, 16 nt, Human
ccccucugcugcuguc

SEQ ID NO: 1357655 - RNA, 17 nt, Human
ccccugccccccagccu

SEQ ID NO: 1357656 - RNA, 11 nt, Human
ccccugccccc

SEQ ID NO: 1357657 - RNA, 23 nt, Human
ccccugccagggcagggccccag

SEQ ID NO: 1357658 - RNA, 19 nt, Human
ccccugccagggcagggcc

SEQ ID NO: 1357659 - RNA, 15 nt, Human
ccccugccagggcag

SEQ ID NO: 1357660 - RNA, 14 nt, Human
ccccugccagggca

SEQ ID NO: 1357661 - RNA, 20 nt, Human
ccccugccaccaggccaccu

SEQ ID NO: 1357662 - RNA, 12 nt, Human
ccccugccacca

SEQ ID NO: 1357663 - RNA, 15 nt, Human
ccccugccaccuccu

SEQ ID NO: 1357664 - RNA, 17 nt, Human
ccccugccaccuccugc

SEQ ID NO: 1357665 - RNA, 22 nt, Human
ccccucuuggagaagucucagc

SEQ ID NO: 1357666 - RNA, 14 nt, Human
ccccucuuggagaa

SEQ ID NO: 1357667 - RNA, 23 nt, Human
ccccucuuggagaagucucagcu

SEQ ID NO: 1357668 - RNA, 13 nt, Human
ccccugaauuuaa

SEQ ID NO: 1357669 - RNA, 16 nt, Human
ccccugaccacucaga

SEQ ID NO: 1357670 - RNA, 17 nt, Human
ccccugaauuuaaauag

SEQ ID NO: 1357671 - RNA, 12 nt, Human
ccagcuuuccug

SEQ ID NO: 1357672 - RNA, 23 nt, Human
ccagcuuguuuacaugcuuauuc

SEQ ID NO: 1357673 - RNA, 18 nt, Human
ccagcuuucccugccucu

SEQ ID NO: 1357674 - RNA, 14 nt, Human
ccagcuuucccugc

SEQ ID NO: 1357675 - RNA, 12 nt, Human
ccagcuuucccu

SEQ ID NO: 1357676 - RNA, 21 nt, Human
ccagcuuguuuacaugcuuau

SEQ ID NO: 1357677 - RNA, 15 nt, Human
ccagcucccccuccc

SEQ ID NO: 1357678 - RNA, 16 nt, Human
ccagcucccccucccu

SEQ ID NO: 1357679 - RNA, 23 nt, Human
ccagcucccaggaccacaggcuc

SEQ ID NO: 1357680 - RNA, 21 nt, Human
ccagcucccaggaccacaggc

SEQ ID NO: 1357681 - RNA, 20 nt, Human
ccagcucccaggaccacagg

SEQ ID NO: 1357682 - RNA, 13 nt, Human
ccagcucccagga

SEQ ID NO: 1357683 - RNA, 12 nt, Human
ccagcucccagg

SEQ ID NO: 1357684 - RNA, 22 nt, Human
ccagcucccaccuccccuuggg

SEQ ID NO: 1357685 - RNA, 19 nt, Human
ccagcucccaccuccccuu

SEQ ID NO: 1357686 - RNA, 15 nt, Human
ccagcucccaccucc

SEQ ID NO: 1357687 - RNA, 22 nt, Human
ccagcuccaaggggaaucagaa

SEQ ID NO: 1357688 - RNA, 20 nt, Human
ccagcuccaaccugcaaaga

SEQ ID NO: 1357689 - RNA, 15 nt, Human
ccagcuccaaccugc

SEQ ID NO: 1357690 - RNA, 14 nt, Human
ccagcuccaaccug

SEQ ID NO: 1357691 - RNA, 17 nt, Human
ccagcucaauggacugg

SEQ ID NO: 1357692 - RNA, 21 nt, Human
ccagcuagugacccacaugcc

SEQ ID NO: 1357693 - RNA, 22 nt, Human
ccagcuauguuauauugaaaaa

SEQ ID NO: 1357694 - RNA, 22 nt, Human
ccagcuagugacccacaugcca

SEQ ID NO: 1357695 - RNA, 20 nt, Human
ccagcuagugacccacaugc

SEQ ID NO: 1357696 - RNA, 18 nt, Human
ccagcuagugacccacau

SEQ ID NO: 1357697 - RNA, 14 nt, Human
ccagcuagugaccc

SEQ ID NO: 1357698 - RNA, 23 nt, Human
ccagcuaggaagagcaggacucc

SEQ ID NO: 1357699 - RNA, 17 nt, Human
ccagcuacuuccuccuc

SEQ ID NO: 1357700 - RNA, 15 nt, Human
ccagcuacuuccucc

SEQ ID NO: 1357701 - RNA, 14 nt, Human
ccagccccucuggu

SEQ ID NO: 1357702 - RNA, 13 nt, Human
ccagccccucugg

SEQ ID NO: 1357703 - RNA, 21 nt, Human
ccagcagacagagccaggaga

SEQ ID NO: 1357704 - RNA, 17 nt, Human
ccagcacuuccauggga

SEQ ID NO: 1357705 - RNA, 15 nt, Human
ccacucuaaagcaaa

SEQ ID NO: 1357706 - RNA, 16 nt, Human
ccacuccuuccugccc

SEQ ID NO: 1357707 - RNA, 18 nt, Human
ccacuccuuccugcccca

SEQ ID NO: 1357708 - RNA, 14 nt, Human
ccacuccuuccugc

SEQ ID NO: 1357709 - RNA, 13 nt, Human
ccacuccuuccug

SEQ ID NO: 1357710 - RNA, 22 nt, Human
ccacuccucugcugaccugcug

SEQ ID NO: 1357711 - RNA, 20 nt, Human
ccagcacuuguccagcugag

SEQ ID NO: 1357712 - RNA, 19 nt, Human
ccagcacuuguccagcuga

SEQ ID NO: 1357713 - RNA, 16 nt, Human
ccagcacuuguccagc

SEQ ID NO: 1357714 - RNA, 22 nt, Human
ccagcagacagagccaggagaa

SEQ ID NO: 1357715 - RNA, 20 nt, Human
ccagcagacagagccaggag

SEQ ID NO: 1357716 - RNA, 19 nt, Human
ccagcagacagagccagga

SEQ ID NO: 1357717 - RNA, 18 nt, Human
ccagcagacagagccagg

SEQ ID NO: 1357718 - RNA, 12 nt, Human
ccagcagaaaug

SEQ ID NO: 1357719 - RNA, 20 nt, Human
ccagcuuugcuaccaaagca

SEQ ID NO: 1357720 - RNA, 13 nt, Human
ccagcuuuucaaa

SEQ ID NO: 1357721 - RNA, 13 nt, Human
ccagcuuuuccca

SEQ ID NO: 1357722 - RNA, 23 nt, Human
ccagcuuuucccaaaagcccauu

SEQ ID NO: 1357723 - RNA, 17 nt, Human
ccagcagacagagccag

SEQ ID NO: 1357724 - RNA, 19 nt, Human
ccaguccuaucugggcuuc

SEQ ID NO: 1357725 - RNA, 21 nt, Human
ccaguccuaucugggcuuccu

SEQ ID NO: 1357726 - RNA, 18 nt, Human
ccaguccuaucugggcuu

SEQ ID NO: 1357727 - RNA, 17 nt, Human
ccaguccuaucugggcu

SEQ ID NO: 1357728 - RNA, 16 nt, Human
ccaguccuaucugggc

SEQ ID NO: 1357729 - RNA, 15 nt, Human
ccagucccagagcag

SEQ ID NO: 1357730 - RNA, 13 nt, Human
ccagucccagagc

SEQ ID NO: 1357731 - RNA, 14 nt, Human
ccaguccaguccua

SEQ ID NO: 1357732 - RNA, 17 nt, Human
ccaguccaccugaggaa

SEQ ID NO: 1357733 - RNA, 19 nt, Human
ccaguccaggcugccgugg

SEQ ID NO: 1357734 - RNA, 16 nt, Human
ccaguccaggcugccg

SEQ ID NO: 1357735 - RNA, 15 nt, Human
ccaguccaggcugcc

SEQ ID NO: 1357736 - RNA, 14 nt, Human
ccaguccaggcugc

SEQ ID NO: 1357737 - RNA, 13 nt, Human
ccaguccaggcug

SEQ ID NO: 1357738 - RNA, 15 nt, Human
ccagucaggcccagg

SEQ ID NO: 1357739 - RNA, 14 nt, Human
ccagucaggcccag

SEQ ID NO: 1357740 - RNA, 20 nt, Human
ccaggggggugaggagcugg

SEQ ID NO: 1357741 - RNA, 19 nt, Human
ccaggggggugaggagcug

SEQ ID NO: 1357742 - RNA, 17 nt, Human
ccaggggggugaggagc

SEQ ID NO: 1357743 - RNA, 21 nt, Human
ccaggauggaacacggccaca

SEQ ID NO: 1357744 - RNA, 18 nt, Human
ccaggaucguuuuuuccc

SEQ ID NO: 1357745 - RNA, 18 nt, Human
ccaggauagagacuggaa

SEQ ID NO: 1357746 - RNA, 16 nt, Human
ccaggauagagacugg

SEQ ID NO: 1357747 - RNA, 19 nt, Human
ccaggggagcagaggggca

SEQ ID NO: 1357748 - RNA, 20 nt, Human
ccaggggagcagaggggcag

SEQ ID NO: 1357749 - RNA, 15 nt, Human
ccaggggagcagagg

SEQ ID NO: 1357750 - RNA, 19 nt, Human
ccaggggaacacuggggac

SEQ ID NO: 1357751 - RNA, 17 nt, Human
ccaggcaggucugaagc

SEQ ID NO: 1357752 - RNA, 23 nt, Human
ccaggcugccucccuuguggcag

SEQ ID NO: 1357753 - RNA, 13 nt, Human
ccaggcugccucc

SEQ ID NO: 1357754 - RNA, 13 nt, Human
ccaggcugcucag

SEQ ID NO: 1357755 - RNA, 18 nt, Human
ccaggcugccguggggcc

SEQ ID NO: 1357756 - RNA, 15 nt, Human
ccaggcugccguggg

SEQ ID NO: 1357757 - RNA, 14 nt, Human
ccaggcugccgugg

SEQ ID NO: 1357758 - RNA, 21 nt, Human
ccaggcugccguccccuagag

SEQ ID NO: 1357759 - RNA, 14 nt, Human
ccaggcugccgucc

SEQ ID NO: 1357760 - RNA, 17 nt, Human
ccaggcugcucagggcu

SEQ ID NO: 1357761 - RNA, 19 nt, Human
ccaggcugcucagggcugg

SEQ ID NO: 1357762 - RNA, 17 nt, Human
ccaggcuggagugcagu

SEQ ID NO: 1357763 - RNA, 18 nt, Human
ccaggcuggagugcagug

SEQ ID NO: 1357764 - RNA, 12 nt, Human
ccaguugcaguc

SEQ ID NO: 1357765 - RNA, 18 nt, Human
ccaguugcacucagguga

SEQ ID NO: 1357766 - RNA, 14 nt, Human
ccaguugccuuuua

SEQ ID NO: 1357767 - RNA, 19 nt, Human
ccaguugcagucacucuag

SEQ ID NO: 1357768 - RNA, 15 nt, Human
ccaguugccaucugc

SEQ ID NO: 1357769 - RNA, 22 nt, Human
ccaguuggagcuccagccugac

SEQ ID NO: 1357770 - RNA, 19 nt, Human
ccaguuggagcuccagccu

SEQ ID NO: 1357771 - RNA, 16 nt, Human
ccaucccuccccaguu

SEQ ID NO: 1357772 - RNA, 22 nt, Human
ccauccccuugaggucucagcc

SEQ ID NO: 1357773 - RNA, 23 nt, Human
ccauccccuugaggucucagccc

SEQ ID NO: 1357774 - RNA, 13 nt, Human
ccaucccaugcug

SEQ ID NO: 1357775 - RNA, 13 nt, Human
ccauccccagcga

SEQ ID NO: 1357776 - RNA, 18 nt, Human
ccauccauggccagcagc

SEQ ID NO: 1357777 - RNA, 17 nt, Human
ccauccauggccagcag

SEQ ID NO: 1357778 - RNA, 16 nt, Human
ccauccauggccagca

SEQ ID NO: 1357779 - RNA, 15 nt, Human
ccauccauggccagc

SEQ ID NO: 1357780 - RNA, 14 nt, Human
ccauccauggccag

SEQ ID NO: 1357781 - RNA, 13 nt, Human
ccauccauggcca

SEQ ID NO: 1357782 - RNA, 15 nt, Human
ccaguuggaguuuuu

SEQ ID NO: 1357783 - RNA, 23 nt, Human
ccaguuggaguuuuuuguaccaa

SEQ ID NO: 1357784 - RNA, 16 nt, Human
ccauguagaaaauuug

SEQ ID NO: 1357785 - RNA, 15 nt, Human
ccauguagaaaauuu

SEQ ID NO: 1357786 - RNA, 16 nt, Human
ccauguacaugaagaa

SEQ ID NO: 1357787 - RNA, 23 nt, Human
ccauguaauggcaguuauauuuu

SEQ ID NO: 1357788 - RNA, 20 nt, Human
ccauguaauggcaguuauau

SEQ ID NO: 1357789 - RNA, 20 nt, Human
ccaugaugccucugucuucu

SEQ ID NO: 1357790 - RNA, 14 nt, Human
ccaugaugccucug

SEQ ID NO: 1357791 - RNA, 19 nt, Human
ccaugaguuccagaaagua

SEQ ID NO: 1357792 - RNA, 22 nt, Human
ccaugaucccuguguugucucu

SEQ ID NO: 1357793 - RNA, 17 nt, Human
ccaugaucccuguguug

SEQ ID NO: 1357794 - RNA, 23 nt, Human
ccauguccaaagaggcugccccu

SEQ ID NO: 1357795 - RNA, 16 nt, Human
ccaugaucccuguguu

SEQ ID NO: 1357796 - RNA, 14 nt, Human
ccaugaucccugug

SEQ ID NO: 1357797 - RNA, 23 nt, Human
ccaugaguuggggucuggcagcc

SEQ ID NO: 1357798 - RNA, 22 nt, Human
ccaugaguuggggucuggcagc

SEQ ID NO: 1357799 - RNA, 21 nt, Human
ccaugaguuggggucuggcag

SEQ ID NO: 1357800 - RNA, 19 nt, Human
ccauucuuccuaguuuucu

SEQ ID NO: 1357801 - RNA, 14 nt, Human
ccauucuuccuagu

SEQ ID NO: 1357802 - RNA, 20 nt, Human
ccauucuuucccaacaccuc

SEQ ID NO: 1357803 - RNA, 14 nt, Human
ccauucuuucccaa

SEQ ID NO: 1357804 - RNA, 20 nt, Human
ccauucuuccuaguuuucuc

SEQ ID NO: 1357805 - RNA, 12 nt, Human
ccauucuuuccc

SEQ ID NO: 1357806 - RNA, 13 nt, Human
ccauuucagagag

SEQ ID NO: 1357807 - RNA, 21 nt, Human
ccauuggcuauuuaaaacuug

SEQ ID NO: 1357808 - RNA, 20 nt, Human
ccauuggcuauuuaaaacuu

SEQ ID NO: 1357809 - RNA, 19 nt, Human
ccauuggcuauuuaaaacu

SEQ ID NO: 1357810 - RNA, 15 nt, Human
ccauuggaucucauu

SEQ ID NO: 1357811 - RNA, 13 nt, Human
cccacucugcucu

SEQ ID NO: 1357812 - RNA, 21 nt, Human
cccacucuccuaggcauucug

SEQ ID NO: 1357813 - RNA, 15 nt, Human
cccacucuccuaggc

SEQ ID NO: 1357814 - RNA, 14 nt, Human
cccacucuccuagg

SEQ ID NO: 1357815 - RNA, 12 nt, Human
cccacucuccua

SEQ ID NO: 1357816 - RNA, 23 nt, Human
cccacuccucugcugaccugcug

SEQ ID NO: 1357817 - RNA, 15 nt, Human
cccacugagaggaca

SEQ ID NO: 1357818 - RNA, 14 nt, Human
cccacugaccagaa

SEQ ID NO: 1357819 - RNA, 18 nt, Human
cccacucugcucugaugc

SEQ ID NO: 1357820 - RNA, 19 nt, Human
cccacucugcucugaugca

SEQ ID NO: 1357821 - RNA, 17 nt, Human
cccacucugcucugaug

SEQ ID NO: 1357822 - RNA, 16 nt, Human
cccacucugcucugau

SEQ ID NO: 1357823 - RNA, 15 nt, Human
cccacucugcucuga

SEQ ID NO: 1357824 - RNA, 14 nt, Human
cccacucugcucug

SEQ ID NO: 1357825 - RNA, 15 nt, Human
cccaccccugcacag

SEQ ID NO: 1357826 - RNA, 12 nt, Human
cccaccccugca

SEQ ID NO: 1357827 - RNA, 13 nt, Human
cccacccccaagg

SEQ ID NO: 1357828 - RNA, 17 nt, Human
cccaccccauucccgca

SEQ ID NO: 1357829 - RNA, 13 nt, Human
cccaccccauucc

SEQ ID NO: 1357830 - RNA, 15 nt, Human
cccaccccagggcag

SEQ ID NO: 1357831 - RNA, 18 nt, Human
cccaagagcaucaugccu

SEQ ID NO: 1357832 - RNA, 15 nt, Human
cccaacucuccccug

SEQ ID NO: 1357833 - RNA, 18 nt, Human
cccaacuccuuccagcua

SEQ ID NO: 1357834 - RNA, 16 nt, Human
cccaacuccuuccagc

SEQ ID NO: 1357835 - RNA, 15 nt, Human
cccaacuccuuccag

SEQ ID NO: 1357836 - RNA, 23 nt, Human
cccaacuacccccagcugugcuu

SEQ ID NO: 1357837 - RNA, 13 nt, Human
cccaacuccagaa

SEQ ID NO: 1357838 - RNA, 22 nt, Human
cccaccccaaccugcucuccuc

SEQ ID NO: 1357839 - RNA, 19 nt, Human
cccaccccaaccugcucuc

SEQ ID NO: 1357840 - RNA, 18 nt, Human
cccaccccaaccugcucu

SEQ ID NO: 1357841 - RNA, 21 nt, Human
cccacccaggccaggcaugug

SEQ ID NO: 1357842 - RNA, 17 nt, Human
cccacccaggccaggca

SEQ ID NO: 1357843 - RNA, 15 nt, Human
cccacccaggccagg

SEQ ID NO: 1357844 - RNA, 13 nt, Human
cccacccaggcca

SEQ ID NO: 1357845 - RNA, 23 nt, Human
cccacccagaugccccuuucugg

SEQ ID NO: 1357846 - RNA, 16 nt, Human
cccacccacuucugca

SEQ ID NO: 1357847 - RNA, 21 nt, Human
cccaagauugagcucucugcc

SEQ ID NO: 1357848 - RNA, 17 nt, Human
cccaagauugagcucuc

SEQ ID NO: 1357849 - RNA, 22 nt, Human
cccaagaugggcaucuuuugua

SEQ ID NO: 1357850 - RNA, 20 nt, Human
cccaagaugggcaucuuuug

SEQ ID NO: 1357851 - RNA, 22 nt, Human
cccaagagcaucaugccucuga

SEQ ID NO: 1357852 - RNA, 23 nt, Human
cccaagagcuacguauuuaauag

SEQ ID NO: 1357853 - RNA, 21 nt, Human
cccaagagcaucaugccucug

SEQ ID NO: 1357854 - RNA, 20 nt, Human
cccaagagcaucaugccucu

SEQ ID NO: 1357855 - RNA, 20 nt, Human
cccaagcaccugggauuaca

SEQ ID NO: 1357856 - RNA, 21 nt, Human
ccgcagcccccacccccaagg

SEQ ID NO: 1357857 - RNA, 15 nt, Human
ccgcagcccccaccc

SEQ ID NO: 1357858 - RNA, 23 nt, Human
ccgaagcuaacagggaaggcagg

SEQ ID NO: 1357859 - RNA, 21 nt, Human
ccgaagcuaacagggaaggca

SEQ ID NO: 1357860 - RNA, 18 nt, Human
ccgaagccgccuguggac

SEQ ID NO: 1357861 - RNA, 19 nt, Human
ccgaaggaaaagggcuuuc

SEQ ID NO: 1357862 - RNA, 21 nt, Human
cccuucuccccugcacuguaa

SEQ ID NO: 1357863 - RNA, 18 nt, Human
cccuucuccccugcacug

SEQ ID NO: 1357864 - RNA, 16 nt, Human
cccuucuccccugcac

SEQ ID NO: 1357865 - RNA, 15 nt, Human
cccuucuccccugca

SEQ ID NO: 1357866 - RNA, 14 nt, Human
cccuucuccccugc

SEQ ID NO: 1357867 - RNA, 20 nt, Human
cccuucucccacucuccuag

SEQ ID NO: 1357868 - RNA, 14 nt, Human
cccuucucccacuc

SEQ ID NO: 1357869 - RNA, 13 nt, Human
cccuccuucccaa

SEQ ID NO: 1357870 - RNA, 21 nt, Human
cccuccuucccaagugagucu

SEQ ID NO: 1357871 - RNA, 20 nt, Human
cccuccuguugggagagggc

SEQ ID NO: 1357872 - RNA, 20 nt, Human
cccuccugugcucagcccug

SEQ ID NO: 1357873 - RNA, 21 nt, Human
cccuccugugcucagcccuga

SEQ ID NO: 1357874 - RNA, 11 nt, Human
cccuccuuccu

SEQ ID NO: 1357875 - RNA, 14 nt, Human
cccuccuuccuaaa

SEQ ID NO: 1357876 - RNA, 13 nt, Human
cccuucuauaccc

SEQ ID NO: 1357877 - RNA, 18 nt, Human
cccuucuauacccaccca

SEQ ID NO: 1357878 - RNA, 19 nt, Human
cccuucuauacccacccag

SEQ ID NO: 1357879 - RNA, 20 nt, Human
cccuucuauacccacccaga

SEQ ID NO: 1357880 - RNA, 23 nt, Human
cccuucuauuuggggcuugauga

SEQ ID NO: 1357881 - RNA, 21 nt, Human
cccuucuauacccacccagaa

SEQ ID NO: 1357882 - RNA, 23 nt, Human
cccuucuccauccacaugggagc

SEQ ID NO: 1357883 - RNA, 21 nt, Human
cccuucuccauggcccugcca

SEQ ID NO: 1357884 - RNA, 15 nt, Human
ccggcacccccugca

SEQ ID NO: 1357885 - RNA, 14 nt, Human
ccggcacccccugc

SEQ ID NO: 1357886 - RNA, 20 nt, Human
ccggcacagggucugcucuu

SEQ ID NO: 1357887 - RNA, 19 nt, Human
ccggcacagggucugcucu

SEQ ID NO: 1357888 - RNA, 14 nt, Human
ccguaauuuaacuu

SEQ ID NO: 1357889 - RNA, 13 nt, Human
ccguaauuuaacu

SEQ ID NO: 1357890 - RNA, 12 nt, Human
ccguaauuuaac

SEQ ID NO: 1357891 - RNA, 15 nt, Human
ccguccugccugugg

SEQ ID NO: 1357892 - RNA, 13 nt, Human
ccguccugccugu

SEQ ID NO: 1357893 - RNA, 18 nt, Human
ccguccccuagaguccca

SEQ ID NO: 1357894 - RNA, 15 nt, Human
ccguccccuagaguc

SEQ ID NO: 1357895 - RNA, 24 nt, Human
ccguagacgugcacgcacacuguc

SEQ ID NO: 1357896 - RNA, 15 nt, Human
ccgguguucuaagau

SEQ ID NO: 1357897 - RNA, 11 nt, Human
ccggccagccc

SEQ ID NO: 1357898 - RNA, 23 nt, Human
ccggcagggcgggcagagggcug

SEQ ID NO: 1357899 - RNA, 21 nt, Human
ccggcagggcgggcagagggc

SEQ ID NO: 1357900 - RNA, 16 nt, Human
ccggcagggcgggcag

SEQ ID NO: 1357901 - RNA, 16 nt, Human
ccggcagcagccccca

SEQ ID NO: 1357902 - RNA, 20 nt, Human
ccggcacccccugcagcuug

SEQ ID NO: 1357903 - RNA, 21 nt, Human
ccggcacccccugcagcuugu

SEQ ID NO: 1357904 - RNA, 19 nt, Human
ccggcacccccugcagcuu

SEQ ID NO: 1357905 - RNA, 18 nt, Human
ccggcacccccugcagcu

SEQ ID NO: 1357906 - RNA, 17 nt, Human
ccggcacccccugcagc

SEQ ID NO: 1357907 - RNA, 16 nt, Human
ccggcacccccugcag

SEQ ID NO: 1357908 - RNA, 11 nt, Human
ccggcagggcg

SEQ ID NO: 1357909 - RNA, 20 nt, Human
ccggcagcuucugcccccug

SEQ ID NO: 1357910 - RNA, 19 nt, Human
ccggcagcuucugcccccu

SEQ ID NO: 1357911 - RNA, 18 nt, Human
ccggcagcuucugccccc

SEQ ID NO: 1357912 - RNA, 22 nt, Human
ccggcagcuucugcccccugca

SEQ ID NO: 1357913 - RNA, 13 nt, Human
ccuaauguguuua

SEQ ID NO: 1357914 - RNA, 13 nt, Human
ccuagcccucuca

SEQ ID NO: 1357915 - RNA, 16 nt, Human
ccuaauucaauucaaa

SEQ ID NO: 1357916 - RNA, 20 nt, Human
ccuaauucaauucaaagcug

SEQ ID NO: 1357917 - RNA, 22 nt, Human
ccgugagccaaucccucaccuu

SEQ ID NO: 1357918 - RNA, 15 nt, Human
ccgugagcauguuug

SEQ ID NO: 1357919 - RNA, 16 nt, Human
ccgugacgucugggug

SEQ ID NO: 1357920 - RNA, 14 nt, Human
ccgugacgucuggg

SEQ ID NO: 1357921 - RNA, 19 nt, Human
ccgugaaugggugcccaca

SEQ ID NO: 1357922 - RNA, 16 nt, Human
ccgucuuuuccuguuu

SEQ ID NO: 1357923 - RNA, 19 nt, Human
ccgucuuucuuuuauacug

SEQ ID NO: 1357924 - RNA, 14 nt, Human
ccguccugccugug

SEQ ID NO: 1357925 - RNA, 12 nt, Human
ccuaauaaagcu

SEQ ID NO: 1357926 - RNA, 13 nt, Human
ccuaauaaagcug

SEQ ID NO: 1357927 - RNA, 17 nt, Human
ccucgcuggacucucag

SEQ ID NO: 1357928 - RNA, 15 nt, Human
ccucgccccuggcag

SEQ ID NO: 1357929 - RNA, 16 nt, Human
ccucgccccuggcaga

SEQ ID NO: 1357930 - RNA, 21 nt, Human
ccucgcccagcggcaucaggc

SEQ ID NO: 1357931 - RNA, 20 nt, Human
ccucgcccagcggcaucagg

SEQ ID NO: 1357932 - RNA, 18 nt, Human
ccucgcuggacucucagu

SEQ ID NO: 1357933 - RNA, 23 nt, Human
ccucgcaacccgugccaagucca

SEQ ID NO: 1357934 - RNA, 20 nt, Human
ccucgaaacacagaaaccuu

SEQ ID NO: 1357935 - RNA, 16 nt, Human
ccucgaaacacagaaa

SEQ ID NO: 1357936 - RNA, 21 nt, Human
ccuccuuuuuccaugcccuaa

SEQ ID NO: 1357937 - RNA, 13 nt, Human
ccuccuuuuucca

SEQ ID NO: 1357938 - RNA, 16 nt, Human
ccuccucacccccagc

SEQ ID NO: 1357939 - RNA, 14 nt, Human
ccuccucaccccca

SEQ ID NO: 1357940 - RNA, 13 nt, Human
ccuccucaccccc

SEQ ID NO: 1357941 - RNA, 21 nt, Human
ccucccaggguuuuaacuuug

SEQ ID NO: 1357942 - RNA, 19 nt, Human
ccucccaggguuuuaacuu

SEQ ID NO: 1357943 - RNA, 18 nt, Human
ccucccaggguuuuaacu

SEQ ID NO: 1357944 - RNA, 13 nt, Human
ccucccaggguuu

SEQ ID NO: 1357945 - RNA, 12 nt, Human
ccucccaggguu

SEQ ID NO: 1357946 - RNA, 21 nt, Human
ccucauuuuuauaaugucccu

SEQ ID NO: 1357947 - RNA, 15 nt, Human
ccucccauccagggc

SEQ ID NO: 1357948 - RNA, 23 nt, Human
ccucauuauuuauguccaggugu

SEQ ID NO: 1357949 - RNA, 13 nt, Human
ccucaagucuuuc

SEQ ID NO: 1357950 - RNA, 23 nt, Human
ccucaagguuuuagguucuaaag

SEQ ID NO: 1357951 - RNA, 22 nt, Human
ccucaagguuuuagguucuaaa

SEQ ID NO: 1357952 - RNA, 20 nt, Human
ccucaagguuuuagguucua

SEQ ID NO: 1357953 - RNA, 12 nt, Human
ccucaaccuccc

SEQ ID NO: 1357954 - RNA, 16 nt, Human
ccucaagaaauaaaag

SEQ ID NO: 1357955 - RNA, 15 nt, Human
ccucaacugccuacu

SEQ ID NO: 1357956 - RNA, 14 nt, Human
ccucaacugccuac

SEQ ID NO: 1357957 - RNA, 14 nt, Human
ccucaaccucccaa

SEQ ID NO: 1357958 - RNA, 19 nt, Human
ccucaagucuuucucuuuc

SEQ ID NO: 1357959 - RNA, 22 nt, Human
ccucagccuugccagagaucca

SEQ ID NO: 1357960 - RNA, 21 nt, Human
ccucaagucuuucucuuuccc

SEQ ID NO: 1357961 - RNA, 15 nt, Human
ccucaagucuuucuc

SEQ ID NO: 1357962 - RNA, 14 nt, Human
ccucaagucuuucu

SEQ ID NO: 1357963 - RNA, 15 nt, Human
ccucagcucccacaa

SEQ ID NO: 1357964 - RNA, 20 nt, Human
ccucagcucccacaagccuc

SEQ ID NO: 1357965 - RNA, 14 nt, Human
ccucagcucccaca

SEQ ID NO: 1357966 - RNA, 17 nt, Human
ccucagcucucaguugc

SEQ ID NO: 1357967 - RNA, 15 nt, Human
ccucaaaucguccag

SEQ ID NO: 1357968 - RNA, 21 nt, Human
ccucaaauaaaaagugcuuuu

SEQ ID NO: 1357969 - RNA, 22 nt, Human
ccucaaauaaaaagugcuuuug

SEQ ID NO: 1357970 - RNA, 18 nt, Human
ccucaaauaaaaagugcu

SEQ ID NO: 1357971 - RNA, 17 nt, Human
ccucaaauuacuuugug

SEQ ID NO: 1357972 - RNA, 14 nt, Human
ccucaaccccuccc

SEQ ID NO: 1357973 - RNA, 23 nt, Human
ccucaaccccuccccuccauccc

SEQ ID NO: 1357974 - RNA, 13 nt, Human
ccucaaccucauc

SEQ ID NO: 1357975 - RNA, 14 nt, Human
ccucaaccucaucc

SEQ ID NO: 1357976 - RNA, 19 nt, Human
ccugucucucagggccagg

SEQ ID NO: 1357977 - RNA, 19 nt, Human
ccuguaaacuuuaucacuu

SEQ ID NO: 1357978 - RNA, 16 nt, Human
ccuguaacaagccaga

SEQ ID NO: 1357979 - RNA, 20 nt, Human
ccuguaaacuuuaucacuua

SEQ ID NO: 1357980 - RNA, 12 nt, Human
ccuguaaacuuu

SEQ ID NO: 1357981 - RNA, 13 nt, Human
ccuguaaaccuga

SEQ ID NO: 1357982 - RNA, 12 nt, Human
ccuguaaaccug

SEQ ID NO: 1357983 - RNA, 21 nt, Human
ccuguaaccucuucagaggcc

SEQ ID NO: 1357984 - RNA, 16 nt, Human
ccuguaaccucuucag

SEQ ID NO: 1357985 - RNA, 23 nt, Human
ccuguaacauacuggccuggacu

SEQ ID NO: 1357986 - RNA, 19 nt, Human
ccuguaacauacuggccug

SEQ ID NO: 1357987 - RNA, 10 nt, Human
ccuguaacuu

SEQ ID NO: 1357988 - RNA, 21 nt, Human
ccugucucccuccucugcccg

SEQ ID NO: 1357989 - RNA, 21 nt, Human
ccugguggggcagcuccucug

SEQ ID NO: 1357990 - RNA, 23 nt, Human
ccugguggggcagcuccucuguc

SEQ ID NO: 1357991 - RNA, 19 nt, Human
ccugguggggcagcuccuc

SEQ ID NO: 1357992 - RNA, 18 nt, Human
ccugguggggcagcuccu

SEQ ID NO: 1357993 - RNA, 21 nt, Human
ccuggugguauuuucaauagc

SEQ ID NO: 1357994 - RNA, 19 nt, Human
ccuggugguauuuucaaua

SEQ ID NO: 1357995 - RNA, 18 nt, Human
ccuggugguauuuucaau

SEQ ID NO: 1357996 - RNA, 16 nt, Human
ccuggugguauuuuca

SEQ ID NO: 1357997 - RNA, 18 nt, Human
ccuggugguggcucggga

SEQ ID NO: 1357998 - RNA, 16 nt, Human
ccugguggggcagcuc

SEQ ID NO: 1357999 - RNA, 15 nt, Human
ccugguggggcagcu

SEQ ID NO: 1358000 - RNA, 14 nt, Human
ccugguggggcagc

SEQ ID NO: 1358001 - RNA, 19 nt, Human
ccuggggcuggccucccaa

SEQ ID NO: 1358002 - RNA, 17 nt, Human
ccuggggcuggccuccc

SEQ ID NO: 1358003 - RNA, 16 nt, Human
ccuggggcuggccucc

SEQ ID NO: 1358004 - RNA, 15 nt, Human
ccuggggcuggccuc

SEQ ID NO: 1358005 - RNA, 22 nt, Human
ccuggggcucuaacgccugagc

SEQ ID NO: 1358006 - RNA, 23 nt, Human
ccuggggcucuaacgccugagcc

SEQ ID NO: 1358007 - RNA, 21 nt, Human
ccuggggcucuaacgccugag

SEQ ID NO: 1358008 - RNA, 20 nt, Human
ccuggggcucuaacgccuga

SEQ ID NO: 1358009 - RNA, 22 nt, Human
ccugguucccguuucuccaccu

SEQ ID NO: 1358010 - RNA, 13 nt, Human
ccugguucccguu

SEQ ID NO: 1358011 - RNA, 20 nt, Human
ccugguuaaauaaggcaggg

SEQ ID NO: 1358012 - RNA, 21 nt, Human
ccuggugguggcucgggaggc

SEQ ID NO: 1358013 - RNA, 15 nt, Human
ccugggcuccuggac

SEQ ID NO: 1358014 - RNA, 16 nt, Human
ccugggcuccuggacc

SEQ ID NO: 1358015 - RNA, 14 nt, Human
ccugggcuccugga

SEQ ID NO: 1358016 - RNA, 16 nt, Human
ccugggcgcugguccu

SEQ ID NO: 1358017 - RNA, 18 nt, Human
ccugggccuugggcuccg

SEQ ID NO: 1358018 - RNA, 18 nt, Human
ccuggccuucaguguacc

SEQ ID NO: 1358019 - RNA, 11 nt, Human
ccuggccuuca

SEQ ID NO: 1358020 - RNA, 15 nt, Human
ccugggcgcuggucc

SEQ ID NO: 1358021 - RNA, 13 nt, Human
ccugggcugggaa

SEQ ID NO: 1358022 - RNA, 14 nt, Human
ccugggcugggaaa

SEQ ID NO: 1358023 - RNA, 20 nt, Human
ccugggcuggaaucaggaau

SEQ ID NO: 1358024 - RNA, 14 nt, Human
ccugggcuggaauc

SEQ ID NO: 1358025 - RNA, 12 nt, Human
ccuggggcucua

SEQ ID NO: 1358026 - RNA, 15 nt, Human
ccuggccuccugccu

SEQ ID NO: 1358027 - RNA, 14 nt, Human
ccuggccuccugcc

SEQ ID NO: 1358028 - RNA, 13 nt, Human
ccuggccuccugc

SEQ ID NO: 1358029 - RNA, 20 nt, Human
ccuggccuccccugccacca

SEQ ID NO: 1358030 - RNA, 19 nt, Human
ccuggccuccccugccacc

SEQ ID NO: 1358031 - RNA, 18 nt, Human
ccuggccuccccugccac

SEQ ID NO: 1358032 - RNA, 17 nt, Human
ccuggccuccccugcca

SEQ ID NO: 1358033 - RNA, 15 nt, Human
ccuggccuccccugc

SEQ ID NO: 1358034 - RNA, 18 nt, Human
ccuggccucccccacuuu

SEQ ID NO: 1358035 - RNA, 17 nt, Human
ccuggccucccccacuu

SEQ ID NO: 1358036 - RNA, 14 nt, Human
ccuggccuccccca

SEQ ID NO: 1358037 - RNA, 12 nt, Human
ccuggccccucu

SEQ ID NO: 1358038 - RNA, 18 nt, Human
ccuggauggggcaggcca

SEQ ID NO: 1358039 - RNA, 18 nt, Human
ccugagggucuguagguu

SEQ ID NO: 1358040 - RNA, 13 nt, Human
ccugagggucugu

SEQ ID NO: 1358041 - RNA, 12 nt, Human
ccugagggucug

SEQ ID NO: 1358042 - RNA, 21 nt, Human
ccugagggaaaggccagcacu

SEQ ID NO: 1358043 - RNA, 22 nt, Human
ccugagggaaaggccagcacuc

SEQ ID NO: 1358044 - RNA, 20 nt, Human
ccugagggaaaggccagcac

SEQ ID NO: 1358045 - RNA, 19 nt, Human
ccugagggaaaggccagca

SEQ ID NO: 1358046 - RNA, 18 nt, Human
ccugagggaaaggccagc

SEQ ID NO: 1358047 - RNA, 13 nt, Human
ccugagggaaagg

SEQ ID NO: 1358048 - RNA, 22 nt, Human
ccugaggcuuuggauuugacau

SEQ ID NO: 1358049 - RNA, 20 nt, Human
ccugaggcuuuggauuugac

SEQ ID NO: 1358050 - RNA, 22 nt, Human
ccugaggucaggaguucaagac

SEQ ID NO: 1358051 - RNA, 19 nt, Human
ccugagggucuguagguug

SEQ ID NO: 1358052 - RNA, 17 nt, Human
ccugaggcuguggucac

SEQ ID NO: 1358053 - RNA, 16 nt, Human
ccugaggcugugguca

SEQ ID NO: 1358054 - RNA, 23 nt, Human
ccugagauuuauuaaagaaaaaa

SEQ ID NO: 1358055 - RNA, 22 nt, Human
ccugagauuuauuaaagaaaaa

SEQ ID NO: 1358056 - RNA, 21 nt, Human
ccugagauuuauuaaagaaaa

SEQ ID NO: 1358057 - RNA, 19 nt, Human
ccugagauuuauuaaagaa

SEQ ID NO: 1358058 - RNA, 15 nt, Human
ccugagauuuauuaa

SEQ ID NO: 1358059 - RNA, 14 nt, Human
ccugagauuuauua

SEQ ID NO: 1358060 - RNA, 18 nt, Human
ccugagaugggcuuccca

SEQ ID NO: 1358061 - RNA, 17 nt, Human
ccugagauucagauguc

SEQ ID NO: 1358062 - RNA, 21 nt, Human
ccugagaugggcuucccaagg

SEQ ID NO: 1358063 - RNA, 22 nt, Human
ccugacccucaucuuucuucca

SEQ ID NO: 1358064 - RNA, 19 nt, Human
ccugacccucaucuuucuu

SEQ ID NO: 1358065 - RNA, 15 nt, Human
ccugaccccugcuca

SEQ ID NO: 1358066 - RNA, 14 nt, Human
ccugaccccugcuc

SEQ ID NO: 1358067 - RNA, 16 nt, Human
ccugaccccugcucag

SEQ ID NO: 1358068 - RNA, 18 nt, Human
ccugacccucaucuuucu

SEQ ID NO: 1358069 - RNA, 20 nt, Human
ccugaguugcuuuucagcug

SEQ ID NO: 1358070 - RNA, 23 nt, Human
ccugcaggaucucaccaggcagc

SEQ ID NO: 1358071 - RNA, 22 nt, Human
ccugcaggaucucaccaggcag

SEQ ID NO: 1358072 - RNA, 22 nt, Human
ccucggccucccaaagugcugg

SEQ ID NO: 1358073 - RNA, 17 nt, Human
ccucuuucuucccauga

SEQ ID NO: 1358074 - RNA, 23 nt, Human
ccugaccccaaguuauccaccug

SEQ ID NO: 1358075 - RNA, 22 nt, Human
ccugccauuguagcgucuuucu

SEQ ID NO: 1358076 - RNA, 16 nt, Human
ccugccucagccuccc

SEQ ID NO: 1358077 - RNA, 14 nt, Human
ccugccucucccag

SEQ ID NO: 1358078 - RNA, 23 nt, Human
ccugccucucaucaacugaauga

SEQ ID NO: 1358079 - RNA, 12 nt, Human
ccugccucagga

SEQ ID NO: 1358080 - RNA, 21 nt, Human
ccugccucucccaggcagggg

SEQ ID NO: 1358081 - RNA, 18 nt, Human
ccugccucucccaggcag

SEQ ID NO: 1358082 - RNA, 15 nt, Human
ccugccucucccagg

SEQ ID NO: 1358083 - RNA, 13 nt, Human
ccugccucucugc

SEQ ID NO: 1358084 - RNA, 14 nt, Human
ccugccucucugca

SEQ ID NO: 1358085 - RNA, 15 nt, Human
ccugccucucugcag

SEQ ID NO: 1358086 - RNA, 22 nt, Human
cucaaagguuuggaaggagcag

SEQ ID NO: 1358087 - RNA, 23 nt, Human
cucaaagguuuggaaggagcaga

SEQ ID NO: 1358088 - RNA, 19 nt, Human
cucaaagguuuggaaggag

SEQ ID NO: 1358089 - RNA, 18 nt, Human
cucaaagguuuggaagga

SEQ ID NO: 1358090 - RNA, 17 nt, Human
cucaaagguuuggaagg

SEQ ID NO: 1358091 - RNA, 20 nt, Human
cucaaagcaugggauuauua

SEQ ID NO: 1358092 - RNA, 19 nt, Human
cucaaagcaagcauucaga

SEQ ID NO: 1358093 - RNA, 18 nt, Human
cucaaagagggagugcau

SEQ ID NO: 1358094 - RNA, 17 nt, Human
cucaaagaaaguguauu

SEQ ID NO: 1358095 - RNA, 16 nt, Human
cucaaagaaaguguau

SEQ ID NO: 1358096 - RNA, 13 nt, Human
cucaaagaaagug

SEQ ID NO: 1358097 - RNA, 22 nt, Human
cucaaacugaggaauuucaccu

SEQ ID NO: 1358098 - RNA, 19 nt, Human
cucaaacugaggaauuuca

SEQ ID NO: 1358099 - RNA, 14 nt, Human
cucaaaacaaaggc

SEQ ID NO: 1358100 - RNA, 22 nt, Human
cuauuuuuggcagucugaauuu

SEQ ID NO: 1358101 - RNA, 20 nt, Human
cuauuuuucuaacuacaaag

SEQ ID NO: 1358102 - RNA, 15 nt, Human
cuauuuuucuaacua

SEQ ID NO: 1358103 - RNA, 12 nt, Human
cuauuuuucuaa

SEQ ID NO: 1358104 - RNA, 13 nt, Human
cucaaaacaaagg

SEQ ID NO: 1358105 - RNA, 21 nt, Human
cuauuuuuggcagucugaauu

SEQ ID NO: 1358106 - RNA, 18 nt, Human
cuauuuuuggcagucuga

SEQ ID NO: 1358107 - RNA, 20 nt, Human
cuauuuuuggagguuuauua

SEQ ID NO: 1358108 - RNA, 13 nt, Human
cuauuuuuggagg

SEQ ID NO: 1358109 - RNA, 14 nt, Human
cuauuuuuaucuga

SEQ ID NO: 1358110 - RNA, 14 nt, Human
cuauuuuucagaau

SEQ ID NO: 1358111 - RNA, 17 nt, Human
cuauuuugugaagccau

SEQ ID NO: 1358112 - RNA, 18 nt, Human
cuaugucauuucauuucc

SEQ ID NO: 1358113 - RNA, 16 nt, Human
cuaugucauuucauuu

SEQ ID NO: 1358114 - RNA, 17 nt, Human
cuaucucugugugcaca

SEQ ID NO: 1358115 - RNA, 18 nt, Human
cuaucucccugccuccug

SEQ ID NO: 1358116 - RNA, 17 nt, Human
cuaucucccugccuccu

SEQ ID NO: 1358117 - RNA, 15 nt, Human
cuaucucccugccuc

SEQ ID NO: 1358118 - RNA, 16 nt, Human
cuaucugggaagcuau

SEQ ID NO: 1358119 - RNA, 21 nt, Human
cuaucucugugugcacaaaua

SEQ ID NO: 1358120 - RNA, 13 nt, Human
cucacacaggcau

SEQ ID NO: 1358121 - RNA, 12 nt, Human
cucacacaggca

SEQ ID NO: 1358122 - RNA, 22 nt, Human
cucacacaggcauuuccugggu

SEQ ID NO: 1358123 - RNA, 21 nt, Human
cucacacaggcauuuccuggg

SEQ ID NO: 1358124 - RNA, 23 nt, Human
cucacacaggcauuuccugggug

SEQ ID NO: 1358125 - RNA, 23 nt, Human
cucacacacccugucugccccgc

SEQ ID NO: 1358126 - RNA, 20 nt, Human
cucacaaguggguaccccca

SEQ ID NO: 1358127 - RNA, 21 nt, Human
cucacaaguggguacccccag

SEQ ID NO: 1358128 - RNA, 19 nt, Human
cucacaaguggguaccccc

SEQ ID NO: 1358129 - RNA, 21 nt, Human
cucacaaggcagcaaggcccg

SEQ ID NO: 1358130 - RNA, 20 nt, Human
cucacaaggcagcaaggccc

SEQ ID NO: 1358131 - RNA, 19 nt, Human
cucacaaggcagcaaggcc

SEQ ID NO: 1358132 - RNA, 17 nt, Human
cucacaaggcagcaagg

SEQ ID NO: 1358133 - RNA, 16 nt, Human
cucacaaggcagcaag

SEQ ID NO: 1358134 - RNA, 15 nt, Human
cucacaaggcagcaa

SEQ ID NO: 1358135 - RNA, 14 nt, Human
cucacaaggcagca

SEQ ID NO: 1358136 - RNA, 13 nt, Human
cucacaaggcagc

SEQ ID NO: 1358137 - RNA, 19 nt, Human
cucaaauaaaaagugcuuu

SEQ ID NO: 1358138 - RNA, 21 nt, Human
cucaaauaaaaagugcuuuug

SEQ ID NO: 1358139 - RNA, 17 nt, Human
cucacaacagcugccug

SEQ ID NO: 1358140 - RNA, 21 nt, Human
cucacccgccccacucccucc

SEQ ID NO: 1358141 - RNA, 15 nt, Human
cucacccugccuuau

SEQ ID NO: 1358142 - RNA, 14 nt, Human
cucacccugccuua

SEQ ID NO: 1358143 - RNA, 13 nt, Human
cucacccugccuu

SEQ ID NO: 1358144 - RNA, 15 nt, Human
cucacccuggaggca

SEQ ID NO: 1358145 - RNA, 21 nt, Human
cucacccugccuuaucuugca

SEQ ID NO: 1358146 - RNA, 12 nt, Human
cucaccuggacu

SEQ ID NO: 1358147 - RNA, 20 nt, Human
cucaccugcacuaacagagu

SEQ ID NO: 1358148 - RNA, 17 nt, Human
cucaccugcacuaacag

SEQ ID NO: 1358149 - RNA, 23 nt, Human
cucaccucuagguccccauacuc

SEQ ID NO: 1358150 - RNA, 22 nt, Human
cucaccucuagguccccauacu

SEQ ID NO: 1358151 - RNA, 19 nt, Human
cucaccugagucacccuac

SEQ ID NO: 1358152 - RNA, 21 nt, Human
cucaccggcucucaccuggcc

SEQ ID NO: 1358153 - RNA, 13 nt, Human
cucaccggcucuc

SEQ ID NO: 1358154 - RNA, 17 nt, Human
cucaccuuggcaccaga

SEQ ID NO: 1358155 - RNA, 16 nt, Human
cucaccuuggcaccag

SEQ ID NO: 1358156 - RNA, 21 nt, Human
cucaccuucugaguacagagu

SEQ ID NO: 1358157 - RNA, 14 nt, Human
cucaccuucugagu

SEQ ID NO: 1358158 - RNA, 17 nt, Human
cucaccuggcccugcuu

SEQ ID NO: 1358159 - RNA, 13 nt, Human
cucaccuggacuu

SEQ ID NO: 1358160 - RNA, 20 nt, Human
cucacuucugggcuucaucu

SEQ ID NO: 1358161 - RNA, 12 nt, Human
cucacuucaggu

SEQ ID NO: 1358162 - RNA, 19 nt, Human
cucaccuuggcaccagaca

SEQ ID NO: 1358163 - RNA, 21 nt, Human
cucacuuuucccacuccaagc

SEQ ID NO: 1358164 - RNA, 17 nt, Human
cucacuuuucccacucc

SEQ ID NO: 1358165 - RNA, 16 nt, Human
cucacuuuucccacuc

SEQ ID NO: 1358166 - RNA, 15 nt, Human
cucacuuuucccacu

SEQ ID NO: 1358167 - RNA, 14 nt, Human
cucacuuuucccac

SEQ ID NO: 1358168 - RNA, 12 nt, Human
cucacuuuuccc

SEQ ID NO: 1358169 - RNA, 22 nt, Human
cucacuuuuaaugaacaaaugg

SEQ ID NO: 1358170 - RNA, 21 nt, Human
cucacuuuuaaugaacaaaug

SEQ ID NO: 1358171 - RNA, 20 nt, Human
cucacuuuccuccugaggcu

SEQ ID NO: 1358172 - RNA, 18 nt, Human
cucacuuguuuuauuuaa

SEQ ID NO: 1358173 - RNA, 22 nt, Human
cucagaagugcaucuggagaga

SEQ ID NO: 1358174 - RNA, 19 nt, Human
cucagaaguuucuucuuua

SEQ ID NO: 1358175 - RNA, 16 nt, Human
cucagaaguuucuucu

SEQ ID NO: 1358176 - RNA, 21 nt, Human
cucagaagugcaucuggagag

SEQ ID NO: 1358177 - RNA, 13 nt, Human
cucagaaguaaag

SEQ ID NO: 1358178 - RNA, 12 nt, Human
cucagaaguaaa

SEQ ID NO: 1358179 - RNA, 11 nt, Human
cucagaaguaa

SEQ ID NO: 1358180 - RNA, 18 nt, Human
cucagaaagugccugaca

SEQ ID NO: 1358181 - RNA, 17 nt, Human
cucagaaagugccugac

SEQ ID NO: 1358182 - RNA, 16 nt, Human
cucagaaagugccuga

SEQ ID NO: 1358183 - RNA, 15 nt, Human
cucagaaagugccug

SEQ ID NO: 1358184 - RNA, 10 nt, Human
cucagaaagu

SEQ ID NO: 1358185 - RNA, 20 nt, Human
cucagaaaauaucccuccug

SEQ ID NO: 1358186 - RNA, 18 nt, Human
cucacuuuucccacucca

SEQ ID NO: 1358187 - RNA, 23 nt, Human
cucagaaaacaaggaugaauuaa

SEQ ID NO: 1358188 - RNA, 19 nt, Human
cucagaaaacaaggaugaa

SEQ ID NO: 1358189 - RNA, 23 nt, Human
cuagggggagccccuucugcuca

SEQ ID NO: 1358190 - RNA, 23 nt, Human
cuagggaggcauggucugcccuc

SEQ ID NO: 1358191 - RNA, 22 nt, Human
cuagggaggcauggucugcccu

SEQ ID NO: 1358192 - RNA, 17 nt, Human
cuagggagccauuugag

SEQ ID NO: 1358193 - RNA, 18 nt, Human
cuagggagccauuugaga

SEQ ID NO: 1358194 - RNA, 14 nt, Human
cuagggagccaugu

SEQ ID NO: 1358195 - RNA, 21 nt, Human
cuaggcugacaccuaacucuu

SEQ ID NO: 1358196 - RNA, 13 nt, Human
cuaggcuccaccc

SEQ ID NO: 1358197 - RNA, 15 nt, Human
cuaggcuaggguggg

SEQ ID NO: 1358198 - RNA, 23 nt, Human
cuaggcugcauugaaaagagcug

SEQ ID NO: 1358199 - RNA, 22 nt, Human
cuaggcucugucuggaagaugg

SEQ ID NO: 1358200 - RNA, 15 nt, Human
cuaggcucugucugg

SEQ ID NO: 1358201 - RNA, 21 nt, Human
cuaggguacauggugcuggga

SEQ ID NO: 1358202 - RNA, 17 nt, Human
cuaggguacauggugcu

SEQ ID NO: 1358203 - RNA, 15 nt, Human
cuaguucuagaaaaa

SEQ ID NO: 1358204 - RNA, 14 nt, Human
cuaguucuagaaaa

SEQ ID NO: 1358205 - RNA, 13 nt, Human
cuaguucugccag

SEQ ID NO: 1358206 - RNA, 15 nt, Human
cuaggguggggagag

SEQ ID NO: 1358207 - RNA, 23 nt, Human
cuaguucuagaaaaacaggcacu

SEQ ID NO: 1358208 - RNA, 16 nt, Human
cuaguucuagaaaaac

SEQ ID NO: 1358209 - RNA, 14 nt, Human
cuaguucuguagaa

SEQ ID NO: 1358210 - RNA, 16 nt, Human
cuaguucugccaggag

SEQ ID NO: 1358211 - RNA, 15 nt, Human
cuaguucugccagga

SEQ ID NO: 1358212 - RNA, 14 nt, Human
cuaguucugccagg

SEQ ID NO: 1358213 - RNA, 17 nt, Human
cuaguuugauuaaauuc

SEQ ID NO: 1358214 - RNA, 19 nt, Human
cuaguuugauuaaauucuu

SEQ ID NO: 1358215 - RNA, 15 nt, Human
cuauaaagcauuuaa

SEQ ID NO: 1358216 - RNA, 14 nt, Human
cuauaaagcauuua

SEQ ID NO: 1358217 - RNA, 13 nt, Human
cuauaaagcauuu

SEQ ID NO: 1358218 - RNA, 11 nt, Human
cuauaaagcau

SEQ ID NO: 1358219 - RNA, 19 nt, Human
cuauaaagcaguauuuuuc

SEQ ID NO: 1358220 - RNA, 18 nt, Human
cuauaaagcaguauuuuu

SEQ ID NO: 1358221 - RNA, 16 nt, Human
cuauaaagcaguauuu

SEQ ID NO: 1358222 - RNA, 14 nt, Human
cuauaaagcaguau

SEQ ID NO: 1358223 - RNA, 11 nt, Human
cuaguuuuuua

SEQ ID NO: 1358224 - RNA, 20 nt, Human
cuaguuuucuccucccagga

SEQ ID NO: 1358225 - RNA, 20 nt, Human
cuaguuugauuaaauucuug

SEQ ID NO: 1358226 - RNA, 21 nt, Human
cuaguuugauuaaauucuugc

SEQ ID NO: 1358227 - RNA, 15 nt, Human
cuaguucuguagaaa

SEQ ID NO: 1358228 - RNA, 16 nt, Human
cuaggccugggcagug

SEQ ID NO: 1358229 - RNA, 21 nt, Human
cuaggccuugcggcuccucag

SEQ ID NO: 1358230 - RNA, 15 nt, Human
cuaggccugggcagu

SEQ ID NO: 1358231 - RNA, 15 nt, Human
cuaggccuaguccug

SEQ ID NO: 1358232 - RNA, 23 nt, Human
cuaggcccccacuugccucuucc

SEQ ID NO: 1358233 - RNA, 22 nt, Human
cuaggcccccacuugccucuuc

SEQ ID NO: 1358234 - RNA, 20 nt, Human
cuaggcccccacuugccucu

SEQ ID NO: 1358235 - RNA, 19 nt, Human
cuaggcccccacuugccuc

SEQ ID NO: 1358236 - RNA, 18 nt, Human
cuagcccaaugaaaugaa

SEQ ID NO: 1358237 - RNA, 21 nt, Human
cuagccauacgcucagcucau

SEQ ID NO: 1358238 - RNA, 23 nt, Human
cuagaccagcagacagagccagg

SEQ ID NO: 1358239 - RNA, 22 nt, Human
cuagaccagcagacagagccag

SEQ ID NO: 1358240 - RNA, 21 nt, Human
cuagaauugaguguuuaaagu

SEQ ID NO: 1358241 - RNA, 19 nt, Human
cuagaauugaguguuuaaa

SEQ ID NO: 1358242 - RNA, 16 nt, Human
cuagaauugaguguuu

SEQ ID NO: 1358243 - RNA, 19 nt, Human
cuagaaucugcaauucaaa

SEQ ID NO: 1358244 - RNA, 21 nt, Human
cuagacauggagguucuaagg

SEQ ID NO: 1358245 - RNA, 20 nt, Human
cuagacauggagguucuaag

SEQ ID NO: 1358246 - RNA, 19 nt, Human
cuagacauggagguucuaa

SEQ ID NO: 1358247 - RNA, 18 nt, Human
cuagacauggagguucua

SEQ ID NO: 1358248 - RNA, 17 nt, Human
cuagacauggagguucu

SEQ ID NO: 1358249 - RNA, 21 nt, Human
cuagacaccaaaguucuaaua

SEQ ID NO: 1358250 - RNA, 13 nt, Human
cuagacacugcca

SEQ ID NO: 1358251 - RNA, 19 nt, Human
cuagacaccaaaguucuaa

SEQ ID NO: 1358252 - RNA, 18 nt, Human
cuagacaccaaaguucua

SEQ ID NO: 1358253 - RNA, 17 nt, Human
cuagacaccaaaguucu

SEQ ID NO: 1358254 - RNA, 16 nt, Human
cuagacaccaaaguuc

SEQ ID NO: 1358255 - RNA, 15 nt, Human
cuagacaccaaaguu

SEQ ID NO: 1358256 - RNA, 23 nt, Human
cuagacacaugaagguaaauaaa

SEQ ID NO: 1358257 - RNA, 22 nt, Human
cuagacacaugaagguaaauaa

SEQ ID NO: 1358258 - RNA, 14 nt, Human
cuagacacaugaag

SEQ ID NO: 1358259 - RNA, 12 nt, Human
cuagaccaauaa

SEQ ID NO: 1358260 - RNA, 11 nt, Human
cuagaccaaua

SEQ ID NO: 1358261 - RNA, 22 nt, Human
cuagacauggagguucuaaggc

SEQ ID NO: 1358262 - RNA, 23 nt, Human
cuagacauggagguucuaaggcc

SEQ ID NO: 1358263 - RNA, 21 nt, Human
cuagaccagcagacagagcca

SEQ ID NO: 1358264 - RNA, 20 nt, Human
cuagaccagcagacagagcc

SEQ ID NO: 1358265 - RNA, 18 nt, Human
cuagaccagcagacagag

SEQ ID NO: 1358266 - RNA, 17 nt, Human
cuagaccagcagacaga

SEQ ID NO: 1358267 - RNA, 16 nt, Human
cuagcauacguacaca

SEQ ID NO: 1358268 - RNA, 18 nt, Human
cuagcauacguacacauu

SEQ ID NO: 1358269 - RNA, 19 nt, Human
cuagcauacguacacauuu

SEQ ID NO: 1358270 - RNA, 20 nt, Human
cuagcauacguacacauuuu

SEQ ID NO: 1358271 - RNA, 21 nt, Human
cuaccuugguucccccacuga

SEQ ID NO: 1358272 - RNA, 19 nt, Human
cuaccuugaaaauaagaau

SEQ ID NO: 1358273 - RNA, 14 nt, Human
cuaccuugaaaaua

SEQ ID NO: 1358274 - RNA, 20 nt, Human
cuaccuucuccccagcuccc

SEQ ID NO: 1358275 - RNA, 21 nt, Human
cuaccuucuccccagcuccca

SEQ ID NO: 1358276 - RNA, 16 nt, Human
cuaccuucuccccagc

SEQ ID NO: 1358277 - RNA, 13 nt, Human
cuaccuucucccc

SEQ ID NO: 1358278 - RNA, 22 nt, Human
cuacuagagucugaacagcugu

SEQ ID NO: 1358279 - RNA, 17 nt, Human
cuacuaccuguaaugac

SEQ ID NO: 1358280 - RNA, 17 nt, Human
cuacuaauuccacaccu

SEQ ID NO: 1358281 - RNA, 15 nt, Human
cuacuaauuccacac

SEQ ID NO: 1358282 - RNA, 12 nt, Human
cuacuaauucca

SEQ ID NO: 1358283 - RNA, 18 nt, Human
cuacuaauagaauaaagg

SEQ ID NO: 1358284 - RNA, 17 nt, Human
cuacuaauagaauaaag

SEQ ID NO: 1358285 - RNA, 23 nt, Human
cuacuaacaaucagcuccuuccu

SEQ ID NO: 1358286 - RNA, 22 nt, Human
cuacucacacaggcauuuccug

SEQ ID NO: 1358287 - RNA, 23 nt, Human
cuacucacacaggcauuuccugg

SEQ ID NO: 1358288 - RNA, 15 nt, Human
cuacucacacaggca

SEQ ID NO: 1358289 - RNA, 14 nt, Human
cuacucacacaggc

SEQ ID NO: 1358290 - RNA, 13 nt, Human
cuacucacacagg

SEQ ID NO: 1358291 - RNA, 13 nt, Human
cuacucaaagcau

SEQ ID NO: 1358292 - RNA, 20 nt, Human
cuacuagggaaaugccuuug

SEQ ID NO: 1358293 - RNA, 15 nt, Human
cgaguaauaugccug

SEQ ID NO: 1358294 - RNA, 14 nt, Human
cgccuuccccaccc

SEQ ID NO: 1358295 - RNA, 22 nt, Human
cgauacugcgacuuucugccug

SEQ ID NO: 1358296 - RNA, 20 nt, Human
cgauacugcgacuuucugcc

SEQ ID NO: 1358297 - RNA, 19 nt, Human
cgauacugcgacuuucugc

SEQ ID NO: 1358298 - RNA, 15 nt, Human
cgcauaggaccuuuc

SEQ ID NO: 1358299 - RNA, 21 nt, Human
cgcaguuuuuuuuuucuuguc

SEQ ID NO: 1358300 - RNA, 20 nt, Human
cgcaguuuuuuuuuucuugu

SEQ ID NO: 1358301 - RNA, 23 nt, Human
cgauacugcgacuuucugccugg

SEQ ID NO: 1358302 - RNA, 12 nt, Human
cgcaguuuuuuu

SEQ ID NO: 1358303 - RNA, 13 nt, Human
cgcaucagacaga

SEQ ID NO: 1358304 - RNA, 20 nt, Human
cgcuggacucucagucucug

SEQ ID NO: 1358305 - RNA, 18 nt, Human
cgcugcuucgugggauac

SEQ ID NO: 1358306 - RNA, 13 nt, Human
cgcugcugucaca

SEQ ID NO: 1358307 - RNA, 12 nt, Human
cguaauuuaacu

SEQ ID NO: 1358308 - RNA, 16 nt, Human
cggugugcaccagggu

SEQ ID NO: 1358309 - RNA, 15 nt, Human
cggugugcaccaggg

SEQ ID NO: 1358310 - RNA, 11 nt, Human
cggugucucuc

SEQ ID NO: 1358311 - RNA, 22 nt, Human
cgguggggguagggggcuggag

SEQ ID NO: 1358312 - RNA, 19 nt, Human
cgguggggguagggggcug

SEQ ID NO: 1358313 - RNA, 11 nt, Human
cggugggggua

SEQ ID NO: 1358314 - RNA, 10 nt, Human
cggugggggu

SEQ ID NO: 1358315 - RNA, 12 nt, Human
cggugggccugg

SEQ ID NO: 1358316 - RNA, 13 nt, Human
cggugggccuggu

SEQ ID NO: 1358317 - RNA, 23 nt, Human
cggagaagugugccuucucucuc

SEQ ID NO: 1358318 - RNA, 23 nt, Human
cguaauaagguuuuaauuuagua

SEQ ID NO: 1358319 - RNA, 15 nt, Human
cguaauaagguuuua

SEQ ID NO: 1358320 - RNA, 13 nt, Human
cguaauaagguuu

SEQ ID NO: 1358321 - RNA, 21 nt, Human
cgguugaguuuugacugcuug

SEQ ID NO: 1358322 - RNA, 13 nt, Human
cguacacauuuua

SEQ ID NO: 1358323 - RNA, 16 nt, Human
cguacacauuuuauuu

SEQ ID NO: 1358324 - RNA, 20 nt, Human
cgguucaggaaaauugaaug

SEQ ID NO: 1358325 - RNA, 20 nt, Human
cgguuaugaaauucaccccc

SEQ ID NO: 1358326 - RNA, 15 nt, Human
cgguuuauauaagcu

SEQ ID NO: 1358327 - RNA, 15 nt, Human
cuaacugcauacacu

SEQ ID NO: 1358328 - RNA, 17 nt, Human
cuaacucuucuuucauu

SEQ ID NO: 1358329 - RNA, 19 nt, Human
cuaacuacaaagguuuaaa

SEQ ID NO: 1358330 - RNA, 23 nt, Human
cuaacuagacaccaaaguucuaa

SEQ ID NO: 1358331 - RNA, 22 nt, Human
cuaacuagacaccaaaguucua

SEQ ID NO: 1358332 - RNA, 21 nt, Human
cuaacuagacaccaaaguucu

SEQ ID NO: 1358333 - RNA, 15 nt, Human
cuaacuagacaccaa

SEQ ID NO: 1358334 - RNA, 23 nt, Human
cuaacuacaaagguuuaaaugaa

SEQ ID NO: 1358335 - RNA, 20 nt, Human
cuaacuacaaagguuuaaau

SEQ ID NO: 1358336 - RNA, 20 nt, Human
cuaaaguucuaagauucuga

SEQ ID NO: 1358337 - RNA, 19 nt, Human
cuaaaguucuaagauucug

SEQ ID NO: 1358338 - RNA, 18 nt, Human
cuaaaguucuaagauucu

SEQ ID NO: 1358339 - RNA, 17 nt, Human
cuaaaguucuaagauuc

SEQ ID NO: 1358340 - RNA, 15 nt, Human
cuaaaguucuaagau

SEQ ID NO: 1358341 - RNA, 14 nt, Human
cuaaaguucuaaga

SEQ ID NO: 1358342 - RNA, 13 nt, Human
cuaaaguucuaag

SEQ ID NO: 1358343 - RNA, 12 nt, Human
cuaaaguucuaa

SEQ ID NO: 1358344 - RNA, 11 nt, Human
cuaaaguucua

SEQ ID NO: 1358345 - RNA, 21 nt, Human
cuaaagguccacaggucuaga

SEQ ID NO: 1358346 - RNA, 20 nt, Human
cuaaagguccacaggucuag

SEQ ID NO: 1358347 - RNA, 19 nt, Human
cuaaagguccacaggucua

SEQ ID NO: 1358348 - RNA, 15 nt, Human
cuaaagguccacagg

SEQ ID NO: 1358349 - RNA, 13 nt, Human
cuaaaggaguuua

SEQ ID NO: 1358350 - RNA, 16 nt, Human
cuaaaggaguuuaugu

SEQ ID NO: 1358351 - RNA, 22 nt, Human
cuaaaguguauuuuuuuacuaa

SEQ ID NO: 1358352 - RNA, 17 nt, Human
cuaaaggcuaccuuugu

SEQ ID NO: 1358353 - RNA, 19 nt, Human
cuaaaggcuaccuuuguau

SEQ ID NO: 1358354 - RNA, 19 nt, Human
cuaaaggaaaucaaaugaa

SEQ ID NO: 1358355 - RNA, 19 nt, Human
cuaaaggaaaaaaccaucc

SEQ ID NO: 1358356 - RNA, 14 nt, Human
cuaaaggaaaaaac

SEQ ID NO: 1358357 - RNA, 18 nt, Human
cuaaagcugguuuaaugu

SEQ ID NO: 1358358 - RNA, 17 nt, Human
cuaaagcugguuuaaug

SEQ ID NO: 1358359 - RNA, 15 nt, Human
cuaaaggcuaccuuu

SEQ ID NO: 1358360 - RNA, 16 nt, Human
cuaaaggcuaccuuug

SEQ ID NO: 1358361 - RNA, 13 nt, Human
cuaaagaaaaaca

SEQ ID NO: 1358362 - RNA, 21 nt, Human
cuaaacuuuuuuucuguacca

SEQ ID NO: 1358363 - RNA, 18 nt, Human
cuaaacuuuuuuucugua

SEQ ID NO: 1358364 - RNA, 17 nt, Human
cuaaacuuuuuuucugu

SEQ ID NO: 1358365 - RNA, 20 nt, Human
cuaaagaaaaacaaacucgu

SEQ ID NO: 1358366 - RNA, 17 nt, Human
cuaaagaaaaacaaacu

SEQ ID NO: 1358367 - RNA, 14 nt, Human
cguguccaccccca

SEQ ID NO: 1358368 - RNA, 16 nt, Human
cgugucaccugugcuu

SEQ ID NO: 1358369 - RNA, 17 nt, Human
cguguccgacucuucug

SEQ ID NO: 1358370 - RNA, 21 nt, Human
cguguuuggguuuuuuuccuu

SEQ ID NO: 1358371 - RNA, 13 nt, Human
cguguccaccccc

SEQ ID NO: 1358372 - RNA, 13 nt, Human
cgugucuggcaca

SEQ ID NO: 1358373 - RNA, 21 nt, Human
cguuaaaaacagauuuggaaa

SEQ ID NO: 1358374 - RNA, 14 nt, Human
cguuaaaaacagau

SEQ ID NO: 1358375 - RNA, 13 nt, Human
cguuaaaauacca

SEQ ID NO: 1358376 - RNA, 21 nt, Human
cguuacuagcagucacuugau

SEQ ID NO: 1358377 - RNA, 15 nt, Human
cuaaacuuuuuuucu

SEQ ID NO: 1358378 - RNA, 13 nt, Human
cucagacauuggc

SEQ ID NO: 1358379 - RNA, 17 nt, Human
cucagacauuggcaccu

SEQ ID NO: 1358380 - RNA, 22 nt, Human
cuccaguguccugagcucagcg

SEQ ID NO: 1358381 - RNA, 21 nt, Human
cuccaguguccugagcucagc

SEQ ID NO: 1358382 - RNA, 20 nt, Human
cuccaguguccugagcucag

SEQ ID NO: 1358383 - RNA, 19 nt, Human
cuccaguguccugagcuca

SEQ ID NO: 1358384 - RNA, 18 nt, Human
cuccaguguccugagcuc

SEQ ID NO: 1358385 - RNA, 17 nt, Human
cuccaguguccugagcu

SEQ ID NO: 1358386 - RNA, 16 nt, Human
cuccaguguccugagc

SEQ ID NO: 1358387 - RNA, 14 nt, Human
cuccaguguccuga

SEQ ID NO: 1358388 - RNA, 13 nt, Human
cuccaguguccug

SEQ ID NO: 1358389 - RNA, 23 nt, Human
cuccagggacagcaacuaucaga

SEQ ID NO: 1358390 - RNA, 14 nt, Human
cuccagggacagca

SEQ ID NO: 1358391 - RNA, 23 nt, Human
cucccagaggagccaccaguucu

SEQ ID NO: 1358392 - RNA, 22 nt, Human
cucccagaggagccaccaguuc

SEQ ID NO: 1358393 - RNA, 21 nt, Human
cucccagaggagccaccaguu

SEQ ID NO: 1358394 - RNA, 19 nt, Human
cucccagaggagccaccag

SEQ ID NO: 1358395 - RNA, 15 nt, Human
cucccucccucuccg

SEQ ID NO: 1358396 - RNA, 14 nt, Human
cucccucccucucc

SEQ ID NO: 1358397 - RNA, 21 nt, Human
cucccuccccuugccugugcc

SEQ ID NO: 1358398 - RNA, 18 nt, Human
cucccuccccuugccugu

SEQ ID NO: 1358399 - RNA, 17 nt, Human
cucccuccccuugccug

SEQ ID NO: 1358400 - RNA, 11 nt, Human
cuccccaguuc

SEQ ID NO: 1358401 - RNA, 23 nt, Human
cuccccagguccagcucuggagg

SEQ ID NO: 1358402 - RNA, 22 nt, Human
cuccccaguacaccccaccucu

SEQ ID NO: 1358403 - RNA, 21 nt, Human
cuccccagguccagcucugga

SEQ ID NO: 1358404 - RNA, 20 nt, Human
cuccccagguccagcucugg

SEQ ID NO: 1358405 - RNA, 19 nt, Human
cuccccagguccagcucug

SEQ ID NO: 1358406 - RNA, 18 nt, Human
cuccccagguccagcucu

SEQ ID NO: 1358407 - RNA, 17 nt, Human
cuccccagguccagcuc

SEQ ID NO: 1358408 - RNA, 16 nt, Human
cuccccagguccagcu

SEQ ID NO: 1358409 - RNA, 20 nt, Human
cuccccagggaagcagcagc

SEQ ID NO: 1358410 - RNA, 22 nt, Human
cuccccagggaagcagcagccu

SEQ ID NO: 1358411 - RNA, 19 nt, Human
cuccccaugauguuuagaa

SEQ ID NO: 1358412 - RNA, 15 nt, Human
cuccgggaccuggug

SEQ ID NO: 1358413 - RNA, 14 nt, Human
cuccgucaacucau

SEQ ID NO: 1358414 - RNA, 13 nt, Human
cucugaacacauu

SEQ ID NO: 1358415 - RNA, 12 nt, Human
cucugaacacau

SEQ ID NO: 1358416 - RNA, 17 nt, Human
cucugaaagagaaacac

SEQ ID NO: 1358417 - RNA, 11 nt, Human
cucugaaauac

SEQ ID NO: 1358418 - RNA, 21 nt, Human
cucugaaagagaaacacguau

SEQ ID NO: 1358419 - RNA, 16 nt, Human
cucugaaagagaaaca

SEQ ID NO: 1358420 - RNA, 14 nt, Human
cucugaaagagaaa

SEQ ID NO: 1358421 - RNA, 13 nt, Human
cucugaaagagaa

SEQ ID NO: 1358422 - RNA, 17 nt, Human
cucugaaaccaguguua

SEQ ID NO: 1358423 - RNA, 12 nt, Human
cucugaaaccag

SEQ ID NO: 1358424 - RNA, 15 nt, Human
cucucuuugcccagu

SEQ ID NO: 1358425 - RNA, 23 nt, Human
cucucuuugcccaguuggagacu

SEQ ID NO: 1358426 - RNA, 18 nt, Human
cucucuuugcauggauuu

SEQ ID NO: 1358427 - RNA, 16 nt, Human
cucucuuugcauggau

SEQ ID NO: 1358428 - RNA, 19 nt, Human
cucucuuuauacagcugua

SEQ ID NO: 1358429 - RNA, 18 nt, Human
cucucuuuauacagcugu

SEQ ID NO: 1358430 - RNA, 17 nt, Human
cucucuuuauacagcug

SEQ ID NO: 1358431 - RNA, 23 nt, Human
cucucccuugggcucugaugaaa

SEQ ID NO: 1358432 - RNA, 21 nt, Human
cucucccuugggcucugauga

SEQ ID NO: 1358433 - RNA, 19 nt, Human
cucucccuugggcucugau

SEQ ID NO: 1358434 - RNA, 18 nt, Human
cucucccuugggcucuga

SEQ ID NO: 1358435 - RNA, 17 nt, Human
cucucccuugggcucug

SEQ ID NO: 1358436 - RNA, 16 nt, Human
cucucccuugggcucu

SEQ ID NO: 1358437 - RNA, 14 nt, Human
cucucccuugggcu

SEQ ID NO: 1358438 - RNA, 21 nt, Human
cucgaacuauuuucaaagacu

SEQ ID NO: 1358439 - RNA, 20 nt, Human
cucgaacuauuuucaaagac

SEQ ID NO: 1358440 - RNA, 13 nt, Human
cuccuuuuuccau

SEQ ID NO: 1358441 - RNA, 13 nt, Human
cuccuuuucccaa

SEQ ID NO: 1358442 - RNA, 23 nt, Human
cuccuuuuaaagaaaaaaauuga

SEQ ID NO: 1358443 - RNA, 19 nt, Human
cucgaaacacagaaaccuu

SEQ ID NO: 1358444 - RNA, 15 nt, Human
cucgaaacacagaaa

SEQ ID NO: 1358445 - RNA, 14 nt, Human
cucgaaacacagaa

SEQ ID NO: 1358446 - RNA, 20 nt, Human
cucgaaacacagaaaccuuu

SEQ ID NO: 1358447 - RNA, 14 nt, Human
cuccuuuuaaagaa

SEQ ID NO: 1358448 - RNA, 13 nt, Human
cuccuuuuaaaga

SEQ ID NO: 1358449 - RNA, 21 nt, Human
cuccuagcuguccuuuuuccu

SEQ ID NO: 1358450 - RNA, 14 nt, Human
cuccuagcuguccu

SEQ ID NO: 1358451 - RNA, 10 nt, Human
cuccuuucca

SEQ ID NO: 1358452 - RNA, 18 nt, Human
cuccuuucaucacacugg

SEQ ID NO: 1358453 - RNA, 18 nt, Human
cuccuuuccauaaauccu

SEQ ID NO: 1358454 - RNA, 14 nt, Human
cuccuuucuggcuu

SEQ ID NO: 1358455 - RNA, 19 nt, Human
cucggggugcacaggaggg

SEQ ID NO: 1358456 - RNA, 17 nt, Human
cucggggugcacaggag

SEQ ID NO: 1358457 - RNA, 16 nt, Human
cucggggugcacagga

SEQ ID NO: 1358458 - RNA, 15 nt, Human
cucggggugcacagg

SEQ ID NO: 1358459 - RNA, 19 nt, Human
cucggggauguguccugac

SEQ ID NO: 1358460 - RNA, 16 nt, Human
cucggggauguguccu

SEQ ID NO: 1358461 - RNA, 13 nt, Human
cucgguuucucca

SEQ ID NO: 1358462 - RNA, 16 nt, Human
cucguaagauuuccuu

SEQ ID NO: 1358463 - RNA, 18 nt, Human
cucggggugcacaggagg

SEQ ID NO: 1358464 - RNA, 14 nt, Human
cucguauagcaugc

SEQ ID NO: 1358465 - RNA, 13 nt, Human
cucguauagcaug

SEQ ID NO: 1358466 - RNA, 18 nt, Human
cucguccccaagugaccu

SEQ ID NO: 1358467 - RNA, 17 nt, Human
cucguggacaccugccc

SEQ ID NO: 1358468 - RNA, 19 nt, Human
cucguggacaccugcccug

SEQ ID NO: 1358469 - RNA, 20 nt, Human
cucguggacaccugcccugc

SEQ ID NO: 1358470 - RNA, 21 nt, Human
cucguggacaccugcccugcc

SEQ ID NO: 1358471 - RNA, 16 nt, Human
cugaccccaucaccua

SEQ ID NO: 1358472 - RNA, 15 nt, Human
cugaccccaucaccu

SEQ ID NO: 1358473 - RNA, 18 nt, Human
cugaccccaucaccuacu

SEQ ID NO: 1358474 - RNA, 22 nt, Human
cugacacacuaaccaagcugag

SEQ ID NO: 1358475 - RNA, 23 nt, Human
cugacacacuaaccaagcugagu

SEQ ID NO: 1358476 - RNA, 20 nt, Human
cugacacacuaaccaagcug

SEQ ID NO: 1358477 - RNA, 19 nt, Human
cugacacacuaaccaagcu

SEQ ID NO: 1358478 - RNA, 16 nt, Human
cugacacacuaaccaa

SEQ ID NO: 1358479 - RNA, 13 nt, Human
cugacacacuaac

SEQ ID NO: 1358480 - RNA, 21 nt, Human
cugacacaugcugaacaucac

SEQ ID NO: 1358481 - RNA, 23 nt, Human
cugacacaccaggcgcuaauuca

SEQ ID NO: 1358482 - RNA, 19 nt, Human
cugacacaccaggcgcuaa

SEQ ID NO: 1358483 - RNA, 17 nt, Human
cugacacaccaggcgcu

SEQ ID NO: 1358484 - RNA, 14 nt, Human
cugacacaccaggc

SEQ ID NO: 1358485 - RNA, 17 nt, Human
cugacacucccuugggc

SEQ ID NO: 1358486 - RNA, 19 nt, Human
cugacaccuaacucuucuu

SEQ ID NO: 1358487 - RNA, 16 nt, Human
cugacaccuaacucuu

SEQ ID NO: 1358488 - RNA, 21 nt, Human
cugacacccuucucccacucu

SEQ ID NO: 1358489 - RNA, 17 nt, Human
cugacacccuucuccca

SEQ ID NO: 1358490 - RNA, 16 nt, Human
cugacacccuucuccc

SEQ ID NO: 1358491 - RNA, 19 nt, Human
cugacacuuuaauuaccaa

SEQ ID NO: 1358492 - RNA, 21 nt, Human
cugacacugcuggagaggccc

SEQ ID NO: 1358493 - RNA, 15 nt, Human
cugacacugcuggag

SEQ ID NO: 1358494 - RNA, 14 nt, Human
cugacacugcugga

SEQ ID NO: 1358495 - RNA, 13 nt, Human
cugacacugcugg

SEQ ID NO: 1358496 - RNA, 20 nt, Human
cugacacugcuggagaggcc

SEQ ID NO: 1358497 - RNA, 15 nt, Human
cugaagcccucccag

SEQ ID NO: 1358498 - RNA, 21 nt, Human
cugaagcagguucccaagcuc

SEQ ID NO: 1358499 - RNA, 20 nt, Human
cugaagcagguucccaagcu

SEQ ID NO: 1358500 - RNA, 19 nt, Human
cugaagcagguucccaagc

SEQ ID NO: 1358501 - RNA, 20 nt, Human
cugaagcagccucuccccag

SEQ ID NO: 1358502 - RNA, 16 nt, Human
cugaagcagccucucc

SEQ ID NO: 1358503 - RNA, 15 nt, Human
cugaagcagccucuc

SEQ ID NO: 1358504 - RNA, 14 nt, Human
cugaagcagccucu

SEQ ID NO: 1358505 - RNA, 22 nt, Human
cugaaagaggcugaggccugga

SEQ ID NO: 1358506 - RNA, 14 nt, Human
cugaaagaggcuga

SEQ ID NO: 1358507 - RNA, 14 nt, Human
cugaaagagaaaca

SEQ ID NO: 1358508 - RNA, 23 nt, Human
cucuugaguuugucgcucaugug

SEQ ID NO: 1358509 - RNA, 23 nt, Human
cucuugauaccccccucugucuu

SEQ ID NO: 1358510 - RNA, 21 nt, Human
cucuugauaccccccucuguc

SEQ ID NO: 1358511 - RNA, 19 nt, Human
cucuugauaccccccucug

SEQ ID NO: 1358512 - RNA, 18 nt, Human
cucuugauaccccccucu

SEQ ID NO: 1358513 - RNA, 17 nt, Human
cucuuuuuucguuuguu

SEQ ID NO: 1358514 - RNA, 18 nt, Human
cucuugccucaaccuccc

SEQ ID NO: 1358515 - RNA, 20 nt, Human
cucuugccucaaccucccaa

SEQ ID NO: 1358516 - RNA, 20 nt, Human
cucuugcacagucacugcuc

SEQ ID NO: 1358517 - RNA, 21 nt, Human
cucuugcacagucacugcucu

SEQ ID NO: 1358518 - RNA, 15 nt, Human
cugaaaauauaacca

SEQ ID NO: 1358519 - RNA, 13 nt, Human
cugaaaauauaac

SEQ ID NO: 1358520 - RNA, 17 nt, Human
cugaaaagguuuaugaa

SEQ ID NO: 1358521 - RNA, 21 nt, Human
cugaaaaaugguaauuguugc

SEQ ID NO: 1358522 - RNA, 22 nt, Human
cugaaaaaucuaagugauauaa

SEQ ID NO: 1358523 - RNA, 19 nt, Human
cugaaaaaucuaagugaua

SEQ ID NO: 1358524 - RNA, 15 nt, Human
cugaaaaaauauaug

SEQ ID NO: 1358525 - RNA, 13 nt, Human
cugaaaaaauaua

SEQ ID NO: 1358526 - RNA, 15 nt, Human
cugaaaaaaaaccug

SEQ ID NO: 1358527 - RNA, 22 nt, Human
cugaaaauauaaccagccauug

SEQ ID NO: 1358528 - RNA, 17 nt, Human
cugaaaauauuguuuua

SEQ ID NO: 1358529 - RNA, 20 nt, Human
cugaaaauauuguuuuacaa

SEQ ID NO: 1358530 - RNA, 22 nt, Human
cugaaaauauuguuuuacaaua

SEQ ID NO: 1358531 - RNA, 24 nt, Human
cugaaaauauuguuuuacaauagu

SEQ ID NO: 1358532 - RNA, 19 nt, Human
cugagguuacuggaaauua

SEQ ID NO: 1358533 - RNA, 17 nt, Human
cugagguuacuggaaau

SEQ ID NO: 1358534 - RNA, 21 nt, Human
cugagguuacuggaaauuagg

SEQ ID NO: 1358535 - RNA, 17 nt, Human
cugaguaccccugcuuu

SEQ ID NO: 1358536 - RNA, 16 nt, Human
cugaggaauuuucuuu

SEQ ID NO: 1358537 - RNA, 16 nt, Human
cugaggaauuucaccu

SEQ ID NO: 1358538 - RNA, 17 nt, Human
cugaggggcuaccagga

SEQ ID NO: 1358539 - RNA, 21 nt, Human
cugagguccugagcacugcca

SEQ ID NO: 1358540 - RNA, 24 nt, Human
cugagguccugagcacugccagga

SEQ ID NO: 1358541 - RNA, 20 nt, Human
cugagguccugagcacugcc

SEQ ID NO: 1358542 - RNA, 19 nt, Human
cugagguccugagcacugc

SEQ ID NO: 1358543 - RNA, 18 nt, Human
cugagguccugagcacug

SEQ ID NO: 1358544 - RNA, 16 nt, Human
cugagguccugagcac

SEQ ID NO: 1358545 - RNA, 15 nt, Human
cugagguccugagca

SEQ ID NO: 1358546 - RNA, 14 nt, Human
cugagguccugagc

SEQ ID NO: 1358547 - RNA, 13 nt, Human
cugagguccugag

SEQ ID NO: 1358548 - RNA, 14 nt, Human
cugagggucuguag

SEQ ID NO: 1358549 - RNA, 16 nt, Human
cugagggucuguaggu

SEQ ID NO: 1358550 - RNA, 12 nt, Human
cugagggucugu

SEQ ID NO: 1358551 - RNA, 20 nt, Human
cugaggggcuaccaggaaag

SEQ ID NO: 1358552 - RNA, 16 nt, Human
cugaggggggauccag

SEQ ID NO: 1358553 - RNA, 18 nt, Human
cugaggggcuaccaggaa

SEQ ID NO: 1358554 - RNA, 11 nt, Human
cugagcuguca

SEQ ID NO: 1358555 - RNA, 15 nt, Human
cugagcugugcaggu

SEQ ID NO: 1358556 - RNA, 16 nt, Human
cugaggaacugucucg

SEQ ID NO: 1358557 - RNA, 22 nt, Human
cugaggaacccuuacaguagga

SEQ ID NO: 1358558 - RNA, 21 nt, Human
cugaggaaauugcuuuguauu

SEQ ID NO: 1358559 - RNA, 13 nt, Human
cugagcugugcag

SEQ ID NO: 1358560 - RNA, 18 nt, Human
cugagcugaggcagcagu

SEQ ID NO: 1358561 - RNA, 18 nt, Human
cugagcugcccacagcag

SEQ ID NO: 1358562 - RNA, 21 nt, Human
cugagcugcccacagcaggcc

SEQ ID NO: 1358563 - RNA, 22 nt, Human
cugagcugcccacagcaggcca

SEQ ID NO: 1358564 - RNA, 14 nt, Human
cugaccccugcuca

SEQ ID NO: 1358565 - RNA, 13 nt, Human
cugaccccugcuc

SEQ ID NO: 1358566 - RNA, 18 nt, Human
cugacccucaucuuucuu

SEQ ID NO: 1358567 - RNA, 16 nt, Human
cugaccccugcucagu

SEQ ID NO: 1358568 - RNA, 18 nt, Human
cugacccuccaccgcaga

SEQ ID NO: 1358569 - RNA, 23 nt, Human
cugacccuccaccgcagaaggaa

SEQ ID NO: 1358570 - RNA, 18 nt, Human
gucugguucucaauucca

SEQ ID NO: 1358571 - RNA, 14 nt, Human
gucugguucucaau

SEQ ID NO: 1358572 - RNA, 20 nt, Human
gucugguggccccguuucug

SEQ ID NO: 1358573 - RNA, 13 nt, Human
gucugguggcccc

SEQ ID NO: 1358574 - RNA, 15 nt, Human
gucuggugaagcuca

SEQ ID NO: 1358575 - RNA, 15 nt, Human
gucuggguggcucac

SEQ ID NO: 1358576 - RNA, 17 nt, Human
gucuggguggcucacuc

SEQ ID NO: 1358577 - RNA, 14 nt, Human
gucuggguggcuca

SEQ ID NO: 1358578 - RNA, 20 nt, Human
gucugggugcuacuggggaa

SEQ ID NO: 1358579 - RNA, 15 nt, Human
gucugggugcuacug

SEQ ID NO: 1358580 - RNA, 14 nt, Human
gucugggugcuacu

SEQ ID NO: 1358581 - RNA, 20 nt, Human
gucugggggcacaagacuga

SEQ ID NO: 1358582 - RNA, 19 nt, Human
gucugggggcacaagacug

SEQ ID NO: 1358583 - RNA, 14 nt, Human
gucugggggcacaa

SEQ ID NO: 1358584 - RNA, 23 nt, Human
gucuggggagcgggucugcuccc

SEQ ID NO: 1358585 - RNA, 22 nt, Human
gucuggggagcgggucugcucc

SEQ ID NO: 1358586 - RNA, 16 nt, Human
gucuggcaaugccaca

SEQ ID NO: 1358587 - RNA, 15 nt, Human
gucuggcaaugccac

SEQ ID NO: 1358588 - RNA, 21 nt, Human
gucuggauaacuuccacaggg

SEQ ID NO: 1358589 - RNA, 20 nt, Human
gucuggauaacuuccacagg

SEQ ID NO: 1358590 - RNA, 18 nt, Human
gucuggauaacuuccaca

SEQ ID NO: 1358591 - RNA, 16 nt, Human
gucuggauaacuucca

SEQ ID NO: 1358592 - RNA, 21 nt, Human
gucuggaguugaucuggaacc

SEQ ID NO: 1358593 - RNA, 17 nt, Human
gucuggagaccaccagg

SEQ ID NO: 1358594 - RNA, 21 nt, Human
gucuggagaccaccagggcau

SEQ ID NO: 1358595 - RNA, 10 nt, Human
gucuggagac

SEQ ID NO: 1358596 - RNA, 13 nt, Human
gucucuuguaauc

SEQ ID NO: 1358597 - RNA, 19 nt, Human
aaccaucucccuggugcuu

SEQ ID NO: 1358598 - RNA, 18 nt, Human
aaccaucucccuggugcu

SEQ ID NO: 1358599 - RNA, 14 nt, Human
aaccaucucccugg

SEQ ID NO: 1358600 - RNA, 13 nt, Human
aaccaucucccug

SEQ ID NO: 1358601 - RNA, 12 nt, Human
aaccaucucccu

SEQ ID NO: 1358602 - RNA, 19 nt, Human
aaccaugcaaaugcuauga

SEQ ID NO: 1358603 - RNA, 22 nt, Human
aaccaugagaccacuguuauca

SEQ ID NO: 1358604 - RNA, 22 nt, Human
gucucuuuaaaaggaaagaaaa

SEQ ID NO: 1358605 - RNA, 19 nt, Human
gucuuuguuaagacugcug

SEQ ID NO: 1358606 - RNA, 15 nt, Human
gucuuccauuugcaa

SEQ ID NO: 1358607 - RNA, 13 nt, Human
gucuucccaccca

SEQ ID NO: 1358608 - RNA, 18 nt, Human
aaccuuaauuuauuauua

SEQ ID NO: 1358609 - RNA, 13 nt, Human
aaccuuaagauac

SEQ ID NO: 1358610 - RNA, 13 nt, Human
aaccuuaagaccu

SEQ ID NO: 1358611 - RNA, 24 nt, Human
aaccuguuaccuacuuugacuuuu

SEQ ID NO: 1358612 - RNA, 21 nt, Human
aaccuguuaccuacuuugacu

SEQ ID NO: 1358613 - RNA, 24 nt, Human
gucuuuuaggacccuucccuugag

SEQ ID NO: 1358614 - RNA, 15 nt, Human
aaccuuguuuuggac

SEQ ID NO: 1358615 - RNA, 19 nt, Human
aaccuuuacaugaggacuc

SEQ ID NO: 1358616 - RNA, 23 nt, Human
aaccuuguuuuggacaguuuacc

SEQ ID NO: 1358617 - RNA, 13 nt, Human
aaccuuguuuugg

SEQ ID NO: 1358618 - RNA, 17 nt, Human
aaccuuaauuuauuauu

SEQ ID NO: 1358619 - RNA, 23 nt, Human
aaccuuagauguucuaagucuuu

SEQ ID NO: 1358620 - RNA, 18 nt, Human
aacguuaagaauuguuaa

SEQ ID NO: 1358621 - RNA, 17 nt, Human
aacguguucaauauuuu

SEQ ID NO: 1358622 - RNA, 18 nt, Human
aaccuuucuucaccaaau

SEQ ID NO: 1358623 - RNA, 16 nt, Human
aaccuuucuucaccaa

SEQ ID NO: 1358624 - RNA, 11 nt, Human
aacuaacaugu

SEQ ID NO: 1358625 - RNA, 16 nt, Human
aacguguucaauauuu

SEQ ID NO: 1358626 - RNA, 14 nt, Human
aacguugcucccca

SEQ ID NO: 1358627 - RNA, 20 nt, Human
aacguuuaagccaaaacaau

SEQ ID NO: 1358628 - RNA, 15 nt, Human
aacuaacauguccug

SEQ ID NO: 1358629 - RNA, 14 nt, Human
aacuaacauguccu

SEQ ID NO: 1358630 - RNA, 15 nt, Human
aacuaagaaacuuaa

SEQ ID NO: 1358631 - RNA, 23 nt, Human
aacuaagaaauaugcacaauagc

SEQ ID NO: 1358632 - RNA, 19 nt, Human
aacuaagaaacuuaaauuu

SEQ ID NO: 1358633 - RNA, 16 nt, Human
aacuacuuugcugcua

SEQ ID NO: 1358634 - RNA, 19 nt, Human
aacuacuuugcugcuaaua

SEQ ID NO: 1358635 - RNA, 17 nt, Human
aacuacuuuauaacuaa

SEQ ID NO: 1358636 - RNA, 15 nt, Human
aacuacuuuauaacu

SEQ ID NO: 1358637 - RNA, 13 nt, Human
aacuacuuuauaa

SEQ ID NO: 1358638 - RNA, 22 nt, Human
aacuacuucucuuguuagguaa

SEQ ID NO: 1358639 - RNA, 13 nt, Human
gugaaggacccuu

SEQ ID NO: 1358640 - RNA, 12 nt, Human
gugaaggacccu

SEQ ID NO: 1358641 - RNA, 12 nt, Human
gugaagccuucc

SEQ ID NO: 1358642 - RNA, 11 nt, Human
gugaagccuuc

SEQ ID NO: 1358643 - RNA, 10 nt, Human
gugaagccuu

SEQ ID NO: 1358644 - RNA, 22 nt, Human
gugaagccaauucagacaggca

SEQ ID NO: 1358645 - RNA, 20 nt, Human
gugaagccaauucagacagg

SEQ ID NO: 1358646 - RNA, 10 nt, Human
gugaagccaa

SEQ ID NO: 1358647 - RNA, 22 nt, Human
gugaaggcuucucucuguggga

SEQ ID NO: 1358648 - RNA, 17 nt, Human
gugaaggcuucucucug

SEQ ID NO: 1358649 - RNA, 14 nt, Human
gugaaggcuucucu

SEQ ID NO: 1358650 - RNA, 14 nt, Human
gugaagugaagaca

SEQ ID NO: 1358651 - RNA, 23 nt, Human
gugaagaaugcacaagaauggau

SEQ ID NO: 1358652 - RNA, 14 nt, Human
gugaagacagaagu

SEQ ID NO: 1358653 - RNA, 21 nt, Human
gugaagaaugcacaagaaugg

SEQ ID NO: 1358654 - RNA, 14 nt, Human
gugaagaauacuuc

SEQ ID NO: 1358655 - RNA, 23 nt, Human
gugaagacaaugacuuacuguac

SEQ ID NO: 1358656 - RNA, 23 nt, Human
aacuaucucauuuccaagcaagu

SEQ ID NO: 1358657 - RNA, 20 nt, Human
aacuaucucauuuccaagca

SEQ ID NO: 1358658 - RNA, 20 nt, Human
aacuagacaccaaaguucua

SEQ ID NO: 1358659 - RNA, 17 nt, Human
aacuagacaccaaaguu

SEQ ID NO: 1358660 - RNA, 16 nt, Human
aacuagaauuugauua

SEQ ID NO: 1358661 - RNA, 15 nt, Human
aacuagaauuugauu

SEQ ID NO: 1358662 - RNA, 13 nt, Human
aacuauauuguuu

SEQ ID NO: 1358663 - RNA, 19 nt, Human
gugacaucggaaaaauaau

SEQ ID NO: 1358664 - RNA, 18 nt, Human
gugacaucggaaaaauaa

SEQ ID NO: 1358665 - RNA, 16 nt, Human
gugacaucggaaaaau

SEQ ID NO: 1358666 - RNA, 14 nt, Human
gugacauccaggag

SEQ ID NO: 1358667 - RNA, 16 nt, Human
gugacccacaugccau

SEQ ID NO: 1358668 - RNA, 17 nt, Human
gugaccaggcauccucc

SEQ ID NO: 1358669 - RNA, 17 nt, Human
gugaccacucugucuug

SEQ ID NO: 1358670 - RNA, 16 nt, Human
gugaccaaugucuuga

SEQ ID NO: 1358671 - RNA, 15 nt, Human
gugaccaaugucuug

SEQ ID NO: 1358672 - RNA, 17 nt, Human
gugacauuuuacauuaa

SEQ ID NO: 1358673 - RNA, 19 nt, Human
gugacauuuuacauuaaau

SEQ ID NO: 1358674 - RNA, 17 nt, Human
gugaccaaaaguuacau

SEQ ID NO: 1358675 - RNA, 20 nt, Human
gugacauuuuacauuaaauu

SEQ ID NO: 1358676 - RNA, 21 nt, Human
gugacauuuuacauuaaauuu

SEQ ID NO: 1358677 - RNA, 20 nt, Human
gugagaagugaaugcuggga

SEQ ID NO: 1358678 - RNA, 22 nt, Human
gugagaaccuggguugcagaca

SEQ ID NO: 1358679 - RNA, 15 nt, Human
gugagaaauuuaaac

SEQ ID NO: 1358680 - RNA, 20 nt, Human
gugagaaccuggguugcaga

SEQ ID NO: 1358681 - RNA, 22 nt, Human
gugagaagugaaugcugggacu

SEQ ID NO: 1358682 - RNA, 21 nt, Human
gugagaagugaaugcugggac

SEQ ID NO: 1358683 - RNA, 16 nt, Human
gugacccccagcuccg

SEQ ID NO: 1358684 - RNA, 17 nt, Human
gugacccccagcuccgg

SEQ ID NO: 1358685 - RNA, 15 nt, Human
gugacccccagcucc

SEQ ID NO: 1358686 - RNA, 23 nt, Human
gugaccccagggcacaggagcua

SEQ ID NO: 1358687 - RNA, 22 nt, Human
gugaccccagggcacaggagcu

SEQ ID NO: 1358688 - RNA, 21 nt, Human
gugaccccagggcacaggagc

SEQ ID NO: 1358689 - RNA, 19 nt, Human
gugaccccagggcacagga

SEQ ID NO: 1358690 - RNA, 15 nt, Human
gugaccccagggcac

SEQ ID NO: 1358691 - RNA, 14 nt, Human
gugaccccagggca

SEQ ID NO: 1358692 - RNA, 13 nt, Human
gugaccccagggc

SEQ ID NO: 1358693 - RNA, 14 nt, Human
gugacccacaugcc

SEQ ID NO: 1358694 - RNA, 14 nt, Human
gugagcacagccua

SEQ ID NO: 1358695 - RNA, 12 nt, Human
gugagacagacu

SEQ ID NO: 1358696 - RNA, 17 nt, Human
gugagcagccuggagcc

SEQ ID NO: 1358697 - RNA, 21 nt, Human
gugagcagccuggagcccugg

SEQ ID NO: 1358698 - RNA, 16 nt, Human
aacucugcuugauuuu

SEQ ID NO: 1358699 - RNA, 16 nt, Human
aacucugcauucuagu

SEQ ID NO: 1358700 - RNA, 18 nt, Human
gugaguaauuuuggauuu

SEQ ID NO: 1358701 - RNA, 14 nt, Human
gugagucaccacuu

SEQ ID NO: 1358702 - RNA, 21 nt, Human
aacugcaggcccuggccuccc

SEQ ID NO: 1358703 - RNA, 20 nt, Human
aacugcaggcccuggccucc

SEQ ID NO: 1358704 - RNA, 19 nt, Human
aacugcaggcccuggccuc

SEQ ID NO: 1358705 - RNA, 18 nt, Human
aacugcaggcccuggccu

SEQ ID NO: 1358706 - RNA, 17 nt, Human
aacugcaggcccuggcc

SEQ ID NO: 1358707 - RNA, 16 nt, Human
aacugcaggcccuggc

SEQ ID NO: 1358708 - RNA, 14 nt, Human
aacugcaggcccug

SEQ ID NO: 1358709 - RNA, 23 nt, Human
aacugaacaccauugaaggcuua

SEQ ID NO: 1358710 - RNA, 22 nt, Human
aacugaacaccauugaaggcuu

SEQ ID NO: 1358711 - RNA, 21 nt, Human
aacugaacaccauugaaggcu

SEQ ID NO: 1358712 - RNA, 16 nt, Human
aacucuguuacacuuu

SEQ ID NO: 1358713 - RNA, 13 nt, Human
aacucugguggca

SEQ ID NO: 1358714 - RNA, 12 nt, Human
aacucugguggc

SEQ ID NO: 1358715 - RNA, 18 nt, Human
aacucugguggcacagga

SEQ ID NO: 1358716 - RNA, 20 nt, Human
aacugaaaucauacuucuua

SEQ ID NO: 1358717 - RNA, 12 nt, Human
aacagaggauau

SEQ ID NO: 1358718 - RNA, 19 nt, Human
aacagagacugaauagaua

SEQ ID NO: 1358719 - RNA, 16 nt, Human
guccuacagaaaaacc

SEQ ID NO: 1358720 - RNA, 15 nt, Human
guccuacagaaaaac

SEQ ID NO: 1358721 - RNA, 14 nt, Human
guccuacagaaaaa

SEQ ID NO: 1358722 - RNA, 18 nt, Human
aacagguauauacuuuga

SEQ ID NO: 1358723 - RNA, 17 nt, Human
aacagguauauacuuug

SEQ ID NO: 1358724 - RNA, 16 nt, Human
aacagugaagacagaa

SEQ ID NO: 1358725 - RNA, 19 nt, Human
aacagguuauaacaguguu

SEQ ID NO: 1358726 - RNA, 22 nt, Human
aacauaaucuucugccuucuca

SEQ ID NO: 1358727 - RNA, 13 nt, Human
aacagugagccug

SEQ ID NO: 1358728 - RNA, 17 nt, Human
aacagugaagacagaag

SEQ ID NO: 1358729 - RNA, 21 nt, Human
aacagugagccugaauuuugu

SEQ ID NO: 1358730 - RNA, 20 nt, Human
aacauaaucuucugccuucu

SEQ ID NO: 1358731 - RNA, 22 nt, Human
aacauaagcuauuuuucuaacu

SEQ ID NO: 1358732 - RNA, 20 nt, Human
aacauaagcuauuuuucuaa

SEQ ID NO: 1358733 - RNA, 18 nt, Human
aacauaagcuauuuuucu

SEQ ID NO: 1358734 - RNA, 15 nt, Human
aacauaagcuauuuu

SEQ ID NO: 1358735 - RNA, 13 nt, Human
aacauaagcuauu

SEQ ID NO: 1358736 - RNA, 15 nt, Human
aacauauauauacua

SEQ ID NO: 1358737 - RNA, 16 nt, Human
aacauagacagaagaa

SEQ ID NO: 1358738 - RNA, 15 nt, Human
aacauagacagaaga

SEQ ID NO: 1358739 - RNA, 22 nt, Human
aacauagaaauugccugacgaa

SEQ ID NO: 1358740 - RNA, 16 nt, Human
aacauauauaacaaug

SEQ ID NO: 1358741 - RNA, 19 nt, Human
aacauagacagaagaaaca

SEQ ID NO: 1358742 - RNA, 17 nt, Human
aacauguuuccagcauu

SEQ ID NO: 1358743 - RNA, 16 nt, Human
aacauguuuccagcau

SEQ ID NO: 1358744 - RNA, 15 nt, Human
aacauguuuccagca

SEQ ID NO: 1358745 - RNA, 11 nt, Human
aacauguuucc

SEQ ID NO: 1358746 - RNA, 20 nt, Human
aacauguuauuuguaauaga

SEQ ID NO: 1358747 - RNA, 14 nt, Human
aacauauuguugaa

SEQ ID NO: 1358748 - RNA, 20 nt, Human
guccuaauaauaucccacug

SEQ ID NO: 1358749 - RNA, 22 nt, Human
guccuaaccucgggccugcugc

SEQ ID NO: 1358750 - RNA, 19 nt, Human
guccguucacauguguggu

SEQ ID NO: 1358751 - RNA, 18 nt, Human
gucccggaggcggugggc

SEQ ID NO: 1358752 - RNA, 16 nt, Human
gucccgauuguaacuc

SEQ ID NO: 1358753 - RNA, 12 nt, Human
guccccucaccu

SEQ ID NO: 1358754 - RNA, 17 nt, Human
guccccuagagucccag

SEQ ID NO: 1358755 - RNA, 21 nt, Human
gucccccucuguccaggcacu

SEQ ID NO: 1358756 - RNA, 19 nt, Human
gucccccucuguccaggca

SEQ ID NO: 1358757 - RNA, 13 nt, Human
gucccccucuguc

SEQ ID NO: 1358758 - RNA, 23 nt, Human
guccaugggcagagcccaaggga

SEQ ID NO: 1358759 - RNA, 18 nt, Human
guccaugggcagagccca

SEQ ID NO: 1358760 - RNA, 16 nt, Human
guccaugggcagagcc

SEQ ID NO: 1358761 - RNA, 14 nt, Human
guccaugggcagag

SEQ ID NO: 1358762 - RNA, 13 nt, Human
guccaugggcaga

SEQ ID NO: 1358763 - RNA, 14 nt, Human
guccccccacuccc

SEQ ID NO: 1358764 - RNA, 12 nt, Human
guccccccacuc

SEQ ID NO: 1358765 - RNA, 19 nt, Human
guagcuccuccccuggagg

SEQ ID NO: 1358766 - RNA, 13 nt, Human
guagcuccucccc

SEQ ID NO: 1358767 - RNA, 12 nt, Human
guagcuccuccc

SEQ ID NO: 1358768 - RNA, 10 nt, Human
guagcuccuc

SEQ ID NO: 1358769 - RNA, 18 nt, Human
guagcuacagagaaacca

SEQ ID NO: 1358770 - RNA, 23 nt, Human
guagcuacagagaaaccagcuuc

SEQ ID NO: 1358771 - RNA, 18 nt, Human
guagccuuuuuguauaaa

SEQ ID NO: 1358772 - RNA, 11 nt, Human
guagccuuuuu

SEQ ID NO: 1358773 - RNA, 22 nt, Human
guagccucaaucgagugagaca

SEQ ID NO: 1358774 - RNA, 17 nt, Human
guagcgucuuucuuuuu

SEQ ID NO: 1358775 - RNA, 23 nt, Human
guagcgggggaggguaggcagga

SEQ ID NO: 1358776 - RNA, 13 nt, Human
guagcguuuuuua

SEQ ID NO: 1358777 - RNA, 17 nt, Human
guagcguuuuuuaaaug

SEQ ID NO: 1358778 - RNA, 18 nt, Human
guagcguuuuuuaaaugu

SEQ ID NO: 1358779 - RNA, 16 nt, Human
guagcuacagagaaac

SEQ ID NO: 1358780 - RNA, 15 nt, Human
guagcuacagagaaa

SEQ ID NO: 1358781 - RNA, 14 nt, Human
guagcuacagagaa

SEQ ID NO: 1358782 - RNA, 13 nt, Human
guagcuacagaga

SEQ ID NO: 1358783 - RNA, 18 nt, Human
guagcgucuuucuuuuuu

SEQ ID NO: 1358784 - RNA, 22 nt, Human
guagcguuuuuuaaauguauac

SEQ ID NO: 1358785 - RNA, 23 nt, Human
gucuccagaaagccccacccagg

SEQ ID NO: 1358786 - RNA, 15 nt, Human
gucuccagaaagccc

SEQ ID NO: 1358787 - RNA, 13 nt, Human
gucuccagaaagc

SEQ ID NO: 1358788 - RNA, 16 nt, Human
gucucaggcugccuga

SEQ ID NO: 1358789 - RNA, 18 nt, Human
gucucaggcugccugagu

SEQ ID NO: 1358790 - RNA, 17 nt, Human
gucucaaugcucauaac

SEQ ID NO: 1358791 - RNA, 12 nt, Human
gucucaaugcuc

SEQ ID NO: 1358792 - RNA, 14 nt, Human
gucucaaugcucau

SEQ ID NO: 1358793 - RNA, 22 nt, Human
gucucaaacuccugaccucagg

SEQ ID NO: 1358794 - RNA, 13 nt, Human
gucuauaaagcau

SEQ ID NO: 1358795 - RNA, 15 nt, Human
gucucaaacuccuga

SEQ ID NO: 1358796 - RNA, 14 nt, Human
gucuccauggcccu

SEQ ID NO: 1358797 - RNA, 16 nt, Human
aacauuuucuggccag

SEQ ID NO: 1358798 - RNA, 12 nt, Human
aacauuuucugg

SEQ ID NO: 1358799 - RNA, 21 nt, Human
gucuccaggggcugcuuccuc

SEQ ID NO: 1358800 - RNA, 20 nt, Human
gucuccaggggcugcuuccu

SEQ ID NO: 1358801 - RNA, 19 nt, Human
gucuccaggggcugcuucc

SEQ ID NO: 1358802 - RNA, 16 nt, Human
gucuccaggggcugcu

SEQ ID NO: 1358803 - RNA, 15 nt, Human
gucuccaggggcugc

SEQ ID NO: 1358804 - RNA, 20 nt, Human
gucuccagaaagccccaccc

SEQ ID NO: 1358805 - RNA, 21 nt, Human
gucuccaguauccacuuugca

SEQ ID NO: 1358806 - RNA, 23 nt, Human
gucuccaggggcugcuuccuccu

SEQ ID NO: 1358807 - RNA, 22 nt, Human
gucuccaggggcugcuuccucc

SEQ ID NO: 1358808 - RNA, 16 nt, Human
aaccaacuuuucuauu

SEQ ID NO: 1358809 - RNA, 23 nt, Human
aacauuuugaaagucuguccuug

SEQ ID NO: 1358810 - RNA, 15 nt, Human
aaccaaaucuggaag

SEQ ID NO: 1358811 - RNA, 22 nt, Human
aaccaaaucacugaacuuugcu

SEQ ID NO: 1358812 - RNA, 16 nt, Human
aaccaaauauuccaga

SEQ ID NO: 1358813 - RNA, 19 nt, Human
aacauuaauagcagccuuu

SEQ ID NO: 1358814 - RNA, 20 nt, Human
aacauuaauagcagccuuuc

SEQ ID NO: 1358815 - RNA, 13 nt, Human
aacauuaaaauau

SEQ ID NO: 1358816 - RNA, 22 nt, Human
aacauguuuccagcauucccag

SEQ ID NO: 1358817 - RNA, 21 nt, Human
aacauguuuccagcauuccca

SEQ ID NO: 1358818 - RNA, 19 nt, Human
aacauguuuccagcauucc

SEQ ID NO: 1358819 - RNA, 18 nt, Human
aacauguuuccagcauuc

SEQ ID NO: 1358820 - RNA, 17 nt, Human
guccugaucagagccgu

SEQ ID NO: 1358821 - RNA, 21 nt, Human
aacauuacucugaaauuguaa

SEQ ID NO: 1358822 - RNA, 20 nt, Human
guccugcaccggggccuggg

SEQ ID NO: 1358823 - RNA, 19 nt, Human
guccugcaccggggccugg

SEQ ID NO: 1358824 - RNA, 15 nt, Human
guccugcaccggggc

SEQ ID NO: 1358825 - RNA, 21 nt, Human
guccuugugaugugcacguaa

SEQ ID NO: 1358826 - RNA, 14 nt, Human
guccuuggccugcu

SEQ ID NO: 1358827 - RNA, 20 nt, Human
guccuuggcaggcugauuuc

SEQ ID NO: 1358828 - RNA, 22 nt, Human
guccugccuguggcgccgucuc

SEQ ID NO: 1358829 - RNA, 16 nt, Human
gucgaaagcucuagaa

SEQ ID NO: 1358830 - RNA, 20 nt, Human
guccuuuuuccucuccacac

SEQ ID NO: 1358831 - RNA, 19 nt, Human
guccuuuuuuuccaucuuu

SEQ ID NO: 1358832 - RNA, 16 nt, Human
guccuuuuuuuccauc

SEQ ID NO: 1358833 - RNA, 16 nt, Human
guccuuuuuccucucc

SEQ ID NO: 1358834 - RNA, 22 nt, Human
gucgagaaagaggcaccaggaa

SEQ ID NO: 1358835 - RNA, 20 nt, Human
gucgcccaggcuggagugca

SEQ ID NO: 1358836 - RNA, 13 nt, Human
gucgccaggcuag

SEQ ID NO: 1358837 - RNA, 22 nt, Human
gucuaucaaccccagacacugg

SEQ ID NO: 1358838 - RNA, 23 nt, Human
gucuaucaaccccagacacuggu

SEQ ID NO: 1358839 - RNA, 21 nt, Human
gucuaucaaccccagacacug

SEQ ID NO: 1358840 - RNA, 20 nt, Human
gucuauaaagcauuuaaccc

SEQ ID NO: 1358841 - RNA, 15 nt, Human
gucuauaaagcauuu

SEQ ID NO: 1358842 - RNA, 15 nt, Human
gucuacuugcucagg

SEQ ID NO: 1358843 - RNA, 14 nt, Human
gucgcccuggacug

SEQ ID NO: 1358844 - RNA, 20 nt, Human
gucgcccaugcuggagugca

SEQ ID NO: 1358845 - RNA, 18 nt, Human
gucgcccuggacugugug

SEQ ID NO: 1358846 - RNA, 16 nt, Human
aagaaaaauaaagaaa

SEQ ID NO: 1358847 - RNA, 15 nt, Human
aagaaaaauaaagaa

SEQ ID NO: 1358848 - RNA, 14 nt, Human
aagaaaaauaaaga

SEQ ID NO: 1358849 - RNA, 22 nt, Human
aagaaaaaggaugcacagaguu

SEQ ID NO: 1358850 - RNA, 20 nt, Human
aagaaaaaggaugcacagag

SEQ ID NO: 1358851 - RNA, 19 nt, Human
aacuugugucccuaaugug

SEQ ID NO: 1358852 - RNA, 16 nt, Human
aacuugugcccucccu

SEQ ID NO: 1358853 - RNA, 20 nt, Human
aagaaaauaagagcucagga

SEQ ID NO: 1358854 - RNA, 22 nt, Human
aagaaaagguucuuacugcuug

SEQ ID NO: 1358855 - RNA, 23 nt, Human
aagaaaagaugcacuuugcuuua

SEQ ID NO: 1358856 - RNA, 11 nt, Human
aagaaaagaug

SEQ ID NO: 1358857 - RNA, 13 nt, Human
aagaaaacaucuu

SEQ ID NO: 1358858 - RNA, 17 nt, Human
aagaaaacaucuuuaag

SEQ ID NO: 1358859 - RNA, 16 nt, Human
aagaagggacugagag

SEQ ID NO: 1358860 - RNA, 23 nt, Human
aagaaggcaucgucaugcacagu

SEQ ID NO: 1358861 - RNA, 24 nt, Human
aagaagcccggcuccuggucaccu

SEQ ID NO: 1358862 - RNA, 19 nt, Human
aagaagcccggcuccuggu

SEQ ID NO: 1358863 - RNA, 17 nt, Human
aagaagcccggcuccug

SEQ ID NO: 1358864 - RNA, 19 nt, Human
aagaagcccccagcuaaga

SEQ ID NO: 1358865 - RNA, 16 nt, Human
aagaagcccccagcua

SEQ ID NO: 1358866 - RNA, 15 nt, Human
aagaagcccccagcu

SEQ ID NO: 1358867 - RNA, 19 nt, Human
aagaagccacagaccuagg

SEQ ID NO: 1358868 - RNA, 22 nt, Human
aagaagcauuuuguaaguugaa

SEQ ID NO: 1358869 - RNA, 22 nt, Human
aagaagcaguggccuuauugca

SEQ ID NO: 1358870 - RNA, 16 nt, Human
aagaaaauuacaaaaa

SEQ ID NO: 1358871 - RNA, 15 nt, Human
aagaaaaucuuuaua

SEQ ID NO: 1358872 - RNA, 13 nt, Human
aagaaaaucacuu

SEQ ID NO: 1358873 - RNA, 13 nt, Human
aagaaaauaucac

SEQ ID NO: 1358874 - RNA, 15 nt, Human
aagaaauaaguuuuu

SEQ ID NO: 1358875 - RNA, 23 nt, Human
aagaaauaaaaggaagccaaaga

SEQ ID NO: 1358876 - RNA, 21 nt, Human
aagaaauaaaaggaagccaaa

SEQ ID NO: 1358877 - RNA, 18 nt, Human
aagaaaguguauuuggaa

SEQ ID NO: 1358878 - RNA, 15 nt, Human
aagaaaguguauuug

SEQ ID NO: 1358879 - RNA, 12 nt, Human
aagaaaguguau

SEQ ID NO: 1358880 - RNA, 13 nt, Human
aagaaaguccacc

SEQ ID NO: 1358881 - RNA, 16 nt, Human
aagaaagucagccaua

SEQ ID NO: 1358882 - RNA, 20 nt, Human
aagaaaggcuguuaaauaca

SEQ ID NO: 1358883 - RNA, 23 nt, Human
aagaaaggaagcauuguaaaaua

SEQ ID NO: 1358884 - RNA, 19 nt, Human
aagaaaauuuuuguaguag

SEQ ID NO: 1358885 - RNA, 20 nt, Human
aagaaaggaagcauuguaaa

SEQ ID NO: 1358886 - RNA, 21 nt, Human
gugccugacacacuaaccaag

SEQ ID NO: 1358887 - RNA, 14 nt, Human
gugccaauuucaag

SEQ ID NO: 1358888 - RNA, 22 nt, Human
gugccaaguccagguccuggug

SEQ ID NO: 1358889 - RNA, 18 nt, Human
aacuugcuuaucaacuuc

SEQ ID NO: 1358890 - RNA, 14 nt, Human
aacuuggaaauagu

SEQ ID NO: 1358891 - RNA, 17 nt, Human
aacuuggauacuuggau

SEQ ID NO: 1358892 - RNA, 22 nt, Human
aacuugguuuugcuacauaauu

SEQ ID NO: 1358893 - RNA, 16 nt, Human
aacuugguuuugcuac

SEQ ID NO: 1358894 - RNA, 21 nt, Human
aacuugguuuugcuacauaau

SEQ ID NO: 1358895 - RNA, 20 nt, Human
aacuuguaauuuuuuuaauu

SEQ ID NO: 1358896 - RNA, 15 nt, Human
aacuuguauuaugug

SEQ ID NO: 1358897 - RNA, 23 nt, Human
gugcacguaaaguacuuguaguu

SEQ ID NO: 1358898 - RNA, 22 nt, Human
aacugcaugcccagagacccag

SEQ ID NO: 1358899 - RNA, 18 nt, Human
aacugcaugcccagagac

SEQ ID NO: 1358900 - RNA, 17 nt, Human
aacugcaugcccagaga

SEQ ID NO: 1358901 - RNA, 16 nt, Human
aacugcauacacuuuu

SEQ ID NO: 1358902 - RNA, 23 nt, Human
aacugcagggaaaauuauuugca

SEQ ID NO: 1358903 - RNA, 14 nt, Human
aacugcagggaaaa

SEQ ID NO: 1358904 - RNA, 23 nt, Human
aacugcaggcccuggccuccccu

SEQ ID NO: 1358905 - RNA, 21 nt, Human
gugccaaguccagguccuggu

SEQ ID NO: 1358906 - RNA, 20 nt, Human
gugccaaguccagguccugg

SEQ ID NO: 1358907 - RNA, 19 nt, Human
gugccaaguccagguccug

SEQ ID NO: 1358908 - RNA, 18 nt, Human
gugccaaguccagguccu

SEQ ID NO: 1358909 - RNA, 19 nt, Human
gugcauuuggagggaguga

SEQ ID NO: 1358910 - RNA, 15 nt, Human
gugcauuuggugguu

SEQ ID NO: 1358911 - RNA, 22 nt, Human
gugcacuaauguguaagacaaa

SEQ ID NO: 1358912 - RNA, 20 nt, Human
gugcacuaauguguaagaca

SEQ ID NO: 1358913 - RNA, 21 nt, Human
gugcauuugaggucuguucuu

SEQ ID NO: 1358914 - RNA, 22 nt, Human
gugcauuugaggucuguucuuu

SEQ ID NO: 1358915 - RNA, 14 nt, Human
aagaaguaaaagca

SEQ ID NO: 1358916 - RNA, 22 nt, Human
aagaaguaaaagcaaaaaagaa

SEQ ID NO: 1358917 - RNA, 14 nt, Human
aagaaggugaauag

SEQ ID NO: 1358918 - RNA, 17 nt, Human
aagaagggacugagaga

SEQ ID NO: 1358919 - RNA, 16 nt, Human
aagaagggcugguauu

SEQ ID NO: 1358920 - RNA, 18 nt, Human
gugcuggaauucuaacaa

SEQ ID NO: 1358921 - RNA, 16 nt, Human
gugcugcugugugcuu

SEQ ID NO: 1358922 - RNA, 15 nt, Human
gugcugcugugugcu

SEQ ID NO: 1358923 - RNA, 18 nt, Human
gugcuggagguuggaucu

SEQ ID NO: 1358924 - RNA, 16 nt, Human
gugcugggccccugcc

SEQ ID NO: 1358925 - RNA, 19 nt, Human
gugcugggccccugccucu

SEQ ID NO: 1358926 - RNA, 19 nt, Human
gugcuggggccugguuccc

SEQ ID NO: 1358927 - RNA, 20 nt, Human
gugcuggucccggggccagc

SEQ ID NO: 1358928 - RNA, 15 nt, Human
gugcuggggccuggu

SEQ ID NO: 1358929 - RNA, 13 nt, Human
gugcuguauaaaa

SEQ ID NO: 1358930 - RNA, 15 nt, Human
gugcuguauaaaauc

SEQ ID NO: 1358931 - RNA, 16 nt, Human
guggaacugcugccac

SEQ ID NO: 1358932 - RNA, 16 nt, Human
gugcuguauaaaauca

SEQ ID NO: 1358933 - RNA, 17 nt, Human
gugcuguauaaaaucag

SEQ ID NO: 1358934 - RNA, 21 nt, Human
gugcuguauaaaaucagccaa

SEQ ID NO: 1358935 - RNA, 14 nt, Human
guggaagcuugggg

SEQ ID NO: 1358936 - RNA, 19 nt, Human
guggaagcuuggggaagac

SEQ ID NO: 1358937 - RNA, 16 nt, Human
guggacacacacagac

SEQ ID NO: 1358938 - RNA, 16 nt, Human
guggaagcuuggggaa

SEQ ID NO: 1358939 - RNA, 11 nt, Human
guggacaccug

SEQ ID NO: 1358940 - RNA, 12 nt, Human
guggacaccugc

SEQ ID NO: 1358941 - RNA, 13 nt, Human
guggacaccugcc

SEQ ID NO: 1358942 - RNA, 14 nt, Human
guggacaccugccc

SEQ ID NO: 1358943 - RNA, 16 nt, Human
guggacaccugcccug

SEQ ID NO: 1358944 - RNA, 17 nt, Human
guggacaccugcccugc

SEQ ID NO: 1358945 - RNA, 18 nt, Human
guggacaccugcccugcc

SEQ ID NO: 1358946 - RNA, 19 nt, Human
guggacaccugcccugccc

SEQ ID NO: 1358947 - RNA, 15 nt, Human
guggacuaaaagaua

SEQ ID NO: 1358948 - RNA, 23 nt, Human
guggacuaaaagauauaagugcu

SEQ ID NO: 1358949 - RNA, 16 nt, Human
guggcacaggcccccu

SEQ ID NO: 1358950 - RNA, 18 nt, Human
guggcacuggggcagggg

SEQ ID NO: 1358951 - RNA, 17 nt, Human
guggcacuggggcaggg

SEQ ID NO: 1358952 - RNA, 15 nt, Human
guggcagaguuacag

SEQ ID NO: 1358953 - RNA, 12 nt, Human
guggcacaggcc

SEQ ID NO: 1358954 - RNA, 19 nt, Human
guggcaagugaauuugccu

SEQ ID NO: 1358955 - RNA, 22 nt, Human
guggcaaagccuucauugccuu

SEQ ID NO: 1358956 - RNA, 23 nt, Human
guggauuuaacagaaauguacag

SEQ ID NO: 1358957 - RNA, 12 nt, Human
guggacucuggu

SEQ ID NO: 1358958 - RNA, 21 nt, Human
guggacuagaccuccagcugu

SEQ ID NO: 1358959 - RNA, 21 nt, Human
guggacucagggcagcgccag

SEQ ID NO: 1358960 - RNA, 16 nt, Human
guggacucagggcagc

SEQ ID NO: 1358961 - RNA, 15 nt, Human
guggacucagggcag

SEQ ID NO: 1358962 - RNA, 14 nt, Human
guggacucagggca

SEQ ID NO: 1358963 - RNA, 20 nt, Human
guggacugagugggaagccc

SEQ ID NO: 1358964 - RNA, 18 nt, Human
guggacugagugggaagc

SEQ ID NO: 1358965 - RNA, 17 nt, Human
guggacugagugggaag

SEQ ID NO: 1358966 - RNA, 21 nt, Human
guggauuuaacagaaauguac

SEQ ID NO: 1358967 - RNA, 12 nt, Human
aagaauguuaag

SEQ ID NO: 1358968 - RNA, 12 nt, Human
aagaaucagaga

SEQ ID NO: 1358969 - RNA, 19 nt, Human
aagaauguuaagacuugac

SEQ ID NO: 1358970 - RNA, 23 nt, Human
aagaaucagagaaggaacauacc

SEQ ID NO: 1358971 - RNA, 21 nt, Human
aagaaucacaauaauuuucua

SEQ ID NO: 1358972 - RNA, 19 nt, Human
aagaauaucuguaauggua

SEQ ID NO: 1358973 - RNA, 17 nt, Human
aagaauaucuguaaugg

SEQ ID NO: 1358974 - RNA, 20 nt, Human
aagaauaucuguaaugguac

SEQ ID NO: 1358975 - RNA, 16 nt, Human
aagaauaucuggcaaa

SEQ ID NO: 1358976 - RNA, 19 nt, Human
guggcagcaacggcacagc

SEQ ID NO: 1358977 - RNA, 13 nt, Human
guggcagcaacaa

SEQ ID NO: 1358978 - RNA, 16 nt, Human
aagacaaaaagcuacu

SEQ ID NO: 1358979 - RNA, 14 nt, Human
aagaauuauuuugu

SEQ ID NO: 1358980 - RNA, 16 nt, Human
aagaauuauuuugaug

SEQ ID NO: 1358981 - RNA, 11 nt, Human
aagaauuauuu

SEQ ID NO: 1358982 - RNA, 18 nt, Human
aagaauguuaagacuuga

SEQ ID NO: 1358983 - RNA, 24 nt, Human
aagaauuucuaggacugaauuaug

SEQ ID NO: 1358984 - RNA, 13 nt, Human
aagagcucaggau

SEQ ID NO: 1358985 - RNA, 12 nt, Human
aagagcucagga

SEQ ID NO: 1358986 - RNA, 20 nt, Human
aagagcuacguauuuaauag

SEQ ID NO: 1358987 - RNA, 23 nt, Human
guggccccacccugggcccuggg

SEQ ID NO: 1358988 - RNA, 21 nt, Human
guggccccacccugggcccug

SEQ ID NO: 1358989 - RNA, 17 nt, Human
guggccccguuucuggu

SEQ ID NO: 1358990 - RNA, 16 nt, Human
guggccccguuucugg

SEQ ID NO: 1358991 - RNA, 22 nt, Human
aagacuggcuuuuauuaaugca

SEQ ID NO: 1358992 - RNA, 15 nt, Human
aagagauuccugagc

SEQ ID NO: 1358993 - RNA, 23 nt, Human
aagacuggcuuuuauuaaugcac

SEQ ID NO: 1358994 - RNA, 11 nt, Human
aagacuggcuu

SEQ ID NO: 1358995 - RNA, 22 nt, Human
aagacugcuguggccaggaggu

SEQ ID NO: 1358996 - RNA, 23 nt, Human
aagacuggaagcuaauuugcauu

SEQ ID NO: 1358997 - RNA, 22 nt, Human
aagacuggaagcuaauuugcau

SEQ ID NO: 1358998 - RNA, 20 nt, Human
aagacuggaagcuaauuugc

SEQ ID NO: 1358999 - RNA, 21 nt, Human
aagacugcuguggccaggagg

SEQ ID NO: 1359000 - RNA, 20 nt, Human
aagacugcuguggccaggag

SEQ ID NO: 1359001 - RNA, 19 nt, Human
aagacugcuguggccagga

SEQ ID NO: 1359002 - RNA, 18 nt, Human
aagacugcuguggccagg

SEQ ID NO: 1359003 - RNA, 14 nt, Human
aagacuccuagcug

SEQ ID NO: 1359004 - RNA, 12 nt, Human
aagacucauccg

SEQ ID NO: 1359005 - RNA, 11 nt, Human
aagacucaucc

SEQ ID NO: 1359006 - RNA, 10 nt, Human
aagacucauc

SEQ ID NO: 1359007 - RNA, 19 nt, Human
aagacucaaauguucuaag

SEQ ID NO: 1359008 - RNA, 18 nt, Human
aagacucaaauguucuaa

SEQ ID NO: 1359009 - RNA, 17 nt, Human
aagacucaaauguucua

SEQ ID NO: 1359010 - RNA, 16 nt, Human
aagacucaaauguucu

SEQ ID NO: 1359011 - RNA, 14 nt, Human
aagacucaaauguu

SEQ ID NO: 1359012 - RNA, 15 nt, Human
aagaccccuaacccu

SEQ ID NO: 1359013 - RNA, 15 nt, Human
aagacccccagcacu

SEQ ID NO: 1359014 - RNA, 13 nt, Human
aagacccccagca

SEQ ID NO: 1359015 - RNA, 23 nt, Human
gugggauguucagcacugucccu

SEQ ID NO: 1359016 - RNA, 14 nt, Human
gugggagccucgca

SEQ ID NO: 1359017 - RNA, 12 nt, Human
gugggagccucg

SEQ ID NO: 1359018 - RNA, 11 nt, Human
gugggagccuc

SEQ ID NO: 1359019 - RNA, 13 nt, Human
gugggagccucgc

SEQ ID NO: 1359020 - RNA, 19 nt, Human
gugggagcaaacugcaugc

SEQ ID NO: 1359021 - RNA, 23 nt, Human
gugggagaccggccugccaggag

SEQ ID NO: 1359022 - RNA, 22 nt, Human
gugggagaccggccugccagga

SEQ ID NO: 1359023 - RNA, 21 nt, Human
gugggagaccggccugccagg

SEQ ID NO: 1359024 - RNA, 20 nt, Human
gugggagcaaacugcaugcc

SEQ ID NO: 1359025 - RNA, 23 nt, Human
gugggagcaaacugcaugcccag

SEQ ID NO: 1359026 - RNA, 16 nt, Human
gugggaaaugguacug

SEQ ID NO: 1359027 - RNA, 23 nt, Human
gugggaaagauuacuuuuucuuu

SEQ ID NO: 1359028 - RNA, 19 nt, Human
guggcuuuaggagcagugg

SEQ ID NO: 1359029 - RNA, 17 nt, Human
guggcuuucagagccuc

SEQ ID NO: 1359030 - RNA, 22 nt, Human
guggcuugagaaauauggacac

SEQ ID NO: 1359031 - RNA, 23 nt, Human
guggccucagcucccacaagccu

SEQ ID NO: 1359032 - RNA, 23 nt, Human
guggccccguuucugguggucug

SEQ ID NO: 1359033 - RNA, 13 nt, Human
gugguggccuggu

SEQ ID NO: 1359034 - RNA, 18 nt, Human
gugguggccuggucccug

SEQ ID NO: 1359035 - RNA, 16 nt, Human
gugguggcacaggccc

SEQ ID NO: 1359036 - RNA, 22 nt, Human
gugguggaaacuuuucuuaaaa

SEQ ID NO: 1359037 - RNA, 23 nt, Human
guggugugucccccucuguccag

SEQ ID NO: 1359038 - RNA, 15 nt, Human
guggugucagacccu

SEQ ID NO: 1359039 - RNA, 22 nt, Human
guggguccaugggcagagccca

SEQ ID NO: 1359040 - RNA, 20 nt, Human
guggguccaugggcagagcc

SEQ ID NO: 1359041 - RNA, 18 nt, Human
guggguccaugggcagag

SEQ ID NO: 1359042 - RNA, 16 nt, Human
guggguauaaaagaug

SEQ ID NO: 1359043 - RNA, 12 nt, Human
guggguauaaaa

SEQ ID NO: 1359044 - RNA, 13 nt, Human
guggguauaaaag

SEQ ID NO: 1359045 - RNA, 15 nt, Human
guggguauaaaagau

SEQ ID NO: 1359046 - RNA, 22 nt, Human
guggggguagggggcuggagga

SEQ ID NO: 1359047 - RNA, 19 nt, Human
guggggguagggggcugga

SEQ ID NO: 1359048 - RNA, 19 nt, Human
guggggggucccaaagagu

SEQ ID NO: 1359049 - RNA, 22 nt, Human
gugggauuaugggucacaggaa

SEQ ID NO: 1359050 - RNA, 24 nt, Human
gugggauguucagcacugucccuu

SEQ ID NO: 1359051 - RNA, 18 nt, Human
guggggggggugcugggc

SEQ ID NO: 1359052 - RNA, 23 nt, Human
aagaucacuuucucaguuuucau

SEQ ID NO: 1359053 - RNA, 17 nt, Human
aagaucacuuucucagu

SEQ ID NO: 1359054 - RNA, 15 nt, Human
aagaucacuuucuca

SEQ ID NO: 1359055 - RNA, 12 nt, Human
aagaucaauaaa

SEQ ID NO: 1359056 - RNA, 22 nt, Human
aagauccuagauccuaaggguc

SEQ ID NO: 1359057 - RNA, 17 nt, Human
aagauauuuugcuuugu

SEQ ID NO: 1359058 - RNA, 20 nt, Human
aagauauuuugcuuugugau

SEQ ID NO: 1359059 - RNA, 22 nt, Human
aagauauuuugcuuugugauuu

SEQ ID NO: 1359060 - RNA, 16 nt, Human
aagaugcacuuugcuu

SEQ ID NO: 1359061 - RNA, 15 nt, Human
aagaugacugagggu

SEQ ID NO: 1359062 - RNA, 14 nt, Human
aagaugacugaggg

SEQ ID NO: 1359063 - RNA, 13 nt, Human
aagaugacugagg

SEQ ID NO: 1359064 - RNA, 13 nt, Human
aagaugaucauuu

SEQ ID NO: 1359065 - RNA, 19 nt, Human
aagcaaaucauuuguuuaa

SEQ ID NO: 1359066 - RNA, 16 nt, Human
aagcaaaucauuuguu

SEQ ID NO: 1359067 - RNA, 14 nt, Human
aagcaaaucauuug

SEQ ID NO: 1359068 - RNA, 21 nt, Human
aagcaaacucuaaaauuauaa

SEQ ID NO: 1359069 - RNA, 22 nt, Human
aagcaaaauuauagaaguuuag

SEQ ID NO: 1359070 - RNA, 19 nt, Human
aagcaaaauuuuuucucua

SEQ ID NO: 1359071 - RNA, 19 nt, Human
aagcaaaugucaugcugcc

SEQ ID NO: 1359072 - RNA, 16 nt, Human
aagcaaaugucaugcu

SEQ ID NO: 1359073 - RNA, 18 nt, Human
aagcaaaucgaaugaaau

SEQ ID NO: 1359074 - RNA, 17 nt, Human
aagcaaaucgaaugaaa

SEQ ID NO: 1359075 - RNA, 13 nt, Human
aagcaaaugugaa

SEQ ID NO: 1359076 - RNA, 14 nt, Human
aagcaaaugugaau

SEQ ID NO: 1359077 - RNA, 20 nt, Human
aagcaaaugugaaucauuuu

SEQ ID NO: 1359078 - RNA, 16 nt, Human
aagcaagauuucagau

SEQ ID NO: 1359079 - RNA, 17 nt, Human
gugugaggccagggcag

SEQ ID NO: 1359080 - RNA, 15 nt, Human
gugugaggccagggc

SEQ ID NO: 1359081 - RNA, 14 nt, Human
gugugaggccaggg

SEQ ID NO: 1359082 - RNA, 12 nt, Human
gugugaggccag

SEQ ID NO: 1359083 - RNA, 23 nt, Human
gugucuugggcagagcuggcucu

SEQ ID NO: 1359084 - RNA, 20 nt, Human
gugucuugggcagagcuggc

SEQ ID NO: 1359085 - RNA, 17 nt, Human
gugucuugggcagagcu

SEQ ID NO: 1359086 - RNA, 16 nt, Human
gugucuugggcagagc

SEQ ID NO: 1359087 - RNA, 21 nt, Human
guguccaugcgcucagggcca

SEQ ID NO: 1359088 - RNA, 20 nt, Human
guguccaugcgcucagggcc

SEQ ID NO: 1359089 - RNA, 19 nt, Human
guguccaugcgcucagggc

SEQ ID NO: 1359090 - RNA, 18 nt, Human
guguccaugcgcucaggg

SEQ ID NO: 1359091 - RNA, 16 nt, Human
aagcaaguauuagaau

SEQ ID NO: 1359092 - RNA, 19 nt, Human
aagcaagcugauuaaauga

SEQ ID NO: 1359093 - RNA, 18 nt, Human
guguccacgacugucucc

SEQ ID NO: 1359094 - RNA, 20 nt, Human
aagcaaguaaaaaggcuaaa

SEQ ID NO: 1359095 - RNA, 19 nt, Human
aagcaagcauucagaagaa

SEQ ID NO: 1359096 - RNA, 15 nt, Human
aagcaagcauucaga

SEQ ID NO: 1359097 - RNA, 15 nt, Human
aagcaagcaagaggc

SEQ ID NO: 1359098 - RNA, 14 nt, Human
aagcaagcaagagg

SEQ ID NO: 1359099 - RNA, 22 nt, Human
aagcaaaugucaugcugccuua

SEQ ID NO: 1359100 - RNA, 21 nt, Human
aagcaaaugucaugcugccuu

SEQ ID NO: 1359101 - RNA, 20 nt, Human
aagcaaaugucaugcugccu

SEQ ID NO: 1359102 - RNA, 13 nt, Human
aagcaagcuuaau

SEQ ID NO: 1359103 - RNA, 21 nt, Human
aagcaagcauucagaagaaaa

SEQ ID NO: 1359104 - RNA, 19 nt, Human
aagcaaguaaaaaggcuaa

SEQ ID NO: 1359105 - RNA, 13 nt, Human
gugugugugaaug

SEQ ID NO: 1359106 - RNA, 15 nt, Human
guguguguauauaua

SEQ ID NO: 1359107 - RNA, 16 nt, Human
guguugaaaauguuca

SEQ ID NO: 1359108 - RNA, 13 nt, Human
guguucuguuuug

SEQ ID NO: 1359109 - RNA, 15 nt, Human
guguucuguuuuguu

SEQ ID NO: 1359110 - RNA, 14 nt, Human
guguguugauacug

SEQ ID NO: 1359111 - RNA, 17 nt, Human
guguguuaagcucugcu

SEQ ID NO: 1359112 - RNA, 16 nt, Human
guguguuaagcucugc

SEQ ID NO: 1359113 - RNA, 21 nt, Human
guguuuaaaguucaacauguu

SEQ ID NO: 1359114 - RNA, 12 nt, Human
guguuuaaaacu

SEQ ID NO: 1359115 - RNA, 14 nt, Human
guguugauacuguu

SEQ ID NO: 1359116 - RNA, 13 nt, Human
guguugauacugu

SEQ ID NO: 1359117 - RNA, 22 nt, Human
guguugagcaucugucccccuu

SEQ ID NO: 1359118 - RNA, 19 nt, Human
guguugagccuuuucccuc

SEQ ID NO: 1359119 - RNA, 17 nt, Human
guguugaaaauguucag

SEQ ID NO: 1359120 - RNA, 18 nt, Human
aaguuauuaauuucuuca

SEQ ID NO: 1359121 - RNA, 17 nt, Human
aaguuauuaauuucuuc

SEQ ID NO: 1359122 - RNA, 20 nt, Human
aaguuacauguuugcaccuu

SEQ ID NO: 1359123 - RNA, 19 nt, Human
aaguuacauguuugcaccu

SEQ ID NO: 1359124 - RNA, 16 nt, Human
aaguuacauguuugca

SEQ ID NO: 1359125 - RNA, 17 nt, Human
aaguuaaauguagaguu

SEQ ID NO: 1359126 - RNA, 13 nt, Human
aaguuaaauguag

SEQ ID NO: 1359127 - RNA, 14 nt, Human
aaguguuuucucug

SEQ ID NO: 1359128 - RNA, 22 nt, Human
aaguguuuucucugaacacauu

SEQ ID NO: 1359129 - RNA, 13 nt, Human
aaguguuuucucu

SEQ ID NO: 1359130 - RNA, 23 nt, Human
aaguguuucauaaauuugagagu

SEQ ID NO: 1359131 - RNA, 14 nt, Human
aaguguucauuguu

SEQ ID NO: 1359132 - RNA, 22 nt, Human
aaguguuagccuuuuuucccca

SEQ ID NO: 1359133 - RNA, 23 nt, Human
aaguguuagccuuuuuuccccag

SEQ ID NO: 1359134 - RNA, 16 nt, Human
guuuuuuuuuuguuug

SEQ ID NO: 1359135 - RNA, 21 nt, Human
guuuuuuuuuucuugucuaua

SEQ ID NO: 1359136 - RNA, 18 nt, Human
guuuuuuuuuucuugucu

SEQ ID NO: 1359137 - RNA, 17 nt, Human
guuuuuuuuuuguuugu

SEQ ID NO: 1359138 - RNA, 17 nt, Human
guuuuuuuuuucuuguc

SEQ ID NO: 1359139 - RNA, 17 nt, Human
guuuuuuuuuaaagacu

SEQ ID NO: 1359140 - RNA, 23 nt, Human
aaguuauugcaguuuaucauuca

SEQ ID NO: 1359141 - RNA, 17 nt, Human
aaguuauugcaguuuau

SEQ ID NO: 1359142 - RNA, 15 nt, Human
aaguuauugcaguuu

SEQ ID NO: 1359143 - RNA, 14 nt, Human
aaguuauugcaguu

SEQ ID NO: 1359144 - RNA, 21 nt, Human
aaguucuaauaauuucuaaug

SEQ ID NO: 1359145 - RNA, 19 nt, Human
aaguucuaauaauuucuaa

SEQ ID NO: 1359146 - RNA, 18 nt, Human
aaguucuaauaauuucua

SEQ ID NO: 1359147 - RNA, 17 nt, Human
aaguucuaauaauuucu

SEQ ID NO: 1359148 - RNA, 17 nt, Human
aaguucuaagauucuga

SEQ ID NO: 1359149 - RNA, 16 nt, Human
aaguucuaagauucug

SEQ ID NO: 1359150 - RNA, 21 nt, Human
aaguucuaagauucuaaugau

SEQ ID NO: 1359151 - RNA, 20 nt, Human
aaguucuaagauucuaauga

SEQ ID NO: 1359152 - RNA, 19 nt, Human
aaguucuaagauucuaaug

SEQ ID NO: 1359153 - RNA, 18 nt, Human
aaguucuaagauucuaau

SEQ ID NO: 1359154 - RNA, 16 nt, Human
aaguucuaagauucua

SEQ ID NO: 1359155 - RNA, 15 nt, Human
aaguucuaagauucu

SEQ ID NO: 1359156 - RNA, 14 nt, Human
aaguucuaagauuc

SEQ ID NO: 1359157 - RNA, 12 nt, Human
aaguucuaagau

SEQ ID NO: 1359158 - RNA, 21 nt, Human
aaguuccaagagucuaaagau

SEQ ID NO: 1359159 - RNA, 20 nt, Human
aaguuccaagagucuaaaga

SEQ ID NO: 1359160 - RNA, 17 nt, Human
aaguuccaagagucuaa

SEQ ID NO: 1359161 - RNA, 16 nt, Human
aaguuccaagagucua

SEQ ID NO: 1359162 - RNA, 15 nt, Human
aaguuccaagagucu

SEQ ID NO: 1359163 - RNA, 21 nt, Human
aaguuuagccccugaaagcca

SEQ ID NO: 1359164 - RNA, 17 nt, Human
aaguuuagauuuuaauc

SEQ ID NO: 1359165 - RNA, 16 nt, Human
aaguuuaccagaaagc

SEQ ID NO: 1359166 - RNA, 20 nt, Human
aaguuuaauggugccuucau

SEQ ID NO: 1359167 - RNA, 13 nt, Human
uaaaauuacaacu

SEQ ID NO: 1359168 - RNA, 15 nt, Human
uaaaauuacaacuaa

SEQ ID NO: 1359169 - RNA, 17 nt, Human
uaaaauuacaacuaagu

SEQ ID NO: 1359170 - RNA, 19 nt, Human
uaaaauuacaacuaaguga

SEQ ID NO: 1359171 - RNA, 20 nt, Human
uaaaauuuguucuuguauuu

SEQ ID NO: 1359172 - RNA, 15 nt, Human
uaaaauuuguugcau

SEQ ID NO: 1359173 - RNA, 14 nt, Human
uaaaauuuguugca

SEQ ID NO: 1359174 - RNA, 13 nt, Human
uaaaauuauuuca

SEQ ID NO: 1359175 - RNA, 17 nt, Human
uaaaauuuuuaaucuuu

SEQ ID NO: 1359176 - RNA, 13 nt, Human
uaaacaaagguug

SEQ ID NO: 1359177 - RNA, 22 nt, Human
uaaacaaacuguguaacugccc

SEQ ID NO: 1359178 - RNA, 19 nt, Human
uaaacaaacuguguaacug

SEQ ID NO: 1359179 - RNA, 18 nt, Human
uaaacaaacuguguaacu

SEQ ID NO: 1359180 - RNA, 13 nt, Human
uaaaccaucuccc

SEQ ID NO: 1359181 - RNA, 20 nt, Human
uaaaccacugaaaaaauaua

SEQ ID NO: 1359182 - RNA, 13 nt, Human
uaaaccacugaaa

SEQ ID NO: 1359183 - RNA, 19 nt, Human
uaaaauuuuuaaucuuuaa

SEQ ID NO: 1359184 - RNA, 16 nt, Human
uaaaauuuuuuuagaa

SEQ ID NO: 1359185 - RNA, 17 nt, Human
uaaaauuuuuuuagaaa

SEQ ID NO: 1359186 - RNA, 18 nt, Human
uaaaauuuuuuuagaaag

SEQ ID NO: 1359187 - RNA, 19 nt, Human
uaaaauuuuuuuagaaagc

SEQ ID NO: 1359188 - RNA, 20 nt, Human
uaaaauuuuuuuagaaagca

SEQ ID NO: 1359189 - RNA, 21 nt, Human
uaaaauuuuuuuagaaagcau

SEQ ID NO: 1359190 - RNA, 22 nt, Human
uaaaauguucacuuuugacaaa

SEQ ID NO: 1359191 - RNA, 17 nt, Human
uaaaauguucacuuuug

SEQ ID NO: 1359192 - RNA, 23 nt, Human
uaaaauguguuguuccaaauacu

SEQ ID NO: 1359193 - RNA, 23 nt, Human
aaguuuuauauauuauauggaaa

SEQ ID NO: 1359194 - RNA, 21 nt, Human
aaguuuuauauauuauaugga

SEQ ID NO: 1359195 - RNA, 17 nt, Human
aaguuuuauauauuaua

SEQ ID NO: 1359196 - RNA, 16 nt, Human
aaguuuuauauauuau

SEQ ID NO: 1359197 - RNA, 15 nt, Human
aaguuuuauauauua

SEQ ID NO: 1359198 - RNA, 14 nt, Human
aaguuuuauauauu

SEQ ID NO: 1359199 - RNA, 13 nt, Human
aaguuuuauauau

SEQ ID NO: 1359200 - RNA, 19 nt, Human
aaguuuuaaaaagccaguu

SEQ ID NO: 1359201 - RNA, 17 nt, Human
aaguuuuaaaaagccag

SEQ ID NO: 1359202 - RNA, 16 nt, Human
aaguuuguuuuugcgu

SEQ ID NO: 1359203 - RNA, 20 nt, Human
aaguuugcacuaucuuucag

SEQ ID NO: 1359204 - RNA, 21 nt, Human
aaguuugcacuaucuuucagc

SEQ ID NO: 1359205 - RNA, 19 nt, Human
aaguuugcacuaucuuuca

SEQ ID NO: 1359206 - RNA, 23 nt, Human
aaguuucauucucccuuucacua

SEQ ID NO: 1359207 - RNA, 15 nt, Human
aaguuucaucauuuu

SEQ ID NO: 1359208 - RNA, 20 nt, Human
aaguuuaucaguaaauaacu

SEQ ID NO: 1359209 - RNA, 18 nt, Human
aaguuuaucaguaaauaa

SEQ ID NO: 1359210 - RNA, 16 nt, Human
aaguuuagcucugaga

SEQ ID NO: 1359211 - RNA, 15 nt, Human
aaguuuagcucugag

SEQ ID NO: 1359212 - RNA, 14 nt, Human
aaguuuagcucuga

SEQ ID NO: 1359213 - RNA, 13 nt, Human
aaguuuagcucug

SEQ ID NO: 1359214 - RNA, 23 nt, Human
aaguuuagccccugaaagccaug

SEQ ID NO: 1359215 - RNA, 22 nt, Human
aaguuuaguuugaggaauucuu

SEQ ID NO: 1359216 - RNA, 18 nt, Human
uaaagauggaguuucuaa

SEQ ID NO: 1359217 - RNA, 17 nt, Human
uaaagauggaguuucua

SEQ ID NO: 1359218 - RNA, 19 nt, Human
uaaagaugagcuuugucua

SEQ ID NO: 1359219 - RNA, 22 nt, Human
uaaagauauuuuuaucuuuaua

SEQ ID NO: 1359220 - RNA, 21 nt, Human
uaaagauauuuuuaucuuuau

SEQ ID NO: 1359221 - RNA, 18 nt, Human
uaaagauauuuuuaucuu

SEQ ID NO: 1359222 - RNA, 23 nt, Human
uaaagagucuagauucaaagguu

SEQ ID NO: 1359223 - RNA, 23 nt, Human
uaaagauacagaacucuuucaaa

SEQ ID NO: 1359224 - RNA, 13 nt, Human
uaaagagacgaau

SEQ ID NO: 1359225 - RNA, 18 nt, Human
uaaagagucuagauucaa

SEQ ID NO: 1359226 - RNA, 15 nt, Human
uaaagagucuagauu

SEQ ID NO: 1359227 - RNA, 13 nt, Human
uaaagagucuaga

SEQ ID NO: 1359228 - RNA, 21 nt, Human
uaaagagucuagauucaaagg

SEQ ID NO: 1359229 - RNA, 19 nt, Human
uaaagagucuagauucaaa

SEQ ID NO: 1359230 - RNA, 21 nt, Human
uaaagauuuuuuaauaauuua

SEQ ID NO: 1359231 - RNA, 20 nt, Human
uaaagauuuuuuaauaauuu

SEQ ID NO: 1359232 - RNA, 17 nt, Human
uaaagauuuuuuaauaa

SEQ ID NO: 1359233 - RNA, 16 nt, Human
uaaagauuuuuuaaua

SEQ ID NO: 1359234 - RNA, 12 nt, Human
uaaagauuuuuu

SEQ ID NO: 1359235 - RNA, 13 nt, Human
uaaagauuugggu

SEQ ID NO: 1359236 - RNA, 24 nt, Human
uaaagauucuauaguucuagacau

SEQ ID NO: 1359237 - RNA, 21 nt, Human
uaaagauucuauaguucuaga

SEQ ID NO: 1359238 - RNA, 20 nt, Human
uaaagauucuauaguucuag

SEQ ID NO: 1359239 - RNA, 19 nt, Human
uaaagauucuauaguucua

SEQ ID NO: 1359240 - RNA, 22 nt, Human
uaaagauggaguuucuaagguc

SEQ ID NO: 1359241 - RNA, 21 nt, Human
uaaagauggaguuucuaaggu

SEQ ID NO: 1359242 - RNA, 19 nt, Human
uaaagauggaguuucuaag

SEQ ID NO: 1359243 - RNA, 22 nt, Human
uaaagauuuuuuaauaauuuag

SEQ ID NO: 1359244 - RNA, 10 nt, Human
uaaagcaaau

SEQ ID NO: 1359245 - RNA, 19 nt, Human
uaaaggcuaccuuuguauu

SEQ ID NO: 1359246 - RNA, 21 nt, Human
uaaaggcuaccuuuguauucu

SEQ ID NO: 1359247 - RNA, 21 nt, Human
uaaagaagaccugagaaugua

SEQ ID NO: 1359248 - RNA, 20 nt, Human
uaaagaagaccugagaaugu

SEQ ID NO: 1359249 - RNA, 16 nt, Human
uaaagaagaccugaga

SEQ ID NO: 1359250 - RNA, 12 nt, Human
uaaagaagaccu

SEQ ID NO: 1359251 - RNA, 11 nt, Human
uaaagaagacc

SEQ ID NO: 1359252 - RNA, 19 nt, Human
uaaagaacacccuauauuu

SEQ ID NO: 1359253 - RNA, 16 nt, Human
uaaagaaauagaacaa

SEQ ID NO: 1359254 - RNA, 17 nt, Human
uaaagaaauagaacaag

SEQ ID NO: 1359255 - RNA, 24 nt, Human
uaaagaaaguguauuuggaaauaa

SEQ ID NO: 1359256 - RNA, 23 nt, Human
uaaagaaaguguauuuggaaaua

SEQ ID NO: 1359257 - RNA, 20 nt, Human
uaaagaaaguguauuuggaa

SEQ ID NO: 1359258 - RNA, 14 nt, Human
uaaagacaaaaaac

SEQ ID NO: 1359259 - RNA, 18 nt, Human
uaaagaauugugguuuau

SEQ ID NO: 1359260 - RNA, 20 nt, Human
uaaagaauugugguuuauau

SEQ ID NO: 1359261 - RNA, 13 nt, Human
uaaagaauuauuu

SEQ ID NO: 1359262 - RNA, 17 nt, Human
uaaagaauaugaaacau

SEQ ID NO: 1359263 - RNA, 16 nt, Human
uaaagaauuauuuugu

SEQ ID NO: 1359264 - RNA, 15 nt, Human
uaaagaauuauuuug

SEQ ID NO: 1359265 - RNA, 16 nt, Human
uaaagacaugaagcca

SEQ ID NO: 1359266 - RNA, 13 nt, Human
uaaagacaugaag

SEQ ID NO: 1359267 - RNA, 22 nt, Human
uaaagagacagugauauuggaa

SEQ ID NO: 1359268 - RNA, 15 nt, Human
uaaagacuggcuuuu

SEQ ID NO: 1359269 - RNA, 20 nt, Human
uaaagacuggcuuuuauuaa

SEQ ID NO: 1359270 - RNA, 14 nt, Human
uaaagacuggcuuu

SEQ ID NO: 1359271 - RNA, 23 nt, Human
uaaagacguuuuauaagcaucau

SEQ ID NO: 1359272 - RNA, 21 nt, Human
uaaagacguuuuauaagcauc

SEQ ID NO: 1359273 - RNA, 16 nt, Human
uaaagacguuuuauaa

SEQ ID NO: 1359274 - RNA, 16 nt, Human
uaaagacuuuuaugau

SEQ ID NO: 1359275 - RNA, 23 nt, Human
uaaacucaaaauauuuguacaua

SEQ ID NO: 1359276 - RNA, 22 nt, Human
uaaacucaaaauauuuguacau

SEQ ID NO: 1359277 - RNA, 21 nt, Human
uaaacucaaaauauuuguaca

SEQ ID NO: 1359278 - RNA, 19 nt, Human
uaaacucaaaauauuugua

SEQ ID NO: 1359279 - RNA, 16 nt, Human
uaaacucaaaauauuu

SEQ ID NO: 1359280 - RNA, 14 nt, Human
uaaacucaaaauau

SEQ ID NO: 1359281 - RNA, 12 nt, Human
uaaacucauuuc

SEQ ID NO: 1359282 - RNA, 17 nt, Human
uaaacucauuucuagca

SEQ ID NO: 1359283 - RNA, 22 nt, Human
uaaacuaucuuggugaauuuuu

SEQ ID NO: 1359284 - RNA, 21 nt, Human
uaaacuaucuuggugaauuuu

SEQ ID NO: 1359285 - RNA, 20 nt, Human
uaaacuaucuuggugaauuu

SEQ ID NO: 1359286 - RNA, 15 nt, Human
uaaacuauaagcaag

SEQ ID NO: 1359287 - RNA, 17 nt, Human
uaaacuauaagcaagaa

SEQ ID NO: 1359288 - RNA, 17 nt, Human
uaaacuagcauaucugc

SEQ ID NO: 1359289 - RNA, 19 nt, Human
uaaacuagcauaucugccu

SEQ ID NO: 1359290 - RNA, 21 nt, Human
uaaacuagcauaucugccuuu

SEQ ID NO: 1359291 - RNA, 22 nt, Human
uaaacuagcauaucugccuuua

SEQ ID NO: 1359292 - RNA, 23 nt, Human
uaaacuagcauaucugccuuuau

SEQ ID NO: 1359293 - RNA, 15 nt, Human
uaaacucuguugcaa

SEQ ID NO: 1359294 - RNA, 17 nt, Human
uaaagaaaguguauuug

SEQ ID NO: 1359295 - RNA, 16 nt, Human
uaaagaaaguguauuu

SEQ ID NO: 1359296 - RNA, 15 nt, Human
uaaagaaaguguauu

SEQ ID NO: 1359297 - RNA, 14 nt, Human
uaaagaaaguguau

SEQ ID NO: 1359298 - RNA, 13 nt, Human
uaaagaaagugua

SEQ ID NO: 1359299 - RNA, 11 nt, Human
uaaagaaagug

SEQ ID NO: 1359300 - RNA, 17 nt, Human
uaaaccgcuaaaagaaa

SEQ ID NO: 1359301 - RNA, 16 nt, Human
uaaaccggaccaucuc

SEQ ID NO: 1359302 - RNA, 19 nt, Human
uaaaccaucucccuggugc

SEQ ID NO: 1359303 - RNA, 16 nt, Human
uaaaccaucucccugg

SEQ ID NO: 1359304 - RNA, 19 nt, Human
uaaacccaguaguggugac

SEQ ID NO: 1359305 - RNA, 22 nt, Human
uaaaccaucucccuggugcuua

SEQ ID NO: 1359306 - RNA, 23 nt, Human
uaaacccauauuguaaaacaggu

SEQ ID NO: 1359307 - RNA, 20 nt, Human
uaaaccccaccuuuauuccu

SEQ ID NO: 1359308 - RNA, 15 nt, Human
uaaacggauuccaaa

SEQ ID NO: 1359309 - RNA, 21 nt, Human
uaaacgauuuuuaaaauguac

SEQ ID NO: 1359310 - RNA, 20 nt, Human
uaaacgauuuuuaaaaugua

SEQ ID NO: 1359311 - RNA, 19 nt, Human
uaaacgauuuuuaaaaugu

SEQ ID NO: 1359312 - RNA, 18 nt, Human
uaaacgauuuuuaaaaug

SEQ ID NO: 1359313 - RNA, 17 nt, Human
uaaacgauuuuuaaaau

SEQ ID NO: 1359314 - RNA, 16 nt, Human
uaaacgauuuuuaaaa

SEQ ID NO: 1359315 - RNA, 13 nt, Human
uaaaccuuuuuug

SEQ ID NO: 1359316 - RNA, 17 nt, Human
uaaacuaauaauugcag

SEQ ID NO: 1359317 - RNA, 16 nt, Human
uaaacuaauaauugca

SEQ ID NO: 1359318 - RNA, 14 nt, Human
uaaacuaaaugugc

SEQ ID NO: 1359319 - RNA, 13 nt, Human
uaaacuaaaugug

SEQ ID NO: 1359320 - RNA, 13 nt, Human
uaaacuaaacacg

SEQ ID NO: 1359321 - RNA, 17 nt, Human
uaaacgucuuaaauauu

SEQ ID NO: 1359322 - RNA, 13 nt, Human
uaaacgucuuaaa

SEQ ID NO: 1359323 - RNA, 19 nt, Human
uaacaagaacuuuaaauug

SEQ ID NO: 1359324 - RNA, 15 nt, Human
uaacaaccaaagacu

SEQ ID NO: 1359325 - RNA, 15 nt, Human
uaacaagccagauuu

SEQ ID NO: 1359326 - RNA, 17 nt, Human
uaacaaugcuguauuuu

SEQ ID NO: 1359327 - RNA, 15 nt, Human
uaacaaugcuguauu

SEQ ID NO: 1359328 - RNA, 24 nt, Human
uaaauuuuccuguccucuuucagc

SEQ ID NO: 1359329 - RNA, 23 nt, Human
uaaauuuuccuguccucuuucag

SEQ ID NO: 1359330 - RNA, 18 nt, Human
uaaauuuuccuguccucu

SEQ ID NO: 1359331 - RNA, 16 nt, Human
uaaauuuuccuguccu

SEQ ID NO: 1359332 - RNA, 21 nt, Human
uaaauuuguacuauuuaacug

SEQ ID NO: 1359333 - RNA, 16 nt, Human
uaaauuuuuuuccuua

SEQ ID NO: 1359334 - RNA, 20 nt, Human
uaacaaaaauaaaaacucuu

SEQ ID NO: 1359335 - RNA, 20 nt, Human
uaacaaaugccaaauuaaaa

SEQ ID NO: 1359336 - RNA, 13 nt, Human
uaacaaaaauaaa

SEQ ID NO: 1359337 - RNA, 21 nt, Human
uaacaacauguuuccagcauu

SEQ ID NO: 1359338 - RNA, 20 nt, Human
uaacaacauguuuccagcau

SEQ ID NO: 1359339 - RNA, 19 nt, Human
uaacaacauguuuccagca

SEQ ID NO: 1359340 - RNA, 14 nt, Human
uaacaacauguuuc

SEQ ID NO: 1359341 - RNA, 17 nt, Human
uaaaugcaaauaacaaa

SEQ ID NO: 1359342 - RNA, 16 nt, Human
uaaaugcaaauaacaa

SEQ ID NO: 1359343 - RNA, 15 nt, Human
uaaaugcaaauaaca

SEQ ID NO: 1359344 - RNA, 19 nt, Human
uaaaugcaaccauuugaaa

SEQ ID NO: 1359345 - RNA, 17 nt, Human
uaaaugauucuuaguga

SEQ ID NO: 1359346 - RNA, 13 nt, Human
uaaaugacacuca

SEQ ID NO: 1359347 - RNA, 13 nt, Human
uaaaugaauguuu

SEQ ID NO: 1359348 - RNA, 22 nt, Human
uaaaucuccaaaauaaaacuuu

SEQ ID NO: 1359349 - RNA, 20 nt, Human
uaaaucuccaaaauaaaacu

SEQ ID NO: 1359350 - RNA, 21 nt, Human
uaaaucuccaaaauaaaacuu

SEQ ID NO: 1359351 - RNA, 22 nt, Human
uaaauuuguacuauuuaacuga

SEQ ID NO: 1359352 - RNA, 20 nt, Human
uaaauuuguacuauuuaacu

SEQ ID NO: 1359353 - RNA, 19 nt, Human
uaaauuuguacuauuuaac

SEQ ID NO: 1359354 - RNA, 14 nt, Human
uaaauuuguacuau

SEQ ID NO: 1359355 - RNA, 13 nt, Human
uaaauuuguacua

SEQ ID NO: 1359356 - RNA, 16 nt, Human
uaaauuacagaaauuu

SEQ ID NO: 1359357 - RNA, 20 nt, Human
uaaauguuuuuuuuuaaaga

SEQ ID NO: 1359358 - RNA, 23 nt, Human
uaaauguuuuuuuuuaaagacuu

SEQ ID NO: 1359359 - RNA, 15 nt, Human
uaaauaacuggaaaa

SEQ ID NO: 1359360 - RNA, 14 nt, Human
uaaauaacuggaaa

SEQ ID NO: 1359361 - RNA, 16 nt, Human
uaaauaaauuugacuu

SEQ ID NO: 1359362 - RNA, 14 nt, Human
uaaauaaauuugac

SEQ ID NO: 1359363 - RNA, 13 nt, Human
uaaauaaauuuga

SEQ ID NO: 1359364 - RNA, 21 nt, Human
uaaauaaauuguauauucacu

SEQ ID NO: 1359365 - RNA, 22 nt, Human
uaaauaaauuguauauucacuu

SEQ ID NO: 1359366 - RNA, 14 nt, Human
uaaauaaauuguau

SEQ ID NO: 1359367 - RNA, 15 nt, Human
uaaauaaauuguaua

SEQ ID NO: 1359368 - RNA, 16 nt, Human
uaaauaaauuguauau

SEQ ID NO: 1359369 - RNA, 17 nt, Human
uaaauaaauuguauauu

SEQ ID NO: 1359370 - RNA, 18 nt, Human
uaaauaaauuguauauuc

SEQ ID NO: 1359371 - RNA, 19 nt, Human
uaaauaaauuguauauuca

SEQ ID NO: 1359372 - RNA, 20 nt, Human
uaaauaaauuguauauucac

SEQ ID NO: 1359373 - RNA, 16 nt, Human
aauacaccacuacauu

SEQ ID NO: 1359374 - RNA, 18 nt, Human
aauacaccacuacauucu

SEQ ID NO: 1359375 - RNA, 20 nt, Human
aauacaccacuacauucugu

SEQ ID NO: 1359376 - RNA, 21 nt, Human
aauacaccacuacauucuguu

SEQ ID NO: 1359377 - RNA, 20 nt, Human
aauacaauuuuuuuuauuag

SEQ ID NO: 1359378 - RNA, 15 nt, Human
aauacaccacuacau

SEQ ID NO: 1359379 - RNA, 17 nt, Human
uaaauccuuuacuguua

SEQ ID NO: 1359380 - RNA, 13 nt, Human
uaaaucuacacac

SEQ ID NO: 1359381 - RNA, 15 nt, Human
uaaaucuacacacgg

SEQ ID NO: 1359382 - RNA, 19 nt, Human
uaaaucuccaaaauaaaac

SEQ ID NO: 1359383 - RNA, 12 nt, Human
uaaauaguauuu

SEQ ID NO: 1359384 - RNA, 22 nt, Human
uaaauaggcggggcuugccuuc

SEQ ID NO: 1359385 - RNA, 21 nt, Human
uaaauaggcggggcuugccuu

SEQ ID NO: 1359386 - RNA, 13 nt, Human
uaaauaguauuuc

SEQ ID NO: 1359387 - RNA, 23 nt, Human
uaaauauaaagacguuuuauaag

SEQ ID NO: 1359388 - RNA, 17 nt, Human
uaaauauaaagacguuu

SEQ ID NO: 1359389 - RNA, 14 nt, Human
uaaauauaaagacg

SEQ ID NO: 1359390 - RNA, 13 nt, Human
uaaauauaaagac

SEQ ID NO: 1359391 - RNA, 12 nt, Human
uaaauauaaaga

SEQ ID NO: 1359392 - RNA, 12 nt, Human
uaaauagcuuuu

SEQ ID NO: 1359393 - RNA, 19 nt, Human
uaaauacaauuuuuuuuau

SEQ ID NO: 1359394 - RNA, 19 nt, Human
aauaaaggcaguuuucuaa

SEQ ID NO: 1359395 - RNA, 18 nt, Human
aauaaaggcaguuuucua

SEQ ID NO: 1359396 - RNA, 16 nt, Human
aauaaaggcaguuuuc

SEQ ID NO: 1359397 - RNA, 15 nt, Human
aauaaaggcaguuuu

SEQ ID NO: 1359398 - RNA, 18 nt, Human
aauaaaggaugugauugu

SEQ ID NO: 1359399 - RNA, 22 nt, Human
aauaaaauccauacauuugugu

SEQ ID NO: 1359400 - RNA, 16 nt, Human
aauaaaagugaccuuu

SEQ ID NO: 1359401 - RNA, 21 nt, Human
aauaaaaggaagccaaagagu

SEQ ID NO: 1359402 - RNA, 20 nt, Human
aauaaaaggaagccaaagag

SEQ ID NO: 1359403 - RNA, 15 nt, Human
aauaaaaauguuuaa

SEQ ID NO: 1359404 - RNA, 14 nt, Human
aauaaaaauguuua

SEQ ID NO: 1359405 - RNA, 16 nt, Human
aauaaaagaaaauuac

SEQ ID NO: 1359406 - RNA, 15 nt, Human
aauaaaaagaaaggc

SEQ ID NO: 1359407 - RNA, 12 nt, Human
aauaaaaauaau

SEQ ID NO: 1359408 - RNA, 21 nt, Human
uaaagucuguugauuaaagau

SEQ ID NO: 1359409 - RNA, 17 nt, Human
uaaagucagauggaaaa

SEQ ID NO: 1359410 - RNA, 13 nt, Human
uaaagucagaugg

SEQ ID NO: 1359411 - RNA, 15 nt, Human
uaaagucagauggaa

SEQ ID NO: 1359412 - RNA, 19 nt, Human
uaaagugcuaagguucuaa

SEQ ID NO: 1359413 - RNA, 18 nt, Human
uaaagugcuaagguucua

SEQ ID NO: 1359414 - RNA, 17 nt, Human
uaaagugcuaagguucu

SEQ ID NO: 1359415 - RNA, 16 nt, Human
uaaagugcuaagguuc

SEQ ID NO: 1359416 - RNA, 15 nt, Human
uaaagugcuaagguu

SEQ ID NO: 1359417 - RNA, 23 nt, Human
uaaagugccaguauuuuaaaaua

SEQ ID NO: 1359418 - RNA, 22 nt, Human
uaaagugccaguauuuuaaaau

SEQ ID NO: 1359419 - RNA, 18 nt, Human
uaaagugccaguauuuua

SEQ ID NO: 1359420 - RNA, 15 nt, Human
uaaagugccaguauu

SEQ ID NO: 1359421 - RNA, 19 nt, Human
uaaagugacuaauggcaug

SEQ ID NO: 1359422 - RNA, 22 nt, Human
uaaagucuguugauuaaagaug

SEQ ID NO: 1359423 - RNA, 17 nt, Human
uaaagugacccugcucu

SEQ ID NO: 1359424 - RNA, 20 nt, Human
uaaagugacccugcucucac

SEQ ID NO: 1359425 - RNA, 22 nt, Human
uaaagugcuaagguucuaaggc

SEQ ID NO: 1359426 - RNA, 21 nt, Human
uaaagugcuaagguucuaagg

SEQ ID NO: 1359427 - RNA, 20 nt, Human
uaaagugcuaagguucuaag

SEQ ID NO: 1359428 - RNA, 14 nt, Human
uaaaguguauuuuu

SEQ ID NO: 1359429 - RNA, 15 nt, Human
uaaaguguauuuuuu

SEQ ID NO: 1359430 - RNA, 19 nt, Human
uaaaguguauuuuuuuacu

SEQ ID NO: 1359431 - RNA, 19 nt, Human
uaaaguguaacaauugugu

SEQ ID NO: 1359432 - RNA, 20 nt, Human
uaaaguguauuuuuuuacua

SEQ ID NO: 1359433 - RNA, 15 nt, Human
aauaaaaaagauccc

SEQ ID NO: 1359434 - RNA, 18 nt, Human
aauaacaaaugccaaauu

SEQ ID NO: 1359435 - RNA, 22 nt, Human
aauaacaaaugccaaauuaaaa

SEQ ID NO: 1359436 - RNA, 22 nt, Human
aauaaauuuuuuauaaaagugu

SEQ ID NO: 1359437 - RNA, 15 nt, Human
aauaacaauaaaaga

SEQ ID NO: 1359438 - RNA, 20 nt, Human
aauaaauauccuuuaauuga

SEQ ID NO: 1359439 - RNA, 23 nt, Human
aauaaauauaucuaccccagacu

SEQ ID NO: 1359440 - RNA, 15 nt, Human
aauaaauauaucuac

SEQ ID NO: 1359441 - RNA, 19 nt, Human
aauaaauaaggaaaagcuu

SEQ ID NO: 1359442 - RNA, 14 nt, Human
aauaagaucuuuuu

SEQ ID NO: 1359443 - RNA, 22 nt, Human
aauaacuccucccaggguuuua

SEQ ID NO: 1359444 - RNA, 17 nt, Human
aauaacuccucccaggg

SEQ ID NO: 1359445 - RNA, 16 nt, Human
aauaacuccucccagg

SEQ ID NO: 1359446 - RNA, 14 nt, Human
aauaacuccuccca

SEQ ID NO: 1359447 - RNA, 19 nt, Human
aauaacuccucauuguaaa

SEQ ID NO: 1359448 - RNA, 22 nt, Human
aauaacguuuaagccaaaacaa

SEQ ID NO: 1359449 - RNA, 23 nt, Human
aauaagcagguggaucuauuuca

SEQ ID NO: 1359450 - RNA, 18 nt, Human
aauaagcagguggaucua

SEQ ID NO: 1359451 - RNA, 14 nt, Human
aauaagcaggugga

SEQ ID NO: 1359452 - RNA, 14 nt, Human
aauaagauucuaac

SEQ ID NO: 1359453 - RNA, 13 nt, Human
aauaagauucuaa

SEQ ID NO: 1359454 - RNA, 12 nt, Human
aauaagauucua

SEQ ID NO: 1359455 - RNA, 21 nt, Human
aauaagcuauuugauguaaua

SEQ ID NO: 1359456 - RNA, 18 nt, Human
aauaagcuauuugaugua

SEQ ID NO: 1359457 - RNA, 16 nt, Human
aauaagcuauuugaug

SEQ ID NO: 1359458 - RNA, 14 nt, Human
aauaagcuauuuga

SEQ ID NO: 1359459 - RNA, 22 nt, Human
aauaagucaacaguaaaccacu

SEQ ID NO: 1359460 - RNA, 16 nt, Human
aauaagucaacaguaa

SEQ ID NO: 1359461 - RNA, 15 nt, Human
aauaagucaacagua

SEQ ID NO: 1359462 - RNA, 14 nt, Human
aauaagucaacagu

SEQ ID NO: 1359463 - RNA, 15 nt, Human
aauaagguacaagaa

SEQ ID NO: 1359464 - RNA, 13 nt, Human
aauaagguuuuaa

SEQ ID NO: 1359465 - RNA, 19 nt, Human
aauaagguacaagaagcau

SEQ ID NO: 1359466 - RNA, 18 nt, Human
aauaaggcacccaucugu

SEQ ID NO: 1359467 - RNA, 12 nt, Human
aauaaggcaggg

SEQ ID NO: 1359468 - RNA, 16 nt, Human
aauaaggcacccaucu

SEQ ID NO: 1359469 - RNA, 15 nt, Human
aauaaggaaaagcuu

SEQ ID NO: 1359470 - RNA, 14 nt, Human
aauaaggaaaagcu

SEQ ID NO: 1359471 - RNA, 20 nt, Human
aauaagcuauuugauguaau

SEQ ID NO: 1359472 - RNA, 14 nt, Human
aaggguugagcugg

SEQ ID NO: 1359473 - RNA, 21 nt, Human
aaggguguugggagggugguu

SEQ ID NO: 1359474 - RNA, 16 nt, Human
aagggucaggccuuug

SEQ ID NO: 1359475 - RNA, 20 nt, Human
aagggucaggccuuugagcu

SEQ ID NO: 1359476 - RNA, 14 nt, Human
aagggucaggccuu

SEQ ID NO: 1359477 - RNA, 13 nt, Human
aagggucaggccu

SEQ ID NO: 1359478 - RNA, 12 nt, Human
aagggucaggcc

SEQ ID NO: 1359479 - RNA, 11 nt, Human
aagggucaggc

SEQ ID NO: 1359480 - RNA, 22 nt, Human
guuucuaagguccgguguucua

SEQ ID NO: 1359481 - RNA, 11 nt, Human
guuucuaaggu

SEQ ID NO: 1359482 - RNA, 21 nt, Human
guuucuaagauucuaaagguc

SEQ ID NO: 1359483 - RNA, 20 nt, Human
guuucuaagauucuaaaggu

SEQ ID NO: 1359484 - RNA, 21 nt, Human
guuucuagcaugaagacagag

SEQ ID NO: 1359485 - RNA, 19 nt, Human
guuucuaagauucuaaagg

SEQ ID NO: 1359486 - RNA, 18 nt, Human
guuucuaagauucuaaag

SEQ ID NO: 1359487 - RNA, 17 nt, Human
guuucuaagauucuaaa

SEQ ID NO: 1359488 - RNA, 16 nt, Human
guuucuaagauucuaa

SEQ ID NO: 1359489 - RNA, 17 nt, Human
aaguaaauacaauuuuu

SEQ ID NO: 1359490 - RNA, 15 nt, Human
aaguaaauacaauuu

SEQ ID NO: 1359491 - RNA, 13 nt, Human
aaguaaauacaau

SEQ ID NO: 1359492 - RNA, 12 nt, Human
aaguaaauacaa

SEQ ID NO: 1359493 - RNA, 12 nt, Human
aaguaaacuuuu

SEQ ID NO: 1359494 - RNA, 20 nt, Human
aaguaaacuuuuuguucugg

SEQ ID NO: 1359495 - RNA, 18 nt, Human
aaguaaaagcaaaaaaga

SEQ ID NO: 1359496 - RNA, 21 nt, Human
aaguaaaagcaaaaaagaaaa

SEQ ID NO: 1359497 - RNA, 13 nt, Human
aaguaaaagcaaa

SEQ ID NO: 1359498 - RNA, 20 nt, Human
aaggggauuuuuaugucugg

SEQ ID NO: 1359499 - RNA, 14 nt, Human
aaggggauuuuuau

SEQ ID NO: 1359500 - RNA, 16 nt, Human
aaggggagcccacugu

SEQ ID NO: 1359501 - RNA, 13 nt, Human
aaggggagcccac

SEQ ID NO: 1359502 - RNA, 23 nt, Human
aagggccugcccaguugcacuca

SEQ ID NO: 1359503 - RNA, 12 nt, Human
aagggcccuggg

SEQ ID NO: 1359504 - RNA, 16 nt, Human
aagggcccuccuuccu

SEQ ID NO: 1359505 - RNA, 14 nt, Human
aaggggcaguggug

SEQ ID NO: 1359506 - RNA, 17 nt, Human
aaggggcaguggugguu

SEQ ID NO: 1359507 - RNA, 16 nt, Human
aaggcugaugucaauu

SEQ ID NO: 1359508 - RNA, 17 nt, Human
guuguaaccugcuguga

SEQ ID NO: 1359509 - RNA, 14 nt, Human
guuguaaccugcug

SEQ ID NO: 1359510 - RNA, 22 nt, Human
guuguaaauuggcauggaaauu

SEQ ID NO: 1359511 - RNA, 16 nt, Human
guuguaaauuggcaug

SEQ ID NO: 1359512 - RNA, 14 nt, Human
guuguaaauuggca

SEQ ID NO: 1359513 - RNA, 21 nt, Human
guuguaaaguauguauuauuu

SEQ ID NO: 1359514 - RNA, 16 nt, Human
guuguaaaccaaguga

SEQ ID NO: 1359515 - RNA, 22 nt, Human
guuucucccccauguucugucc

SEQ ID NO: 1359516 - RNA, 17 nt, Human
guuucucccccauguuc

SEQ ID NO: 1359517 - RNA, 11 nt, Human
guuucuccccc

SEQ ID NO: 1359518 - RNA, 18 nt, Human
guuucuccaaacugaagc

SEQ ID NO: 1359519 - RNA, 23 nt, Human
guuucuagguaauuuuuacagaa

SEQ ID NO: 1359520 - RNA, 22 nt, Human
guuucuaugacacaugcaaggu

SEQ ID NO: 1359521 - RNA, 14 nt, Human
guuucuggauuuca

SEQ ID NO: 1359522 - RNA, 21 nt, Human
guuucugguggucuguuggca

SEQ ID NO: 1359523 - RNA, 18 nt, Human
guuucugguggucuguug

SEQ ID NO: 1359524 - RNA, 18 nt, Human
guuugccuucuacuuuua

SEQ ID NO: 1359525 - RNA, 15 nt, Human
guuugccuuccagaa

SEQ ID NO: 1359526 - RNA, 19 nt, Human
guuugcaucugaaaauuga

SEQ ID NO: 1359527 - RNA, 21 nt, Human
guuugcagaagggggucucuu

SEQ ID NO: 1359528 - RNA, 14 nt, Human
guuugcacuuccuc

SEQ ID NO: 1359529 - RNA, 15 nt, Human
guuugcacuuccucu

SEQ ID NO: 1359530 - RNA, 22 nt, Human
guuugcagguggccaaguuccu

SEQ ID NO: 1359531 - RNA, 16 nt, Human
guuugcagucccaagc

SEQ ID NO: 1359532 - RNA, 17 nt, Human
guuugcacuaucuuuca

SEQ ID NO: 1359533 - RNA, 13 nt, Human
guuuuaacuuugu

SEQ ID NO: 1359534 - RNA, 14 nt, Human
guuuuaacuuuguu

SEQ ID NO: 1359535 - RNA, 18 nt, Human
guuuuaaggaugcuugua

SEQ ID NO: 1359536 - RNA, 22 nt, Human
guuuuaacuguggauauuguua

SEQ ID NO: 1359537 - RNA, 21 nt, Human
guuuuacuuuuaaacugugua

SEQ ID NO: 1359538 - RNA, 18 nt, Human
guuuuacuuuuaaacugu

SEQ ID NO: 1359539 - RNA, 13 nt, Human
guuuuacuuuuaa

SEQ ID NO: 1359540 - RNA, 19 nt, Human
guuuuauauauuauaugga

SEQ ID NO: 1359541 - RNA, 12 nt, Human
guuuuauauauu

SEQ ID NO: 1359542 - RNA, 11 nt, Human
guuuuauauau

SEQ ID NO: 1359543 - RNA, 22 nt, Human
guuuuauaauuuugugaagcaa

SEQ ID NO: 1359544 - RNA, 15 nt, Human
guuuuauaauuuugu

SEQ ID NO: 1359545 - RNA, 23 nt, Human
aagucaucuugcuaccaguauuu

SEQ ID NO: 1359546 - RNA, 20 nt, Human
aagucaucuugcuaccagua

SEQ ID NO: 1359547 - RNA, 14 nt, Human
aagucaucuugcua

SEQ ID NO: 1359548 - RNA, 13 nt, Human
aagucaucuugcu

SEQ ID NO: 1359549 - RNA, 15 nt, Human
aagugaaugcuggga

SEQ ID NO: 1359550 - RNA, 22 nt, Human
aagucuuauauauuguagauaa

SEQ ID NO: 1359551 - RNA, 22 nt, Human
aagugacauugcaucaaagcau

SEQ ID NO: 1359552 - RNA, 17 nt, Human
aagugaauuugccugua

SEQ ID NO: 1359553 - RNA, 20 nt, Human
aagugaauuugccuguaaca

SEQ ID NO: 1359554 - RNA, 16 nt, Human
aagugaauuugccugu

SEQ ID NO: 1359555 - RNA, 15 nt, Human
aagugaauuugccug

SEQ ID NO: 1359556 - RNA, 12 nt, Human
guuuuucuauua

SEQ ID NO: 1359557 - RNA, 11 nt, Human
guuuuucuauu

SEQ ID NO: 1359558 - RNA, 20 nt, Human
guuuuucuaaaggaguuuau

SEQ ID NO: 1359559 - RNA, 13 nt, Human
guuuuucuaaagg

SEQ ID NO: 1359560 - RNA, 19 nt, Human
aagugacuaauggcaugag

SEQ ID NO: 1359561 - RNA, 20 nt, Human
aagugaccuauaccuguguu

SEQ ID NO: 1359562 - RNA, 19 nt, Human
aagugacuuuggcugcaug

SEQ ID NO: 1359563 - RNA, 18 nt, Human
guuuuugguuuuuaaaac

SEQ ID NO: 1359564 - RNA, 15 nt, Human
guuuuugcacauguu

SEQ ID NO: 1359565 - RNA, 23 nt, Human
guuuuugaucaaaaacuauuugg

SEQ ID NO: 1359566 - RNA, 22 nt, Human
guuuuucuauuaaaagacucau

SEQ ID NO: 1359567 - RNA, 21 nt, Human
guuuuucuauuaaaagacuca

SEQ ID NO: 1359568 - RNA, 20 nt, Human
guuuuucuauuaaaagacuc

SEQ ID NO: 1359569 - RNA, 19 nt, Human
guuuuucuauuaaaagacu

SEQ ID NO: 1359570 - RNA, 18 nt, Human
guuuuucuauuaaaagac

SEQ ID NO: 1359571 - RNA, 17 nt, Human
guuuuucuauuaaaaga

SEQ ID NO: 1359572 - RNA, 16 nt, Human
guuuuucuauuaaaag

SEQ ID NO: 1359573 - RNA, 15 nt, Human
guuuuucuauuaaaa

SEQ ID NO: 1359574 - RNA, 13 nt, Human
guuuuucuauuaa

SEQ ID NO: 1359575 - RNA, 15 nt, Human
guuuuuguucaaagc

SEQ ID NO: 1359576 - RNA, 20 nt, Human
guuuuuggucuuuuauaauu

SEQ ID NO: 1359577 - RNA, 14 nt, Human
guuuuuuguaccaa

SEQ ID NO: 1359578 - RNA, 23 nt, Human
guuuuuugccacagcuuuugcaa

SEQ ID NO: 1359579 - RNA, 14 nt, Human
guuuuuugccacag

SEQ ID NO: 1359580 - RNA, 22 nt, Human
guuuuuucaucuucaguugucu

SEQ ID NO: 1359581 - RNA, 11 nt, Human
guuuuuucauc

SEQ ID NO: 1359582 - RNA, 16 nt, Human
guuuuuuaguugaauu

SEQ ID NO: 1359583 - RNA, 15 nt, Human
guuuuuuaugcuaau

SEQ ID NO: 1359584 - RNA, 12 nt, Human
guuuuuuaaguc

SEQ ID NO: 1359585 - RNA, 23 nt, Human
guuuuuuuuuaaaaaagaaacau

SEQ ID NO: 1359586 - RNA, 15 nt, Human
guuuuuuuuuaaaga

SEQ ID NO: 1359587 - RNA, 12 nt, Human
guuuuuuucuau

SEQ ID NO: 1359588 - RNA, 15 nt, Human
guuuuuuuucaguug

SEQ ID NO: 1359589 - RNA, 14 nt, Human
guuuuuuucuaaua

SEQ ID NO: 1359590 - RNA, 17 nt, Human
guuuuuuuguuauuaaa

SEQ ID NO: 1359591 - RNA, 20 nt, Human
guuuuauauauuauauggaa

SEQ ID NO: 1359592 - RNA, 23 nt, Human
aaguauguuagugcaaauuguca

SEQ ID NO: 1359593 - RNA, 13 nt, Human
aaguauguucuaa

SEQ ID NO: 1359594 - RNA, 16 nt, Human
aagucaacaguaaacc

SEQ ID NO: 1359595 - RNA, 15 nt, Human
aagucaacaguaaac

SEQ ID NO: 1359596 - RNA, 14 nt, Human
aagucaacaguaaa

SEQ ID NO: 1359597 - RNA, 13 nt, Human
aagucaacaguaa

SEQ ID NO: 1359598 - RNA, 21 nt, Human
aagucaacaguaaaccacuga

SEQ ID NO: 1359599 - RNA, 19 nt, Human
aagucaacaguaaaccacu

SEQ ID NO: 1359600 - RNA, 17 nt, Human
aagucaacaguaaacca

SEQ ID NO: 1359601 - RNA, 16 nt, Human
aagucaaccugccuga

SEQ ID NO: 1359602 - RNA, 13 nt, Human
aagucaaggagaa

SEQ ID NO: 1359603 - RNA, 15 nt, Human
aagucauaauugcau

SEQ ID NO: 1359604 - RNA, 14 nt, Human
aagucauaauugca

SEQ ID NO: 1359605 - RNA, 23 nt, Human
aagucaguccaggaugcuaacau

SEQ ID NO: 1359606 - RNA, 21 nt, Human
aagucacggcugcgcacugug

SEQ ID NO: 1359607 - RNA, 23 nt, Human
aagucacagggcaguaccugagg

SEQ ID NO: 1359608 - RNA, 15 nt, Human
aagucacagggcagu

SEQ ID NO: 1359609 - RNA, 14 nt, Human
aagucacagggcag

SEQ ID NO: 1359610 - RNA, 19 nt, Human
aagucacagggcaguaccu

SEQ ID NO: 1359611 - RNA, 20 nt, Human
aagucacauuccugaacagg

SEQ ID NO: 1359612 - RNA, 17 nt, Human
aaggauccggaaagaag

SEQ ID NO: 1359613 - RNA, 16 nt, Human
aaggauccggaaagaa

SEQ ID NO: 1359614 - RNA, 22 nt, Human
aaggauaggccuucauuaacaa

SEQ ID NO: 1359615 - RNA, 20 nt, Human
aaggauagaugcuggcccag

SEQ ID NO: 1359616 - RNA, 19 nt, Human
aaggagccccauuccuggg

SEQ ID NO: 1359617 - RNA, 17 nt, Human
aaggagccccauuccug

SEQ ID NO: 1359618 - RNA, 23 nt, Human
aaggagcagagcugauggagaag

SEQ ID NO: 1359619 - RNA, 13 nt, Human
aaggaggacccag

SEQ ID NO: 1359620 - RNA, 14 nt, Human
aaggaggacccagg

SEQ ID NO: 1359621 - RNA, 15 nt, Human
aaggaggacccagga

SEQ ID NO: 1359622 - RNA, 17 nt, Human
aaggaggacccaggaca

SEQ ID NO: 1359623 - RNA, 18 nt, Human
aaggaggacccaggacag

SEQ ID NO: 1359624 - RNA, 21 nt, Human
aaggaggacccaggacaggau

SEQ ID NO: 1359625 - RNA, 22 nt, Human
aaggaggacccaggacaggauc

SEQ ID NO: 1359626 - RNA, 13 nt, Human
aaggauaaugaau

SEQ ID NO: 1359627 - RNA, 23 nt, Human
aaggauaaaguugguaaaccuuu

SEQ ID NO: 1359628 - RNA, 23 nt, Human
aaggaggauggcauauaauacaa

SEQ ID NO: 1359629 - RNA, 22 nt, Human
aaggaggagccuguccugccug

SEQ ID NO: 1359630 - RNA, 17 nt, Human
aaggaggagccuguccu

SEQ ID NO: 1359631 - RNA, 16 nt, Human
aaggaggagccugucc

SEQ ID NO: 1359632 - RNA, 15 nt, Human
aaggaggagccuguc

SEQ ID NO: 1359633 - RNA, 21 nt, Human
aaggauaaaguugguaaaccu

SEQ ID NO: 1359634 - RNA, 22 nt, Human
guugaucuggaacccagacuca

SEQ ID NO: 1359635 - RNA, 17 nt, Human
guugaucuggaacccag

SEQ ID NO: 1359636 - RNA, 16 nt, Human
guugaucuggaaccca

SEQ ID NO: 1359637 - RNA, 15 nt, Human
guugaucuggaaccc

SEQ ID NO: 1359638 - RNA, 20 nt, Human
aaggaaacaaccaugucauu

SEQ ID NO: 1359639 - RNA, 19 nt, Human
guugaucuggaacccagac

SEQ ID NO: 1359640 - RNA, 17 nt, Human
aaggaagguggauggcc

SEQ ID NO: 1359641 - RNA, 12 nt, Human
aaggaaggugga

SEQ ID NO: 1359642 - RNA, 17 nt, Human
aaggaaggcagggagga

SEQ ID NO: 1359643 - RNA, 17 nt, Human
aaggaaggcuccaucuc

SEQ ID NO: 1359644 - RNA, 21 nt, Human
aaggaagucaaagcaaggaaa

SEQ ID NO: 1359645 - RNA, 18 nt, Human
aaggaagguggauggccc

SEQ ID NO: 1359646 - RNA, 23 nt, Human
aaggagaaucaucaggacccugg

SEQ ID NO: 1359647 - RNA, 22 nt, Human
aaggagcaagucagaauagaaa

SEQ ID NO: 1359648 - RNA, 18 nt, Human
aaggagauuuacaacugg

SEQ ID NO: 1359649 - RNA, 18 nt, Human
guugggacuacaggcgug

SEQ ID NO: 1359650 - RNA, 16 nt, Human
guuggcuuaccuggcc

SEQ ID NO: 1359651 - RNA, 14 nt, Human
guuggcuuaccugg

SEQ ID NO: 1359652 - RNA, 17 nt, Human
guuggcuuaccuggccc

SEQ ID NO: 1359653 - RNA, 16 nt, Human
guuggggucuggcagc

SEQ ID NO: 1359654 - RNA, 21 nt, Human
guugggguggguauaaaagau

SEQ ID NO: 1359655 - RNA, 21 nt, Human
guuggggacacauguauuugg

SEQ ID NO: 1359656 - RNA, 18 nt, Human
guuggggaagggccugcc

SEQ ID NO: 1359657 - RNA, 23 nt, Human
guuggggaaacagcaucuccaag

SEQ ID NO: 1359658 - RNA, 20 nt, Human
guugggagagggcgcaggcc

SEQ ID NO: 1359659 - RNA, 15 nt, Human
guugguuuucuucuu

SEQ ID NO: 1359660 - RNA, 12 nt, Human
guugguuuucuu

SEQ ID NO: 1359661 - RNA, 14 nt, Human
guugguugguuuuc

SEQ ID NO: 1359662 - RNA, 23 nt, Human
guugggguggguauaaaagaugg

SEQ ID NO: 1359663 - RNA, 22 nt, Human
guugcuccgccuggccuggcca

SEQ ID NO: 1359664 - RNA, 19 nt, Human
guugcuccgccuggccugg

SEQ ID NO: 1359665 - RNA, 13 nt, Human
guugcugaauagg

SEQ ID NO: 1359666 - RNA, 17 nt, Human
guugcuaagccccagca

SEQ ID NO: 1359667 - RNA, 22 nt, Human
guugcuaagccccagcaagcaa

SEQ ID NO: 1359668 - RNA, 23 nt, Human
guugcugaugaacucuuaaucaa

SEQ ID NO: 1359669 - RNA, 15 nt, Human
aaggccuccuggcug

SEQ ID NO: 1359670 - RNA, 14 nt, Human
aaggcccgagcagc

SEQ ID NO: 1359671 - RNA, 24 nt, Human
aaggaugcacagaguuguuacauu

SEQ ID NO: 1359672 - RNA, 18 nt, Human
aaggccuucaacccgaga

SEQ ID NO: 1359673 - RNA, 22 nt, Human
aaggccuggggugacccggcac

SEQ ID NO: 1359674 - RNA, 11 nt, Human
aaggccuuuaa

SEQ ID NO: 1359675 - RNA, 15 nt, Human
aaggccuuuaaaauu

SEQ ID NO: 1359676 - RNA, 16 nt, Human
aaggccuuuaaaauuu

SEQ ID NO: 1359677 - RNA, 17 nt, Human
aaggccuuuaaaauuuu

SEQ ID NO: 1359678 - RNA, 21 nt, Human
aaggccuggggugacccggca

SEQ ID NO: 1359679 - RNA, 17 nt, Human
aaggccuggggugaccc

SEQ ID NO: 1359680 - RNA, 15 nt, Human
aaggccuggggugac

SEQ ID NO: 1359681 - RNA, 11 nt, Human
aaggccugggg

SEQ ID NO: 1359682 - RNA, 20 nt, Human
aaggccugguguuucuugau

SEQ ID NO: 1359683 - RNA, 13 nt, Human
aaggcuaccuuug

SEQ ID NO: 1359684 - RNA, 15 nt, Human
aaggcuaccuuugua

SEQ ID NO: 1359685 - RNA, 22 nt, Human
guucuccaacaucacagcccag

SEQ ID NO: 1359686 - RNA, 21 nt, Human
guucuccaacaucacagccca

SEQ ID NO: 1359687 - RNA, 19 nt, Human
guucucauggguggcacuc

SEQ ID NO: 1359688 - RNA, 17 nt, Human
guucucagguguugcca

SEQ ID NO: 1359689 - RNA, 23 nt, Human
guucucagaaucccuuaacaguu

SEQ ID NO: 1359690 - RNA, 21 nt, Human
guucucacacuggucugcugu

SEQ ID NO: 1359691 - RNA, 21 nt, Human
guucucaauuccaacaguuua

SEQ ID NO: 1359692 - RNA, 17 nt, Human
guucucaauuccaacag

SEQ ID NO: 1359693 - RNA, 14 nt, Human
guucucaauuccaa

SEQ ID NO: 1359694 - RNA, 14 nt, Human
guucuaguuuuuua

SEQ ID NO: 1359695 - RNA, 13 nt, Human
guuccccuuccac

SEQ ID NO: 1359696 - RNA, 11 nt, Human
guucugugcac

SEQ ID NO: 1359697 - RNA, 18 nt, Human
guucugucccuugccccc

SEQ ID NO: 1359698 - RNA, 16 nt, Human
guucugucccuugccc

SEQ ID NO: 1359699 - RNA, 11 nt, Human
guucugucccu

SEQ ID NO: 1359700 - RNA, 12 nt, Human
guucugucacca

SEQ ID NO: 1359701 - RNA, 21 nt, Human
guucuccguuagcuccugugg

SEQ ID NO: 1359702 - RNA, 19 nt, Human
guucuccguuagcuccugu

SEQ ID NO: 1359703 - RNA, 18 nt, Human
guucuccguuagcuccug

SEQ ID NO: 1359704 - RNA, 20 nt, Human
guucucccuguacaguguua

SEQ ID NO: 1359705 - RNA, 23 nt, Human
guucuccaacaucacagcccagc

SEQ ID NO: 1359706 - RNA, 14 nt, Human
guugagccuuuucc

SEQ ID NO: 1359707 - RNA, 15 nt, Human
guugagccccuggag

SEQ ID NO: 1359708 - RNA, 16 nt, Human
guugagcaucuguccc

SEQ ID NO: 1359709 - RNA, 17 nt, Human
guugagauaguuuucau

SEQ ID NO: 1359710 - RNA, 18 nt, Human
guugagauaguuuucauc

SEQ ID NO: 1359711 - RNA, 17 nt, Human
guugagagugugaccaa

SEQ ID NO: 1359712 - RNA, 15 nt, Human
guugagagugugacc

SEQ ID NO: 1359713 - RNA, 18 nt, Human
guugacaguucauaugua

SEQ ID NO: 1359714 - RNA, 12 nt, Human
guugagacagag

SEQ ID NO: 1359715 - RNA, 13 nt, Human
guugacaugggac

SEQ ID NO: 1359716 - RNA, 21 nt, Human
guucuguuaacugaauaccac

SEQ ID NO: 1359717 - RNA, 19 nt, Human
guucuguuaacugaauacc

SEQ ID NO: 1359718 - RNA, 18 nt, Human
guucuguuaacugaauac

SEQ ID NO: 1359719 - RNA, 17 nt, Human
guucuguuaacugaaua

SEQ ID NO: 1359720 - RNA, 16 nt, Human
guucuguuaacugaau

SEQ ID NO: 1359721 - RNA, 14 nt, Human
guucuguuaacuga

SEQ ID NO: 1359722 - RNA, 13 nt, Human
guucuguuaacug

SEQ ID NO: 1359723 - RNA, 23 nt, Human
guucugugucuuucacagcuccu

SEQ ID NO: 1359724 - RNA, 22 nt, Human
guucugugucuuucacagcucc

SEQ ID NO: 1359725 - RNA, 13 nt, Human
guucugugucuuu

SEQ ID NO: 1359726 - RNA, 21 nt, Human
guucugugguuucauguuagu

SEQ ID NO: 1359727 - RNA, 19 nt, Human
guucugugguuucauguua

SEQ ID NO: 1359728 - RNA, 16 nt, Human
guucugugguuucaug

SEQ ID NO: 1359729 - RNA, 12 nt, Human
guucuguuuugu

SEQ ID NO: 1359730 - RNA, 18 nt, Human
guucuguuucaaggcacu

SEQ ID NO: 1359731 - RNA, 13 nt, Human
guucuguuugcug

SEQ ID NO: 1359732 - RNA, 14 nt, Human
guucuguuucaagg

SEQ ID NO: 1359733 - RNA, 13 nt, Human
guucuguuucaag

SEQ ID NO: 1359734 - RNA, 23 nt, Human
guugaauuuuuuuuaacauuccu

SEQ ID NO: 1359735 - RNA, 21 nt, Human
guugaauuuuuuuuaacauuc

SEQ ID NO: 1359736 - RNA, 20 nt, Human
guugaauuuuuuuuaacauu

SEQ ID NO: 1359737 - RNA, 13 nt, Human
guugaauuuuaca

SEQ ID NO: 1359738 - RNA, 22 nt, Human
guguuuauccuaucucuccaac

SEQ ID NO: 1359739 - RNA, 15 nt, Human
guguuuauccuuuca

SEQ ID NO: 1359740 - RNA, 17 nt, Human
guguuuauccuuucaua

SEQ ID NO: 1359741 - RNA, 16 nt, Human
aagcucugagcuguca

SEQ ID NO: 1359742 - RNA, 15 nt, Human
aagcucugagcuguc

SEQ ID NO: 1359743 - RNA, 12 nt, Human
aagcucugagcu

SEQ ID NO: 1359744 - RNA, 11 nt, Human
aagcucugagc

SEQ ID NO: 1359745 - RNA, 12 nt, Human
aagcucugacau

SEQ ID NO: 1359746 - RNA, 9 nt, Human
aagcucuga

SEQ ID NO: 1359747 - RNA, 15 nt, Human
aagcucuagaaucug

SEQ ID NO: 1359748 - RNA, 16 nt, Human
aagcuccucuccccag

SEQ ID NO: 1359749 - RNA, 15 nt, Human
aagcucccccagcaa

SEQ ID NO: 1359750 - RNA, 23 nt, Human
aagcucccccagcaaagccccca

SEQ ID NO: 1359751 - RNA, 15 nt, Human
aagcucccagggccu

SEQ ID NO: 1359752 - RNA, 19 nt, Human
aagcuuuggugagaaccug

SEQ ID NO: 1359753 - RNA, 22 nt, Human
aagcuuuggugagaaccugggu

SEQ ID NO: 1359754 - RNA, 22 nt, Human
aagcuuuccugccccaggccug

SEQ ID NO: 1359755 - RNA, 21 nt, Human
aagcuuuccugccccaggccu

SEQ ID NO: 1359756 - RNA, 18 nt, Human
aagcuuuccugccccagg

SEQ ID NO: 1359757 - RNA, 16 nt, Human
aagcuuuccugcccca

SEQ ID NO: 1359758 - RNA, 14 nt, Human
aagcucugcuauua

SEQ ID NO: 1359759 - RNA, 13 nt, Human
aagcucugaggga

SEQ ID NO: 1359760 - RNA, 16 nt, Human
aaggaaaaaauaacaa

SEQ ID NO: 1359761 - RNA, 19 nt, Human
aaggaaaaaauaacaauga

SEQ ID NO: 1359762 - RNA, 16 nt, Human
aagcuuuuaugugaaa

SEQ ID NO: 1359763 - RNA, 22 nt, Human
aauacauaccacgcuagggcug

SEQ ID NO: 1359764 - RNA, 17 nt, Human
aauacaguucugcucug

SEQ ID NO: 1359765 - RNA, 16 nt, Human
aauacaguucugcucu

SEQ ID NO: 1359766 - RNA, 21 nt, Human
aauacagucuuccauuugcaa

SEQ ID NO: 1359767 - RNA, 19 nt, Human
uaacaaugcuguauuuuaa

SEQ ID NO: 1359768 - RNA, 18 nt, Human
uaauacagcaacaauuua

SEQ ID NO: 1359769 - RNA, 19 nt, Human
aauacauagggauaugcgu

SEQ ID NO: 1359770 - RNA, 23 nt, Human
uaauacaccacuacauucuguua

SEQ ID NO: 1359771 - RNA, 23 nt, Human
aauacaucccuuaccugggaaag

SEQ ID NO: 1359772 - RNA, 22 nt, Human
uaauacaccacuacauucuguu

SEQ ID NO: 1359773 - RNA, 22 nt, Human
uaauacagcaacaauuuaugaa

SEQ ID NO: 1359774 - RNA, 21 nt, Human
uaauacagcaacaauuuauga

SEQ ID NO: 1359775 - RNA, 17 nt, Human
uaauacauuauauuucu

SEQ ID NO: 1359776 - RNA, 16 nt, Human
uaauacauuauauuuc

SEQ ID NO: 1359777 - RNA, 20 nt, Human
uaauacauuccaacucguau

SEQ ID NO: 1359778 - RNA, 16 nt, Human
uaauagaauaaaggca

SEQ ID NO: 1359779 - RNA, 14 nt, Human
uaauagaauaaagg

SEQ ID NO: 1359780 - RNA, 17 nt, Human
uaauagaaaaguauguu

SEQ ID NO: 1359781 - RNA, 17 nt, Human
uaauacuucuugugugu

SEQ ID NO: 1359782 - RNA, 18 nt, Human
uaauacuugcuuuggaaa

SEQ ID NO: 1359783 - RNA, 22 nt, Human
uaaucagguccucagagaauuu

SEQ ID NO: 1359784 - RNA, 19 nt, Human
uaaucagguccucagagaa

SEQ ID NO: 1359785 - RNA, 19 nt, Human
uaaucagggaggucauuuu

SEQ ID NO: 1359786 - RNA, 16 nt, Human
uaauauugauuuauua

SEQ ID NO: 1359787 - RNA, 18 nt, Human
uaauauugacuuguauau

SEQ ID NO: 1359788 - RNA, 16 nt, Human
uaauauugacuuguau

SEQ ID NO: 1359789 - RNA, 22 nt, Human
uaauagaauaaaggcaguuuuc

SEQ ID NO: 1359790 - RNA, 20 nt, Human
uaauagaauaaaggcaguuu

SEQ ID NO: 1359791 - RNA, 14 nt, Human
uaauagacaauuua

SEQ ID NO: 1359792 - RNA, 15 nt, Human
uaaucuugcuuucuu

SEQ ID NO: 1359793 - RNA, 14 nt, Human
uaaucuugcuuucu

SEQ ID NO: 1359794 - RNA, 22 nt, Human
uaaucuugaauuguaacuguuc

SEQ ID NO: 1359795 - RNA, 16 nt, Human
uaaucuugaauuguaa

SEQ ID NO: 1359796 - RNA, 15 nt, Human
uaaucuucugccuuc

SEQ ID NO: 1359797 - RNA, 14 nt, Human
uaaucuucugccuu

SEQ ID NO: 1359798 - RNA, 13 nt, Human
uaaucuuucacag

SEQ ID NO: 1359799 - RNA, 17 nt, Human
uaaucuuuaauuuuaca

SEQ ID NO: 1359800 - RNA, 19 nt, Human
uaauccaauggguuuuucc

SEQ ID NO: 1359801 - RNA, 22 nt, Human
uaauccaagcaaaugugaauca

SEQ ID NO: 1359802 - RNA, 21 nt, Human
uaaugugaaaaugguccagga

SEQ ID NO: 1359803 - RNA, 16 nt, Human
aaucuuuuauaggauu

SEQ ID NO: 1359804 - RNA, 17 nt, Human
aaucuugucauguguau

SEQ ID NO: 1359805 - RNA, 15 nt, Human
aaucuugucaugugu

SEQ ID NO: 1359806 - RNA, 13 nt, Human
aaucuugguuugc

SEQ ID NO: 1359807 - RNA, 19 nt, Human
aaucuugguugaugccaaa

SEQ ID NO: 1359808 - RNA, 18 nt, Human
aaucuugcuuucuuuguu

SEQ ID NO: 1359809 - RNA, 15 nt, Human
aaucuugcuuucuuu

SEQ ID NO: 1359810 - RNA, 23 nt, Human
aaucuugaucaguuaagaaauuu

SEQ ID NO: 1359811 - RNA, 13 nt, Human
aaucuugcaugua

SEQ ID NO: 1359812 - RNA, 22 nt, Human
aaucuugacuacagucaggaaa

SEQ ID NO: 1359813 - RNA, 17 nt, Human
aaucuugaaauuaagaa

SEQ ID NO: 1359814 - RNA, 14 nt, Human
aaucuugaaauuaa

SEQ ID NO: 1359815 - RNA, 19 nt, Human
aaugaaaaauuccacucaa

SEQ ID NO: 1359816 - RNA, 14 nt, Human
aaugaaaaauucca

SEQ ID NO: 1359817 - RNA, 14 nt, Human
aaugaaaaaaugua

SEQ ID NO: 1359818 - RNA, 16 nt, Human
aaucuugucaugugua

SEQ ID NO: 1359819 - RNA, 16 nt, Human
uaaugaagaucuaaau

SEQ ID NO: 1359820 - RNA, 19 nt, Human
uaaugaaguuugaauguua

SEQ ID NO: 1359821 - RNA, 12 nt, Human
uaaugugaaacu

SEQ ID NO: 1359822 - RNA, 20 nt, Human
uaaugugaaacuggauuaaa

SEQ ID NO: 1359823 - RNA, 22 nt, Human
uaaugugaaacuggauuaaacu

SEQ ID NO: 1359824 - RNA, 23 nt, Human
uaaugugaaacuggauuaaacuu

SEQ ID NO: 1359825 - RNA, 17 nt, Human
uaaugaagaucuaaaua

SEQ ID NO: 1359826 - RNA, 13 nt, Human
uaaugaaguuuga

SEQ ID NO: 1359827 - RNA, 14 nt, Human
uaaugaaguuugaa

SEQ ID NO: 1359828 - RNA, 15 nt, Human
uaaugaagaucuaaa

SEQ ID NO: 1359829 - RNA, 14 nt, Human
uaaugaagaucuaa

SEQ ID NO: 1359830 - RNA, 13 nt, Human
uaaugaagaucua

SEQ ID NO: 1359831 - RNA, 23 nt, Human
uaaugaagaaaguggaaaacaag

SEQ ID NO: 1359832 - RNA, 22 nt, Human
uaaugaagaaaguggaaaacaa

SEQ ID NO: 1359833 - RNA, 17 nt, Human
uaaugaagaaaguggaa

SEQ ID NO: 1359834 - RNA, 16 nt, Human
uaaugaagaaagugga

SEQ ID NO: 1359835 - RNA, 14 nt, Human
uaaugaacaaaugg

SEQ ID NO: 1359836 - RNA, 13 nt, Human
uaaugaacaaaug

SEQ ID NO: 1359837 - RNA, 15 nt, Human
uaauguaagacaaau

SEQ ID NO: 1359838 - RNA, 15 nt, Human
uaaugaaguuugaau

SEQ ID NO: 1359839 - RNA, 16 nt, Human
uaaugaaguuugaaug

SEQ ID NO: 1359840 - RNA, 17 nt, Human
uaaugaaguuugaaugu

SEQ ID NO: 1359841 - RNA, 18 nt, Human
uaaugaaguuugaauguu

SEQ ID NO: 1359842 - RNA, 18 nt, Human
aaugcaaccauuugaaac

SEQ ID NO: 1359843 - RNA, 17 nt, Human
aaugcaaccauuugaaa

SEQ ID NO: 1359844 - RNA, 13 nt, Human
aaugcaaccauuu

SEQ ID NO: 1359845 - RNA, 17 nt, Human
aaugcaaauaacaaaug

SEQ ID NO: 1359846 - RNA, 16 nt, Human
aaugcaaauaacaaau

SEQ ID NO: 1359847 - RNA, 14 nt, Human
aaugcaaauaacaa

SEQ ID NO: 1359848 - RNA, 13 nt, Human
aaugcaaauaaca

SEQ ID NO: 1359849 - RNA, 21 nt, Human
uaauuagugcuaagugugaac

SEQ ID NO: 1359850 - RNA, 20 nt, Human
uaauucacuguacuaucagg

SEQ ID NO: 1359851 - RNA, 22 nt, Human
uaauucacagugcucuuuucuc

SEQ ID NO: 1359852 - RNA, 21 nt, Human
uaauucacagugcucuuuucu

SEQ ID NO: 1359853 - RNA, 14 nt, Human
uaauucacagugcu

SEQ ID NO: 1359854 - RNA, 20 nt, Human
uaauuauggagucauuuuua

SEQ ID NO: 1359855 - RNA, 19 nt, Human
uaauucaauucaaagcugu

SEQ ID NO: 1359856 - RNA, 17 nt, Human
uaauuauggagucauuu

SEQ ID NO: 1359857 - RNA, 22 nt, Human
uaauuauggagucauuuuuaca

SEQ ID NO: 1359858 - RNA, 21 nt, Human
uaauuaugccuuuuuugauca

SEQ ID NO: 1359859 - RNA, 20 nt, Human
uaauuauauaacuguauuug

SEQ ID NO: 1359860 - RNA, 17 nt, Human
uaauuauauaacuguau

SEQ ID NO: 1359861 - RNA, 16 nt, Human
uaauuauauaacugua

SEQ ID NO: 1359862 - RNA, 14 nt, Human
uaauuauauaacug

SEQ ID NO: 1359863 - RNA, 23 nt, Human
uaauuauaccgcuaucauuccaa

SEQ ID NO: 1359864 - RNA, 14 nt, Human
uaauuauccaggaa

SEQ ID NO: 1359865 - RNA, 16 nt, Human
uaauuauauguuguaa

SEQ ID NO: 1359866 - RNA, 15 nt, Human
uaauuauauguugua

SEQ ID NO: 1359867 - RNA, 14 nt, Human
uaauuuuuuuaauu

SEQ ID NO: 1359868 - RNA, 21 nt, Human
uacaagcauucugucuugaag

SEQ ID NO: 1359869 - RNA, 15 nt, Human
uacaaguuggaguca

SEQ ID NO: 1359870 - RNA, 15 nt, Human
uacaaguuagaaaac

SEQ ID NO: 1359871 - RNA, 13 nt, Human
uacaaguuagaaa

SEQ ID NO: 1359872 - RNA, 16 nt, Human
uacaagccugcacaau

SEQ ID NO: 1359873 - RNA, 19 nt, Human
uacaaguauuuuuaauuaa

SEQ ID NO: 1359874 - RNA, 20 nt, Human
uaauuugcauuaaauucaca

SEQ ID NO: 1359875 - RNA, 17 nt, Human
uaauuugcauuaaauuc

SEQ ID NO: 1359876 - RNA, 16 nt, Human
uaauuugcauuaaauu

SEQ ID NO: 1359877 - RNA, 12 nt, Human
uaauuugcauua

SEQ ID NO: 1359878 - RNA, 22 nt, Human
uaauuugaggacaaccauucca

SEQ ID NO: 1359879 - RNA, 18 nt, Human
uaauuugaggacaaccau

SEQ ID NO: 1359880 - RNA, 15 nt, Human
uaauuugagagaaau

SEQ ID NO: 1359881 - RNA, 16 nt, Human
uaauuugacuagaaaa

SEQ ID NO: 1359882 - RNA, 15 nt, Human
uaauuugacuagaaa

SEQ ID NO: 1359883 - RNA, 13 nt, Human
uaauuucuaaugu

SEQ ID NO: 1359884 - RNA, 22 nt, Human
uaauuuaccuaagauuacaaau

SEQ ID NO: 1359885 - RNA, 21 nt, Human
uaauuuaccuaagauuacaaa

SEQ ID NO: 1359886 - RNA, 22 nt, Human
uaauuuacaaaaauauaaaaua

SEQ ID NO: 1359887 - RNA, 21 nt, Human
uaauuuacaaaaauauaaaau

SEQ ID NO: 1359888 - RNA, 19 nt, Human
uaauuuacaaaaauauaaa

SEQ ID NO: 1359889 - RNA, 19 nt, Human
uaauucagguuuuuccuuu

SEQ ID NO: 1359890 - RNA, 21 nt, Human
uaauucagguuuuuccuuuuu

SEQ ID NO: 1359891 - RNA, 17 nt, Human
uaauucagguuuuuccu

SEQ ID NO: 1359892 - RNA, 16 nt, Human
uaauucagguuuuucc

SEQ ID NO: 1359893 - RNA, 14 nt, Human
uaauucagguuuuu

SEQ ID NO: 1359894 - RNA, 13 nt, Human
uaauucauguugc

SEQ ID NO: 1359895 - RNA, 17 nt, Human
uacacgcuuuugugaug

SEQ ID NO: 1359896 - RNA, 18 nt, Human
uacaccuauuaucccagc

SEQ ID NO: 1359897 - RNA, 16 nt, Human
uacaccuauuauccca

SEQ ID NO: 1359898 - RNA, 18 nt, Human
aauguacccaccgggcca

SEQ ID NO: 1359899 - RNA, 21 nt, Human
uacaccuaugucauuucauuu

SEQ ID NO: 1359900 - RNA, 17 nt, Human
uacaccuaugucauuuc

SEQ ID NO: 1359901 - RNA, 14 nt, Human
uacaccuaugucau

SEQ ID NO: 1359902 - RNA, 22 nt, Human
aauguacccaccgggccacucc

SEQ ID NO: 1359903 - RNA, 15 nt, Human
aauguacauuaauua

SEQ ID NO: 1359904 - RNA, 21 nt, Human
aauguacagcaaggagauuua

SEQ ID NO: 1359905 - RNA, 23 nt, Human
aauguacagcaaggagauuuaca

SEQ ID NO: 1359906 - RNA, 15 nt, Human
uacagagaagccauc

SEQ ID NO: 1359907 - RNA, 14 nt, Human
uacagagaagccau

SEQ ID NO: 1359908 - RNA, 21 nt, Human
uacagagaagccagcuuguuu

SEQ ID NO: 1359909 - RNA, 20 nt, Human
uacagagaagccagcuuguu

SEQ ID NO: 1359910 - RNA, 19 nt, Human
uacagagaagccagcuugu

SEQ ID NO: 1359911 - RNA, 18 nt, Human
uacagagaagccagcuug

SEQ ID NO: 1359912 - RNA, 17 nt, Human
uacagagaagccagcuu

SEQ ID NO: 1359913 - RNA, 15 nt, Human
uacagagaagccagc

SEQ ID NO: 1359914 - RNA, 14 nt, Human
uacagagaagccag

SEQ ID NO: 1359915 - RNA, 13 nt, Human
uacagagaagcca

SEQ ID NO: 1359916 - RNA, 12 nt, Human
uacagagaagcc

SEQ ID NO: 1359917 - RNA, 11 nt, Human
uacagagaagc

SEQ ID NO: 1359918 - RNA, 10 nt, Human
uacagagaag

SEQ ID NO: 1359919 - RNA, 19 nt, Human
uacagagaaaccagcuucc

SEQ ID NO: 1359920 - RNA, 20 nt, Human
uacagagaaaccagcuuccu

SEQ ID NO: 1359921 - RNA, 18 nt, Human
uacagagaaaccagcuuc

SEQ ID NO: 1359922 - RNA, 17 nt, Human
uacagagaaaccagcuu

SEQ ID NO: 1359923 - RNA, 15 nt, Human
uacagagaaaccagc

SEQ ID NO: 1359924 - RNA, 19 nt, Human
uacagacuggauguaccac

SEQ ID NO: 1359925 - RNA, 21 nt, Human
uacacguauuugaauggccuu

SEQ ID NO: 1359926 - RNA, 15 nt, Human
uacagauuuugauag

SEQ ID NO: 1359927 - RNA, 16 nt, Human
uacagauuuugauagc

SEQ ID NO: 1359928 - RNA, 17 nt, Human
uacagauuuugauagca

SEQ ID NO: 1359929 - RNA, 18 nt, Human
uacagauuuugauagcaa

SEQ ID NO: 1359930 - RNA, 16 nt, Human
uacagagaagccuuca

SEQ ID NO: 1359931 - RNA, 15 nt, Human
uacagagaagccuuc

SEQ ID NO: 1359932 - RNA, 14 nt, Human
uacagagaagccuu

SEQ ID NO: 1359933 - RNA, 13 nt, Human
uacagagaagccu

SEQ ID NO: 1359934 - RNA, 23 nt, Human
uacagagaagccaucaccucaga

SEQ ID NO: 1359935 - RNA, 22 nt, Human
uacagagaagccaucaccucag

SEQ ID NO: 1359936 - RNA, 18 nt, Human
uacagagaagccaucacc

SEQ ID NO: 1359937 - RNA, 16 nt, Human
uacagagaagccauca

SEQ ID NO: 1359938 - RNA, 23 nt, Human
uacagauuuugauagcaaagcga

SEQ ID NO: 1359939 - RNA, 21 nt, Human
uacagauuuugauagcaaagc

SEQ ID NO: 1359940 - RNA, 22 nt, Human
uacagauuuugauagcaaagcg

SEQ ID NO: 1359941 - RNA, 22 nt, Human
uacagcaaggagauuuacaacu

SEQ ID NO: 1359942 - RNA, 16 nt, Human
uacaauaauucuauga

SEQ ID NO: 1359943 - RNA, 23 nt, Human
uacaaugaaaaggacuuuauaga

SEQ ID NO: 1359944 - RNA, 19 nt, Human
aaugguuguauuagauguu

SEQ ID NO: 1359945 - RNA, 21 nt, Human
aaugguuguauuagauguucu

SEQ ID NO: 1359946 - RNA, 23 nt, Human
aaugguuguauuagauguucucu

SEQ ID NO: 1359947 - RNA, 24 nt, Human
aaugguuguauuagauguucucua

SEQ ID NO: 1359948 - RNA, 23 nt, Human
aauguaagauuauagauucuaaa

SEQ ID NO: 1359949 - RNA, 22 nt, Human
aauguaagauuauagauucuaa

SEQ ID NO: 1359950 - RNA, 21 nt, Human
aauguaagauuauagauucua

SEQ ID NO: 1359951 - RNA, 20 nt, Human
aauguaagauuauagauucu

SEQ ID NO: 1359952 - RNA, 19 nt, Human
aauguaagauuauagauuc

SEQ ID NO: 1359953 - RNA, 16 nt, Human
aauguaagauuauaga

SEQ ID NO: 1359954 - RNA, 13 nt, Human
aauguaagacaaa

SEQ ID NO: 1359955 - RNA, 14 nt, Human
uacauagaugcuua

SEQ ID NO: 1359956 - RNA, 22 nt, Human
uacauacccuggccgcccccug

SEQ ID NO: 1359957 - RNA, 23 nt, Human
uacauaccacgcuagggcuggcu

SEQ ID NO: 1359958 - RNA, 20 nt, Human
uacauaccacgcuagggcug

SEQ ID NO: 1359959 - RNA, 20 nt, Human
uacauacagaauuacuguaa

SEQ ID NO: 1359960 - RNA, 12 nt, Human
uacauacagaau

SEQ ID NO: 1359961 - RNA, 23 nt, Human
aauguaguucugcuccagacagg

SEQ ID NO: 1359962 - RNA, 22 nt, Human
aauguaggcuuaguuugugugu

SEQ ID NO: 1359963 - RNA, 19 nt, Human
aauguaggcuuaguuugug

SEQ ID NO: 1359964 - RNA, 16 nt, Human
aauguaggcuuaguuu

SEQ ID NO: 1359965 - RNA, 22 nt, Human
aauguaggagacuguuuggaaa

SEQ ID NO: 1359966 - RNA, 18 nt, Human
aauguagauaaguguucu

SEQ ID NO: 1359967 - RNA, 16 nt, Human
aauguagauaaguguu

SEQ ID NO: 1359968 - RNA, 15 nt, Human
aauguagauaagugu

SEQ ID NO: 1359969 - RNA, 14 nt, Human
aauguagauaagug

SEQ ID NO: 1359970 - RNA, 21 nt, Human
aauguagaguuuuuaaacauc

SEQ ID NO: 1359971 - RNA, 22 nt, Human
aauguaucauagaaauguaacu

SEQ ID NO: 1359972 - RNA, 19 nt, Human
aauguaucauagaaaugua

SEQ ID NO: 1359973 - RNA, 18 nt, Human
aauguaucauagaaaugu

SEQ ID NO: 1359974 - RNA, 16 nt, Human
aauguaucauagaaau

SEQ ID NO: 1359975 - RNA, 13 nt, Human
aauguaugcaugu

SEQ ID NO: 1359976 - RNA, 19 nt, Human
aauguaugcauguugucua

SEQ ID NO: 1359977 - RNA, 22 nt, Human
aaugugaaacuggauuaaacuu

SEQ ID NO: 1359978 - RNA, 20 nt, Human
uacagcaacaauuuaugaau

SEQ ID NO: 1359979 - RNA, 19 nt, Human
uacagcaacaauuuaugaa

SEQ ID NO: 1359980 - RNA, 22 nt, Human
uacagcaacaauuuaugaauug

SEQ ID NO: 1359981 - RNA, 24 nt, Human
uacagcaaggagauuuacaacugg

SEQ ID NO: 1359982 - RNA, 17 nt, Human
uacagucucgucucuuu

SEQ ID NO: 1359983 - RNA, 15 nt, Human
uacagucuaaagcug

SEQ ID NO: 1359984 - RNA, 14 nt, Human
uacagucuaaagcu

SEQ ID NO: 1359985 - RNA, 22 nt, Human
uacaguauggggguuguaaauu

SEQ ID NO: 1359986 - RNA, 21 nt, Human
uacaguauggggguuguaaau

SEQ ID NO: 1359987 - RNA, 20 nt, Human
uacaguauggggguuguaaa

SEQ ID NO: 1359988 - RNA, 19 nt, Human
uacagucuucuuacuugga

SEQ ID NO: 1359989 - RNA, 22 nt, Human
uacagucuuccauuugcaaggg

SEQ ID NO: 1359990 - RNA, 20 nt, Human
uacagucuuccauuugcaag

SEQ ID NO: 1359991 - RNA, 19 nt, Human
uacagucuuccauuugcaa

SEQ ID NO: 1359992 - RNA, 18 nt, Human
uacagucuuccauuugca

SEQ ID NO: 1359993 - RNA, 15 nt, Human
uacagucucgucucu

SEQ ID NO: 1359994 - RNA, 15 nt, Human
uacauaaguuuagga

SEQ ID NO: 1359995 - RNA, 15 nt, Human
uacauaaugcgugca

SEQ ID NO: 1359996 - RNA, 20 nt, Human
uacaguggggaaugaagaua

SEQ ID NO: 1359997 - RNA, 16 nt, Human
aauuaaggcauaagaa

SEQ ID NO: 1359998 - RNA, 15 nt, Human
uacaugguguuugug

SEQ ID NO: 1359999 - RNA, 23 nt, Human
uacauggugcugggagaggcagc

SEQ ID NO: 1360000 - RNA, 17 nt, Human
uacauggugcugggaga

SEQ ID NO: 1360001 - RNA, 14 nt, Human
uacauggugcuggg

SEQ ID NO: 1360002 - RNA, 23 nt, Human
uacauggcuggagcuagaauuug

SEQ ID NO: 1360003 - RNA, 17 nt, Human
uacauguacugauuacu

SEQ ID NO: 1360004 - RNA, 15 nt, Human
uacauguauugcaca

SEQ ID NO: 1360005 - RNA, 13 nt, Human
uacauguuugcac

SEQ ID NO: 1360006 - RNA, 12 nt, Human
uacauguuugca

SEQ ID NO: 1360007 - RNA, 22 nt, Human
uacauguuugcaccuuucuagu

SEQ ID NO: 1360008 - RNA, 23 nt, Human
uacauuguugagcuauugcuguu

SEQ ID NO: 1360009 - RNA, 13 nt, Human
uacauuguugagc

SEQ ID NO: 1360010 - RNA, 17 nt, Human
uacauuguuaccucuau

SEQ ID NO: 1360011 - RNA, 21 nt, Human
uacauuguuaccucuauauac

SEQ ID NO: 1360012 - RNA, 23 nt, Human
uacauugugggauguucagcacu

SEQ ID NO: 1360013 - RNA, 15 nt, Human
uacauuguauauaug

SEQ ID NO: 1360014 - RNA, 20 nt, Human
aauuaagaaaggauaaaguu

SEQ ID NO: 1360015 - RNA, 22 nt, Human
aauuaacuuuuauaaacuuuac

SEQ ID NO: 1360016 - RNA, 18 nt, Human
aauuaacuuuuauaaacu

SEQ ID NO: 1360017 - RNA, 20 nt, Human
aauuaacuuuuauaaacuuu

SEQ ID NO: 1360018 - RNA, 17 nt, Human
aauguugcugaaaaaug

SEQ ID NO: 1360019 - RNA, 19 nt, Human
aauuaacaugaauauuuag

SEQ ID NO: 1360020 - RNA, 15 nt, Human
aaugugaagccuucc

SEQ ID NO: 1360021 - RNA, 14 nt, Human
aaugugaagccuuc

SEQ ID NO: 1360022 - RNA, 13 nt, Human
aaugugaagccuu

SEQ ID NO: 1360023 - RNA, 14 nt, Human
aauguugcugaaaa

SEQ ID NO: 1360024 - RNA, 13 nt, Human
aauguugcugaaa

SEQ ID NO: 1360025 - RNA, 19 nt, Human
aauguugauuacagugcag

SEQ ID NO: 1360026 - RNA, 18 nt, Human
aauguugagaaucccaaa

SEQ ID NO: 1360027 - RNA, 18 nt, Human
aauguugacaugggacau

SEQ ID NO: 1360028 - RNA, 22 nt, Human
uacccucuggagggguguggcu

SEQ ID NO: 1360029 - RNA, 14 nt, Human
uacccucuggaggg

SEQ ID NO: 1360030 - RNA, 12 nt, Human
uacccucuggag

SEQ ID NO: 1360031 - RNA, 16 nt, Human
uacccucugaaauaca

SEQ ID NO: 1360032 - RNA, 15 nt, Human
uacccucugaaauac

SEQ ID NO: 1360033 - RNA, 14 nt, Human
uacccucugaaaua

SEQ ID NO: 1360034 - RNA, 13 nt, Human
uacccucugaaau

SEQ ID NO: 1360035 - RNA, 21 nt, Human
uacccucucagcuccaggugg

SEQ ID NO: 1360036 - RNA, 20 nt, Human
uacccucucagcuccaggug

SEQ ID NO: 1360037 - RNA, 17 nt, Human
uacccucucagcuccag

SEQ ID NO: 1360038 - RNA, 16 nt, Human
uacccucucagcucca

SEQ ID NO: 1360039 - RNA, 15 nt, Human
uacccucucagcucc

SEQ ID NO: 1360040 - RNA, 13 nt, Human
uacccucucagcu

SEQ ID NO: 1360041 - RNA, 18 nt, Human
uacccuccuuuuuuuccc

SEQ ID NO: 1360042 - RNA, 18 nt, Human
uacccugagcugaggcag

SEQ ID NO: 1360043 - RNA, 17 nt, Human
uacccugagcugaggca

SEQ ID NO: 1360044 - RNA, 16 nt, Human
uacccugagcugaggc

SEQ ID NO: 1360045 - RNA, 22 nt, Human
uacccugaccuggcccccucag

SEQ ID NO: 1360046 - RNA, 20 nt, Human
uacccugaccuggcccccuc

SEQ ID NO: 1360047 - RNA, 14 nt, Human
uacccugaccuggc

SEQ ID NO: 1360048 - RNA, 13 nt, Human
uacccugaccugg

SEQ ID NO: 1360049 - RNA, 17 nt, Human
uacccucugaaauacau

SEQ ID NO: 1360050 - RNA, 22 nt, Human
uacccucuucauggauggggga

SEQ ID NO: 1360051 - RNA, 15 nt, Human
uacccuccuggcucu

SEQ ID NO: 1360052 - RNA, 12 nt, Human
uacccuccuggc

SEQ ID NO: 1360053 - RNA, 16 nt, Human
uacccucauguucuua

SEQ ID NO: 1360054 - RNA, 17 nt, Human
uaccccgcagacaccuu

SEQ ID NO: 1360055 - RNA, 19 nt, Human
uaccccuuacaaaugaaaa

SEQ ID NO: 1360056 - RNA, 14 nt, Human
uacccgcagaguuc

SEQ ID NO: 1360057 - RNA, 18 nt, Human
uacauuuacaaacugaag

SEQ ID NO: 1360058 - RNA, 17 nt, Human
uacauuuacaaacugaa

SEQ ID NO: 1360059 - RNA, 16 nt, Human
uacauuuacaaacuga

SEQ ID NO: 1360060 - RNA, 15 nt, Human
uacauuuacaaacug

SEQ ID NO: 1360061 - RNA, 11 nt, Human
uacauuuaaua

SEQ ID NO: 1360062 - RNA, 20 nt, Human
uacauuuaaaacauuaaaau

SEQ ID NO: 1360063 - RNA, 19 nt, Human
uacauuuaaaacauuaaaa

SEQ ID NO: 1360064 - RNA, 16 nt, Human
uacauuuaaaacauua

SEQ ID NO: 1360065 - RNA, 15 nt, Human
uacauuuaaaacauu

SEQ ID NO: 1360066 - RNA, 13 nt, Human
uaccagaaagcag

SEQ ID NO: 1360067 - RNA, 21 nt, Human
uaccacugcugauauuuucuc

SEQ ID NO: 1360068 - RNA, 22 nt, Human
uaccacugcugauauuuucucu

SEQ ID NO: 1360069 - RNA, 19 nt, Human
uaccagagaaaaagggagg

SEQ ID NO: 1360070 - RNA, 12 nt, Human
uaccaguugccu

SEQ ID NO: 1360071 - RNA, 20 nt, Human
uaccacugcugauauuuucu

SEQ ID NO: 1360072 - RNA, 17 nt, Human
uaccacugcugauauuu

SEQ ID NO: 1360073 - RNA, 17 nt, Human
uaccacuuuuguucuug

SEQ ID NO: 1360074 - RNA, 17 nt, Human
uaccaucacugaguuuu

SEQ ID NO: 1360075 - RNA, 20 nt, Human
uaccaucacugaguuuucca

SEQ ID NO: 1360076 - RNA, 19 nt, Human
uaccaguugccuuuuaucc

SEQ ID NO: 1360077 - RNA, 16 nt, Human
uaccauauacagcuca

SEQ ID NO: 1360078 - RNA, 16 nt, Human
uaccaguugccuuuua

SEQ ID NO: 1360079 - RNA, 14 nt, Human
uaccaguugccuuu

SEQ ID NO: 1360080 - RNA, 15 nt, Human
uaccccccucugucu

SEQ ID NO: 1360081 - RNA, 16 nt, Human
uacccccagcugugcu

SEQ ID NO: 1360082 - RNA, 20 nt, Human
uaccccauggagcugggcua

SEQ ID NO: 1360083 - RNA, 18 nt, Human
uaccccaauuucggauuu

SEQ ID NO: 1360084 - RNA, 22 nt, Human
uaccccagacuagauguaguau

SEQ ID NO: 1360085 - RNA, 21 nt, Human
uaccccagacuagauguagua

SEQ ID NO: 1360086 - RNA, 23 nt, Human
uaccccaccucccucaaccucau

SEQ ID NO: 1360087 - RNA, 14 nt, Human
uagagcuccucccu

SEQ ID NO: 1360088 - RNA, 23 nt, Human
uagagcagggauuaaccucugca

SEQ ID NO: 1360089 - RNA, 20 nt, Human
uagagcuguauuaagccacu

SEQ ID NO: 1360090 - RNA, 23 nt, Human
uagagcaggacugaugucuccua

SEQ ID NO: 1360091 - RNA, 17 nt, Human
uagagcaggacugaugu

SEQ ID NO: 1360092 - RNA, 16 nt, Human
uagagcaggacugaug

SEQ ID NO: 1360093 - RNA, 16 nt, Human
uagagcagacuacagc

SEQ ID NO: 1360094 - RNA, 17 nt, Human
uagagcagacuacagcu

SEQ ID NO: 1360095 - RNA, 16 nt, Human
uagagcacugccacca

SEQ ID NO: 1360096 - RNA, 17 nt, Human
uagagcacugccaccag

SEQ ID NO: 1360097 - RNA, 14 nt, Human
uagagcacugccac

SEQ ID NO: 1360098 - RNA, 22 nt, Human
acaaaaacagguauauacuuug

SEQ ID NO: 1360099 - RNA, 14 nt, Human
acaaaaagaaaaga

SEQ ID NO: 1360100 - RNA, 18 nt, Human
acaaaaagaaaagaaaau

SEQ ID NO: 1360101 - RNA, 21 nt, Human
uagaucauaaggcuucaaaau

SEQ ID NO: 1360102 - RNA, 15 nt, Human
uagaucauaaggcuu

SEQ ID NO: 1360103 - RNA, 14 nt, Human
uagaucauaaggcu

SEQ ID NO: 1360104 - RNA, 23 nt, Human
uagaucagaugcuccaagauucu

SEQ ID NO: 1360105 - RNA, 20 nt, Human
uagaucagaugcuccaagau

SEQ ID NO: 1360106 - RNA, 19 nt, Human
uagaucagaugcuccaaga

SEQ ID NO: 1360107 - RNA, 18 nt, Human
uagaucagaugcuccaag

SEQ ID NO: 1360108 - RNA, 19 nt, Human
uagaugcaguucugaagaa

SEQ ID NO: 1360109 - RNA, 17 nt, Human
uagaugcaguucugaag

SEQ ID NO: 1360110 - RNA, 14 nt, Human
uagaucagaugcuc

SEQ ID NO: 1360111 - RNA, 16 nt, Human
uagauauuggacaaag

SEQ ID NO: 1360112 - RNA, 15 nt, Human
uagaggaagcagcca

SEQ ID NO: 1360113 - RNA, 22 nt, Human
uagauuuucugguucuaacauu

SEQ ID NO: 1360114 - RNA, 21 nt, Human
uagauuuucugguucuaacau

SEQ ID NO: 1360115 - RNA, 19 nt, Human
uagauuuucugguucuaac

SEQ ID NO: 1360116 - RNA, 17 nt, Human
uagauuuucugguucua

SEQ ID NO: 1360117 - RNA, 14 nt, Human
uagauuuucugguu

SEQ ID NO: 1360118 - RNA, 13 nt, Human
uagauuuucugcu

SEQ ID NO: 1360119 - RNA, 13 nt, Human
uagauuuuccaaa

SEQ ID NO: 1360120 - RNA, 12 nt, Human
uagauuuuccaa

SEQ ID NO: 1360121 - RNA, 22 nt, Human
uagauuuuacaugaaguauuuu

SEQ ID NO: 1360122 - RNA, 21 nt, Human
uagauuuuacaugaaguauuu

SEQ ID NO: 1360123 - RNA, 20 nt, Human
uagaugcaguucugaagaag

SEQ ID NO: 1360124 - RNA, 17 nt, Human
uagcacagauggccagc

SEQ ID NO: 1360125 - RNA, 21 nt, Human
uagcaugucgucaaagcugaa

SEQ ID NO: 1360126 - RNA, 14 nt, Human
acaagcuaaaauua

SEQ ID NO: 1360127 - RNA, 14 nt, Human
acaagccagaacuu

SEQ ID NO: 1360128 - RNA, 22 nt, Human
acaagccagaacuugacccuga

SEQ ID NO: 1360129 - RNA, 23 nt, Human
acaagcauggucccacaucccug

SEQ ID NO: 1360130 - RNA, 21 nt, Human
acaagagcacuacauucauuu

SEQ ID NO: 1360131 - RNA, 15 nt, Human
acaagagcacuacau

SEQ ID NO: 1360132 - RNA, 23 nt, Human
acaagaauggaucacaagaugga

SEQ ID NO: 1360133 - RNA, 19 nt, Human
acaagagaagcauucucau

SEQ ID NO: 1360134 - RNA, 21 nt, Human
acaagcauucugucuugaagg

SEQ ID NO: 1360135 - RNA, 18 nt, Human
acaagcacuaaacaaaga

SEQ ID NO: 1360136 - RNA, 14 nt, Human
acaagaauggauca

SEQ ID NO: 1360137 - RNA, 13 nt, Human
acaagaauggauc

SEQ ID NO: 1360138 - RNA, 20 nt, Human
acaagaagccacagaccuag

SEQ ID NO: 1360139 - RNA, 18 nt, Human
acaagaagcauuuuguaa

SEQ ID NO: 1360140 - RNA, 17 nt, Human
acaagaagcauuuugua

SEQ ID NO: 1360141 - RNA, 15 nt, Human
acaagaagcauuuug

SEQ ID NO: 1360142 - RNA, 14 nt, Human
acaagaagaagggc

SEQ ID NO: 1360143 - RNA, 13 nt, Human
acaacacccauuu

SEQ ID NO: 1360144 - RNA, 18 nt, Human
acaaauucugucucugga

SEQ ID NO: 1360145 - RNA, 17 nt, Human
acaaauuauuaaugaaa

SEQ ID NO: 1360146 - RNA, 15 nt, Human
acaaauuaucuuaaa

SEQ ID NO: 1360147 - RNA, 15 nt, Human
acaaauuaguuauau

SEQ ID NO: 1360148 - RNA, 19 nt, Human
acaaauguuaaaauguguu

SEQ ID NO: 1360149 - RNA, 20 nt, Human
acaaauguuaaaauguguug

SEQ ID NO: 1360150 - RNA, 18 nt, Human
acaaauguuaaaaugugu

SEQ ID NO: 1360151 - RNA, 24 nt, Human
uagcauuguaaaauuauuucauga

SEQ ID NO: 1360152 - RNA, 19 nt, Human
uagcauuguaaaagcauuu

SEQ ID NO: 1360153 - RNA, 18 nt, Human
uagcauuguaaaagcauu

SEQ ID NO: 1360154 - RNA, 21 nt, Human
uagcauuguagugcuuugaga

SEQ ID NO: 1360155 - RNA, 19 nt, Human
uagcauuuguguugaagag

SEQ ID NO: 1360156 - RNA, 14 nt, Human
acaaaaaaaaauuu

SEQ ID NO: 1360157 - RNA, 20 nt, Human
acaaaaacagguauauacuu

SEQ ID NO: 1360158 - RNA, 13 nt, Human
acaaaaacaggua

SEQ ID NO: 1360159 - RNA, 20 nt, Human
aauuuuuuuccuuaccuuuu

SEQ ID NO: 1360160 - RNA, 20 nt, Human
aauuuuuuucaccuagauuu

SEQ ID NO: 1360161 - RNA, 19 nt, Human
acaaaaaaaaaauuugcca

SEQ ID NO: 1360162 - RNA, 20 nt, Human
aauuuuuccaacuacuaaua

SEQ ID NO: 1360163 - RNA, 14 nt, Human
aauuuuuccaacua

SEQ ID NO: 1360164 - RNA, 15 nt, Human
aauuuuuuaaaaagc

SEQ ID NO: 1360165 - RNA, 13 nt, Human
aauuuuuguagua

SEQ ID NO: 1360166 - RNA, 17 nt, Human
aauuuuuuauaaaagug

SEQ ID NO: 1360167 - RNA, 22 nt, Human
aauuuuuucucuaggaaauauu

SEQ ID NO: 1360168 - RNA, 13 nt, Human
aauuuuuuucacc

SEQ ID NO: 1360169 - RNA, 20 nt, Human
aauuuuuuaucaugcauguc

SEQ ID NO: 1360170 - RNA, 18 nt, Human
aauuuuuuaucaugcaug

SEQ ID NO: 1360171 - RNA, 21 nt, Human
aauuuuuuaagugaaaauaua

SEQ ID NO: 1360172 - RNA, 19 nt, Human
aauuuuuucucuaggaaau

SEQ ID NO: 1360173 - RNA, 17 nt, Human
aauuuguuuuggauaua

SEQ ID NO: 1360174 - RNA, 19 nt, Human
aauuuguacuauuuaacug

SEQ ID NO: 1360175 - RNA, 17 nt, Human
aauuuguaggguuucua

SEQ ID NO: 1360176 - RNA, 20 nt, Human
aauuuguaaugucuugagcu

SEQ ID NO: 1360177 - RNA, 18 nt, Human
aauuuguaaugucuugag

SEQ ID NO: 1360178 - RNA, 17 nt, Human
aauuuguaaugucuuga

SEQ ID NO: 1360179 - RNA, 22 nt, Human
aauuuuuauuuuugcugagacu

SEQ ID NO: 1360180 - RNA, 15 nt, Human
aauuuuuauuucuuc

SEQ ID NO: 1360181 - RNA, 19 nt, Human
aauuuuaaccuaugauauu

SEQ ID NO: 1360182 - RNA, 14 nt, Human
aauuuuaaacaaag

SEQ ID NO: 1360183 - RNA, 17 nt, Human
aauuuuaaacaaagguu

SEQ ID NO: 1360184 - RNA, 19 nt, Human
aauuuuuauauuugaaaua

SEQ ID NO: 1360185 - RNA, 19 nt, Human
uagacaagccagaacuuga

SEQ ID NO: 1360186 - RNA, 15 nt, Human
uagacaagccagaac

SEQ ID NO: 1360187 - RNA, 14 nt, Human
uagacaagccagaa

SEQ ID NO: 1360188 - RNA, 22 nt, Human
uagacaaguccagccuggcaag

SEQ ID NO: 1360189 - RNA, 16 nt, Human
uagacaauuuauuaug

SEQ ID NO: 1360190 - RNA, 15 nt, Human
uagacaauugaggua

SEQ ID NO: 1360191 - RNA, 14 nt, Human
uagacagcaugaga

SEQ ID NO: 1360192 - RNA, 18 nt, Human
uagacaauugagguaagu

SEQ ID NO: 1360193 - RNA, 15 nt, Human
uagaauugcauugac

SEQ ID NO: 1360194 - RNA, 14 nt, Human
uagaauugcauuga

SEQ ID NO: 1360195 - RNA, 13 nt, Human
uagaauugcauug

SEQ ID NO: 1360196 - RNA, 19 nt, Human
uagaauugaguguuuaaag

SEQ ID NO: 1360197 - RNA, 13 nt, Human
uagacaagccaga

SEQ ID NO: 1360198 - RNA, 19 nt, Human
uagacaaauagaaaauggu

SEQ ID NO: 1360199 - RNA, 20 nt, Human
uagacaaauagaaaaugguc

SEQ ID NO: 1360200 - RNA, 17 nt, Human
uagacaaauagaaaaug

SEQ ID NO: 1360201 - RNA, 19 nt, Human
uagaauuugauaugugaac

SEQ ID NO: 1360202 - RNA, 20 nt, Human
uagaauugaguguuuaaagu

SEQ ID NO: 1360203 - RNA, 17 nt, Human
uagaauugaguguuuaa

SEQ ID NO: 1360204 - RNA, 12 nt, Human
uagaagccugca

SEQ ID NO: 1360205 - RNA, 23 nt, Human
uagaagucacauuccugaacagg

SEQ ID NO: 1360206 - RNA, 23 nt, Human
uagaacucaaccucuacaggguu

SEQ ID NO: 1360207 - RNA, 16 nt, Human
uacuucaugcugucua

SEQ ID NO: 1360208 - RNA, 22 nt, Human
uacuucaaaaguuuguuugcuu

SEQ ID NO: 1360209 - RNA, 17 nt, Human
uacuucaaaaguuuguu

SEQ ID NO: 1360210 - RNA, 21 nt, Human
uacuucaaauccuugaagauu

SEQ ID NO: 1360211 - RNA, 22 nt, Human
uagaacuuggauguaccugccc

SEQ ID NO: 1360212 - RNA, 21 nt, Human
uagaacucaaccucuacaggg

SEQ ID NO: 1360213 - RNA, 19 nt, Human
uagaacucugaaaugaaga

SEQ ID NO: 1360214 - RNA, 14 nt, Human
uagaagagagaggu

SEQ ID NO: 1360215 - RNA, 22 nt, Human
uagaagagagagguugaaaaac

SEQ ID NO: 1360216 - RNA, 22 nt, Human
aauuguuguucuguuaacugaa

SEQ ID NO: 1360217 - RNA, 23 nt, Human
aauuguuguucuguuaacugaau

SEQ ID NO: 1360218 - RNA, 17 nt, Human
aauuguuguucuguuaa

SEQ ID NO: 1360219 - RNA, 16 nt, Human
aauuguuguucuguua

SEQ ID NO: 1360220 - RNA, 15 nt, Human
aauuguuguucuguu

SEQ ID NO: 1360221 - RNA, 14 nt, Human
aauuguuguucugu

SEQ ID NO: 1360222 - RNA, 13 nt, Human
aauuguuguucug

SEQ ID NO: 1360223 - RNA, 12 nt, Human
aauuguuguucu

SEQ ID NO: 1360224 - RNA, 23 nt, Human
aauugugugugaugugaagccaa

SEQ ID NO: 1360225 - RNA, 19 nt, Human
aauuguguggauucuuuaa

SEQ ID NO: 1360226 - RNA, 15 nt, Human
aauuguguggauucu

SEQ ID NO: 1360227 - RNA, 20 nt, Human
aauuguguuuauaauuuuaa

SEQ ID NO: 1360228 - RNA, 16 nt, Human
uacuguaacauucagg

SEQ ID NO: 1360229 - RNA, 13 nt, Human
uacuguaagaaaa

SEQ ID NO: 1360230 - RNA, 13 nt, Human
aauugcugcuacu

SEQ ID NO: 1360231 - RNA, 19 nt, Human
aauugcugacuguagcuuu

SEQ ID NO: 1360232 - RNA, 18 nt, Human
aauugcugacuguagcuu

SEQ ID NO: 1360233 - RNA, 17 nt, Human
aauugcugacuguagcu

SEQ ID NO: 1360234 - RNA, 23 nt, Human
aauugugugaaagguacuucaaa

SEQ ID NO: 1360235 - RNA, 20 nt, Human
aauuuaaagcagguucuugu

SEQ ID NO: 1360236 - RNA, 22 nt, Human
aauuuaaagcagguucuuguug

SEQ ID NO: 1360237 - RNA, 19 nt, Human
aauuuaaagcagguucuug

SEQ ID NO: 1360238 - RNA, 12 nt, Human
aauuuaaagcag

SEQ ID NO: 1360239 - RNA, 11 nt, Human
aauuuaaagca

SEQ ID NO: 1360240 - RNA, 22 nt, Human
aauuuaaacuauaagcaagaag

SEQ ID NO: 1360241 - RNA, 19 nt, Human
aauuuaaacaccuccucau

SEQ ID NO: 1360242 - RNA, 15 nt, Human
aauuuaaacaccucc

SEQ ID NO: 1360243 - RNA, 10 nt, Human
aauuuaaaca

SEQ ID NO: 1360244 - RNA, 9 nt, Human
aauuuaaac

SEQ ID NO: 1360245 - RNA, 19 nt, Human
aauuuaaaauaauuauaua

SEQ ID NO: 1360246 - RNA, 22 nt, Human
aauuguuuuaucugaauuuuua

SEQ ID NO: 1360247 - RNA, 19 nt, Human
aauuguuuuaucugaauuu

SEQ ID NO: 1360248 - RNA, 21 nt, Human
aauuuacaaaaauauaaaaua

SEQ ID NO: 1360249 - RNA, 18 nt, Human
aauuuacaaaaauauaaa

SEQ ID NO: 1360250 - RNA, 16 nt, Human
aauuuacaaaaauaua

SEQ ID NO: 1360251 - RNA, 16 nt, Human
aauuuacaucauuucu

SEQ ID NO: 1360252 - RNA, 16 nt, Human
aauuuaaauagcuuuu

SEQ ID NO: 1360253 - RNA, 22 nt, Human
aauuuaaaguuguuugugccuu

SEQ ID NO: 1360254 - RNA, 15 nt, Human
aauuuaaauagcuuu

SEQ ID NO: 1360255 - RNA, 17 nt, Human
aauuucuacuuugaagu

SEQ ID NO: 1360256 - RNA, 16 nt, Human
aauuucuacuuugaag

SEQ ID NO: 1360257 - RNA, 15 nt, Human
aauuucuacuuugaa

SEQ ID NO: 1360258 - RNA, 18 nt, Human
aauuucuaccauuucaga

SEQ ID NO: 1360259 - RNA, 16 nt, Human
aauuucuaccauuuca

SEQ ID NO: 1360260 - RNA, 23 nt, Human
aauuuaugaauugaauuaucuug

SEQ ID NO: 1360261 - RNA, 21 nt, Human
aauuuaugaauugaauuaucu

SEQ ID NO: 1360262 - RNA, 13 nt, Human
aauuucuaaaucu

SEQ ID NO: 1360263 - RNA, 21 nt, Human
aauuucuaaaucuccaaaaua

SEQ ID NO: 1360264 - RNA, 15 nt, Human
aauuuaguaaaccaa

SEQ ID NO: 1360265 - RNA, 23 nt, Human
aauuuauccugaaauuucagauu

SEQ ID NO: 1360266 - RNA, 19 nt, Human
aauuuauccugaaauuuca

SEQ ID NO: 1360267 - RNA, 18 nt, Human
aauuuauccugaaauuuc

SEQ ID NO: 1360268 - RNA, 20 nt, Human
aauuuaguaaaccaauccua

SEQ ID NO: 1360269 - RNA, 16 nt, Human
aauuuagcauuguagu

SEQ ID NO: 1360270 - RNA, 14 nt, Human
aauuuagcauugua

SEQ ID NO: 1360271 - RNA, 13 nt, Human
aauuuagcauugu

SEQ ID NO: 1360272 - RNA, 20 nt, Human
aauuuagacuuggauucuuu

SEQ ID NO: 1360273 - RNA, 16 nt, Human
aauuuagacuuggauu

SEQ ID NO: 1360274 - RNA, 17 nt, Human
aauuuagacuucaagca

SEQ ID NO: 1360275 - RNA, 21 nt, Human
aauuuagaaaucauuuugcaa

SEQ ID NO: 1360276 - RNA, 20 nt, Human
aauuuagaaaucauuuugca

SEQ ID NO: 1360277 - RNA, 17 nt, Human
aauuuagaaaucauuuu

SEQ ID NO: 1360278 - RNA, 15 nt, Human
aauuuagaaaucauu

SEQ ID NO: 1360279 - RNA, 14 nt, Human
aauuuagaaaucau

SEQ ID NO: 1360280 - RNA, 15 nt, Human
aauuuagaaaacuuu

SEQ ID NO: 1360281 - RNA, 16 nt, Human
aauuuagaaaacuuua

SEQ ID NO: 1360282 - RNA, 17 nt, Human
aauuuaccuaagauuac

SEQ ID NO: 1360283 - RNA, 16 nt, Human
aauuuaccuaagauua

SEQ ID NO: 1360284 - RNA, 14 nt, Human
aauuuaccuaagau

SEQ ID NO: 1360285 - RNA, 13 nt, Human
aauuuaccuaaga

SEQ ID NO: 1360286 - RNA, 21 nt, Human
aauuuaccuaagauuacaaau

SEQ ID NO: 1360287 - RNA, 18 nt, Human
aauuuaccuaagauuaca

SEQ ID NO: 1360288 - RNA, 13 nt, Human
aauuugagugcuc

SEQ ID NO: 1360289 - RNA, 19 nt, Human
aauuugacuuuucuguaau

SEQ ID NO: 1360290 - RNA, 14 nt, Human
aauuugaggacaac

SEQ ID NO: 1360291 - RNA, 18 nt, Human
aauuugauaugugaacag

SEQ ID NO: 1360292 - RNA, 16 nt, Human
aauuugauaugugaac

SEQ ID NO: 1360293 - RNA, 15 nt, Human
aauuugauaugugaa

SEQ ID NO: 1360294 - RNA, 20 nt, Human
uacuuauuuuugacaguguu

SEQ ID NO: 1360295 - RNA, 19 nt, Human
aauuugauaugugaacagu

SEQ ID NO: 1360296 - RNA, 19 nt, Human
uacuucaaauccuugaaga

SEQ ID NO: 1360297 - RNA, 14 nt, Human
uacuucaaauccuu

SEQ ID NO: 1360298 - RNA, 12 nt, Human
aauuucuuaacu

SEQ ID NO: 1360299 - RNA, 21 nt, Human
aauuucuguguugccaagcuc

SEQ ID NO: 1360300 - RNA, 20 nt, Human
aauuugaaacacuuugcaua

SEQ ID NO: 1360301 - RNA, 13 nt, Human
aauuugaggacaa

SEQ ID NO: 1360302 - RNA, 17 nt, Human
aauuugagauacaaaca

SEQ ID NO: 1360303 - RNA, 20 nt, Human
aauuugagagaaauaugaag

SEQ ID NO: 1360304 - RNA, 18 nt, Human
aauuugagagaaauauga

SEQ ID NO: 1360305 - RNA, 18 nt, Human
aauuugacuuuucuguaa

SEQ ID NO: 1360306 - RNA, 17 nt, Human
aauuugacuuuucugua

SEQ ID NO: 1360307 - RNA, 16 nt, Human
aauuugacuuuucugu

SEQ ID NO: 1360308 - RNA, 14 nt, Human
uacguaugucuggu

SEQ ID NO: 1360309 - RNA, 12 nt, Human
uacguaugucug

SEQ ID NO: 1360310 - RNA, 21 nt, Human
uacguagccuaaggcuccugu

SEQ ID NO: 1360311 - RNA, 19 nt, Human
uacgugggcauugucuuuu

SEQ ID NO: 1360312 - RNA, 16 nt, Human
uacguauuuaauagca

SEQ ID NO: 1360313 - RNA, 21 nt, Human
uacguaugucugguucucaau

SEQ ID NO: 1360314 - RNA, 18 nt, Human
uacguaugucugguucuc

SEQ ID NO: 1360315 - RNA, 22 nt, Human
uacguaugucugguucucaauu

SEQ ID NO: 1360316 - RNA, 18 nt, Human
uacgugcucugugggucu

SEQ ID NO: 1360317 - RNA, 20 nt, Human
uacuagucaccagagacuuu

SEQ ID NO: 1360318 - RNA, 21 nt, Human
uacuagucaccagagacuuua

SEQ ID NO: 1360319 - RNA, 13 nt, Human
uacguugugcauu

SEQ ID NO: 1360320 - RNA, 14 nt, Human
uacguugugcauuu

SEQ ID NO: 1360321 - RNA, 15 nt, Human
uacuauuguuacauu

SEQ ID NO: 1360322 - RNA, 19 nt, Human
uacuauguggaugugacag

SEQ ID NO: 1360323 - RNA, 17 nt, Human
uacuauaagaacuuuga

SEQ ID NO: 1360324 - RNA, 23 nt, Human
uacucaaaugaguaacauuugcu

SEQ ID NO: 1360325 - RNA, 18 nt, Human
uacucaaaugaguaacau

SEQ ID NO: 1360326 - RNA, 17 nt, Human
uacucaaaugaguaaca

SEQ ID NO: 1360327 - RNA, 11 nt, Human
uacuauuuaaa

SEQ ID NO: 1360328 - RNA, 12 nt, Human
uacuauuaaaaa

SEQ ID NO: 1360329 - RNA, 22 nt, Human
uacuagucaccagagacuuuag

SEQ ID NO: 1360330 - RNA, 20 nt, Human
uacugaacaucugaguccug

SEQ ID NO: 1360331 - RNA, 21 nt, Human
uacugaacaucugaguccugg

SEQ ID NO: 1360332 - RNA, 19 nt, Human
uacugaacaucugaguccu

SEQ ID NO: 1360333 - RNA, 18 nt, Human
uacugaacaucugagucc

SEQ ID NO: 1360334 - RNA, 18 nt, Human
uacucuucuugaaauuuu

SEQ ID NO: 1360335 - RNA, 17 nt, Human
uacucuucuugaaauuu

SEQ ID NO: 1360336 - RNA, 14 nt, Human
uacucuucuugaaa

SEQ ID NO: 1360337 - RNA, 20 nt, Human
uacugacauguggggccagg

SEQ ID NO: 1360338 - RNA, 13 nt, Human
uacugacaugugg

SEQ ID NO: 1360339 - RNA, 19 nt, Human
uacugaaugucauugaaaa

SEQ ID NO: 1360340 - RNA, 13 nt, Human
uacugaaucugcu

SEQ ID NO: 1360341 - RNA, 22 nt, Human
uacucuuauaucuauauuuuac

SEQ ID NO: 1360342 - RNA, 20 nt, Human
uacucuuauaucuauauuuu

SEQ ID NO: 1360343 - RNA, 21 nt, Human
uacucacacaggcauuuccug

SEQ ID NO: 1360344 - RNA, 14 nt, Human
uacucacacaggca

SEQ ID NO: 1360345 - RNA, 13 nt, Human
uacucacacaggc

SEQ ID NO: 1360346 - RNA, 21 nt, Human
aauucuugccaaauauaaaua

SEQ ID NO: 1360347 - RNA, 14 nt, Human
aauucuugcaaagu

SEQ ID NO: 1360348 - RNA, 20 nt, Human
aauucuugcaaaguaucccu

SEQ ID NO: 1360349 - RNA, 18 nt, Human
aauucuucugaacucaaa

SEQ ID NO: 1360350 - RNA, 15 nt, Human
aauucuucugaacuc

SEQ ID NO: 1360351 - RNA, 11 nt, Human
aauucuucccu

SEQ ID NO: 1360352 - RNA, 13 nt, Human
aauucuucugaac

SEQ ID NO: 1360353 - RNA, 21 nt, Human
aauucuucccuaucuuugcca

SEQ ID NO: 1360354 - RNA, 19 nt, Human
uacccuuuuucuccagcug

SEQ ID NO: 1360355 - RNA, 18 nt, Human
uacccuuuuucuccagcu

SEQ ID NO: 1360356 - RNA, 17 nt, Human
uacccuuuuucuccagc

SEQ ID NO: 1360357 - RNA, 22 nt, Human
uacccuuuucugaccaaagaga

SEQ ID NO: 1360358 - RNA, 18 nt, Human
uacccuggccgcccccug

SEQ ID NO: 1360359 - RNA, 21 nt, Human
uacccuggccccucucccuug

SEQ ID NO: 1360360 - RNA, 19 nt, Human
uacccuggccccucucccu

SEQ ID NO: 1360361 - RNA, 16 nt, Human
uacccuggccccucuc

SEQ ID NO: 1360362 - RNA, 14 nt, Human
uacccuggccccuc

SEQ ID NO: 1360363 - RNA, 13 nt, Human
uacccuggccccu

SEQ ID NO: 1360364 - RNA, 12 nt, Human
uacccuggcccc

SEQ ID NO: 1360365 - RNA, 19 nt, Human
aauucuuaugccauauaau

SEQ ID NO: 1360366 - RNA, 21 nt, Human
aauugaaccuuugugcccuau

SEQ ID NO: 1360367 - RNA, 23 nt, Human
aauugaaccuuugugcccuauca

SEQ ID NO: 1360368 - RNA, 13 nt, Human
aauugaaccuuug

SEQ ID NO: 1360369 - RNA, 12 nt, Human
aauugaaccuuu

SEQ ID NO: 1360370 - RNA, 24 nt, Human
aauugaaauguaaggcuguguaag

SEQ ID NO: 1360371 - RNA, 16 nt, Human
aauugaaauguaaggc

SEQ ID NO: 1360372 - RNA, 15 nt, Human
aauugaaauguaagg

SEQ ID NO: 1360373 - RNA, 13 nt, Human
aauugaaauguaa

SEQ ID NO: 1360374 - RNA, 12 nt, Human
aauugaaaugua

SEQ ID NO: 1360375 - RNA, 22 nt, Human
aauugaaagugggcaaaagcuu

SEQ ID NO: 1360376 - RNA, 18 nt, Human
aauugaaguaaacuuuuu

SEQ ID NO: 1360377 - RNA, 17 nt, Human
aauugaaguaaacuuuu

SEQ ID NO: 1360378 - RNA, 15 nt, Human
uacguacacauuuua

SEQ ID NO: 1360379 - RNA, 22 nt, Human
aauucuuucaauacagauauau

SEQ ID NO: 1360380 - RNA, 21 nt, Human
aauucuuucaauacagauaua

SEQ ID NO: 1360381 - RNA, 20 nt, Human
aauucuuucaauacagauau

SEQ ID NO: 1360382 - RNA, 19 nt, Human
aauucuuucaauacagaua

SEQ ID NO: 1360383 - RNA, 18 nt, Human
aauucuuucaauacagau

SEQ ID NO: 1360384 - RNA, 14 nt, Human
aauucuuucauuuu

SEQ ID NO: 1360385 - RNA, 20 nt, Human
aauucuugguugaggaaaca

SEQ ID NO: 1360386 - RNA, 19 nt, Human
aauucuugguugaggaaac

SEQ ID NO: 1360387 - RNA, 18 nt, Human
aauucuugguugaggaaa

SEQ ID NO: 1360388 - RNA, 23 nt, Human
aauucuucugaacucaaacugag

SEQ ID NO: 1360389 - RNA, 17 nt, Human
aauucuuucaauacaga

SEQ ID NO: 1360390 - RNA, 17 nt, Human
aauucuuuaaaauuaca

SEQ ID NO: 1360391 - RNA, 22 nt, Human
aauucuuuaaaauuacaacuaa

SEQ ID NO: 1360392 - RNA, 23 nt, Human
uauaaaauaauuuuuauauuuga

SEQ ID NO: 1360393 - RNA, 19 nt, Human
uauaaaagccuguuuaaga

SEQ ID NO: 1360394 - RNA, 19 nt, Human
acacaugcaaggucauuuu

SEQ ID NO: 1360395 - RNA, 20 nt, Human
acacaugcaaggucauuuuu

SEQ ID NO: 1360396 - RNA, 22 nt, Human
uauaaaauaauuuuuauauuug

SEQ ID NO: 1360397 - RNA, 21 nt, Human
uauaaaauaauuuuuauauuu

SEQ ID NO: 1360398 - RNA, 14 nt, Human
uauaaaagccuguu

SEQ ID NO: 1360399 - RNA, 17 nt, Human
uauaaaagccuguuuaa

SEQ ID NO: 1360400 - RNA, 22 nt, Human
uaguuuucauccauaacugaac

SEQ ID NO: 1360401 - RNA, 11 nt, Human
uauaaaagaug

SEQ ID NO: 1360402 - RNA, 13 nt, Human
uaguuuuauucuu

SEQ ID NO: 1360403 - RNA, 12 nt, Human
uauaaaagccug

SEQ ID NO: 1360404 - RNA, 20 nt, Human
uauaaaagauggggucugua

SEQ ID NO: 1360405 - RNA, 21 nt, Human
uauaaaagauggggucuguaa

SEQ ID NO: 1360406 - RNA, 22 nt, Human
uauaaaagauggggucuguaaa

SEQ ID NO: 1360407 - RNA, 23 nt, Human
uauaaaagauggggucuguaaaa

SEQ ID NO: 1360408 - RNA, 21 nt, Human
acaccaggcuugccugcaggc

SEQ ID NO: 1360409 - RNA, 22 nt, Human
acaccaggauagagacuggaac

SEQ ID NO: 1360410 - RNA, 19 nt, Human
acacaugaagguaaauaaa

SEQ ID NO: 1360411 - RNA, 21 nt, Human
acacaugcaaggucauuuuuu

SEQ ID NO: 1360412 - RNA, 17 nt, Human
acaccagggccagccuc

SEQ ID NO: 1360413 - RNA, 18 nt, Human
acaccagggccagccucu

SEQ ID NO: 1360414 - RNA, 14 nt, Human
acaccagggccagc

SEQ ID NO: 1360415 - RNA, 22 nt, Human
acacccuguacuguucuguguc

SEQ ID NO: 1360416 - RNA, 13 nt, Human
acacccuguacug

SEQ ID NO: 1360417 - RNA, 18 nt, Human
acaccguucauucaggca

SEQ ID NO: 1360418 - RNA, 21 nt, Human
acaccuacuagucaccagaga

SEQ ID NO: 1360419 - RNA, 21 nt, Human
acaaggaagucaaagcaagga

SEQ ID NO: 1360420 - RNA, 16 nt, Human
acaagcuucugagacg

SEQ ID NO: 1360421 - RNA, 15 nt, Human
acaagcuucugagac

SEQ ID NO: 1360422 - RNA, 13 nt, Human
acaagcuucugag

SEQ ID NO: 1360423 - RNA, 22 nt, Human
acaagcucacagaccuuugaac

SEQ ID NO: 1360424 - RNA, 22 nt, Human
uagucucaguuugugugucuua

SEQ ID NO: 1360425 - RNA, 19 nt, Human
uagucucaguuuguguguc

SEQ ID NO: 1360426 - RNA, 11 nt, Human
uagucucaguu

SEQ ID NO: 1360427 - RNA, 18 nt, Human
uagucucagugaagacua

SEQ ID NO: 1360428 - RNA, 15 nt, Human
uagucauguuuaucu

SEQ ID NO: 1360429 - RNA, 13 nt, Human
uagucaugugacc

SEQ ID NO: 1360430 - RNA, 22 nt, Human
uagugagcagucaggaaagaga

SEQ ID NO: 1360431 - RNA, 18 nt, Human
uagucucuuuaaaaggaa

SEQ ID NO: 1360432 - RNA, 16 nt, Human
uagucucuuuaaaagg

SEQ ID NO: 1360433 - RNA, 19 nt, Human
uagugaucaaauugugcag

SEQ ID NO: 1360434 - RNA, 16 nt, Human
uagugacuuguguccc

SEQ ID NO: 1360435 - RNA, 19 nt, Human
uaguuacuguguaauuagu

SEQ ID NO: 1360436 - RNA, 18 nt, Human
uaguuacuguguaauuag

SEQ ID NO: 1360437 - RNA, 17 nt, Human
uaguuacuguguaauua

SEQ ID NO: 1360438 - RNA, 22 nt, Human
uaguuagcuaauaaaaagcuuu

SEQ ID NO: 1360439 - RNA, 19 nt, Human
uaguuauacuuauuuguau

SEQ ID NO: 1360440 - RNA, 15 nt, Human
uaguucuaggcacug

SEQ ID NO: 1360441 - RNA, 23 nt, Human
uaguucuagacauggagguucua

SEQ ID NO: 1360442 - RNA, 12 nt, Human
uaguucuagaca

SEQ ID NO: 1360443 - RNA, 11 nt, Human
uaguucuagac

SEQ ID NO: 1360444 - RNA, 22 nt, Human
uaguucuagaaaaacaggcacu

SEQ ID NO: 1360445 - RNA, 16 nt, Human
uaguucuagaaaaaca

SEQ ID NO: 1360446 - RNA, 15 nt, Human
uaguucuagaaaaac

SEQ ID NO: 1360447 - RNA, 14 nt, Human
uaguucuagaaaaa

SEQ ID NO: 1360448 - RNA, 13 nt, Human
uaguucuagaaaa

SEQ ID NO: 1360449 - RNA, 15 nt, Human
uaguucuaagacuca

SEQ ID NO: 1360450 - RNA, 14 nt, Human
uaguucuaagacuc

SEQ ID NO: 1360451 - RNA, 13 nt, Human
uaguucuaagacu

SEQ ID NO: 1360452 - RNA, 21 nt, Human
uaguuccugcuaaaacaauga

SEQ ID NO: 1360453 - RNA, 15 nt, Human
uaguucugcuccaga

SEQ ID NO: 1360454 - RNA, 14 nt, Human
uaguucugccagga

SEQ ID NO: 1360455 - RNA, 16 nt, Human
uaguucuaggcacugu

SEQ ID NO: 1360456 - RNA, 13 nt, Human
uaguucugccagg

SEQ ID NO: 1360457 - RNA, 18 nt, Human
uaguucugcuccagacag

SEQ ID NO: 1360458 - RNA, 16 nt, Human
uaguucuguagaaaug

SEQ ID NO: 1360459 - RNA, 18 nt, Human
uaguucuguagaaauggu

SEQ ID NO: 1360460 - RNA, 19 nt, Human
uaguucugcuccagacagg

SEQ ID NO: 1360461 - RNA, 13 nt, Human
uaguucuguagaa

SEQ ID NO: 1360462 - RNA, 14 nt, Human
uaguucuguagaaa

SEQ ID NO: 1360463 - RNA, 15 nt, Human
uaguucuguagaaau

SEQ ID NO: 1360464 - RNA, 16 nt, Human
uaguuuuauaugcuuc

SEQ ID NO: 1360465 - RNA, 20 nt, Human
uauauauaaucaucaaguaa

SEQ ID NO: 1360466 - RNA, 12 nt, Human
uauauauaaaua

SEQ ID NO: 1360467 - RNA, 11 nt, Human
uauauauaaau

SEQ ID NO: 1360468 - RNA, 17 nt, Human
uauagauuguccuuuug

SEQ ID NO: 1360469 - RNA, 14 nt, Human
uauagcuaaguaca

SEQ ID NO: 1360470 - RNA, 20 nt, Human
uauauccaaaagcuuuuuau

SEQ ID NO: 1360471 - RNA, 22 nt, Human
uauaucacccagacauaaagga

SEQ ID NO: 1360472 - RNA, 13 nt, Human
uauaucacccaga

SEQ ID NO: 1360473 - RNA, 19 nt, Human
uauaucacauguuuucucu

SEQ ID NO: 1360474 - RNA, 23 nt, Human
uauauauuuuuuucugaaauuuc

SEQ ID NO: 1360475 - RNA, 22 nt, Human
uauauauuuuuuucugaaauuu

SEQ ID NO: 1360476 - RNA, 21 nt, Human
uauauauuuuuuucugaaauu

SEQ ID NO: 1360477 - RNA, 16 nt, Human
uauauauauauaugua

SEQ ID NO: 1360478 - RNA, 13 nt, Human
uauauauauauau

SEQ ID NO: 1360479 - RNA, 15 nt, Human
uauauauauauaaag

SEQ ID NO: 1360480 - RNA, 16 nt, Human
uauauauagcagcuuu

SEQ ID NO: 1360481 - RNA, 15 nt, Human
uauauauauauguac

SEQ ID NO: 1360482 - RNA, 14 nt, Human
uauauauauauaug

SEQ ID NO: 1360483 - RNA, 13 nt, Human
uauauaucaaaua

SEQ ID NO: 1360484 - RNA, 12 nt, Human
uauacacugugu

SEQ ID NO: 1360485 - RNA, 13 nt, Human
uauacauaaacaa

SEQ ID NO: 1360486 - RNA, 14 nt, Human
uauacauaaacaag

SEQ ID NO: 1360487 - RNA, 19 nt, Human
uauaauuuugugaagcaaa

SEQ ID NO: 1360488 - RNA, 22 nt, Human
uauaccaaagcacauuuuaaaa

SEQ ID NO: 1360489 - RNA, 15 nt, Human
uauaccaaaauguug

SEQ ID NO: 1360490 - RNA, 12 nt, Human
uauaccaauaaa

SEQ ID NO: 1360491 - RNA, 13 nt, Human
uauaccaauaaag

SEQ ID NO: 1360492 - RNA, 15 nt, Human
uauaccaauaaagug

SEQ ID NO: 1360493 - RNA, 17 nt, Human
uauaccaaagcacauuu

SEQ ID NO: 1360494 - RNA, 19 nt, Human
uauaccaguauaauugagu

SEQ ID NO: 1360495 - RNA, 14 nt, Human
uauaccaauaaagu

SEQ ID NO: 1360496 - RNA, 14 nt, Human
uauacccacccaga

SEQ ID NO: 1360497 - RNA, 17 nt, Human
uauagauucuaaagauu

SEQ ID NO: 1360498 - RNA, 15 nt, Human
uauagauucuaaaga

SEQ ID NO: 1360499 - RNA, 14 nt, Human
uauagauucuaaag

SEQ ID NO: 1360500 - RNA, 13 nt, Human
uauagauucuaaa

SEQ ID NO: 1360501 - RNA, 12 nt, Human
uauagauucuaa

SEQ ID NO: 1360502 - RNA, 19 nt, Human
uauaaccaacuuuucuauu

SEQ ID NO: 1360503 - RNA, 16 nt, Human
uauaacaguguuuaaa

SEQ ID NO: 1360504 - RNA, 12 nt, Human
acaccucccagg

SEQ ID NO: 1360505 - RNA, 22 nt, Human
acaccuauuaucccagcugccu

SEQ ID NO: 1360506 - RNA, 20 nt, Human
acaccuauuaucccagcugc

SEQ ID NO: 1360507 - RNA, 19 nt, Human
acaccuauuaucccagcug

SEQ ID NO: 1360508 - RNA, 18 nt, Human
acaccuauuaucccagcu

SEQ ID NO: 1360509 - RNA, 20 nt, Human
acaccuaugucauuucauuu

SEQ ID NO: 1360510 - RNA, 17 nt, Human
acaccuaugucauuuca

SEQ ID NO: 1360511 - RNA, 23 nt, Human
acaccuaggcuaggguggggaga

SEQ ID NO: 1360512 - RNA, 17 nt, Human
acaccuacccuccuuuu

SEQ ID NO: 1360513 - RNA, 20 nt, Human
acaccuaggcuagggugggg

SEQ ID NO: 1360514 - RNA, 16 nt, Human
uauaagcaucauuauu

SEQ ID NO: 1360515 - RNA, 15 nt, Human
uauaagcaucauuau

SEQ ID NO: 1360516 - RNA, 22 nt, Human
uauaagcaagaaggcaaaaaua

SEQ ID NO: 1360517 - RNA, 21 nt, Human
uauaagauccuagauccuaag

SEQ ID NO: 1360518 - RNA, 19 nt, Human
uauaagauccuagauccua

SEQ ID NO: 1360519 - RNA, 18 nt, Human
uauaagauccuagauccu

SEQ ID NO: 1360520 - RNA, 14 nt, Human
uauaagauccuaga

SEQ ID NO: 1360521 - RNA, 12 nt, Human
uauaagacucuc

SEQ ID NO: 1360522 - RNA, 15 nt, Human
uauaagaaagccuga

SEQ ID NO: 1360523 - RNA, 14 nt, Human
uauaagaaagccug

SEQ ID NO: 1360524 - RNA, 13 nt, Human
uauaagaaagccu

SEQ ID NO: 1360525 - RNA, 12 nt, Human
uauaagaaagcc

SEQ ID NO: 1360526 - RNA, 16 nt, Human
uauaaccagacacaua

SEQ ID NO: 1360527 - RNA, 20 nt, Human
uauaaccaguguuguggauu

SEQ ID NO: 1360528 - RNA, 17 nt, Human
uauaagcaucauuauuu

SEQ ID NO: 1360529 - RNA, 21 nt, Human
uauaagcaucauuauuuaugu

SEQ ID NO: 1360530 - RNA, 14 nt, Human
uauaauuuugugaa

SEQ ID NO: 1360531 - RNA, 22 nt, Human
acagccuccccugccagggcag

SEQ ID NO: 1360532 - RNA, 21 nt, Human
acagccuccccugccagggca

SEQ ID NO: 1360533 - RNA, 19 nt, Human
acagccuccccugccaggg

SEQ ID NO: 1360534 - RNA, 18 nt, Human
acagccuccccugccagg

SEQ ID NO: 1360535 - RNA, 17 nt, Human
acagccuccccugccag

SEQ ID NO: 1360536 - RNA, 15 nt, Human
acagccuccccugcc

SEQ ID NO: 1360537 - RNA, 12 nt, Human
acagccucagaa

SEQ ID NO: 1360538 - RNA, 15 nt, Human
acagccccacccugg

SEQ ID NO: 1360539 - RNA, 14 nt, Human
acagccccacccug

SEQ ID NO: 1360540 - RNA, 13 nt, Human
acagccccacccu

SEQ ID NO: 1360541 - RNA, 12 nt, Human
acagccccaccc

SEQ ID NO: 1360542 - RNA, 22 nt, Human
acagcagccuggggcuggccuc

SEQ ID NO: 1360543 - RNA, 14 nt, Human
acagauaacugaaa

SEQ ID NO: 1360544 - RNA, 22 nt, Human
acagcaggccagguccagagag

SEQ ID NO: 1360545 - RNA, 18 nt, Human
acagauaacugaaaauua

SEQ ID NO: 1360546 - RNA, 16 nt, Human
acagaguugauuuuuu

SEQ ID NO: 1360547 - RNA, 13 nt, Human
acagaguugauuu

SEQ ID NO: 1360548 - RNA, 18 nt, Human
acagaguguggacucugg

SEQ ID NO: 1360549 - RNA, 15 nt, Human
acagaguuguuacau

SEQ ID NO: 1360550 - RNA, 23 nt, Human
uaugaggacuugugucucugugc

SEQ ID NO: 1360551 - RNA, 17 nt, Human
uaugaggacuugugucu

SEQ ID NO: 1360552 - RNA, 17 nt, Human
uaucuuggacaaaucac

SEQ ID NO: 1360553 - RNA, 13 nt, Human
uaugaggcauuug

SEQ ID NO: 1360554 - RNA, 19 nt, Human
uaucuuggacaaaucacau

SEQ ID NO: 1360555 - RNA, 15 nt, Human
uaucuugaauaaugu

SEQ ID NO: 1360556 - RNA, 16 nt, Human
uaugagucuagauguu

SEQ ID NO: 1360557 - RNA, 14 nt, Human
uaugagucuagaug

SEQ ID NO: 1360558 - RNA, 15 nt, Human
uaugauaauagauuc

SEQ ID NO: 1360559 - RNA, 18 nt, Human
uaugauguuaaaaaaaua

SEQ ID NO: 1360560 - RNA, 14 nt, Human
uaugauguuaaaaa

SEQ ID NO: 1360561 - RNA, 21 nt, Human
uaugauggguguuuuuagcag

SEQ ID NO: 1360562 - RNA, 14 nt, Human
uaugaucugucugu

SEQ ID NO: 1360563 - RNA, 16 nt, Human
uaugaucugucugugg

SEQ ID NO: 1360564 - RNA, 17 nt, Human
uaugcucuuaauugcca

SEQ ID NO: 1360565 - RNA, 18 nt, Human
uaugcucuuaauugccac

SEQ ID NO: 1360566 - RNA, 16 nt, Human
uaugcucuuaauugcc

SEQ ID NO: 1360567 - RNA, 21 nt, Human
uauggcguaaguacagagaag

SEQ ID NO: 1360568 - RNA, 20 nt, Human
uauggcguaaguacagagaa

SEQ ID NO: 1360569 - RNA, 19 nt, Human
uauggcguaaguacagaga

SEQ ID NO: 1360570 - RNA, 18 nt, Human
uauggcguaaguacagag

SEQ ID NO: 1360571 - RNA, 17 nt, Human
uauggcguaaguacaga

SEQ ID NO: 1360572 - RNA, 14 nt, Human
uauggccuguguca

SEQ ID NO: 1360573 - RNA, 13 nt, Human
uauggccuguguc

SEQ ID NO: 1360574 - RNA, 22 nt, Human
uauggccugugagcuaggaauu

SEQ ID NO: 1360575 - RNA, 14 nt, Human
uauggccuguggau

SEQ ID NO: 1360576 - RNA, 12 nt, Human
acagccuggcug

SEQ ID NO: 1360577 - RNA, 21 nt, Human
uauggggaagguuaucagugc

SEQ ID NO: 1360578 - RNA, 22 nt, Human
uauggcguaaguacagagaagc

SEQ ID NO: 1360579 - RNA, 23 nt, Human
uauggcguaaguacagagaagcc

SEQ ID NO: 1360580 - RNA, 16 nt, Human
uauggcuuuugugcau

SEQ ID NO: 1360581 - RNA, 23 nt, Human
uauggggaagguuaucagugcuu

SEQ ID NO: 1360582 - RNA, 17 nt, Human
acagcuccacccuggcc

SEQ ID NO: 1360583 - RNA, 15 nt, Human
acagcuccaagaauu

SEQ ID NO: 1360584 - RNA, 16 nt, Human
acagagaggacuguag

SEQ ID NO: 1360585 - RNA, 20 nt, Human
acagagacugaauagauaug

SEQ ID NO: 1360586 - RNA, 14 nt, Human
acagagaccaagau

SEQ ID NO: 1360587 - RNA, 13 nt, Human
acagagaccaaga

SEQ ID NO: 1360588 - RNA, 12 nt, Human
acagagaccaag

SEQ ID NO: 1360589 - RNA, 14 nt, Human
acagagaaaccagc

SEQ ID NO: 1360590 - RNA, 15 nt, Human
acagagaaaccagcu

SEQ ID NO: 1360591 - RNA, 13 nt, Human
acagagaaaccag

SEQ ID NO: 1360592 - RNA, 20 nt, Human
acagacuggauguaccacca

SEQ ID NO: 1360593 - RNA, 14 nt, Human
acagaguggccguc

SEQ ID NO: 1360594 - RNA, 23 nt, Human
acagagcgugagcugagcaggcc

SEQ ID NO: 1360595 - RNA, 22 nt, Human
acagagcgugagcugagcaggc

SEQ ID NO: 1360596 - RNA, 22 nt, Human
uaucuacuuccaaacuaauuuu

SEQ ID NO: 1360597 - RNA, 22 nt, Human
uaucccaaaguuguuguaaccu

SEQ ID NO: 1360598 - RNA, 15 nt, Human
uaucuagauacugua

SEQ ID NO: 1360599 - RNA, 16 nt, Human
uaucuagauacuguau

SEQ ID NO: 1360600 - RNA, 16 nt, Human
uaucacuuaaacuugc

SEQ ID NO: 1360601 - RNA, 22 nt, Human
uauccauauugagucaaauggu

SEQ ID NO: 1360602 - RNA, 17 nt, Human
uaucuaggcaacauagu

SEQ ID NO: 1360603 - RNA, 17 nt, Human
uaucuacuuccaaacua

SEQ ID NO: 1360604 - RNA, 19 nt, Human
uaucuagauacuguaucau

SEQ ID NO: 1360605 - RNA, 16 nt, Human
uaucucccugccuccu

SEQ ID NO: 1360606 - RNA, 22 nt, Human
uaucucccugccuccugccggc

SEQ ID NO: 1360607 - RNA, 15 nt, Human
uauauuuacaaaugg

SEQ ID NO: 1360608 - RNA, 21 nt, Human
uaucaaguauuauaccuuuuu

SEQ ID NO: 1360609 - RNA, 16 nt, Human
uauauugauaagaucu

SEQ ID NO: 1360610 - RNA, 14 nt, Human
uauauuuacaaaug

SEQ ID NO: 1360611 - RNA, 12 nt, Human
uaucacauguuu

SEQ ID NO: 1360612 - RNA, 20 nt, Human
uaucacacacauugcuguga

SEQ ID NO: 1360613 - RNA, 19 nt, Human
uaucacacacauugcugug

SEQ ID NO: 1360614 - RNA, 13 nt, Human
uaucacacacauu

SEQ ID NO: 1360615 - RNA, 19 nt, Human
uaucaauaaauagaccauu

SEQ ID NO: 1360616 - RNA, 16 nt, Human
uaucacacaaagcaga

SEQ ID NO: 1360617 - RNA, 18 nt, Human
uaucacauguuuucucug

SEQ ID NO: 1360618 - RNA, 18 nt, Human
uaucacccagaagaaaau

SEQ ID NO: 1360619 - RNA, 22 nt, Human
uaucacuuaaacuugcaucacu

SEQ ID NO: 1360620 - RNA, 18 nt, Human
uaucacugaagcuuuuua

SEQ ID NO: 1360621 - RNA, 21 nt, Human
uaucacccaacgcuccaaagu

SEQ ID NO: 1360622 - RNA, 16 nt, Human
uaucacccaacgcucc

SEQ ID NO: 1360623 - RNA, 14 nt, Human
acagacacuggcau

SEQ ID NO: 1360624 - RNA, 14 nt, Human
acacucccuugggc

SEQ ID NO: 1360625 - RNA, 15 nt, Human
acacuccccgaaguc

SEQ ID NO: 1360626 - RNA, 23 nt, Human
acagacuauuuuuagauuuucuu

SEQ ID NO: 1360627 - RNA, 17 nt, Human
acagacuauuuuuagau

SEQ ID NO: 1360628 - RNA, 14 nt, Human
acagacuauuuuua

SEQ ID NO: 1360629 - RNA, 23 nt, Human
acagacugcgauuugucccaggu

SEQ ID NO: 1360630 - RNA, 16 nt, Human
uauauugauccagaaa

SEQ ID NO: 1360631 - RNA, 15 nt, Human
uauucugucccuagg

SEQ ID NO: 1360632 - RNA, 13 nt, Human
uauucugucccua

SEQ ID NO: 1360633 - RNA, 12 nt, Human
uauucugucccu

SEQ ID NO: 1360634 - RNA, 11 nt, Human
uauucuguccc

SEQ ID NO: 1360635 - RNA, 18 nt, Human
uauucugggguauggcgu

SEQ ID NO: 1360636 - RNA, 19 nt, Human
uauucugggggcugcaguu

SEQ ID NO: 1360637 - RNA, 13 nt, Human
uauucuucucuuc

SEQ ID NO: 1360638 - RNA, 18 nt, Human
uauucuucuagaguucag

SEQ ID NO: 1360639 - RNA, 17 nt, Human
uauucuucuagaguuca

SEQ ID NO: 1360640 - RNA, 14 nt, Human
uauucuucuagagu

SEQ ID NO: 1360641 - RNA, 13 nt, Human
uauucuucuagag

SEQ ID NO: 1360642 - RNA, 14 nt, Human
uauucuucauaaca

SEQ ID NO: 1360643 - RNA, 19 nt, Human
uauucucugagcugugcag

SEQ ID NO: 1360644 - RNA, 18 nt, Human
uauucucugagcugugca

SEQ ID NO: 1360645 - RNA, 12 nt, Human
uauucucugagc

SEQ ID NO: 1360646 - RNA, 19 nt, Human
acaguucuuugggccagac

SEQ ID NO: 1360647 - RNA, 20 nt, Human
acaguucuuugggccagaca

SEQ ID NO: 1360648 - RNA, 20 nt, Human
uauucucuccuguaccucuu

SEQ ID NO: 1360649 - RNA, 24 nt, Human
uauucucuccuguaccucuugagc

SEQ ID NO: 1360650 - RNA, 18 nt, Human
acaguucuuugggccaga

SEQ ID NO: 1360651 - RNA, 17 nt, Human
acaguucuuugggccag

SEQ ID NO: 1360652 - RNA, 21 nt, Human
acaguucugcucugguuguuu

SEQ ID NO: 1360653 - RNA, 22 nt, Human
acaguucugugguuucauguua

SEQ ID NO: 1360654 - RNA, 12 nt, Human
acaguucugugg

SEQ ID NO: 1360655 - RNA, 16 nt, Human
acaguucugcucuggu

SEQ ID NO: 1360656 - RNA, 15 nt, Human
acaguucauauguac

SEQ ID NO: 1360657 - RNA, 16 nt, Human
acaguucaagaaagcu

SEQ ID NO: 1360658 - RNA, 20 nt, Human
acaguucaagaaagcuucaa

SEQ ID NO: 1360659 - RNA, 12 nt, Human
acaguucaagaa

SEQ ID NO: 1360660 - RNA, 23 nt, Human
acaguuaucuaaguuaauuuaaa

SEQ ID NO: 1360661 - RNA, 17 nt, Human
acaguuaucuaaguuaa

SEQ ID NO: 1360662 - RNA, 16 nt, Human
acaguuaucuaaguua

SEQ ID NO: 1360663 - RNA, 15 nt, Human
acaguuaucuaaguu

SEQ ID NO: 1360664 - RNA, 13 nt, Human
acaguuacucaga

SEQ ID NO: 1360665 - RNA, 20 nt, Human
acaguuacucagaauucucu

SEQ ID NO: 1360666 - RNA, 23 nt, Human
acaguucggugagcuacaaaugc

SEQ ID NO: 1360667 - RNA, 19 nt, Human
acaguucggugagcuacaa

SEQ ID NO: 1360668 - RNA, 22 nt, Human
acaguucggugagcuacaaaug

SEQ ID NO: 1360669 - RNA, 13 nt, Human
uauucuugguuuu

SEQ ID NO: 1360670 - RNA, 14 nt, Human
uauucuugauguaa

SEQ ID NO: 1360671 - RNA, 14 nt, Human
uauucuugguuuuc

SEQ ID NO: 1360672 - RNA, 16 nt, Human
uauucuugauguaaaa

SEQ ID NO: 1360673 - RNA, 22 nt, Human
uauucuucucuuccuuuuauca

SEQ ID NO: 1360674 - RNA, 20 nt, Human
uauugacacagaaaauguug

SEQ ID NO: 1360675 - RNA, 18 nt, Human
uauugacacagaaaaugu

SEQ ID NO: 1360676 - RNA, 16 nt, Human
uauugacacagaaaau

SEQ ID NO: 1360677 - RNA, 13 nt, Human
uauugacacagaa

SEQ ID NO: 1360678 - RNA, 23 nt, Human
uauugacacagaaaauguugaga

SEQ ID NO: 1360679 - RNA, 17 nt, Human
uauugacuuguauauuu

SEQ ID NO: 1360680 - RNA, 15 nt, Human
uauugacuuguauau

SEQ ID NO: 1360681 - RNA, 14 nt, Human
uauugacuuguaua

SEQ ID NO: 1360682 - RNA, 22 nt, Human
uauugacuaacaggccaaagag

SEQ ID NO: 1360683 - RNA, 14 nt, Human
uauugagucaaaug

SEQ ID NO: 1360684 - RNA, 20 nt, Human
uauuguaacccugucuggau

SEQ ID NO: 1360685 - RNA, 15 nt, Human
uauuguaaauauugu

SEQ ID NO: 1360686 - RNA, 15 nt, Human
uauuguaaaacaggu

SEQ ID NO: 1360687 - RNA, 20 nt, Human
uauugguuuaaagaaagugu

SEQ ID NO: 1360688 - RNA, 17 nt, Human
uauugguguaagguacu

SEQ ID NO: 1360689 - RNA, 17 nt, Human
uauuggggucugacccc

SEQ ID NO: 1360690 - RNA, 16 nt, Human
uauuggggucugaccc

SEQ ID NO: 1360691 - RNA, 23 nt, Human
uauuuagaugauaaagagacagu

SEQ ID NO: 1360692 - RNA, 17 nt, Human
uauuuaccucagccugg

SEQ ID NO: 1360693 - RNA, 14 nt, Human
uauuuacgcuuuga

SEQ ID NO: 1360694 - RNA, 16 nt, Human
uauuuaccucagccug

SEQ ID NO: 1360695 - RNA, 15 nt, Human
uauuuaccucagccu

SEQ ID NO: 1360696 - RNA, 14 nt, Human
uauuuaccucagcc

SEQ ID NO: 1360697 - RNA, 13 nt, Human
uauuuaccucagc

SEQ ID NO: 1360698 - RNA, 17 nt, Human
uauuuaccccuccccua

SEQ ID NO: 1360699 - RNA, 14 nt, Human
uauuuacauuuaau

SEQ ID NO: 1360700 - RNA, 21 nt, Human
uauuuacaugaauugcauuuu

SEQ ID NO: 1360701 - RNA, 22 nt, Human
uauuuacgcuuugauucauagu

SEQ ID NO: 1360702 - RNA, 19 nt, Human
uauuuacgcuuugauucau

SEQ ID NO: 1360703 - RNA, 15 nt, Human
uauuuacgcuuugau

SEQ ID NO: 1360704 - RNA, 14 nt, Human
uauuuaaugcugug

SEQ ID NO: 1360705 - RNA, 21 nt, Human
uauuuaaugccgauauacucu

SEQ ID NO: 1360706 - RNA, 16 nt, Human
uauuuaauuagugcua

SEQ ID NO: 1360707 - RNA, 17 nt, Human
uauuuaauuagugcuaa

SEQ ID NO: 1360708 - RNA, 18 nt, Human
uauuuaauuagugcuaag

SEQ ID NO: 1360709 - RNA, 19 nt, Human
uauuuaauuagugcuaagu

SEQ ID NO: 1360710 - RNA, 21 nt, Human
uauuuaauuagugcuaagugu

SEQ ID NO: 1360711 - RNA, 14 nt, Human
uauuuaauucaugu

SEQ ID NO: 1360712 - RNA, 19 nt, Human
uauuuagcuugggaaaggu

SEQ ID NO: 1360713 - RNA, 21 nt, Human
uauuuagaugauaaagagaca

SEQ ID NO: 1360714 - RNA, 19 nt, Human
uauuuaguguucauaaaua

SEQ ID NO: 1360715 - RNA, 14 nt, Human
uauuucacuggagc

SEQ ID NO: 1360716 - RNA, 15 nt, Human
uauuucacuggagca

SEQ ID NO: 1360717 - RNA, 15 nt, Human
uauuucacaacagcc

SEQ ID NO: 1360718 - RNA, 15 nt, Human
uauuucaauguuagc

SEQ ID NO: 1360719 - RNA, 16 nt, Human
uauuucaauguuagcc

SEQ ID NO: 1360720 - RNA, 18 nt, Human
uauuucaaauuggagcuu

SEQ ID NO: 1360721 - RNA, 14 nt, Human
uauuucaaauugga

SEQ ID NO: 1360722 - RNA, 20 nt, Human
uauuuauuuuuuuuaaguau

SEQ ID NO: 1360723 - RNA, 18 nt, Human
uauuuauuuuaauaaugu

SEQ ID NO: 1360724 - RNA, 16 nt, Human
uauuuauuuuaauaau

SEQ ID NO: 1360725 - RNA, 14 nt, Human
uauuuauuuuaaua

SEQ ID NO: 1360726 - RNA, 13 nt, Human
uauuuaauagcaa

SEQ ID NO: 1360727 - RNA, 20 nt, Human
uauuuaagauaauuauaaua

SEQ ID NO: 1360728 - RNA, 17 nt, Human
uauuuaagauaauuaua

SEQ ID NO: 1360729 - RNA, 22 nt, Human
uauuuaauagcaaagaauugac

SEQ ID NO: 1360730 - RNA, 20 nt, Human
uauuuaauagcaaagaauug

SEQ ID NO: 1360731 - RNA, 19 nt, Human
uauuuaauagcaaagaauu

SEQ ID NO: 1360732 - RNA, 18 nt, Human
uauuuaauagcaaagaau

SEQ ID NO: 1360733 - RNA, 14 nt, Human
uauuuaauagguuu

SEQ ID NO: 1360734 - RNA, 21 nt, Human
uauuuaacugccuuguguaca

SEQ ID NO: 1360735 - RNA, 13 nt, Human
uauuuaacugacu

SEQ ID NO: 1360736 - RNA, 11 nt, Human
uauuuaacuga

SEQ ID NO: 1360737 - RNA, 23 nt, Human
uauuuaacucucuuuaugucugu

SEQ ID NO: 1360738 - RNA, 16 nt, Human
uauuuaacucucuuua

SEQ ID NO: 1360739 - RNA, 13 nt, Human
uauuuaacuaauu

SEQ ID NO: 1360740 - RNA, 19 nt, Human
uauuuaacagaaauuguau

SEQ ID NO: 1360741 - RNA, 17 nt, Human
uauugugcaauguaaau

SEQ ID NO: 1360742 - RNA, 16 nt, Human
uauuuaacagaaauug

SEQ ID NO: 1360743 - RNA, 18 nt, Human
uauuuaaccucuaaauuc

SEQ ID NO: 1360744 - RNA, 17 nt, Human
uauuuaaccucuaaauu

SEQ ID NO: 1360745 - RNA, 23 nt, Human
uauugucugaacuugcauuguga

SEQ ID NO: 1360746 - RNA, 17 nt, Human
uauuguccauuguccaa

SEQ ID NO: 1360747 - RNA, 15 nt, Human
uauuguccauugucc

SEQ ID NO: 1360748 - RNA, 17 nt, Human
uauugucuagugaaacu

SEQ ID NO: 1360749 - RNA, 13 nt, Human
uauuguauucugg

SEQ ID NO: 1360750 - RNA, 10 nt, Human
uauuguauuu

SEQ ID NO: 1360751 - RNA, 15 nt, Human
uauuguauuuauuca

SEQ ID NO: 1360752 - RNA, 16 nt, Human
uauuguauuuauucaa

SEQ ID NO: 1360753 - RNA, 17 nt, Human
uauuguauuuauucaau

SEQ ID NO: 1360754 - RNA, 18 nt, Human
uauuguauuuauucaaua

SEQ ID NO: 1360755 - RNA, 20 nt, Human
uauuguauuuauucaauaaa

SEQ ID NO: 1360756 - RNA, 21 nt, Human
uauuguagcauccuggaauau

SEQ ID NO: 1360757 - RNA, 20 nt, Human
uauuguagcauccuggaaua

SEQ ID NO: 1360758 - RNA, 18 nt, Human
uauuguagcauccuggaa

SEQ ID NO: 1360759 - RNA, 17 nt, Human
uauuguagcauccugga

SEQ ID NO: 1360760 - RNA, 16 nt, Human
uauuguauauuacaau

SEQ ID NO: 1360761 - RNA, 17 nt, Human
uauuguauauuacaaug

SEQ ID NO: 1360762 - RNA, 19 nt, Human
uauuguauauuacaaugau

SEQ ID NO: 1360763 - RNA, 21 nt, Human
acaguccgucaaaacagauug

SEQ ID NO: 1360764 - RNA, 17 nt, Human
acaguccgucaaaacag

SEQ ID NO: 1360765 - RNA, 18 nt, Human
acagucaaaaccaaguca

SEQ ID NO: 1360766 - RNA, 18 nt, Human
acaguauuuguaauuaaa

SEQ ID NO: 1360767 - RNA, 17 nt, Human
acaguauuuguaauuaa

SEQ ID NO: 1360768 - RNA, 14 nt, Human
acaguauuuguaau

SEQ ID NO: 1360769 - RNA, 22 nt, Human
acaguauugcucacccagugcc

SEQ ID NO: 1360770 - RNA, 16 nt, Human
acaguauugcucaccc

SEQ ID NO: 1360771 - RNA, 15 nt, Human
acaguauugcucacc

SEQ ID NO: 1360772 - RNA, 12 nt, Human
acaguauugcuc

SEQ ID NO: 1360773 - RNA, 20 nt, Human
acaguauuauacgcuggcaa

SEQ ID NO: 1360774 - RNA, 20 nt, Human
acagggcaguaccugagggu

SEQ ID NO: 1360775 - RNA, 22 nt, Human
uauucauccaaguuaaauguag

SEQ ID NO: 1360776 - RNA, 23 nt, Human
acaguauggggguuguaaauugg

SEQ ID NO: 1360777 - RNA, 22 nt, Human
acaguauggggguuguaaauug

SEQ ID NO: 1360778 - RNA, 21 nt, Human
acaguauggggguuguaaauu

SEQ ID NO: 1360779 - RNA, 20 nt, Human
acaguauggggguuguaaau

SEQ ID NO: 1360780 - RNA, 19 nt, Human
acaguauggggguuguaaa

SEQ ID NO: 1360781 - RNA, 22 nt, Human
acaguaaaccacugaaaaaaua

SEQ ID NO: 1360782 - RNA, 20 nt, Human
acaguaaaccacugaaaaaa

SEQ ID NO: 1360783 - RNA, 19 nt, Human
acaguaaaccacugaaaaa

SEQ ID NO: 1360784 - RNA, 18 nt, Human
acaguaaaccacugaaaa

SEQ ID NO: 1360785 - RNA, 17 nt, Human
acaguaaaccacugaaa

SEQ ID NO: 1360786 - RNA, 16 nt, Human
acaguaaaccacugaa

SEQ ID NO: 1360787 - RNA, 15 nt, Human
acaguaaaccacuga

SEQ ID NO: 1360788 - RNA, 21 nt, Human
acaguaaaccacugaaaaaau

SEQ ID NO: 1360789 - RNA, 14 nt, Human
acagucuaaagcug

SEQ ID NO: 1360790 - RNA, 15 nt, Human
acagucuaaagcugg

SEQ ID NO: 1360791 - RNA, 12 nt, Human
acagucuaaagc

SEQ ID NO: 1360792 - RNA, 19 nt, Human
acagucuuccauuugcaag

SEQ ID NO: 1360793 - RNA, 14 nt, Human
acagucuuccauuu

SEQ ID NO: 1360794 - RNA, 20 nt, Human
acagugaaagaaaauaacaa

SEQ ID NO: 1360795 - RNA, 22 nt, Human
acagugugcaaggcagccgugg

SEQ ID NO: 1360796 - RNA, 13 nt, Human
acagugugcaagg

SEQ ID NO: 1360797 - RNA, 19 nt, Human
acagugucuuuuuuuguau

SEQ ID NO: 1360798 - RNA, 21 nt, Human
acagugucuuuuuuuguauag

SEQ ID NO: 1360799 - RNA, 14 nt, Human
acagugucuuuuuu

SEQ ID NO: 1360800 - RNA, 12 nt, Human
acagugucuuuu

SEQ ID NO: 1360801 - RNA, 11 nt, Human
acagugucuuu

SEQ ID NO: 1360802 - RNA, 17 nt, Human
acagugagccugaauuu

SEQ ID NO: 1360803 - RNA, 14 nt, Human
acagugagccugaa

SEQ ID NO: 1360804 - RNA, 12 nt, Human
acagugagccug

SEQ ID NO: 1360805 - RNA, 17 nt, Human
acagugacuucugagau

SEQ ID NO: 1360806 - RNA, 15 nt, Human
acagugacuucugag

SEQ ID NO: 1360807 - RNA, 14 nt, Human
acagugacuucuga

SEQ ID NO: 1360808 - RNA, 19 nt, Human
acagugaagacagaaguuu

SEQ ID NO: 1360809 - RNA, 21 nt, Human
acagugaagacagaaguuugc

SEQ ID NO: 1360810 - RNA, 18 nt, Human
acagugaagacagaaguu

SEQ ID NO: 1360811 - RNA, 14 nt, Human
acagugaagacaga

SEQ ID NO: 1360812 - RNA, 13 nt, Human
acagugaagacag

SEQ ID NO: 1360813 - RNA, 20 nt, Human
acaguguuuauccuuucaua

SEQ ID NO: 1360814 - RNA, 21 nt, Human
acaguguuuauccuuucauau

SEQ ID NO: 1360815 - RNA, 18 nt, Human
acaguguuuauccuuuca

SEQ ID NO: 1360816 - RNA, 14 nt, Human
acaguguuuauccu

SEQ ID NO: 1360817 - RNA, 21 nt, Human
acaguguugaaaauguucaga

SEQ ID NO: 1360818 - RNA, 19 nt, Human
acaguguugaaaauguuca

SEQ ID NO: 1360819 - RNA, 19 nt, Human
acaguuacauaauucacuc

SEQ ID NO: 1360820 - RNA, 13 nt, Human
acaguuacauaau

SEQ ID NO: 1360821 - RNA, 21 nt, Human
acaguuaccucugccucagaa

SEQ ID NO: 1360822 - RNA, 21 nt, Human
uauucauccaaguuaaaugua

SEQ ID NO: 1360823 - RNA, 17 nt, Human
uauucauccaaguuaaa

SEQ ID NO: 1360824 - RNA, 16 nt, Human
uauucauaguuuaauu

SEQ ID NO: 1360825 - RNA, 23 nt, Human
uauucagggaaggaggagccugu

SEQ ID NO: 1360826 - RNA, 20 nt, Human
uauucagggaaggaggagcc

SEQ ID NO: 1360827 - RNA, 20 nt, Human
uauucaggacuugaaagaaa

SEQ ID NO: 1360828 - RNA, 13 nt, Human
uauucagacagau

SEQ ID NO: 1360829 - RNA, 11 nt, Human
uauucaauaaa

SEQ ID NO: 1360830 - RNA, 15 nt, Human
uauucagcucaugga

SEQ ID NO: 1360831 - RNA, 18 nt, Human
uauuagagugucuuucca

SEQ ID NO: 1360832 - RNA, 15 nt, Human
uauuagagugucuuu

SEQ ID NO: 1360833 - RNA, 22 nt, Human
uauuagaaucaaacauuuugaa

SEQ ID NO: 1360834 - RNA, 23 nt, Human
uauuagaaucaaacauuuugaaa

SEQ ID NO: 1360835 - RNA, 21 nt, Human
uauuagaaucaaacauuuuga

SEQ ID NO: 1360836 - RNA, 17 nt, Human
uauuagaaucaaacauu

SEQ ID NO: 1360837 - RNA, 15 nt, Human
uauuaccccuuuucg

SEQ ID NO: 1360838 - RNA, 15 nt, Human
uauuacauuuucagu

SEQ ID NO: 1360839 - RNA, 16 nt, Human
uauuaccacagacaua

SEQ ID NO: 1360840 - RNA, 14 nt, Human
uauuaguuuugauu

SEQ ID NO: 1360841 - RNA, 16 nt, Human
uauuagugcuuugcca

SEQ ID NO: 1360842 - RNA, 22 nt, Human
uauuagcccuucuccauggccc

SEQ ID NO: 1360843 - RNA, 12 nt, Human
uauuagauguuc

SEQ ID NO: 1360844 - RNA, 14 nt, Human
uauuagauguucuc

SEQ ID NO: 1360845 - RNA, 15 nt, Human
uauuagauguucucu

SEQ ID NO: 1360846 - RNA, 17 nt, Human
uauuagauguucucuau

SEQ ID NO: 1360847 - RNA, 21 nt, Human
uauuagauguucucuaucauu

SEQ ID NO: 1360848 - RNA, 22 nt, Human
uauuagauguucucuaucauuu

SEQ ID NO: 1360849 - RNA, 20 nt, Human
uauuaaagaaaaaaauguau

SEQ ID NO: 1360850 - RNA, 18 nt, Human
uauuaaagaaaaaaaugu

SEQ ID NO: 1360851 - RNA, 13 nt, Human
uauuaaagaaaaa

SEQ ID NO: 1360852 - RNA, 22 nt, Human
uauuaaagaaaaaaauguauuu

SEQ ID NO: 1360853 - RNA, 23 nt, Human
uauuaaaaaucucaaauuucuaa

SEQ ID NO: 1360854 - RNA, 19 nt, Human
uauuacaguguuuauccuu

SEQ ID NO: 1360855 - RNA, 16 nt, Human
uauuacaguguuuauc

SEQ ID NO: 1360856 - RNA, 15 nt, Human
uauuacaguguuuau

SEQ ID NO: 1360857 - RNA, 23 nt, Human
uauuacaguggggaaugaagaua

SEQ ID NO: 1360858 - RNA, 22 nt, Human
uauuaaagugcuaagguucuaa

SEQ ID NO: 1360859 - RNA, 24 nt, Human
uauuaaagugcuaagguucuaagg

SEQ ID NO: 1360860 - RNA, 18 nt, Human
uauuaaagugcuaagguu

SEQ ID NO: 1360861 - RNA, 14 nt, Human
uauuaaagugcuaa

SEQ ID NO: 1360862 - RNA, 21 nt, Human
uauuaaagaaaaaaauguauu

SEQ ID NO: 1360863 - RNA, 21 nt, Human
uauguuuucaggcuagaugua

SEQ ID NO: 1360864 - RNA, 16 nt, Human
uauuaaaaaucucaaa

SEQ ID NO: 1360865 - RNA, 18 nt, Human
uauuaaaaaucucaaauu

SEQ ID NO: 1360866 - RNA, 20 nt, Human
uauuaaaaaucucaaauuuc

SEQ ID NO: 1360867 - RNA, 22 nt, Human
uauuaaaaaucucaaauuucua

SEQ ID NO: 1360868 - RNA, 23 nt, Human
acagcuggggugcagggaugugg

SEQ ID NO: 1360869 - RNA, 21 nt, Human
acagcuggggugcagggaugu

SEQ ID NO: 1360870 - RNA, 16 nt, Human
acagcuggggugcagg

SEQ ID NO: 1360871 - RNA, 20 nt, Human
acagcuggcucuacuucccc

SEQ ID NO: 1360872 - RNA, 16 nt, Human
acagcuggcucuacuu

SEQ ID NO: 1360873 - RNA, 13 nt, Human
acagcuggcucua

SEQ ID NO: 1360874 - RNA, 17 nt, Human
acagcuggacccugacc

SEQ ID NO: 1360875 - RNA, 14 nt, Human
acagcuggacccug

SEQ ID NO: 1360876 - RNA, 14 nt, Human
acagcuccucccac

SEQ ID NO: 1360877 - RNA, 12 nt, Human
acagcuccuccc

SEQ ID NO: 1360878 - RNA, 16 nt, Human
accagggcuccagccc

SEQ ID NO: 1360879 - RNA, 15 nt, Human
accagggcuccagcc

SEQ ID NO: 1360880 - RNA, 17 nt, Human
accagggccagccucua

SEQ ID NO: 1360881 - RNA, 16 nt, Human
accagggccagccucu

SEQ ID NO: 1360882 - RNA, 22 nt, Human
accagggcaucucugggcugga

SEQ ID NO: 1360883 - RNA, 21 nt, Human
accagggcaucucugggcugg

SEQ ID NO: 1360884 - RNA, 20 nt, Human
accagggcaucucugggcug

SEQ ID NO: 1360885 - RNA, 19 nt, Human
accagggcaucucugggcu

SEQ ID NO: 1360886 - RNA, 18 nt, Human
accagggcaucucugggc

SEQ ID NO: 1360887 - RNA, 17 nt, Human
accagggcaucucuggg

SEQ ID NO: 1360888 - RNA, 21 nt, Human
accagggaugaugcaacaucc

SEQ ID NO: 1360889 - RNA, 19 nt, Human
ucacugucuuuaauucugu

SEQ ID NO: 1360890 - RNA, 16 nt, Human
accaguucucaugggu

SEQ ID NO: 1360891 - RNA, 16 nt, Human
accaguuaauuuuucc

SEQ ID NO: 1360892 - RNA, 14 nt, Human
accaguuaauuuuu

SEQ ID NO: 1360893 - RNA, 13 nt, Human
accaguuaauuuu

SEQ ID NO: 1360894 - RNA, 12 nt, Human
accaguuaauuu

SEQ ID NO: 1360895 - RNA, 21 nt, Human
accaguugcagucacucuagu

SEQ ID NO: 1360896 - RNA, 20 nt, Human
accaguugcagucacucuag

SEQ ID NO: 1360897 - RNA, 15 nt, Human
accaguugcagucac

SEQ ID NO: 1360898 - RNA, 21 nt, Human
accaguucucauggguggcac

SEQ ID NO: 1360899 - RNA, 15 nt, Human
accaguugccuuuua

SEQ ID NO: 1360900 - RNA, 14 nt, Human
accaguugccuuuu

SEQ ID NO: 1360901 - RNA, 13 nt, Human
accaguugccuuu

SEQ ID NO: 1360902 - RNA, 12 nt, Human
accaguugccuu

SEQ ID NO: 1360903 - RNA, 12 nt, Human
accagugccuua

SEQ ID NO: 1360904 - RNA, 21 nt, Human
accaguguuguggauuuaaca

SEQ ID NO: 1360905 - RNA, 14 nt, Human
ucaccuggcccugc

SEQ ID NO: 1360906 - RNA, 13 nt, Human
ucaccuggcccug

SEQ ID NO: 1360907 - RNA, 12 nt, Human
ucaccuggcccu

SEQ ID NO: 1360908 - RNA, 19 nt, Human
ucaccuggaagcauuuguu

SEQ ID NO: 1360909 - RNA, 22 nt, Human
ucaccuggacuuaagcaucugg

SEQ ID NO: 1360910 - RNA, 13 nt, Human
ucaccuggaagca

SEQ ID NO: 1360911 - RNA, 23 nt, Human
ucaccuggcccugcuuccugcuu

SEQ ID NO: 1360912 - RNA, 19 nt, Human
ucaccuggcccugcuuccu

SEQ ID NO: 1360913 - RNA, 16 nt, Human
ucaccuggcccugcuu

SEQ ID NO: 1360914 - RNA, 20 nt, Human
ucacugucuuuaauucugua

SEQ ID NO: 1360915 - RNA, 21 nt, Human
ucacuguagaaugauuucaug

SEQ ID NO: 1360916 - RNA, 19 nt, Human
accauuuccucagacucua

SEQ ID NO: 1360917 - RNA, 20 nt, Human
accauuucagagaggccuuu

SEQ ID NO: 1360918 - RNA, 14 nt, Human
accauuucagagag

SEQ ID NO: 1360919 - RNA, 11 nt, Human
accauuucaga

SEQ ID NO: 1360920 - RNA, 15 nt, Human
accauuuccucagac

SEQ ID NO: 1360921 - RNA, 13 nt, Human
accauuuccucag

SEQ ID NO: 1360922 - RNA, 23 nt, Human
accauuuuguuauugacuaacag

SEQ ID NO: 1360923 - RNA, 16 nt, Human
accaguugccuuuuau

SEQ ID NO: 1360924 - RNA, 14 nt, Human
accaugauuccuuu

SEQ ID NO: 1360925 - RNA, 23 nt, Human
acccaaccacaucccacucacaa

SEQ ID NO: 1360926 - RNA, 17 nt, Human
acccacuucugcacuug

SEQ ID NO: 1360927 - RNA, 20 nt, Human
acccaagaugcaagaaggag

SEQ ID NO: 1360928 - RNA, 22 nt, Human
acccaagaugggcaucuuuugu

SEQ ID NO: 1360929 - RNA, 16 nt, Human
acccaacgcuccaaag

SEQ ID NO: 1360930 - RNA, 13 nt, Human
acccaacgcucca

SEQ ID NO: 1360931 - RNA, 19 nt, Human
acccacuugcuuuuaaaau

SEQ ID NO: 1360932 - RNA, 16 nt, Human
acccagaagaaaauag

SEQ ID NO: 1360933 - RNA, 23 nt, Human
ucagaacagcagacucagcucug

SEQ ID NO: 1360934 - RNA, 14 nt, Human
ucagaacagcagac

SEQ ID NO: 1360935 - RNA, 15 nt, Human
acccagacauaaagg

SEQ ID NO: 1360936 - RNA, 17 nt, Human
acccagacauaaaggaa

SEQ ID NO: 1360937 - RNA, 15 nt, Human
acccacuucugcacu

SEQ ID NO: 1360938 - RNA, 22 nt, Human
acccacuuuaaaauaucuacau

SEQ ID NO: 1360939 - RNA, 18 nt, Human
acccagaaugagacaucc

SEQ ID NO: 1360940 - RNA, 20 nt, Human
acccagaaugagacauccag

SEQ ID NO: 1360941 - RNA, 19 nt, Human
acccagaaugagacaucca

SEQ ID NO: 1360942 - RNA, 21 nt, Human
uauuucauguuuuugaucaaa

SEQ ID NO: 1360943 - RNA, 13 nt, Human
uauuucauguuuu

SEQ ID NO: 1360944 - RNA, 21 nt, Human
uauuucaggcauuggauauuu

SEQ ID NO: 1360945 - RNA, 17 nt, Human
accacagccagcaccug

SEQ ID NO: 1360946 - RNA, 16 nt, Human
accacagccagcaccu

SEQ ID NO: 1360947 - RNA, 16 nt, Human
accacagcacagccaa

SEQ ID NO: 1360948 - RNA, 15 nt, Human
accacagcacagcca

SEQ ID NO: 1360949 - RNA, 21 nt, Human
accacagacauacuaaccagc

SEQ ID NO: 1360950 - RNA, 22 nt, Human
accacagacauacuaaccagca

SEQ ID NO: 1360951 - RNA, 12 nt, Human
accacucuguaa

SEQ ID NO: 1360952 - RNA, 20 nt, Human
accacucuggcagccacacu

SEQ ID NO: 1360953 - RNA, 18 nt, Human
accacucuggcagccaca

SEQ ID NO: 1360954 - RNA, 17 nt, Human
accacucuggcagccac

SEQ ID NO: 1360955 - RNA, 16 nt, Human
accacucuggcagcca

SEQ ID NO: 1360956 - RNA, 15 nt, Human
accacucuggcagcc

SEQ ID NO: 1360957 - RNA, 14 nt, Human
accacucuggcagc

SEQ ID NO: 1360958 - RNA, 13 nt, Human
accacucuggcag

SEQ ID NO: 1360959 - RNA, 12 nt, Human
accacucuggca

SEQ ID NO: 1360960 - RNA, 14 nt, Human
accacucagagaca

SEQ ID NO: 1360961 - RNA, 13 nt, Human
accacucagagac

SEQ ID NO: 1360962 - RNA, 20 nt, Human
accacucagagacaugcaga

SEQ ID NO: 1360963 - RNA, 12 nt, Human
accacucagaga

SEQ ID NO: 1360964 - RNA, 20 nt, Human
accacucuaucaaguauuau

SEQ ID NO: 1360965 - RNA, 19 nt, Human
accacugaaaaaauauaug

SEQ ID NO: 1360966 - RNA, 17 nt, Human
accacugaaaaaauaua

SEQ ID NO: 1360967 - RNA, 16 nt, Human
accacugaaaaaauau

SEQ ID NO: 1360968 - RNA, 15 nt, Human
accacugaaaaaaua

SEQ ID NO: 1360969 - RNA, 14 nt, Human
accacugaaaaaau

SEQ ID NO: 1360970 - RNA, 14 nt, Human
accacucuguaauu

SEQ ID NO: 1360971 - RNA, 21 nt, Human
accacugcccccugcugccau

SEQ ID NO: 1360972 - RNA, 23 nt, Human
accagcgaggaggcuccagaggg

SEQ ID NO: 1360973 - RNA, 12 nt, Human
accaggccaccu

SEQ ID NO: 1360974 - RNA, 21 nt, Human
accaggcagccucuggggggu

SEQ ID NO: 1360975 - RNA, 20 nt, Human
accaggcagccucugggggg

SEQ ID NO: 1360976 - RNA, 17 nt, Human
accaggcagccucuggg

SEQ ID NO: 1360977 - RNA, 21 nt, Human
accaggcaccaaaagaaguaa

SEQ ID NO: 1360978 - RNA, 15 nt, Human
accaggcaccaggca

SEQ ID NO: 1360979 - RNA, 19 nt, Human
accaggauagagacuggaa

SEQ ID NO: 1360980 - RNA, 16 nt, Human
accaggauagagacug

SEQ ID NO: 1360981 - RNA, 14 nt, Human
accaggauagagac

SEQ ID NO: 1360982 - RNA, 20 nt, Human
accaggaguggguggggagu

SEQ ID NO: 1360983 - RNA, 16 nt, Human
accaggaguggguggg

SEQ ID NO: 1360984 - RNA, 20 nt, Human
accaggcaccaaaagaagua

SEQ ID NO: 1360985 - RNA, 19 nt, Human
accaggcaccaaaagaagu

SEQ ID NO: 1360986 - RNA, 17 nt, Human
accaggcaccaaaagaa

SEQ ID NO: 1360987 - RNA, 17 nt, Human
accaggauagagacugg

SEQ ID NO: 1360988 - RNA, 17 nt, Human
accaggccaccucccca

SEQ ID NO: 1360989 - RNA, 14 nt, Human
accaggccaccucc

SEQ ID NO: 1360990 - RNA, 22 nt, Human
ucaccuccucuaagguugggca

SEQ ID NO: 1360991 - RNA, 12 nt, Human
ucaccuccucua

SEQ ID NO: 1360992 - RNA, 14 nt, Human
accagccuggccca

SEQ ID NO: 1360993 - RNA, 13 nt, Human
accagccuggccc

SEQ ID NO: 1360994 - RNA, 15 nt, Human
accagagagaguugu

SEQ ID NO: 1360995 - RNA, 15 nt, Human
accacuuucuuauuu

SEQ ID NO: 1360996 - RNA, 20 nt, Human
accagagaaaaagggagggg

SEQ ID NO: 1360997 - RNA, 18 nt, Human
accagagaaaaagggagg

SEQ ID NO: 1360998 - RNA, 23 nt, Human
accacuuguguuuugcaagccag

SEQ ID NO: 1360999 - RNA, 19 nt, Human
accacuuguguuuugcaag

SEQ ID NO: 1361000 - RNA, 12 nt, Human
accacuuuuguu

SEQ ID NO: 1361001 - RNA, 17 nt, Human
acccccucaccccucca

SEQ ID NO: 1361002 - RNA, 15 nt, Human
acccccggcagcagc

SEQ ID NO: 1361003 - RNA, 14 nt, Human
accccccaagcugu

SEQ ID NO: 1361004 - RNA, 14 nt, Human
acccccagcuuugc

SEQ ID NO: 1361005 - RNA, 18 nt, Human
acccccagcuccggccug

SEQ ID NO: 1361006 - RNA, 21 nt, Human
acccccagcucaauggacugg

SEQ ID NO: 1361007 - RNA, 20 nt, Human
acccccagcucaauggacug

SEQ ID NO: 1361008 - RNA, 13 nt, Human
acccccagcucaa

SEQ ID NO: 1361009 - RNA, 12 nt, Human
acccccagcuca

SEQ ID NO: 1361010 - RNA, 16 nt, Human
acccccagcuuugcua

SEQ ID NO: 1361011 - RNA, 15 nt, Human
acccccaggaccaga

SEQ ID NO: 1361012 - RNA, 22 nt, Human
accccauggcagugggaaaaau

SEQ ID NO: 1361013 - RNA, 19 nt, Human
accccauggagcugggcua

SEQ ID NO: 1361014 - RNA, 19 nt, Human
accccaugcuggccuugcc

SEQ ID NO: 1361015 - RNA, 18 nt, Human
acccagugcccccacuga

SEQ ID NO: 1361016 - RNA, 15 nt, Human
acccagugcccccac

SEQ ID NO: 1361017 - RNA, 16 nt, Human
acccagucuguucccc

SEQ ID NO: 1361018 - RNA, 15 nt, Human
accccauucccgcag

SEQ ID NO: 1361019 - RNA, 14 nt, Human
accccauucccgca

SEQ ID NO: 1361020 - RNA, 13 nt, Human
accccauucccgc

SEQ ID NO: 1361021 - RNA, 21 nt, Human
accccauggugcuaggaagag

SEQ ID NO: 1361022 - RNA, 17 nt, Human
acccccagccugggccu

SEQ ID NO: 1361023 - RNA, 16 nt, Human
acccccagccugggcc

SEQ ID NO: 1361024 - RNA, 15 nt, Human
acccccagccugggc

SEQ ID NO: 1361025 - RNA, 14 nt, Human
acccccagccuggg

SEQ ID NO: 1361026 - RNA, 13 nt, Human
acccccagccugg

SEQ ID NO: 1361027 - RNA, 13 nt, Human
acccccucacccc

SEQ ID NO: 1361028 - RNA, 17 nt, Human
acccccgucaagaguga

SEQ ID NO: 1361029 - RNA, 13 nt, Human
accccuguuucug

SEQ ID NO: 1361030 - RNA, 19 nt, Human
ucagccuggcuucaaauug

SEQ ID NO: 1361031 - RNA, 16 nt, Human
ucagaagaaaaagaag

SEQ ID NO: 1361032 - RNA, 13 nt, Human
ucagaagaaaaag

SEQ ID NO: 1361033 - RNA, 22 nt, Human
ucagaacucaaauggggccaga

SEQ ID NO: 1361034 - RNA, 21 nt, Human
ucagaacucaaauggggccag

SEQ ID NO: 1361035 - RNA, 15 nt, Human
ucagaacuagaauuu

SEQ ID NO: 1361036 - RNA, 17 nt, Human
ucagaagaaaaagaagc

SEQ ID NO: 1361037 - RNA, 18 nt, Human
ucagaagaaaaagaagca

SEQ ID NO: 1361038 - RNA, 18 nt, Human
ucagauggcagcuuuuaa

SEQ ID NO: 1361039 - RNA, 17 nt, Human
ucagauggcagcuuuua

SEQ ID NO: 1361040 - RNA, 16 nt, Human
ucagauggcagcuuuu

SEQ ID NO: 1361041 - RNA, 15 nt, Human
ucagauggcagcuuu

SEQ ID NO: 1361042 - RNA, 18 nt, Human
ucagaugcacaugagcug

SEQ ID NO: 1361043 - RNA, 14 nt, Human
ucagauucccagag

SEQ ID NO: 1361044 - RNA, 15 nt, Human
ucagcccugcaccau

SEQ ID NO: 1361045 - RNA, 20 nt, Human
acccagcucccuucuucccu

SEQ ID NO: 1361046 - RNA, 17 nt, Human
acccaggacaagcaugg

SEQ ID NO: 1361047 - RNA, 16 nt, Human
acccaggacaagcaug

SEQ ID NO: 1361048 - RNA, 14 nt, Human
acccaggacaagca

SEQ ID NO: 1361049 - RNA, 10 nt, Human
acccaggaca

SEQ ID NO: 1361050 - RNA, 11 nt, Human
acccaggacag

SEQ ID NO: 1361051 - RNA, 19 nt, Human
acccagguuggagugcagu

SEQ ID NO: 1361052 - RNA, 17 nt, Human
acccagguuaagaaaau

SEQ ID NO: 1361053 - RNA, 16 nt, Human
acccaguccacaaaau

SEQ ID NO: 1361054 - RNA, 18 nt, Human
acccaguaacucaucugu

SEQ ID NO: 1361055 - RNA, 17 nt, Human
acccaguaacucaucug

SEQ ID NO: 1361056 - RNA, 20 nt, Human
acccagguuggagugcagug

SEQ ID NO: 1361057 - RNA, 14 nt, Human
ucagcccugcacca

SEQ ID NO: 1361058 - RNA, 13 nt, Human
ucagcccugagga

SEQ ID NO: 1361059 - RNA, 16 nt, Human
ucagccccgcguggaa

SEQ ID NO: 1361060 - RNA, 23 nt, Human
ucagccccaccccagggcagcca

SEQ ID NO: 1361061 - RNA, 18 nt, Human
ucagccccacccuggccu

SEQ ID NO: 1361062 - RNA, 19 nt, Human
ucagccccaccccagggca

SEQ ID NO: 1361063 - RNA, 18 nt, Human
ucagccccaccccagggc

SEQ ID NO: 1361064 - RNA, 15 nt, Human
ucagccccaccccag

SEQ ID NO: 1361065 - RNA, 20 nt, Human
acccuucucccacucuccua

SEQ ID NO: 1361066 - RNA, 18 nt, Human
acccuucucccacucucc

SEQ ID NO: 1361067 - RNA, 17 nt, Human
acccuucucccacucuc

SEQ ID NO: 1361068 - RNA, 16 nt, Human
acccuucucccacucu

SEQ ID NO: 1361069 - RNA, 15 nt, Human
acccuucucccacuc

SEQ ID NO: 1361070 - RNA, 14 nt, Human
acccuucucccacu

SEQ ID NO: 1361071 - RNA, 19 nt, Human
acccuucccuugagcccuc

SEQ ID NO: 1361072 - RNA, 20 nt, Human
acccuucccuugagcccucu

SEQ ID NO: 1361073 - RNA, 15 nt, Human
acccucuuccuacug

SEQ ID NO: 1361074 - RNA, 16 nt, Human
acccucuuccuacugg

SEQ ID NO: 1361075 - RNA, 13 nt, Human
acccucuucaugg

SEQ ID NO: 1361076 - RNA, 21 nt, Human
acccucuguuccuucccugug

SEQ ID NO: 1361077 - RNA, 20 nt, Human
acccucuguuccuucccugu

SEQ ID NO: 1361078 - RNA, 14 nt, Human
acccucuguuccuu

SEQ ID NO: 1361079 - RNA, 23 nt, Human
acccucuggagggguguggcucc

SEQ ID NO: 1361080 - RNA, 21 nt, Human
acccgagucauucguucugug

SEQ ID NO: 1361081 - RNA, 16 nt, Human
acccgaggcugagaau

SEQ ID NO: 1361082 - RNA, 14 nt, Human
acccgaggcccgca

SEQ ID NO: 1361083 - RNA, 21 nt, Human
accccuuucuagaccaauaaa

SEQ ID NO: 1361084 - RNA, 19 nt, Human
accccuuucuagaccaaua

SEQ ID NO: 1361085 - RNA, 16 nt, Human
accccuuucccacccc

SEQ ID NO: 1361086 - RNA, 17 nt, Human
accccuuucccacccca

SEQ ID NO: 1361087 - RNA, 14 nt, Human
accccuuucccacc

SEQ ID NO: 1361088 - RNA, 13 nt, Human
accccuuucccac

SEQ ID NO: 1361089 - RNA, 21 nt, Human
accccuugucgccccucccuc

SEQ ID NO: 1361090 - RNA, 15 nt, Human
ucaggguaggcugga

SEQ ID NO: 1361091 - RNA, 13 nt, Human
acccuccuggcuc

SEQ ID NO: 1361092 - RNA, 11 nt, Human
acccuccuggc

SEQ ID NO: 1361093 - RNA, 18 nt, Human
acccuccaccgcagaagg

SEQ ID NO: 1361094 - RNA, 20 nt, Human
acccuccaccgcagaaggaa

SEQ ID NO: 1361095 - RNA, 21 nt, Human
acccuccaccgcagaaggaag

SEQ ID NO: 1361096 - RNA, 20 nt, Human
ucaggcccccgccuuggccu

SEQ ID NO: 1361097 - RNA, 19 nt, Human
ucaggcccccgccuuggcc

SEQ ID NO: 1361098 - RNA, 21 nt, Human
ucaggcccccaccuggcucac

SEQ ID NO: 1361099 - RNA, 20 nt, Human
ucaggcccccaccuggcuca

SEQ ID NO: 1361100 - RNA, 15 nt, Human
ucaggcccaggcacu

SEQ ID NO: 1361101 - RNA, 12 nt, Human
ucaggcccaggc

SEQ ID NO: 1361102 - RNA, 21 nt, Human
ucaggcccggcagggcgggca

SEQ ID NO: 1361103 - RNA, 16 nt, Human
ucaggcccggcagggc

SEQ ID NO: 1361104 - RNA, 22 nt, Human
ucaggcccccgccuuggccugu

SEQ ID NO: 1361105 - RNA, 19 nt, Human
ucaggcccuuauuuucaag

SEQ ID NO: 1361106 - RNA, 20 nt, Human
ucaggcauuggauauuuuuu

SEQ ID NO: 1361107 - RNA, 20 nt, Human
ucaggaagagaaggagcaga

SEQ ID NO: 1361108 - RNA, 13 nt, Human
ucagccugggcgc

SEQ ID NO: 1361109 - RNA, 20 nt, Human
ucagccuggccagacacagg

SEQ ID NO: 1361110 - RNA, 19 nt, Human
ucagccuggccagacacag

SEQ ID NO: 1361111 - RNA, 18 nt, Human
ucaggaaccgaggcaggg

SEQ ID NO: 1361112 - RNA, 19 nt, Human
ucagccugggcgcuggucc

SEQ ID NO: 1361113 - RNA, 16 nt, Human
ucagccugggcgcugg

SEQ ID NO: 1361114 - RNA, 15 nt, Human
ucaggaagagaagga

SEQ ID NO: 1361115 - RNA, 16 nt, Human
ucaggaagagaaggag

SEQ ID NO: 1361116 - RNA, 21 nt, Human
uccagccugacaucaaaaaag

SEQ ID NO: 1361117 - RNA, 13 nt, Human
uccagccugacau

SEQ ID NO: 1361118 - RNA, 11 nt, Human
uccagccugac

SEQ ID NO: 1361119 - RNA, 21 nt, Human
uccacguucugcucaucauuc

SEQ ID NO: 1361120 - RNA, 20 nt, Human
uccacguucugcucaucauu

SEQ ID NO: 1361121 - RNA, 19 nt, Human
uccacguucugcucaucau

SEQ ID NO: 1361122 - RNA, 18 nt, Human
uccacguacugcagccuc

SEQ ID NO: 1361123 - RNA, 17 nt, Human
uccacguacugcagccu

SEQ ID NO: 1361124 - RNA, 15 nt, Human
uccacguacugcagc

SEQ ID NO: 1361125 - RNA, 22 nt, Human
accuugaaaaaaaacaguggau

SEQ ID NO: 1361126 - RNA, 23 nt, Human
accuuuguauucucuccuguacc

SEQ ID NO: 1361127 - RNA, 15 nt, Human
accuuuguauucucu

SEQ ID NO: 1361128 - RNA, 19 nt, Human
accuuuguauucucuccug

SEQ ID NO: 1361129 - RNA, 17 nt, Human
uccagaaugcuguacau

SEQ ID NO: 1361130 - RNA, 16 nt, Human
uccagaaugcuguaca

SEQ ID NO: 1361131 - RNA, 15 nt, Human
uccagaaugcuguac

SEQ ID NO: 1361132 - RNA, 13 nt, Human
uccagaaugcugu

SEQ ID NO: 1361133 - RNA, 19 nt, Human
uccagaagugugacuggcu

SEQ ID NO: 1361134 - RNA, 20 nt, Human
uccagaagugugacuggcua

SEQ ID NO: 1361135 - RNA, 15 nt, Human
uccagaagugugacu

SEQ ID NO: 1361136 - RNA, 14 nt, Human
uccagaagugugac

SEQ ID NO: 1361137 - RNA, 15 nt, Human
uccacugagggcagu

SEQ ID NO: 1361138 - RNA, 20 nt, Human
uccacucugcuucucugacu

SEQ ID NO: 1361139 - RNA, 19 nt, Human
uccacucugcuucucugac

SEQ ID NO: 1361140 - RNA, 15 nt, Human
uccacucugcuucuc

SEQ ID NO: 1361141 - RNA, 14 nt, Human
uccacucugcuucu

SEQ ID NO: 1361142 - RNA, 12 nt, Human
uccacucugcuu

SEQ ID NO: 1361143 - RNA, 24 nt, Human
uccacucugcuucucugacuucug

SEQ ID NO: 1361144 - RNA, 23 nt, Human
uccacucugcuucucugacuucu

SEQ ID NO: 1361145 - RNA, 21 nt, Human
uccacucugcuucucugacuu

SEQ ID NO: 1361146 - RNA, 13 nt, Human
uccacucuuucuu

SEQ ID NO: 1361147 - RNA, 15 nt, Human
uccacucuuucuuuc

SEQ ID NO: 1361148 - RNA, 16 nt, Human
uccacucuuucuuuca

SEQ ID NO: 1361149 - RNA, 14 nt, Human
accuuaauuuauua

SEQ ID NO: 1361150 - RNA, 15 nt, Human
accuuaauuuauuau

SEQ ID NO: 1361151 - RNA, 22 nt, Human
accuuaagaccuacuguucuaa

SEQ ID NO: 1361152 - RNA, 12 nt, Human
accuuaagaccu

SEQ ID NO: 1361153 - RNA, 16 nt, Human
accuggugcugccucu

SEQ ID NO: 1361154 - RNA, 14 nt, Human
accuggucucuccu

SEQ ID NO: 1361155 - RNA, 20 nt, Human
accuuauaguuacuguguaa

SEQ ID NO: 1361156 - RNA, 19 nt, Human
accuuauaguuacugugua

SEQ ID NO: 1361157 - RNA, 18 nt, Human
accuuauaguuacugugu

SEQ ID NO: 1361158 - RNA, 14 nt, Human
accuuauaguuacu

SEQ ID NO: 1361159 - RNA, 12 nt, Human
accuuauaguua

SEQ ID NO: 1361160 - RNA, 22 nt, Human
accuuagcuggcauuacagcug

SEQ ID NO: 1361161 - RNA, 21 nt, Human
accuuagcuggcauuacagcu

SEQ ID NO: 1361162 - RNA, 23 nt, Human
accuuaggaauaaucuccuguua

SEQ ID NO: 1361163 - RNA, 14 nt, Human
accuuagaauacag

SEQ ID NO: 1361164 - RNA, 18 nt, Human
accuugaaaaaaaacagu

SEQ ID NO: 1361165 - RNA, 16 nt, Human
accuugaaaaaaaaca

SEQ ID NO: 1361166 - RNA, 14 nt, Human
accuucuccccagc

SEQ ID NO: 1361167 - RNA, 22 nt, Human
accuucuccccagcucccagga

SEQ ID NO: 1361168 - RNA, 23 nt, Human
accuucuccccagcucccaggac

SEQ ID NO: 1361169 - RNA, 21 nt, Human
accuucuccccagcucccagg

SEQ ID NO: 1361170 - RNA, 19 nt, Human
accuucuccccagcuccca

SEQ ID NO: 1361171 - RNA, 18 nt, Human
accuucuccccagcuccc

SEQ ID NO: 1361172 - RNA, 15 nt, Human
accuucuccccagcu

SEQ ID NO: 1361173 - RNA, 23 nt, Human
accuuauaguuacuguguaauua

SEQ ID NO: 1361174 - RNA, 22 nt, Human
accuuauaguuacuguguaauu

SEQ ID NO: 1361175 - RNA, 12 nt, Human
accuuccaccca

SEQ ID NO: 1361176 - RNA, 17 nt, Human
accuuccagcuccugua

SEQ ID NO: 1361177 - RNA, 14 nt, Human
accuuccagcuccu

SEQ ID NO: 1361178 - RNA, 13 nt, Human
accuuccagcucc

SEQ ID NO: 1361179 - RNA, 23 nt, Human
accuuccagaaauacuacugugu

SEQ ID NO: 1361180 - RNA, 15 nt, Human
accuuccagaaauac

SEQ ID NO: 1361181 - RNA, 14 nt, Human
accuuccacccagu

SEQ ID NO: 1361182 - RNA, 16 nt, Human
uccacauuucuaaaau

SEQ ID NO: 1361183 - RNA, 14 nt, Human
uccacauuucuaaa

SEQ ID NO: 1361184 - RNA, 13 nt, Human
uccacauuucuaa

SEQ ID NO: 1361185 - RNA, 15 nt, Human
uccacauuucuaaaa

SEQ ID NO: 1361186 - RNA, 19 nt, Human
uccaccaaaugugcuuuga

SEQ ID NO: 1361187 - RNA, 17 nt, Human
uccacaggucuagacua

SEQ ID NO: 1361188 - RNA, 16 nt, Human
uccacaggucuagacu

SEQ ID NO: 1361189 - RNA, 15 nt, Human
uccacaggucuagac

SEQ ID NO: 1361190 - RNA, 14 nt, Human
uccacaggucuaga

SEQ ID NO: 1361191 - RNA, 14 nt, Human
uccacagugacucc

SEQ ID NO: 1361192 - RNA, 21 nt, Human
uccacagggucccacagccac

SEQ ID NO: 1361193 - RNA, 20 nt, Human
uccacagggucccacagcca

SEQ ID NO: 1361194 - RNA, 18 nt, Human
uccacagggucccacagc

SEQ ID NO: 1361195 - RNA, 17 nt, Human
uccacagggucccacag

SEQ ID NO: 1361196 - RNA, 16 nt, Human
uccacagggucccaca

SEQ ID NO: 1361197 - RNA, 15 nt, Human
uccacagggucccac

SEQ ID NO: 1361198 - RNA, 20 nt, Human
uccaaucaaucuugcaugua

SEQ ID NO: 1361199 - RNA, 21 nt, Human
uccaaucaaucuugcauguaa

SEQ ID NO: 1361200 - RNA, 19 nt, Human
uccaaucaaucuugcaugu

SEQ ID NO: 1361201 - RNA, 17 nt, Human
uccaaguuguucgggcc

SEQ ID NO: 1361202 - RNA, 22 nt, Human
uccaaguuguucgggccaagga

SEQ ID NO: 1361203 - RNA, 17 nt, Human
uccaaguuaaauguaga

SEQ ID NO: 1361204 - RNA, 16 nt, Human
uccaaguuaaauguag

SEQ ID NO: 1361205 - RNA, 15 nt, Human
uccaaguuaaaugua

SEQ ID NO: 1361206 - RNA, 14 nt, Human
uccaaguuaaaugu

SEQ ID NO: 1361207 - RNA, 22 nt, Human
uccaagcugggagauucaaggg

SEQ ID NO: 1361208 - RNA, 12 nt, Human
uccaagcuggga

SEQ ID NO: 1361209 - RNA, 19 nt, Human
uccaacuaaugccuuacuc

SEQ ID NO: 1361210 - RNA, 15 nt, Human
uccaacuaaugccuu

SEQ ID NO: 1361211 - RNA, 14 nt, Human
uccaacguggccca

SEQ ID NO: 1361212 - RNA, 16 nt, Human
uccaacguggcccaga

SEQ ID NO: 1361213 - RNA, 20 nt, Human
uccaacaucacagcccagcc

SEQ ID NO: 1361214 - RNA, 23 nt, Human
uccaacaguuuaaugaagaucua

SEQ ID NO: 1361215 - RNA, 21 nt, Human
uccaacaguuuaaugaagauc

SEQ ID NO: 1361216 - RNA, 18 nt, Human
uccaacaguuuaaugaag

SEQ ID NO: 1361217 - RNA, 15 nt, Human
uccaacaguuuaaug

SEQ ID NO: 1361218 - RNA, 23 nt, Human
uccaacaccaagcacagcagccu

SEQ ID NO: 1361219 - RNA, 21 nt, Human
uccaacaccaagcacagcagc

SEQ ID NO: 1361220 - RNA, 17 nt, Human
uccaacaccaagcacag

SEQ ID NO: 1361221 - RNA, 17 nt, Human
uccaaauacuaaugaaa

SEQ ID NO: 1361222 - RNA, 22 nt, Human
uccaagcucacuccccaacccc

SEQ ID NO: 1361223 - RNA, 17 nt, Human
uccaagcucacucccca

SEQ ID NO: 1361224 - RNA, 23 nt, Human
uccaacuacuaauagaauaaagg

SEQ ID NO: 1361225 - RNA, 21 nt, Human
uccaacuacuaauagaauaaa

SEQ ID NO: 1361226 - RNA, 20 nt, Human
uccaacuacuaauagaauaa

SEQ ID NO: 1361227 - RNA, 22 nt, Human
uccaacuaaugccuuacucuuc

SEQ ID NO: 1361228 - RNA, 21 nt, Human
uccaacuaucucauuuccaag

SEQ ID NO: 1361229 - RNA, 15 nt, Human
accugaaggguugac

SEQ ID NO: 1361230 - RNA, 18 nt, Human
accugaauaaagaaugaa

SEQ ID NO: 1361231 - RNA, 18 nt, Human
accuggaacuuggggagu

SEQ ID NO: 1361232 - RNA, 17 nt, Human
accugcugagcucugag

SEQ ID NO: 1361233 - RNA, 16 nt, Human
accugcugagcucuga

SEQ ID NO: 1361234 - RNA, 15 nt, Human
accugcugagcucug

SEQ ID NO: 1361235 - RNA, 14 nt, Human
accugcugagcucu

SEQ ID NO: 1361236 - RNA, 13 nt, Human
accugcugagcuc

SEQ ID NO: 1361237 - RNA, 12 nt, Human
accugcugagcu

SEQ ID NO: 1361238 - RNA, 11 nt, Human
accugcugagc

SEQ ID NO: 1361239 - RNA, 17 nt, Human
accugcugaccugugca

SEQ ID NO: 1361240 - RNA, 18 nt, Human
accugcugaccugugcac

SEQ ID NO: 1361241 - RNA, 16 nt, Human
accugcugaccugugc

SEQ ID NO: 1361242 - RNA, 23 nt, Human
accuggaagcauuuguuucuacu

SEQ ID NO: 1361243 - RNA, 18 nt, Human
accuggaagcauuuguuu

SEQ ID NO: 1361244 - RNA, 14 nt, Human
accuggaauauaua

SEQ ID NO: 1361245 - RNA, 17 nt, Human
accuggaauauauaacc

SEQ ID NO: 1361246 - RNA, 16 nt, Human
ucauuuuuuaaaaaag

SEQ ID NO: 1361247 - RNA, 15 nt, Human
ucauuuuauguuaag

SEQ ID NO: 1361248 - RNA, 18 nt, Human
ucauuuuuuuccuugcaa

SEQ ID NO: 1361249 - RNA, 15 nt, Human
ucauuuuuuuccuug

SEQ ID NO: 1361250 - RNA, 13 nt, Human
ucauuuuuuuuaa

SEQ ID NO: 1361251 - RNA, 18 nt, Human
uccaaagucucuaauucu

SEQ ID NO: 1361252 - RNA, 17 nt, Human
uccaaagucucuaauuc

SEQ ID NO: 1361253 - RNA, 14 nt, Human
uccaaagucucuaa

SEQ ID NO: 1361254 - RNA, 13 nt, Human
uccaaagucucua

SEQ ID NO: 1361255 - RNA, 17 nt, Human
ucauuuuuuuuaagaaa

SEQ ID NO: 1361256 - RNA, 23 nt, Human
uccaaagucucuggaauuugaaa

SEQ ID NO: 1361257 - RNA, 14 nt, Human
ucauuugcuuugga

SEQ ID NO: 1361258 - RNA, 22 nt, Human
ucauuuuaacaucugagaaaag

SEQ ID NO: 1361259 - RNA, 21 nt, Human
ucauuuguuuaaaaaggcagu

SEQ ID NO: 1361260 - RNA, 17 nt, Human
ucauuuguuuaaaaagg

SEQ ID NO: 1361261 - RNA, 13 nt, Human
ucauuuguuuaaa

SEQ ID NO: 1361262 - RNA, 12 nt, Human
ucauuuguuuaa

SEQ ID NO: 1361263 - RNA, 15 nt, Human
ucauuuguuggaaug

SEQ ID NO: 1361264 - RNA, 14 nt, Human
ucauuuuaauuauu

SEQ ID NO: 1361265 - RNA, 13 nt, Human
ucauuuuaauuau

SEQ ID NO: 1361266 - RNA, 20 nt, Human
ucauuuuaacaucugagaaa

SEQ ID NO: 1361267 - RNA, 20 nt, Human
ucauuuuagggguagcauuu

SEQ ID NO: 1361268 - RNA, 23 nt, Human
accuccucagccugaaccccagg

SEQ ID NO: 1361269 - RNA, 15 nt, Human
accuccucagccuga

SEQ ID NO: 1361270 - RNA, 14 nt, Human
accuccucagccug

SEQ ID NO: 1361271 - RNA, 13 nt, Human
accuccucagccu

SEQ ID NO: 1361272 - RNA, 19 nt, Human
accuccuauggguugucac

SEQ ID NO: 1361273 - RNA, 19 nt, Human
accucagauggcagcuuuu

SEQ ID NO: 1361274 - RNA, 18 nt, Human
accucagauggcagcuuu

SEQ ID NO: 1361275 - RNA, 16 nt, Human
accucagauggcagcu

SEQ ID NO: 1361276 - RNA, 15 nt, Human
accucagauggcagc

SEQ ID NO: 1361277 - RNA, 14 nt, Human
accucagauggcag

SEQ ID NO: 1361278 - RNA, 20 nt, Human
accucagaaguaaaggaauu

SEQ ID NO: 1361279 - RNA, 17 nt, Human
accucagaccccggggu

SEQ ID NO: 1361280 - RNA, 13 nt, Human
accucagaaguaa

SEQ ID NO: 1361281 - RNA, 22 nt, Human
accucagauggcagcuuuuaaa

SEQ ID NO: 1361282 - RNA, 21 nt, Human
accucagauggcagcuuuuaa

SEQ ID NO: 1361283 - RNA, 20 nt, Human
accucagauggcagcuuuua

SEQ ID NO: 1361284 - RNA, 19 nt, Human
accucaccaacuccuaguu

SEQ ID NO: 1361285 - RNA, 17 nt, Human
accucaccaagcugcug

SEQ ID NO: 1361286 - RNA, 17 nt, Human
accucaccaacuccuag

SEQ ID NO: 1361287 - RNA, 16 nt, Human
accucaccaacuccua

SEQ ID NO: 1361288 - RNA, 15 nt, Human
accucaccaacuccu

SEQ ID NO: 1361289 - RNA, 19 nt, Human
accucaagugaucugccca

SEQ ID NO: 1361290 - RNA, 16 nt, Human
accucaagcugcaucu

SEQ ID NO: 1361291 - RNA, 21 nt, Human
accucaaucagucucagaaug

SEQ ID NO: 1361292 - RNA, 19 nt, Human
accucaaucagucucagaa

SEQ ID NO: 1361293 - RNA, 23 nt, Human
accucaagugaucugcccaccuc

SEQ ID NO: 1361294 - RNA, 13 nt, Human
accucaauguccc

SEQ ID NO: 1361295 - RNA, 19 nt, Human
accuaugucauuucauuuc

SEQ ID NO: 1361296 - RNA, 14 nt, Human
accucaagcugcau

SEQ ID NO: 1361297 - RNA, 18 nt, Human
accuaugucauuucauuu

SEQ ID NO: 1361298 - RNA, 16 nt, Human
accuaugucauuucau

SEQ ID NO: 1361299 - RNA, 15 nt, Human
accuaugucauuuca

SEQ ID NO: 1361300 - RNA, 12 nt, Human
accuaugucauu

SEQ ID NO: 1361301 - RNA, 19 nt, Human
accuaugauauuuucugug

SEQ ID NO: 1361302 - RNA, 14 nt, Human
accuaucccaccuc

SEQ ID NO: 1361303 - RNA, 17 nt, Human
accuaucccaccuccau

SEQ ID NO: 1361304 - RNA, 18 nt, Human
accuauaccuguguuucu

SEQ ID NO: 1361305 - RNA, 15 nt, Human
accuauaccuguguu

SEQ ID NO: 1361306 - RNA, 23 nt, Human
accuagcugaauguuuuucuaaa

SEQ ID NO: 1361307 - RNA, 22 nt, Human
accuagcugaauguuuuucuaa

SEQ ID NO: 1361308 - RNA, 21 nt, Human
accuagcugaauguuuuucua

SEQ ID NO: 1361309 - RNA, 20 nt, Human
accuagcugaauguuuuucu

SEQ ID NO: 1361310 - RNA, 19 nt, Human
accuagcugaauguuuuuc

SEQ ID NO: 1361311 - RNA, 18 nt, Human
accuagcugaauguuuuu

SEQ ID NO: 1361312 - RNA, 21 nt, Human
accuagcgggauggggcuccc

SEQ ID NO: 1361313 - RNA, 17 nt, Human
accuagauuuaauauaa

SEQ ID NO: 1361314 - RNA, 23 nt, Human
accuagcagcaccguucugugca

SEQ ID NO: 1361315 - RNA, 22 nt, Human
accuagcagcaccguucugugc

SEQ ID NO: 1361316 - RNA, 21 nt, Human
accuagcagcaccguucugug

SEQ ID NO: 1361317 - RNA, 14 nt, Human
accuagcagcaccg

SEQ ID NO: 1361318 - RNA, 13 nt, Human
accuagauuuaau

SEQ ID NO: 1361319 - RNA, 21 nt, Human
accuagauguauaacuaggag

SEQ ID NO: 1361320 - RNA, 13 nt, Human
accguugucucau

SEQ ID NO: 1361321 - RNA, 14 nt, Human
accguucugugcac

SEQ ID NO: 1361322 - RNA, 16 nt, Human
accgugggcucccuga

SEQ ID NO: 1361323 - RNA, 14 nt, Human
accgugggcucccu

SEQ ID NO: 1361324 - RNA, 21 nt, Human
accuaagauuacaaaucagaa

SEQ ID NO: 1361325 - RNA, 18 nt, Human
accuaacucuucuuucau

SEQ ID NO: 1361326 - RNA, 17 nt, Human
accuaacucuucuuuca

SEQ ID NO: 1361327 - RNA, 15 nt, Human
accuaauccaggcag

SEQ ID NO: 1361328 - RNA, 11 nt, Human
accuaauccaa

SEQ ID NO: 1361329 - RNA, 21 nt, Human
accuaauccaggcagauccag

SEQ ID NO: 1361330 - RNA, 20 nt, Human
accuaauccaggcagaucca

SEQ ID NO: 1361331 - RNA, 12 nt, Human
accuagauuuuu

SEQ ID NO: 1361332 - RNA, 19 nt, Human
accgaaugugucuuuagau

SEQ ID NO: 1361333 - RNA, 22 nt, Human
accgaaugugucuuuagauagc

SEQ ID NO: 1361334 - RNA, 16 nt, Human
accgaaugugucuuua

SEQ ID NO: 1361335 - RNA, 15 nt, Human
accgaaugugucuuu

SEQ ID NO: 1361336 - RNA, 18 nt, Human
accgaagcccagaggguc

SEQ ID NO: 1361337 - RNA, 13 nt, Human
accgaagcccaga

SEQ ID NO: 1361338 - RNA, 12 nt, Human
accgaagcccag

SEQ ID NO: 1361339 - RNA, 12 nt, Human
acccuuuuccag

SEQ ID NO: 1361340 - RNA, 11 nt, Human
acccuuuucau

SEQ ID NO: 1361341 - RNA, 19 nt, Human
acccuuugugugcucucca

SEQ ID NO: 1361342 - RNA, 23 nt, Human
acccuuugugugcucuccauucu

SEQ ID NO: 1361343 - RNA, 23 nt, Human
acccuuugcugugaggcuguccu

SEQ ID NO: 1361344 - RNA, 22 nt, Human
acccuuugcugugaggcugucc

SEQ ID NO: 1361345 - RNA, 17 nt, Human
acccuuuucaugauuuu

SEQ ID NO: 1361346 - RNA, 21 nt, Human
accgccagcucuguucuuccu

SEQ ID NO: 1361347 - RNA, 16 nt, Human
accgccagcucuguuc

SEQ ID NO: 1361348 - RNA, 14 nt, Human
accgccagcucugu

SEQ ID NO: 1361349 - RNA, 13 nt, Human
accgccagcucug

SEQ ID NO: 1361350 - RNA, 12 nt, Human
accgccagcucu

SEQ ID NO: 1361351 - RNA, 20 nt, Human
accgcccagcggcuugccug

SEQ ID NO: 1361352 - RNA, 19 nt, Human
accgcccccugucucucag

SEQ ID NO: 1361353 - RNA, 19 nt, Human
accgcccccuccucuagcu

SEQ ID NO: 1361354 - RNA, 14 nt, Human
accgcccccuccuc

SEQ ID NO: 1361355 - RNA, 12 nt, Human
accgcccccucc

SEQ ID NO: 1361356 - RNA, 11 nt, Human
accgcccccuc

SEQ ID NO: 1361357 - RNA, 23 nt, Human
accgcccagcggcuugccugccu

SEQ ID NO: 1361358 - RNA, 18 nt, Human
accggaccagccuggccc

SEQ ID NO: 1361359 - RNA, 16 nt, Human
accggaccagccuggc

SEQ ID NO: 1361360 - RNA, 15 nt, Human
accggaccagccugg

SEQ ID NO: 1361361 - RNA, 18 nt, Human
accgugggcagggagcgg

SEQ ID NO: 1361362 - RNA, 16 nt, Human
accgugggcagggagc

SEQ ID NO: 1361363 - RNA, 22 nt, Human
accguggcccuuccuggacagc

SEQ ID NO: 1361364 - RNA, 20 nt, Human
accguggcccuuccuggaca

SEQ ID NO: 1361365 - RNA, 19 nt, Human
accguggcccuuccuggac

SEQ ID NO: 1361366 - RNA, 18 nt, Human
accguggcccuuccugga

SEQ ID NO: 1361367 - RNA, 19 nt, Human
accggagaguggggguggg

SEQ ID NO: 1361368 - RNA, 16 nt, Human
accggacuuuucugca

SEQ ID NO: 1361369 - RNA, 15 nt, Human
accggacuuuucugc

SEQ ID NO: 1361370 - RNA, 12 nt, Human
accggaccaucu

SEQ ID NO: 1361371 - RNA, 13 nt, Human
ucauugcuuacaa

SEQ ID NO: 1361372 - RNA, 15 nt, Human
ucauucguucugugg

SEQ ID NO: 1361373 - RNA, 23 nt, Human
ucauucgcuacuaugauuuaauu

SEQ ID NO: 1361374 - RNA, 21 nt, Human
ucauucuccuuguguuacuaa

SEQ ID NO: 1361375 - RNA, 19 nt, Human
accuccuuucaucacacug

SEQ ID NO: 1361376 - RNA, 22 nt, Human
accuccuuucaucacacugggu

SEQ ID NO: 1361377 - RNA, 13 nt, Human
ucauuguaaucac

SEQ ID NO: 1361378 - RNA, 16 nt, Human
ucauuguaaacaaacu

SEQ ID NO: 1361379 - RNA, 21 nt, Human
ucauuggaaauuuagcauugu

SEQ ID NO: 1361380 - RNA, 19 nt, Human
ucauuggaaauuuagcauu

SEQ ID NO: 1361381 - RNA, 15 nt, Human
ucauuggaaauuuag

SEQ ID NO: 1361382 - RNA, 14 nt, Human
ucauuggaaauuua

SEQ ID NO: 1361383 - RNA, 11 nt, Human
ucauuggcuuu

SEQ ID NO: 1361384 - RNA, 14 nt, Human
ucauuggcuuuauc

SEQ ID NO: 1361385 - RNA, 16 nt, Human
ucauuggcuuuauccu

SEQ ID NO: 1361386 - RNA, 17 nt, Human
ucauuggcuuuauccuc

SEQ ID NO: 1361387 - RNA, 16 nt, Human
accucgcuggacucuc

SEQ ID NO: 1361388 - RNA, 14 nt, Human
accucgcuggacuc

SEQ ID NO: 1361389 - RNA, 23 nt, Human
accucgcccagcggcaucaggcu

SEQ ID NO: 1361390 - RNA, 15 nt, Human
accucgggccugcug

SEQ ID NO: 1361391 - RNA, 18 nt, Human
accucgcuggacucucag

SEQ ID NO: 1361392 - RNA, 18 nt, Human
accucuaaauucuuucau

SEQ ID NO: 1361393 - RNA, 20 nt, Human
accucugacagcagcaucuc

SEQ ID NO: 1361394 - RNA, 19 nt, Human
accucugacagcagcaucu

SEQ ID NO: 1361395 - RNA, 17 nt, Human
accucugacagcagcau

SEQ ID NO: 1361396 - RNA, 15 nt, Human
accucugacagcagc

SEQ ID NO: 1361397 - RNA, 14 nt, Human
accucugacagcag

SEQ ID NO: 1361398 - RNA, 13 nt, Human
accucugacagca

SEQ ID NO: 1361399 - RNA, 21 nt, Human
accucugacagcagcaucucu

SEQ ID NO: 1361400 - RNA, 19 nt, Human
accucuaacagcaccaaau

SEQ ID NO: 1361401 - RNA, 16 nt, Human
accucuaacagcacca

SEQ ID NO: 1361402 - RNA, 15 nt, Human
accucuaacagcacc

SEQ ID NO: 1361403 - RNA, 21 nt, Human
accucuaaauucuuucauuuu

SEQ ID NO: 1361404 - RNA, 19 nt, Human
accucuagguccccauacu

SEQ ID NO: 1361405 - RNA, 21 nt, Human
accucuccccuggaacugucu

SEQ ID NO: 1361406 - RNA, 12 nt, Human
accucucaauau

SEQ ID NO: 1361407 - RNA, 17 nt, Human
ucauuccuucagauuug

SEQ ID NO: 1361408 - RNA, 19 nt, Human
ucauuaaauaaauuugacu

SEQ ID NO: 1361409 - RNA, 14 nt, Human
ucauuaaauaaauu

SEQ ID NO: 1361410 - RNA, 13 nt, Human
ucauuaaauaaau

SEQ ID NO: 1361411 - RNA, 15 nt, Human
ucauuaaauggggcu

SEQ ID NO: 1361412 - RNA, 12 nt, Human
ucauuaaauaaa

SEQ ID NO: 1361413 - RNA, 12 nt, Human
ucauguuuuuga

SEQ ID NO: 1361414 - RNA, 15 nt, Human
ucauguuuuugauca

SEQ ID NO: 1361415 - RNA, 17 nt, Human
ucauguugaagccacug

SEQ ID NO: 1361416 - RNA, 11 nt, Human
ucauguucuua

SEQ ID NO: 1361417 - RNA, 17 nt, Human
ucauguucuuaauucuu

SEQ ID NO: 1361418 - RNA, 12 nt, Human
ucauguguguua

SEQ ID NO: 1361419 - RNA, 23 nt, Human
ucauguguguccacgacugucuc

SEQ ID NO: 1361420 - RNA, 21 nt, Human
ucauguguguccacgacuguc

SEQ ID NO: 1361421 - RNA, 16 nt, Human
ucauguguguccacga

SEQ ID NO: 1361422 - RNA, 22 nt, Human
ucauguuaaauaggcggggcuu

SEQ ID NO: 1361423 - RNA, 23 nt, Human
ucauguuaguuaccuuauaguua

SEQ ID NO: 1361424 - RNA, 19 nt, Human
ucauguuaguuaccuuaua

SEQ ID NO: 1361425 - RNA, 15 nt, Human
ucauguuaguuaccu

SEQ ID NO: 1361426 - RNA, 14 nt, Human
ucaugugaaaucau

SEQ ID NO: 1361427 - RNA, 12 nt, Human
ucaugugugucc

SEQ ID NO: 1361428 - RNA, 22 nt, Human
ucaugugucccagaagaugacu

SEQ ID NO: 1361429 - RNA, 20 nt, Human
ucaugugugcaacaggguau

SEQ ID NO: 1361430 - RNA, 18 nt, Human
ucaugugucccagaagau

SEQ ID NO: 1361431 - RNA, 17 nt, Human
ucaugugucccagaaga

SEQ ID NO: 1361432 - RNA, 22 nt, Human
ucaugaauuaguuuuauaugcu

SEQ ID NO: 1361433 - RNA, 14 nt, Human
ucaugacagccucc

SEQ ID NO: 1361434 - RNA, 14 nt, Human
ucaugaccaguaaa

SEQ ID NO: 1361435 - RNA, 15 nt, Human
ucaugaccaguaaag

SEQ ID NO: 1361436 - RNA, 19 nt, Human
ucaugacaaagacugagua

SEQ ID NO: 1361437 - RNA, 23 nt, Human
ucaugccagcuacuuccuccucc

SEQ ID NO: 1361438 - RNA, 21 nt, Human
ucaugccagcuacuuccuccu

SEQ ID NO: 1361439 - RNA, 12 nt, Human
ucaugccagcua

SEQ ID NO: 1361440 - RNA, 18 nt, Human
ucaugagugaauaaaugu

SEQ ID NO: 1361441 - RNA, 22 nt, Human
ucaugaggagauucugccuuug

SEQ ID NO: 1361442 - RNA, 23 nt, Human
ucaugaggagauucugccuuugc

SEQ ID NO: 1361443 - RNA, 21 nt, Human
ucaugaggagauucugccuuu

SEQ ID NO: 1361444 - RNA, 20 nt, Human
ucaugaggagauucugccuu

SEQ ID NO: 1361445 - RNA, 16 nt, Human
ucaugaggagauucug

SEQ ID NO: 1361446 - RNA, 13 nt, Human
ucaugauccaacu

SEQ ID NO: 1361447 - RNA, 21 nt, Human
ucaugauaaugaacagaacau

SEQ ID NO: 1361448 - RNA, 17 nt, Human
ucaugauaaugaacaga

SEQ ID NO: 1361449 - RNA, 18 nt, Human
ucaugcauguccuguaaa

SEQ ID NO: 1361450 - RNA, 15 nt, Human
ucaugcauggaaauu

SEQ ID NO: 1361451 - RNA, 15 nt, Human
ucccagguuggcucu

SEQ ID NO: 1361452 - RNA, 23 nt, Human
ucccagguguuaacauuccaaga

SEQ ID NO: 1361453 - RNA, 22 nt, Human
ucccagguguuaacauuccaag

SEQ ID NO: 1361454 - RNA, 21 nt, Human
ucccagguguuaacauuccaa

SEQ ID NO: 1361455 - RNA, 15 nt, Human
ucccagguguuaaca

SEQ ID NO: 1361456 - RNA, 20 nt, Human
ucccaggguuuuaacuuugu

SEQ ID NO: 1361457 - RNA, 19 nt, Human
ucccaggguuuuaacuuug

SEQ ID NO: 1361458 - RNA, 18 nt, Human
ucccaggguuuuaacuuu

SEQ ID NO: 1361459 - RNA, 14 nt, Human
ucccaggguuuuaa

SEQ ID NO: 1361460 - RNA, 18 nt, Human
ucccaggggcucccuccg

SEQ ID NO: 1361461 - RNA, 13 nt, Human
acuacauucauuu

SEQ ID NO: 1361462 - RNA, 11 nt, Human
acuacauucug

SEQ ID NO: 1361463 - RNA, 14 nt, Human
acuacaugcacuug

SEQ ID NO: 1361464 - RNA, 12 nt, Human
acuacaugcacu

SEQ ID NO: 1361465 - RNA, 20 nt, Human
acuacaugagaacaaacaga

SEQ ID NO: 1361466 - RNA, 15 nt, Human
acuacagucaggaaa

SEQ ID NO: 1361467 - RNA, 22 nt, Human
uccccaaguacaaccacaccca

SEQ ID NO: 1361468 - RNA, 18 nt, Human
uccccaacugaccaccuu

SEQ ID NO: 1361469 - RNA, 16 nt, Human
uccccaacccccaacu

SEQ ID NO: 1361470 - RNA, 19 nt, Human
uccccaacugaccaccuuu

SEQ ID NO: 1361471 - RNA, 14 nt, Human
uccccaacugacca

SEQ ID NO: 1361472 - RNA, 20 nt, Human
uccccaacagcgcccaaagg

SEQ ID NO: 1361473 - RNA, 17 nt, Human
uccccaacagcgcccaa

SEQ ID NO: 1361474 - RNA, 16 nt, Human
uccccaacagcgccca

SEQ ID NO: 1361475 - RNA, 15 nt, Human
uccccaacagcgccc

SEQ ID NO: 1361476 - RNA, 19 nt, Human
uccccaaaagcgugagcuu

SEQ ID NO: 1361477 - RNA, 18 nt, Human
ucccauuuuggaauuugc

SEQ ID NO: 1361478 - RNA, 13 nt, Human
ucccaucuaggga

SEQ ID NO: 1361479 - RNA, 20 nt, Human
ucccaucgucucggccuuca

SEQ ID NO: 1361480 - RNA, 22 nt, Human
ucccaucgucucggccuucaca

SEQ ID NO: 1361481 - RNA, 13 nt, Human
ucccaucgcuguc

SEQ ID NO: 1361482 - RNA, 17 nt, Human
ucccauagccaggaaac

SEQ ID NO: 1361483 - RNA, 21 nt, Human
ucccaguuggagcuccagccu

SEQ ID NO: 1361484 - RNA, 22 nt, Human
ucccaguuggagcuccagccug

SEQ ID NO: 1361485 - RNA, 22 nt, Human
acuaaaguuagaaaguugauuu

SEQ ID NO: 1361486 - RNA, 12 nt, Human
acuaaagccuuu

SEQ ID NO: 1361487 - RNA, 23 nt, Human
acuaaagccaaacauauauauac

SEQ ID NO: 1361488 - RNA, 17 nt, Human
acuaaagccaaacauau

SEQ ID NO: 1361489 - RNA, 16 nt, Human
acuaaagccaaacaua

SEQ ID NO: 1361490 - RNA, 17 nt, Human
acuaaacucuuaccaua

SEQ ID NO: 1361491 - RNA, 18 nt, Human
acuaaacacgugacacaa

SEQ ID NO: 1361492 - RNA, 14 nt, Human
acuaaaauauuuau

SEQ ID NO: 1361493 - RNA, 20 nt, Human
acuaaaauaauuuuguaaug

SEQ ID NO: 1361494 - RNA, 19 nt, Human
acuaaaauaauuuuguaau

SEQ ID NO: 1361495 - RNA, 17 nt, Human
acuaaaauaauuuugua

SEQ ID NO: 1361496 - RNA, 16 nt, Human
acuaaaauaauuuugu

SEQ ID NO: 1361497 - RNA, 15 nt, Human
acuaaaauaauuuug

SEQ ID NO: 1361498 - RNA, 14 nt, Human
acuaaaauaauuuu

SEQ ID NO: 1361499 - RNA, 23 nt, Human
acuaaaagauauaagugcuguau

SEQ ID NO: 1361500 - RNA, 16 nt, Human
acuaaaagauauaagu

SEQ ID NO: 1361501 - RNA, 19 nt, Human
acuaaaagauauaagugcu

SEQ ID NO: 1361502 - RNA, 20 nt, Human
acuaaaagauauaagugcug

SEQ ID NO: 1361503 - RNA, 21 nt, Human
acuaaaagauauaagugcugu

SEQ ID NO: 1361504 - RNA, 21 nt, Human
acuaaccauguguuauguuuu

SEQ ID NO: 1361505 - RNA, 17 nt, Human
acuaaccagcagaaaug

SEQ ID NO: 1361506 - RNA, 16 nt, Human
acuaaccagcagaaau

SEQ ID NO: 1361507 - RNA, 17 nt, Human
acuaaaaaaaagaugaa

SEQ ID NO: 1361508 - RNA, 11 nt, Human
acuaaaagaua

SEQ ID NO: 1361509 - RNA, 16 nt, Human
acuaaaaaaaagauga

SEQ ID NO: 1361510 - RNA, 15 nt, Human
acuaaaaaaaagaug

SEQ ID NO: 1361511 - RNA, 19 nt, Human
acguuuucuaauugcuuau

SEQ ID NO: 1361512 - RNA, 18 nt, Human
acguuuucuaauugcuua

SEQ ID NO: 1361513 - RNA, 17 nt, Human
acguuuucuaauugcuu

SEQ ID NO: 1361514 - RNA, 16 nt, Human
acguuuucuaauugcu

SEQ ID NO: 1361515 - RNA, 13 nt, Human
acguuuucuaauu

SEQ ID NO: 1361516 - RNA, 12 nt, Human
acguuuucuaau

SEQ ID NO: 1361517 - RNA, 20 nt, Human
acguuuuauaagcaucauua

SEQ ID NO: 1361518 - RNA, 21 nt, Human
acguuuuauaagcaucauuau

SEQ ID NO: 1361519 - RNA, 14 nt, Human
acguuuuauaagca

SEQ ID NO: 1361520 - RNA, 15 nt, Human
acguuucuaaaggcu

SEQ ID NO: 1361521 - RNA, 14 nt, Human
acguuucuaaaggc

SEQ ID NO: 1361522 - RNA, 19 nt, Human
acguuuaagccaaaacaau

SEQ ID NO: 1361523 - RNA, 23 nt, Human
acguuuaagccaaaacaauguuu

SEQ ID NO: 1361524 - RNA, 12 nt, Human
acguuucuaaag

SEQ ID NO: 1361525 - RNA, 20 nt, Human
uccagcuagugacccacaug

SEQ ID NO: 1361526 - RNA, 15 nt, Human
uccagcuagugaccc

SEQ ID NO: 1361527 - RNA, 14 nt, Human
uccagcggcccugu

SEQ ID NO: 1361528 - RNA, 17 nt, Human
uccagccuggggucugg

SEQ ID NO: 1361529 - RNA, 19 nt, Human
uccagccuggggcugaggc

SEQ ID NO: 1361530 - RNA, 22 nt, Human
acucaaauguucuaaguuucua

SEQ ID NO: 1361531 - RNA, 18 nt, Human
acucaaauguucuaaguu

SEQ ID NO: 1361532 - RNA, 18 nt, Human
acuauuauccccauuucu

SEQ ID NO: 1361533 - RNA, 22 nt, Human
acuauuaggugcaauuucaagg

SEQ ID NO: 1361534 - RNA, 22 nt, Human
acuauuaaaaagguuuacagaa

SEQ ID NO: 1361535 - RNA, 18 nt, Human
acuaucuuucagcuccag

SEQ ID NO: 1361536 - RNA, 16 nt, Human
acuaucuuggugaauu

SEQ ID NO: 1361537 - RNA, 20 nt, Human
acuaucuuacuauuucacaa

SEQ ID NO: 1361538 - RNA, 18 nt, Human
acuaugaaaaugcuggcu

SEQ ID NO: 1361539 - RNA, 16 nt, Human
acuaugaaaaugcugg

SEQ ID NO: 1361540 - RNA, 21 nt, Human
acuaugaaaagcuagaauuga

SEQ ID NO: 1361541 - RNA, 20 nt, Human
acuaugaaaagcuagaauug

SEQ ID NO: 1361542 - RNA, 19 nt, Human
acuaugaaaagcuagaauu

SEQ ID NO: 1361543 - RNA, 16 nt, Human
acuaugaaaagcuaga

SEQ ID NO: 1361544 - RNA, 22 nt, Human
acuaugaaguuuuuuuuauaca

SEQ ID NO: 1361545 - RNA, 16 nt, Human
uccccaggcaccucac

SEQ ID NO: 1361546 - RNA, 20 nt, Human
uccccacgagggcuggcugg

SEQ ID NO: 1361547 - RNA, 17 nt, Human
uccccacgagggcuggc

SEQ ID NO: 1361548 - RNA, 16 nt, Human
uccccacgagggcugg

SEQ ID NO: 1361549 - RNA, 15 nt, Human
uccccacgagggcug

SEQ ID NO: 1361550 - RNA, 21 nt, Human
uccccagggaagcagcagccu

SEQ ID NO: 1361551 - RNA, 20 nt, Human
uccccagggaagcagcagcc

SEQ ID NO: 1361552 - RNA, 19 nt, Human
uccccagggaagcagcagc

SEQ ID NO: 1361553 - RNA, 17 nt, Human
uccccagggaagcagca

SEQ ID NO: 1361554 - RNA, 13 nt, Human
acuauauguaugg

SEQ ID NO: 1361555 - RNA, 19 nt, Human
uccccuccaaaaugugccu

SEQ ID NO: 1361556 - RNA, 17 nt, Human
uccccucaccuccucua

SEQ ID NO: 1361557 - RNA, 15 nt, Human
uccccucaccuccuc

SEQ ID NO: 1361558 - RNA, 17 nt, Human
acucaagaagugaagaa

SEQ ID NO: 1361559 - RNA, 23 nt, Human
acucaagaagugaagaaugcaca

SEQ ID NO: 1361560 - RNA, 23 nt, Human
acucaaccuuaagaccuacuguu

SEQ ID NO: 1361561 - RNA, 19 nt, Human
uccccuugaggucucagcc

SEQ ID NO: 1361562 - RNA, 18 nt, Human
uccccuugaggucucagc

SEQ ID NO: 1361563 - RNA, 17 nt, Human
uccccuugaggucucag

SEQ ID NO: 1361564 - RNA, 18 nt, Human
uccccuugaacucuucac

SEQ ID NO: 1361565 - RNA, 13 nt, Human
uccccuucucugu

SEQ ID NO: 1361566 - RNA, 18 nt, Human
uccccuucuccccugcac

SEQ ID NO: 1361567 - RNA, 20 nt, Human
uccccuucuccccugcacug

SEQ ID NO: 1361568 - RNA, 14 nt, Human
uccccuucuccccu

SEQ ID NO: 1361569 - RNA, 21 nt, Human
uccccuugaggucucagcccc

SEQ ID NO: 1361570 - RNA, 20 nt, Human
uccccuugaggucucagccc

SEQ ID NO: 1361571 - RNA, 20 nt, Human
ucccgcagugggagcaaacu

SEQ ID NO: 1361572 - RNA, 19 nt, Human
ucccgcagugggagcaaac

SEQ ID NO: 1361573 - RNA, 15 nt, Human
ucccgauuguaacuc

SEQ ID NO: 1361574 - RNA, 19 nt, Human
ucccgauucacccugucca

SEQ ID NO: 1361575 - RNA, 18 nt, Human
ucccggagguuggguggg

SEQ ID NO: 1361576 - RNA, 18 nt, Human
ucccucaaccucauccuc

SEQ ID NO: 1361577 - RNA, 13 nt, Human
ucccucacaagug

SEQ ID NO: 1361578 - RNA, 19 nt, Human
ucccucaaccucauccucu

SEQ ID NO: 1361579 - RNA, 14 nt, Human
ucccucacaagugg

SEQ ID NO: 1361580 - RNA, 12 nt, Human
ucccucacccau

SEQ ID NO: 1361581 - RNA, 18 nt, Human
ucccucacccauccuaga

SEQ ID NO: 1361582 - RNA, 20 nt, Human
ucccucaccuguagcagcca

SEQ ID NO: 1361583 - RNA, 14 nt, Human
ucccucaccuguag

SEQ ID NO: 1361584 - RNA, 13 nt, Human
ucccucaccugua

SEQ ID NO: 1361585 - RNA, 12 nt, Human
ucccucaccugu

SEQ ID NO: 1361586 - RNA, 14 nt, Human
ucccucacccaucc

SEQ ID NO: 1361587 - RNA, 19 nt, Human
ucccuuguauccccugcag

SEQ ID NO: 1361588 - RNA, 21 nt, Human
ucccuuguauccccugcaggc

SEQ ID NO: 1361589 - RNA, 16 nt, Human
ucccuuguauccccug

SEQ ID NO: 1361590 - RNA, 15 nt, Human
ucccuuguauccccu

SEQ ID NO: 1361591 - RNA, 16 nt, Human
ucccuuguagcuccuc

SEQ ID NO: 1361592 - RNA, 15 nt, Human
ucccuuguagcuccu

SEQ ID NO: 1361593 - RNA, 22 nt, Human
ucccuguuucuuccacagugcc

SEQ ID NO: 1361594 - RNA, 17 nt, Human
ucccuguuccccagaga

SEQ ID NO: 1361595 - RNA, 18 nt, Human
ucccuguuccccagagaa

SEQ ID NO: 1361596 - RNA, 16 nt, Human
ucccuguuccccagag

SEQ ID NO: 1361597 - RNA, 15 nt, Human
ucccuguuccccaga

SEQ ID NO: 1361598 - RNA, 17 nt, Human
ucccuguguugucucua

SEQ ID NO: 1361599 - RNA, 12 nt, Human
ucccuguaacuu

SEQ ID NO: 1361600 - RNA, 15 nt, Human
ucccuguaacuugau

SEQ ID NO: 1361601 - RNA, 23 nt, Human
ucccuguaaccucuucagaggcc

SEQ ID NO: 1361602 - RNA, 22 nt, Human
ucccuguaaccucuucagaggc

SEQ ID NO: 1361603 - RNA, 19 nt, Human
ucccuguaaccucuucaga

SEQ ID NO: 1361604 - RNA, 18 nt, Human
ucccuguaaccucuucag

SEQ ID NO: 1361605 - RNA, 14 nt, Human
ucccuguaaccucu

SEQ ID NO: 1361606 - RNA, 23 nt, Human
uccuaaacugagacaaugccuug

SEQ ID NO: 1361607 - RNA, 21 nt, Human
uccuaaacaucauucauuuuu

SEQ ID NO: 1361608 - RNA, 15 nt, Human
uccguuggccacucc

SEQ ID NO: 1361609 - RNA, 13 nt, Human
uccguuggccacu

SEQ ID NO: 1361610 - RNA, 23 nt, Human
uccuagauccuaagggucgaaag

SEQ ID NO: 1361611 - RNA, 14 nt, Human
uccuagauccuaag

SEQ ID NO: 1361612 - RNA, 13 nt, Human
uccuagauccuaa

SEQ ID NO: 1361613 - RNA, 16 nt, Human
uccuagcacagauggc

SEQ ID NO: 1361614 - RNA, 15 nt, Human
uccuagcacagaugg

SEQ ID NO: 1361615 - RNA, 12 nt, Human
uccuagcacaga

SEQ ID NO: 1361616 - RNA, 17 nt, Human
ucccuuugcccagaaag

SEQ ID NO: 1361617 - RNA, 18 nt, Human
uccguccccugcccaugc

SEQ ID NO: 1361618 - RNA, 14 nt, Human
uccguccccugccc

SEQ ID NO: 1361619 - RNA, 16 nt, Human
uccgucaaaacagauu

SEQ ID NO: 1361620 - RNA, 23 nt, Human
uccgucaaaacagauuguuugca

SEQ ID NO: 1361621 - RNA, 16 nt, Human
uccguucacaugugug

SEQ ID NO: 1361622 - RNA, 16 nt, Human
ucccucaucugucccu

SEQ ID NO: 1361623 - RNA, 15 nt, Human
ucccucaccuucuga

SEQ ID NO: 1361624 - RNA, 16 nt, Human
ucccucagugcccuca

SEQ ID NO: 1361625 - RNA, 20 nt, Human
ucccucaccuuggcaccaga

SEQ ID NO: 1361626 - RNA, 21 nt, Human
ucccucaccuuggcaccagac

SEQ ID NO: 1361627 - RNA, 15 nt, Human
ucccucaccuuggca

SEQ ID NO: 1361628 - RNA, 14 nt, Human
ucccucaccuucug

SEQ ID NO: 1361629 - RNA, 21 nt, Human
ucccucaucugucccuccggg

SEQ ID NO: 1361630 - RNA, 16 nt, Human
acucaucuagguaaau

SEQ ID NO: 1361631 - RNA, 18 nt, Human
acucaucuagguaaauua

SEQ ID NO: 1361632 - RNA, 17 nt, Human
acucaugugacucuuuc

SEQ ID NO: 1361633 - RNA, 16 nt, Human
acucaugugacucuuu

SEQ ID NO: 1361634 - RNA, 15 nt, Human
acucaugugacucuu

SEQ ID NO: 1361635 - RNA, 21 nt, Human
acucaucuagguaaauuacag

SEQ ID NO: 1361636 - RNA, 13 nt, Human
acuccacacugca

SEQ ID NO: 1361637 - RNA, 12 nt, Human
acuccacacugc

SEQ ID NO: 1361638 - RNA, 18 nt, Human
acuccaagcccagcccau

SEQ ID NO: 1361639 - RNA, 17 nt, Human
acuccaagcccagccca

SEQ ID NO: 1361640 - RNA, 15 nt, Human
acuccaagcccagcc

SEQ ID NO: 1361641 - RNA, 14 nt, Human
acuccaacucuucc

SEQ ID NO: 1361642 - RNA, 17 nt, Human
acuccacacugcacaau

SEQ ID NO: 1361643 - RNA, 21 nt, Human
acuccacacugcacaauaacu

SEQ ID NO: 1361644 - RNA, 16 nt, Human
acuccacacugcacaa

SEQ ID NO: 1361645 - RNA, 14 nt, Human
acuccacacugcac

SEQ ID NO: 1361646 - RNA, 14 nt, Human
acuccaggcccaag

SEQ ID NO: 1361647 - RNA, 13 nt, Human
acuccaggcccaa

SEQ ID NO: 1361648 - RNA, 19 nt, Human
acuccaggcccaaggcucc

SEQ ID NO: 1361649 - RNA, 17 nt, Human
acuccaggcccaaggcu

SEQ ID NO: 1361650 - RNA, 16 nt, Human
acuccaggcccaaggc

SEQ ID NO: 1361651 - RNA, 21 nt, Human
acuccaggcccaaggcucccg

SEQ ID NO: 1361652 - RNA, 17 nt, Human
acuccugaccucaggca

SEQ ID NO: 1361653 - RNA, 23 nt, Human
acuccuagcuguccuuuuuccuc

SEQ ID NO: 1361654 - RNA, 16 nt, Human
acuccuagcuguccuu

SEQ ID NO: 1361655 - RNA, 16 nt, Human
acuccugaccucaggc

SEQ ID NO: 1361656 - RNA, 15 nt, Human
acuccugaccucagg

SEQ ID NO: 1361657 - RNA, 14 nt, Human
acuccugaccucag

SEQ ID NO: 1361658 - RNA, 18 nt, Human
acuccugaccucaaguga

SEQ ID NO: 1361659 - RNA, 20 nt, Human
uccucacccccagcuuugcu

SEQ ID NO: 1361660 - RNA, 16 nt, Human
uccucacccccagcuu

SEQ ID NO: 1361661 - RNA, 13 nt, Human
uccucacccccag

SEQ ID NO: 1361662 - RNA, 17 nt, Human
uccucagacucuaagaa

SEQ ID NO: 1361663 - RNA, 20 nt, Human
uccucagagaauuucuacca

SEQ ID NO: 1361664 - RNA, 17 nt, Human
uccucagagaauuucua

SEQ ID NO: 1361665 - RNA, 15 nt, Human
uccucagccagccuc

SEQ ID NO: 1361666 - RNA, 13 nt, Human
uccucagccagcc

SEQ ID NO: 1361667 - RNA, 12 nt, Human
uccucagccagc

SEQ ID NO: 1361668 - RNA, 10 nt, Human
uccucagcca

SEQ ID NO: 1361669 - RNA, 11 nt, Human
uccucagcccc

SEQ ID NO: 1361670 - RNA, 21 nt, Human
uccucagacucuaagaaagaa

SEQ ID NO: 1361671 - RNA, 16 nt, Human
uccucagacucuaaga

SEQ ID NO: 1361672 - RNA, 14 nt, Human
uccucacuguaucc

SEQ ID NO: 1361673 - RNA, 14 nt, Human
uccucaauccagcu

SEQ ID NO: 1361674 - RNA, 13 nt, Human
uccucaauccagc

SEQ ID NO: 1361675 - RNA, 12 nt, Human
uccucaauccag

SEQ ID NO: 1361676 - RNA, 19 nt, Human
uccucaaccccuccccucc

SEQ ID NO: 1361677 - RNA, 23 nt, Human
uccucaagaaauaaaaggaagcc

SEQ ID NO: 1361678 - RNA, 17 nt, Human
uccucaagaaauaaaag

SEQ ID NO: 1361679 - RNA, 22 nt, Human
uccucaaccccuccccuccauc

SEQ ID NO: 1361680 - RNA, 17 nt, Human
uccucaacacccaacug

SEQ ID NO: 1361681 - RNA, 19 nt, Human
uccucaaagaaaguguauu

SEQ ID NO: 1361682 - RNA, 18 nt, Human
uccucaaagaaaguguau

SEQ ID NO: 1361683 - RNA, 16 nt, Human
uccucaaagaaagugu

SEQ ID NO: 1361684 - RNA, 15 nt, Human
uccucaaagaaagug

SEQ ID NO: 1361685 - RNA, 21 nt, Human
acucuuaugcuguacccaguu

SEQ ID NO: 1361686 - RNA, 18 nt, Human
uccucagccuugccagag

SEQ ID NO: 1361687 - RNA, 21 nt, Human
uccucagccugaaccccaggg

SEQ ID NO: 1361688 - RNA, 11 nt, Human
uccucagccuu

SEQ ID NO: 1361689 - RNA, 14 nt, Human
uccucagccugaac

SEQ ID NO: 1361690 - RNA, 12 nt, Human
uccucagccuga

SEQ ID NO: 1361691 - RNA, 16 nt, Human
uccucagccagccucg

SEQ ID NO: 1361692 - RNA, 14 nt, Human
uccuccccuggagg

SEQ ID NO: 1361693 - RNA, 15 nt, Human
uccuccccuggaggg

SEQ ID NO: 1361694 - RNA, 13 nt, Human
uccuccccuggag

SEQ ID NO: 1361695 - RNA, 18 nt, Human
acucgcuagcaguggcag

SEQ ID NO: 1361696 - RNA, 16 nt, Human
acucgcuagcaguggc

SEQ ID NO: 1361697 - RNA, 14 nt, Human
acucgcuagcagug

SEQ ID NO: 1361698 - RNA, 18 nt, Human
uccuagguaggguuuaau

SEQ ID NO: 1361699 - RNA, 22 nt, Human
uccuaggcuccaccccauccag

SEQ ID NO: 1361700 - RNA, 20 nt, Human
uccuaggcuccaccccaucc

SEQ ID NO: 1361701 - RNA, 20 nt, Human
uccuagcacagauggccagc

SEQ ID NO: 1361702 - RNA, 21 nt, Human
uccuagcacagauggccagcc

SEQ ID NO: 1361703 - RNA, 22 nt, Human
acucggccucccaaagugcugg

SEQ ID NO: 1361704 - RNA, 21 nt, Human
acucggccucccaaagugcug

SEQ ID NO: 1361705 - RNA, 22 nt, Human
acucggcagcccuuccaaacuc

SEQ ID NO: 1361706 - RNA, 23 nt, Human
acucgcuagcaguggcaggcaga

SEQ ID NO: 1361707 - RNA, 22 nt, Human
acucuccccacgagggcuggcu

SEQ ID NO: 1361708 - RNA, 20 nt, Human
acucuccccacgagggcugg

SEQ ID NO: 1361709 - RNA, 19 nt, Human
acucuccccacgagggcug

SEQ ID NO: 1361710 - RNA, 16 nt, Human
acucugaaaugaagau

SEQ ID NO: 1361711 - RNA, 23 nt, Human
acucucuuauugccucacuucag

SEQ ID NO: 1361712 - RNA, 21 nt, Human
acucucuuauugccucacuuc

SEQ ID NO: 1361713 - RNA, 21 nt, Human
acucuccccacgagggcuggc

SEQ ID NO: 1361714 - RNA, 21 nt, Human
acucugcuucucugacuucug

SEQ ID NO: 1361715 - RNA, 20 nt, Human
acucugcuucucugacuucu

SEQ ID NO: 1361716 - RNA, 18 nt, Human
acucugcuucucugacuu

SEQ ID NO: 1361717 - RNA, 17 nt, Human
acucugcuucucugacu

SEQ ID NO: 1361718 - RNA, 16 nt, Human
acucugcauucuagua

SEQ ID NO: 1361719 - RNA, 16 nt, Human
acucugcagccucaga

SEQ ID NO: 1361720 - RNA, 17 nt, Human
acucugcagccucagag

SEQ ID NO: 1361721 - RNA, 15 nt, Human
acucugcagccucag

SEQ ID NO: 1361722 - RNA, 14 nt, Human
acucugcagccuca

SEQ ID NO: 1361723 - RNA, 13 nt, Human
acucugcagccuc

SEQ ID NO: 1361724 - RNA, 12 nt, Human
acucugcagccu

SEQ ID NO: 1361725 - RNA, 13 nt, Human
acucugcuuguua

SEQ ID NO: 1361726 - RNA, 18 nt, Human
acucugcuugauuuuugc

SEQ ID NO: 1361727 - RNA, 16 nt, Human
acucugcuugauuuuu

SEQ ID NO: 1361728 - RNA, 15 nt, Human
acucugcuugauuuu

SEQ ID NO: 1361729 - RNA, 22 nt, Human
acucugcuucucugacuucugc

SEQ ID NO: 1361730 - RNA, 23 nt, Human
acucuuauaucuauauuuuacau

SEQ ID NO: 1361731 - RNA, 14 nt, Human
uccuguuuuucaca

SEQ ID NO: 1361732 - RNA, 21 nt, Human
uccuguuuugcacagccaaau

SEQ ID NO: 1361733 - RNA, 17 nt, Human
uccuguuugucuacaua

SEQ ID NO: 1361734 - RNA, 13 nt, Human
uccuguuugucua

SEQ ID NO: 1361735 - RNA, 18 nt, Human
uccuguuuccuagcugug

SEQ ID NO: 1361736 - RNA, 21 nt, Human
uccuguugggagagggcgcag

SEQ ID NO: 1361737 - RNA, 17 nt, Human
uccuguugucaagaaua

SEQ ID NO: 1361738 - RNA, 14 nt, Human
uccuguugggagag

SEQ ID NO: 1361739 - RNA, 13 nt, Human
uccuguugggaga

SEQ ID NO: 1361740 - RNA, 15 nt, Human
uccuguucacaccag

SEQ ID NO: 1361741 - RNA, 14 nt, Human
uccuguguuuguga

SEQ ID NO: 1361742 - RNA, 22 nt, Human
uccuguguguuaagcucugcua

SEQ ID NO: 1361743 - RNA, 21 nt, Human
uccuguguguuaagcucugcu

SEQ ID NO: 1361744 - RNA, 20 nt, Human
uccuguguguuaagcucugc

SEQ ID NO: 1361745 - RNA, 19 nt, Human
uccuguguguuaagcucug

SEQ ID NO: 1361746 - RNA, 18 nt, Human
uccuguguguuaagcucu

SEQ ID NO: 1361747 - RNA, 12 nt, Human
uccuguguguua

SEQ ID NO: 1361748 - RNA, 21 nt, Human
uccuguguggagagggaaugu

SEQ ID NO: 1361749 - RNA, 22 nt, Human
uccuguguguccaaaacugccu

SEQ ID NO: 1361750 - RNA, 22 nt, Human
uccuguguggagagggaaugug

SEQ ID NO: 1361751 - RNA, 18 nt, Human
uccuguguggagagggaa

SEQ ID NO: 1361752 - RNA, 16 nt, Human
uccuguguggagaggg

SEQ ID NO: 1361753 - RNA, 15 nt, Human
uccuguguggagagg

SEQ ID NO: 1361754 - RNA, 18 nt, Human
uccuuaaaauguaagauu

SEQ ID NO: 1361755 - RNA, 17 nt, Human
uccuguuuugcacagcc

SEQ ID NO: 1361756 - RNA, 22 nt, Human
acugcaggcccuggccuccccu

SEQ ID NO: 1361757 - RNA, 19 nt, Human
acugcaggcccuggccucc

SEQ ID NO: 1361758 - RNA, 18 nt, Human
acugcaggcccuggccuc

SEQ ID NO: 1361759 - RNA, 17 nt, Human
acugcaggcccuggccu

SEQ ID NO: 1361760 - RNA, 23 nt, Human
acugcagggaaaauuauuugcau

SEQ ID NO: 1361761 - RNA, 10 nt, Human
acugcaggga

SEQ ID NO: 1361762 - RNA, 16 nt, Human
acugcaggcccuggcc

SEQ ID NO: 1361763 - RNA, 15 nt, Human
acugcaggcccuggc

SEQ ID NO: 1361764 - RNA, 14 nt, Human
acugcaggcccugg

SEQ ID NO: 1361765 - RNA, 13 nt, Human
acugcaggcccug

SEQ ID NO: 1361766 - RNA, 12 nt, Human
acugcaggcccu

SEQ ID NO: 1361767 - RNA, 16 nt, Human
uccugugaaugccacu

SEQ ID NO: 1361768 - RNA, 21 nt, Human
uccugucuuauccuccaccgu

SEQ ID NO: 1361769 - RNA, 14 nt, Human
uccugucuuauccu

SEQ ID NO: 1361770 - RNA, 16 nt, Human
uccuggucaccuagga

SEQ ID NO: 1361771 - RNA, 23 nt, Human
uccuggguuuuguauucucugag

SEQ ID NO: 1361772 - RNA, 22 nt, Human
uccuggguuuuguauucucuga

SEQ ID NO: 1361773 - RNA, 21 nt, Human
uccuggguuuuguauucucug

SEQ ID NO: 1361774 - RNA, 20 nt, Human
uccuggguuuuguauucucu

SEQ ID NO: 1361775 - RNA, 17 nt, Human
uccuggguuuuguauuc

SEQ ID NO: 1361776 - RNA, 23 nt, Human
uccuggguggcuacucugugcca

SEQ ID NO: 1361777 - RNA, 24 nt, Human
uccuggguggcuacucugugccag

SEQ ID NO: 1361778 - RNA, 22 nt, Human
uccuggguggcuacucugugcc

SEQ ID NO: 1361779 - RNA, 17 nt, Human
uccuggguggcuacucu

SEQ ID NO: 1361780 - RNA, 15 nt, Human
uccuggguggcuacu

SEQ ID NO: 1361781 - RNA, 13 nt, Human
uccuggguggcua

SEQ ID NO: 1361782 - RNA, 23 nt, Human
uccugggguauaaaacuuuccuc

SEQ ID NO: 1361783 - RNA, 18 nt, Human
uccugugggagccucgca

SEQ ID NO: 1361784 - RNA, 16 nt, Human
uccugugggagccucg

SEQ ID NO: 1361785 - RNA, 15 nt, Human
uccugugggagccuc

SEQ ID NO: 1361786 - RNA, 14 nt, Human
uccugugggagccu

SEQ ID NO: 1361787 - RNA, 13 nt, Human
uccugugggagcc

SEQ ID NO: 1361788 - RNA, 14 nt, Human
uccuguggcucccu

SEQ ID NO: 1361789 - RNA, 12 nt, Human
uccuguggcucc

SEQ ID NO: 1361790 - RNA, 23 nt, Human
uccuguggccccacccugggccc

SEQ ID NO: 1361791 - RNA, 22 nt, Human
uccuguggccccacccugggcc

SEQ ID NO: 1361792 - RNA, 12 nt, Human
uccuguggcccc

SEQ ID NO: 1361793 - RNA, 16 nt, Human
uccugugcucagcccu

SEQ ID NO: 1361794 - RNA, 15 nt, Human
uccugugcucagccc

SEQ ID NO: 1361795 - RNA, 18 nt, Human
uccugugcucagcccuga

SEQ ID NO: 1361796 - RNA, 22 nt, Human
uccugugaaugccacugccuuc

SEQ ID NO: 1361797 - RNA, 20 nt, Human
uccugugaaugccacugccu

SEQ ID NO: 1361798 - RNA, 16 nt, Human
uccugggccugcagaa

SEQ ID NO: 1361799 - RNA, 15 nt, Human
uccugggccugcaga

SEQ ID NO: 1361800 - RNA, 13 nt, Human
uccugggccugca

SEQ ID NO: 1361801 - RNA, 12 nt, Human
uccugggccugc

SEQ ID NO: 1361802 - RNA, 23 nt, Human
uccugggcccucucugcucugcg

SEQ ID NO: 1361803 - RNA, 21 nt, Human
uccugggcccucucugcucug

SEQ ID NO: 1361804 - RNA, 17 nt, Human
uccugggcccucucugc

SEQ ID NO: 1361805 - RNA, 16 nt, Human
uccugggcccucucug

SEQ ID NO: 1361806 - RNA, 23 nt, Human
acugagggcagucgauagagcug

SEQ ID NO: 1361807 - RNA, 18 nt, Human
acugaguacguugugcau

SEQ ID NO: 1361808 - RNA, 19 nt, Human
acugaguacguugugcauu

SEQ ID NO: 1361809 - RNA, 21 nt, Human
acugaguacguugugcauuug

SEQ ID NO: 1361810 - RNA, 24 nt, Human
acugagggugaguuggcuuaccug

SEQ ID NO: 1361811 - RNA, 19 nt, Human
uccuccccuccagcucccu

SEQ ID NO: 1361812 - RNA, 20 nt, Human
acugaggggggauccaguuu

SEQ ID NO: 1361813 - RNA, 14 nt, Human
acugagugggaagc

SEQ ID NO: 1361814 - RNA, 13 nt, Human
acugagugggaag

SEQ ID NO: 1361815 - RNA, 23 nt, Human
acugagugacucuauauagcuga

SEQ ID NO: 1361816 - RNA, 12 nt, Human
acugagugacuc

SEQ ID NO: 1361817 - RNA, 22 nt, Human
acugaguacguugugcauuugg

SEQ ID NO: 1361818 - RNA, 23 nt, Human
acugaguacguugugcauuuggu

SEQ ID NO: 1361819 - RNA, 14 nt, Human
acugcaaccuccac

SEQ ID NO: 1361820 - RNA, 13 nt, Human
acugcaaccucca

SEQ ID NO: 1361821 - RNA, 13 nt, Human
acugaguuuucca

SEQ ID NO: 1361822 - RNA, 22 nt, Human
acugcaaaucaggcuuuuguuu

SEQ ID NO: 1361823 - RNA, 18 nt, Human
acugaguuuuccauggca

SEQ ID NO: 1361824 - RNA, 16 nt, Human
acugagugggaagccc

SEQ ID NO: 1361825 - RNA, 15 nt, Human
acugagugggaagcc

SEQ ID NO: 1361826 - RNA, 16 nt, Human
acugcaaccuccaccu

SEQ ID NO: 1361827 - RNA, 17 nt, Human
acugcaaccuccaccuc

SEQ ID NO: 1361828 - RNA, 18 nt, Human
acugcaaccuccaccucc

SEQ ID NO: 1361829 - RNA, 20 nt, Human
acugcaaccuccaccucgca

SEQ ID NO: 1361830 - RNA, 16 nt, Human
acugaggaauuuucuu

SEQ ID NO: 1361831 - RNA, 19 nt, Human
acugaggaauuucaccugu

SEQ ID NO: 1361832 - RNA, 17 nt, Human
acugaggaauuucaccu

SEQ ID NO: 1361833 - RNA, 20 nt, Human
uccucuccccagcccagaga

SEQ ID NO: 1361834 - RNA, 19 nt, Human
uccucuccccagcccagag

SEQ ID NO: 1361835 - RNA, 18 nt, Human
uccucuccccagcccaga

SEQ ID NO: 1361836 - RNA, 17 nt, Human
uccucuccccagcccag

SEQ ID NO: 1361837 - RNA, 16 nt, Human
uccucuccccagccca

SEQ ID NO: 1361838 - RNA, 15 nt, Human
uccucuccccagccc

SEQ ID NO: 1361839 - RNA, 14 nt, Human
uccucuccccagcc

SEQ ID NO: 1361840 - RNA, 12 nt, Human
acugagggcagu

SEQ ID NO: 1361841 - RNA, 20 nt, Human
acugaggaauuuucuuugug

SEQ ID NO: 1361842 - RNA, 14 nt, Human
acugaggaucagag

SEQ ID NO: 1361843 - RNA, 16 nt, Human
uccugcucauauugug

SEQ ID NO: 1361844 - RNA, 15 nt, Human
uccugcucauauugu

SEQ ID NO: 1361845 - RNA, 18 nt, Human
uccugcuaaguuaauguu

SEQ ID NO: 1361846 - RNA, 20 nt, Human
uccugcuaacggugcucagg

SEQ ID NO: 1361847 - RNA, 17 nt, Human
uccugcuaaaacaauga

SEQ ID NO: 1361848 - RNA, 14 nt, Human
uccugcgggugggg

SEQ ID NO: 1361849 - RNA, 13 nt, Human
uccugcggguggg

SEQ ID NO: 1361850 - RNA, 12 nt, Human
uccugcagcccc

SEQ ID NO: 1361851 - RNA, 13 nt, Human
uccugcagcccca

SEQ ID NO: 1361852 - RNA, 17 nt, Human
uccugcagaccacgccc

SEQ ID NO: 1361853 - RNA, 21 nt, Human
uccugcacuuacuugcuuauu

SEQ ID NO: 1361854 - RNA, 21 nt, Human
uccugcaccggggccugggca

SEQ ID NO: 1361855 - RNA, 17 nt, Human
uccugcaacucaaggac

SEQ ID NO: 1361856 - RNA, 18 nt, Human
uccugcaacucaaggacu

SEQ ID NO: 1361857 - RNA, 20 nt, Human
uccugcaccggggccugggc

SEQ ID NO: 1361858 - RNA, 15 nt, Human
uccugagugcuugcu

SEQ ID NO: 1361859 - RNA, 15 nt, Human
uccugaguggugcca

SEQ ID NO: 1361860 - RNA, 13 nt, Human
uccugaguagcug

SEQ ID NO: 1361861 - RNA, 20 nt, Human
acugcacaauaacuccuccc

SEQ ID NO: 1361862 - RNA, 21 nt, Human
acugcacaauaacuccuccca

SEQ ID NO: 1361863 - RNA, 14 nt, Human
acugcacaauaacu

SEQ ID NO: 1361864 - RNA, 15 nt, Human
acugcaaccuucacc

SEQ ID NO: 1361865 - RNA, 16 nt, Human
acugcaaccucugccu

SEQ ID NO: 1361866 - RNA, 21 nt, Human
acugcuggagaggccccagcc

SEQ ID NO: 1361867 - RNA, 16 nt, Human
acugcuggagaggccc

SEQ ID NO: 1361868 - RNA, 17 nt, Human
acugcugccacugaggg

SEQ ID NO: 1361869 - RNA, 14 nt, Human
acugcugccacuga

SEQ ID NO: 1361870 - RNA, 22 nt, Human
acugcuugcccuaagcagaaag

SEQ ID NO: 1361871 - RNA, 20 nt, Human
acugcuugcccuaagcagaa

SEQ ID NO: 1361872 - RNA, 16 nt, Human
acugcuugcccuaagc

SEQ ID NO: 1361873 - RNA, 18 nt, Human
acugcuugaggaaaacaa

SEQ ID NO: 1361874 - RNA, 15 nt, Human
acugcuugaggaaaa

SEQ ID NO: 1361875 - RNA, 14 nt, Human
acugcuugaggaaa

SEQ ID NO: 1361876 - RNA, 22 nt, Human
acugcuggagaggccccagccg

SEQ ID NO: 1361877 - RNA, 16 nt, Human
acugcuuggagcugag

SEQ ID NO: 1361878 - RNA, 13 nt, Human
acugcuuggagcu

SEQ ID NO: 1361879 - RNA, 18 nt, Human
acugcuuggagcugagca

SEQ ID NO: 1361880 - RNA, 22 nt, Human
acugccuucucaacuccaaacu

SEQ ID NO: 1361881 - RNA, 11 nt, Human
acugccuuuga

SEQ ID NO: 1361882 - RNA, 18 nt, Human
acugcgacuuucugccug

SEQ ID NO: 1361883 - RNA, 17 nt, Human
acugcgacuuucugccu

SEQ ID NO: 1361884 - RNA, 15 nt, Human
acugcgacuuucugc

SEQ ID NO: 1361885 - RNA, 13 nt, Human
acugccuuugacc

SEQ ID NO: 1361886 - RNA, 16 nt, Human
acugccuuuggcagag

SEQ ID NO: 1361887 - RNA, 19 nt, Human
acugccuuuggcagaguuc

SEQ ID NO: 1361888 - RNA, 23 nt, Human
acugcgacuuucugccuggagug

SEQ ID NO: 1361889 - RNA, 22 nt, Human
acugcgacuuucugccuggagu

SEQ ID NO: 1361890 - RNA, 21 nt, Human
acugcgacuuucugccuggag

SEQ ID NO: 1361891 - RNA, 19 nt, Human
acugcgacuuucugccugg

SEQ ID NO: 1361892 - RNA, 23 nt, Human
acugcgcccuuaacugcauccag

SEQ ID NO: 1361893 - RNA, 13 nt, Human
acugcugccacug

SEQ ID NO: 1361894 - RNA, 12 nt, Human
acugcugccacu

SEQ ID NO: 1361895 - RNA, 22 nt, Human
acugcugagauacauacagaau

SEQ ID NO: 1361896 - RNA, 20 nt, Human
acugcugagauacauacaga

SEQ ID NO: 1361897 - RNA, 19 nt, Human
acugcugagauacauacag

SEQ ID NO: 1361898 - RNA, 18 nt, Human
acugcugagauacauaca

SEQ ID NO: 1361899 - RNA, 13 nt, Human
acugcucugagaa

SEQ ID NO: 1361900 - RNA, 12 nt, Human
acugcucugaga

SEQ ID NO: 1361901 - RNA, 18 nt, Human
acugcucccaccuccuga

SEQ ID NO: 1361902 - RNA, 19 nt, Human
acugcucccaccuccugac

SEQ ID NO: 1361903 - RNA, 16 nt, Human
acugcucccaccuccu

SEQ ID NO: 1361904 - RNA, 15 nt, Human
acugcucccaccucc

SEQ ID NO: 1361905 - RNA, 15 nt, Human
acugcucuccuccac

SEQ ID NO: 1361906 - RNA, 21 nt, Human
acugcucuccuccaccucaac

SEQ ID NO: 1361907 - RNA, 21 nt, Human
acuggcaggcaggcucccagg

SEQ ID NO: 1361908 - RNA, 15 nt, Human
acuggcggggggccc

SEQ ID NO: 1361909 - RNA, 19 nt, Human
acuggcgacacguagcagc

SEQ ID NO: 1361910 - RNA, 18 nt, Human
acuggccuuuuucauuua

SEQ ID NO: 1361911 - RNA, 23 nt, Human
acuggcauggauauaguuuuacu

SEQ ID NO: 1361912 - RNA, 21 nt, Human
acuggcauggauauaguuuua

SEQ ID NO: 1361913 - RNA, 15 nt, Human
acuggcucuccuggc

SEQ ID NO: 1361914 - RNA, 17 nt, Human
acuggcucuccuggccc

SEQ ID NO: 1361915 - RNA, 23 nt, Human
uccuucagagagcagugcuuuug

SEQ ID NO: 1361916 - RNA, 21 nt, Human
uccuucagagagcagugcuuu

SEQ ID NO: 1361917 - RNA, 20 nt, Human
uccuucagagagcagugcuu

SEQ ID NO: 1361918 - RNA, 19 nt, Human
uccuucagagagcagugcu

SEQ ID NO: 1361919 - RNA, 13 nt, Human
uccuucagagagc

SEQ ID NO: 1361920 - RNA, 14 nt, Human
uccuucagauuugg

SEQ ID NO: 1361921 - RNA, 22 nt, Human
uccuucagagagcagugcuuuu

SEQ ID NO: 1361922 - RNA, 18 nt, Human
uccuucagcacuuuagaa

SEQ ID NO: 1361923 - RNA, 15 nt, Human
uccuucagcacuuua

SEQ ID NO: 1361924 - RNA, 14 nt, Human
uccuucauuuccuc

SEQ ID NO: 1361925 - RNA, 11 nt, Human
uccuucauuuc

SEQ ID NO: 1361926 - RNA, 19 nt, Human
uccuucaugacagccucca

SEQ ID NO: 1361927 - RNA, 14 nt, Human
uccuuccugcccca

SEQ ID NO: 1361928 - RNA, 12 nt, Human
uccuuccugccc

SEQ ID NO: 1361929 - RNA, 10 nt, Human
uccuuccugc

SEQ ID NO: 1361930 - RNA, 16 nt, Human
uccuuccucacaccag

SEQ ID NO: 1361931 - RNA, 23 nt, Human
uccuuccuaaauuuuccuguccu

SEQ ID NO: 1361932 - RNA, 23 nt, Human
uccuuccgcuuggagcuauuuuc

SEQ ID NO: 1361933 - RNA, 16 nt, Human
uccuuccgcuuggagc

SEQ ID NO: 1361934 - RNA, 21 nt, Human
uccuuccucacaccaggcuug

SEQ ID NO: 1361935 - RNA, 12 nt, Human
uccuucccucuc

SEQ ID NO: 1361936 - RNA, 14 nt, Human
uccuucccauggag

SEQ ID NO: 1361937 - RNA, 23 nt, Human
uccuucccagaggggccugccac

SEQ ID NO: 1361938 - RNA, 15 nt, Human
uccuucauuuccucc

SEQ ID NO: 1361939 - RNA, 17 nt, Human
uccuucccuuuucuguu

SEQ ID NO: 1361940 - RNA, 16 nt, Human
uccuucccuuuucugu

SEQ ID NO: 1361941 - RNA, 19 nt, Human
uccuucccugugccuccuc

SEQ ID NO: 1361942 - RNA, 14 nt, Human
uccuucccucucug

SEQ ID NO: 1361943 - RNA, 18 nt, Human
uccuuccaaugucuggag

SEQ ID NO: 1361944 - RNA, 14 nt, Human
uccuucccugcugu

SEQ ID NO: 1361945 - RNA, 20 nt, Human
ucgacucugugcuggccagc

SEQ ID NO: 1361946 - RNA, 23 nt, Human
ucgacucugugcuggccagcgag

SEQ ID NO: 1361947 - RNA, 22 nt, Human
ucgacacuguucuuagcucaau

SEQ ID NO: 1361948 - RNA, 17 nt, Human
ucgagcagcauuuuauu

SEQ ID NO: 1361949 - RNA, 20 nt, Human
ucgagauuaucguuuucuua

SEQ ID NO: 1361950 - RNA, 19 nt, Human
ucgagauuaucguuuucuu

SEQ ID NO: 1361951 - RNA, 23 nt, Human
ucgagaucccaacacugccagca

SEQ ID NO: 1361952 - RNA, 22 nt, Human
ucgagaucccaacacugccagc

SEQ ID NO: 1361953 - RNA, 23 nt, Human
ucgccuuucccaggugcuacacc

SEQ ID NO: 1361954 - RNA, 12 nt, Human
ucgccuucccca

SEQ ID NO: 1361955 - RNA, 20 nt, Human
ucgcuccccacucugcucug

SEQ ID NO: 1361956 - RNA, 21 nt, Human
ucgcuccccacucugcucuga

SEQ ID NO: 1361957 - RNA, 17 nt, Human
ucgaggaguaacaauac

SEQ ID NO: 1361958 - RNA, 16 nt, Human
ucgccuguaaucucac

SEQ ID NO: 1361959 - RNA, 20 nt, Human
ucgaggaguaacaauacaaa

SEQ ID NO: 1361960 - RNA, 14 nt, Human
ucgaggaguaacaa

SEQ ID NO: 1361961 - RNA, 19 nt, Human
uccuuucauauaguuagcu

SEQ ID NO: 1361962 - RNA, 16 nt, Human
uccuuuagguaagaag

SEQ ID NO: 1361963 - RNA, 20 nt, Human
acuguagaaugauuucaugc

SEQ ID NO: 1361964 - RNA, 19 nt, Human
acuguagaaugauuucaug

SEQ ID NO: 1361965 - RNA, 18 nt, Human
acuguagaaugauuucau

SEQ ID NO: 1361966 - RNA, 16 nt, Human
acuguacagugucuuu

SEQ ID NO: 1361967 - RNA, 15 nt, Human
acuguacagugucuu

SEQ ID NO: 1361968 - RNA, 12 nt, Human
acuguacagugu

SEQ ID NO: 1361969 - RNA, 11 nt, Human
acuguacagug

SEQ ID NO: 1361970 - RNA, 21 nt, Human
acuguacagugucuuuuuuug

SEQ ID NO: 1361971 - RNA, 17 nt, Human
acuguacagugucuuuu

SEQ ID NO: 1361972 - RNA, 16 nt, Human
acuguacaugaaaaca

SEQ ID NO: 1361973 - RNA, 23 nt, Human
acuguacaugaaaacacauuuuu

SEQ ID NO: 1361974 - RNA, 13 nt, Human
acuguacaugaaa

SEQ ID NO: 1361975 - RNA, 14 nt, Human
acuguacaugaaaa

SEQ ID NO: 1361976 - RNA, 18 nt, Human
acuguacagcuggcucua

SEQ ID NO: 1361977 - RNA, 14 nt, Human
acuguacagcuggc

SEQ ID NO: 1361978 - RNA, 13 nt, Human
acuguacagcugg

SEQ ID NO: 1361979 - RNA, 20 nt, Human
acuguacagacagaaaaaac

SEQ ID NO: 1361980 - RNA, 16 nt, Human
acuguaaguugggcuu

SEQ ID NO: 1361981 - RNA, 19 nt, Human
acuguaaucuuauuuagga

SEQ ID NO: 1361982 - RNA, 22 nt, Human
acuguaaucuuauuuaggaagu

SEQ ID NO: 1361983 - RNA, 19 nt, Human
acuguaauuugugauacaa

SEQ ID NO: 1361984 - RNA, 23 nt, Human
acugggcaugagggguuccuccc

SEQ ID NO: 1361985 - RNA, 18 nt, Human
acugggcaaugauggcaa

SEQ ID NO: 1361986 - RNA, 13 nt, Human
acugggcaaugau

SEQ ID NO: 1361987 - RNA, 17 nt, Human
acugggaggcuccccuu

SEQ ID NO: 1361988 - RNA, 12 nt, Human
acugggaggcuc

SEQ ID NO: 1361989 - RNA, 21 nt, Human
acugggagcccccagccuguc

SEQ ID NO: 1361990 - RNA, 20 nt, Human
acugggagcccccagccugu

SEQ ID NO: 1361991 - RNA, 19 nt, Human
acugggagcccccagccug

SEQ ID NO: 1361992 - RNA, 18 nt, Human
acugggagcccccagccu

SEQ ID NO: 1361993 - RNA, 17 nt, Human
acugggagcccccagcc

SEQ ID NO: 1361994 - RNA, 15 nt, Human
acugggagcccccag

SEQ ID NO: 1361995 - RNA, 15 nt, Human
ucgcuccugcagccc

SEQ ID NO: 1361996 - RNA, 14 nt, Human
ucgcuccugcccac

SEQ ID NO: 1361997 - RNA, 22 nt, Human
ucgcuccucaaccccuccccuc

SEQ ID NO: 1361998 - RNA, 19 nt, Human
ucgcuccucaaccccuccc

SEQ ID NO: 1361999 - RNA, 18 nt, Human
ucgcuccucaaccccucc

SEQ ID NO: 1362000 - RNA, 16 nt, Human
ucgcuccucaaccccu

SEQ ID NO: 1362001 - RNA, 19 nt, Human
acuggggacuuggccucuc

SEQ ID NO: 1362002 - RNA, 21 nt, Human
acuggggagcccgucucagug

SEQ ID NO: 1362003 - RNA, 17 nt, Human
acuggggagcccgucuc

SEQ ID NO: 1362004 - RNA, 13 nt, Human
acuggggagcccg

SEQ ID NO: 1362005 - RNA, 18 nt, Human
acuggggacuuggccucu

SEQ ID NO: 1362006 - RNA, 17 nt, Human
acuggggacuuggccuc

SEQ ID NO: 1362007 - RNA, 15 nt, Human
acuggggacuuggcc

SEQ ID NO: 1362008 - RNA, 18 nt, Human
acuggggaaacuggccau

SEQ ID NO: 1362009 - RNA, 15 nt, Human
acuggggaaacuggc

SEQ ID NO: 1362010 - RNA, 19 nt, Human
acuggggaaaacuccaccu

SEQ ID NO: 1362011 - RNA, 15 nt, Human
acugggcaugagggg

SEQ ID NO: 1362012 - RNA, 14 nt, Human
acuggggcaggggc

SEQ ID NO: 1362013 - RNA, 16 nt, Human
acuguaaggcaaucau

SEQ ID NO: 1362014 - RNA, 22 nt, Human
agcacuuggggguucaggcccg

SEQ ID NO: 1362015 - RNA, 14 nt, Human
agcacuuggcccuu

SEQ ID NO: 1362016 - RNA, 17 nt, Human
agcacgacaguggaugc

SEQ ID NO: 1362017 - RNA, 18 nt, Human
agcacgaaauguuauuuu

SEQ ID NO: 1362018 - RNA, 16 nt, Human
agcacgauuucuguuu

SEQ ID NO: 1362019 - RNA, 14 nt, Human
agcacgauuucugu

SEQ ID NO: 1362020 - RNA, 15 nt, Human
agcacgauuucuguu

SEQ ID NO: 1362021 - RNA, 17 nt, Human
agcacgaaauguuauuu

SEQ ID NO: 1362022 - RNA, 13 nt, Human
agcacgauuucug

SEQ ID NO: 1362023 - RNA, 14 nt, Human
agcaccugcugucu

SEQ ID NO: 1362024 - RNA, 15 nt, Human
agcaccugcugucug

SEQ ID NO: 1362025 - RNA, 14 nt, Human
agcaccagaaugua

SEQ ID NO: 1362026 - RNA, 23 nt, Human
agcagaaggggagauggacgaca

SEQ ID NO: 1362027 - RNA, 17 nt, Human
agcagaaggggagaugg

SEQ ID NO: 1362028 - RNA, 13 nt, Human
agcagaagcagca

SEQ ID NO: 1362029 - RNA, 14 nt, Human
agcagaagcagcaa

SEQ ID NO: 1362030 - RNA, 21 nt, Human
agcagaaagugccuuucagga

SEQ ID NO: 1362031 - RNA, 18 nt, Human
agcagaaauccaagcacc

SEQ ID NO: 1362032 - RNA, 23 nt, Human
agcagaaagugccuuucaggauc

SEQ ID NO: 1362033 - RNA, 19 nt, Human
agcagaaaugccuuacccu

SEQ ID NO: 1362034 - RNA, 12 nt, Human
agcagaaaugcc

SEQ ID NO: 1362035 - RNA, 13 nt, Human
agcagaaaugccu

SEQ ID NO: 1362036 - RNA, 20 nt, Human
agcagaaagugccuuucagg

SEQ ID NO: 1362037 - RNA, 19 nt, Human
agcagaaagugccuuucag

SEQ ID NO: 1362038 - RNA, 18 nt, Human
agcagaaagugccuuuca

SEQ ID NO: 1362039 - RNA, 15 nt, Human
agcagaaagugccuu

SEQ ID NO: 1362040 - RNA, 14 nt, Human
agcagaaagugccu

SEQ ID NO: 1362041 - RNA, 22 nt, Human
agcagaaaacccuugggccaga

SEQ ID NO: 1362042 - RNA, 21 nt, Human
agcagaaaacccuugggccag

SEQ ID NO: 1362043 - RNA, 15 nt, Human
agcagaaaacccuug

SEQ ID NO: 1362044 - RNA, 20 nt, Human
agcacuuuagaauaugccuu

SEQ ID NO: 1362045 - RNA, 16 nt, Human
agcacuuguccagcug

SEQ ID NO: 1362046 - RNA, 15 nt, Human
agcacuuggcccuuc

SEQ ID NO: 1362047 - RNA, 21 nt, Human
agcacuuguggguuuuuguuu

SEQ ID NO: 1362048 - RNA, 14 nt, Human
agcacuuuagaaua

SEQ ID NO: 1362049 - RNA, 21 nt, Human
agcacuuuagaauaugccuug

SEQ ID NO: 1362050 - RNA, 15 nt, Human
ugagccuugaacuuu

SEQ ID NO: 1362051 - RNA, 17 nt, Human
ugagccuugaacuuuga

SEQ ID NO: 1362052 - RNA, 18 nt, Human
ugagccuugaacuuugac

SEQ ID NO: 1362053 - RNA, 19 nt, Human
ugagccuugaacuuugacc

SEQ ID NO: 1362054 - RNA, 14 nt, Human
ugagccuugaacuu

SEQ ID NO: 1362055 - RNA, 23 nt, Human
agcagacagagccaggagaagcu

SEQ ID NO: 1362056 - RNA, 21 nt, Human
agcagacaguguuuucuggga

SEQ ID NO: 1362057 - RNA, 12 nt, Human
agcagacaggcc

SEQ ID NO: 1362058 - RNA, 19 nt, Human
agcagacagagccaggaga

SEQ ID NO: 1362059 - RNA, 18 nt, Human
agcagacagagccaggag

SEQ ID NO: 1362060 - RNA, 17 nt, Human
agcagacagagccagga

SEQ ID NO: 1362061 - RNA, 16 nt, Human
agcagacagagccagg

SEQ ID NO: 1362062 - RNA, 15 nt, Human
agcagacagagccag

SEQ ID NO: 1362063 - RNA, 14 nt, Human
agcagacagagcca

SEQ ID NO: 1362064 - RNA, 20 nt, Human
agcagacucagcucugacau

SEQ ID NO: 1362065 - RNA, 19 nt, Human
agcagacucagcucugaca

SEQ ID NO: 1362066 - RNA, 16 nt, Human
agcagacucagcucug

SEQ ID NO: 1362067 - RNA, 23 nt, Human
agcagacuacagcuggggugcag

SEQ ID NO: 1362068 - RNA, 22 nt, Human
agcagacuacagcuggggugca

SEQ ID NO: 1362069 - RNA, 17 nt, Human
agcagacuacagcuggg

SEQ ID NO: 1362070 - RNA, 13 nt, Human
agcagacuacagc

SEQ ID NO: 1362071 - RNA, 22 nt, Human
agcagaccaccccgccugcccu

SEQ ID NO: 1362072 - RNA, 11 nt, Human
agcagacauuu

SEQ ID NO: 1362073 - RNA, 16 nt, Human
ugagcacugccaggag

SEQ ID NO: 1362074 - RNA, 15 nt, Human
ugagcacugccagga

SEQ ID NO: 1362075 - RNA, 14 nt, Human
ugagcacugccagg

SEQ ID NO: 1362076 - RNA, 13 nt, Human
ugagcacugccag

SEQ ID NO: 1362077 - RNA, 22 nt, Human
ugagcacugccaggagggacaa

SEQ ID NO: 1362078 - RNA, 18 nt, Human
ugagcacugccaggaggg

SEQ ID NO: 1362079 - RNA, 17 nt, Human
ugagcacugccaggagg

SEQ ID NO: 1362080 - RNA, 15 nt, Human
ugagcacuguuuaua

SEQ ID NO: 1362081 - RNA, 19 nt, Human
ugagcacugccaggaggga

SEQ ID NO: 1362082 - RNA, 22 nt, Human
ugagcacuguuuauacacugug

SEQ ID NO: 1362083 - RNA, 17 nt, Human
ugagcacagccuagggc

SEQ ID NO: 1362084 - RNA, 15 nt, Human
agcaaccuguagagu

SEQ ID NO: 1362085 - RNA, 23 nt, Human
agcaaccguggcccuuccuggac

SEQ ID NO: 1362086 - RNA, 15 nt, Human
agcaaccucaguaau

SEQ ID NO: 1362087 - RNA, 22 nt, Human
agcaaccguggcccuuccugga

SEQ ID NO: 1362088 - RNA, 21 nt, Human
agcaaccguggcccuuccugg

SEQ ID NO: 1362089 - RNA, 20 nt, Human
agcaaccguggcccuuccug

SEQ ID NO: 1362090 - RNA, 19 nt, Human
agcaaccguggcccuuccu

SEQ ID NO: 1362091 - RNA, 16 nt, Human
agcaaccguggcccuu

SEQ ID NO: 1362092 - RNA, 15 nt, Human
agcaaccguggcccu

SEQ ID NO: 1362093 - RNA, 18 nt, Human
ugagcaacucuugauuau

SEQ ID NO: 1362094 - RNA, 16 nt, Human
ugagcaacucuugauu

SEQ ID NO: 1362095 - RNA, 21 nt, Human
ugagcaacgcuauuccagcug

SEQ ID NO: 1362096 - RNA, 13 nt, Human
ugagccagggucu

SEQ ID NO: 1362097 - RNA, 22 nt, Human
ugagccagggucuccagaaagc

SEQ ID NO: 1362098 - RNA, 12 nt, Human
agcacagcagcc

SEQ ID NO: 1362099 - RNA, 10 nt, Human
agcacagcag

SEQ ID NO: 1362100 - RNA, 18 nt, Human
agcaaguucgucuguugu

SEQ ID NO: 1362101 - RNA, 23 nt, Human
agcacagccaacacgcaccugcc

SEQ ID NO: 1362102 - RNA, 13 nt, Human
agcacagccaaca

SEQ ID NO: 1362103 - RNA, 12 nt, Human
agcacagccaac

SEQ ID NO: 1362104 - RNA, 23 nt, Human
agcacagcagccuggggcuggcc

SEQ ID NO: 1362105 - RNA, 15 nt, Human
agcacagcagccugg

SEQ ID NO: 1362106 - RNA, 13 nt, Human
agcacagcagccu

SEQ ID NO: 1362107 - RNA, 15 nt, Human
agcaaguucgucugu

SEQ ID NO: 1362108 - RNA, 23 nt, Human
agcacaucucaacaggccucagg

SEQ ID NO: 1362109 - RNA, 19 nt, Human
agcacaucucaacaggccu

SEQ ID NO: 1362110 - RNA, 16 nt, Human
agcacaucucaacagg

SEQ ID NO: 1362111 - RNA, 15 nt, Human
agcacaucucaacag

SEQ ID NO: 1362112 - RNA, 20 nt, Human
agcacaucucaacaggccuc

SEQ ID NO: 1362113 - RNA, 22 nt, Human
agcaccaccaaacacaguguau

SEQ ID NO: 1362114 - RNA, 22 nt, Human
agcaccaaaucaaaaucucucc

SEQ ID NO: 1362115 - RNA, 18 nt, Human
agcaccaaaucaaaaucu

SEQ ID NO: 1362116 - RNA, 17 nt, Human
agcaccaaaucaaaauc

SEQ ID NO: 1362117 - RNA, 16 nt, Human
agcaccaaucaugaau

SEQ ID NO: 1362118 - RNA, 12 nt, Human
agcacagccuag

SEQ ID NO: 1362119 - RNA, 12 nt, Human
agcacagcccuu

SEQ ID NO: 1362120 - RNA, 22 nt, Human
agcacagccucuuagaugcagu

SEQ ID NO: 1362121 - RNA, 16 nt, Human
agcacauauggaauuu

SEQ ID NO: 1362122 - RNA, 20 nt, Human
agcacagcuuagauuucaua

SEQ ID NO: 1362123 - RNA, 18 nt, Human
agcacagcuuagauuuca

SEQ ID NO: 1362124 - RNA, 16 nt, Human
agcacagcuuagauuu

SEQ ID NO: 1362125 - RNA, 15 nt, Human
agcacagugaucaag

SEQ ID NO: 1362126 - RNA, 22 nt, Human
ugaggacaagagaaaaaagcca

SEQ ID NO: 1362127 - RNA, 13 nt, Human
ugaggacaagaga

SEQ ID NO: 1362128 - RNA, 20 nt, Human
ugaggacaaccauuccagac

SEQ ID NO: 1362129 - RNA, 19 nt, Human
ugaggacaaccauuccaga

SEQ ID NO: 1362130 - RNA, 18 nt, Human
ugaggaauuuucuuugug

SEQ ID NO: 1362131 - RNA, 14 nt, Human
ugaggaauuuucuu

SEQ ID NO: 1362132 - RNA, 13 nt, Human
ugaggaauuuucu

SEQ ID NO: 1362133 - RNA, 22 nt, Human
ugaggaauuucaccuguaaacc

SEQ ID NO: 1362134 - RNA, 21 nt, Human
ugaggaauuucaccuguaaac

SEQ ID NO: 1362135 - RNA, 15 nt, Human
ugaggaauuucaccu

SEQ ID NO: 1362136 - RNA, 19 nt, Human
ugaggccacacucagcaca

SEQ ID NO: 1362137 - RNA, 13 nt, Human
ugaggccacacuc

SEQ ID NO: 1362138 - RNA, 12 nt, Human
ugaggccacacu

SEQ ID NO: 1362139 - RNA, 15 nt, Human
ugaggccacuguguu

SEQ ID NO: 1362140 - RNA, 16 nt, Human
ugaggccacccagagg

SEQ ID NO: 1362141 - RNA, 23 nt, Human
ugaggccacacucagcacaaggc

SEQ ID NO: 1362142 - RNA, 20 nt, Human
ugaggccacacucagcacaa

SEQ ID NO: 1362143 - RNA, 12 nt, Human
ugaggacacaug

SEQ ID NO: 1362144 - RNA, 13 nt, Human
ugaggacacaugu

SEQ ID NO: 1362145 - RNA, 14 nt, Human
ugaggacacauguc

SEQ ID NO: 1362146 - RNA, 15 nt, Human
ugaggacacaugucc

SEQ ID NO: 1362147 - RNA, 15 nt, Human
ugaggacacugauau

SEQ ID NO: 1362148 - RNA, 20 nt, Human
ugaggacagaugccuccuuc

SEQ ID NO: 1362149 - RNA, 18 nt, Human
ugaggacagaugccuccu

SEQ ID NO: 1362150 - RNA, 15 nt, Human
ugaggacagaugccu

SEQ ID NO: 1362151 - RNA, 16 nt, Human
ugaggacacaugucca

SEQ ID NO: 1362152 - RNA, 23 nt, Human
ugaggccauggacucuguccuga

SEQ ID NO: 1362153 - RNA, 20 nt, Human
ugaggccauggacucugucc

SEQ ID NO: 1362154 - RNA, 14 nt, Human
ugaggccauggacu

SEQ ID NO: 1362155 - RNA, 16 nt, Human
ugaggccagggcagag

SEQ ID NO: 1362156 - RNA, 15 nt, Human
ugaggccagggcaga

SEQ ID NO: 1362157 - RNA, 14 nt, Human
ugaggccagggcag

SEQ ID NO: 1362158 - RNA, 13 nt, Human
ugaggccagggca

SEQ ID NO: 1362159 - RNA, 22 nt, Human
ugaggccagccuggccuccugc

SEQ ID NO: 1362160 - RNA, 21 nt, Human
ugaggccagccuggccuccug

SEQ ID NO: 1362161 - RNA, 20 nt, Human
ugaggccagccuggccuccu

SEQ ID NO: 1362162 - RNA, 18 nt, Human
ugaggccagccuggccuc

SEQ ID NO: 1362163 - RNA, 17 nt, Human
ugaggccagccuggccu

SEQ ID NO: 1362164 - RNA, 16 nt, Human
ugaggccagccuggcc

SEQ ID NO: 1362165 - RNA, 15 nt, Human
ugaggccagccuggc

SEQ ID NO: 1362166 - RNA, 14 nt, Human
ugaggccagccugg

SEQ ID NO: 1362167 - RNA, 13 nt, Human
ugaggccagccug

SEQ ID NO: 1362168 - RNA, 12 nt, Human
ugaggccagccu

SEQ ID NO: 1362169 - RNA, 21 nt, Human
ugaggccacuguguuccuucc

SEQ ID NO: 1362170 - RNA, 13 nt, Human
ugaggccagacca

SEQ ID NO: 1362171 - RNA, 18 nt, Human
ugaggaaagcaagaauca

SEQ ID NO: 1362172 - RNA, 15 nt, Human
ugaggaaagucauug

SEQ ID NO: 1362173 - RNA, 17 nt, Human
ugaggaaagucauuggc

SEQ ID NO: 1362174 - RNA, 18 nt, Human
ugaggaaagucauuggcu

SEQ ID NO: 1362175 - RNA, 19 nt, Human
ugaggaaagucauuggcuu

SEQ ID NO: 1362176 - RNA, 21 nt, Human
ugaggaaagucauuggcuuua

SEQ ID NO: 1362177 - RNA, 22 nt, Human
ugaggaaagucauuggcuuuau

SEQ ID NO: 1362178 - RNA, 20 nt, Human
ugagcgccuccauccaaggc

SEQ ID NO: 1362179 - RNA, 23 nt, Human
ugagcgccuccauccaaggccag

SEQ ID NO: 1362180 - RNA, 18 nt, Human
ugagcgccuccauccaag

SEQ ID NO: 1362181 - RNA, 12 nt, Human
ugagcgccagga

SEQ ID NO: 1362182 - RNA, 23 nt, Human
ugagcgaguggagucugccaccc

SEQ ID NO: 1362183 - RNA, 21 nt, Human
ugagcgaguggagucugccac

SEQ ID NO: 1362184 - RNA, 23 nt, Human
ugagcgaggagaugcuccuuggg

SEQ ID NO: 1362185 - RNA, 22 nt, Human
ugagcgaggagaugcuccuugg

SEQ ID NO: 1362186 - RNA, 16 nt, Human
ugagccuuuucccucu

SEQ ID NO: 1362187 - RNA, 13 nt, Human
ugagccuuguaau

SEQ ID NO: 1362188 - RNA, 13 nt, Human
ugagcuacaaaug

SEQ ID NO: 1362189 - RNA, 14 nt, Human
ugagcuacaaaugc

SEQ ID NO: 1362190 - RNA, 17 nt, Human
ugagcuagaacccucug

SEQ ID NO: 1362191 - RNA, 18 nt, Human
ugagcuagaacccucugu

SEQ ID NO: 1362192 - RNA, 16 nt, Human
ugagcuagaacccucu

SEQ ID NO: 1362193 - RNA, 21 nt, Human
ugagcuacugccgucagugcu

SEQ ID NO: 1362194 - RNA, 24 nt, Human
ugagcuacugccgucagugcugug

SEQ ID NO: 1362195 - RNA, 16 nt, Human
ugagcuacaaaugcau

SEQ ID NO: 1362196 - RNA, 23 nt, Human
ugagcuuucugaacagcuggugu

SEQ ID NO: 1362197 - RNA, 22 nt, Human
ugagcuuucugaacagcuggug

SEQ ID NO: 1362198 - RNA, 20 nt, Human
ugagcuuucugaacagcugg

SEQ ID NO: 1362199 - RNA, 19 nt, Human
ugagcuuucugaacagcug

SEQ ID NO: 1362200 - RNA, 18 nt, Human
ugagcuuucugaacagcu

SEQ ID NO: 1362201 - RNA, 17 nt, Human
ugagcuuucugaacagc

SEQ ID NO: 1362202 - RNA, 16 nt, Human
ugagcuuucugaacag

SEQ ID NO: 1362203 - RNA, 14 nt, Human
ugagcuuucugaac

SEQ ID NO: 1362204 - RNA, 13 nt, Human
ugagcuuucugaa

SEQ ID NO: 1362205 - RNA, 14 nt, Human
ugagcuaggaauug

SEQ ID NO: 1362206 - RNA, 22 nt, Human
ugaggcccuccacaccugcggc

SEQ ID NO: 1362207 - RNA, 21 nt, Human
ugaggcccuccacaccugcgg

SEQ ID NO: 1362208 - RNA, 19 nt, Human
ugaggcccuccacaccugc

SEQ ID NO: 1362209 - RNA, 18 nt, Human
ugaggcccuccacaccug

SEQ ID NO: 1362210 - RNA, 17 nt, Human
ugaggcccuccacaccu

SEQ ID NO: 1362211 - RNA, 13 nt, Human
ugaggcccuccac

SEQ ID NO: 1362212 - RNA, 12 nt, Human
ugaggcccucca

SEQ ID NO: 1362213 - RNA, 23 nt, Human
ugaggcccuccacaccugcggcc

SEQ ID NO: 1362214 - RNA, 23 nt, Human
ugagggcagcagccagcccugcc

SEQ ID NO: 1362215 - RNA, 22 nt, Human
ugagggcagcagccagcccugc

SEQ ID NO: 1362216 - RNA, 21 nt, Human
ugagggcagcagccagcccug

SEQ ID NO: 1362217 - RNA, 20 nt, Human
ugagggcagcagccagcccu

SEQ ID NO: 1362218 - RNA, 18 nt, Human
ugagggcagcagccagcc

SEQ ID NO: 1362219 - RNA, 17 nt, Human
ugagggcagcagccagc

SEQ ID NO: 1362220 - RNA, 16 nt, Human
ugagggcagcagccag

SEQ ID NO: 1362221 - RNA, 15 nt, Human
ugagggcagcagcca

SEQ ID NO: 1362222 - RNA, 14 nt, Human
ugagggcagcagcc

SEQ ID NO: 1362223 - RNA, 13 nt, Human
ugagggcagcagc

SEQ ID NO: 1362224 - RNA, 12 nt, Human
ugagggcagcag

SEQ ID NO: 1362225 - RNA, 23 nt, Human
ugagggcaguucgcagccacccu

SEQ ID NO: 1362226 - RNA, 21 nt, Human
ugagggcaguucgcagccacc

SEQ ID NO: 1362227 - RNA, 20 nt, Human
ugagggcaguucgcagccac

SEQ ID NO: 1362228 - RNA, 19 nt, Human
ugagggcaguucgcagcca

SEQ ID NO: 1362229 - RNA, 18 nt, Human
ugagggcaguucgcagcc

SEQ ID NO: 1362230 - RNA, 11 nt, Human
ugagggcaguc

SEQ ID NO: 1362231 - RNA, 22 nt, Human
ugaggggaccaggagugggugg

SEQ ID NO: 1362232 - RNA, 18 nt, Human
ugaggggaccaggagugg

SEQ ID NO: 1362233 - RNA, 16 nt, Human
ugaggggaccaggagu

SEQ ID NO: 1362234 - RNA, 15 nt, Human
ugaggggaccaggag

SEQ ID NO: 1362235 - RNA, 14 nt, Human
ugaggggaccagga

SEQ ID NO: 1362236 - RNA, 13 nt, Human
ugaggggaccagg

SEQ ID NO: 1362237 - RNA, 18 nt, Human
ugaggggaagcuagucuu

SEQ ID NO: 1362238 - RNA, 18 nt, Human
ugagggucuguagguugc

SEQ ID NO: 1362239 - RNA, 15 nt, Human
ugagggucuguaggu

SEQ ID NO: 1362240 - RNA, 18 nt, Human
ugagggguuccuccccuc

SEQ ID NO: 1362241 - RNA, 14 nt, Human
ugaggguaaguauu

SEQ ID NO: 1362242 - RNA, 22 nt, Human
ugagggguuccuccccuccagc

SEQ ID NO: 1362243 - RNA, 17 nt, Human
ugagggguuccuccccu

SEQ ID NO: 1362244 - RNA, 16 nt, Human
ugagggguuccucccc

SEQ ID NO: 1362245 - RNA, 15 nt, Human
ugagggguuccuccc

SEQ ID NO: 1362246 - RNA, 13 nt, Human
ugagggguuccuc

SEQ ID NO: 1362247 - RNA, 20 nt, Human
ugagggggggcucccugggg

SEQ ID NO: 1362248 - RNA, 16 nt, Human
ugaggggcuaccagga

SEQ ID NO: 1362249 - RNA, 17 nt, Human
ugaggggcuaccaggaa

SEQ ID NO: 1362250 - RNA, 19 nt, Human
ugaggggcuaccaggaaag

SEQ ID NO: 1362251 - RNA, 20 nt, Human
agcagaggggcagaggccca

SEQ ID NO: 1362252 - RNA, 14 nt, Human
agcagaggggcuga

SEQ ID NO: 1362253 - RNA, 13 nt, Human
agcagaggucucc

SEQ ID NO: 1362254 - RNA, 18 nt, Human
agcagagcuagguggaaa

SEQ ID NO: 1362255 - RNA, 17 nt, Human
agcagagcugauggaga

SEQ ID NO: 1362256 - RNA, 19 nt, Human
agcagagcugauggagaag

SEQ ID NO: 1362257 - RNA, 21 nt, Human
agcagagcugauggagaagga

SEQ ID NO: 1362258 - RNA, 22 nt, Human
agcagagcugauggagaaggaa

SEQ ID NO: 1362259 - RNA, 23 nt, Human
agcagagcugauggagaaggaag

SEQ ID NO: 1362260 - RNA, 17 nt, Human
agcagcaacuuguccua

SEQ ID NO: 1362261 - RNA, 24 nt, Human
agcagauucagaaaugaggccaug

SEQ ID NO: 1362262 - RNA, 22 nt, Human
ugagggucuguagguugcacac

SEQ ID NO: 1362263 - RNA, 23 nt, Human
ugagggucuguagguugcacacu

SEQ ID NO: 1362264 - RNA, 15 nt, Human
ugagguaaguuuuuu

SEQ ID NO: 1362265 - RNA, 17 nt, Human
agauuuggcuugacaaa

SEQ ID NO: 1362266 - RNA, 19 nt, Human
agauuuauuaaagaaaaaa

SEQ ID NO: 1362267 - RNA, 18 nt, Human
agauuuauuaaagaaaaa

SEQ ID NO: 1362268 - RNA, 17 nt, Human
agauuuauuaaagaaaa

SEQ ID NO: 1362269 - RNA, 16 nt, Human
agauuuauuaaagaaa

SEQ ID NO: 1362270 - RNA, 15 nt, Human
agauuuauuaaagaa

SEQ ID NO: 1362271 - RNA, 14 nt, Human
agauuuauuaaaga

SEQ ID NO: 1362272 - RNA, 20 nt, Human
agauugguguuuuuuucuau

SEQ ID NO: 1362273 - RNA, 19 nt, Human
agauugguguuuuuuucua

SEQ ID NO: 1362274 - RNA, 14 nt, Human
agauugguguuuuu

SEQ ID NO: 1362275 - RNA, 23 nt, Human
agauuuaauauaaaguuuuauau

SEQ ID NO: 1362276 - RNA, 20 nt, Human
agauuguccuuuugcaaaga

SEQ ID NO: 1362277 - RNA, 13 nt, Human
agauuguccuuuu

SEQ ID NO: 1362278 - RNA, 16 nt, Human
agauuuaccacuugug

SEQ ID NO: 1362279 - RNA, 20 nt, Human
agauuuaaucugccaagggc

SEQ ID NO: 1362280 - RNA, 14 nt, Human
agauuuaugcauau

SEQ ID NO: 1362281 - RNA, 16 nt, Human
agcaaccccaggcuga

SEQ ID NO: 1362282 - RNA, 15 nt, Human
agcaaccccaggcug

SEQ ID NO: 1362283 - RNA, 14 nt, Human
agcaaccccaggcu

SEQ ID NO: 1362284 - RNA, 14 nt, Human
agcaacauggcuuu

SEQ ID NO: 1362285 - RNA, 15 nt, Human
agcaacauucauagu

SEQ ID NO: 1362286 - RNA, 13 nt, Human
agcaacauggcuu

SEQ ID NO: 1362287 - RNA, 12 nt, Human
agcaacauggcu

SEQ ID NO: 1362288 - RNA, 21 nt, Human
agcaacaauuuaugaauugaa

SEQ ID NO: 1362289 - RNA, 19 nt, Human
agauuuucagcaaacucuu

SEQ ID NO: 1362290 - RNA, 14 nt, Human
agauuuuccugaaa

SEQ ID NO: 1362291 - RNA, 21 nt, Human
agcaaaaccaaauauuccaga

SEQ ID NO: 1362292 - RNA, 20 nt, Human
ugacucauucugaaggagcc

SEQ ID NO: 1362293 - RNA, 19 nt, Human
ugacucagggcuccugggu

SEQ ID NO: 1362294 - RNA, 18 nt, Human
ugacucagggcuccuggg

SEQ ID NO: 1362295 - RNA, 17 nt, Human
ugacucagggcuccugg

SEQ ID NO: 1362296 - RNA, 15 nt, Human
ugacucagggcuccu

SEQ ID NO: 1362297 - RNA, 14 nt, Human
ugacucagggcucc

SEQ ID NO: 1362298 - RNA, 13 nt, Human
ugacucagggcuc

SEQ ID NO: 1362299 - RNA, 21 nt, Human
ugacucaggagccugugacau

SEQ ID NO: 1362300 - RNA, 19 nt, Human
ugacucaggagccugugac

SEQ ID NO: 1362301 - RNA, 15 nt, Human
ugacucaggagccug

SEQ ID NO: 1362302 - RNA, 14 nt, Human
ugacucaggagccu

SEQ ID NO: 1362303 - RNA, 12 nt, Human
ugacucaggagc

SEQ ID NO: 1362304 - RNA, 12 nt, Human
ugacugucuggg

SEQ ID NO: 1362305 - RNA, 17 nt, Human
ugacugucacuguuccu

SEQ ID NO: 1362306 - RNA, 16 nt, Human
ugacugucacuguucc

SEQ ID NO: 1362307 - RNA, 13 nt, Human
ugacugucacugu

SEQ ID NO: 1362308 - RNA, 21 nt, Human
ugacugugguagccagcaucg

SEQ ID NO: 1362309 - RNA, 22 nt, Human
ugacugucuggggagcgggucu

SEQ ID NO: 1362310 - RNA, 14 nt, Human
ugacugucugggga

SEQ ID NO: 1362311 - RNA, 15 nt, Human
ugacuguuuccauca

SEQ ID NO: 1362312 - RNA, 16 nt, Human
ugacuucugccuggag

SEQ ID NO: 1362313 - RNA, 15 nt, Human
ugacuucugccugga

SEQ ID NO: 1362314 - RNA, 13 nt, Human
ugacuucugccug

SEQ ID NO: 1362315 - RNA, 12 nt, Human
ugacuucugccu

SEQ ID NO: 1362316 - RNA, 13 nt, Human
ugacuucugagau

SEQ ID NO: 1362317 - RNA, 15 nt, Human
ugacuugugucccau

SEQ ID NO: 1362318 - RNA, 19 nt, Human
ugacuuguauauuuuaaga

SEQ ID NO: 1362319 - RNA, 12 nt, Human
ugacuuguauau

SEQ ID NO: 1362320 - RNA, 23 nt, Human
ugacuugggcacccccagccugg

SEQ ID NO: 1362321 - RNA, 21 nt, Human
ugacuugggcacccccagccu

SEQ ID NO: 1362322 - RNA, 19 nt, Human
ugacuugggcacccccagc

SEQ ID NO: 1362323 - RNA, 17 nt, Human
ugacuugggcaccccca

SEQ ID NO: 1362324 - RNA, 21 nt, Human
ugacuuggcuggugugguaca

SEQ ID NO: 1362325 - RNA, 16 nt, Human
ugacuuggcuggugug

SEQ ID NO: 1362326 - RNA, 15 nt, Human
ugacuuggcuggugu

SEQ ID NO: 1362327 - RNA, 13 nt, Human
ugacuuggcuggu

SEQ ID NO: 1362328 - RNA, 12 nt, Human
ugacuuggcugg

SEQ ID NO: 1362329 - RNA, 18 nt, Human
ugacuucugccuggagac

SEQ ID NO: 1362330 - RNA, 21 nt, Human
agauucaaagguucuagguuu

SEQ ID NO: 1362331 - RNA, 22 nt, Human
agauucaaugccccugaauuua

SEQ ID NO: 1362332 - RNA, 21 nt, Human
agauucaaugccccugaauuu

SEQ ID NO: 1362333 - RNA, 19 nt, Human
agauucaaagguucuaggu

SEQ ID NO: 1362334 - RNA, 18 nt, Human
agauucaaagguucuagg

SEQ ID NO: 1362335 - RNA, 17 nt, Human
agauucaaagguucuag

SEQ ID NO: 1362336 - RNA, 16 nt, Human
agauucaaagguucua

SEQ ID NO: 1362337 - RNA, 15 nt, Human
agauucaaagguucu

SEQ ID NO: 1362338 - RNA, 14 nt, Human
agauucaaagguuc

SEQ ID NO: 1362339 - RNA, 22 nt, Human
ugacuugggcacccccagccug

SEQ ID NO: 1362340 - RNA, 19 nt, Human
agauuaucguuuucuuaaa

SEQ ID NO: 1362341 - RNA, 17 nt, Human
agauuaucguuuucuua

SEQ ID NO: 1362342 - RNA, 16 nt, Human
agauuaucguuuucuu

SEQ ID NO: 1362343 - RNA, 15 nt, Human
agauuaucguuuucu

SEQ ID NO: 1362344 - RNA, 23 nt, Human
agauuauagauucuaaagauucu

SEQ ID NO: 1362345 - RNA, 21 nt, Human
agauuauagauucuaaagauu

SEQ ID NO: 1362346 - RNA, 23 nt, Human
agauuauauauauuuuuuucuga

SEQ ID NO: 1362347 - RNA, 18 nt, Human
agauggaguuucuaaggu

SEQ ID NO: 1362348 - RNA, 17 nt, Human
agauggaguuucuaagg

SEQ ID NO: 1362349 - RNA, 16 nt, Human
agauggaguuucuaag

SEQ ID NO: 1362350 - RNA, 15 nt, Human
agauggaguuucuaa

SEQ ID NO: 1362351 - RNA, 14 nt, Human
agauggaguuucua

SEQ ID NO: 1362352 - RNA, 13 nt, Human
agauggaguuucu

SEQ ID NO: 1362353 - RNA, 23 nt, Human
agaugucauuuaguucagcaucc

SEQ ID NO: 1362354 - RNA, 23 nt, Human
agaugcuccaagauucuagauga

SEQ ID NO: 1362355 - RNA, 22 nt, Human
agaugcuccaagauucuagaug

SEQ ID NO: 1362356 - RNA, 21 nt, Human
agaugcuccaagauucuagau

SEQ ID NO: 1362357 - RNA, 20 nt, Human
agaugcuccaagauucuaga

SEQ ID NO: 1362358 - RNA, 19 nt, Human
agaugcuccaagauucuag

SEQ ID NO: 1362359 - RNA, 18 nt, Human
agaugcuccaagauucua

SEQ ID NO: 1362360 - RNA, 15 nt, Human
agaugcuccaagauu

SEQ ID NO: 1362361 - RNA, 13 nt, Human
agaugcuccaaga

SEQ ID NO: 1362362 - RNA, 22 nt, Human
agauggaaaauucauuuuuuaa

SEQ ID NO: 1362363 - RNA, 18 nt, Human
agauggaaaauucauuuu

SEQ ID NO: 1362364 - RNA, 18 nt, Human
agaugcuuuuaacagagu

SEQ ID NO: 1362365 - RNA, 20 nt, Human
agaugcuuuuaacagagucu

SEQ ID NO: 1362366 - RNA, 11 nt, Human
agaugcuuuua

SEQ ID NO: 1362367 - RNA, 21 nt, Human
ugaccccagggcacaggagcu

SEQ ID NO: 1362368 - RNA, 14 nt, Human
ugacccccagcucc

SEQ ID NO: 1362369 - RNA, 22 nt, Human
ugaccccagggcacaggagcua

SEQ ID NO: 1362370 - RNA, 24 nt, Human
agauguguguugauacuguugcac

SEQ ID NO: 1362371 - RNA, 23 nt, Human
agauguguguugauacuguugca

SEQ ID NO: 1362372 - RNA, 16 nt, Human
ugacccagugccccca

SEQ ID NO: 1362373 - RNA, 18 nt, Human
ugacccagugcccccacu

SEQ ID NO: 1362374 - RNA, 17 nt, Human
ugacccagugcccccac

SEQ ID NO: 1362375 - RNA, 23 nt, Human
ugacccagugcccccacugacca

SEQ ID NO: 1362376 - RNA, 22 nt, Human
agauguguguugauacuguugc

SEQ ID NO: 1362377 - RNA, 21 nt, Human
agauguguguugauacuguug

SEQ ID NO: 1362378 - RNA, 20 nt, Human
agauguguguugauacuguu

SEQ ID NO: 1362379 - RNA, 19 nt, Human
agauguguguugauacugu

SEQ ID NO: 1362380 - RNA, 18 nt, Human
agauguguguugauacug

SEQ ID NO: 1362381 - RNA, 17 nt, Human
agauguguguugauacu

SEQ ID NO: 1362382 - RNA, 15 nt, Human
agauguguguugaua

SEQ ID NO: 1362383 - RNA, 13 nt, Human
agauguguguuga

SEQ ID NO: 1362384 - RNA, 15 nt, Human
agauguguucacaau

SEQ ID NO: 1362385 - RNA, 18 nt, Human
agauguguucacaaugga

SEQ ID NO: 1362386 - RNA, 17 nt, Human
ugaauuuagugagcaua

SEQ ID NO: 1362387 - RNA, 21 nt, Human
ugaauuuagugagcauaggug

SEQ ID NO: 1362388 - RNA, 15 nt, Human
ugaauuuagugagca

SEQ ID NO: 1362389 - RNA, 19 nt, Human
ugaauuuaauaaucuguag

SEQ ID NO: 1362390 - RNA, 23 nt, Human
agaucagaugcuccaagauucua

SEQ ID NO: 1362391 - RNA, 20 nt, Human
agaucagcaaaccggggccu

SEQ ID NO: 1362392 - RNA, 22 nt, Human
agaucagaugcuccaagauucu

SEQ ID NO: 1362393 - RNA, 18 nt, Human
agaucagaugcuccaaga

SEQ ID NO: 1362394 - RNA, 23 nt, Human
agaucacuuucucaguuuucaua

SEQ ID NO: 1362395 - RNA, 19 nt, Human
agaucacuuucucaguuuu

SEQ ID NO: 1362396 - RNA, 18 nt, Human
agaucacuuucucaguuu

SEQ ID NO: 1362397 - RNA, 22 nt, Human
ugacaguauuauacgcuggcaa

SEQ ID NO: 1362398 - RNA, 19 nt, Human
ugacauugcguuugaccuu

SEQ ID NO: 1362399 - RNA, 15 nt, Human
ugacauugcguuuga

SEQ ID NO: 1362400 - RNA, 20 nt, Human
ugacauucugaaugcuucua

SEQ ID NO: 1362401 - RNA, 19 nt, Human
ugacauucugaaugcuucu

SEQ ID NO: 1362402 - RNA, 22 nt, Human
ugacaguccgucaaaacagauu

SEQ ID NO: 1362403 - RNA, 18 nt, Human
ugacaguccgucaaaaca

SEQ ID NO: 1362404 - RNA, 21 nt, Human
ugacaguauuauacgcuggca

SEQ ID NO: 1362405 - RNA, 12 nt, Human
ugacauuuuaca

SEQ ID NO: 1362406 - RNA, 14 nt, Human
ugacauuuuacauu

SEQ ID NO: 1362407 - RNA, 16 nt, Human
ugaccaaaguccuuuu

SEQ ID NO: 1362408 - RNA, 14 nt, Human
ugaccaaaguccuu

SEQ ID NO: 1362409 - RNA, 23 nt, Human
ugaccaaaaguuacauguuugca

SEQ ID NO: 1362410 - RNA, 22 nt, Human
ugaccaaaaguuacauguuugc

SEQ ID NO: 1362411 - RNA, 16 nt, Human
ugaccaaaaguuacau

SEQ ID NO: 1362412 - RNA, 15 nt, Human
ugaccaaaaguuaca

SEQ ID NO: 1362413 - RNA, 15 nt, Human
ugacauuuuacauua

SEQ ID NO: 1362414 - RNA, 16 nt, Human
ugacauuuuacauuaa

SEQ ID NO: 1362415 - RNA, 23 nt, Human
agaugauuucaguucuaggaaaa

SEQ ID NO: 1362416 - RNA, 20 nt, Human
agaugauuucaguucuagga

SEQ ID NO: 1362417 - RNA, 22 nt, Human
agaugauuaaauaagauucuaa

SEQ ID NO: 1362418 - RNA, 21 nt, Human
agaugauuaaauaagauucua

SEQ ID NO: 1362419 - RNA, 20 nt, Human
agaugauuaaauaagauucu

SEQ ID NO: 1362420 - RNA, 19 nt, Human
agaugauuaaauaagauuc

SEQ ID NO: 1362421 - RNA, 18 nt, Human
agaugauuaaauaagauu

SEQ ID NO: 1362422 - RNA, 19 nt, Human
agaugauggaugccaauau

SEQ ID NO: 1362423 - RNA, 16 nt, Human
agaugauggaugccaa

SEQ ID NO: 1362424 - RNA, 12 nt, Human
agauccaggacu

SEQ ID NO: 1362425 - RNA, 15 nt, Human
agauccuuccuuuug

SEQ ID NO: 1362426 - RNA, 13 nt, Human
agauccaggacua

SEQ ID NO: 1362427 - RNA, 14 nt, Human
agauccagccuggg

SEQ ID NO: 1362428 - RNA, 13 nt, Human
agauccagccugg

SEQ ID NO: 1362429 - RNA, 21 nt, Human
agauccaaaagaagcccccag

SEQ ID NO: 1362430 - RNA, 23 nt, Human
agauccaaaagaagcccccagcu

SEQ ID NO: 1362431 - RNA, 18 nt, Human
agauccaaaagaagcccc

SEQ ID NO: 1362432 - RNA, 14 nt, Human
ugaccacagcacag

SEQ ID NO: 1362433 - RNA, 21 nt, Human
agaucauugugaaauuauuca

SEQ ID NO: 1362434 - RNA, 11 nt, Human
agaucacuuuc

SEQ ID NO: 1362435 - RNA, 21 nt, Human
agauauuuuuaucuuuauaug

SEQ ID NO: 1362436 - RNA, 20 nt, Human
agauauuuuuaucuuuauau

SEQ ID NO: 1362437 - RNA, 19 nt, Human
agauauuuuuaucuuuaua

SEQ ID NO: 1362438 - RNA, 17 nt, Human
agauauuuuuaucuuua

SEQ ID NO: 1362439 - RNA, 23 nt, Human
agauacccuacgcuguccagaaa

SEQ ID NO: 1362440 - RNA, 22 nt, Human
agauacccuacgcuguccagaa

SEQ ID NO: 1362441 - RNA, 23 nt, Human
agauaccagcgaggaggcuccag

SEQ ID NO: 1362442 - RNA, 21 nt, Human
agauaccagcgaggaggcucc

SEQ ID NO: 1362443 - RNA, 19 nt, Human
agauaccagcgaggaggcu

SEQ ID NO: 1362444 - RNA, 14 nt, Human
agauaccagcgagg

SEQ ID NO: 1362445 - RNA, 20 nt, Human
agauacagaacucuuucaaa

SEQ ID NO: 1362446 - RNA, 18 nt, Human
agauacagaacucuuuca

SEQ ID NO: 1362447 - RNA, 14 nt, Human
agauaauucacugu

SEQ ID NO: 1362448 - RNA, 12 nt, Human
agaguuuuggga

SEQ ID NO: 1362449 - RNA, 13 nt, Human
agagugagagaca

SEQ ID NO: 1362450 - RNA, 22 nt, Human
agagugagagacauuaacucau

SEQ ID NO: 1362451 - RNA, 18 nt, Human
agagugagacucagucuu

SEQ ID NO: 1362452 - RNA, 17 nt, Human
agagugaauucccucac

SEQ ID NO: 1362453 - RNA, 15 nt, Human
agauaaacacaagau

SEQ ID NO: 1362454 - RNA, 14 nt, Human
agauaaacacaaga

SEQ ID NO: 1362455 - RNA, 18 nt, Human
agauaaugugaaaauggu

SEQ ID NO: 1362456 - RNA, 13 nt, Human
agauaaugugaaa

SEQ ID NO: 1362457 - RNA, 12 nt, Human
agauaaugugaa

SEQ ID NO: 1362458 - RNA, 23 nt, Human
agauaaucuagaacacaggcaaa

SEQ ID NO: 1362459 - RNA, 16 nt, Human
agauaaucuagaacac

SEQ ID NO: 1362460 - RNA, 13 nt, Human
agauaaucccugu

SEQ ID NO: 1362461 - RNA, 12 nt, Human
agauaauuauaa

SEQ ID NO: 1362462 - RNA, 19 nt, Human
agauaauuaccuacucugg

SEQ ID NO: 1362463 - RNA, 18 nt, Human
agauaagguaaaaugcca

SEQ ID NO: 1362464 - RNA, 18 nt, Human
agauaauacaccacuaca

SEQ ID NO: 1362465 - RNA, 13 nt, Human
agagucuagauuc

SEQ ID NO: 1362466 - RNA, 12 nt, Human
agagucuagauu

SEQ ID NO: 1362467 - RNA, 11 nt, Human
agagucuagau

SEQ ID NO: 1362468 - RNA, 23 nt, Human
agagucuaaagauggaguuucua

SEQ ID NO: 1362469 - RNA, 22 nt, Human
agagucuaaagauggaguuucu

SEQ ID NO: 1362470 - RNA, 17 nt, Human
agagucuaaagauggag

SEQ ID NO: 1362471 - RNA, 14 nt, Human
agagucuaaagaug

SEQ ID NO: 1362472 - RNA, 13 nt, Human
agagucuaaagau

SEQ ID NO: 1362473 - RNA, 12 nt, Human
agagucuaaaga

SEQ ID NO: 1362474 - RNA, 21 nt, Human
ugaauggcuauguuuuuaaug

SEQ ID NO: 1362475 - RNA, 20 nt, Human
ugaauggcuauguuuuuaau

SEQ ID NO: 1362476 - RNA, 23 nt, Human
ugaauggccuucauaucauccac

SEQ ID NO: 1362477 - RNA, 15 nt, Human
agagucuagauucuc

SEQ ID NO: 1362478 - RNA, 23 nt, Human
agagucuagauucaaagguucua

SEQ ID NO: 1362479 - RNA, 22 nt, Human
agagucuagauucaaagguucu

SEQ ID NO: 1362480 - RNA, 21 nt, Human
agagucuagauucaaagguuc

SEQ ID NO: 1362481 - RNA, 19 nt, Human
agagucuagauucaaaggu

SEQ ID NO: 1362482 - RNA, 17 nt, Human
agagucuagauucaaag

SEQ ID NO: 1362483 - RNA, 15 nt, Human
agagucuagauucaa

SEQ ID NO: 1362484 - RNA, 16 nt, Human
agagugaauucccuca

SEQ ID NO: 1362485 - RNA, 14 nt, Human
agagucuagauucu

SEQ ID NO: 1362486 - RNA, 18 nt, Human
agagucuauuuacggaac

SEQ ID NO: 1362487 - RNA, 17 nt, Human
ugaaugcuucuaaguaa

SEQ ID NO: 1362488 - RNA, 23 nt, Human
ugaaugcuucuaaguaaauacaa

SEQ ID NO: 1362489 - RNA, 22 nt, Human
ugaaugccacugccuucgcuuc

SEQ ID NO: 1362490 - RNA, 21 nt, Human
ugaaugccacugccuucgcuu

SEQ ID NO: 1362491 - RNA, 15 nt, Human
ugaaugccacugccu

SEQ ID NO: 1362492 - RNA, 22 nt, Human
ugaaugcauuuuguuugguauu

SEQ ID NO: 1362493 - RNA, 15 nt, Human
ugaaugcauuuuguu

SEQ ID NO: 1362494 - RNA, 21 nt, Human
ugaaugcauuuuguuugguau

SEQ ID NO: 1362495 - RNA, 12 nt, Human
ugaaugcauuuu

SEQ ID NO: 1362496 - RNA, 13 nt, Human
ugaaugcauuuug

SEQ ID NO: 1362497 - RNA, 14 nt, Human
ugaaugcauuuugu

SEQ ID NO: 1362498 - RNA, 21 nt, Human
ugaauauacagcaggugcuca

SEQ ID NO: 1362499 - RNA, 18 nt, Human
ugaagguuguggccuuug

SEQ ID NO: 1362500 - RNA, 15 nt, Human
ugaagguuguggccu

SEQ ID NO: 1362501 - RNA, 15 nt, Human
ugaaggugcugacgg

SEQ ID NO: 1362502 - RNA, 16 nt, Human
ugaagcuuuuauguga

SEQ ID NO: 1362503 - RNA, 22 nt, Human
ugaaggugauuuaagggcccag

SEQ ID NO: 1362504 - RNA, 20 nt, Human
ugaaggugcugacggccagg

SEQ ID NO: 1362505 - RNA, 19 nt, Human
ugaaggugcugacggccag

SEQ ID NO: 1362506 - RNA, 18 nt, Human
ugaagguggaaauaaacu

SEQ ID NO: 1362507 - RNA, 16 nt, Human
agagcuucccugacuc

SEQ ID NO: 1362508 - RNA, 13 nt, Human
agagcuucccuga

SEQ ID NO: 1362509 - RNA, 20 nt, Human
agagcuucccugacucauuc

SEQ ID NO: 1362510 - RNA, 17 nt, Human
agagcuucccugacuca

SEQ ID NO: 1362511 - RNA, 11 nt, Human
agagcuggugc

SEQ ID NO: 1362512 - RNA, 16 nt, Human
agagcuggcucugagc

SEQ ID NO: 1362513 - RNA, 15 nt, Human
agagcuggcucugag

SEQ ID NO: 1362514 - RNA, 13 nt, Human
agagcuggcucug

SEQ ID NO: 1362515 - RNA, 21 nt, Human
ugaagacaaugacuuacugua

SEQ ID NO: 1362516 - RNA, 12 nt, Human
ucuuuguaauga

SEQ ID NO: 1362517 - RNA, 16 nt, Human
ucuuuguaaugaaaac

SEQ ID NO: 1362518 - RNA, 11 nt, Human
ugaacuuugac

SEQ ID NO: 1362519 - RNA, 13 nt, Human
ucuuuguaaugaa

SEQ ID NO: 1362520 - RNA, 15 nt, Human
ucuuuguaaugaaaa

SEQ ID NO: 1362521 - RNA, 20 nt, Human
ugaagaagcaccaaucauga

SEQ ID NO: 1362522 - RNA, 14 nt, Human
ugaagaagauggua

SEQ ID NO: 1362523 - RNA, 16 nt, Human
ugaacuuugaccucug

SEQ ID NO: 1362524 - RNA, 17 nt, Human
ugaacuuugaccucugc

SEQ ID NO: 1362525 - RNA, 23 nt, Human
ugaagaacugcaggcccuggccu

SEQ ID NO: 1362526 - RNA, 22 nt, Human
ugaagaagcaccaaucaugaau

SEQ ID NO: 1362527 - RNA, 11 nt, Human
ugaagacaaug

SEQ ID NO: 1362528 - RNA, 13 nt, Human
ugaagacaaugac

SEQ ID NO: 1362529 - RNA, 17 nt, Human
ugaagacaaugacuuac

SEQ ID NO: 1362530 - RNA, 19 nt, Human
ugaagcuguugugugaggu

SEQ ID NO: 1362531 - RNA, 16 nt, Human
ugaagcuguuguguga

SEQ ID NO: 1362532 - RNA, 15 nt, Human
ugaagcuguugugug

SEQ ID NO: 1362533 - RNA, 15 nt, Human
ugaagcccucccagg

SEQ ID NO: 1362534 - RNA, 18 nt, Human
ugaagccugaacccaaga

SEQ ID NO: 1362535 - RNA, 21 nt, Human
ugaagccaugaguuccagaaa

SEQ ID NO: 1362536 - RNA, 20 nt, Human
ugaagcagguucccaagcuc

SEQ ID NO: 1362537 - RNA, 19 nt, Human
ugaagcagguucccaagcu

SEQ ID NO: 1362538 - RNA, 21 nt, Human
agaggugggccagucugugga

SEQ ID NO: 1362539 - RNA, 13 nt, Human
agaggugggccag

SEQ ID NO: 1362540 - RNA, 15 nt, Human
agagguggaaaaaca

SEQ ID NO: 1362541 - RNA, 20 nt, Human
ugaagcagccucuccccagg

SEQ ID NO: 1362542 - RNA, 15 nt, Human
ugaagcagccucucc

SEQ ID NO: 1362543 - RNA, 13 nt, Human
ugaagcagccucu

SEQ ID NO: 1362544 - RNA, 16 nt, Human
ugaagauucuuuccca

SEQ ID NO: 1362545 - RNA, 18 nt, Human
agagggaaugugaaauuu

SEQ ID NO: 1362546 - RNA, 12 nt, Human
agagggacagau

SEQ ID NO: 1362547 - RNA, 16 nt, Human
agagggaaugugaaau

SEQ ID NO: 1362548 - RNA, 15 nt, Human
agagggaaugugaaa

SEQ ID NO: 1362549 - RNA, 14 nt, Human
agagggaaugugaa

SEQ ID NO: 1362550 - RNA, 13 nt, Human
agagggaauguga

SEQ ID NO: 1362551 - RNA, 12 nt, Human
agagggaaugug

SEQ ID NO: 1362552 - RNA, 16 nt, Human
agaggugagaaauuua

SEQ ID NO: 1362553 - RNA, 17 nt, Human
agaggugagaaauuuaa

SEQ ID NO: 1362554 - RNA, 24 nt, Human
agaggugaccccagggcacaggag

SEQ ID NO: 1362555 - RNA, 23 nt, Human
agaggugaccccagggcacagga

SEQ ID NO: 1362556 - RNA, 18 nt, Human
agaggugaccccagggca

SEQ ID NO: 1362557 - RNA, 17 nt, Human
agaggugaccccagggc

SEQ ID NO: 1362558 - RNA, 16 nt, Human
agaggugaccccaggg

SEQ ID NO: 1362559 - RNA, 15 nt, Human
agaggugaccccagg

SEQ ID NO: 1362560 - RNA, 15 nt, Human
agagggacgccuggg

SEQ ID NO: 1362561 - RNA, 21 nt, Human
agagggacgccugggggugcc

SEQ ID NO: 1362562 - RNA, 19 nt, Human
agaggccuuuuggaaugug

SEQ ID NO: 1362563 - RNA, 17 nt, Human
agaggcaccaggaagcc

SEQ ID NO: 1362564 - RNA, 18 nt, Human
agaggcaccugucccaga

SEQ ID NO: 1362565 - RNA, 14 nt, Human
agaggcaccaggaa

SEQ ID NO: 1362566 - RNA, 13 nt, Human
agaggcaccagga

SEQ ID NO: 1362567 - RNA, 11 nt, Human
agaggcaccag

SEQ ID NO: 1362568 - RNA, 21 nt, Human
agaggcgcaugaauuugugaa

SEQ ID NO: 1362569 - RNA, 23 nt, Human
agacugugugugcccucugggcu

SEQ ID NO: 1362570 - RNA, 11 nt, Human
agacuguuggg

SEQ ID NO: 1362571 - RNA, 23 nt, Human
agacuguugggguggguauaaaa

SEQ ID NO: 1362572 - RNA, 22 nt, Human
agacugugugugcccucugggc

SEQ ID NO: 1362573 - RNA, 20 nt, Human
agacugugugugcccucugg

SEQ ID NO: 1362574 - RNA, 19 nt, Human
agacugugugugcccucug

SEQ ID NO: 1362575 - RNA, 18 nt, Human
agacugugugugcccucu

SEQ ID NO: 1362576 - RNA, 17 nt, Human
agacugugugugcccuc

SEQ ID NO: 1362577 - RNA, 16 nt, Human
agacugugugugcccu

SEQ ID NO: 1362578 - RNA, 17 nt, Human
agacugugauucagaaa

SEQ ID NO: 1362579 - RNA, 16 nt, Human
agacugugauucagaa

SEQ ID NO: 1362580 - RNA, 18 nt, Human
agacugucuggccccccu

SEQ ID NO: 1362581 - RNA, 17 nt, Human
agacucuaagaaagaac

SEQ ID NO: 1362582 - RNA, 16 nt, Human
agacucuaagaaagaa

SEQ ID NO: 1362583 - RNA, 21 nt, Human
agacuggauaguccgucucug

SEQ ID NO: 1362584 - RNA, 15 nt, Human
agacuuggauucuuu

SEQ ID NO: 1362585 - RNA, 21 nt, Human
agacuuggauucuuuccauuu

SEQ ID NO: 1362586 - RNA, 15 nt, Human
agacuugacagugga

SEQ ID NO: 1362587 - RNA, 14 nt, Human
agacuugacagugg

SEQ ID NO: 1362588 - RNA, 13 nt, Human
agacuugacagug

SEQ ID NO: 1362589 - RNA, 12 nt, Human
agacuugacagu

SEQ ID NO: 1362590 - RNA, 22 nt, Human
agacuucaagcauggcuauuuu

SEQ ID NO: 1362591 - RNA, 19 nt, Human
agacuucaagcauggcuau

SEQ ID NO: 1362592 - RNA, 22 nt, Human
agacuuugcuaaagacaugaag

SEQ ID NO: 1362593 - RNA, 15 nt, Human
agagaaugagagaca

SEQ ID NO: 1362594 - RNA, 21 nt, Human
agagaaugcccuucuccuuau

SEQ ID NO: 1362595 - RNA, 17 nt, Human
agagacacacugaagaa

SEQ ID NO: 1362596 - RNA, 16 nt, Human
ucuuuggggugccccu

SEQ ID NO: 1362597 - RNA, 20 nt, Human
ucuuugggccagacaugcca

SEQ ID NO: 1362598 - RNA, 16 nt, Human
ucuuugggccagacau

SEQ ID NO: 1362599 - RNA, 15 nt, Human
ucuuugggccagaca

SEQ ID NO: 1362600 - RNA, 20 nt, Human
agagaccagggcuccagccc

SEQ ID NO: 1362601 - RNA, 19 nt, Human
agagaccagggcuccagcc

SEQ ID NO: 1362602 - RNA, 14 nt, Human
agagaccagggcuc

SEQ ID NO: 1362603 - RNA, 13 nt, Human
agagaccagggcu

SEQ ID NO: 1362604 - RNA, 20 nt, Human
agagacacacugaagaagca

SEQ ID NO: 1362605 - RNA, 18 nt, Human
agagacacacugaagaag

SEQ ID NO: 1362606 - RNA, 12 nt, Human
agacucuaagaa

SEQ ID NO: 1362607 - RNA, 21 nt, Human
ucuuuagauagcccuguccug

SEQ ID NO: 1362608 - RNA, 23 nt, Human
ucuuuagauagcccuguccuggu

SEQ ID NO: 1362609 - RNA, 20 nt, Human
ucuuuagauagcccuguccu

SEQ ID NO: 1362610 - RNA, 19 nt, Human
ucuuuagaguuagacuguu

SEQ ID NO: 1362611 - RNA, 14 nt, Human
ucuuuagaguuaga

SEQ ID NO: 1362612 - RNA, 16 nt, Human
ucuuuagaguuagacu

SEQ ID NO: 1362613 - RNA, 17 nt, Human
ucuuuagaguuagacug

SEQ ID NO: 1362614 - RNA, 18 nt, Human
ucuuuagaguuagacugu

SEQ ID NO: 1362615 - RNA, 11 nt, Human
ucuuuagaaca

SEQ ID NO: 1362616 - RNA, 12 nt, Human
ucuuuagaguua

SEQ ID NO: 1362617 - RNA, 12 nt, Human
ucuuuacuuuua

SEQ ID NO: 1362618 - RNA, 23 nt, Human
ucuuuacaaaacaaacucauuca

SEQ ID NO: 1362619 - RNA, 22 nt, Human
ucuuuacaaaacaaacucauuc

SEQ ID NO: 1362620 - RNA, 14 nt, Human
ucuuuacaaaacaa

SEQ ID NO: 1362621 - RNA, 15 nt, Human
ucuuggagcugugag

SEQ ID NO: 1362622 - RNA, 14 nt, Human
ucuuggagcuguga

SEQ ID NO: 1362623 - RNA, 23 nt, Human
ucuuggagcugugaguucucccu

SEQ ID NO: 1362624 - RNA, 19 nt, Human
ucuuggagaagucucagcu

SEQ ID NO: 1362625 - RNA, 20 nt, Human
ucuuggagaagucucagcua

SEQ ID NO: 1362626 - RNA, 23 nt, Human
ucuuuaaagugacuaauggcaug

SEQ ID NO: 1362627 - RNA, 20 nt, Human
ucuuuaaaauguaaagccau

SEQ ID NO: 1362628 - RNA, 15 nt, Human
ucuuuaaaauuacaa

SEQ ID NO: 1362629 - RNA, 20 nt, Human
ucuuuaaaauuacaacuaag

SEQ ID NO: 1362630 - RNA, 17 nt, Human
agaccuacuguucuaaa

SEQ ID NO: 1362631 - RNA, 16 nt, Human
agaccuacuguucuaa

SEQ ID NO: 1362632 - RNA, 15 nt, Human
agaccuacuguucua

SEQ ID NO: 1362633 - RNA, 22 nt, Human
agaccuacagggggucuggcug

SEQ ID NO: 1362634 - RNA, 23 nt, Human
agaccuacagggggucuggcugg

SEQ ID NO: 1362635 - RNA, 21 nt, Human
agaccuacagggggucuggcu

SEQ ID NO: 1362636 - RNA, 19 nt, Human
agaccuacagggggucugg

SEQ ID NO: 1362637 - RNA, 14 nt, Human
agaccuacaggggg

SEQ ID NO: 1362638 - RNA, 11 nt, Human
agaccuacagg

SEQ ID NO: 1362639 - RNA, 21 nt, Human
agaccuaaucucuguaaagcu

SEQ ID NO: 1362640 - RNA, 19 nt, Human
agaccuaaucucuguaaag

SEQ ID NO: 1362641 - RNA, 19 nt, Human
agaccuaacgagaaauaga

SEQ ID NO: 1362642 - RNA, 22 nt, Human
agacccuuucuucagcucugaa

SEQ ID NO: 1362643 - RNA, 18 nt, Human
agacccuugacaccugcu

SEQ ID NO: 1362644 - RNA, 14 nt, Human
agacccuggaggcc

SEQ ID NO: 1362645 - RNA, 12 nt, Human
agacccuggagg

SEQ ID NO: 1362646 - RNA, 17 nt, Human
agacaugugacauuuau

SEQ ID NO: 1362647 - RNA, 16 nt, Human
agacaugugacauuua

SEQ ID NO: 1362648 - RNA, 15 nt, Human
agacaugugacauuu

SEQ ID NO: 1362649 - RNA, 14 nt, Human
agacaugugacauu

SEQ ID NO: 1362650 - RNA, 13 nt, Human
agacaugugacau

SEQ ID NO: 1362651 - RNA, 12 nt, Human
agacaugugaca

SEQ ID NO: 1362652 - RNA, 20 nt, Human
agacaugucuguucuacaua

SEQ ID NO: 1362653 - RNA, 18 nt, Human
agacaugucuguucuaca

SEQ ID NO: 1362654 - RNA, 14 nt, Human
ucuuccucagccag

SEQ ID NO: 1362655 - RNA, 15 nt, Human
ucuuccucagccagc

SEQ ID NO: 1362656 - RNA, 13 nt, Human
ucuuccucagcca

SEQ ID NO: 1362657 - RNA, 12 nt, Human
ucuuccucagcc

SEQ ID NO: 1362658 - RNA, 23 nt, Human
ucuuccuaguuuucuccucccag

SEQ ID NO: 1362659 - RNA, 21 nt, Human
ucuuccuaguuuucuccuccc

SEQ ID NO: 1362660 - RNA, 19 nt, Human
ucuuccuaguuuucuccuc

SEQ ID NO: 1362661 - RNA, 20 nt, Human
ucuuccuacuggucucucua

SEQ ID NO: 1362662 - RNA, 17 nt, Human
ucuuccuacuggucucu

SEQ ID NO: 1362663 - RNA, 17 nt, Human
ucuuccuaccuauccca

SEQ ID NO: 1362664 - RNA, 20 nt, Human
ucuuccuaccaagucaaacu

SEQ ID NO: 1362665 - RNA, 21 nt, Human
ucuuccuaccaagucaaacuu

SEQ ID NO: 1362666 - RNA, 23 nt, Human
ucuuccggccccuccccuccaaa

SEQ ID NO: 1362667 - RNA, 20 nt, Human
ucuuccggccccuccccucc

SEQ ID NO: 1362668 - RNA, 12 nt, Human
agacccugcccu

SEQ ID NO: 1362669 - RNA, 16 nt, Human
agaccugauccuggag

SEQ ID NO: 1362670 - RNA, 15 nt, Human
agaccugauccugga

SEQ ID NO: 1362671 - RNA, 14 nt, Human
agaccugauccugg

SEQ ID NO: 1362672 - RNA, 16 nt, Human
agaccugagaauguau

SEQ ID NO: 1362673 - RNA, 19 nt, Human
agaccuacuguucuaaagc

SEQ ID NO: 1362674 - RNA, 18 nt, Human
agaccuacuguucuaaag

SEQ ID NO: 1362675 - RNA, 22 nt, Human
agaccugauccuggaggcccag

SEQ ID NO: 1362676 - RNA, 21 nt, Human
agaccugauccuggaggccca

SEQ ID NO: 1362677 - RNA, 19 nt, Human
agaccugauccuggaggcc

SEQ ID NO: 1362678 - RNA, 18 nt, Human
agaccugauccuggaggc

SEQ ID NO: 1362679 - RNA, 17 nt, Human
agacuaucuuacuauuu

SEQ ID NO: 1362680 - RNA, 15 nt, Human
ucuuggacaaaucac

SEQ ID NO: 1362681 - RNA, 16 nt, Human
ucuuggaacuugccug

SEQ ID NO: 1362682 - RNA, 20 nt, Human
ucuuggaacuugccugccuu

SEQ ID NO: 1362683 - RNA, 15 nt, Human
ucuuggaacuugccu

SEQ ID NO: 1362684 - RNA, 21 nt, Human
ucuuggaacauuggaauguuc

SEQ ID NO: 1362685 - RNA, 17 nt, Human
ucuuggagaagucucag

SEQ ID NO: 1362686 - RNA, 16 nt, Human
ucuuggagaagucuca

SEQ ID NO: 1362687 - RNA, 12 nt, Human
ucuuggagaagu

SEQ ID NO: 1362688 - RNA, 14 nt, Human
ucuugcuuucuuug

SEQ ID NO: 1362689 - RNA, 18 nt, Human
ucuugaucaguuaagaaa

SEQ ID NO: 1362690 - RNA, 23 nt, Human
ucuugaucaguuaagaaauuuca

SEQ ID NO: 1362691 - RNA, 23 nt, Human
agaccugauccuggaggcccagu

SEQ ID NO: 1362692 - RNA, 12 nt, Human
ucuugaugacca

SEQ ID NO: 1362693 - RNA, 14 nt, Human
ucuugaugccuggc

SEQ ID NO: 1362694 - RNA, 21 nt, Human
ucuugaugcaugcacuguucc

SEQ ID NO: 1362695 - RNA, 13 nt, Human
ucuugaugcaugc

SEQ ID NO: 1362696 - RNA, 20 nt, Human
ucuugaugccuggcggggug

SEQ ID NO: 1362697 - RNA, 16 nt, Human
ucuucaccaaaucuug

SEQ ID NO: 1362698 - RNA, 17 nt, Human
ucuucaccauuuggcaa

SEQ ID NO: 1362699 - RNA, 14 nt, Human
ucuucaaaugccug

SEQ ID NO: 1362700 - RNA, 16 nt, Human
ucuuauuuuuuucuau

SEQ ID NO: 1362701 - RNA, 20 nt, Human
ucuuccaguuugcuuugccc

SEQ ID NO: 1362702 - RNA, 21 nt, Human
ucuuccagucuuccugacacu

SEQ ID NO: 1362703 - RNA, 18 nt, Human
ucuuccagucuuccugac

SEQ ID NO: 1362704 - RNA, 22 nt, Human
ucuuccaguuugcuuugcccuu

SEQ ID NO: 1362705 - RNA, 16 nt, Human
ucuucccucucugcag

SEQ ID NO: 1362706 - RNA, 21 nt, Human
ucuucccuggaaaccuuccac

SEQ ID NO: 1362707 - RNA, 20 nt, Human
ucuuaauuauuauuuguguu

SEQ ID NO: 1362708 - RNA, 11 nt, Human
ucuuagaaauu

SEQ ID NO: 1362709 - RNA, 12 nt, Human
ucuuaauuauua

SEQ ID NO: 1362710 - RNA, 15 nt, Human
ucuuagaaauuuauu

SEQ ID NO: 1362711 - RNA, 12 nt, Human
ucuuagaaauuu

SEQ ID NO: 1362712 - RNA, 22 nt, Human
ucuuagaugcaguucugaagaa

SEQ ID NO: 1362713 - RNA, 19 nt, Human
agacagggucaaaguguuu

SEQ ID NO: 1362714 - RNA, 21 nt, Human
agacagggaauuaggccccca

SEQ ID NO: 1362715 - RNA, 22 nt, Human
agacaggcuggaagauagcugu

SEQ ID NO: 1362716 - RNA, 15 nt, Human
agacaggcuggaaga

SEQ ID NO: 1362717 - RNA, 20 nt, Human
agacaggcucuuagcagcuu

SEQ ID NO: 1362718 - RNA, 15 nt, Human
agacaggcucuuagc

SEQ ID NO: 1362719 - RNA, 22 nt, Human
agacaggucccuccccuucucu

SEQ ID NO: 1362720 - RNA, 22 nt, Human
agacagggaauuaggcccccau

SEQ ID NO: 1362721 - RNA, 23 nt, Human
agacaggguuucaccauguugcc

SEQ ID NO: 1362722 - RNA, 18 nt, Human
agacaguauauaacuaac

SEQ ID NO: 1362723 - RNA, 19 nt, Human
ucuuaauauguucuuuuaa

SEQ ID NO: 1362724 - RNA, 20 nt, Human
agacacuccccgaagucuuu

SEQ ID NO: 1362725 - RNA, 17 nt, Human
agacaccguucauucag

SEQ ID NO: 1362726 - RNA, 16 nt, Human
agacacccaggacuua

SEQ ID NO: 1362727 - RNA, 15 nt, Human
agacacccaggacuu

SEQ ID NO: 1362728 - RNA, 14 nt, Human
agacacccaggacu

SEQ ID NO: 1362729 - RNA, 13 nt, Human
agacacccaggac

SEQ ID NO: 1362730 - RNA, 12 nt, Human
agacacccagga

SEQ ID NO: 1362731 - RNA, 18 nt, Human
agacaccaaaguucuaau

SEQ ID NO: 1362732 - RNA, 17 nt, Human
agacaccaaaguucuaa

SEQ ID NO: 1362733 - RNA, 16 nt, Human
agacaccaaaguucua

SEQ ID NO: 1362734 - RNA, 15 nt, Human
agacaccaaaguucu

SEQ ID NO: 1362735 - RNA, 14 nt, Human
agacaccaaaguuc

SEQ ID NO: 1362736 - RNA, 13 nt, Human
agacaccaaaguu

SEQ ID NO: 1362737 - RNA, 18 nt, Human
agaauuugagugcucuga

SEQ ID NO: 1362738 - RNA, 21 nt, Human
agaauuugauaugugaacagu

SEQ ID NO: 1362739 - RNA, 20 nt, Human
agaauuugauaugugaacag

SEQ ID NO: 1362740 - RNA, 19 nt, Human
agaauuugauaugugaaca

SEQ ID NO: 1362741 - RNA, 18 nt, Human
agaauuugauaugugaac

SEQ ID NO: 1362742 - RNA, 17 nt, Human
agaauuugagugcucug

SEQ ID NO: 1362743 - RNA, 17 nt, Human
agaauuugauaugugaa

SEQ ID NO: 1362744 - RNA, 23 nt, Human
agacagcuucucauccugcaggc

SEQ ID NO: 1362745 - RNA, 22 nt, Human
agacagcuucucauccugcagg

SEQ ID NO: 1362746 - RNA, 14 nt, Human
agacagacuagaag

SEQ ID NO: 1362747 - RNA, 18 nt, Human
agacacugaaaaaucuaa

SEQ ID NO: 1362748 - RNA, 23 nt, Human
agacacuccccgaagucuuuugu

SEQ ID NO: 1362749 - RNA, 22 nt, Human
agacacuccccgaagucuuuug

SEQ ID NO: 1362750 - RNA, 20 nt, Human
agacagaaucucagucuguc

SEQ ID NO: 1362751 - RNA, 19 nt, Human
ucugggugcuacuggggaa

SEQ ID NO: 1362752 - RNA, 18 nt, Human
ucugggugcuacugggga

SEQ ID NO: 1362753 - RNA, 17 nt, Human
ucuggucgcuccugccc

SEQ ID NO: 1362754 - RNA, 15 nt, Human
ucuggucgcuccugc

SEQ ID NO: 1362755 - RNA, 13 nt, Human
ucugguccuuuuu

SEQ ID NO: 1362756 - RNA, 14 nt, Human
ucuggguggcucac

SEQ ID NO: 1362757 - RNA, 22 nt, Human
ucuggguggcucacucagcacu

SEQ ID NO: 1362758 - RNA, 13 nt, Human
ucuggguggcccu

SEQ ID NO: 1362759 - RNA, 21 nt, Human
agaaggaaaauuuuagcgugc

SEQ ID NO: 1362760 - RNA, 11 nt, Human
agaaggaaggc

SEQ ID NO: 1362761 - RNA, 17 nt, Human
agaaggaaggcagggag

SEQ ID NO: 1362762 - RNA, 19 nt, Human
agaaggaaggcagggagga

SEQ ID NO: 1362763 - RNA, 21 nt, Human
ucuggggcaggcugggccaug

SEQ ID NO: 1362764 - RNA, 20 nt, Human
ucuggggcaggcugggccau

SEQ ID NO: 1362765 - RNA, 19 nt, Human
ucuggggcaggcugggcca

SEQ ID NO: 1362766 - RNA, 18 nt, Human
ucuggggcaggcugggcc

SEQ ID NO: 1362767 - RNA, 17 nt, Human
ucuggggcaggcugggc

SEQ ID NO: 1362768 - RNA, 23 nt, Human
ucuggggagcgggucugcuccca

SEQ ID NO: 1362769 - RNA, 19 nt, Human
ucuggggagcgggucugcu

SEQ ID NO: 1362770 - RNA, 22 nt, Human
ucuggggagcaggcagccagca

SEQ ID NO: 1362771 - RNA, 21 nt, Human
ucuggggagcaggcagccagc

SEQ ID NO: 1362772 - RNA, 19 nt, Human
ucuggggagcaggcagcca

SEQ ID NO: 1362773 - RNA, 17 nt, Human
ucuggggagcaggcagc

SEQ ID NO: 1362774 - RNA, 20 nt, Human
agaaggaaggcagggaggag

SEQ ID NO: 1362775 - RNA, 21 nt, Human
agaaggaaggcagggaggagg

SEQ ID NO: 1362776 - RNA, 12 nt, Human
ucugucaguucu

SEQ ID NO: 1362777 - RNA, 19 nt, Human
ucugucagucacagccacc

SEQ ID NO: 1362778 - RNA, 17 nt, Human
ucugucagucacagcca

SEQ ID NO: 1362779 - RNA, 13 nt, Human
ucugucagucaca

SEQ ID NO: 1362780 - RNA, 14 nt, Human
ucugucagcugcaa

SEQ ID NO: 1362781 - RNA, 13 nt, Human
ucugucagcugca

SEQ ID NO: 1362782 - RNA, 20 nt, Human
ucuguaggguaauuaguaac

SEQ ID NO: 1362783 - RNA, 22 nt, Human
ucuguagggauuuuuggcuaca

SEQ ID NO: 1362784 - RNA, 14 nt, Human
ucuggucucgaacu

SEQ ID NO: 1362785 - RNA, 23 nt, Human
ucuguagguugcacacuuuggua

SEQ ID NO: 1362786 - RNA, 21 nt, Human
ucuguagguugcacacuuugg

SEQ ID NO: 1362787 - RNA, 20 nt, Human
ucuguagguugcacacuuug

SEQ ID NO: 1362788 - RNA, 19 nt, Human
ucuguagguugcacacuuu

SEQ ID NO: 1362789 - RNA, 18 nt, Human
ucuguagguugcacacuu

SEQ ID NO: 1362790 - RNA, 17 nt, Human
ucuguagguugcacacu

SEQ ID NO: 1362791 - RNA, 16 nt, Human
ucuguagguugcacac

SEQ ID NO: 1362792 - RNA, 15 nt, Human
ucuguagguugcaca

SEQ ID NO: 1362793 - RNA, 20 nt, Human
ucuguauaaaugucuuuaau

SEQ ID NO: 1362794 - RNA, 15 nt, Human
ucuguauaaaugucu

SEQ ID NO: 1362795 - RNA, 18 nt, Human
ucugugccccuuccgcca

SEQ ID NO: 1362796 - RNA, 17 nt, Human
ucugugccuuguuuuuu

SEQ ID NO: 1362797 - RNA, 16 nt, Human
ucugugccuucgucuu

SEQ ID NO: 1362798 - RNA, 17 nt, Human
ucugugccugaauauuu

SEQ ID NO: 1362799 - RNA, 15 nt, Human
ucugugccugaauau

SEQ ID NO: 1362800 - RNA, 20 nt, Human
ucugugccccuuccgccacu

SEQ ID NO: 1362801 - RNA, 20 nt, Human
ucuguucuacauagaugcuu

SEQ ID NO: 1362802 - RNA, 17 nt, Human
ucuguuccaaauucagu

SEQ ID NO: 1362803 - RNA, 14 nt, Human
ucuguuccaaauuc

SEQ ID NO: 1362804 - RNA, 13 nt, Human
ucuguuccaaauu

SEQ ID NO: 1362805 - RNA, 13 nt, Human
ucuguuccaaaug

SEQ ID NO: 1362806 - RNA, 12 nt, Human
ucuguuccaaau

SEQ ID NO: 1362807 - RNA, 18 nt, Human
ucuguucauuuccucaaa

SEQ ID NO: 1362808 - RNA, 23 nt, Human
ucuguuccaaauucaguuucaua

SEQ ID NO: 1362809 - RNA, 20 nt, Human
ucuguuccccauggccacuu

SEQ ID NO: 1362810 - RNA, 22 nt, Human
ucuguuccaaauucaguuucau

SEQ ID NO: 1362811 - RNA, 19 nt, Human
ucuguuccaaauucaguuu

SEQ ID NO: 1362812 - RNA, 13 nt, Human
ucugugcuggcca

SEQ ID NO: 1362813 - RNA, 12 nt, Human
ucugugcugugu

SEQ ID NO: 1362814 - RNA, 16 nt, Human
ucuguucauuccucca

SEQ ID NO: 1362815 - RNA, 17 nt, Human
ucuguucauuccuccag

SEQ ID NO: 1362816 - RNA, 14 nt, Human
agaauuuaguguau

SEQ ID NO: 1362817 - RNA, 21 nt, Human
agaauuguuggggguuuuuuu

SEQ ID NO: 1362818 - RNA, 20 nt, Human
agaauuucuaccauuucaga

SEQ ID NO: 1362819 - RNA, 16 nt, Human
agaauuucuaccauuu

SEQ ID NO: 1362820 - RNA, 21 nt, Human
agaauuucuaccauuucagag

SEQ ID NO: 1362821 - RNA, 21 nt, Human
agaauuucuaggacugaauua

SEQ ID NO: 1362822 - RNA, 13 nt, Human
agaauuucuagga

SEQ ID NO: 1362823 - RNA, 23 nt, Human
agaauuguuggggguuuuuuugg

SEQ ID NO: 1362824 - RNA, 17 nt, Human
agaauuguugagauacu

SEQ ID NO: 1362825 - RNA, 16 nt, Human
agaauuguugagauac

SEQ ID NO: 1362826 - RNA, 20 nt, Human
agaauugugucagacuguuu

SEQ ID NO: 1362827 - RNA, 23 nt, Human
agaauugugucagacuguuuagu

SEQ ID NO: 1362828 - RNA, 19 nt, Human
agaauugugucagacuguu

SEQ ID NO: 1362829 - RNA, 23 nt, Human
agaauugugguuuauauauuuaa

SEQ ID NO: 1362830 - RNA, 22 nt, Human
agaauugugguuuauauauuua

SEQ ID NO: 1362831 - RNA, 12 nt, Human
agaauugugguu

SEQ ID NO: 1362832 - RNA, 14 nt, Human
ucuguuuuacaagu

SEQ ID NO: 1362833 - RNA, 18 nt, Human
ucuguuugcuguggaacu

SEQ ID NO: 1362834 - RNA, 13 nt, Human
ucuguuugcugug

SEQ ID NO: 1362835 - RNA, 20 nt, Human
ucuguucuaguuuuuuacuu

SEQ ID NO: 1362836 - RNA, 15 nt, Human
ucuguucuaguuuuu

SEQ ID NO: 1362837 - RNA, 13 nt, Human
ucuguucuaguuu

SEQ ID NO: 1362838 - RNA, 18 nt, Human
ucuguuuuauaauuuugu

SEQ ID NO: 1362839 - RNA, 20 nt, Human
ucuguuuuauaauuuuguga

SEQ ID NO: 1362840 - RNA, 13 nt, Human
ucucugcccaacc

SEQ ID NO: 1362841 - RNA, 12 nt, Human
ucucugcccaac

SEQ ID NO: 1362842 - RNA, 21 nt, Human
ucucugccagugacagacagg

SEQ ID NO: 1362843 - RNA, 15 nt, Human
ucucugccagugaca

SEQ ID NO: 1362844 - RNA, 14 nt, Human
ucucugccagugac

SEQ ID NO: 1362845 - RNA, 19 nt, Human
ucucuccuuguucugauaa

SEQ ID NO: 1362846 - RNA, 15 nt, Human
ucucuccuuguucug

SEQ ID NO: 1362847 - RNA, 20 nt, Human
ucucuccacuuucagcuguc

SEQ ID NO: 1362848 - RNA, 22 nt, Human
ucucuccacuuucagcugucuu

SEQ ID NO: 1362849 - RNA, 20 nt, Human
ucucuccuguaccucuugag

SEQ ID NO: 1362850 - RNA, 22 nt, Human
ucucuccuguaccucuugagcc

SEQ ID NO: 1362851 - RNA, 16 nt, Human
ucuccuuccugugugu

SEQ ID NO: 1362852 - RNA, 21 nt, Human
ucuccuucaugacagccucca

SEQ ID NO: 1362853 - RNA, 14 nt, Human
ucuccuuccugugu

SEQ ID NO: 1362854 - RNA, 13 nt, Human
ucuccuuccugug

SEQ ID NO: 1362855 - RNA, 22 nt, Human
ucucuucugagcuauuucaucu

SEQ ID NO: 1362856 - RNA, 21 nt, Human
ucucuucugagcuauuucauc

SEQ ID NO: 1362857 - RNA, 21 nt, Human
ucucugcucugcgugucaccu

SEQ ID NO: 1362858 - RNA, 18 nt, Human
ucucugcucugcguguca

SEQ ID NO: 1362859 - RNA, 22 nt, Human
ucucugcucugcgugucaccug

SEQ ID NO: 1362860 - RNA, 23 nt, Human
ucucugcucugcgugucaccugu

SEQ ID NO: 1362861 - RNA, 20 nt, Human
ucucugcccuugaucagccc

SEQ ID NO: 1362862 - RNA, 22 nt, Human
ucucugcccuugaucagcccca

SEQ ID NO: 1362863 - RNA, 12 nt, Human
ucucuuucuguc

SEQ ID NO: 1362864 - RNA, 19 nt, Human
ucucuuucccuggucccuu

SEQ ID NO: 1362865 - RNA, 17 nt, Human
ucucuuucccugguccc

SEQ ID NO: 1362866 - RNA, 16 nt, Human
ucucuuucccuggucc

SEQ ID NO: 1362867 - RNA, 14 nt, Human
ucucuuucccuggu

SEQ ID NO: 1362868 - RNA, 12 nt, Human
ucucuuuccaug

SEQ ID NO: 1362869 - RNA, 19 nt, Human
ucucuuuaugucuguggau

SEQ ID NO: 1362870 - RNA, 17 nt, Human
ucucuuuauacagcugu

SEQ ID NO: 1362871 - RNA, 16 nt, Human
ucucuuuauacagcug

SEQ ID NO: 1362872 - RNA, 16 nt, Human
agaaaaauauguacca

SEQ ID NO: 1362873 - RNA, 14 nt, Human
agaaaaauaaagaa

SEQ ID NO: 1362874 - RNA, 13 nt, Human
agaaaaauaaaga

SEQ ID NO: 1362875 - RNA, 20 nt, Human
agaaaaauaaagaaaagaug

SEQ ID NO: 1362876 - RNA, 17 nt, Human
agaaaaauauauacuaa

SEQ ID NO: 1362877 - RNA, 23 nt, Human
agaaaacauaaucuucugccuuc

SEQ ID NO: 1362878 - RNA, 20 nt, Human
agaaaacaggcacugcccug

SEQ ID NO: 1362879 - RNA, 19 nt, Human
agaaaacaaggaugaauua

SEQ ID NO: 1362880 - RNA, 16 nt, Human
agaaacugaggaauuu

SEQ ID NO: 1362881 - RNA, 13 nt, Human
agaaacugaggaa

SEQ ID NO: 1362882 - RNA, 16 nt, Human
agaaaccuacugccca

SEQ ID NO: 1362883 - RNA, 15 nt, Human
agaaaccuacugccc

SEQ ID NO: 1362884 - RNA, 23 nt, Human
agaaaccuacugcccaggcacug

SEQ ID NO: 1362885 - RNA, 22 nt, Human
agaaagaagacaaacuuugcau

SEQ ID NO: 1362886 - RNA, 15 nt, Human
agaaagaagaugaau

SEQ ID NO: 1362887 - RNA, 15 nt, Human
agaaacugcagggaa

SEQ ID NO: 1362888 - RNA, 18 nt, Human
agaaacugaggaauuuuc

SEQ ID NO: 1362889 - RNA, 20 nt, Human
agaaagaacggaagaagaga

SEQ ID NO: 1362890 - RNA, 16 nt, Human
agaaaaccuuucuuca

SEQ ID NO: 1362891 - RNA, 22 nt, Human
agaaaacccuugggccagaagu

SEQ ID NO: 1362892 - RNA, 20 nt, Human
agaaaacccuugggccagaa

SEQ ID NO: 1362893 - RNA, 19 nt, Human
agaaaacccuugggccaga

SEQ ID NO: 1362894 - RNA, 20 nt, Human
agaaaaccagcucagcacug

SEQ ID NO: 1362895 - RNA, 21 nt, Human
agaaaaccagcucagcacugc

SEQ ID NO: 1362896 - RNA, 16 nt, Human
agaaaaccagcucagc

SEQ ID NO: 1362897 - RNA, 15 nt, Human
agaaaacaugccucu

SEQ ID NO: 1362898 - RNA, 22 nt, Human
agaaaacaggcacugcccuggu

SEQ ID NO: 1362899 - RNA, 13 nt, Human
agaaaacauguuu

SEQ ID NO: 1362900 - RNA, 16 nt, Human
agaaaccagcuuccuu

SEQ ID NO: 1362901 - RNA, 15 nt, Human
agaaaccagcuuccu

SEQ ID NO: 1362902 - RNA, 14 nt, Human
agaaaccagcuucc

SEQ ID NO: 1362903 - RNA, 13 nt, Human
agaaaccagcuuc

SEQ ID NO: 1362904 - RNA, 19 nt, Human
agaaaacuuguauuaugug

SEQ ID NO: 1362905 - RNA, 22 nt, Human
agaaaccagcuuccuucagaga

SEQ ID NO: 1362906 - RNA, 20 nt, Human
agaaaccagcuuccuucaga

SEQ ID NO: 1362907 - RNA, 19 nt, Human
agaaaccagcuuccuucag

SEQ ID NO: 1362908 - RNA, 21 nt, Human
agaaaccagcuuccuucagag

SEQ ID NO: 1362909 - RNA, 13 nt, Human
agaaacccugcac

SEQ ID NO: 1362910 - RNA, 11 nt, Human
ucucccaguug

SEQ ID NO: 1362911 - RNA, 23 nt, Human
ucucccaggccccaugaccucca

SEQ ID NO: 1362912 - RNA, 21 nt, Human
ucucccaggccccaugaccuc

SEQ ID NO: 1362913 - RNA, 20 nt, Human
ucucccaggccccaugaccu

SEQ ID NO: 1362914 - RNA, 17 nt, Human
ucucccaggccccauga

SEQ ID NO: 1362915 - RNA, 14 nt, Human
ucucccaggcccca

SEQ ID NO: 1362916 - RNA, 13 nt, Human
ucucccaggcccc

SEQ ID NO: 1362917 - RNA, 12 nt, Human
ucucccaggccc

SEQ ID NO: 1362918 - RNA, 20 nt, Human
ucucccaggcaaggcugugg

SEQ ID NO: 1362919 - RNA, 13 nt, Human
ucucccaggcagg

SEQ ID NO: 1362920 - RNA, 19 nt, Human
ucucccaggcaaggcugug

SEQ ID NO: 1362921 - RNA, 22 nt, Human
ucucccaacucuugcacaguca

SEQ ID NO: 1362922 - RNA, 19 nt, Human
ucucccaacucuugcacag

SEQ ID NO: 1362923 - RNA, 18 nt, Human
ucucccaaaaaacuacuu

SEQ ID NO: 1362924 - RNA, 17 nt, Human
acuguaguucuaagacu

SEQ ID NO: 1362925 - RNA, 16 nt, Human
acuguaguucuaagac

SEQ ID NO: 1362926 - RNA, 15 nt, Human
acuguaguucuaaga

SEQ ID NO: 1362927 - RNA, 13 nt, Human
acuguaguucuaa

SEQ ID NO: 1362928 - RNA, 22 nt, Human
acuguaguaaauaaugcuuuga

SEQ ID NO: 1362929 - RNA, 21 nt, Human
acuguaguaaauaaugcuuug

SEQ ID NO: 1362930 - RNA, 20 nt, Human
acuguaguaaauaaugcuuu

SEQ ID NO: 1362931 - RNA, 19 nt, Human
acuguaguaaauaaugcuu

SEQ ID NO: 1362932 - RNA, 18 nt, Human
acuguaguaaauaaugcu

SEQ ID NO: 1362933 - RNA, 16 nt, Human
acuguaguaaauaaug

SEQ ID NO: 1362934 - RNA, 13 nt, Human
acuguagggaggg

SEQ ID NO: 1362935 - RNA, 15 nt, Human
acuguaggcacacuu

SEQ ID NO: 1362936 - RNA, 15 nt, Human
acuguagcuuuggaa

SEQ ID NO: 1362937 - RNA, 18 nt, Human
ucuccauucugcuccuuc

SEQ ID NO: 1362938 - RNA, 21 nt, Human
ucuccauucugcuccuucccc

SEQ ID NO: 1362939 - RNA, 19 nt, Human
ucuccauugugccuaaguc

SEQ ID NO: 1362940 - RNA, 19 nt, Human
ucuccguuagcuccugugg

SEQ ID NO: 1362941 - RNA, 18 nt, Human
ucuccguuagcuccugug

SEQ ID NO: 1362942 - RNA, 17 nt, Human
ucuccguuagcuccugu

SEQ ID NO: 1362943 - RNA, 16 nt, Human
ucuccguuagcuccug

SEQ ID NO: 1362944 - RNA, 20 nt, Human
ucuccguuagcuccuguggc

SEQ ID NO: 1362945 - RNA, 15 nt, Human
ucuccucucucugua

SEQ ID NO: 1362946 - RNA, 22 nt, Human
acuugugucucugugcuuuuaa

SEQ ID NO: 1362947 - RNA, 21 nt, Human
acuugugucucugugcuuuua

SEQ ID NO: 1362948 - RNA, 16 nt, Human
acuugugucucugugc

SEQ ID NO: 1362949 - RNA, 14 nt, Human
acuugugucucugu

SEQ ID NO: 1362950 - RNA, 22 nt, Human
acuugugucccuaauguguuua

SEQ ID NO: 1362951 - RNA, 23 nt, Human
acuugugucccaugaucccugug

SEQ ID NO: 1362952 - RNA, 20 nt, Human
acuuugacuuuuugcauuua

SEQ ID NO: 1362953 - RNA, 15 nt, Human
acuuugacuuuuugc

SEQ ID NO: 1362954 - RNA, 23 nt, Human
acuuugaccucugcagcaauaaa

SEQ ID NO: 1362955 - RNA, 23 nt, Human
acuuuaccuuuuuuauacauaaa

SEQ ID NO: 1362956 - RNA, 19 nt, Human
acuuugaccucugcagcaa

SEQ ID NO: 1362957 - RNA, 22 nt, Human
acuuguuggcguaggcuacaga

SEQ ID NO: 1362958 - RNA, 23 nt, Human
acuuguuggcguaggcuacagag

SEQ ID NO: 1362959 - RNA, 18 nt, Human
acuuuaccuuuuuuauac

SEQ ID NO: 1362960 - RNA, 19 nt, Human
acuuuaccuuuuuuauaca

SEQ ID NO: 1362961 - RNA, 22 nt, Human
acuuuaccuuuuuuauacauaa

SEQ ID NO: 1362962 - RNA, 21 nt, Human
acuuugacuuuuugcauuuaa

SEQ ID NO: 1362963 - RNA, 23 nt, Human
acuuuggcuuauaauucuuucaa

SEQ ID NO: 1362964 - RNA, 22 nt, Human
acuuuggcuuauaauucuuuca

SEQ ID NO: 1362965 - RNA, 21 nt, Human
acuuuggcuuauaauucuuuc

SEQ ID NO: 1362966 - RNA, 19 nt, Human
acuuuggcuuauaauucuu

SEQ ID NO: 1362967 - RNA, 14 nt, Human
acuuuggcugcaug

SEQ ID NO: 1362968 - RNA, 17 nt, Human
acuuuggcugcaugcga

SEQ ID NO: 1362969 - RNA, 12 nt, Human
acuuuuucugau

SEQ ID NO: 1362970 - RNA, 11 nt, Human
acuuuuucuga

SEQ ID NO: 1362971 - RNA, 15 nt, Human
acuuuuuauugauuu

SEQ ID NO: 1362972 - RNA, 22 nt, Human
acuuuugugaauuaggcuguaa

SEQ ID NO: 1362973 - RNA, 12 nt, Human
acuuuugugaaa

SEQ ID NO: 1362974 - RNA, 12 nt, Human
acuuuuguaaga

SEQ ID NO: 1362975 - RNA, 17 nt, Human
acuuuuguaagacaaag

SEQ ID NO: 1362976 - RNA, 17 nt, Human
acuuugguaccagauaa

SEQ ID NO: 1362977 - RNA, 16 nt, Human
acuuugguaccagaua

SEQ ID NO: 1362978 - RNA, 17 nt, Human
acuuuggggcuaauuua

SEQ ID NO: 1362979 - RNA, 14 nt, Human
acuuuuggcauuuu

SEQ ID NO: 1362980 - RNA, 23 nt, Human
acuuuuuuauuuaaaaaacuaaa

SEQ ID NO: 1362981 - RNA, 15 nt, Human
acuuuuuuauuuaaa

SEQ ID NO: 1362982 - RNA, 18 nt, Human
acuuuuuguucugguccu

SEQ ID NO: 1362983 - RNA, 19 nt, Human
acuuuuugaggcaaaagaa

SEQ ID NO: 1362984 - RNA, 23 nt, Human
acuuuuuguucugguccuuuuug

SEQ ID NO: 1362985 - RNA, 16 nt, Human
acuuuuugaggcaaaa

SEQ ID NO: 1362986 - RNA, 15 nt, Human
acuuuuugaggcaaa

SEQ ID NO: 1362987 - RNA, 12 nt, Human
acuuuuugcagc

SEQ ID NO: 1362988 - RNA, 15 nt, Human
acuuuuucuuuaugu

SEQ ID NO: 1362989 - RNA, 13 nt, Human
acuuuuugcagcu

SEQ ID NO: 1362990 - RNA, 15 nt, Human
acuuuuugcagcuuu

SEQ ID NO: 1362991 - RNA, 13 nt, Human
acuuuuugcauuu

SEQ ID NO: 1362992 - RNA, 17 nt, Human
acuuuuugcagcuuucu

SEQ ID NO: 1362993 - RNA, 21 nt, Human
acuuuuuuucuguaccaguua

SEQ ID NO: 1362994 - RNA, 20 nt, Human
acuuuuuuucuguaccaguu

SEQ ID NO: 1362995 - RNA, 23 nt, Human
acuuuuuuucuguaccaguuaau

SEQ ID NO: 1362996 - RNA, 22 nt, Human
acuuuuuuuuuuuaagaguaaa

SEQ ID NO: 1362997 - RNA, 19 nt, Human
agaaccuaauucaauucaa

SEQ ID NO: 1362998 - RNA, 15 nt, Human
agaaccuaauucaau

SEQ ID NO: 1362999 - RNA, 14 nt, Human
agaaccuaauucaa

SEQ ID NO: 1363000 - RNA, 19 nt, Human
agaaccguagaugauuuca

SEQ ID NO: 1363001 - RNA, 18 nt, Human
agaaccggagagccagcu

SEQ ID NO: 1363002 - RNA, 24 nt, Human
agaaauuuaaacuauaagcaagaa

SEQ ID NO: 1363003 - RNA, 17 nt, Human
agaaauuuaauucagaa

SEQ ID NO: 1363004 - RNA, 20 nt, Human
agaaauuuaaacuauaagca

SEQ ID NO: 1363005 - RNA, 16 nt, Human
agaaauuuaaacuaua

SEQ ID NO: 1363006 - RNA, 13 nt, Human
agaaauuuaaacu

SEQ ID NO: 1363007 - RNA, 21 nt, Human
agaaauuguauauuguaauuu

SEQ ID NO: 1363008 - RNA, 20 nt, Human
agaaauuguauauuguaauu

SEQ ID NO: 1363009 - RNA, 17 nt, Human
agaaauuguauauugua

SEQ ID NO: 1363010 - RNA, 16 nt, Human
agaaauuguauauugu

SEQ ID NO: 1363011 - RNA, 14 nt, Human
agaaauuguauauu

SEQ ID NO: 1363012 - RNA, 18 nt, Human
ucugcagacuucccagcu

SEQ ID NO: 1363013 - RNA, 16 nt, Human
ucugcagacuucccag

SEQ ID NO: 1363014 - RNA, 23 nt, Human
ucugcacuugcgguuccggcaug

SEQ ID NO: 1363015 - RNA, 17 nt, Human
agaaauguacagcaagg

SEQ ID NO: 1363016 - RNA, 16 nt, Human
agaaauguacagcaag

SEQ ID NO: 1363017 - RNA, 19 nt, Human
ucugcagacuucccagcua

SEQ ID NO: 1363018 - RNA, 11 nt, Human
agaaauguguu

SEQ ID NO: 1363019 - RNA, 19 nt, Human
agaagaaaagguucuuacu

SEQ ID NO: 1363020 - RNA, 15 nt, Human
agaagaaaaagaagc

SEQ ID NO: 1363021 - RNA, 13 nt, Human
agaagaaaaagaa

SEQ ID NO: 1363022 - RNA, 15 nt, Human
agaacugaaugagaa

SEQ ID NO: 1363023 - RNA, 14 nt, Human
agaacucuuucaaa

SEQ ID NO: 1363024 - RNA, 13 nt, Human
agaacguggucag

SEQ ID NO: 1363025 - RNA, 21 nt, Human
agaacucaugacggaagaguu

SEQ ID NO: 1363026 - RNA, 20 nt, Human
ucugacuuucuuuuuugaua

SEQ ID NO: 1363027 - RNA, 20 nt, Human
ucugacuucugccuggagac

SEQ ID NO: 1363028 - RNA, 19 nt, Human
ucugacuucugccuggaga

SEQ ID NO: 1363029 - RNA, 17 nt, Human
ucugacuucugccugga

SEQ ID NO: 1363030 - RNA, 16 nt, Human
ucugacuucugccugg

SEQ ID NO: 1363031 - RNA, 15 nt, Human
ucugacuucugccug

SEQ ID NO: 1363032 - RNA, 14 nt, Human
ucugacuucugccu

SEQ ID NO: 1363033 - RNA, 12 nt, Human
ucugacuucugc

SEQ ID NO: 1363034 - RNA, 21 nt, Human
ucugacuguuuccaucaaggg

SEQ ID NO: 1363035 - RNA, 18 nt, Human
ucugaccugcacugggga

SEQ ID NO: 1363036 - RNA, 15 nt, Human
ucugaucaaggccuu

SEQ ID NO: 1363037 - RNA, 21 nt, Human
ucugauaggguuugugacagg

SEQ ID NO: 1363038 - RNA, 22 nt, Human
ucugauaggguuugugacaggg

SEQ ID NO: 1363039 - RNA, 21 nt, Human
ucugagguccugagcacugcc

SEQ ID NO: 1363040 - RNA, 17 nt, Human
ucugauacagaaaaguu

SEQ ID NO: 1363041 - RNA, 16 nt, Human
ucugauacagaaaagu

SEQ ID NO: 1363042 - RNA, 22 nt, Human
ucugagaaaagcuuugaacccu

SEQ ID NO: 1363043 - RNA, 23 nt, Human
ucugacuuucuuuuuugauauag

SEQ ID NO: 1363044 - RNA, 20 nt, Human
ucugagguccugagcacugc

SEQ ID NO: 1363045 - RNA, 19 nt, Human
ucugagguccugagcacug

SEQ ID NO: 1363046 - RNA, 18 nt, Human
ucugagguccugagcacu

SEQ ID NO: 1363047 - RNA, 17 nt, Human
ucugagguccugagcac

SEQ ID NO: 1363048 - RNA, 16 nt, Human
ucugagguccugagca

SEQ ID NO: 1363049 - RNA, 15 nt, Human
ucugagguccugagc

SEQ ID NO: 1363050 - RNA, 14 nt, Human
ucugagguccugag

SEQ ID NO: 1363051 - RNA, 19 nt, Human
ucugaggggcuaccaggaa

SEQ ID NO: 1363052 - RNA, 20 nt, Human
ucugaggggcuaccaggaaa

SEQ ID NO: 1363053 - RNA, 21 nt, Human
ucugaggggcuaccaggaaag

SEQ ID NO: 1363054 - RNA, 16 nt, Human
ucugcuguuccagugg

SEQ ID NO: 1363055 - RNA, 15 nt, Human
ucugcuguuccagug

SEQ ID NO: 1363056 - RNA, 14 nt, Human
ucugcuguuccagu

SEQ ID NO: 1363057 - RNA, 12 nt, Human
ucugcuguagaa

SEQ ID NO: 1363058 - RNA, 13 nt, Human
ucugcuguagaaa

SEQ ID NO: 1363059 - RNA, 23 nt, Human
ucugcucaucauucucugucuca

SEQ ID NO: 1363060 - RNA, 22 nt, Human
ucugcucaucauucucugucuc

SEQ ID NO: 1363061 - RNA, 18 nt, Human
ucugcucaucauucucug

SEQ ID NO: 1363062 - RNA, 15 nt, Human
ucugcucaucauucu

SEQ ID NO: 1363063 - RNA, 14 nt, Human
ucugcucaucauuc

SEQ ID NO: 1363064 - RNA, 18 nt, Human
ucugcuugauuuuugccu

SEQ ID NO: 1363065 - RNA, 22 nt, Human
ucugcuucucugacuucugccu

SEQ ID NO: 1363066 - RNA, 19 nt, Human
ucugcuucucugacuucug

SEQ ID NO: 1363067 - RNA, 16 nt, Human
ucugcuucucugacuu

SEQ ID NO: 1363068 - RNA, 14 nt, Human
ucugcuucucugac

SEQ ID NO: 1363069 - RNA, 12 nt, Human
ucugcucaucau

SEQ ID NO: 1363070 - RNA, 22 nt, Human
ucugcucaguaauuugaggaca

SEQ ID NO: 1363071 - RNA, 16 nt, Human
ucugcucagcucuggg

SEQ ID NO: 1363072 - RNA, 14 nt, Human
ucugcucagcucug

SEQ ID NO: 1363073 - RNA, 16 nt, Human
ucugcuacuuugcugc

SEQ ID NO: 1363074 - RNA, 22 nt, Human
ucugccuuuggggacuuuucuu

SEQ ID NO: 1363075 - RNA, 21 nt, Human
ucugccuuugccaggugacug

SEQ ID NO: 1363076 - RNA, 15 nt, Human
ucugccuuugccagg

SEQ ID NO: 1363077 - RNA, 20 nt, Human
ucugccuucucaugauccaa

SEQ ID NO: 1363078 - RNA, 11 nt, Human
ucugccuuuau

SEQ ID NO: 1363079 - RNA, 16 nt, Human
ucugccuuuauugugu

SEQ ID NO: 1363080 - RNA, 18 nt, Human
ucugccuuuauuguguuu

SEQ ID NO: 1363081 - RNA, 23 nt, Human
ucugccuuuauuguguuugucau

SEQ ID NO: 1363082 - RNA, 20 nt, Human
ucugccuuuauuguguuugu

SEQ ID NO: 1363083 - RNA, 21 nt, Human
agaagaaacaagguuuucagu

SEQ ID NO: 1363084 - RNA, 16 nt, Human
agaagaaagaacggaa

SEQ ID NO: 1363085 - RNA, 13 nt, Human
agaagaaacaagg

SEQ ID NO: 1363086 - RNA, 18 nt, Human
agaagaaagaacggaaga

SEQ ID NO: 1363087 - RNA, 21 nt, Human
agaagaacugaaaucauacuu

SEQ ID NO: 1363088 - RNA, 21 nt, Human
ucuggaguugaucuggaaccc

SEQ ID NO: 1363089 - RNA, 17 nt, Human
ucuggaguugaucugga

SEQ ID NO: 1363090 - RNA, 16 nt, Human
ucuggaguugaucugg

SEQ ID NO: 1363091 - RNA, 21 nt, Human
ucuggagucucacuugucuca

SEQ ID NO: 1363092 - RNA, 17 nt, Human
ucuggaguauucuauaa

SEQ ID NO: 1363093 - RNA, 16 nt, Human
ucuggaaccucagccu

SEQ ID NO: 1363094 - RNA, 15 nt, Human
ucuggaaccucagcc

SEQ ID NO: 1363095 - RNA, 23 nt, Human
ucuggaacccagacucagacauu

SEQ ID NO: 1363096 - RNA, 22 nt, Human
ucuggaacccagacucagacau

SEQ ID NO: 1363097 - RNA, 18 nt, Human
ucuggaacccagacucag

SEQ ID NO: 1363098 - RNA, 17 nt, Human
ucuggaacccagacuca

SEQ ID NO: 1363099 - RNA, 16 nt, Human
ucuggaacccagacuc

SEQ ID NO: 1363100 - RNA, 15 nt, Human
ucuggaacccagacu

SEQ ID NO: 1363101 - RNA, 14 nt, Human
ucuggaacccagac

SEQ ID NO: 1363102 - RNA, 13 nt, Human
ucuggaacccaga

SEQ ID NO: 1363103 - RNA, 16 nt, Human
ucuggcagccucccau

SEQ ID NO: 1363104 - RNA, 23 nt, Human
ucuggcagccacacuucucagga

SEQ ID NO: 1363105 - RNA, 22 nt, Human
ucuggcagccacacuucucagg

SEQ ID NO: 1363106 - RNA, 21 nt, Human
ucuggcagccacacuucucag

SEQ ID NO: 1363107 - RNA, 18 nt, Human
ucuggcagccacacuucu

SEQ ID NO: 1363108 - RNA, 15 nt, Human
ucuggcagccacacu

SEQ ID NO: 1363109 - RNA, 13 nt, Human
ucuggcagccaca

SEQ ID NO: 1363110 - RNA, 12 nt, Human
ucuggcagccac

SEQ ID NO: 1363111 - RNA, 11 nt, Human
ucuggcagcca

SEQ ID NO: 1363112 - RNA, 19 nt, Human
ucuggauuauucugggggc

SEQ ID NO: 1363113 - RNA, 23 nt, Human
ucuggauaacuuccacagggucc

SEQ ID NO: 1363114 - RNA, 21 nt, Human
ucuggauaacuuccacagggu

SEQ ID NO: 1363115 - RNA, 18 nt, Human
ucuggauaacuuccacag

SEQ ID NO: 1363116 - RNA, 12 nt, Human
ucuggauuauau

SEQ ID NO: 1363117 - RNA, 18 nt, Human
ucuggauuauauuaugaa

SEQ ID NO: 1363118 - RNA, 23 nt, Human
agaagccuucaagcucugaggga

SEQ ID NO: 1363119 - RNA, 21 nt, Human
agaagccuucaagcucugagg

SEQ ID NO: 1363120 - RNA, 20 nt, Human
agaagccuucaagcucugag

SEQ ID NO: 1363121 - RNA, 19 nt, Human
agaagccuucaagcucuga

SEQ ID NO: 1363122 - RNA, 18 nt, Human
agaagccuucaagcucug

SEQ ID NO: 1363123 - RNA, 17 nt, Human
agaagccuucaagcucu

SEQ ID NO: 1363124 - RNA, 15 nt, Human
agaagccuucaagcu

SEQ ID NO: 1363125 - RNA, 11 nt, Human
agaagccuuca

SEQ ID NO: 1363126 - RNA, 21 nt, Human
agaagccugggggccuggcug

SEQ ID NO: 1363127 - RNA, 20 nt, Human
agaagccugggggccuggcu

SEQ ID NO: 1363128 - RNA, 19 nt, Human
agaagccugggggccuggc

SEQ ID NO: 1363129 - RNA, 18 nt, Human
agaagccugggggccugg

SEQ ID NO: 1363130 - RNA, 17 nt, Human
agaagccugggggccug

SEQ ID NO: 1363131 - RNA, 14 nt, Human
agaagccugggggc

SEQ ID NO: 1363132 - RNA, 13 nt, Human
agaagccuggggg

SEQ ID NO: 1363133 - RNA, 12 nt, Human
agaagccugggg

SEQ ID NO: 1363134 - RNA, 11 nt, Human
agaagccuggg

SEQ ID NO: 1363135 - RNA, 21 nt, Human
agaagccugcauaauguuucu

SEQ ID NO: 1363136 - RNA, 11 nt, Human
agaagccugca

SEQ ID NO: 1363137 - RNA, 10 nt, Human
agaagccugc

SEQ ID NO: 1363138 - RNA, 12 nt, Human
ucuggccccccu

SEQ ID NO: 1363139 - RNA, 22 nt, Human
ucuggccccccugguccccucc

SEQ ID NO: 1363140 - RNA, 21 nt, Human
ucuggccaguguuuaaaacuu

SEQ ID NO: 1363141 - RNA, 16 nt, Human
ucuggcccaccagggu

SEQ ID NO: 1363142 - RNA, 14 nt, Human
ucuggcccaccagg

SEQ ID NO: 1363143 - RNA, 16 nt, Human
ucuggccaggaagcuu

SEQ ID NO: 1363144 - RNA, 17 nt, Human
ucuggccaggaagcuuu

SEQ ID NO: 1363145 - RNA, 18 nt, Human
ucuggcauuagaauuauu

SEQ ID NO: 1363146 - RNA, 21 nt, Human
ucuggcagccucccauccagg

SEQ ID NO: 1363147 - RNA, 17 nt, Human
agaagcucagcugcauu

SEQ ID NO: 1363148 - RNA, 13 nt, Human
agaagcucagcug

SEQ ID NO: 1363149 - RNA, 18 nt, Human
agaagcuaagguuuagau

SEQ ID NO: 1363150 - RNA, 18 nt, Human
agaagcucagcugcauuc

SEQ ID NO: 1363151 - RNA, 14 nt, Human
agaagcuccaggua

SEQ ID NO: 1363152 - RNA, 22 nt, Human
ugcccccugcaggaaggagcug

SEQ ID NO: 1363153 - RNA, 23 nt, Human
ugcccccugcaggaaggagcugc

SEQ ID NO: 1363154 - RNA, 21 nt, Human
ugcccccugcaggaaggagcu

SEQ ID NO: 1363155 - RNA, 18 nt, Human
ugcccccugcaggaagga

SEQ ID NO: 1363156 - RNA, 17 nt, Human
ugcccccugcaggaagg

SEQ ID NO: 1363157 - RNA, 16 nt, Human
ugcccccugcaggaag

SEQ ID NO: 1363158 - RNA, 14 nt, Human
ugcccccugcagga

SEQ ID NO: 1363159 - RNA, 20 nt, Human
ugccccccagccucuggcau

SEQ ID NO: 1363160 - RNA, 12 nt, Human
ugcccccacccc

SEQ ID NO: 1363161 - RNA, 19 nt, Human
ugccccccagccucuggca

SEQ ID NO: 1363162 - RNA, 15 nt, Human
ugccccccagccucu

SEQ ID NO: 1363163 - RNA, 14 nt, Human
ugccccccagccuc

SEQ ID NO: 1363164 - RNA, 15 nt, Human
ugcccccauuucuga

SEQ ID NO: 1363165 - RNA, 18 nt, Human
ugcccccauuucugaggu

SEQ ID NO: 1363166 - RNA, 22 nt, Human
ugcccccaggguccugggagga

SEQ ID NO: 1363167 - RNA, 21 nt, Human
ugcccccaggguccugggagg

SEQ ID NO: 1363168 - RNA, 18 nt, Human
ugcccccaggguccuggg

SEQ ID NO: 1363169 - RNA, 23 nt, Human
ugcccucauggccccucugaccu

SEQ ID NO: 1363170 - RNA, 19 nt, Human
ugcccucauggccccucug

SEQ ID NO: 1363171 - RNA, 17 nt, Human
ugcccucauggccccuc

SEQ ID NO: 1363172 - RNA, 19 nt, Human
ugcccuaucacccaacgcu

SEQ ID NO: 1363173 - RNA, 17 nt, Human
ugcccccacugaccaga

SEQ ID NO: 1363174 - RNA, 19 nt, Human
ugcccccaccccauucccg

SEQ ID NO: 1363175 - RNA, 22 nt, Human
ugcccccaccccauucccgcag

SEQ ID NO: 1363176 - RNA, 17 nt, Human
ugcccccaccccauucc

SEQ ID NO: 1363177 - RNA, 22 nt, Human
ugcccaagccagaggcuggguu

SEQ ID NO: 1363178 - RNA, 14 nt, Human
agcuauuuuucuaa

SEQ ID NO: 1363179 - RNA, 21 nt, Human
agcuauuuuccaggcuucugc

SEQ ID NO: 1363180 - RNA, 13 nt, Human
agcuauuuuguga

SEQ ID NO: 1363181 - RNA, 13 nt, Human
agcuauuuuccag

SEQ ID NO: 1363182 - RNA, 12 nt, Human
agcuauuuucca

SEQ ID NO: 1363183 - RNA, 20 nt, Human
agcuauuugauguaauacuu

SEQ ID NO: 1363184 - RNA, 17 nt, Human
agcuauuugauguaaua

SEQ ID NO: 1363185 - RNA, 15 nt, Human
agcuauuugauguaa

SEQ ID NO: 1363186 - RNA, 23 nt, Human
ugcccaagccagaggcuggguuc

SEQ ID NO: 1363187 - RNA, 11 nt, Human
ugccauuguag

SEQ ID NO: 1363188 - RNA, 22 nt, Human
ugcccaacccuucccucaccuu

SEQ ID NO: 1363189 - RNA, 20 nt, Human
ugcccaacccuucccucacc

SEQ ID NO: 1363190 - RNA, 19 nt, Human
ugccauugggguaguugug

SEQ ID NO: 1363191 - RNA, 16 nt, Human
ugccauucacuucaua

SEQ ID NO: 1363192 - RNA, 14 nt, Human
ugccauuaacaaau

SEQ ID NO: 1363193 - RNA, 14 nt, Human
ugccauuaaagaau

SEQ ID NO: 1363194 - RNA, 13 nt, Human
agcuauuuuucua

SEQ ID NO: 1363195 - RNA, 22 nt, Human
agcuauaaagcaguauuuuucu

SEQ ID NO: 1363196 - RNA, 18 nt, Human
agcuauaaaaugaauaca

SEQ ID NO: 1363197 - RNA, 22 nt, Human
agcuaguuuuauucuugguuuu

SEQ ID NO: 1363198 - RNA, 21 nt, Human
agcuacuuccuccuccccacu

SEQ ID NO: 1363199 - RNA, 16 nt, Human
agcuacuuccuccucc

SEQ ID NO: 1363200 - RNA, 15 nt, Human
agcuacuuccuccuc

SEQ ID NO: 1363201 - RNA, 23 nt, Human
agcuacugugugugugaaugaac

SEQ ID NO: 1363202 - RNA, 20 nt, Human
agcuacugugugugugaaug

SEQ ID NO: 1363203 - RNA, 19 nt, Human
agcuacugugugugugaau

SEQ ID NO: 1363204 - RNA, 15 nt, Human
agcuacugugugugu

SEQ ID NO: 1363205 - RNA, 23 nt, Human
agcuacugccgucagugcugugc

SEQ ID NO: 1363206 - RNA, 22 nt, Human
agcuacucuccccacgagggcu

SEQ ID NO: 1363207 - RNA, 23 nt, Human
agcuacucuccccacgagggcug

SEQ ID NO: 1363208 - RNA, 21 nt, Human
agcuauuucaucuauuuuugg

SEQ ID NO: 1363209 - RNA, 17 nt, Human
agcuauuucaucuauuu

SEQ ID NO: 1363210 - RNA, 14 nt, Human
agcuauuucaucua

SEQ ID NO: 1363211 - RNA, 13 nt, Human
agcuauuucaucu

SEQ ID NO: 1363212 - RNA, 15 nt, Human
agcuauuuaaagcau

SEQ ID NO: 1363213 - RNA, 19 nt, Human
agcuauggugucauaggcu

SEQ ID NO: 1363214 - RNA, 11 nt, Human
agcuauauaag

SEQ ID NO: 1363215 - RNA, 17 nt, Human
agcuauauaagacaaga

SEQ ID NO: 1363216 - RNA, 22 nt, Human
agcguggccuuguucugucacc

SEQ ID NO: 1363217 - RNA, 18 nt, Human
agcguggccuuguucugu

SEQ ID NO: 1363218 - RNA, 20 nt, Human
agcguggagggguaggggcu

SEQ ID NO: 1363219 - RNA, 14 nt, Human
agcguggaggggua

SEQ ID NO: 1363220 - RNA, 17 nt, Human
agcgugcuuuaaaaaau

SEQ ID NO: 1363221 - RNA, 23 nt, Human
ugccauauuaaauuuuuuguuga

SEQ ID NO: 1363222 - RNA, 16 nt, Human
ugccauauuaaauuuu

SEQ ID NO: 1363223 - RNA, 14 nt, Human
ugccauauuaaauu

SEQ ID NO: 1363224 - RNA, 15 nt, Human
ugccauauugcacau

SEQ ID NO: 1363225 - RNA, 16 nt, Human
ugccauauugcacaug

SEQ ID NO: 1363226 - RNA, 19 nt, Human
ugccauauugcacaugucu

SEQ ID NO: 1363227 - RNA, 20 nt, Human
ugccauauugcacaugucuu

SEQ ID NO: 1363228 - RNA, 18 nt, Human
ugccauaugauuuacauu

SEQ ID NO: 1363229 - RNA, 20 nt, Human
ugccauagucuuaacugguc

SEQ ID NO: 1363230 - RNA, 17 nt, Human
ugccauagucuuaacug

SEQ ID NO: 1363231 - RNA, 12 nt, Human
ugccacuguugu

SEQ ID NO: 1363232 - RNA, 23 nt, Human
ugccacuuaauguauguuaccaa

SEQ ID NO: 1363233 - RNA, 20 nt, Human
ugccacuuaauguauguuac

SEQ ID NO: 1363234 - RNA, 18 nt, Human
ugccacuuaauguauguu

SEQ ID NO: 1363235 - RNA, 17 nt, Human
ugccacuuaauguaugu

SEQ ID NO: 1363236 - RNA, 14 nt, Human
ugccacuuaaugua

SEQ ID NO: 1363237 - RNA, 19 nt, Human
ugccacuggggaaaacucc

SEQ ID NO: 1363238 - RNA, 13 nt, Human
ugccacuggagug

SEQ ID NO: 1363239 - RNA, 22 nt, Human
ugccacugccuucgcuucuugc

SEQ ID NO: 1363240 - RNA, 21 nt, Human
ugccacugccuucgcuucuug

SEQ ID NO: 1363241 - RNA, 19 nt, Human
ugccacugccuucgcuucu

SEQ ID NO: 1363242 - RNA, 18 nt, Human
agcggcccugucauccag

SEQ ID NO: 1363243 - RNA, 22 nt, Human
agcggccggccagccccuggcc

SEQ ID NO: 1363244 - RNA, 18 nt, Human
agcggccggccagccccu

SEQ ID NO: 1363245 - RNA, 11 nt, Human
agcggccggcc

SEQ ID NO: 1363246 - RNA, 14 nt, Human
agcggcccugucau

SEQ ID NO: 1363247 - RNA, 13 nt, Human
agcggcaucaggc

SEQ ID NO: 1363248 - RNA, 15 nt, Human
agcggcaucaggcuu

SEQ ID NO: 1363249 - RNA, 14 nt, Human
agcggcagaugggg

SEQ ID NO: 1363250 - RNA, 17 nt, Human
agcgcuaucucccugcc

SEQ ID NO: 1363251 - RNA, 18 nt, Human
agcgcuaucucccugccu

SEQ ID NO: 1363252 - RNA, 13 nt, Human
agcgcuaucuccc

SEQ ID NO: 1363253 - RNA, 20 nt, Human
agcgcuagaggaagcagcca

SEQ ID NO: 1363254 - RNA, 19 nt, Human
agcgcuagaggaagcagcc

SEQ ID NO: 1363255 - RNA, 16 nt, Human
agcgcccagcuccuga

SEQ ID NO: 1363256 - RNA, 14 nt, Human
agcgcccagcuccu

SEQ ID NO: 1363257 - RNA, 22 nt, Human
agcgcccaaaggacgcacugag

SEQ ID NO: 1363258 - RNA, 21 nt, Human
agccugcgccaccgcccagag

SEQ ID NO: 1363259 - RNA, 17 nt, Human
agccugccgagcaaccg

SEQ ID NO: 1363260 - RNA, 21 nt, Human
agcgccaggcugaccacagca

SEQ ID NO: 1363261 - RNA, 12 nt, Human
agcgccaggcug

SEQ ID NO: 1363262 - RNA, 10 nt, Human
agccugcuca

SEQ ID NO: 1363263 - RNA, 18 nt, Human
ugcauugaacacaaacug

SEQ ID NO: 1363264 - RNA, 17 nt, Human
ugcauugaacacaaacu

SEQ ID NO: 1363265 - RNA, 15 nt, Human
ugcauugaacacaaa

SEQ ID NO: 1363266 - RNA, 14 nt, Human
ugcauugaacacaa

SEQ ID NO: 1363267 - RNA, 13 nt, Human
ugcauugaacaca

SEQ ID NO: 1363268 - RNA, 20 nt, Human
ugcauugaaaagagcugaag

SEQ ID NO: 1363269 - RNA, 18 nt, Human
ugcauugaaaagagcuga

SEQ ID NO: 1363270 - RNA, 17 nt, Human
ugcauugaaaagagcug

SEQ ID NO: 1363271 - RNA, 20 nt, Human
ugcauucuucugagcacugu

SEQ ID NO: 1363272 - RNA, 16 nt, Human
ugcauucuucugagca

SEQ ID NO: 1363273 - RNA, 16 nt, Human
ugcauucuucucuguu

SEQ ID NO: 1363274 - RNA, 15 nt, Human
ugcauucuucucugu

SEQ ID NO: 1363275 - RNA, 16 nt, Human
ugcauucuggauuuua

SEQ ID NO: 1363276 - RNA, 21 nt, Human
ugcauugaacacaaacuguaa

SEQ ID NO: 1363277 - RNA, 19 nt, Human
ugcauugaacacaaacugu

SEQ ID NO: 1363278 - RNA, 22 nt, Human
ugcauugaacacaaacuguaaa

SEQ ID NO: 1363279 - RNA, 19 nt, Human
ugcauuugaaaauuuugau

SEQ ID NO: 1363280 - RNA, 23 nt, Human
ugcauuugaaaauuuugauguuu

SEQ ID NO: 1363281 - RNA, 22 nt, Human
ugccacacaaggauagaugcug

SEQ ID NO: 1363282 - RNA, 19 nt, Human
ugccacaaggacuuccugu

SEQ ID NO: 1363283 - RNA, 19 nt, Human
ugccaauauuaaaucugcu

SEQ ID NO: 1363284 - RNA, 18 nt, Human
ugccaauauuaaaucugc

SEQ ID NO: 1363285 - RNA, 21 nt, Human
ugccacaccccccaccccuag

SEQ ID NO: 1363286 - RNA, 23 nt, Human
ugccacaccccccaccccuagga

SEQ ID NO: 1363287 - RNA, 18 nt, Human
ugcauuugaggucuguuc

SEQ ID NO: 1363288 - RNA, 14 nt, Human
ugcacuacugacau

SEQ ID NO: 1363289 - RNA, 17 nt, Human
ugcacuaacagaguggc

SEQ ID NO: 1363290 - RNA, 17 nt, Human
ugcacguggccucuuga

SEQ ID NO: 1363291 - RNA, 16 nt, Human
ugcacguggccucuug

SEQ ID NO: 1363292 - RNA, 15 nt, Human
ugcacguggccucuu

SEQ ID NO: 1363293 - RNA, 14 nt, Human
ugcacguggccucu

SEQ ID NO: 1363294 - RNA, 15 nt, Human
ugcacucccaccuga

SEQ ID NO: 1363295 - RNA, 14 nt, Human
ugcacucccaccug

SEQ ID NO: 1363296 - RNA, 18 nt, Human
ugcacuacugacaugugg

SEQ ID NO: 1363297 - RNA, 16 nt, Human
ugcacuacugacaugu

SEQ ID NO: 1363298 - RNA, 15 nt, Human
ugcacuacugacaug

SEQ ID NO: 1363299 - RNA, 19 nt, Human
ugcaccaccaagccaaggg

SEQ ID NO: 1363300 - RNA, 18 nt, Human
ugcaccaccaagccaagg

SEQ ID NO: 1363301 - RNA, 16 nt, Human
ugcaccaccaagccaa

SEQ ID NO: 1363302 - RNA, 14 nt, Human
ugcaccaagcagga

SEQ ID NO: 1363303 - RNA, 14 nt, Human
ugcacaugucuuaa

SEQ ID NO: 1363304 - RNA, 15 nt, Human
ugcacaugucuuaau

SEQ ID NO: 1363305 - RNA, 16 nt, Human
ugcacaugucuuaaug

SEQ ID NO: 1363306 - RNA, 15 nt, Human
ugcaccaccaagcca

SEQ ID NO: 1363307 - RNA, 14 nt, Human
ugcaccaccaagcc

SEQ ID NO: 1363308 - RNA, 12 nt, Human
ugcaccaccaag

SEQ ID NO: 1363309 - RNA, 22 nt, Human
ugcaccaagcaggaaaugaaaa

SEQ ID NO: 1363310 - RNA, 17 nt, Human
ugcacaugaacuuagau

SEQ ID NO: 1363311 - RNA, 21 nt, Human
ugcacaugacucggggguggg

SEQ ID NO: 1363312 - RNA, 12 nt, Human
ugcacaugucuu

SEQ ID NO: 1363313 - RNA, 21 nt, Human
ugcacaugaacuuagauuuua

SEQ ID NO: 1363314 - RNA, 14 nt, Human
ugcacaugaacuua

SEQ ID NO: 1363315 - RNA, 13 nt, Human
ugcacaauguaga

SEQ ID NO: 1363316 - RNA, 21 nt, Human
ugcacaauaacuccucccagg

SEQ ID NO: 1363317 - RNA, 22 nt, Human
ugcacaauaacuccucccaggg

SEQ ID NO: 1363318 - RNA, 19 nt, Human
ugcacaauaacuccuccca

SEQ ID NO: 1363319 - RNA, 18 nt, Human
ugcacaauaacuccuccc

SEQ ID NO: 1363320 - RNA, 21 nt, Human
ugcacaauaaaaauguuuaac

SEQ ID NO: 1363321 - RNA, 20 nt, Human
ugcacaauaaaaauguuuaa

SEQ ID NO: 1363322 - RNA, 15 nt, Human
ugcacaauaaaaaug

SEQ ID NO: 1363323 - RNA, 20 nt, Human
ugcacaagaauggaucacaa

SEQ ID NO: 1363324 - RNA, 23 nt, Human
ugcacaagaauggaucacaagau

SEQ ID NO: 1363325 - RNA, 16 nt, Human
ugcacaagaauggauc

SEQ ID NO: 1363326 - RNA, 15 nt, Human
ugcacaagaauggau

SEQ ID NO: 1363327 - RNA, 14 nt, Human
ugcacaagaaugga

SEQ ID NO: 1363328 - RNA, 18 nt, Human
agcagcaccguucugugc

SEQ ID NO: 1363329 - RNA, 16 nt, Human
agcagcaacuuguccu

SEQ ID NO: 1363330 - RNA, 22 nt, Human
agcccuuaugcgguuaauuuug

SEQ ID NO: 1363331 - RNA, 21 nt, Human
agcccuuaugcgguuaauuuu

SEQ ID NO: 1363332 - RNA, 16 nt, Human
ugcagacuucccagcu

SEQ ID NO: 1363333 - RNA, 22 nt, Human
ugcagacuucccagcuaggaag

SEQ ID NO: 1363334 - RNA, 15 nt, Human
ugcagacuucccagc

SEQ ID NO: 1363335 - RNA, 18 nt, Human
ugcagaaaauucugugcc

SEQ ID NO: 1363336 - RNA, 19 nt, Human
ugcacucccaccugacaca

SEQ ID NO: 1363337 - RNA, 17 nt, Human
ugcacucccaccugaca

SEQ ID NO: 1363338 - RNA, 21 nt, Human
ugcagaaccggagagccagcu

SEQ ID NO: 1363339 - RNA, 20 nt, Human
ugcagaaccggagagccagc

SEQ ID NO: 1363340 - RNA, 15 nt, Human
ugcagaaacuacuga

SEQ ID NO: 1363341 - RNA, 17 nt, Human
ugcagaaaauucugugc

SEQ ID NO: 1363342 - RNA, 13 nt, Human
ugcagaaagcauc

SEQ ID NO: 1363343 - RNA, 20 nt, Human
ugcagaaagcaucccucacc

SEQ ID NO: 1363344 - RNA, 18 nt, Human
agccucaaaacaaaggcc

SEQ ID NO: 1363345 - RNA, 20 nt, Human
agccucaaaacaaaggccua

SEQ ID NO: 1363346 - RNA, 20 nt, Human
agccuagugaaggcuucucu

SEQ ID NO: 1363347 - RNA, 23 nt, Human
agccuagugaaggcuucucucug

SEQ ID NO: 1363348 - RNA, 14 nt, Human
agccuagugaaggc

SEQ ID NO: 1363349 - RNA, 22 nt, Human
agccuaggccuaguccugcgaa

SEQ ID NO: 1363350 - RNA, 19 nt, Human
agccuaggccuaguccugc

SEQ ID NO: 1363351 - RNA, 17 nt, Human
agccuaggccuaguccu

SEQ ID NO: 1363352 - RNA, 14 nt, Human
agccuacaggccuc

SEQ ID NO: 1363353 - RNA, 13 nt, Human
agccuacaggccu

SEQ ID NO: 1363354 - RNA, 19 nt, Human
agccuaaggcuccuguuuu

SEQ ID NO: 1363355 - RNA, 18 nt, Human
agccuaaggcuccuguuu

SEQ ID NO: 1363356 - RNA, 17 nt, Human
agcccuugcauugcaga

SEQ ID NO: 1363357 - RNA, 19 nt, Human
agcccuucuuuccacagaa

SEQ ID NO: 1363358 - RNA, 18 nt, Human
agcccuucuuuccacaga

SEQ ID NO: 1363359 - RNA, 21 nt, Human
ugcaucuggagagaacagguu

SEQ ID NO: 1363360 - RNA, 17 nt, Human
ugcaucuggagagaaca

SEQ ID NO: 1363361 - RNA, 18 nt, Human
ugcaucucccagauaaug

SEQ ID NO: 1363362 - RNA, 13 nt, Human
ugcaucucccaga

SEQ ID NO: 1363363 - RNA, 22 nt, Human
ugcauaccacuuuuguucuugg

SEQ ID NO: 1363364 - RNA, 22 nt, Human
ugcaugaaguaauaugcacaca

SEQ ID NO: 1363365 - RNA, 23 nt, Human
agccugcaggaucucaccaggca

SEQ ID NO: 1363366 - RNA, 22 nt, Human
agccugcaggaucucaccaggc

SEQ ID NO: 1363367 - RNA, 14 nt, Human
agccugcaggaucu

SEQ ID NO: 1363368 - RNA, 19 nt, Human
agccugacccucaucuuuc

SEQ ID NO: 1363369 - RNA, 21 nt, Human
agccugagcaacucuugauua

SEQ ID NO: 1363370 - RNA, 16 nt, Human
agccugagcaacucuu

SEQ ID NO: 1363371 - RNA, 21 nt, Human
ugcagcuguuuuguugacauu

SEQ ID NO: 1363372 - RNA, 23 nt, Human
ugcagcuguuuuguugacauucu

SEQ ID NO: 1363373 - RNA, 18 nt, Human
ugcagcuguuuuguugac

SEQ ID NO: 1363374 - RNA, 15 nt, Human
ugcagcuguuuuguu

SEQ ID NO: 1363375 - RNA, 22 nt, Human
ugcagcuguggcagaguuacag

SEQ ID NO: 1363376 - RNA, 20 nt, Human
ugcagcuguggcagaguuac

SEQ ID NO: 1363377 - RNA, 19 nt, Human
ugcagccggcacagggucu

SEQ ID NO: 1363378 - RNA, 18 nt, Human
ugcagccggcacaggguc

SEQ ID NO: 1363379 - RNA, 17 nt, Human
ugcagccggcacagggu

SEQ ID NO: 1363380 - RNA, 14 nt, Human
ugcagccgcugagc

SEQ ID NO: 1363381 - RNA, 22 nt, Human
ugcagcccugcugcugccugcc

SEQ ID NO: 1363382 - RNA, 21 nt, Human
ugcaggucccuaauaaagcug

SEQ ID NO: 1363383 - RNA, 20 nt, Human
ugcagcuuguagccagccgg

SEQ ID NO: 1363384 - RNA, 19 nt, Human
ugcagcuuguagccagccg

SEQ ID NO: 1363385 - RNA, 18 nt, Human
ugcagcuuguagccagcc

SEQ ID NO: 1363386 - RNA, 17 nt, Human
ugcagcuuguagccagc

SEQ ID NO: 1363387 - RNA, 16 nt, Human
ugcagcuuguagccag

SEQ ID NO: 1363388 - RNA, 14 nt, Human
ugcagcuuguagcc

SEQ ID NO: 1363389 - RNA, 18 nt, Human
ugcaggucccuaauaaag

SEQ ID NO: 1363390 - RNA, 19 nt, Human
ugcaggucccuaauaaagc

SEQ ID NO: 1363391 - RNA, 20 nt, Human
ugcaggucccuaauaaagcu

SEQ ID NO: 1363392 - RNA, 18 nt, Human
ugcauaacaauuccucua

SEQ ID NO: 1363393 - RNA, 17 nt, Human
ugcauaacaauuccucu

SEQ ID NO: 1363394 - RNA, 22 nt, Human
ugcauaacguauaaaagccugu

SEQ ID NO: 1363395 - RNA, 18 nt, Human
ugcauaauguuucuggau

SEQ ID NO: 1363396 - RNA, 17 nt, Human
ugcauaauguuucugga

SEQ ID NO: 1363397 - RNA, 15 nt, Human
ugcauaauggucaga

SEQ ID NO: 1363398 - RNA, 14 nt, Human
ugcuaguaauugga

SEQ ID NO: 1363399 - RNA, 17 nt, Human
aggaaagaggaagcaaa

SEQ ID NO: 1363400 - RNA, 13 nt, Human
ugcuauacugcau

SEQ ID NO: 1363401 - RNA, 11 nt, Human
ugcuaguguga

SEQ ID NO: 1363402 - RNA, 16 nt, Human
ugcuaguaauuggaaa

SEQ ID NO: 1363403 - RNA, 19 nt, Human
aggaaagagaacuuccaga

SEQ ID NO: 1363404 - RNA, 13 nt, Human
aggaaagagaacu

SEQ ID NO: 1363405 - RNA, 21 nt, Human
aggaaacucugcauucuagua

SEQ ID NO: 1363406 - RNA, 20 nt, Human
aggaaacgagacuuuccauu

SEQ ID NO: 1363407 - RNA, 22 nt, Human
aggaaacuccugugaccacaac

SEQ ID NO: 1363408 - RNA, 12 nt, Human
aggaaagaaaac

SEQ ID NO: 1363409 - RNA, 13 nt, Human
aggaaagaaaaca

SEQ ID NO: 1363410 - RNA, 15 nt, Human
aggaaacgagacuuu

SEQ ID NO: 1363411 - RNA, 18 nt, Human
aggaaaaggccuggggug

SEQ ID NO: 1363412 - RNA, 16 nt, Human
aggaaaaggccugggg

SEQ ID NO: 1363413 - RNA, 15 nt, Human
aggaaaaggccuggg

SEQ ID NO: 1363414 - RNA, 14 nt, Human
aggaaaaggccugg

SEQ ID NO: 1363415 - RNA, 13 nt, Human
aggaaaaggccug

SEQ ID NO: 1363416 - RNA, 21 nt, Human
agcuuugacucaggagccugu

SEQ ID NO: 1363417 - RNA, 20 nt, Human
agcuuugacucaggagccug

SEQ ID NO: 1363418 - RNA, 16 nt, Human
agcuuugacucaggag

SEQ ID NO: 1363419 - RNA, 15 nt, Human
agcuuugacucagga

SEQ ID NO: 1363420 - RNA, 17 nt, Human
aggaaaaggccuggggu

SEQ ID NO: 1363421 - RNA, 21 nt, Human
agcuuauacgaaauaauuguu

SEQ ID NO: 1363422 - RNA, 21 nt, Human
agcuuagcuuuagaaacagug

SEQ ID NO: 1363423 - RNA, 15 nt, Human
agcuuaaaauacaag

SEQ ID NO: 1363424 - RNA, 14 nt, Human
agcuuaaaauacaa

SEQ ID NO: 1363425 - RNA, 13 nt, Human
agcuuaaaauaca

SEQ ID NO: 1363426 - RNA, 16 nt, Human
agcuuaaaacuuugaa

SEQ ID NO: 1363427 - RNA, 22 nt, Human
agcuuaaaacuuugaaguuagc

SEQ ID NO: 1363428 - RNA, 14 nt, Human
agcuuaaaacuuug

SEQ ID NO: 1363429 - RNA, 13 nt, Human
agcuuaaaacuuu

SEQ ID NO: 1363430 - RNA, 12 nt, Human
agcuuaaaacuu

SEQ ID NO: 1363431 - RNA, 14 nt, Human
agcuguuuuguuga

SEQ ID NO: 1363432 - RNA, 23 nt, Human
agcuguuuuguugacauucugaa

SEQ ID NO: 1363433 - RNA, 14 nt, Human
agcuguuuucuucu

SEQ ID NO: 1363434 - RNA, 18 nt, Human
agcuuagcuuuagaaaca

SEQ ID NO: 1363435 - RNA, 16 nt, Human
agcuuagauuucauag

SEQ ID NO: 1363436 - RNA, 15 nt, Human
agcuuagauuucaua

SEQ ID NO: 1363437 - RNA, 13 nt, Human
agcuuagauuuca

SEQ ID NO: 1363438 - RNA, 22 nt, Human
agcuuagaguuggccauauuua

SEQ ID NO: 1363439 - RNA, 20 nt, Human
agcuuaaaauacaagacugc

SEQ ID NO: 1363440 - RNA, 18 nt, Human
agcuuaaaauacaagacu

SEQ ID NO: 1363441 - RNA, 17 nt, Human
agcuuaaaauacaagac

SEQ ID NO: 1363442 - RNA, 22 nt, Human
agcuuucugaacagcuggugua

SEQ ID NO: 1363443 - RNA, 21 nt, Human
agcuuucugaacagcuggugu

SEQ ID NO: 1363444 - RNA, 20 nt, Human
agcuuucugaacagcuggug

SEQ ID NO: 1363445 - RNA, 19 nt, Human
agcuuucugaacagcuggu

SEQ ID NO: 1363446 - RNA, 18 nt, Human
agcuuucugaacagcugg

SEQ ID NO: 1363447 - RNA, 17 nt, Human
agcuuucugaacagcug

SEQ ID NO: 1363448 - RNA, 16 nt, Human
agcuuucugaacagcu

SEQ ID NO: 1363449 - RNA, 15 nt, Human
agcuuucugaacagc

SEQ ID NO: 1363450 - RNA, 12 nt, Human
agcuuucugaac

SEQ ID NO: 1363451 - RNA, 20 nt, Human
agcuugggaaaggugguguu

SEQ ID NO: 1363452 - RNA, 14 nt, Human
agcuugggaaugga

SEQ ID NO: 1363453 - RNA, 12 nt, Human
agcuugggaaug

SEQ ID NO: 1363454 - RNA, 23 nt, Human
agcuuaucuacuuccaaacuaau

SEQ ID NO: 1363455 - RNA, 20 nt, Human
agcuuauacgaaauaauugu

SEQ ID NO: 1363456 - RNA, 18 nt, Human
agcuuauacgaaauaauu

SEQ ID NO: 1363457 - RNA, 19 nt, Human
agcuuagcuuuagaaacag

SEQ ID NO: 1363458 - RNA, 16 nt, Human
agcuuaugaaaagaau

SEQ ID NO: 1363459 - RNA, 15 nt, Human
agcuuaugaaaagaa

SEQ ID NO: 1363460 - RNA, 21 nt, Human
agcuuauugucuagugaaacu

SEQ ID NO: 1363461 - RNA, 17 nt, Human
agcuuggaaaggaccag

SEQ ID NO: 1363462 - RNA, 14 nt, Human
ugcugccacugagg

SEQ ID NO: 1363463 - RNA, 14 nt, Human
aggacaaccauucc

SEQ ID NO: 1363464 - RNA, 16 nt, Human
aggaauuuucuuugug

SEQ ID NO: 1363465 - RNA, 14 nt, Human
aggaauuuucuuug

SEQ ID NO: 1363466 - RNA, 22 nt, Human
aggaauuuuauuuuuuucugaa

SEQ ID NO: 1363467 - RNA, 12 nt, Human
aggaagagaagg

SEQ ID NO: 1363468 - RNA, 14 nt, Human
aggaagagaaggag

SEQ ID NO: 1363469 - RNA, 16 nt, Human
aggaagagaaggagca

SEQ ID NO: 1363470 - RNA, 17 nt, Human
aggaagagaaggagcag

SEQ ID NO: 1363471 - RNA, 16 nt, Human
aggaaucuuuaaaaga

SEQ ID NO: 1363472 - RNA, 22 nt, Human
aggaaucuuuaaaagaugcuuu

SEQ ID NO: 1363473 - RNA, 22 nt, Human
aggaaucugugggucugggagu

SEQ ID NO: 1363474 - RNA, 19 nt, Human
aggaaucugugggucuggg

SEQ ID NO: 1363475 - RNA, 23 nt, Human
aggaaugaaauccugcuucagug

SEQ ID NO: 1363476 - RNA, 21 nt, Human
ugcucugguuguuucuguucc

SEQ ID NO: 1363477 - RNA, 19 nt, Human
ugcucugguuguuucuguu

SEQ ID NO: 1363478 - RNA, 18 nt, Human
ugcucugguuguuucugu

SEQ ID NO: 1363479 - RNA, 23 nt, Human
ugcucugguuguuucuguuccaa

SEQ ID NO: 1363480 - RNA, 21 nt, Human
ugcucuuaauugccaccucua

SEQ ID NO: 1363481 - RNA, 16 nt, Human
ugcucuuaauugccac

SEQ ID NO: 1363482 - RNA, 15 nt, Human
ugcucuuaauugcca

SEQ ID NO: 1363483 - RNA, 13 nt, Human
ugcucuuaauugc

SEQ ID NO: 1363484 - RNA, 22 nt, Human
ugcucugucuucuuugcccaca

SEQ ID NO: 1363485 - RNA, 17 nt, Human
ugcuaucauuauucgua

SEQ ID NO: 1363486 - RNA, 18 nt, Human
ugcucugaugcaucagaa

SEQ ID NO: 1363487 - RNA, 14 nt, Human
ugcucugauuuauc

SEQ ID NO: 1363488 - RNA, 17 nt, Human
ugcucugaugcaucaga

SEQ ID NO: 1363489 - RNA, 16 nt, Human
ugcucugaugcaucag

SEQ ID NO: 1363490 - RNA, 19 nt, Human
ugcucugaucccucuacag

SEQ ID NO: 1363491 - RNA, 16 nt, Human
ugcucugaucccucua

SEQ ID NO: 1363492 - RNA, 14 nt, Human
ugcucugaucccuc

SEQ ID NO: 1363493 - RNA, 13 nt, Human
ugcucugaucccu

SEQ ID NO: 1363494 - RNA, 12 nt, Human
ugcucuuagcug

SEQ ID NO: 1363495 - RNA, 15 nt, Human
ugcucuuagcugucu

SEQ ID NO: 1363496 - RNA, 13 nt, Human
aggaaagcaagaa

SEQ ID NO: 1363497 - RNA, 24 nt, Human
aggaaagcgccuccaacccuagca

SEQ ID NO: 1363498 - RNA, 18 nt, Human
aggaaauauuuauuuuaa

SEQ ID NO: 1363499 - RNA, 14 nt, Human
aggaaauauuuauu

SEQ ID NO: 1363500 - RNA, 18 nt, Human
agcucuccggucucucuc

SEQ ID NO: 1363501 - RNA, 18 nt, Human
ugcccucauuuuauguca

SEQ ID NO: 1363502 - RNA, 21 nt, Human
ugcccucauggccccucugac

SEQ ID NO: 1363503 - RNA, 16 nt, Human
agcucuauuaugaaug

SEQ ID NO: 1363504 - RNA, 19 nt, Human
agcucuauuaugaauguga

SEQ ID NO: 1363505 - RNA, 17 nt, Human
agcucucaguugcagcc

SEQ ID NO: 1363506 - RNA, 21 nt, Human
agcucucaguugcagcccugc

SEQ ID NO: 1363507 - RNA, 18 nt, Human
agcucuucuuaaaguauu

SEQ ID NO: 1363508 - RNA, 14 nt, Human
agcucuucuccauc

SEQ ID NO: 1363509 - RNA, 23 nt, Human
agcucuguaucaggacccagagg

SEQ ID NO: 1363510 - RNA, 22 nt, Human
agcucuguaucaggacccagag

SEQ ID NO: 1363511 - RNA, 12 nt, Human
agcucuguauca

SEQ ID NO: 1363512 - RNA, 23 nt, Human
agcucugcuauuaggccagcaag

SEQ ID NO: 1363513 - RNA, 14 nt, Human
agcugauggagaag

SEQ ID NO: 1363514 - RNA, 15 nt, Human
agcugauggagaagg

SEQ ID NO: 1363515 - RNA, 16 nt, Human
agcugauggagaagga

SEQ ID NO: 1363516 - RNA, 17 nt, Human
agcugauggagaaggaa

SEQ ID NO: 1363517 - RNA, 16 nt, Human
agcugauuaaaugaca

SEQ ID NO: 1363518 - RNA, 19 nt, Human
agcugauggagaaggaagg

SEQ ID NO: 1363519 - RNA, 21 nt, Human
ugccucauuuuuuuccuugca

SEQ ID NO: 1363520 - RNA, 16 nt, Human
ugccucauuuuuuucc

SEQ ID NO: 1363521 - RNA, 16 nt, Human
ugccggggcagccccc

SEQ ID NO: 1363522 - RNA, 24 nt, Human
ugcccuuguuuggggcaggaguag

SEQ ID NO: 1363523 - RNA, 23 nt, Human
ugcccuuguuuggggcaggagua

SEQ ID NO: 1363524 - RNA, 20 nt, Human
ugcccuuguuuggggcagga

SEQ ID NO: 1363525 - RNA, 18 nt, Human
agcugcauuccgcagccc

SEQ ID NO: 1363526 - RNA, 15 nt, Human
agcugcauuccgcag

SEQ ID NO: 1363527 - RNA, 21 nt, Human
ugcccuucuuucuacccugcu

SEQ ID NO: 1363528 - RNA, 12 nt, Human
ugccucucuaca

SEQ ID NO: 1363529 - RNA, 16 nt, Human
ugccucucugcagguc

SEQ ID NO: 1363530 - RNA, 18 nt, Human
ugccucucugcagguccc

SEQ ID NO: 1363531 - RNA, 19 nt, Human
ugccucucugcaggucccu

SEQ ID NO: 1363532 - RNA, 20 nt, Human
ugccucucugcaggucccua

SEQ ID NO: 1363533 - RNA, 15 nt, Human
agcuggagaagaccc

SEQ ID NO: 1363534 - RNA, 13 nt, Human
ugcccccugcagg

SEQ ID NO: 1363535 - RNA, 16 nt, Human
agcugggcagaaggcc

SEQ ID NO: 1363536 - RNA, 18 nt, Human
agcugggcagaaggccaa

SEQ ID NO: 1363537 - RNA, 15 nt, Human
agcugggccuggucu

SEQ ID NO: 1363538 - RNA, 15 nt, Human
agcugggcucugcaa

SEQ ID NO: 1363539 - RNA, 17 nt, Human
agcugggcuaaguaaau

SEQ ID NO: 1363540 - RNA, 13 nt, Human
agcugggccuggu

SEQ ID NO: 1363541 - RNA, 22 nt, Human
agcuggggaucccuccccccca

SEQ ID NO: 1363542 - RNA, 15 nt, Human
agcuggggaucccuc

SEQ ID NO: 1363543 - RNA, 14 nt, Human
agcuggggaccugg

SEQ ID NO: 1363544 - RNA, 17 nt, Human
agcuggggccaggcugg

SEQ ID NO: 1363545 - RNA, 16 nt, Human
agcuggaccucaccaa

SEQ ID NO: 1363546 - RNA, 15 nt, Human
agcuggaccucacca

SEQ ID NO: 1363547 - RNA, 17 nt, Human
agcuggacccugaccag

SEQ ID NO: 1363548 - RNA, 15 nt, Human
agcuggacccugacc

SEQ ID NO: 1363549 - RNA, 14 nt, Human
agcuggacccugac

SEQ ID NO: 1363550 - RNA, 15 nt, Human
agcugccuggacccg

SEQ ID NO: 1363551 - RNA, 15 nt, Human
agcugccugguauau

SEQ ID NO: 1363552 - RNA, 14 nt, Human
agcugccuggaccc

SEQ ID NO: 1363553 - RNA, 13 nt, Human
agcugccuggacc

SEQ ID NO: 1363554 - RNA, 21 nt, Human
agcugccuggaagagcagccc

SEQ ID NO: 1363555 - RNA, 20 nt, Human
agcugccuggaagagcagcc

SEQ ID NO: 1363556 - RNA, 11 nt, Human
ugccucugagg

SEQ ID NO: 1363557 - RNA, 15 nt, Human
ugccucucuaggacc

SEQ ID NO: 1363558 - RNA, 12 nt, Human
ugccucucuagg

SEQ ID NO: 1363559 - RNA, 21 nt, Human
ugccucucugcaggucccuaa

SEQ ID NO: 1363560 - RNA, 20 nt, Human
agcugccuccccucuccuuc

SEQ ID NO: 1363561 - RNA, 23 nt, Human
agcugccuccccucuccuuccug

SEQ ID NO: 1363562 - RNA, 15 nt, Human
agcugccucuucccu

SEQ ID NO: 1363563 - RNA, 19 nt, Human
agcugccucuucccucuuc

SEQ ID NO: 1363564 - RNA, 15 nt, Human
ugcgagagaugugug

SEQ ID NO: 1363565 - RNA, 14 nt, Human
ugcgagagaugugu

SEQ ID NO: 1363566 - RNA, 13 nt, Human
ugcgagagaugug

SEQ ID NO: 1363567 - RNA, 12 nt, Human
ugcgagagaugu

SEQ ID NO: 1363568 - RNA, 21 nt, Human
ugcgacuuucugccuggagug

SEQ ID NO: 1363569 - RNA, 18 nt, Human
ugcgacuuucugccugga

SEQ ID NO: 1363570 - RNA, 17 nt, Human
ugcgacuuucugccugg

SEQ ID NO: 1363571 - RNA, 16 nt, Human
ugcgacuuucugccug

SEQ ID NO: 1363572 - RNA, 15 nt, Human
ugcgacuuucugccu

SEQ ID NO: 1363573 - RNA, 23 nt, Human
ugcgagagauguguguugauacu

SEQ ID NO: 1363574 - RNA, 17 nt, Human
ugcgagagauguguguu

SEQ ID NO: 1363575 - RNA, 16 nt, Human
ugcgagagaugugugu

SEQ ID NO: 1363576 - RNA, 14 nt, Human
ugccuuuuuugauc

SEQ ID NO: 1363577 - RNA, 23 nt, Human
ugccuuuuuucuguauaaauguc

SEQ ID NO: 1363578 - RNA, 22 nt, Human
ugccuuuuuucuguauaaaugu

SEQ ID NO: 1363579 - RNA, 20 nt, Human
ugccuuuuuucuguauaaau

SEQ ID NO: 1363580 - RNA, 22 nt, Human
ugccuuuuuauuuuuguuuuua

SEQ ID NO: 1363581 - RNA, 16 nt, Human
ugccuuguuuuuuguu

SEQ ID NO: 1363582 - RNA, 20 nt, Human
ugccuuguuuuuuguuuguu

SEQ ID NO: 1363583 - RNA, 13 nt, Human
ugccuuguuucau

SEQ ID NO: 1363584 - RNA, 14 nt, Human
ugccuuuauugugu

SEQ ID NO: 1363585 - RNA, 17 nt, Human
ugccuuuauuuccacug

SEQ ID NO: 1363586 - RNA, 20 nt, Human
ugccuuuauuguguuuguca

SEQ ID NO: 1363587 - RNA, 21 nt, Human
ugccuuuauuguguuugucau

SEQ ID NO: 1363588 - RNA, 19 nt, Human
ugccuuacucuucuugaaa

SEQ ID NO: 1363589 - RNA, 18 nt, Human
ugccuuacucuucuugaa

SEQ ID NO: 1363590 - RNA, 15 nt, Human
ugccuuacucuucuu

SEQ ID NO: 1363591 - RNA, 17 nt, Human
ugccuugucacgccaga

SEQ ID NO: 1363592 - RNA, 19 nt, Human
ugccuuguguacaguuauu

SEQ ID NO: 1363593 - RNA, 19 nt, Human
agcugugcagguggggaga

SEQ ID NO: 1363594 - RNA, 18 nt, Human
agcugugcagguggggag

SEQ ID NO: 1363595 - RNA, 12 nt, Human
agcugugcaggu

SEQ ID NO: 1363596 - RNA, 10 nt, Human
agcugugcag

SEQ ID NO: 1363597 - RNA, 19 nt, Human
agcugugaguucucccugu

SEQ ID NO: 1363598 - RNA, 19 nt, Human
agcugugacuucuauuuua

SEQ ID NO: 1363599 - RNA, 23 nt, Human
agcugugaccugcugagcucuga

SEQ ID NO: 1363600 - RNA, 22 nt, Human
agcugugaccugcugagcucug

SEQ ID NO: 1363601 - RNA, 20 nt, Human
agcugugaccugcugagcuc

SEQ ID NO: 1363602 - RNA, 19 nt, Human
agcugugaccugcugagcu

SEQ ID NO: 1363603 - RNA, 18 nt, Human
agcugugaccugcugagc

SEQ ID NO: 1363604 - RNA, 17 nt, Human
agcugugaccugcugag

SEQ ID NO: 1363605 - RNA, 16 nt, Human
agcugugaccugcuga

SEQ ID NO: 1363606 - RNA, 15 nt, Human
agcugugaccugcug

SEQ ID NO: 1363607 - RNA, 14 nt, Human
agcugugaccugcu

SEQ ID NO: 1363608 - RNA, 17 nt, Human
agcugugaccucucccc

SEQ ID NO: 1363609 - RNA, 19 nt, Human
agcugucuuuuggaggacg

SEQ ID NO: 1363610 - RNA, 17 nt, Human
agcugucuuuuggagga

SEQ ID NO: 1363611 - RNA, 16 nt, Human
agcugucuuuuggagg

SEQ ID NO: 1363612 - RNA, 18 nt, Human
agcuggggugcagggaug

SEQ ID NO: 1363613 - RNA, 15 nt, Human
agcuggggugcaggg

SEQ ID NO: 1363614 - RNA, 14 nt, Human
agcuggggugcagg

SEQ ID NO: 1363615 - RNA, 22 nt, Human
agcuggggcuuugauguuccuu

SEQ ID NO: 1363616 - RNA, 20 nt, Human
agcuggggccaggcuggguc

SEQ ID NO: 1363617 - RNA, 20 nt, Human
aggcucaggcaggggccucc

SEQ ID NO: 1363618 - RNA, 16 nt, Human
aggcucaggucccugg

SEQ ID NO: 1363619 - RNA, 10 nt, Human
aggcucaggu

SEQ ID NO: 1363620 - RNA, 21 nt, Human
aggcucaggcaggggccucca

SEQ ID NO: 1363621 - RNA, 14 nt, Human
aggcucaggcaggg

SEQ ID NO: 1363622 - RNA, 20 nt, Human
aggcucagaggguguccugc

SEQ ID NO: 1363623 - RNA, 19 nt, Human
aggcucagaggguguccug

SEQ ID NO: 1363624 - RNA, 23 nt, Human
aggcucacccccuucuccaucca

SEQ ID NO: 1363625 - RNA, 21 nt, Human
aggcucacccccuucuccauc

SEQ ID NO: 1363626 - RNA, 19 nt, Human
aggcucacccccuucucca

SEQ ID NO: 1363627 - RNA, 16 nt, Human
aggcucacccccuucu

SEQ ID NO: 1363628 - RNA, 15 nt, Human
aggcucaaacaauga

SEQ ID NO: 1363629 - RNA, 14 nt, Human
aggcucacugguca

SEQ ID NO: 1363630 - RNA, 18 nt, Human
aggcucagaggguguccu

SEQ ID NO: 1363631 - RNA, 14 nt, Human
aggcuccagagggc

SEQ ID NO: 1363632 - RNA, 13 nt, Human
aggcuccagaggg

SEQ ID NO: 1363633 - RNA, 22 nt, Human
aggcuccaccccauccaguuca

SEQ ID NO: 1363634 - RNA, 23 nt, Human
aggcucaaacaaugacaaagcag

SEQ ID NO: 1363635 - RNA, 22 nt, Human
aggcuauuuguaaaucugccac

SEQ ID NO: 1363636 - RNA, 21 nt, Human
aggcuauuuguaaaucugcca

SEQ ID NO: 1363637 - RNA, 17 nt, Human
aggcuauuuguaaaucu

SEQ ID NO: 1363638 - RNA, 16 nt, Human
aggcuauuuguaaauc

SEQ ID NO: 1363639 - RNA, 11 nt, Human
aggcuauuugu

SEQ ID NO: 1363640 - RNA, 19 nt, Human
aggcuauuauuuucacugu

SEQ ID NO: 1363641 - RNA, 18 nt, Human
aggcuauuauuuucacug

SEQ ID NO: 1363642 - RNA, 16 nt, Human
aggcuauuauuuucac

SEQ ID NO: 1363643 - RNA, 22 nt, Human
aggcgcacugugacccccagcu

SEQ ID NO: 1363644 - RNA, 21 nt, Human
aggcgcacugugacccccagc

SEQ ID NO: 1363645 - RNA, 19 nt, Human
aggcgaucacaacgugcau

SEQ ID NO: 1363646 - RNA, 20 nt, Human
aggcgaucacaacgugcauu

SEQ ID NO: 1363647 - RNA, 21 nt, Human
aggcgaucacaacgugcauug

SEQ ID NO: 1363648 - RNA, 22 nt, Human
aggcgccccaacccguggaggc

SEQ ID NO: 1363649 - RNA, 21 nt, Human
aggcgccccaacccguggagg

SEQ ID NO: 1363650 - RNA, 14 nt, Human
aggccuuuaaaauu

SEQ ID NO: 1363651 - RNA, 15 nt, Human
aggccuuuaaaauuu

SEQ ID NO: 1363652 - RNA, 18 nt, Human
aggcgagaagggcugcuu

SEQ ID NO: 1363653 - RNA, 19 nt, Human
aggcgagaagggcugcuuc

SEQ ID NO: 1363654 - RNA, 16 nt, Human
aggccuuuuggaaugu

SEQ ID NO: 1363655 - RNA, 18 nt, Human
aggcgaagcguuguccuc

SEQ ID NO: 1363656 - RNA, 22 nt, Human
aggccuugcggcuccucaggga

SEQ ID NO: 1363657 - RNA, 23 nt, Human
aggccuugcggcuccucagggac

SEQ ID NO: 1363658 - RNA, 20 nt, Human
aggccuugcggcuccucagg

SEQ ID NO: 1363659 - RNA, 19 nt, Human
aggccuugcggcuccucag

SEQ ID NO: 1363660 - RNA, 19 nt, Human
uggccuguguucuuccugg

SEQ ID NO: 1363661 - RNA, 16 nt, Human
uggccugugucacuca

SEQ ID NO: 1363662 - RNA, 18 nt, Human
uggccuguagaguugcug

SEQ ID NO: 1363663 - RNA, 15 nt, Human
uggccuguagaguug

SEQ ID NO: 1363664 - RNA, 13 nt, Human
uggccuggacugu

SEQ ID NO: 1363665 - RNA, 20 nt, Human
uggccugcuaaggucuugga

SEQ ID NO: 1363666 - RNA, 20 nt, Human
uggccugcaaacugggaacc

SEQ ID NO: 1363667 - RNA, 23 nt, Human
uggccugcaaacugggaaccccu

SEQ ID NO: 1363668 - RNA, 19 nt, Human
uggccugcaaacugggaac

SEQ ID NO: 1363669 - RNA, 18 nt, Human
uggccugcaaacugggaa

SEQ ID NO: 1363670 - RNA, 17 nt, Human
uggccugcaaacuggga

SEQ ID NO: 1363671 - RNA, 16 nt, Human
uggccugcaaacuggg

SEQ ID NO: 1363672 - RNA, 15 nt, Human
uggccugcaaacugg

SEQ ID NO: 1363673 - RNA, 22 nt, Human
uggccugaucagaccacggcuc

SEQ ID NO: 1363674 - RNA, 14 nt, Human
uggccucugcuuuc

SEQ ID NO: 1363675 - RNA, 19 nt, Human
uggcccuugcuuaccucuc

SEQ ID NO: 1363676 - RNA, 21 nt, Human
uggcccuuccuggacagcugu

SEQ ID NO: 1363677 - RNA, 18 nt, Human
uggcccuuccuggacagc

SEQ ID NO: 1363678 - RNA, 17 nt, Human
uggcccuuccuggacag

SEQ ID NO: 1363679 - RNA, 16 nt, Human
uggcccuuccuggaca

SEQ ID NO: 1363680 - RNA, 15 nt, Human
uggcccuuccuggac

SEQ ID NO: 1363681 - RNA, 13 nt, Human
uggcccuuccugg

SEQ ID NO: 1363682 - RNA, 21 nt, Human
uggcccuuaugacugccaaga

SEQ ID NO: 1363683 - RNA, 12 nt, Human
uggccucugcuu

SEQ ID NO: 1363684 - RNA, 20 nt, Human
uggcccuuccuggacagcug

SEQ ID NO: 1363685 - RNA, 15 nt, Human
uggccgaguccaagc

SEQ ID NO: 1363686 - RNA, 13 nt, Human
uggcccagccuuu

SEQ ID NO: 1363687 - RNA, 12 nt, Human
uggcccagccuu

SEQ ID NO: 1363688 - RNA, 11 nt, Human
uggcccagccu

SEQ ID NO: 1363689 - RNA, 19 nt, Human
uggcccucuccccugcccc

SEQ ID NO: 1363690 - RNA, 18 nt, Human
uggcccucuccccugccc

SEQ ID NO: 1363691 - RNA, 17 nt, Human
uggcccucuccccugcc

SEQ ID NO: 1363692 - RNA, 16 nt, Human
uggcccucuccccugc

SEQ ID NO: 1363693 - RNA, 21 nt, Human
uggcccucuccccugcccccu

SEQ ID NO: 1363694 - RNA, 15 nt, Human
uggcccugcaaaagg

SEQ ID NO: 1363695 - RNA, 17 nt, Human
uggcauuagaauuauuu

SEQ ID NO: 1363696 - RNA, 19 nt, Human
uggcauuacagcuggagaa

SEQ ID NO: 1363697 - RNA, 20 nt, Human
uggcauguuagcccuuccuc

SEQ ID NO: 1363698 - RNA, 12 nt, Human
uggcauguguuu

SEQ ID NO: 1363699 - RNA, 13 nt, Human
aggccauuauugu

SEQ ID NO: 1363700 - RNA, 15 nt, Human
aggccauucuuuccc

SEQ ID NO: 1363701 - RNA, 14 nt, Human
aggccauucuuucc

SEQ ID NO: 1363702 - RNA, 17 nt, Human
aggccagagcccacucc

SEQ ID NO: 1363703 - RNA, 18 nt, Human
aggccagaggcccccagc

SEQ ID NO: 1363704 - RNA, 15 nt, Human
aggccagagcccacu

SEQ ID NO: 1363705 - RNA, 14 nt, Human
aggccagagcccac

SEQ ID NO: 1363706 - RNA, 14 nt, Human
aggccagagccaag

SEQ ID NO: 1363707 - RNA, 18 nt, Human
aggcauccuuccucacac

SEQ ID NO: 1363708 - RNA, 20 nt, Human
aggcauccuuccucacacca

SEQ ID NO: 1363709 - RNA, 21 nt, Human
uggcaccagacacccaggacu

SEQ ID NO: 1363710 - RNA, 20 nt, Human
uggcaccagacacccaggac

SEQ ID NO: 1363711 - RNA, 16 nt, Human
uggcacaggcccccuu

SEQ ID NO: 1363712 - RNA, 21 nt, Human
uggcacaggaguguccucuuc

SEQ ID NO: 1363713 - RNA, 14 nt, Human
uggcacaggacaug

SEQ ID NO: 1363714 - RNA, 22 nt, Human
uggcacagccuggcuguggccu

SEQ ID NO: 1363715 - RNA, 23 nt, Human
uggcaccagacacccaggacuua

SEQ ID NO: 1363716 - RNA, 20 nt, Human
uggcagauguaggagggacu

SEQ ID NO: 1363717 - RNA, 19 nt, Human
uggcagauguaggagggac

SEQ ID NO: 1363718 - RNA, 18 nt, Human
uggcagauguaggaggga

SEQ ID NO: 1363719 - RNA, 17 nt, Human
uggcagauguaggaggg

SEQ ID NO: 1363720 - RNA, 15 nt, Human
uggcagauguaggag

SEQ ID NO: 1363721 - RNA, 20 nt, Human
uggcagcaacggcacagcua

SEQ ID NO: 1363722 - RNA, 13 nt, Human
uggcagcaacaau

SEQ ID NO: 1363723 - RNA, 22 nt, Human
aggccgugacgucuggguggcc

SEQ ID NO: 1363724 - RNA, 21 nt, Human
aggccgugacgucuggguggc

SEQ ID NO: 1363725 - RNA, 20 nt, Human
aggccgugacgucugggugg

SEQ ID NO: 1363726 - RNA, 17 nt, Human
aggccgugacgucuggg

SEQ ID NO: 1363727 - RNA, 14 nt, Human
aggccgggaaaaag

SEQ ID NO: 1363728 - RNA, 18 nt, Human
aggccgggaaaaagccca

SEQ ID NO: 1363729 - RNA, 14 nt, Human
aggcccgagcagcu

SEQ ID NO: 1363730 - RNA, 21 nt, Human
aggccccugucucagggugag

SEQ ID NO: 1363731 - RNA, 23 nt, Human
aggccugaaagaggcugaggccu

SEQ ID NO: 1363732 - RNA, 21 nt, Human
aggccugaaagaggcugaggc

SEQ ID NO: 1363733 - RNA, 17 nt, Human
aggccugaaagaggcug

SEQ ID NO: 1363734 - RNA, 17 nt, Human
aggccuaguccugcgaa

SEQ ID NO: 1363735 - RNA, 15 nt, Human
aggccuaguccugcg

SEQ ID NO: 1363736 - RNA, 17 nt, Human
aggccuaggauucuaaa

SEQ ID NO: 1363737 - RNA, 16 nt, Human
aggccuaggauucuaa

SEQ ID NO: 1363738 - RNA, 15 nt, Human
aggccuaggauucua

SEQ ID NO: 1363739 - RNA, 21 nt, Human
aggccuaggaggguccucuga

SEQ ID NO: 1363740 - RNA, 18 nt, Human
aggccuaggaggguccuc

SEQ ID NO: 1363741 - RNA, 17 nt, Human
aggccuaggaggguccu

SEQ ID NO: 1363742 - RNA, 22 nt, Human
aggccuaccccgcagacaccuu

SEQ ID NO: 1363743 - RNA, 19 nt, Human
aggccuaccccgcagacac

SEQ ID NO: 1363744 - RNA, 16 nt, Human
aggccuaccccgcaga

SEQ ID NO: 1363745 - RNA, 22 nt, Human
aggccuaauucuaugccugucu

SEQ ID NO: 1363746 - RNA, 19 nt, Human
aggccuaauucuaugccug

SEQ ID NO: 1363747 - RNA, 15 nt, Human
aggccguggcugcug

SEQ ID NO: 1363748 - RNA, 20 nt, Human
aggccguggcugcuguggga

SEQ ID NO: 1363749 - RNA, 22 nt, Human
aggccuggacuuuccugcaacu

SEQ ID NO: 1363750 - RNA, 19 nt, Human
aggccuggacuuuccugca

SEQ ID NO: 1363751 - RNA, 18 nt, Human
aggccuggacuuuccugc

SEQ ID NO: 1363752 - RNA, 17 nt, Human
aggccuggacuuuccug

SEQ ID NO: 1363753 - RNA, 22 nt, Human
uggcauccagagucccugccug

SEQ ID NO: 1363754 - RNA, 21 nt, Human
uggcauccagagucccugccu

SEQ ID NO: 1363755 - RNA, 20 nt, Human
uggcauccagagucccugcc

SEQ ID NO: 1363756 - RNA, 18 nt, Human
uggcaucaucucagcuca

SEQ ID NO: 1363757 - RNA, 23 nt, Human
aggcaggaccuucgggcugugcc

SEQ ID NO: 1363758 - RNA, 22 nt, Human
aggcaggaccuucgggcugugc

SEQ ID NO: 1363759 - RNA, 21 nt, Human
aggcaggaccuucgggcugug

SEQ ID NO: 1363760 - RNA, 20 nt, Human
aggcaggaguuucguuuuca

SEQ ID NO: 1363761 - RNA, 23 nt, Human
aggcagggaacauggggaggagg

SEQ ID NO: 1363762 - RNA, 17 nt, Human
aggcaggagaaucacuu

SEQ ID NO: 1363763 - RNA, 22 nt, Human
aggcagggaggaggcagagaag

SEQ ID NO: 1363764 - RNA, 21 nt, Human
aggcagggaacauggggagga

SEQ ID NO: 1363765 - RNA, 16 nt, Human
aggcaccaggaagccg

SEQ ID NO: 1363766 - RNA, 15 nt, Human
aggcaccaggaagcc

SEQ ID NO: 1363767 - RNA, 14 nt, Human
aggcaccaggaagc

SEQ ID NO: 1363768 - RNA, 14 nt, Human
aggcagccucuggg

SEQ ID NO: 1363769 - RNA, 13 nt, Human
aggcagccucugg

SEQ ID NO: 1363770 - RNA, 23 nt, Human
aggcagccgugggccccacccuc

SEQ ID NO: 1363771 - RNA, 21 nt, Human
aggcagccucugggggguggc

SEQ ID NO: 1363772 - RNA, 22 nt, Human
aggcagccucugggggguggcc

SEQ ID NO: 1363773 - RNA, 16 nt, Human
aggcagccucuggggg

SEQ ID NO: 1363774 - RNA, 15 nt, Human
aggcagccucugggg

SEQ ID NO: 1363775 - RNA, 20 nt, Human
aggcagcucuaaaugucaau

SEQ ID NO: 1363776 - RNA, 14 nt, Human
aggcagggugcagu

SEQ ID NO: 1363777 - RNA, 23 nt, Human
aggcaguuaccauuaaaccaucu

SEQ ID NO: 1363778 - RNA, 22 nt, Human
aggcaguuaccauuaaaccauc

SEQ ID NO: 1363779 - RNA, 21 nt, Human
aggcaguuaccauuaaaccau

SEQ ID NO: 1363780 - RNA, 18 nt, Human
aggcaguuaccauuaaac

SEQ ID NO: 1363781 - RNA, 24 nt, Human
aggcaguuaccauuaaaccaucuc

SEQ ID NO: 1363782 - RNA, 18 nt, Human
aggcaguucaaagcagga

SEQ ID NO: 1363783 - RNA, 19 nt, Human
aggcaguucaaagcaggau

SEQ ID NO: 1363784 - RNA, 20 nt, Human
uggacccguucaugggggag

SEQ ID NO: 1363785 - RNA, 16 nt, Human
uggaccccugcauugg

SEQ ID NO: 1363786 - RNA, 13 nt, Human
uggaccccugcau

SEQ ID NO: 1363787 - RNA, 12 nt, Human
uggaccccugca

SEQ ID NO: 1363788 - RNA, 21 nt, Human
uggacccguucaugggggagg

SEQ ID NO: 1363789 - RNA, 22 nt, Human
uggacccguucaugggggaggg

SEQ ID NO: 1363790 - RNA, 23 nt, Human
uggaccccccuuucacaggcagc

SEQ ID NO: 1363791 - RNA, 22 nt, Human
uggaccccccuuucacaggcag

SEQ ID NO: 1363792 - RNA, 20 nt, Human
uggaccccccuuucacaggc

SEQ ID NO: 1363793 - RNA, 17 nt, Human
uggaccccccuuucaca

SEQ ID NO: 1363794 - RNA, 15 nt, Human
uggaccccccuuuca

SEQ ID NO: 1363795 - RNA, 17 nt, Human
uggacaccugcccugcc

SEQ ID NO: 1363796 - RNA, 18 nt, Human
uggacaccugcccugccc

SEQ ID NO: 1363797 - RNA, 23 nt, Human
uggacaccugcccugcccugcca

SEQ ID NO: 1363798 - RNA, 17 nt, Human
uggagaagacccucccc

SEQ ID NO: 1363799 - RNA, 16 nt, Human
uggagaagaacugaaa

SEQ ID NO: 1363800 - RNA, 16 nt, Human
uggagcccacuguacu

SEQ ID NO: 1363801 - RNA, 19 nt, Human
uggagcccacuguacuugc

SEQ ID NO: 1363802 - RNA, 23 nt, Human
uggagcccacuguacuugcucuu

SEQ ID NO: 1363803 - RNA, 13 nt, Human
aggcaccaggaag

SEQ ID NO: 1363804 - RNA, 12 nt, Human
aggcaccaggaa

SEQ ID NO: 1363805 - RNA, 11 nt, Human
aggcaccagga

SEQ ID NO: 1363806 - RNA, 18 nt, Human
aggcaccaaaagaaguaa

SEQ ID NO: 1363807 - RNA, 20 nt, Human
aggcaccaaaagaaguaaaa

SEQ ID NO: 1363808 - RNA, 17 nt, Human
aggcaccaaaagaagua

SEQ ID NO: 1363809 - RNA, 16 nt, Human
aggcacaugucagcaa

SEQ ID NO: 1363810 - RNA, 21 nt, Human
aggcaauuagacacuuuggaa

SEQ ID NO: 1363811 - RNA, 12 nt, Human
aggcaauuagac

SEQ ID NO: 1363812 - RNA, 21 nt, Human
uggagcuucauggcagaaggc

SEQ ID NO: 1363813 - RNA, 12 nt, Human
uggagcugagca

SEQ ID NO: 1363814 - RNA, 12 nt, Human
uggagccgaggc

SEQ ID NO: 1363815 - RNA, 17 nt, Human
uggagccgaggccuacc

SEQ ID NO: 1363816 - RNA, 20 nt, Human
aggauuugguccgucauaac

SEQ ID NO: 1363817 - RNA, 20 nt, Human
aggauuucaugauuucauuu

SEQ ID NO: 1363818 - RNA, 19 nt, Human
aggauuucaugauuucauu

SEQ ID NO: 1363819 - RNA, 17 nt, Human
aggauuuauuuaaaaua

SEQ ID NO: 1363820 - RNA, 21 nt, Human
aggauuggggaagagagccug

SEQ ID NO: 1363821 - RNA, 12 nt, Human
aggauuggggaa

SEQ ID NO: 1363822 - RNA, 13 nt, Human
aggaugcuuggga

SEQ ID NO: 1363823 - RNA, 18 nt, Human
aggaugcuuguacauaau

SEQ ID NO: 1363824 - RNA, 23 nt, Human
aggaugcuaacaucuaaaaauag

SEQ ID NO: 1363825 - RNA, 22 nt, Human
aggaugcuaacaucuaaaaaua

SEQ ID NO: 1363826 - RNA, 15 nt, Human
aggaugcuuguacau

SEQ ID NO: 1363827 - RNA, 16 nt, Human
aggaugcuuguacaua

SEQ ID NO: 1363828 - RNA, 18 nt, Human
aggaucucaccaggcagc

SEQ ID NO: 1363829 - RNA, 23 nt, Human
aggaucucaccaggcagccucug

SEQ ID NO: 1363830 - RNA, 17 nt, Human
aggaucucaccaggcag

SEQ ID NO: 1363831 - RNA, 21 nt, Human
aggaucuauuuuuggagguuu

SEQ ID NO: 1363832 - RNA, 20 nt, Human
aggaucuauuuuuggagguu

SEQ ID NO: 1363833 - RNA, 19 nt, Human
aggaucuauuuuuggaggu

SEQ ID NO: 1363834 - RNA, 18 nt, Human
aggaucuauuuuuggagg

SEQ ID NO: 1363835 - RNA, 16 nt, Human
uggaauuugccugcug

SEQ ID NO: 1363836 - RNA, 14 nt, Human
uggaauuugaaaca

SEQ ID NO: 1363837 - RNA, 17 nt, Human
uggaauuugccugcugg

SEQ ID NO: 1363838 - RNA, 22 nt, Human
uggacaaaucacauauuuuaaa

SEQ ID NO: 1363839 - RNA, 10 nt, Human
uggacaccug

SEQ ID NO: 1363840 - RNA, 11 nt, Human
uggacaccugc

SEQ ID NO: 1363841 - RNA, 12 nt, Human
uggacaccugcc

SEQ ID NO: 1363842 - RNA, 13 nt, Human
uggacaccugccc

SEQ ID NO: 1363843 - RNA, 14 nt, Human
uggacaccugcccu

SEQ ID NO: 1363844 - RNA, 15 nt, Human
uggacaccugcccug

SEQ ID NO: 1363845 - RNA, 16 nt, Human
uggacaccugcccugc

SEQ ID NO: 1363846 - RNA, 22 nt, Human
uggaauuuugcaaagauuuaau

SEQ ID NO: 1363847 - RNA, 15 nt, Human
uggaauuuugcaaag

SEQ ID NO: 1363848 - RNA, 23 nt, Human
uggaauuuugcaaagauuuaauc

SEQ ID NO: 1363849 - RNA, 14 nt, Human
uggacaaaauggaa

SEQ ID NO: 1363850 - RNA, 23 nt, Human
uggacaaaucacauauuuuaaaa

SEQ ID NO: 1363851 - RNA, 21 nt, Human
uggacaaaucacauauuuuaa

SEQ ID NO: 1363852 - RNA, 15 nt, Human
uggacaaaucacaua

SEQ ID NO: 1363853 - RNA, 15 nt, Human
uggacaaagaaccuu

SEQ ID NO: 1363854 - RNA, 19 nt, Human
uggacaaaacaagaaagac

SEQ ID NO: 1363855 - RNA, 17 nt, Human
uggacaaaauggaauac

SEQ ID NO: 1363856 - RNA, 17 nt, Human
uggaaguccaauguggc

SEQ ID NO: 1363857 - RNA, 18 nt, Human
uggaagcugcccugccca

SEQ ID NO: 1363858 - RNA, 17 nt, Human
uggaagcugcccugccc

SEQ ID NO: 1363859 - RNA, 20 nt, Human
uggaagcuagacacaugaag

SEQ ID NO: 1363860 - RNA, 23 nt, Human
uggaagcuagacacaugaaggua

SEQ ID NO: 1363861 - RNA, 19 nt, Human
uggaagcuagacacaugaa

SEQ ID NO: 1363862 - RNA, 21 nt, Human
uggaacacuagacaagccaga

SEQ ID NO: 1363863 - RNA, 18 nt, Human
uggaagcuaauuugcauu

SEQ ID NO: 1363864 - RNA, 17 nt, Human
uggaagcuaauuugcau

SEQ ID NO: 1363865 - RNA, 16 nt, Human
uggaagcuaauuugca

SEQ ID NO: 1363866 - RNA, 22 nt, Human
uggaacacuagacaagccagaa

SEQ ID NO: 1363867 - RNA, 20 nt, Human
uggaacacuagacaagccag

SEQ ID NO: 1363868 - RNA, 17 nt, Human
uggaacacggccacauc

SEQ ID NO: 1363869 - RNA, 15 nt, Human
uggaacacggccaca

SEQ ID NO: 1363870 - RNA, 15 nt, Human
uggaacaccaggcug

SEQ ID NO: 1363871 - RNA, 14 nt, Human
uggaacaccaggcu

SEQ ID NO: 1363872 - RNA, 17 nt, Human
ugcugcccauguuucaa

SEQ ID NO: 1363873 - RNA, 21 nt, Human
ugcugccccaucagugcuccc

SEQ ID NO: 1363874 - RNA, 19 nt, Human
ugcugccccaucagugcuc

SEQ ID NO: 1363875 - RNA, 18 nt, Human
ugcugccccaucagugcu

SEQ ID NO: 1363876 - RNA, 16 nt, Human
ugcugcccauguuuca

SEQ ID NO: 1363877 - RNA, 14 nt, Human
aggaguuuggagga

SEQ ID NO: 1363878 - RNA, 19 nt, Human
aggaguuucguuuucaaaa

SEQ ID NO: 1363879 - RNA, 14 nt, Human
uggaagugcuaauu

SEQ ID NO: 1363880 - RNA, 19 nt, Human
uggaagugaaaacuuugua

SEQ ID NO: 1363881 - RNA, 18 nt, Human
uggaagugaaaacuuugu

SEQ ID NO: 1363882 - RNA, 15 nt, Human
uggaagugacuuugg

SEQ ID NO: 1363883 - RNA, 17 nt, Human
uggaagugacuuuggcu

SEQ ID NO: 1363884 - RNA, 23 nt, Human
uggaagugacuuuggcugcaugc

SEQ ID NO: 1363885 - RNA, 14 nt, Human
agggagucugccag

SEQ ID NO: 1363886 - RNA, 13 nt, Human
agggagucugcca

SEQ ID NO: 1363887 - RNA, 15 nt, Human
agggagggcugucau

SEQ ID NO: 1363888 - RNA, 20 nt, Human
agggagggcucugaggcgcc

SEQ ID NO: 1363889 - RNA, 18 nt, Human
agggagggcucugaggcg

SEQ ID NO: 1363890 - RNA, 17 nt, Human
agggagggcucugaggc

SEQ ID NO: 1363891 - RNA, 16 nt, Human
agggagggcucugagg

SEQ ID NO: 1363892 - RNA, 15 nt, Human
agggagggcucugag

SEQ ID NO: 1363893 - RNA, 14 nt, Human
agggagggcucuga

SEQ ID NO: 1363894 - RNA, 13 nt, Human
agggagggcucug

SEQ ID NO: 1363895 - RNA, 12 nt, Human
agggagggcucu

SEQ ID NO: 1363896 - RNA, 21 nt, Human
agggagggcagagcuggugcg

SEQ ID NO: 1363897 - RNA, 20 nt, Human
agggagggcagagcuggugc

SEQ ID NO: 1363898 - RNA, 19 nt, Human
agggagggcagagcuggug

SEQ ID NO: 1363899 - RNA, 18 nt, Human
agggagggcagagcuggu

SEQ ID NO: 1363900 - RNA, 17 nt, Human
agggagggcagagcugg

SEQ ID NO: 1363901 - RNA, 16 nt, Human
agggagggcagagcug

SEQ ID NO: 1363902 - RNA, 12 nt, Human
agggagggcaga

SEQ ID NO: 1363903 - RNA, 13 nt, Human
agggagggagugg

SEQ ID NO: 1363904 - RNA, 16 nt, Human
ugggccaacucaccug

SEQ ID NO: 1363905 - RNA, 23 nt, Human
ugggccaacaaagaacacuaacu

SEQ ID NO: 1363906 - RNA, 22 nt, Human
agggcaguucgcagccacccug

SEQ ID NO: 1363907 - RNA, 16 nt, Human
agggcauaaauuauug

SEQ ID NO: 1363908 - RNA, 23 nt, Human
agggcaguucgcagccacccuga

SEQ ID NO: 1363909 - RNA, 21 nt, Human
agggccaagcccagcacugcu

SEQ ID NO: 1363910 - RNA, 16 nt, Human
agggccaaagaaccaa

SEQ ID NO: 1363911 - RNA, 23 nt, Human
agggccaaagaaccaaagaagaa

SEQ ID NO: 1363912 - RNA, 13 nt, Human
agggccaaagaac

SEQ ID NO: 1363913 - RNA, 21 nt, Human
agggcaguucgcagccacccu

SEQ ID NO: 1363914 - RNA, 20 nt, Human
agggcaguucgcagccaccc

SEQ ID NO: 1363915 - RNA, 19 nt, Human
agggcaguucgcagccacc

SEQ ID NO: 1363916 - RNA, 18 nt, Human
agggcaguucgcagccac

SEQ ID NO: 1363917 - RNA, 17 nt, Human
agggcaguucgcagcca

SEQ ID NO: 1363918 - RNA, 16 nt, Human
agggcaguucgcagcc

SEQ ID NO: 1363919 - RNA, 14 nt, Human
agggcaguucgcag

SEQ ID NO: 1363920 - RNA, 12 nt, Human
agggcagaguga

SEQ ID NO: 1363921 - RNA, 16 nt, Human
agggcagagcuggugc

SEQ ID NO: 1363922 - RNA, 17 nt, Human
agggcagagcuggugcg

SEQ ID NO: 1363923 - RNA, 15 nt, Human
agggcagagcuggug

SEQ ID NO: 1363924 - RNA, 14 nt, Human
agggcagagcuggu

SEQ ID NO: 1363925 - RNA, 13 nt, Human
agggcagagcugg

SEQ ID NO: 1363926 - RNA, 12 nt, Human
agggcagagcug

SEQ ID NO: 1363927 - RNA, 17 nt, Human
agggaguguucccuauc

SEQ ID NO: 1363928 - RNA, 20 nt, Human
agggcagaccacauugcuuu

SEQ ID NO: 1363929 - RNA, 19 nt, Human
agggccccucacccugccu

SEQ ID NO: 1363930 - RNA, 14 nt, Human
agggcuccagcccc

SEQ ID NO: 1363931 - RNA, 13 nt, Human
agggccccucucc

SEQ ID NO: 1363932 - RNA, 12 nt, Human
agggccccucuc

SEQ ID NO: 1363933 - RNA, 18 nt, Human
agggccccucuccccagg

SEQ ID NO: 1363934 - RNA, 21 nt, Human
agggcccagagcccagcucca

SEQ ID NO: 1363935 - RNA, 20 nt, Human
agggcccagagcccagcucc

SEQ ID NO: 1363936 - RNA, 19 nt, Human
agggcccagagcccagcuc

SEQ ID NO: 1363937 - RNA, 18 nt, Human
agggcccagagcccagcu

SEQ ID NO: 1363938 - RNA, 17 nt, Human
agggcccagagcccagc

SEQ ID NO: 1363939 - RNA, 19 nt, Human
agggccacaucccacugcc

SEQ ID NO: 1363940 - RNA, 20 nt, Human
agggcugcuucccugaagcu

SEQ ID NO: 1363941 - RNA, 18 nt, Human
agggcuccuugugggccu

SEQ ID NO: 1363942 - RNA, 16 nt, Human
agggcugagcugggga

SEQ ID NO: 1363943 - RNA, 17 nt, Human
agggcugagcucucugu

SEQ ID NO: 1363944 - RNA, 12 nt, Human
agggcuccuggg

SEQ ID NO: 1363945 - RNA, 11 nt, Human
agggcuccugc

SEQ ID NO: 1363946 - RNA, 23 nt, Human
agggcuccagccccucuuggaga

SEQ ID NO: 1363947 - RNA, 20 nt, Human
agggcuccagccccucuugg

SEQ ID NO: 1363948 - RNA, 15 nt, Human
agggcuccagccccu

SEQ ID NO: 1363949 - RNA, 15 nt, Human
agggcuccuauucaa

SEQ ID NO: 1363950 - RNA, 14 nt, Human
ugggcucugaugaa

SEQ ID NO: 1363951 - RNA, 13 nt, Human
ugggcucugauga

SEQ ID NO: 1363952 - RNA, 11 nt, Human
ugggcucugau

SEQ ID NO: 1363953 - RNA, 21 nt, Human
ugggcucugaguaccccugcu

SEQ ID NO: 1363954 - RNA, 18 nt, Human
ugggcuccuggacccccc

SEQ ID NO: 1363955 - RNA, 13 nt, Human
ugggcuccuggac

SEQ ID NO: 1363956 - RNA, 12 nt, Human
ugggcuccugga

SEQ ID NO: 1363957 - RNA, 11 nt, Human
ugggcuccugg

SEQ ID NO: 1363958 - RNA, 18 nt, Human
ugggcuccgugugggaga

SEQ ID NO: 1363959 - RNA, 23 nt, Human
ugggcuccuccagggugugugcu

SEQ ID NO: 1363960 - RNA, 15 nt, Human
ugggcuccuccaggg

SEQ ID NO: 1363961 - RNA, 13 nt, Human
ugggcuccuccag

SEQ ID NO: 1363962 - RNA, 21 nt, Human
ugggcuccggaggacucacca

SEQ ID NO: 1363963 - RNA, 19 nt, Human
ugggcucccugacugggag

SEQ ID NO: 1363964 - RNA, 15 nt, Human
ugggcucccugacug

SEQ ID NO: 1363965 - RNA, 11 nt, Human
ugggcucccug

SEQ ID NO: 1363966 - RNA, 19 nt, Human
ugggcucagugaaguugcu

SEQ ID NO: 1363967 - RNA, 14 nt, Human
ugggcucagugaag

SEQ ID NO: 1363968 - RNA, 18 nt, Human
agggcugggaggaaggac

SEQ ID NO: 1363969 - RNA, 16 nt, Human
agggcugggaggaagg

SEQ ID NO: 1363970 - RNA, 14 nt, Human
agggcugggaggaa

SEQ ID NO: 1363971 - RNA, 12 nt, Human
agggcugggagg

SEQ ID NO: 1363972 - RNA, 17 nt, Human
agggcuggcuggccuca

SEQ ID NO: 1363973 - RNA, 20 nt, Human
agggcuggcuggccucaccc

SEQ ID NO: 1363974 - RNA, 13 nt, Human
agggcuggcuggc

SEQ ID NO: 1363975 - RNA, 12 nt, Human
agggcuggcugg

SEQ ID NO: 1363976 - RNA, 17 nt, Human
agggcuggcucaauuga

SEQ ID NO: 1363977 - RNA, 21 nt, Human
agggcuggaggcccaggcugg

SEQ ID NO: 1363978 - RNA, 19 nt, Human
agggcuggaggcccaggcu

SEQ ID NO: 1363979 - RNA, 18 nt, Human
agggcuggaggcccaggc

SEQ ID NO: 1363980 - RNA, 17 nt, Human
agggcuggaggcccagg

SEQ ID NO: 1363981 - RNA, 16 nt, Human
agggcuggaggcccag

SEQ ID NO: 1363982 - RNA, 15 nt, Human
agggcuggaggccca

SEQ ID NO: 1363983 - RNA, 18 nt, Human
ugggcucaaccagaaaag

SEQ ID NO: 1363984 - RNA, 19 nt, Human
agggcuguaacugccaggc

SEQ ID NO: 1363985 - RNA, 20 nt, Human
agggcugucaucugugcacu

SEQ ID NO: 1363986 - RNA, 19 nt, Human
agggcugucaucugugcac

SEQ ID NO: 1363987 - RNA, 18 nt, Human
agggcugucaucugugca

SEQ ID NO: 1363988 - RNA, 20 nt, Human
agggcuguaacugccaggcu

SEQ ID NO: 1363989 - RNA, 18 nt, Human
agggcuguaacugccagg

SEQ ID NO: 1363990 - RNA, 22 nt, Human
agggcuguuauaaucuuucaca

SEQ ID NO: 1363991 - RNA, 17 nt, Human
agggagccauuugagag

SEQ ID NO: 1363992 - RNA, 15 nt, Human
agggagccauuugag

SEQ ID NO: 1363993 - RNA, 16 nt, Human
agggagccauguuuca

SEQ ID NO: 1363994 - RNA, 21 nt, Human
agggagccaagggauggacau

SEQ ID NO: 1363995 - RNA, 20 nt, Human
agggagccaagggauggaca

SEQ ID NO: 1363996 - RNA, 17 nt, Human
agggagccaagggaugg

SEQ ID NO: 1363997 - RNA, 16 nt, Human
agggagccaagggaug

SEQ ID NO: 1363998 - RNA, 15 nt, Human
agggagccaagggau

SEQ ID NO: 1363999 - RNA, 14 nt, Human
agggagccaaggga

SEQ ID NO: 1364000 - RNA, 13 nt, Human
agggagccaaggg

SEQ ID NO: 1364001 - RNA, 12 nt, Human
agggagccaagg

SEQ ID NO: 1364002 - RNA, 11 nt, Human
agggagccaag

SEQ ID NO: 1364003 - RNA, 10 nt, Human
agggagccaa

SEQ ID NO: 1364004 - RNA, 17 nt, Human
agggagcaugagaggag

SEQ ID NO: 1364005 - RNA, 20 nt, Human
agggagcaugagaggaggca

SEQ ID NO: 1364006 - RNA, 19 nt, Human
agggagcggccggccagcc

SEQ ID NO: 1364007 - RNA, 14 nt, Human
agggagccuggccc

SEQ ID NO: 1364008 - RNA, 22 nt, Human
agggagcggccggccagccccu

SEQ ID NO: 1364009 - RNA, 21 nt, Human
agggagcggccggccagcccc

SEQ ID NO: 1364010 - RNA, 19 nt, Human
ugggacuagccuggcuugg

SEQ ID NO: 1364011 - RNA, 17 nt, Human
ugggacuagccuggcuu

SEQ ID NO: 1364012 - RNA, 15 nt, Human
ugggagaaaugaaaa

SEQ ID NO: 1364013 - RNA, 22 nt, Human
agggacuucaggaucaaguccu

SEQ ID NO: 1364014 - RNA, 18 nt, Human
agggaaaggccagcacuc

SEQ ID NO: 1364015 - RNA, 13 nt, Human
agggaaaggccag

SEQ ID NO: 1364016 - RNA, 13 nt, Human
agggaaagcccau

SEQ ID NO: 1364017 - RNA, 22 nt, Human
agggaaagcccauaugcuacca

SEQ ID NO: 1364018 - RNA, 13 nt, Human
agggaaauuucag

SEQ ID NO: 1364019 - RNA, 20 nt, Human
agggagacacuggccccuca

SEQ ID NO: 1364020 - RNA, 13 nt, Human
agggagaagcucc

SEQ ID NO: 1364021 - RNA, 21 nt, Human
agggagacuggguaggaaaga

SEQ ID NO: 1364022 - RNA, 13 nt, Human
ugggaggcucacc

SEQ ID NO: 1364023 - RNA, 19 nt, Human
ugggagaaaucuggcuucu

SEQ ID NO: 1364024 - RNA, 16 nt, Human
ugggagaaaugaaaaa

SEQ ID NO: 1364025 - RNA, 22 nt, Human
ugggagggaggcucaggucccu

SEQ ID NO: 1364026 - RNA, 17 nt, Human
ugggagggaggcucagg

SEQ ID NO: 1364027 - RNA, 16 nt, Human
ugggagggaggcucag

SEQ ID NO: 1364028 - RNA, 15 nt, Human
ugggaggcuccccuu

SEQ ID NO: 1364029 - RNA, 14 nt, Human
ugggaggcuccccu

SEQ ID NO: 1364030 - RNA, 22 nt, Human
ugggaggcucacccccuucucc

SEQ ID NO: 1364031 - RNA, 20 nt, Human
ugggaggcucacccccuucu

SEQ ID NO: 1364032 - RNA, 14 nt, Human
ugggaggcucugga

SEQ ID NO: 1364033 - RNA, 17 nt, Human
ugggaggcucuggagcc

SEQ ID NO: 1364034 - RNA, 23 nt, Human
ugggaggcucuggagcccacugu

SEQ ID NO: 1364035 - RNA, 21 nt, Human
ugggcaaagccuagugaaggc

SEQ ID NO: 1364036 - RNA, 15 nt, Human
ugggcaaagccuagu

SEQ ID NO: 1364037 - RNA, 22 nt, Human
ugggcaagcuggcggcuggggu

SEQ ID NO: 1364038 - RNA, 19 nt, Human
ugggagggcagcagggcua

SEQ ID NO: 1364039 - RNA, 18 nt, Human
ugggagggcagcagggcu

SEQ ID NO: 1364040 - RNA, 17 nt, Human
ugggagggcagcagggc

SEQ ID NO: 1364041 - RNA, 14 nt, Human
ugggagggcagcag

SEQ ID NO: 1364042 - RNA, 15 nt, Human
ugggcaauugucuga

SEQ ID NO: 1364043 - RNA, 19 nt, Human
ugggcaaugauggcaauuu

SEQ ID NO: 1364044 - RNA, 14 nt, Human
ugggcauucaaaug

SEQ ID NO: 1364045 - RNA, 20 nt, Human
aggcuugguuccuucccaau

SEQ ID NO: 1364046 - RNA, 19 nt, Human
aggcuugguuccuucccaa

SEQ ID NO: 1364047 - RNA, 14 nt, Human
aggcuugguuccuu

SEQ ID NO: 1364048 - RNA, 17 nt, Human
aggcuuggggcuggaga

SEQ ID NO: 1364049 - RNA, 21 nt, Human
aggcuugggauuugcugugua

SEQ ID NO: 1364050 - RNA, 17 nt, Human
aggcuugccugcaggca

SEQ ID NO: 1364051 - RNA, 16 nt, Human
aggcuugccugcaggc

SEQ ID NO: 1364052 - RNA, 15 nt, Human
aggcuugccugcagg

SEQ ID NO: 1364053 - RNA, 21 nt, Human
aggcuucugcuggggccuggg

SEQ ID NO: 1364054 - RNA, 21 nt, Human
aggcuuccuucauuuccuccg

SEQ ID NO: 1364055 - RNA, 15 nt, Human
aggcuucugagcagc

SEQ ID NO: 1364056 - RNA, 16 nt, Human
aggcuucucucugugg

SEQ ID NO: 1364057 - RNA, 19 nt, Human
aggcuucugcuggggccug

SEQ ID NO: 1364058 - RNA, 18 nt, Human
aggcuucugcuggggccu

SEQ ID NO: 1364059 - RNA, 17 nt, Human
aggcuucugcuggggcc

SEQ ID NO: 1364060 - RNA, 14 nt, Human
aggcuucugcuggg

SEQ ID NO: 1364061 - RNA, 19 nt, Human
aggcuuccuucauuuccuc

SEQ ID NO: 1364062 - RNA, 18 nt, Human
aggcuuccuucauuuccu

SEQ ID NO: 1364063 - RNA, 16 nt, Human
aggcuuccuucauuuc

SEQ ID NO: 1364064 - RNA, 14 nt, Human
aggcuuccuucauu

SEQ ID NO: 1364065 - RNA, 23 nt, Human
aggcuuccacguacugcagccuc

SEQ ID NO: 1364066 - RNA, 19 nt, Human
aggcuucaaaauguuaucu

SEQ ID NO: 1364067 - RNA, 15 nt, Human
aggcuuaguuugugu

SEQ ID NO: 1364068 - RNA, 14 nt, Human
aggcuuaguuugug

SEQ ID NO: 1364069 - RNA, 18 nt, Human
agggaaaauuauuugcau

SEQ ID NO: 1364070 - RNA, 20 nt, Human
agggaaaauaggcaggaagc

SEQ ID NO: 1364071 - RNA, 18 nt, Human
agggaaaauaggcaggaa

SEQ ID NO: 1364072 - RNA, 23 nt, Human
aggcuuuaugauaauagauucuc

SEQ ID NO: 1364073 - RNA, 22 nt, Human
aggcuuuaugauaauagauucu

SEQ ID NO: 1364074 - RNA, 15 nt, Human
aggcuuguugugcuu

SEQ ID NO: 1364075 - RNA, 16 nt, Human
aggcuuguugugcuuu

SEQ ID NO: 1364076 - RNA, 14 nt, Human
aggcuuguugugcu

SEQ ID NO: 1364077 - RNA, 13 nt, Human
aggcuuucucuac

SEQ ID NO: 1364078 - RNA, 15 nt, Human
aggcuuuuuuaucau

SEQ ID NO: 1364079 - RNA, 18 nt, Human
aggcuuuuuuaucaugug

SEQ ID NO: 1364080 - RNA, 21 nt, Human
aggcuuuuuuaucaugugaaa

SEQ ID NO: 1364081 - RNA, 22 nt, Human
aggcuuuuguuuccuuuuucag

SEQ ID NO: 1364082 - RNA, 19 nt, Human
aggcuuuggauuugacauu

SEQ ID NO: 1364083 - RNA, 15 nt, Human
agggaaaacauucca

SEQ ID NO: 1364084 - RNA, 16 nt, Human
agggaaaacauuccau

SEQ ID NO: 1364085 - RNA, 18 nt, Human
agggaaaacauuccaucc

SEQ ID NO: 1364086 - RNA, 22 nt, Human
aggcugggccauguccaaagag

SEQ ID NO: 1364087 - RNA, 21 nt, Human
aggcugggccauguccaaaga

SEQ ID NO: 1364088 - RNA, 20 nt, Human
aggcugggccauguccaaag

SEQ ID NO: 1364089 - RNA, 18 nt, Human
aggcugggccauguccaa

SEQ ID NO: 1364090 - RNA, 12 nt, Human
aggcugggccau

SEQ ID NO: 1364091 - RNA, 10 nt, Human
aggcugggcc

SEQ ID NO: 1364092 - RNA, 22 nt, Human
ugggaaccccuucauccucuga

SEQ ID NO: 1364093 - RNA, 20 nt, Human
ugggaaccccuucauccucu

SEQ ID NO: 1364094 - RNA, 10 nt, Human
aggcuggguc

SEQ ID NO: 1364095 - RNA, 15 nt, Human
aggcugggucgcccu

SEQ ID NO: 1364096 - RNA, 18 nt, Human
aggcugggucgcccugga

SEQ ID NO: 1364097 - RNA, 20 nt, Human
aggcugggucgcccuggacu

SEQ ID NO: 1364098 - RNA, 21 nt, Human
aggcugggucgcccuggacug

SEQ ID NO: 1364099 - RNA, 18 nt, Human
uggcugacaugaagcugu

SEQ ID NO: 1364100 - RNA, 21 nt, Human
uggcugaauagcuucuccaaa

SEQ ID NO: 1364101 - RNA, 22 nt, Human
uggcugaaauucuccuggaggu

SEQ ID NO: 1364102 - RNA, 21 nt, Human
uggcugaaauucuccuggagg

SEQ ID NO: 1364103 - RNA, 20 nt, Human
uggcugaaauucuccuggag

SEQ ID NO: 1364104 - RNA, 19 nt, Human
uggcugaaauucuccugga

SEQ ID NO: 1364105 - RNA, 18 nt, Human
uggcugaaauucuccugg

SEQ ID NO: 1364106 - RNA, 16 nt, Human
uggcugaaauucuccu

SEQ ID NO: 1364107 - RNA, 23 nt, Human
uggcucuugauaccccccucugu

SEQ ID NO: 1364108 - RNA, 21 nt, Human
uggcucuugauaccccccucu

SEQ ID NO: 1364109 - RNA, 20 nt, Human
uggcucuugauaccccccuc

SEQ ID NO: 1364110 - RNA, 19 nt, Human
uggcucuugauaccccccu

SEQ ID NO: 1364111 - RNA, 18 nt, Human
uggcucacucagcacuug

SEQ ID NO: 1364112 - RNA, 16 nt, Human
uggcucagccagcacu

SEQ ID NO: 1364113 - RNA, 13 nt, Human
uggcucagccagc

SEQ ID NO: 1364114 - RNA, 12 nt, Human
uggcucagccag

SEQ ID NO: 1364115 - RNA, 21 nt, Human
uggcucacacucgacaugaaa

SEQ ID NO: 1364116 - RNA, 18 nt, Human
uggcuauagaugucuuuu

SEQ ID NO: 1364117 - RNA, 17 nt, Human
uggcuauagaugucuuu

SEQ ID NO: 1364118 - RNA, 19 nt, Human
uggcuauagaugucuuuuc

SEQ ID NO: 1364119 - RNA, 17 nt, Human
uggcucacucagcacuu

SEQ ID NO: 1364120 - RNA, 22 nt, Human
uggcucacucagcacuuggccc

SEQ ID NO: 1364121 - RNA, 17 nt, Human
uggcucacgccuguaau

SEQ ID NO: 1364122 - RNA, 17 nt, Human
uggcucacacucgacau

SEQ ID NO: 1364123 - RNA, 22 nt, Human
uggcuauagaugucuuuuccca

SEQ ID NO: 1364124 - RNA, 24 nt, Human
uggcuacucugugccagagccugg

SEQ ID NO: 1364125 - RNA, 23 nt, Human
uggcuacucugugccagagccug

SEQ ID NO: 1364126 - RNA, 22 nt, Human
uggcuacucugugccagagccu

SEQ ID NO: 1364127 - RNA, 21 nt, Human
uggcuacucugugccagagcc

SEQ ID NO: 1364128 - RNA, 20 nt, Human
uggcuacucugugccagagc

SEQ ID NO: 1364129 - RNA, 19 nt, Human
uggcuacucugugccagag

SEQ ID NO: 1364130 - RNA, 18 nt, Human
uggcuacucugugccaga

SEQ ID NO: 1364131 - RNA, 17 nt, Human
uggcuacucugugccag

SEQ ID NO: 1364132 - RNA, 16 nt, Human
uggcuacucugugcca

SEQ ID NO: 1364133 - RNA, 15 nt, Human
uggcuacucugugcc

SEQ ID NO: 1364134 - RNA, 14 nt, Human
uggcuacucugugc

SEQ ID NO: 1364135 - RNA, 16 nt, Human
aggcuccagagggcac

SEQ ID NO: 1364136 - RNA, 15 nt, Human
aggcuccagagggca

SEQ ID NO: 1364137 - RNA, 15 nt, Human
aggcucccagggaca

SEQ ID NO: 1364138 - RNA, 14 nt, Human
uggcuaaccaagag

SEQ ID NO: 1364139 - RNA, 13 nt, Human
aggcuccccuucu

SEQ ID NO: 1364140 - RNA, 20 nt, Human
uggcuguggccuaaccugcc

SEQ ID NO: 1364141 - RNA, 14 nt, Human
uggcuguggcaggc

SEQ ID NO: 1364142 - RNA, 17 nt, Human
uggcuguggcauccaga

SEQ ID NO: 1364143 - RNA, 19 nt, Human
uggcugcaggaaucuuuaa

SEQ ID NO: 1364144 - RNA, 16 nt, Human
uggcugcaggaaucuu

SEQ ID NO: 1364145 - RNA, 14 nt, Human
uggcugcaggaauc

SEQ ID NO: 1364146 - RNA, 23 nt, Human
uggcugcagccucaggacuggga

SEQ ID NO: 1364147 - RNA, 20 nt, Human
uggcugcagccucaggacug

SEQ ID NO: 1364148 - RNA, 17 nt, Human
uggcugcagccucagga

SEQ ID NO: 1364149 - RNA, 16 nt, Human
uggcugcagccucagg

SEQ ID NO: 1364150 - RNA, 15 nt, Human
uggcugcagccucag

SEQ ID NO: 1364151 - RNA, 13 nt, Human
uggcugcagccuc

SEQ ID NO: 1364152 - RNA, 12 nt, Human
uggcugcagccu

SEQ ID NO: 1364153 - RNA, 19 nt, Human
uggcugagauaugaacaua

SEQ ID NO: 1364154 - RNA, 20 nt, Human
uggcugacuuacaucaugug

SEQ ID NO: 1364155 - RNA, 18 nt, Human
ugggaaacuuggcucgaa

SEQ ID NO: 1364156 - RNA, 16 nt, Human
ugggaaaaauguagga

SEQ ID NO: 1364157 - RNA, 17 nt, Human
ugggaaaaauguaggag

SEQ ID NO: 1364158 - RNA, 14 nt, Human
uggcuguuugagau

SEQ ID NO: 1364159 - RNA, 21 nt, Human
uggcuuuugugcauuaucuag

SEQ ID NO: 1364160 - RNA, 18 nt, Human
ugggaaacaaaaggauaa

SEQ ID NO: 1364161 - RNA, 16 nt, Human
uggcuuuugugcauua

SEQ ID NO: 1364162 - RNA, 15 nt, Human
uguacauaacugaaa

SEQ ID NO: 1364163 - RNA, 14 nt, Human
uguacauaacugaa

SEQ ID NO: 1364164 - RNA, 13 nt, Human
uguacauaacuga

SEQ ID NO: 1364165 - RNA, 17 nt, Human
uguacaaaauaaacaaa

SEQ ID NO: 1364166 - RNA, 22 nt, Human
uguacaaaauaaacaaauaaca

SEQ ID NO: 1364167 - RNA, 19 nt, Human
uguacauaaugcgugcaua

SEQ ID NO: 1364168 - RNA, 20 nt, Human
uguacauaaugcgugcauac

SEQ ID NO: 1364169 - RNA, 20 nt, Human
uguaauuuuguguaagaaau

SEQ ID NO: 1364170 - RNA, 16 nt, Human
uguaauuuuguguaag

SEQ ID NO: 1364171 - RNA, 15 nt, Human
uguaauuuuguguaa

SEQ ID NO: 1364172 - RNA, 21 nt, Human
uguaauuguguggauucuuua

SEQ ID NO: 1364173 - RNA, 20 nt, Human
uguaauuguguggauucuuu

SEQ ID NO: 1364174 - RNA, 16 nt, Human
uguaauuguguggauu

SEQ ID NO: 1364175 - RNA, 13 nt, Human
uguacaaaauaaa

SEQ ID NO: 1364176 - RNA, 20 nt, Human
uguaauuuuuuuaucgucac

SEQ ID NO: 1364177 - RNA, 23 nt, Human
uguacaucuauuuuggauuguau

SEQ ID NO: 1364178 - RNA, 16 nt, Human
uguacaugaaaacaca

SEQ ID NO: 1364179 - RNA, 21 nt, Human
uguacaucuauuuuggauugu

SEQ ID NO: 1364180 - RNA, 20 nt, Human
uguacaucuauuuuggauug

SEQ ID NO: 1364181 - RNA, 19 nt, Human
uguacaucuauuuuggauu

SEQ ID NO: 1364182 - RNA, 18 nt, Human
uguacaucuauuuuggau

SEQ ID NO: 1364183 - RNA, 14 nt, Human
uguacaugaaaaca

SEQ ID NO: 1364184 - RNA, 21 nt, Human
uguacauacccuggccgcccc

SEQ ID NO: 1364185 - RNA, 19 nt, Human
uguacauaacugaaaaugu

SEQ ID NO: 1364186 - RNA, 18 nt, Human
uguacauaacugaaaaug

SEQ ID NO: 1364187 - RNA, 17 nt, Human
uguacauaacugaaaau

SEQ ID NO: 1364188 - RNA, 18 nt, Human
uguacauaguuauuuauu

SEQ ID NO: 1364189 - RNA, 14 nt, Human
uguacauauaagug

SEQ ID NO: 1364190 - RNA, 19 nt, Human
uguaauugaauauuauucc

SEQ ID NO: 1364191 - RNA, 17 nt, Human
uguaauugaauauuauu

SEQ ID NO: 1364192 - RNA, 16 nt, Human
uguaauucuaaaugaa

SEQ ID NO: 1364193 - RNA, 15 nt, Human
uguaauucuaaauga

SEQ ID NO: 1364194 - RNA, 14 nt, Human
uguaauucuaaaug

SEQ ID NO: 1364195 - RNA, 13 nt, Human
uguaauucuaaau

SEQ ID NO: 1364196 - RNA, 19 nt, Human
uguaauucagguuuuuccu

SEQ ID NO: 1364197 - RNA, 21 nt, Human
uguaaggcuguguaagauuug

SEQ ID NO: 1364198 - RNA, 20 nt, Human
uguaaggcuguguaagauuu

SEQ ID NO: 1364199 - RNA, 14 nt, Human
uguaaggcugugua

SEQ ID NO: 1364200 - RNA, 18 nt, Human
uguaaggcucuagaucau

SEQ ID NO: 1364201 - RNA, 15 nt, Human
uguaaggcucuagau

SEQ ID NO: 1364202 - RNA, 14 nt, Human
uguaaggcucuaga

SEQ ID NO: 1364203 - RNA, 21 nt, Human
agguuucugaguuccugcaug

SEQ ID NO: 1364204 - RNA, 19 nt, Human
agguuucugaguuccugca

SEQ ID NO: 1364205 - RNA, 14 nt, Human
agguuucaaagaug

SEQ ID NO: 1364206 - RNA, 13 nt, Human
agguuucaaagau

SEQ ID NO: 1364207 - RNA, 17 nt, Human
agguuucaaagaugcug

SEQ ID NO: 1364208 - RNA, 20 nt, Human
agguuucacuguguuggcca

SEQ ID NO: 1364209 - RNA, 16 nt, Human
ugggcugagggagccu

SEQ ID NO: 1364210 - RNA, 12 nt, Human
ugggcugaggga

SEQ ID NO: 1364211 - RNA, 15 nt, Human
ugggcucugaugaaa

SEQ ID NO: 1364212 - RNA, 22 nt, Human
ugggcucugcaauuccccucug

SEQ ID NO: 1364213 - RNA, 20 nt, Human
ugggcucugcaauuccccuc

SEQ ID NO: 1364214 - RNA, 23 nt, Human
aggugcuaauuuguuuuggauau

SEQ ID NO: 1364215 - RNA, 20 nt, Human
aggugcuaauuuguuuugga

SEQ ID NO: 1364216 - RNA, 17 nt, Human
aggugcuaauuuguuuu

SEQ ID NO: 1364217 - RNA, 21 nt, Human
aggugucauacagauuugcaa

SEQ ID NO: 1364218 - RNA, 15 nt, Human
aggugucauacagau

SEQ ID NO: 1364219 - RNA, 20 nt, Human
agguguagccacaccaggau

SEQ ID NO: 1364220 - RNA, 18 nt, Human
agguggggagacugggcu

SEQ ID NO: 1364221 - RNA, 17 nt, Human
agguucuuguuggugca

SEQ ID NO: 1364222 - RNA, 18 nt, Human
agguucuuguuggugcac

SEQ ID NO: 1364223 - RNA, 13 nt, Human
agguugaaaaaca

SEQ ID NO: 1364224 - RNA, 17 nt, Human
aguacagagaagccauc

SEQ ID NO: 1364225 - RNA, 20 nt, Human
aguacagagaagccaucacc

SEQ ID NO: 1364226 - RNA, 16 nt, Human
aguacagagaagccau

SEQ ID NO: 1364227 - RNA, 15 nt, Human
aguacagagaagcca

SEQ ID NO: 1364228 - RNA, 14 nt, Human
aguacagagaagcc

SEQ ID NO: 1364229 - RNA, 13 nt, Human
aguacagagaagc

SEQ ID NO: 1364230 - RNA, 12 nt, Human
aguacagagaag

SEQ ID NO: 1364231 - RNA, 17 nt, Human
aguaauuuagaaaucau

SEQ ID NO: 1364232 - RNA, 23 nt, Human
aguacacuguuucaaacuuuacu

SEQ ID NO: 1364233 - RNA, 22 nt, Human
aguaauugguccgaucuuugac

SEQ ID NO: 1364234 - RNA, 23 nt, Human
aguaauuuagaaaucauuuugca

SEQ ID NO: 1364235 - RNA, 14 nt, Human
aguaauuuagaaau

SEQ ID NO: 1364236 - RNA, 12 nt, Human
aguaauuuagaa

SEQ ID NO: 1364237 - RNA, 21 nt, Human
aguacacuguuucaaacuuua

SEQ ID NO: 1364238 - RNA, 20 nt, Human
aguaauugacaugugccagg

SEQ ID NO: 1364239 - RNA, 18 nt, Human
aguaauugacaugugcca

SEQ ID NO: 1364240 - RNA, 13 nt, Human
aguaauuggaaag

SEQ ID NO: 1364241 - RNA, 12 nt, Human
aguaauuggaaa

SEQ ID NO: 1364242 - RNA, 23 nt, Human
aguaaucugcauuauuggaauau

SEQ ID NO: 1364243 - RNA, 13 nt, Human
aguaaucugcauu

SEQ ID NO: 1364244 - RNA, 19 nt, Human
aguaaucuaauauggccac

SEQ ID NO: 1364245 - RNA, 13 nt, Human
aguaaugauaacu

SEQ ID NO: 1364246 - RNA, 23 nt, Human
aguaauaaaauucaacaaacauu

SEQ ID NO: 1364247 - RNA, 15 nt, Human
aguaauaaaauucaa

SEQ ID NO: 1364248 - RNA, 22 nt, Human
aguaauaaaauucaacaaacau

SEQ ID NO: 1364249 - RNA, 13 nt, Human
aguaauacaaacu

SEQ ID NO: 1364250 - RNA, 22 nt, Human
uguacaugaagaagcuaaaucc

SEQ ID NO: 1364251 - RNA, 16 nt, Human
uguacaugagaaggaa

SEQ ID NO: 1364252 - RNA, 17 nt, Human
agguuuuuuuucaguug

SEQ ID NO: 1364253 - RNA, 16 nt, Human
aguaaaaacaaagaaa

SEQ ID NO: 1364254 - RNA, 23 nt, Human
aguaaaaacaaagaaauuaugug

SEQ ID NO: 1364255 - RNA, 16 nt, Human
agguuuuuuuucaguu

SEQ ID NO: 1364256 - RNA, 14 nt, Human
aguaaaaaggcuaa

SEQ ID NO: 1364257 - RNA, 15 nt, Human
uguauauauauauau

SEQ ID NO: 1364258 - RNA, 13 nt, Human
uguauauacuuuu

SEQ ID NO: 1364259 - RNA, 12 nt, Human
uguauauacuuu

SEQ ID NO: 1364260 - RNA, 14 nt, Human
uguauauauuauua

SEQ ID NO: 1364261 - RNA, 20 nt, Human
uguauauauuauuauaaucu

SEQ ID NO: 1364262 - RNA, 16 nt, Human
uguauauuaaggugug

SEQ ID NO: 1364263 - RNA, 14 nt, Human
uguauauuacaaug

SEQ ID NO: 1364264 - RNA, 15 nt, Human
uguauauuacaauga

SEQ ID NO: 1364265 - RNA, 14 nt, Human
uguauaguucacgu

SEQ ID NO: 1364266 - RNA, 17 nt, Human
uguauaguuaacacacu

SEQ ID NO: 1364267 - RNA, 16 nt, Human
uguauaguuaacacac

SEQ ID NO: 1364268 - RNA, 15 nt, Human
uguauaguuaacaca

SEQ ID NO: 1364269 - RNA, 19 nt, Human
uguaguguuggagaagaac

SEQ ID NO: 1364270 - RNA, 18 nt, Human
uguaguguuggagaagaa

SEQ ID NO: 1364271 - RNA, 17 nt, Human
uguaguguuggagaaga

SEQ ID NO: 1364272 - RNA, 21 nt, Human
uguagugauuuuuaugccacc

SEQ ID NO: 1364273 - RNA, 20 nt, Human
uguagugauuuuuaugccac

SEQ ID NO: 1364274 - RNA, 22 nt, Human
uguaggggaggggcuccuuucc

SEQ ID NO: 1364275 - RNA, 13 nt, Human
uguaggguuucua

SEQ ID NO: 1364276 - RNA, 23 nt, Human
uguaggggaggggcuccuuucca

SEQ ID NO: 1364277 - RNA, 21 nt, Human
uguaggggaggggcuccuuuc

SEQ ID NO: 1364278 - RNA, 22 nt, Human
uguagggagggcggcaggggcc

SEQ ID NO: 1364279 - RNA, 22 nt, Human
aguagcagugauugucuuaaua

SEQ ID NO: 1364280 - RNA, 14 nt, Human
aguagcagugauug

SEQ ID NO: 1364281 - RNA, 18 nt, Human
aguagcacccuggauuga

SEQ ID NO: 1364282 - RNA, 23 nt, Human
aguagcacaaguuauuuaaaucu

SEQ ID NO: 1364283 - RNA, 15 nt, Human
aguagauuuuccaaa

SEQ ID NO: 1364284 - RNA, 16 nt, Human
aguaccaaucauuuua

SEQ ID NO: 1364285 - RNA, 15 nt, Human
aguaccaaucauuuu

SEQ ID NO: 1364286 - RNA, 20 nt, Human
aguagauugcagaaaauucu

SEQ ID NO: 1364287 - RNA, 14 nt, Human
aguaccagacuaga

SEQ ID NO: 1364288 - RNA, 23 nt, Human
aguaccaguaggggcuuauaaua

SEQ ID NO: 1364289 - RNA, 20 nt, Human
agucauauauaucacccaga

SEQ ID NO: 1364290 - RNA, 22 nt, Human
agucauagguuaauauuuaaga

SEQ ID NO: 1364291 - RNA, 16 nt, Human
agucauagguuaauau

SEQ ID NO: 1364292 - RNA, 23 nt, Human
agucauaccaaugaaaaaaugua

SEQ ID NO: 1364293 - RNA, 17 nt, Human
agucauaccaaugaaaa

SEQ ID NO: 1364294 - RNA, 14 nt, Human
agucauaccaauga

SEQ ID NO: 1364295 - RNA, 17 nt, Human
agucauaauugcauuga

SEQ ID NO: 1364296 - RNA, 13 nt, Human
agucauaauugca

SEQ ID NO: 1364297 - RNA, 20 nt, Human
agucccaagcggugucucuc

SEQ ID NO: 1364298 - RNA, 19 nt, Human
agucccaagcggugucucu

SEQ ID NO: 1364299 - RNA, 14 nt, Human
agucccaagcggug

SEQ ID NO: 1364300 - RNA, 18 nt, Human
aguccccauugaggcuug

SEQ ID NO: 1364301 - RNA, 12 nt, Human
ugucgcugcuuc

SEQ ID NO: 1364302 - RNA, 15 nt, Human
ugucgcugcuucgug

SEQ ID NO: 1364303 - RNA, 22 nt, Human
ugucgcucaugugugcaacagg

SEQ ID NO: 1364304 - RNA, 16 nt, Human
ugucgcucaugugugc

SEQ ID NO: 1364305 - RNA, 15 nt, Human
ugucgcucaugugug

SEQ ID NO: 1364306 - RNA, 14 nt, Human
ugucgcucaugugu

SEQ ID NO: 1364307 - RNA, 16 nt, Human
ugucccuuaaacaaaa

SEQ ID NO: 1364308 - RNA, 23 nt, Human
agucacuggucuguuugcauuug

SEQ ID NO: 1364309 - RNA, 12 nt, Human
agucacugcucu

SEQ ID NO: 1364310 - RNA, 17 nt, Human
agucagaacagcagacu

SEQ ID NO: 1364311 - RNA, 15 nt, Human
agucagaacagcaga

SEQ ID NO: 1364312 - RNA, 14 nt, Human
agucagaacagcag

SEQ ID NO: 1364313 - RNA, 12 nt, Human
agucagaacagc

SEQ ID NO: 1364314 - RNA, 22 nt, Human
agucagaacagcagacucagcu

SEQ ID NO: 1364315 - RNA, 15 nt, Human
agucaggaaagagaa

SEQ ID NO: 1364316 - RNA, 14 nt, Human
agucaggaaagaga

SEQ ID NO: 1364317 - RNA, 24 nt, Human
aguccuaucugggcuuccuggagc

SEQ ID NO: 1364318 - RNA, 23 nt, Human
aguccuaucugggcuuccuggag

SEQ ID NO: 1364319 - RNA, 22 nt, Human
aguccuaucugggcuuccugga

SEQ ID NO: 1364320 - RNA, 20 nt, Human
aguccuaucugggcuuccug

SEQ ID NO: 1364321 - RNA, 19 nt, Human
aguccuaucugggcuuccu

SEQ ID NO: 1364322 - RNA, 16 nt, Human
aguccuaucugggcuu

SEQ ID NO: 1364323 - RNA, 15 nt, Human
aguccuaucugggcu

SEQ ID NO: 1364324 - RNA, 20 nt, Human
aguccuacaagcuaaaauua

SEQ ID NO: 1364325 - RNA, 16 nt, Human
aguccccucaccuccu

SEQ ID NO: 1364326 - RNA, 20 nt, Human
agucuaaagcugguuuaaug

SEQ ID NO: 1364327 - RNA, 21 nt, Human
agucuaaagcugguuuaaugu

SEQ ID NO: 1364328 - RNA, 23 nt, Human
agucuaaagauggaguuucuaag

SEQ ID NO: 1364329 - RNA, 21 nt, Human
agucguccuuacuccuguggg

SEQ ID NO: 1364330 - RNA, 22 nt, Human
agucguccuuacuccuguggga

SEQ ID NO: 1364331 - RNA, 20 nt, Human
agucguccuuacuccugugg

SEQ ID NO: 1364332 - RNA, 19 nt, Human
agucguccuuacuccugug

SEQ ID NO: 1364333 - RNA, 17 nt, Human
agucguccuuacuccug

SEQ ID NO: 1364334 - RNA, 18 nt, Human
agucguacagaaagcugc

SEQ ID NO: 1364335 - RNA, 12 nt, Human
agucggauuaga

SEQ ID NO: 1364336 - RNA, 21 nt, Human
ugucucaugccaguaacaggc

SEQ ID NO: 1364337 - RNA, 21 nt, Human
ugucucauccaucaucaugug

SEQ ID NO: 1364338 - RNA, 17 nt, Human
ugucucauccaucauca

SEQ ID NO: 1364339 - RNA, 16 nt, Human
ugucucauccaucauc

SEQ ID NO: 1364340 - RNA, 11 nt, Human
ugucucaucca

SEQ ID NO: 1364341 - RNA, 13 nt, Human
agucucagcuaag

SEQ ID NO: 1364342 - RNA, 18 nt, Human
agucucagcuaagcucac

SEQ ID NO: 1364343 - RNA, 11 nt, Human
agucucagcua

SEQ ID NO: 1364344 - RNA, 19 nt, Human
agucucagaaugucauuuu

SEQ ID NO: 1364345 - RNA, 19 nt, Human
agucucacuuugucgccca

SEQ ID NO: 1364346 - RNA, 23 nt, Human
agucuaucaaccccagacacugg

SEQ ID NO: 1364347 - RNA, 22 nt, Human
agucuaucaaccccagacacug

SEQ ID NO: 1364348 - RNA, 20 nt, Human
agucuauuuacggaacucaa

SEQ ID NO: 1364349 - RNA, 15 nt, Human
agucuauuuacggaa

SEQ ID NO: 1364350 - RNA, 16 nt, Human
ugucccgauuguaacu

SEQ ID NO: 1364351 - RNA, 17 nt, Human
ugucccgauuguaacuc

SEQ ID NO: 1364352 - RNA, 21 nt, Human
uguccagacagagcccuguga

SEQ ID NO: 1364353 - RNA, 22 nt, Human
uguccagacagagcccugugag

SEQ ID NO: 1364354 - RNA, 14 nt, Human
uguccaauccuaug

SEQ ID NO: 1364355 - RNA, 19 nt, Human
uguccaacuggcccuauuu

SEQ ID NO: 1364356 - RNA, 14 nt, Human
uguccaacuggccc

SEQ ID NO: 1364357 - RNA, 20 nt, Human
uguccagccccguagacgug

SEQ ID NO: 1364358 - RNA, 21 nt, Human
uguccaaagaggcugccccuc

SEQ ID NO: 1364359 - RNA, 20 nt, Human
uguccaaagaggcugccccu

SEQ ID NO: 1364360 - RNA, 19 nt, Human
uguccaaagaggcugcccc

SEQ ID NO: 1364361 - RNA, 17 nt, Human
uguccaaagaggcugcc

SEQ ID NO: 1364362 - RNA, 11 nt, Human
uguccaaagag

SEQ ID NO: 1364363 - RNA, 22 nt, Human
uguccaaacugccuaagcccuc

SEQ ID NO: 1364364 - RNA, 15 nt, Human
uguccaaacugccua

SEQ ID NO: 1364365 - RNA, 17 nt, Human
uguccaaacugccuaag

SEQ ID NO: 1364366 - RNA, 16 nt, Human
uguccaaaacugccuc

SEQ ID NO: 1364367 - RNA, 16 nt, Human
ugucagcagggacugu

SEQ ID NO: 1364368 - RNA, 18 nt, Human
uguccaacccgaggcccg

SEQ ID NO: 1364369 - RNA, 21 nt, Human
ugucagauccaggagcuccag

SEQ ID NO: 1364370 - RNA, 20 nt, Human
ugucagauccaggagcucca

SEQ ID NO: 1364371 - RNA, 18 nt, Human
ugucagauccaggagcuc

SEQ ID NO: 1364372 - RNA, 24 nt, Human
ugucagauccaggagcuccagugu

SEQ ID NO: 1364373 - RNA, 23 nt, Human
aguauacuagggagccauuugag

SEQ ID NO: 1364374 - RNA, 15 nt, Human
aguauaccugauuuu

SEQ ID NO: 1364375 - RNA, 19 nt, Human
aguauaagacuacugaauc

SEQ ID NO: 1364376 - RNA, 20 nt, Human
aguauuccagaccugaagaa

SEQ ID NO: 1364377 - RNA, 18 nt, Human
aguauuaaaauguaugca

SEQ ID NO: 1364378 - RNA, 15 nt, Human
aguauuaaaauguau

SEQ ID NO: 1364379 - RNA, 14 nt, Human
aguauuaaaaugua

SEQ ID NO: 1364380 - RNA, 13 nt, Human
aguauuaaaaugu

SEQ ID NO: 1364381 - RNA, 19 nt, Human
aguauuaaaauguaugcau

SEQ ID NO: 1364382 - RNA, 20 nt, Human
uguauauuguguuuguguau

SEQ ID NO: 1364383 - RNA, 17 nt, Human
uguauauuguaauuuaa

SEQ ID NO: 1364384 - RNA, 14 nt, Human
uguauauuguaauu

SEQ ID NO: 1364385 - RNA, 13 nt, Human
uguauauuguaau

SEQ ID NO: 1364386 - RNA, 12 nt, Human
uguauauucacu

SEQ ID NO: 1364387 - RNA, 14 nt, Human
uguauauucacuuu

SEQ ID NO: 1364388 - RNA, 19 nt, Human
uguauauuaagguguggcu

SEQ ID NO: 1364389 - RNA, 19 nt, Human
uguauauuacaaugaucac

SEQ ID NO: 1364390 - RNA, 16 nt, Human
aguauuuuaaaauagc

SEQ ID NO: 1364391 - RNA, 18 nt, Human
aguauuuguuaauuuaga

SEQ ID NO: 1364392 - RNA, 15 nt, Human
aguauuuguuaauuu

SEQ ID NO: 1364393 - RNA, 14 nt, Human
aguauuuguuaauu

SEQ ID NO: 1364394 - RNA, 13 nt, Human
aguauuuguuaau

SEQ ID NO: 1364395 - RNA, 20 nt, Human
aguauuucaaauuggagcuu

SEQ ID NO: 1364396 - RNA, 16 nt, Human
aguauuucaaauugga

SEQ ID NO: 1364397 - RNA, 19 nt, Human
aguauuuagaagccaacua

SEQ ID NO: 1364398 - RNA, 17 nt, Human
aguauuuugcuggaaua

SEQ ID NO: 1364399 - RNA, 21 nt, Human
aguauuuuccuguugucaaga

SEQ ID NO: 1364400 - RNA, 18 nt, Human
aguauuuuagugaacuug

SEQ ID NO: 1364401 - RNA, 20 nt, Human
aguauuuuagugaacuugaa

SEQ ID NO: 1364402 - RNA, 17 nt, Human
aguauuuuaaaauagcg

SEQ ID NO: 1364403 - RNA, 14 nt, Human
agucaccagagacu

SEQ ID NO: 1364404 - RNA, 16 nt, Human
ugucuccuaccucugc

SEQ ID NO: 1364405 - RNA, 21 nt, Human
ugucuccuaagcaccuguaau

SEQ ID NO: 1364406 - RNA, 16 nt, Human
ugucuccuaagcaccu

SEQ ID NO: 1364407 - RNA, 13 nt, Human
ugucuccuaagca

SEQ ID NO: 1364408 - RNA, 15 nt, Human
ugucuccauggcccu

SEQ ID NO: 1364409 - RNA, 13 nt, Human
ugucucaugccag

SEQ ID NO: 1364410 - RNA, 16 nt, Human
ugugacuuuugugaaa

SEQ ID NO: 1364411 - RNA, 23 nt, Human
ugugacuucuauuuuaaagacaa

SEQ ID NO: 1364412 - RNA, 18 nt, Human
ugugacuggcuaaagcuc

SEQ ID NO: 1364413 - RNA, 20 nt, Human
ugugacuggcuaaagcucga

SEQ ID NO: 1364414 - RNA, 17 nt, Human
ugugacuggcuaaagcu

SEQ ID NO: 1364415 - RNA, 24 nt, Human
ugugagaagugaaugcugggacuc

SEQ ID NO: 1364416 - RNA, 23 nt, Human
ugugagaagugaaugcugggacu

SEQ ID NO: 1364417 - RNA, 22 nt, Human
ugugagaagugaaugcugggac

SEQ ID NO: 1364418 - RNA, 21 nt, Human
ugugagaagugaaugcuggga

SEQ ID NO: 1364419 - RNA, 18 nt, Human
ugugagcccagcuggguc

SEQ ID NO: 1364420 - RNA, 16 nt, Human
ugugaggaaagucauu

SEQ ID NO: 1364421 - RNA, 22 nt, Human
ugugaggaaagucauuggcuuu

SEQ ID NO: 1364422 - RNA, 23 nt, Human
ugugaggaaagucauuggcuuua

SEQ ID NO: 1364423 - RNA, 14 nt, Human
agucucuaauucua

SEQ ID NO: 1364424 - RNA, 20 nt, Human
agucucgucucuuuuacccu

SEQ ID NO: 1364425 - RNA, 18 nt, Human
agucugaacagcuguaau

SEQ ID NO: 1364426 - RNA, 16 nt, Human
agucugaacagcugua

SEQ ID NO: 1364427 - RNA, 15 nt, Human
agucugaacagcugu

SEQ ID NO: 1364428 - RNA, 20 nt, Human
agucugaaccuauuucuuaa

SEQ ID NO: 1364429 - RNA, 17 nt, Human
agugacuaauggcauga

SEQ ID NO: 1364430 - RNA, 16 nt, Human
agugacuaauggcaug

SEQ ID NO: 1364431 - RNA, 18 nt, Human
agugaacuuaguccuguu

SEQ ID NO: 1364432 - RNA, 16 nt, Human
agucuuucacauuuaa

SEQ ID NO: 1364433 - RNA, 18 nt, Human
agucuuucacauuuaaau

SEQ ID NO: 1364434 - RNA, 21 nt, Human
agugagccugaauuuuguugc

SEQ ID NO: 1364435 - RNA, 11 nt, Human
agugagccuga

SEQ ID NO: 1364436 - RNA, 12 nt, Human
agugagaggcug

SEQ ID NO: 1364437 - RNA, 14 nt, Human
agugacuucugaga

SEQ ID NO: 1364438 - RNA, 13 nt, Human
agugacuucugag

SEQ ID NO: 1364439 - RNA, 12 nt, Human
agugacuucuga

SEQ ID NO: 1364440 - RNA, 18 nt, Human
agugacucuauauagcug

SEQ ID NO: 1364441 - RNA, 18 nt, Human
agugacuugugucccaug

SEQ ID NO: 1364442 - RNA, 16 nt, Human
agugacuuguguccca

SEQ ID NO: 1364443 - RNA, 15 nt, Human
agugacuucugagau

SEQ ID NO: 1364444 - RNA, 17 nt, Human
agugacuucugagaucu

SEQ ID NO: 1364445 - RNA, 18 nt, Human
agugacuuuggcugcaug

SEQ ID NO: 1364446 - RNA, 15 nt, Human
ugugcugugugugac

SEQ ID NO: 1364447 - RNA, 12 nt, Human
ugugcugugugu

SEQ ID NO: 1364448 - RNA, 19 nt, Human
ugugcugugcuauggugcu

SEQ ID NO: 1364449 - RNA, 14 nt, Human
uguggaucagagau

SEQ ID NO: 1364450 - RNA, 17 nt, Human
uguggaucagagaugca

SEQ ID NO: 1364451 - RNA, 20 nt, Human
uguggaucaaccaucgcuuu

SEQ ID NO: 1364452 - RNA, 19 nt, Human
uguggaucaaccaucgcuu

SEQ ID NO: 1364453 - RNA, 21 nt, Human
uguggaucaaauccagccugc

SEQ ID NO: 1364454 - RNA, 19 nt, Human
uguggauuuaacagaaaug

SEQ ID NO: 1364455 - RNA, 20 nt, Human
uguggauuuaacagaaaugu

SEQ ID NO: 1364456 - RNA, 22 nt, Human
uguggauuuaacagaaauguac

SEQ ID NO: 1364457 - RNA, 18 nt, Human
ugugcccucugggcucug

SEQ ID NO: 1364458 - RNA, 21 nt, Human
ugugcccucugggcucugagu

SEQ ID NO: 1364459 - RNA, 17 nt, Human
ugugcccucugggcucu

SEQ ID NO: 1364460 - RNA, 15 nt, Human
ugugcccucugggcu

SEQ ID NO: 1364461 - RNA, 14 nt, Human
ugugcccucugggc

SEQ ID NO: 1364462 - RNA, 13 nt, Human
ugugcccucuggg

SEQ ID NO: 1364463 - RNA, 12 nt, Human
ugugcccucugg

SEQ ID NO: 1364464 - RNA, 17 nt, Human
ugugauuggccuguaga

SEQ ID NO: 1364465 - RNA, 15 nt, Human
ugugauuggccugua

SEQ ID NO: 1364466 - RNA, 14 nt, Human
ugugauuggccugu

SEQ ID NO: 1364467 - RNA, 13 nt, Human
ugugcccucccug

SEQ ID NO: 1364468 - RNA, 20 nt, Human
ugugauucagaaaauguucu

SEQ ID NO: 1364469 - RNA, 23 nt, Human
ugugauucagaaaauguucuguu

SEQ ID NO: 1364470 - RNA, 22 nt, Human
ugugauucaaucuguaaacugu

SEQ ID NO: 1364471 - RNA, 20 nt, Human
ugugauucaaucuguaaacu

SEQ ID NO: 1364472 - RNA, 16 nt, Human
ugugauucaaucugua

SEQ ID NO: 1364473 - RNA, 21 nt, Human
ugugcucuccauucugcuccu

SEQ ID NO: 1364474 - RNA, 19 nt, Human
ugugccuauugcuagagcu

SEQ ID NO: 1364475 - RNA, 21 nt, Human
ugugcucaggagcccugggag

SEQ ID NO: 1364476 - RNA, 14 nt, Human
uguggauucuuuaa

SEQ ID NO: 1364477 - RNA, 21 nt, Human
agugagcuuggaaaggaccag

SEQ ID NO: 1364478 - RNA, 17 nt, Human
agugauagucuuuugcu

SEQ ID NO: 1364479 - RNA, 15 nt, Human
agugauagucuuuug

SEQ ID NO: 1364480 - RNA, 19 nt, Human
agugaguuuuuuagugcgu

SEQ ID NO: 1364481 - RNA, 15 nt, Human
agugaguuuuuuagu

SEQ ID NO: 1364482 - RNA, 14 nt, Human
agugauauaaauca

SEQ ID NO: 1364483 - RNA, 21 nt, Human
agugauagucuuuugcuuuug

SEQ ID NO: 1364484 - RNA, 20 nt, Human
agugauagucuuuugcuuuu

SEQ ID NO: 1364485 - RNA, 20 nt, Human
agugauuuuuaugccaccug

SEQ ID NO: 1364486 - RNA, 16 nt, Human
agugauuuuuaugcca

SEQ ID NO: 1364487 - RNA, 21 nt, Human
agugcaacacuggucugcugu

SEQ ID NO: 1364488 - RNA, 16 nt, Human
agugcaacacuggucu

SEQ ID NO: 1364489 - RNA, 13 nt, Human
agugcaacacugg

SEQ ID NO: 1364490 - RNA, 21 nt, Human
agugauuuuuaugccaccuga

SEQ ID NO: 1364491 - RNA, 14 nt, Human
agugcaaauuguca

SEQ ID NO: 1364492 - RNA, 19 nt, Human
agugcagaaugcuccucca

SEQ ID NO: 1364493 - RNA, 23 nt, Human
agugcauagcuacuaaaaucagu

SEQ ID NO: 1364494 - RNA, 23 nt, Human
agugcaguggcgcgaucucagcu

SEQ ID NO: 1364495 - RNA, 23 nt, Human
agugcaguggcgugaucucagcu

SEQ ID NO: 1364496 - RNA, 23 nt, Human
agugcaguccugaucagagccgu

SEQ ID NO: 1364497 - RNA, 23 nt, Human
agugcaguggcaucaucucagcu

SEQ ID NO: 1364498 - RNA, 23 nt, Human
agugcaauaaaucugacccagug

SEQ ID NO: 1364499 - RNA, 22 nt, Human
agugcaauaaaucugacccagu

SEQ ID NO: 1364500 - RNA, 21 nt, Human
agugcaauaaaucugacccag

SEQ ID NO: 1364501 - RNA, 20 nt, Human
agugcaauaaaucugaccca

SEQ ID NO: 1364502 - RNA, 18 nt, Human
agugcacuugcuggaaga

SEQ ID NO: 1364503 - RNA, 20 nt, Human
agugcacuugcuggaagacg

SEQ ID NO: 1364504 - RNA, 16 nt, Human
agugcacuugcuggaa

SEQ ID NO: 1364505 - RNA, 14 nt, Human
agugcaaggaccua

SEQ ID NO: 1364506 - RNA, 21 nt, Human
agugcacugaaagucacggcu

SEQ ID NO: 1364507 - RNA, 21 nt, Human
agugcacuaauguguaagaca

SEQ ID NO: 1364508 - RNA, 17 nt, Human
agugcacuaauguguaa

SEQ ID NO: 1364509 - RNA, 22 nt, Human
agugcauuuaugagcucuucau

SEQ ID NO: 1364510 - RNA, 21 nt, Human
agugccacuuaauguauguua

SEQ ID NO: 1364511 - RNA, 20 nt, Human
agugccacuuaauguauguu

SEQ ID NO: 1364512 - RNA, 18 nt, Human
agugccacuuaauguaug

SEQ ID NO: 1364513 - RNA, 18 nt, Human
agugccagcaccugccca

SEQ ID NO: 1364514 - RNA, 21 nt, Human
aguguguggcuuucagagccu

SEQ ID NO: 1364515 - RNA, 22 nt, Human
uguugcccacagcuguaugauu

SEQ ID NO: 1364516 - RNA, 21 nt, Human
uguugcacguguguuuuucua

SEQ ID NO: 1364517 - RNA, 14 nt, Human
uguugcacgugugu

SEQ ID NO: 1364518 - RNA, 14 nt, Human
uguucuaaggcucu

SEQ ID NO: 1364519 - RNA, 12 nt, Human
uguucuaaggcu

SEQ ID NO: 1364520 - RNA, 16 nt, Human
uguucuaagaugugau

SEQ ID NO: 1364521 - RNA, 22 nt, Human
uguucuaagaugugauauucua

SEQ ID NO: 1364522 - RNA, 14 nt, Human
uguucuaagaugug

SEQ ID NO: 1364523 - RNA, 13 nt, Human
uguucuaagaugu

SEQ ID NO: 1364524 - RNA, 16 nt, Human
uguucuaaccuuuaca

SEQ ID NO: 1364525 - RNA, 19 nt, Human
uguucuaaagcucugacau

SEQ ID NO: 1364526 - RNA, 18 nt, Human
uguucuaaagcucugaca

SEQ ID NO: 1364527 - RNA, 20 nt, Human
uguugccaagcuccaagccc

SEQ ID NO: 1364528 - RNA, 18 nt, Human
uguugccaagcuccaagc

SEQ ID NO: 1364529 - RNA, 23 nt, Human
uguugccaaauauguccuggggu

SEQ ID NO: 1364530 - RNA, 22 nt, Human
uguugccaaauauguccugggg

SEQ ID NO: 1364531 - RNA, 20 nt, Human
uguugccaaauauguccugg

SEQ ID NO: 1364532 - RNA, 19 nt, Human
uguugccaaauauguccug

SEQ ID NO: 1364533 - RNA, 15 nt, Human
uguugcauagaauaa

SEQ ID NO: 1364534 - RNA, 18 nt, Human
aguuagcuaauaaaaagc

SEQ ID NO: 1364535 - RNA, 11 nt, Human
aguuagcacca

SEQ ID NO: 1364536 - RNA, 13 nt, Human
aguuagacuguug

SEQ ID NO: 1364537 - RNA, 19 nt, Human
aguguuguggauuuaacag

SEQ ID NO: 1364538 - RNA, 20 nt, Human
aguguuguggauuuaacaga

SEQ ID NO: 1364539 - RNA, 13 nt, Human
aguuacucagaau

SEQ ID NO: 1364540 - RNA, 19 nt, Human
aguguucugucugacuuuc

SEQ ID NO: 1364541 - RNA, 22 nt, Human
aguguucccuauccaaucaauc

SEQ ID NO: 1364542 - RNA, 23 nt, Human
aguguucccuauccaaucaaucu

SEQ ID NO: 1364543 - RNA, 17 nt, Human
aguguugaaaauguuca

SEQ ID NO: 1364544 - RNA, 16 nt, Human
aguguugaaaauguuc

SEQ ID NO: 1364545 - RNA, 16 nt, Human
aguguuguggauuuaa

SEQ ID NO: 1364546 - RNA, 16 nt, Human
aguguuccccuuccac

SEQ ID NO: 1364547 - RNA, 15 nt, Human
aguguucccuaucca

SEQ ID NO: 1364548 - RNA, 14 nt, Human
aguguucccuaucc

SEQ ID NO: 1364549 - RNA, 21 nt, Human
aguguuccccuuccacugagg

SEQ ID NO: 1364550 - RNA, 18 nt, Human
aguguguguuuuucauaa

SEQ ID NO: 1364551 - RNA, 19 nt, Human
aguguguguuuuucauaaa

SEQ ID NO: 1364552 - RNA, 15 nt, Human
aguguggaggccacu

SEQ ID NO: 1364553 - RNA, 14 nt, Human
aguguggacucugg

SEQ ID NO: 1364554 - RNA, 22 nt, Human
agugugcuucuguuaucaaaca

SEQ ID NO: 1364555 - RNA, 23 nt, Human
agugugcgugguggucccugggu

SEQ ID NO: 1364556 - RNA, 22 nt, Human
agugugcgugguggucccuggg

SEQ ID NO: 1364557 - RNA, 20 nt, Human
agugugcgugguggucccug

SEQ ID NO: 1364558 - RNA, 17 nt, Human
agugugcggcugugugu

SEQ ID NO: 1364559 - RNA, 14 nt, Human
agugugccuucucu

SEQ ID NO: 1364560 - RNA, 18 nt, Human
agugugaggccagggcag

SEQ ID NO: 1364561 - RNA, 17 nt, Human
agugguaagcuaugucc

SEQ ID NO: 1364562 - RNA, 19 nt, Human
agugguaaaaaggccuccu

SEQ ID NO: 1364563 - RNA, 23 nt, Human
aguggguuuuuuaguugaauuuu

SEQ ID NO: 1364564 - RNA, 15 nt, Human
agugugaggccaggg

SEQ ID NO: 1364565 - RNA, 22 nt, Human
agugugaccaaaaguuacaugu

SEQ ID NO: 1364566 - RNA, 14 nt, Human
agugugaccaggca

SEQ ID NO: 1364567 - RNA, 19 nt, Human
agugugaccaaaaguuaca

SEQ ID NO: 1364568 - RNA, 17 nt, Human
agugugaccaaaaguua

SEQ ID NO: 1364569 - RNA, 16 nt, Human
uguucuaaagcucuga

SEQ ID NO: 1364570 - RNA, 14 nt, Human
uguucuaaagcucu

SEQ ID NO: 1364571 - RNA, 13 nt, Human
uguucuaaagcuc

SEQ ID NO: 1364572 - RNA, 22 nt, Human
uguucgggccaaggaccugaga

SEQ ID NO: 1364573 - RNA, 19 nt, Human
uguucgggccaaggaccug

SEQ ID NO: 1364574 - RNA, 23 nt, Human
uguucgcauggucacacacugau

SEQ ID NO: 1364575 - RNA, 22 nt, Human
uguucgcauggucacacacuga

SEQ ID NO: 1364576 - RNA, 20 nt, Human
uguucgcauggucacacacu

SEQ ID NO: 1364577 - RNA, 19 nt, Human
uguuccuuccgcuuggagc

SEQ ID NO: 1364578 - RNA, 18 nt, Human
uguuccuucccugugccu

SEQ ID NO: 1364579 - RNA, 17 nt, Human
uguuccuucccugugcc

SEQ ID NO: 1364580 - RNA, 22 nt, Human
uguuccuuccagugucauuucu

SEQ ID NO: 1364581 - RNA, 19 nt, Human
uguuccuuaagucagaaca

SEQ ID NO: 1364582 - RNA, 21 nt, Human
uguuccaaauucaguuucaua

SEQ ID NO: 1364583 - RNA, 22 nt, Human
uguuccaaauucaguuucauaa

SEQ ID NO: 1364584 - RNA, 20 nt, Human
uguuccaaauucaguuucau

SEQ ID NO: 1364585 - RNA, 19 nt, Human
uguuccaaauucaguuuca

SEQ ID NO: 1364586 - RNA, 18 nt, Human
uguuccaaauucaguuuc

SEQ ID NO: 1364587 - RNA, 17 nt, Human
uguuccaaauucaguuu

SEQ ID NO: 1364588 - RNA, 16 nt, Human
uguuccugcugcuguc

SEQ ID NO: 1364589 - RNA, 13 nt, Human
uguuccugcugcu

SEQ ID NO: 1364590 - RNA, 12 nt, Human
uguuccugcugc

SEQ ID NO: 1364591 - RNA, 23 nt, Human
uguuaucuucucaaguucuaaga

SEQ ID NO: 1364592 - RNA, 22 nt, Human
uguuaucuucucaaguucuaag

SEQ ID NO: 1364593 - RNA, 10 nt, Human
uguuccaaau

SEQ ID NO: 1364594 - RNA, 14 nt, Human
uguucauuuccuca

SEQ ID NO: 1364595 - RNA, 16 nt, Human
uguuaugacuauguaa

SEQ ID NO: 1364596 - RNA, 17 nt, Human
uguuaugacuauguaaa

SEQ ID NO: 1364597 - RNA, 18 nt, Human
uguuaugacuauguaaac

SEQ ID NO: 1364598 - RNA, 20 nt, Human
uguuaugacuauguaaacua

SEQ ID NO: 1364599 - RNA, 16 nt, Human
ugugguacaugguguu

SEQ ID NO: 1364600 - RNA, 23 nt, Human
ugugguacagagaagccagcuug

SEQ ID NO: 1364601 - RNA, 19 nt, Human
ugugguacaugguguuugu

SEQ ID NO: 1364602 - RNA, 21 nt, Human
ugugguacagagaagccagcu

SEQ ID NO: 1364603 - RNA, 20 nt, Human
ugugguacagagaagccagc

SEQ ID NO: 1364604 - RNA, 19 nt, Human
ugugguacagagaagccag

SEQ ID NO: 1364605 - RNA, 18 nt, Human
ugugguacagagaagcca

SEQ ID NO: 1364606 - RNA, 17 nt, Human
ugugguacagagaagcc

SEQ ID NO: 1364607 - RNA, 16 nt, Human
ugugguacagagaagc

SEQ ID NO: 1364608 - RNA, 15 nt, Human
ugugguacagagaag

SEQ ID NO: 1364609 - RNA, 14 nt, Human
ugugguacagagaa

SEQ ID NO: 1364610 - RNA, 13 nt, Human
ugugguacagaga

SEQ ID NO: 1364611 - RNA, 12 nt, Human
ugugguacagag

SEQ ID NO: 1364612 - RNA, 21 nt, Human
ugugguaagcaacauggcuuu

SEQ ID NO: 1364613 - RNA, 21 nt, Human
ugugguacaagcauucugucu

SEQ ID NO: 1364614 - RNA, 20 nt, Human
ugugguaagcaacauggcuu

SEQ ID NO: 1364615 - RNA, 23 nt, Human
agugcccucucccacccucuucc

SEQ ID NO: 1364616 - RNA, 19 nt, Human
agugcccucucccacccuc

SEQ ID NO: 1364617 - RNA, 18 nt, Human
agugcccucucccacccu

SEQ ID NO: 1364618 - RNA, 15 nt, Human
agugcccucucccac

SEQ ID NO: 1364619 - RNA, 13 nt, Human
agugcccucuccc

SEQ ID NO: 1364620 - RNA, 22 nt, Human
agugcccucucccacccucuuc

SEQ ID NO: 1364621 - RNA, 21 nt, Human
agugcccucucccacccucuu

SEQ ID NO: 1364622 - RNA, 18 nt, Human
agugcccccacugaccag

SEQ ID NO: 1364623 - RNA, 23 nt, Human
agugccaguauuuuaaaauagcg

SEQ ID NO: 1364624 - RNA, 16 nt, Human
agugccauuaacaaau

SEQ ID NO: 1364625 - RNA, 12 nt, Human
agugcccucucc

SEQ ID NO: 1364626 - RNA, 23 nt, Human
uguguccaaaaccgccagcucug

SEQ ID NO: 1364627 - RNA, 21 nt, Human
uguguccaaaaccgccagcuc

SEQ ID NO: 1364628 - RNA, 19 nt, Human
uguguccaaaaccgccagc

SEQ ID NO: 1364629 - RNA, 17 nt, Human
uguguccaaaaccgcca

SEQ ID NO: 1364630 - RNA, 20 nt, Human
ugugguuuucuuuugccaug

SEQ ID NO: 1364631 - RNA, 21 nt, Human
ugugguuuucuuuugccauga

SEQ ID NO: 1364632 - RNA, 19 nt, Human
ugugguuuucuuuugccau

SEQ ID NO: 1364633 - RNA, 18 nt, Human
ugugguuuucgagauuau

SEQ ID NO: 1364634 - RNA, 23 nt, Human
uguggucacagcuguauagcugc

SEQ ID NO: 1364635 - RNA, 23 nt, Human
uguggucacagcggaggugugga

SEQ ID NO: 1364636 - RNA, 15 nt, Human
uguggucacagcugu

SEQ ID NO: 1364637 - RNA, 14 nt, Human
uguguccugguucc

SEQ ID NO: 1364638 - RNA, 14 nt, Human
uguguccugacacu

SEQ ID NO: 1364639 - RNA, 17 nt, Human
uguguccugacacugca

SEQ ID NO: 1364640 - RNA, 21 nt, Human
ugugucccccucuguccaggc

SEQ ID NO: 1364641 - RNA, 18 nt, Human
ugugucccccucugucca

SEQ ID NO: 1364642 - RNA, 16 nt, Human
ugugucccccucuguc

SEQ ID NO: 1364643 - RNA, 20 nt, Human
ugugucccaugaucccugug

SEQ ID NO: 1364644 - RNA, 19 nt, Human
ugugucccaugaucccugu

SEQ ID NO: 1364645 - RNA, 23 nt, Human
ugugucccagaagaugacugagg

SEQ ID NO: 1364646 - RNA, 21 nt, Human
ugugucccagaagaugacuga

SEQ ID NO: 1364647 - RNA, 20 nt, Human
uguguccaugcgcucagggc

SEQ ID NO: 1364648 - RNA, 19 nt, Human
uguguccacgacugucucc

SEQ ID NO: 1364649 - RNA, 18 nt, Human
uguguccacgacugucuc

SEQ ID NO: 1364650 - RNA, 17 nt, Human
uguguccacgacugucu

SEQ ID NO: 1364651 - RNA, 16 nt, Human
uguguccaaaacugcc

SEQ ID NO: 1364652 - RNA, 16 nt, Human
ugugucuuaauuauua

SEQ ID NO: 1364653 - RNA, 14 nt, Human
ugugucuuaauuau

SEQ ID NO: 1364654 - RNA, 14 nt, Human
ugugucugcucagu

SEQ ID NO: 1364655 - RNA, 18 nt, Human
uguguguugucucuugag

SEQ ID NO: 1364656 - RNA, 21 nt, Human
uguguguugauacuguugcac

SEQ ID NO: 1364657 - RNA, 20 nt, Human
uguguguugauacuguugca

SEQ ID NO: 1364658 - RNA, 19 nt, Human
uguguguugauacuguugc

SEQ ID NO: 1364659 - RNA, 17 nt, Human
uguguguugauacuguu

SEQ ID NO: 1364660 - RNA, 20 nt, Human
uguuaagacuugacagugga

SEQ ID NO: 1364661 - RNA, 17 nt, Human
uguuaagacuugacagu

SEQ ID NO: 1364662 - RNA, 15 nt, Human
uguuaagacuugaca

SEQ ID NO: 1364663 - RNA, 22 nt, Human
uguuaacugaauaccacucugu

SEQ ID NO: 1364664 - RNA, 18 nt, Human
uguuaacugaauaccacu

SEQ ID NO: 1364665 - RNA, 17 nt, Human
uguuaacugaauaccac

SEQ ID NO: 1364666 - RNA, 15 nt, Human
uguuaacugaauacc

SEQ ID NO: 1364667 - RNA, 14 nt, Human
uguuaacugaauac

SEQ ID NO: 1364668 - RNA, 12 nt, Human
uguuaacugaau

SEQ ID NO: 1364669 - RNA, 23 nt, Human
uguguuacuaaaaaaaagaugaa

SEQ ID NO: 1364670 - RNA, 23 nt, Human
uguguuaccugaaaacacugugc

SEQ ID NO: 1364671 - RNA, 23 nt, Human
uguguuaucacccagaagaaaau

SEQ ID NO: 1364672 - RNA, 22 nt, Human
uguguuaucacccagaagaaaa

SEQ ID NO: 1364673 - RNA, 19 nt, Human
uguuaauauugauuuauua

SEQ ID NO: 1364674 - RNA, 21 nt, Human
uguuaaguuauagugaauacu

SEQ ID NO: 1364675 - RNA, 17 nt, Human
uguuaaguuauagugaa

SEQ ID NO: 1364676 - RNA, 18 nt, Human
uguuacacuuuuuggaag

SEQ ID NO: 1364677 - RNA, 13 nt, Human
uguuaauauugau

SEQ ID NO: 1364678 - RNA, 17 nt, Human
uguuacaaauuguagaa

SEQ ID NO: 1364679 - RNA, 18 nt, Human
uguuacaaauuguagaag

SEQ ID NO: 1364680 - RNA, 20 nt, Human
aguggcagcccagccagcgu

SEQ ID NO: 1364681 - RNA, 17 nt, Human
aguggcagcccagccag

SEQ ID NO: 1364682 - RNA, 16 nt, Human
aguggcagcccagcca

SEQ ID NO: 1364683 - RNA, 15 nt, Human
aguggcagcccagcc

SEQ ID NO: 1364684 - RNA, 14 nt, Human
aguggcagcccagc

SEQ ID NO: 1364685 - RNA, 13 nt, Human
aguggcagcccag

SEQ ID NO: 1364686 - RNA, 22 nt, Human
aguggacuggccucaaagcaag

SEQ ID NO: 1364687 - RNA, 16 nt, Human
aguggaugcugggucc

SEQ ID NO: 1364688 - RNA, 16 nt, Human
aguggacucagggcag

SEQ ID NO: 1364689 - RNA, 13 nt, Human
aguggacucaggg

SEQ ID NO: 1364690 - RNA, 20 nt, Human
agugggguuaucucuguguu

SEQ ID NO: 1364691 - RNA, 20 nt, Human
agugggguggugucagaccc

SEQ ID NO: 1364692 - RNA, 19 nt, Human
agugggguuaucucugugu

SEQ ID NO: 1364693 - RNA, 18 nt, Human
agugggguuaucucugug

SEQ ID NO: 1364694 - RNA, 19 nt, Human
aguggggguggggguaggg

SEQ ID NO: 1364695 - RNA, 16 nt, Human
aguggggguggggggu

SEQ ID NO: 1364696 - RNA, 12 nt, Human
aguggggguggg

SEQ ID NO: 1364697 - RNA, 21 nt, Human
aguggcagcccagccagcguc

SEQ ID NO: 1364698 - RNA, 22 nt, Human
agugggcuugauucugcaguaa

SEQ ID NO: 1364699 - RNA, 16 nt, Human
agugggcuugauucug

SEQ ID NO: 1364700 - RNA, 16 nt, Human
aguggggaaugaagau

SEQ ID NO: 1364701 - RNA, 17 nt, Human
auacuaaaaagaagugc

SEQ ID NO: 1364702 - RNA, 13 nt, Human
auacuaaaaagaa

SEQ ID NO: 1364703 - RNA, 15 nt, Human
auacgguggggguag

SEQ ID NO: 1364704 - RNA, 13 nt, Human
auacuaaccagca

SEQ ID NO: 1364705 - RNA, 19 nt, Human
auacuaaccagcagaaaug

SEQ ID NO: 1364706 - RNA, 20 nt, Human
auacuaaccagcagaaaugc

SEQ ID NO: 1364707 - RNA, 22 nt, Human
auacuauuaaaaagguuuacag

SEQ ID NO: 1364708 - RNA, 23 nt, Human
auacuauguggaugugacagugg

SEQ ID NO: 1364709 - RNA, 19 nt, Human
auacuauguggaugugaca

SEQ ID NO: 1364710 - RNA, 21 nt, Human
auacuagggagccauuugaga

SEQ ID NO: 1364711 - RNA, 19 nt, Human
auacuaaaaagaagugcug

SEQ ID NO: 1364712 - RNA, 14 nt, Human
auacuauauuuaug

SEQ ID NO: 1364713 - RNA, 14 nt, Human
auacuauaguacca

SEQ ID NO: 1364714 - RNA, 20 nt, Human
auacuagggagccauuugag

SEQ ID NO: 1364715 - RNA, 13 nt, Human
uuaucacacaaag

SEQ ID NO: 1364716 - RNA, 19 nt, Human
uuaucacacaaagcagaau

SEQ ID NO: 1364717 - RNA, 15 nt, Human
uuaucaaaacuuucu

SEQ ID NO: 1364718 - RNA, 15 nt, Human
uuauauuuugcaguu

SEQ ID NO: 1364719 - RNA, 21 nt, Human
auacuauuaaaaagguuuaca

SEQ ID NO: 1364720 - RNA, 19 nt, Human
uuauauuugaaauauugac

SEQ ID NO: 1364721 - RNA, 16 nt, Human
auacgacaguacacug

SEQ ID NO: 1364722 - RNA, 21 nt, Human
auacgaaauaauuguuguucu

SEQ ID NO: 1364723 - RNA, 19 nt, Human
auacgaaauaauuguuguu

SEQ ID NO: 1364724 - RNA, 18 nt, Human
auacgaaauaauuguugu

SEQ ID NO: 1364725 - RNA, 15 nt, Human
auacgaaauaauugu

SEQ ID NO: 1364726 - RNA, 14 nt, Human
auacgaaauaauug

SEQ ID NO: 1364727 - RNA, 19 nt, Human
auaccacucuguaauugca

SEQ ID NO: 1364728 - RNA, 18 nt, Human
auaccacucuguaauugc

SEQ ID NO: 1364729 - RNA, 17 nt, Human
auaccacucuguaauug

SEQ ID NO: 1364730 - RNA, 15 nt, Human
auaccacucuguaau

SEQ ID NO: 1364731 - RNA, 14 nt, Human
auaccacucuguaa

SEQ ID NO: 1364732 - RNA, 17 nt, Human
auaccagccaguaaaug

SEQ ID NO: 1364733 - RNA, 14 nt, Human
auaccuuuuuuaga

SEQ ID NO: 1364734 - RNA, 17 nt, Human
auaccacgcuagggcug

SEQ ID NO: 1364735 - RNA, 17 nt, Human
auaccacuuuuguucuu

SEQ ID NO: 1364736 - RNA, 18 nt, Human
auaccacuuuuguucuug

SEQ ID NO: 1364737 - RNA, 19 nt, Human
auacgagagcagaggucuc

SEQ ID NO: 1364738 - RNA, 20 nt, Human
auacgagagcagaggucucc

SEQ ID NO: 1364739 - RNA, 17 nt, Human
auacgagagcagagguc

SEQ ID NO: 1364740 - RNA, 16 nt, Human
auacgagagcagaggu

SEQ ID NO: 1364741 - RNA, 13 nt, Human
auacggugggggu

SEQ ID NO: 1364742 - RNA, 15 nt, Human
auacggcuccccagu

SEQ ID NO: 1364743 - RNA, 21 nt, Human
auacgcuggcaacacagaggc

SEQ ID NO: 1364744 - RNA, 23 nt, Human
auacgcucagcucauccaugccu

SEQ ID NO: 1364745 - RNA, 21 nt, Human
auacgcucagcucauccaugc

SEQ ID NO: 1364746 - RNA, 14 nt, Human
auacgcucagcuca

SEQ ID NO: 1364747 - RNA, 13 nt, Human
auacguacacauu

SEQ ID NO: 1364748 - RNA, 19 nt, Human
auacgugggcauucaaaug

SEQ ID NO: 1364749 - RNA, 18 nt, Human
auacgugggcauucaaau

SEQ ID NO: 1364750 - RNA, 16 nt, Human
auacguacacauuuua

SEQ ID NO: 1364751 - RNA, 14 nt, Human
auacguacacauuu

SEQ ID NO: 1364752 - RNA, 15 nt, Human
auacguacacauuuu

SEQ ID NO: 1364753 - RNA, 20 nt, Human
auacagaauuacuguaacug

SEQ ID NO: 1364754 - RNA, 23 nt, Human
auacagaacucuuucaaaaccuu

SEQ ID NO: 1364755 - RNA, 20 nt, Human
auacagaacucuuucaaaac

SEQ ID NO: 1364756 - RNA, 18 nt, Human
auacagaacucuuucaaa

SEQ ID NO: 1364757 - RNA, 16 nt, Human
auacagaacucuuuca

SEQ ID NO: 1364758 - RNA, 15 nt, Human
auacagaacucuuuc

SEQ ID NO: 1364759 - RNA, 14 nt, Human
auacagaacucuuu

SEQ ID NO: 1364760 - RNA, 12 nt, Human
auacaagacugc

SEQ ID NO: 1364761 - RNA, 15 nt, Human
auacagagaagucac

SEQ ID NO: 1364762 - RNA, 14 nt, Human
auacagagaaguca

SEQ ID NO: 1364763 - RNA, 12 nt, Human
uuauaaacuuuu

SEQ ID NO: 1364764 - RNA, 16 nt, Human
uuauaaacuuuuuucu

SEQ ID NO: 1364765 - RNA, 17 nt, Human
uuauaaacuuuaccuuu

SEQ ID NO: 1364766 - RNA, 18 nt, Human
uuauaaacuuuaccuuuu

SEQ ID NO: 1364767 - RNA, 15 nt, Human
uuauaaauauauuua

SEQ ID NO: 1364768 - RNA, 19 nt, Human
uuauaaauacugcaaauca

SEQ ID NO: 1364769 - RNA, 22 nt, Human
uuauaaacuuuuuucuuacugu

SEQ ID NO: 1364770 - RNA, 12 nt, Human
auacauacagaa

SEQ ID NO: 1364771 - RNA, 17 nt, Human
auacauacagaauuacu

SEQ ID NO: 1364772 - RNA, 20 nt, Human
auacaguuacucagaauucu

SEQ ID NO: 1364773 - RNA, 18 nt, Human
auacauagggauaugcgu

SEQ ID NO: 1364774 - RNA, 18 nt, Human
auacaugcuaagagaagu

SEQ ID NO: 1364775 - RNA, 22 nt, Human
auacaugcuaagagaaguagaa

SEQ ID NO: 1364776 - RNA, 22 nt, Human
auacauguaauucuaccaaggu

SEQ ID NO: 1364777 - RNA, 15 nt, Human
auacaggaaacaguu

SEQ ID NO: 1364778 - RNA, 14 nt, Human
auacaggaaacagu

SEQ ID NO: 1364779 - RNA, 13 nt, Human
auacaggaaacag

SEQ ID NO: 1364780 - RNA, 18 nt, Human
auacagauauauuuucuu

SEQ ID NO: 1364781 - RNA, 17 nt, Human
auacagaucaucuugga

SEQ ID NO: 1364782 - RNA, 14 nt, Human
auacagauauauuu

SEQ ID NO: 1364783 - RNA, 13 nt, Human
auacagauauauu

SEQ ID NO: 1364784 - RNA, 23 nt, Human
auacagagaagucacagggcagu

SEQ ID NO: 1364785 - RNA, 20 nt, Human
auacagucuuccauuugcaa

SEQ ID NO: 1364786 - RNA, 19 nt, Human
auacagucuuccauuugca

SEQ ID NO: 1364787 - RNA, 18 nt, Human
auacaguuacucagaauu

SEQ ID NO: 1364788 - RNA, 16 nt, Human
auacaggaaacaguug

SEQ ID NO: 1364789 - RNA, 17 nt, Human
auacaggagauucucuu

SEQ ID NO: 1364790 - RNA, 21 nt, Human
auacaggaugaugacuaugga

SEQ ID NO: 1364791 - RNA, 23 nt, Human
uuaugacaucacuuguacaaaau

SEQ ID NO: 1364792 - RNA, 21 nt, Human
uuaugacaucacuuguacaaa

SEQ ID NO: 1364793 - RNA, 18 nt, Human
uuaugacaucacuuguac

SEQ ID NO: 1364794 - RNA, 16 nt, Human
uuaugacaucacuugu

SEQ ID NO: 1364795 - RNA, 20 nt, Human
uuaugaaugugaagccuucc

SEQ ID NO: 1364796 - RNA, 19 nt, Human
uuaugaaugugaagccuuc

SEQ ID NO: 1364797 - RNA, 21 nt, Human
uuaugaauuacauuuguauaa

SEQ ID NO: 1364798 - RNA, 17 nt, Human
uuaugaauuacauuugu

SEQ ID NO: 1364799 - RNA, 16 nt, Human
uuaugaauuacauuug

SEQ ID NO: 1364800 - RNA, 18 nt, Human
uuaugaaugugaagccuu

SEQ ID NO: 1364801 - RNA, 17 nt, Human
uuaugaaugugaagccu

SEQ ID NO: 1364802 - RNA, 14 nt, Human
uuaugaauuacauu

SEQ ID NO: 1364803 - RNA, 18 nt, Human
uuaugagcucuucauguu

SEQ ID NO: 1364804 - RNA, 15 nt, Human
uuaugagaaagccuu

SEQ ID NO: 1364805 - RNA, 22 nt, Human
uuaugagaaacuuaaauguuau

SEQ ID NO: 1364806 - RNA, 13 nt, Human
uuaugagaaacuu

SEQ ID NO: 1364807 - RNA, 15 nt, Human
uuaugacugccaaga

SEQ ID NO: 1364808 - RNA, 15 nt, Human
uuaugacuauguaaa

SEQ ID NO: 1364809 - RNA, 16 nt, Human
uuaugacuauguaaac

SEQ ID NO: 1364810 - RNA, 20 nt, Human
uuaugauacuugaaaauuaa

SEQ ID NO: 1364811 - RNA, 22 nt, Human
uuaugauagcaaauggccucau

SEQ ID NO: 1364812 - RNA, 17 nt, Human
uuaugauaauagauucu

SEQ ID NO: 1364813 - RNA, 16 nt, Human
uuaugauaauagauuc

SEQ ID NO: 1364814 - RNA, 20 nt, Human
uuaucccucaccuguagcag

SEQ ID NO: 1364815 - RNA, 17 nt, Human
uuaucccucaccuguag

SEQ ID NO: 1364816 - RNA, 15 nt, Human
uuaucccucaccugu

SEQ ID NO: 1364817 - RNA, 15 nt, Human
uuaucccagcugccu

SEQ ID NO: 1364818 - RNA, 13 nt, Human
uuaucccagcugc

SEQ ID NO: 1364819 - RNA, 23 nt, Human
uuaucccaaaguuguuguaaccu

SEQ ID NO: 1364820 - RNA, 19 nt, Human
uuauccauauugagucaaa

SEQ ID NO: 1364821 - RNA, 17 nt, Human
uuauccauauugaguca

SEQ ID NO: 1364822 - RNA, 16 nt, Human
uuaucauuuucaaaau

SEQ ID NO: 1364823 - RNA, 12 nt, Human
uuaucauuuuca

SEQ ID NO: 1364824 - RNA, 18 nt, Human
uuaucaccgugggcuccc

SEQ ID NO: 1364825 - RNA, 17 nt, Human
uuaucacccagaagaaa

SEQ ID NO: 1364826 - RNA, 18 nt, Human
uuaucacccagaagaaaa

SEQ ID NO: 1364827 - RNA, 19 nt, Human
uuaucacccagaagaaaau

SEQ ID NO: 1364828 - RNA, 21 nt, Human
uuaucacccagaagaaaauag

SEQ ID NO: 1364829 - RNA, 19 nt, Human
uuaugaaauucacccccuu

SEQ ID NO: 1364830 - RNA, 19 nt, Human
uuaugaaacuuuuggaagg

SEQ ID NO: 1364831 - RNA, 22 nt, Human
uuaugaagaaggugaauagcca

SEQ ID NO: 1364832 - RNA, 20 nt, Human
uuaugaagcuuuuaugugaa

SEQ ID NO: 1364833 - RNA, 18 nt, Human
uuaugaaacuuuuggaag

SEQ ID NO: 1364834 - RNA, 17 nt, Human
uuaugaaacuuuuggaa

SEQ ID NO: 1364835 - RNA, 14 nt, Human
uuaugaaacuuuug

SEQ ID NO: 1364836 - RNA, 19 nt, Human
uuaugaaaaagaagaaucu

SEQ ID NO: 1364837 - RNA, 18 nt, Human
uuaugaaaaagaagaauc

SEQ ID NO: 1364838 - RNA, 16 nt, Human
uuaucccagcugccua

SEQ ID NO: 1364839 - RNA, 23 nt, Human
uuaugggaaccccuucauccucu

SEQ ID NO: 1364840 - RNA, 22 nt, Human
uuaugauuaaguaaugauaacu

SEQ ID NO: 1364841 - RNA, 19 nt, Human
uuauggcuuuugugcauua

SEQ ID NO: 1364842 - RNA, 19 nt, Human
uuaugauuaaguaaugaua

SEQ ID NO: 1364843 - RNA, 21 nt, Human
uuaugaucuggcccuugcuua

SEQ ID NO: 1364844 - RNA, 13 nt, Human
uuaugaucuggcc

SEQ ID NO: 1364845 - RNA, 18 nt, Human
uuaugauaauagauucuc

SEQ ID NO: 1364846 - RNA, 23 nt, Human
uuaugguaacugcuuucuguucc

SEQ ID NO: 1364847 - RNA, 22 nt, Human
uuaugguaacugcuuucuguuc

SEQ ID NO: 1364848 - RNA, 21 nt, Human
uuaugguaacugcuuucuguu

SEQ ID NO: 1364849 - RNA, 15 nt, Human
uuaugggucacagga

SEQ ID NO: 1364850 - RNA, 13 nt, Human
uuaugggucacag

SEQ ID NO: 1364851 - RNA, 11 nt, Human
uuaugggucac

SEQ ID NO: 1364852 - RNA, 20 nt, Human
uuaugugguuuuagauuuuc

SEQ ID NO: 1364853 - RNA, 19 nt, Human
uuaugugguuuuagauuuu

SEQ ID NO: 1364854 - RNA, 18 nt, Human
uuaugugguuuuagauuu

SEQ ID NO: 1364855 - RNA, 16 nt, Human
uuaugugguuuuagau

SEQ ID NO: 1364856 - RNA, 16 nt, Human
uuaugugaucaugugu

SEQ ID NO: 1364857 - RNA, 15 nt, Human
uuaugugaaacaugu

SEQ ID NO: 1364858 - RNA, 14 nt, Human
uuaugugacauuuu

SEQ ID NO: 1364859 - RNA, 19 nt, Human
uuaugugacauuuuacauu

SEQ ID NO: 1364860 - RNA, 22 nt, Human
uuaugugccagauuuaugcaua

SEQ ID NO: 1364861 - RNA, 20 nt, Human
uuaugugacauuuuacauua

SEQ ID NO: 1364862 - RNA, 21 nt, Human
uuauguaguuuuuauauguug

SEQ ID NO: 1364863 - RNA, 11 nt, Human
uuauguaguuu

SEQ ID NO: 1364864 - RNA, 18 nt, Human
uuauguagcucuuuguca

SEQ ID NO: 1364865 - RNA, 19 nt, Human
uuauguaguaauugacaug

SEQ ID NO: 1364866 - RNA, 16 nt, Human
uuauguaguaauugac

SEQ ID NO: 1364867 - RNA, 15 nt, Human
uuauguaguaauuga

SEQ ID NO: 1364868 - RNA, 16 nt, Human
uuauguagcucuuugu

SEQ ID NO: 1364869 - RNA, 13 nt, Human
uuauguagcucuu

SEQ ID NO: 1364870 - RNA, 11 nt, Human
uuauguaauuu

SEQ ID NO: 1364871 - RNA, 13 nt, Human
uuauguaauuuca

SEQ ID NO: 1364872 - RNA, 17 nt, Human
uuauguaaauuauguaa

SEQ ID NO: 1364873 - RNA, 22 nt, Human
uuauguaaauuaucaggcaaau

SEQ ID NO: 1364874 - RNA, 15 nt, Human
uuaugucucuucuga

SEQ ID NO: 1364875 - RNA, 14 nt, Human
uuauguauugugca

SEQ ID NO: 1364876 - RNA, 20 nt, Human
uuauguauugugcaaugugu

SEQ ID NO: 1364877 - RNA, 11 nt, Human
uuaugucuggg

SEQ ID NO: 1364878 - RNA, 17 nt, Human
uuaugucuguggauuuu

SEQ ID NO: 1364879 - RNA, 13 nt, Human
uuaugugaaacau

SEQ ID NO: 1364880 - RNA, 16 nt, Human
uuauuauuauuuuuua

SEQ ID NO: 1364881 - RNA, 14 nt, Human
uuauuaugcauuau

SEQ ID NO: 1364882 - RNA, 13 nt, Human
uuauuaugcauga

SEQ ID NO: 1364883 - RNA, 22 nt, Human
uuauuauuuguguuuuaauuua

SEQ ID NO: 1364884 - RNA, 12 nt, Human
uuauucaauaaa

SEQ ID NO: 1364885 - RNA, 21 nt, Human
uuauucaauuuauuugaauga

SEQ ID NO: 1364886 - RNA, 20 nt, Human
uuauucaauuuauuugaaug

SEQ ID NO: 1364887 - RNA, 18 nt, Human
uuauucaauuuauuugaa

SEQ ID NO: 1364888 - RNA, 17 nt, Human
uuauucaauuuauuuga

SEQ ID NO: 1364889 - RNA, 14 nt, Human
uuauucaauaaagu

SEQ ID NO: 1364890 - RNA, 17 nt, Human
uuauucaauaaaguauu

SEQ ID NO: 1364891 - RNA, 19 nt, Human
uuauucaauaaaguauuua

SEQ ID NO: 1364892 - RNA, 20 nt, Human
uuauucaauaaaguauuuaa

SEQ ID NO: 1364893 - RNA, 21 nt, Human
uuauucaauaaaguauuuaau

SEQ ID NO: 1364894 - RNA, 15 nt, Human
uuauucagggaagga

SEQ ID NO: 1364895 - RNA, 14 nt, Human
uuauucagugucac

SEQ ID NO: 1364896 - RNA, 13 nt, Human
uuauucaguguca

SEQ ID NO: 1364897 - RNA, 12 nt, Human
uuauucauaauu

SEQ ID NO: 1364898 - RNA, 13 nt, Human
uuauuaugaagaa

SEQ ID NO: 1364899 - RNA, 12 nt, Human
uuauuaugcaug

SEQ ID NO: 1364900 - RNA, 15 nt, Human
uuauuauauuuacaa

SEQ ID NO: 1364901 - RNA, 22 nt, Human
uuauuauaaucuuauaauuguu

SEQ ID NO: 1364902 - RNA, 21 nt, Human
uuauuauaaucuuauaauugu

SEQ ID NO: 1364903 - RNA, 18 nt, Human
uuauguuauauauaaaua

SEQ ID NO: 1364904 - RNA, 17 nt, Human
uuauguuauauauaaau

SEQ ID NO: 1364905 - RNA, 16 nt, Human
uuauguuauauauaaa

SEQ ID NO: 1364906 - RNA, 15 nt, Human
uuauguuauauauaa

SEQ ID NO: 1364907 - RNA, 13 nt, Human
uuauguuauauau

SEQ ID NO: 1364908 - RNA, 22 nt, Human
uuauguuaagggaagaauucca

SEQ ID NO: 1364909 - RNA, 17 nt, Human
uuauguuaaaucaauaa

SEQ ID NO: 1364910 - RNA, 14 nt, Human
uuauguuaaacuag

SEQ ID NO: 1364911 - RNA, 19 nt, Human
uuauguuaaaacugggaca

SEQ ID NO: 1364912 - RNA, 10 nt, Human
uuauguuaaa

SEQ ID NO: 1364913 - RNA, 11 nt, Human
uuauguuaaac

SEQ ID NO: 1364914 - RNA, 12 nt, Human
uuauguuaaacu

SEQ ID NO: 1364915 - RNA, 13 nt, Human
uuauguuaaacua

SEQ ID NO: 1364916 - RNA, 14 nt, Human
uuauuauauuuaca

SEQ ID NO: 1364917 - RNA, 18 nt, Human
uuauuaguauuguugucc

SEQ ID NO: 1364918 - RNA, 19 nt, Human
uuauuaguauuguuguccu

SEQ ID NO: 1364919 - RNA, 16 nt, Human
uuauuaguauuguugu

SEQ ID NO: 1364920 - RNA, 23 nt, Human
uuauucccuuccugccagccccu

SEQ ID NO: 1364921 - RNA, 13 nt, Human
uuauucccuuccu

SEQ ID NO: 1364922 - RNA, 20 nt, Human
uuauuccccauucuuccuag

SEQ ID NO: 1364923 - RNA, 23 nt, Human
uuauuccaugacugcuugcccua

SEQ ID NO: 1364924 - RNA, 16 nt, Human
uuauuccaugacugcu

SEQ ID NO: 1364925 - RNA, 13 nt, Human
uuauuccaugacu

SEQ ID NO: 1364926 - RNA, 22 nt, Human
uuauuccagaaugcuguacauc

SEQ ID NO: 1364927 - RNA, 20 nt, Human
uuauuccagaaugcuguaca

SEQ ID NO: 1364928 - RNA, 17 nt, Human
uuauuccagaaugcugu

SEQ ID NO: 1364929 - RNA, 18 nt, Human
uuauucccuuccugccag

SEQ ID NO: 1364930 - RNA, 20 nt, Human
uuauuccuccugcucauauu

SEQ ID NO: 1364931 - RNA, 16 nt, Human
uuauuccuccugcuca

SEQ ID NO: 1364932 - RNA, 23 nt, Human
auacucuagaugaaguuuuacau

SEQ ID NO: 1364933 - RNA, 17 nt, Human
auacucuagaugaaguu

SEQ ID NO: 1364934 - RNA, 17 nt, Human
auacucauuuuucauga

SEQ ID NO: 1364935 - RNA, 20 nt, Human
auacucucaccauuuggauc

SEQ ID NO: 1364936 - RNA, 18 nt, Human
auacucuuauaucuauau

SEQ ID NO: 1364937 - RNA, 14 nt, Human
auacucuuauaucu

SEQ ID NO: 1364938 - RNA, 22 nt, Human
auacugaacaucugaguccugg

SEQ ID NO: 1364939 - RNA, 23 nt, Human
auacugaacaucugaguccugga

SEQ ID NO: 1364940 - RNA, 20 nt, Human
auacugaacaucugaguccu

SEQ ID NO: 1364941 - RNA, 15 nt, Human
auacugaacaucuga

SEQ ID NO: 1364942 - RNA, 23 nt, Human
auacucuuucuguauauacuuuu

SEQ ID NO: 1364943 - RNA, 22 nt, Human
auacucuuucuguauauacuuu

SEQ ID NO: 1364944 - RNA, 17 nt, Human
auacucuuucuguauau

SEQ ID NO: 1364945 - RNA, 16 nt, Human
auacucuuucuguaua

SEQ ID NO: 1364946 - RNA, 15 nt, Human
auacucuuucuguau

SEQ ID NO: 1364947 - RNA, 14 nt, Human
auacucuuucugua

SEQ ID NO: 1364948 - RNA, 21 nt, Human
auacugcauacuuuuuaaaug

SEQ ID NO: 1364949 - RNA, 15 nt, Human
auacugcauacuuuu

SEQ ID NO: 1364950 - RNA, 14 nt, Human
auacuggaaagcuu

SEQ ID NO: 1364951 - RNA, 21 nt, Human
auacugcuuggagcugagcaa

SEQ ID NO: 1364952 - RNA, 20 nt, Human
auacugcuuggagcugagca

SEQ ID NO: 1364953 - RNA, 15 nt, Human
auacugcuuggagcu

SEQ ID NO: 1364954 - RNA, 22 nt, Human
auacugcugagauacauacaga

SEQ ID NO: 1364955 - RNA, 10 nt, Human
auacugcuug

SEQ ID NO: 1364956 - RNA, 21 nt, Human
auacugcugagauacauacag

SEQ ID NO: 1364957 - RNA, 19 nt, Human
auacugcugagauacauac

SEQ ID NO: 1364958 - RNA, 18 nt, Human
auacugcugagauacaua

SEQ ID NO: 1364959 - RNA, 12 nt, Human
auacugcugaga

SEQ ID NO: 1364960 - RNA, 22 nt, Human
auacugcuacagcaauuucuaa

SEQ ID NO: 1364961 - RNA, 19 nt, Human
auacugcuacagcaauuuc

SEQ ID NO: 1364962 - RNA, 15 nt, Human
auacugcuacagcaa

SEQ ID NO: 1364963 - RNA, 22 nt, Human
auacugcgacuuucugccugga

SEQ ID NO: 1364964 - RNA, 20 nt, Human
auacugcgacuuucugccug

SEQ ID NO: 1364965 - RNA, 19 nt, Human
auacugcgacuuucugccu

SEQ ID NO: 1364966 - RNA, 15 nt, Human
auacuggccuggacu

SEQ ID NO: 1364967 - RNA, 14 nt, Human
auacuggccuggac

SEQ ID NO: 1364968 - RNA, 22 nt, Human
auagaauuauaacuggaaagaa

SEQ ID NO: 1364969 - RNA, 17 nt, Human
auagacaaauagaaaau

SEQ ID NO: 1364970 - RNA, 16 nt, Human
auagacaaauagaaaa

SEQ ID NO: 1364971 - RNA, 14 nt, Human
auagacaauugagg

SEQ ID NO: 1364972 - RNA, 16 nt, Human
auagacaauuuauuau

SEQ ID NO: 1364973 - RNA, 22 nt, Human
auagacaauuuauuauggcaca

SEQ ID NO: 1364974 - RNA, 18 nt, Human
auagacagaagaaacaag

SEQ ID NO: 1364975 - RNA, 15 nt, Human
auagacagcaugaga

SEQ ID NO: 1364976 - RNA, 19 nt, Human
auagacagaagaaacaagg

SEQ ID NO: 1364977 - RNA, 17 nt, Human
auagacagaagaaacaa

SEQ ID NO: 1364978 - RNA, 16 nt, Human
auagacagaagaaaca

SEQ ID NO: 1364979 - RNA, 14 nt, Human
auagacagaagaaa

SEQ ID NO: 1364980 - RNA, 13 nt, Human
auagacagaagaa

SEQ ID NO: 1364981 - RNA, 19 nt, Human
auagacaaauagaaaaugg

SEQ ID NO: 1364982 - RNA, 21 nt, Human
auagacaauugagguaaguuu

SEQ ID NO: 1364983 - RNA, 22 nt, Human
auagacacuccccgaagucuuu

SEQ ID NO: 1364984 - RNA, 12 nt, Human
auagacacgcac

SEQ ID NO: 1364985 - RNA, 23 nt, Human
auagacaauuuauuauggcacau

SEQ ID NO: 1364986 - RNA, 22 nt, Human
auagaauaaaggcaguuuucua

SEQ ID NO: 1364987 - RNA, 20 nt, Human
auagaauaaaggcaguuuuc

SEQ ID NO: 1364988 - RNA, 18 nt, Human
auagaaugguaucaauaa

SEQ ID NO: 1364989 - RNA, 13 nt, Human
auagaaugacagu

SEQ ID NO: 1364990 - RNA, 14 nt, Human
auagaauaaaauuu

SEQ ID NO: 1364991 - RNA, 19 nt, Human
auagaauaaaauuuuuaau

SEQ ID NO: 1364992 - RNA, 19 nt, Human
auagaauaaaggcaguuuu

SEQ ID NO: 1364993 - RNA, 18 nt, Human
auagaauaaaggcaguuu

SEQ ID NO: 1364994 - RNA, 17 nt, Human
auagaauaaaggcaguu

SEQ ID NO: 1364995 - RNA, 12 nt, Human
auagaauaaagg

SEQ ID NO: 1364996 - RNA, 22 nt, Human
auagaauaaaauuuuuaaucuu

SEQ ID NO: 1364997 - RNA, 14 nt, Human
auagaacugaauga

SEQ ID NO: 1364998 - RNA, 18 nt, Human
auagaacucugaaaugaa

SEQ ID NO: 1364999 - RNA, 14 nt, Human
auagaaguuuagau

SEQ ID NO: 1365000 - RNA, 13 nt, Human
auagaaggugaug

SEQ ID NO: 1365001 - RNA, 18 nt, Human
auagaaguauaaagaauu

SEQ ID NO: 1365002 - RNA, 13 nt, Human
auagaaguaaaaa

SEQ ID NO: 1365003 - RNA, 19 nt, Human
auacuguauauucaggacu

SEQ ID NO: 1365004 - RNA, 16 nt, Human
auacuguaguauucuu

SEQ ID NO: 1365005 - RNA, 14 nt, Human
auagaacaaggcug

SEQ ID NO: 1365006 - RNA, 14 nt, Human
auagagcuguauua

SEQ ID NO: 1365007 - RNA, 15 nt, Human
auagagccugaggga

SEQ ID NO: 1365008 - RNA, 13 nt, Human
auagagccugagg

SEQ ID NO: 1365009 - RNA, 20 nt, Human
auagagccggguguccccaa

SEQ ID NO: 1365010 - RNA, 19 nt, Human
auagagccgggugucccca

SEQ ID NO: 1365011 - RNA, 15 nt, Human
auagacuuaaaucuc

SEQ ID NO: 1365012 - RNA, 14 nt, Human
auagagacgggacu

SEQ ID NO: 1365013 - RNA, 18 nt, Human
auagauaggucagugcaa

SEQ ID NO: 1365014 - RNA, 22 nt, Human
auagaggauggucuuacagcag

SEQ ID NO: 1365015 - RNA, 13 nt, Human
auagagcuguauu

SEQ ID NO: 1365016 - RNA, 20 nt, Human
auagaugcuggcccagggcc

SEQ ID NO: 1365017 - RNA, 17 nt, Human
auagaugcuggcccagg

SEQ ID NO: 1365018 - RNA, 16 nt, Human
auagaugcuggcccag

SEQ ID NO: 1365019 - RNA, 15 nt, Human
auagaugcuggccca

SEQ ID NO: 1365020 - RNA, 21 nt, Human
auagauacccuacgcugucca

SEQ ID NO: 1365021 - RNA, 20 nt, Human
auagauaaaacaucuuugaa

SEQ ID NO: 1365022 - RNA, 21 nt, Human
auagauaaaacaucuuugaaa

SEQ ID NO: 1365023 - RNA, 20 nt, Human
auagauaagaguagaaacug

SEQ ID NO: 1365024 - RNA, 14 nt, Human
auagaguguuauca

SEQ ID NO: 1365025 - RNA, 22 nt, Human
auagaugggggaaagcaaagca

SEQ ID NO: 1365026 - RNA, 23 nt, Human
auagaugcuggcccagggcccag

SEQ ID NO: 1365027 - RNA, 13 nt, Human
auagaugucuuuu

SEQ ID NO: 1365028 - RNA, 12 nt, Human
auagauguuuga

SEQ ID NO: 1365029 - RNA, 17 nt, Human
auagaugucuuuuccca

SEQ ID NO: 1365030 - RNA, 14 nt, Human
auagaugucuuuuc

SEQ ID NO: 1365031 - RNA, 21 nt, Human
auagauuguccuuuugcaaag

SEQ ID NO: 1365032 - RNA, 20 nt, Human
auagauuguccuuuugcaaa

SEQ ID NO: 1365033 - RNA, 14 nt, Human
auagauuguccuuu

SEQ ID NO: 1365034 - RNA, 18 nt, Human
auagauucuaaagauucu

SEQ ID NO: 1365035 - RNA, 19 nt, Human
auagauucucuuguauaag

SEQ ID NO: 1365036 - RNA, 16 nt, Human
auagauucuaaagauu

SEQ ID NO: 1365037 - RNA, 15 nt, Human
auagauucuaaagau

SEQ ID NO: 1365038 - RNA, 14 nt, Human
auagauucuaaaga

SEQ ID NO: 1365039 - RNA, 13 nt, Human
auagauucuaaag

SEQ ID NO: 1365040 - RNA, 12 nt, Human
auagauucuaaa

SEQ ID NO: 1365041 - RNA, 23 nt, Human
aguuucuaagguccgguguucua

SEQ ID NO: 1365042 - RNA, 12 nt, Human
aguuucuaaggu

SEQ ID NO: 1365043 - RNA, 11 nt, Human
aguuucuaagg

SEQ ID NO: 1365044 - RNA, 20 nt, Human
aguuucuaagauucuaaagg

SEQ ID NO: 1365045 - RNA, 19 nt, Human
aguuucuaagauucuaaag

SEQ ID NO: 1365046 - RNA, 18 nt, Human
aguuucuaagauucuaaa

SEQ ID NO: 1365047 - RNA, 17 nt, Human
aguuucuaagauucuaa

SEQ ID NO: 1365048 - RNA, 16 nt, Human
aguuucuaagauucua

SEQ ID NO: 1365049 - RNA, 15 nt, Human
aguuucuaagauucu

SEQ ID NO: 1365050 - RNA, 14 nt, Human
aguuucuaagauuc

SEQ ID NO: 1365051 - RNA, 20 nt, Human
aguuucuaaacuggagacug

SEQ ID NO: 1365052 - RNA, 19 nt, Human
aguuucuaaacuggagacu

SEQ ID NO: 1365053 - RNA, 18 nt, Human
aguuucuaaacuggagac

SEQ ID NO: 1365054 - RNA, 17 nt, Human
aguuucuaaacuggaga

SEQ ID NO: 1365055 - RNA, 13 nt, Human
aguuuauuuguug

SEQ ID NO: 1365056 - RNA, 23 nt, Human
aguuucucugcagaaacuacuga

SEQ ID NO: 1365057 - RNA, 21 nt, Human
aguuuguguguugucucuuga

SEQ ID NO: 1365058 - RNA, 14 nt, Human
aguuuguguguugu

SEQ ID NO: 1365059 - RNA, 22 nt, Human
aguuugugugucuuaauuauua

SEQ ID NO: 1365060 - RNA, 22 nt, Human
aguuuguuaguaugaggcauuu

SEQ ID NO: 1365061 - RNA, 16 nt, Human
aguuugugugucuuaa

SEQ ID NO: 1365062 - RNA, 15 nt, Human
aguuugugugucuua

SEQ ID NO: 1365063 - RNA, 14 nt, Human
aguuugugugucuu

SEQ ID NO: 1365064 - RNA, 18 nt, Human
aguuuuaacuguggauau

SEQ ID NO: 1365065 - RNA, 13 nt, Human
aguuuuaacugug

SEQ ID NO: 1365066 - RNA, 22 nt, Human
aguuuuaaaaagccaguuuggg

SEQ ID NO: 1365067 - RNA, 13 nt, Human
aguuuguuuuugc

SEQ ID NO: 1365068 - RNA, 15 nt, Human
aguuuguugaaacac

SEQ ID NO: 1365069 - RNA, 16 nt, Human
uuaaauuuuuuguuga

SEQ ID NO: 1365070 - RNA, 18 nt, Human
uuaaauuuuuuguugaca

SEQ ID NO: 1365071 - RNA, 12 nt, Human
uuaacagaaaug

SEQ ID NO: 1365072 - RNA, 13 nt, Human
uuaacagaaaugu

SEQ ID NO: 1365073 - RNA, 14 nt, Human
uuaacagaaaugua

SEQ ID NO: 1365074 - RNA, 17 nt, Human
aguuuaucauucaagug

SEQ ID NO: 1365075 - RNA, 16 nt, Human
aguuuaucauucaagu

SEQ ID NO: 1365076 - RNA, 15 nt, Human
aguuuaucauucaag

SEQ ID NO: 1365077 - RNA, 14 nt, Human
aguuuaucauucaa

SEQ ID NO: 1365078 - RNA, 19 nt, Human
aguuuaucaguaaauaacu

SEQ ID NO: 1365079 - RNA, 18 nt, Human
aguuuaucaguaaauaac

SEQ ID NO: 1365080 - RNA, 18 nt, Human
aguuuauauuuaacucuc

SEQ ID NO: 1365081 - RNA, 16 nt, Human
aguuuauauuuaacuc

SEQ ID NO: 1365082 - RNA, 15 nt, Human
aguuuauauuuaacu

SEQ ID NO: 1365083 - RNA, 16 nt, Human
uuaaauuuuuuuuaca

SEQ ID NO: 1365084 - RNA, 16 nt, Human
uuaacagaaauguaca

SEQ ID NO: 1365085 - RNA, 15 nt, Human
uuaaaguuguuugug

SEQ ID NO: 1365086 - RNA, 23 nt, Human
uuaaaguuaguaucuuuugauau

SEQ ID NO: 1365087 - RNA, 23 nt, Human
uuaaaccaucucccuggugcuua

SEQ ID NO: 1365088 - RNA, 13 nt, Human
uuaaaauccucaa

SEQ ID NO: 1365089 - RNA, 12 nt, Human
uuaaaauccuca

SEQ ID NO: 1365090 - RNA, 19 nt, Human
uuaaaaaucucaaauuucu

SEQ ID NO: 1365091 - RNA, 20 nt, Human
uuaaaaaucucaaauuucua

SEQ ID NO: 1365092 - RNA, 17 nt, Human
uuaaaauguaaagccau

SEQ ID NO: 1365093 - RNA, 16 nt, Human
uuaaaauguaaagcca

SEQ ID NO: 1365094 - RNA, 12 nt, Human
uuaaaaugagaa

SEQ ID NO: 1365095 - RNA, 19 nt, Human
uuaaaaugagaaaucuaaa

SEQ ID NO: 1365096 - RNA, 19 nt, Human
uuaaaauguaugcauguug

SEQ ID NO: 1365097 - RNA, 14 nt, Human
uuaaaauguaugca

SEQ ID NO: 1365098 - RNA, 24 nt, Human
uuaaaauguaagauuauagauucu

SEQ ID NO: 1365099 - RNA, 17 nt, Human
uuaaaauguaagauuau

SEQ ID NO: 1365100 - RNA, 15 nt, Human
uuaaaccaucucccu

SEQ ID NO: 1365101 - RNA, 14 nt, Human
uuaaaccaucuccc

SEQ ID NO: 1365102 - RNA, 17 nt, Human
uuaaaauguaugcaugu

SEQ ID NO: 1365103 - RNA, 22 nt, Human
uuaaaccaucucccuggugcuu

SEQ ID NO: 1365104 - RNA, 21 nt, Human
uuaaaccaucucccuggugcu

SEQ ID NO: 1365105 - RNA, 18 nt, Human
uuaaaccaucucccuggu

SEQ ID NO: 1365106 - RNA, 17 nt, Human
uuaaaccaucucccugg

SEQ ID NO: 1365107 - RNA, 19 nt, Human
uuaaaaaagcuuaaaacuu

SEQ ID NO: 1365108 - RNA, 12 nt, Human
uuaaaaaagcuu

SEQ ID NO: 1365109 - RNA, 21 nt, Human
uuaaaaaagcuuaaaacuuug

SEQ ID NO: 1365110 - RNA, 21 nt, Human
uuaaaaaagauaaacacaaga

SEQ ID NO: 1365111 - RNA, 18 nt, Human
uuaaaaaagauaaacaca

SEQ ID NO: 1365112 - RNA, 17 nt, Human
uuaaaaaagauaaacac

SEQ ID NO: 1365113 - RNA, 15 nt, Human
uuaaaaaagauaaac

SEQ ID NO: 1365114 - RNA, 13 nt, Human
uuaaaaaagauaa

SEQ ID NO: 1365115 - RNA, 12 nt, Human
uuaaaaaagaua

SEQ ID NO: 1365116 - RNA, 14 nt, Human
aguuuagcucugag

SEQ ID NO: 1365117 - RNA, 16 nt, Human
aguuuagcuggaaaag

SEQ ID NO: 1365118 - RNA, 20 nt, Human
aguuuaccuuguauacugua

SEQ ID NO: 1365119 - RNA, 14 nt, Human
aguuuaccuuguau

SEQ ID NO: 1365120 - RNA, 15 nt, Human
aguuuagcuggaaaa

SEQ ID NO: 1365121 - RNA, 20 nt, Human
aguuuaccaguugccuuuua

SEQ ID NO: 1365122 - RNA, 21 nt, Human
aguuagcuuuaacuuaaauag

SEQ ID NO: 1365123 - RNA, 22 nt, Human
aguuagcuuuaacuuaaauagu

SEQ ID NO: 1365124 - RNA, 20 nt, Human
aguuagcuuuaacuuaaaua

SEQ ID NO: 1365125 - RNA, 15 nt, Human
aguuagcuuuaacuu

SEQ ID NO: 1365126 - RNA, 17 nt, Human
aguuuaaauuguaauag

SEQ ID NO: 1365127 - RNA, 20 nt, Human
aguuuaaauuguaauaggcg

SEQ ID NO: 1365128 - RNA, 20 nt, Human
uuaagacacugaaaaaucua

SEQ ID NO: 1365129 - RNA, 19 nt, Human
uuaagaauugaguaauggu

SEQ ID NO: 1365130 - RNA, 20 nt, Human
uuaagaauaucuguaauggu

SEQ ID NO: 1365131 - RNA, 10 nt, Human
uuaagaauau

SEQ ID NO: 1365132 - RNA, 18 nt, Human
uuaagaaggcaaaaaugu

SEQ ID NO: 1365133 - RNA, 19 nt, Human
uuaagaaaaaggaugcaca

SEQ ID NO: 1365134 - RNA, 18 nt, Human
uuaagaccuacuguucua

SEQ ID NO: 1365135 - RNA, 18 nt, Human
uuaagacaugauuuccuu

SEQ ID NO: 1365136 - RNA, 16 nt, Human
uuaagacaugauuucc

SEQ ID NO: 1365137 - RNA, 18 nt, Human
uuaagaccuggcagcucu

SEQ ID NO: 1365138 - RNA, 14 nt, Human
uuaagaccuggcag

SEQ ID NO: 1365139 - RNA, 11 nt, Human
uuaagaccugg

SEQ ID NO: 1365140 - RNA, 21 nt, Human
uuaagaccuacuguucuaaag

SEQ ID NO: 1365141 - RNA, 20 nt, Human
uuaagaccuacuguucuaaa

SEQ ID NO: 1365142 - RNA, 19 nt, Human
uuaagacgaaacauuuguu

SEQ ID NO: 1365143 - RNA, 20 nt, Human
auaaaaggaagccaaagagu

SEQ ID NO: 1365144 - RNA, 19 nt, Human
auaaaaggaagccaaagag

SEQ ID NO: 1365145 - RNA, 23 nt, Human
uuaacuuuuauaaacuuuaccuu

SEQ ID NO: 1365146 - RNA, 22 nt, Human
auaaaagggacugagaaauuua

SEQ ID NO: 1365147 - RNA, 22 nt, Human
uuaacuuuuauaaacuuuaccu

SEQ ID NO: 1365148 - RNA, 22 nt, Human
aguuuuuuuuuucuugucuaua

SEQ ID NO: 1365149 - RNA, 15 nt, Human
aguuuuuuguaccaa

SEQ ID NO: 1365150 - RNA, 18 nt, Human
aguuuuuuuuuucuuguc

SEQ ID NO: 1365151 - RNA, 23 nt, Human
aguuuuuugaaauuaugugacau

SEQ ID NO: 1365152 - RNA, 17 nt, Human
auaaaaggaagccaaag

SEQ ID NO: 1365153 - RNA, 15 nt, Human
auaaaaggaagccaa

SEQ ID NO: 1365154 - RNA, 19 nt, Human
aguuuuuuuuuucuugucu

SEQ ID NO: 1365155 - RNA, 20 nt, Human
auaaaagccuguuuaagaga

SEQ ID NO: 1365156 - RNA, 13 nt, Human
aguuuuauauauu

SEQ ID NO: 1365157 - RNA, 12 nt, Human
aguuuuauauau

SEQ ID NO: 1365158 - RNA, 20 nt, Human
aguuuuacuuuuaaacugug

SEQ ID NO: 1365159 - RNA, 19 nt, Human
aguuuuacuuuuaaacugu

SEQ ID NO: 1365160 - RNA, 21 nt, Human
aguuuuauauauuauauggaa

SEQ ID NO: 1365161 - RNA, 20 nt, Human
aguuuuauauauuauaugga

SEQ ID NO: 1365162 - RNA, 16 nt, Human
aguuuuauauauuaua

SEQ ID NO: 1365163 - RNA, 14 nt, Human
aguuuuauauauua

SEQ ID NO: 1365164 - RNA, 16 nt, Human
aguuuuauaugcuucu

SEQ ID NO: 1365165 - RNA, 16 nt, Human
aguuuuguguuuguug

SEQ ID NO: 1365166 - RNA, 12 nt, Human
aguuuuguguuu

SEQ ID NO: 1365167 - RNA, 13 nt, Human
aguuuuaucauuu

SEQ ID NO: 1365168 - RNA, 12 nt, Human
aguuuuaucauu

SEQ ID NO: 1365169 - RNA, 22 nt, Human
aguuuuguguuuguuguagauu

SEQ ID NO: 1365170 - RNA, 21 nt, Human
aguuuuguguuuguuguagau

SEQ ID NO: 1365171 - RNA, 19 nt, Human
aguuuuguguuuguuguag

SEQ ID NO: 1365172 - RNA, 22 nt, Human
aguuuuucauuaaauaaauuug

SEQ ID NO: 1365173 - RNA, 20 nt, Human
aguuuuucauuaaauaaauu

SEQ ID NO: 1365174 - RNA, 18 nt, Human
aguuuuucauuaaauaaa

SEQ ID NO: 1365175 - RNA, 9 nt, Human
aguuuuuca

SEQ ID NO: 1365176 - RNA, 15 nt, Human
aguuuuuaaacauca

SEQ ID NO: 1365177 - RNA, 14 nt, Human
aguuuuuucaucuu

SEQ ID NO: 1365178 - RNA, 13 nt, Human
aguuuuuucaucu

SEQ ID NO: 1365179 - RNA, 12 nt, Human
aguuuuuucauc

SEQ ID NO: 1365180 - RNA, 17 nt, Human
aguuuuuuauuaugcau

SEQ ID NO: 1365181 - RNA, 21 nt, Human
aguuuuuuacuuuuguuuauu

SEQ ID NO: 1365182 - RNA, 20 nt, Human
aguuuuuucaucuucaguug

SEQ ID NO: 1365183 - RNA, 23 nt, Human
aguuuuuucaucuucaguugucu

SEQ ID NO: 1365184 - RNA, 22 nt, Human
aguuuuuugaaaaugggcucaa

SEQ ID NO: 1365185 - RNA, 21 nt, Human
aguuuuuugaaauuaugugac

SEQ ID NO: 1365186 - RNA, 15 nt, Human
aguuuuuuuuauaca

SEQ ID NO: 1365187 - RNA, 17 nt, Human
uuaauaaaagaaaauua

SEQ ID NO: 1365188 - RNA, 20 nt, Human
uuaaucagguccucagagaa

SEQ ID NO: 1365189 - RNA, 22 nt, Human
uuaaucaguucauuagaaauau

SEQ ID NO: 1365190 - RNA, 17 nt, Human
uuaaucagauagauauu

SEQ ID NO: 1365191 - RNA, 17 nt, Human
uuaaucaucaagagaau

SEQ ID NO: 1365192 - RNA, 16 nt, Human
uuaaucaucaagagaa

SEQ ID NO: 1365193 - RNA, 15 nt, Human
uuaaucaucaagaga

SEQ ID NO: 1365194 - RNA, 12 nt, Human
uuaauccaaugg

SEQ ID NO: 1365195 - RNA, 17 nt, Human
uuaauccccaguaaaau

SEQ ID NO: 1365196 - RNA, 18 nt, Human
uuaauccccaguaaaauu

SEQ ID NO: 1365197 - RNA, 21 nt, Human
uuaauccccaguaaaauugcc

SEQ ID NO: 1365198 - RNA, 20 nt, Human
uuaauccgccaauauuagua

SEQ ID NO: 1365199 - RNA, 15 nt, Human
uuaaucuaaauggaa

SEQ ID NO: 1365200 - RNA, 20 nt, Human
uuaauaaaagaaaauuacaa

SEQ ID NO: 1365201 - RNA, 14 nt, Human
uuaauaaaagaaaa

SEQ ID NO: 1365202 - RNA, 12 nt, Human
uuaauaaaagaa

SEQ ID NO: 1365203 - RNA, 11 nt, Human
uuaauaaaaga

SEQ ID NO: 1365204 - RNA, 14 nt, Human
uuaauaaaaauaau

SEQ ID NO: 1365205 - RNA, 17 nt, Human
uuaaguuucucugcaga

SEQ ID NO: 1365206 - RNA, 13 nt, Human
uuaagacuugaca

SEQ ID NO: 1365207 - RNA, 17 nt, Human
uuaagacuugacagugg

SEQ ID NO: 1365208 - RNA, 22 nt, Human
uuaagaccuacuguucuaaagc

SEQ ID NO: 1365209 - RNA, 22 nt, Human
uuaagagagucuauuuacggaa

SEQ ID NO: 1365210 - RNA, 22 nt, Human
uuaagacgaaacauuuguucua

SEQ ID NO: 1365211 - RNA, 16 nt, Human
uuaauuugguuuucac

SEQ ID NO: 1365212 - RNA, 19 nt, Human
uuaauuuugaagugcuguu

SEQ ID NO: 1365213 - RNA, 13 nt, Human
uuaauuuuccugg

SEQ ID NO: 1365214 - RNA, 23 nt, Human
uuaauuuuauuuuuuauaaaaua

SEQ ID NO: 1365215 - RNA, 21 nt, Human
uuaauuuuaguuuuucauuaa

SEQ ID NO: 1365216 - RNA, 17 nt, Human
uuaauuuuaguuuuuca

SEQ ID NO: 1365217 - RNA, 15 nt, Human
uuaauuuuaguuuuu

SEQ ID NO: 1365218 - RNA, 23 nt, Human
uuaauuuugaagugcuguuuauu

SEQ ID NO: 1365219 - RNA, 20 nt, Human
uuaauuuugaagugcuguuu

SEQ ID NO: 1365220 - RNA, 15 nt, Human
uuaauuuuuccaacu

SEQ ID NO: 1365221 - RNA, 13 nt, Human
uuaauuuuuccaa

SEQ ID NO: 1365222 - RNA, 18 nt, Human
uuaauuuuuauuucuucc

SEQ ID NO: 1365223 - RNA, 15 nt, Human
uuaauuugaaauaug

SEQ ID NO: 1365224 - RNA, 13 nt, Human
uuaauuugaaaua

SEQ ID NO: 1365225 - RNA, 14 nt, Human
uuaauuuaugcaga

SEQ ID NO: 1365226 - RNA, 14 nt, Human
uuaauuuauuauua

SEQ ID NO: 1365227 - RNA, 21 nt, Human
uuaaucuuaguguaugauuac

SEQ ID NO: 1365228 - RNA, 19 nt, Human
uuaaucuuaguguaugauu

SEQ ID NO: 1365229 - RNA, 13 nt, Human
uuaaucuuuaauu

SEQ ID NO: 1365230 - RNA, 17 nt, Human
uuaaucuuugaaagguu

SEQ ID NO: 1365231 - RNA, 17 nt, Human
uuaaucuuuaauuuuac

SEQ ID NO: 1365232 - RNA, 14 nt, Human
uuaccaguugccuu

SEQ ID NO: 1365233 - RNA, 19 nt, Human
uuaccaguugccuuuuauc

SEQ ID NO: 1365234 - RNA, 18 nt, Human
uuaccagugccuuaaacu

SEQ ID NO: 1365235 - RNA, 16 nt, Human
uuacucaguaauuugu

SEQ ID NO: 1365236 - RNA, 22 nt, Human
uuacucuaagaucuuagauucu

SEQ ID NO: 1365237 - RNA, 21 nt, Human
uuacucuaagaucuuagauuc

SEQ ID NO: 1365238 - RNA, 19 nt, Human
uuacucuaagaucuuagau

SEQ ID NO: 1365239 - RNA, 14 nt, Human
uuacucuaagaucu

SEQ ID NO: 1365240 - RNA, 12 nt, Human
uuacucuaagau

SEQ ID NO: 1365241 - RNA, 19 nt, Human
uuacuccugugggagccuc

SEQ ID NO: 1365242 - RNA, 23 nt, Human
uuacuguacagacagaaaaaacu

SEQ ID NO: 1365243 - RNA, 12 nt, Human
uuacuguacaug

SEQ ID NO: 1365244 - RNA, 18 nt, Human
uuacuggccuuuuucauu

SEQ ID NO: 1365245 - RNA, 16 nt, Human
uuacuggccuuuuuca

SEQ ID NO: 1365246 - RNA, 13 nt, Human
uuacuggccuuuu

SEQ ID NO: 1365247 - RNA, 15 nt, Human
uuacugcucugagaa

SEQ ID NO: 1365248 - RNA, 14 nt, Human
uuacugcucugaga

SEQ ID NO: 1365249 - RNA, 20 nt, Human
uuacugcuuaauucaaauaa

SEQ ID NO: 1365250 - RNA, 13 nt, Human
uuacuguacauga

SEQ ID NO: 1365251 - RNA, 14 nt, Human
uuacuguacaugaa

SEQ ID NO: 1365252 - RNA, 22 nt, Human
uuacuguacaugaaaacacauu

SEQ ID NO: 1365253 - RNA, 23 nt, Human
uuacuguacaugaaaacacauuu

SEQ ID NO: 1365254 - RNA, 16 nt, Human
uuagaauuauuuaaac

SEQ ID NO: 1365255 - RNA, 15 nt, Human
uuagaauuauuuaaa

SEQ ID NO: 1365256 - RNA, 13 nt, Human
uuagaauuauuua

SEQ ID NO: 1365257 - RNA, 12 nt, Human
uuagaauuauuu

SEQ ID NO: 1365258 - RNA, 20 nt, Human
uuagaaucaaacauuuugaa

SEQ ID NO: 1365259 - RNA, 18 nt, Human
uuagaaucaaacauuuug

SEQ ID NO: 1365260 - RNA, 17 nt, Human
uuagaaucaaacauuuu

SEQ ID NO: 1365261 - RNA, 23 nt, Human
uuagaaucaaacauuuugaaagu

SEQ ID NO: 1365262 - RNA, 20 nt, Human
uuacuggccuuuuucauuua

SEQ ID NO: 1365263 - RNA, 15 nt, Human
uuacuguaauuccuc

SEQ ID NO: 1365264 - RNA, 17 nt, Human
uuacugucuuuuuucua

SEQ ID NO: 1365265 - RNA, 15 nt, Human
auaagaaagccugag

SEQ ID NO: 1365266 - RNA, 14 nt, Human
auaagaaagccuga

SEQ ID NO: 1365267 - RNA, 13 nt, Human
auaagaaagccug

SEQ ID NO: 1365268 - RNA, 11 nt, Human
auaagaaagcc

SEQ ID NO: 1365269 - RNA, 21 nt, Human
auaagaaacuuuuuuauuuaa

SEQ ID NO: 1365270 - RNA, 22 nt, Human
auaagaaacuuuuuuauuuaaa

SEQ ID NO: 1365271 - RNA, 14 nt, Human
auaagaaacuuuuu

SEQ ID NO: 1365272 - RNA, 13 nt, Human
auaagaaacuuuu

SEQ ID NO: 1365273 - RNA, 20 nt, Human
auaagaucuuuuauuuugcc

SEQ ID NO: 1365274 - RNA, 17 nt, Human
auaagaucuuuuauuuu

SEQ ID NO: 1365275 - RNA, 15 nt, Human
auaagaucuuuuauu

SEQ ID NO: 1365276 - RNA, 13 nt, Human
auaagaucuuuua

SEQ ID NO: 1365277 - RNA, 19 nt, Human
auaagauccuagauccuaa

SEQ ID NO: 1365278 - RNA, 23 nt, Human
auaacuuuuuuuuuucuuuauaa

SEQ ID NO: 1365279 - RNA, 17 nt, Human
auaacuccucauuguaa

SEQ ID NO: 1365280 - RNA, 15 nt, Human
auaacuccucauugu

SEQ ID NO: 1365281 - RNA, 14 nt, Human
auaaauuguauauu

SEQ ID NO: 1365282 - RNA, 17 nt, Human
auaaauuguacagccgg

SEQ ID NO: 1365283 - RNA, 13 nt, Human
auaaauuguauau

SEQ ID NO: 1365284 - RNA, 22 nt, Human
auaacuccucccaggguuuuaa

SEQ ID NO: 1365285 - RNA, 18 nt, Human
auaacuccucccaggguu

SEQ ID NO: 1365286 - RNA, 16 nt, Human
auaacuccucccaggg

SEQ ID NO: 1365287 - RNA, 14 nt, Human
auaacuccucccag

SEQ ID NO: 1365288 - RNA, 12 nt, Human
auaacuccuccc

SEQ ID NO: 1365289 - RNA, 23 nt, Human
uuaccaggcaccaaaagaaguaa

SEQ ID NO: 1365290 - RNA, 21 nt, Human
uuaccaggcaccaaaagaagu

SEQ ID NO: 1365291 - RNA, 22 nt, Human
uuacaguucugugguuucaugu

SEQ ID NO: 1365292 - RNA, 14 nt, Human
uuacaguucugugg

SEQ ID NO: 1365293 - RNA, 13 nt, Human
uuacaguucugug

SEQ ID NO: 1365294 - RNA, 12 nt, Human
uuacaguucugu

SEQ ID NO: 1365295 - RNA, 11 nt, Human
uuacaguucug

SEQ ID NO: 1365296 - RNA, 12 nt, Human
uuacaguguuua

SEQ ID NO: 1365297 - RNA, 14 nt, Human
uuacagugcagugc

SEQ ID NO: 1365298 - RNA, 17 nt, Human
uuacaguaggagcccag

SEQ ID NO: 1365299 - RNA, 17 nt, Human
uuacaguggggaaugaa

SEQ ID NO: 1365300 - RNA, 19 nt, Human
auaaaucugacccagugcc

SEQ ID NO: 1365301 - RNA, 18 nt, Human
auaaaucugacccagugc

SEQ ID NO: 1365302 - RNA, 16 nt, Human
auaaaucugacccagu

SEQ ID NO: 1365303 - RNA, 15 nt, Human
auaaaucugacccag

SEQ ID NO: 1365304 - RNA, 21 nt, Human
uuacaaaugaaaaauuccacu

SEQ ID NO: 1365305 - RNA, 22 nt, Human
uuacaaaucagaagucaucuug

SEQ ID NO: 1365306 - RNA, 17 nt, Human
uuacaaaucagaaguca

SEQ ID NO: 1365307 - RNA, 16 nt, Human
uuacaaaucagaaguc

SEQ ID NO: 1365308 - RNA, 13 nt, Human
uuacaaacugaag

SEQ ID NO: 1365309 - RNA, 18 nt, Human
uuacaaagcccuuuuaua

SEQ ID NO: 1365310 - RNA, 16 nt, Human
uuacaaacugaagagu

SEQ ID NO: 1365311 - RNA, 15 nt, Human
uuaauuuuugauacu

SEQ ID NO: 1365312 - RNA, 13 nt, Human
uuaauuuuugaua

SEQ ID NO: 1365313 - RNA, 12 nt, Human
uuaauuuuugau

SEQ ID NO: 1365314 - RNA, 13 nt, Human
uuaauuuuuccua

SEQ ID NO: 1365315 - RNA, 18 nt, Human
uuaauuuuuccaacuacu

SEQ ID NO: 1365316 - RNA, 13 nt, Human
auaaauugcucaa

SEQ ID NO: 1365317 - RNA, 21 nt, Human
auaaauugcacaccuuggaau

SEQ ID NO: 1365318 - RNA, 19 nt, Human
auaaauugauuuuuauaaa

SEQ ID NO: 1365319 - RNA, 18 nt, Human
auaaaugauucuuaguga

SEQ ID NO: 1365320 - RNA, 16 nt, Human
auaaaugauucuuagu

SEQ ID NO: 1365321 - RNA, 13 nt, Human
auaaaugcaaaua

SEQ ID NO: 1365322 - RNA, 14 nt, Human
auaaaugcaaauaa

SEQ ID NO: 1365323 - RNA, 12 nt, Human
auaaaugcaaau

SEQ ID NO: 1365324 - RNA, 14 nt, Human
uuauaaaaaauggu

SEQ ID NO: 1365325 - RNA, 15 nt, Human
uuauaaaaauaaaaa

SEQ ID NO: 1365326 - RNA, 19 nt, Human
uuaguacuccccuccuuga

SEQ ID NO: 1365327 - RNA, 12 nt, Human
uuauaaaagugu

SEQ ID NO: 1365328 - RNA, 16 nt, Human
uuauaaaaguguucau

SEQ ID NO: 1365329 - RNA, 13 nt, Human
uuauaaacuuuac

SEQ ID NO: 1365330 - RNA, 17 nt, Human
uuauaaaaaaugguuca

SEQ ID NO: 1365331 - RNA, 19 nt, Human
uuauaaaaagguguuuuga

SEQ ID NO: 1365332 - RNA, 18 nt, Human
uuauaaaaaaugguucag

SEQ ID NO: 1365333 - RNA, 15 nt, Human
uuauaaaaaaugguu

SEQ ID NO: 1365334 - RNA, 21 nt, Human
uuauaaaaauaaaaaacacug

SEQ ID NO: 1365335 - RNA, 22 nt, Human
uuauaaaaauaaaaaacacugg

SEQ ID NO: 1365336 - RNA, 18 nt, Human
uuagguucuaaaguucua

SEQ ID NO: 1365337 - RNA, 16 nt, Human
uuagguucuaaaguuc

SEQ ID NO: 1365338 - RNA, 14 nt, Human
uuagguucuaaagu

SEQ ID NO: 1365339 - RNA, 13 nt, Human
uuagguucuaaag

SEQ ID NO: 1365340 - RNA, 12 nt, Human
uuagguucuaaa

SEQ ID NO: 1365341 - RNA, 14 nt, Human
uuagguuaggacuu

SEQ ID NO: 1365342 - RNA, 23 nt, Human
uuagguaagaaguuuuaaaaagc

SEQ ID NO: 1365343 - RNA, 17 nt, Human
uuagguaauuuuuuuca

SEQ ID NO: 1365344 - RNA, 22 nt, Human
uuagguucuaaaguucuaagau

SEQ ID NO: 1365345 - RNA, 20 nt, Human
uuagguucuaaaguucuaag

SEQ ID NO: 1365346 - RNA, 19 nt, Human
uuagguucuaaaguucuaa

SEQ ID NO: 1365347 - RNA, 13 nt, Human
uuaguaaucauau

SEQ ID NO: 1365348 - RNA, 14 nt, Human
uuaguaaucauauu

SEQ ID NO: 1365349 - RNA, 15 nt, Human
uuagauuaagaaaua

SEQ ID NO: 1365350 - RNA, 19 nt, Human
uuagauuaagaaauagaca

SEQ ID NO: 1365351 - RNA, 21 nt, Human
uuagauguucucuaucauuua

SEQ ID NO: 1365352 - RNA, 22 nt, Human
uuagauguucucuaucauuuaa

SEQ ID NO: 1365353 - RNA, 23 nt, Human
uuagauguucucuaucauuuaau

SEQ ID NO: 1365354 - RNA, 17 nt, Human
uuagggcaccagggguu

SEQ ID NO: 1365355 - RNA, 16 nt, Human
uuaggguuaugauuaa

SEQ ID NO: 1365356 - RNA, 14 nt, Human
uuaggguuaugauu

SEQ ID NO: 1365357 - RNA, 15 nt, Human
auaauauauuuucug

SEQ ID NO: 1365358 - RNA, 17 nt, Human
auaaucuucugccuucu

SEQ ID NO: 1365359 - RNA, 15 nt, Human
auaaucuucugccuu

SEQ ID NO: 1365360 - RNA, 14 nt, Human
auaaucuucugccu

SEQ ID NO: 1365361 - RNA, 17 nt, Human
auaaucuuauaauuguu

SEQ ID NO: 1365362 - RNA, 13 nt, Human
auaauauauuuuc

SEQ ID NO: 1365363 - RNA, 13 nt, Human
auaauauacuugu

SEQ ID NO: 1365364 - RNA, 14 nt, Human
auaauauacuugug

SEQ ID NO: 1365365 - RNA, 20 nt, Human
auaauauacuuguggacuaa

SEQ ID NO: 1365366 - RNA, 17 nt, Human
auaagcaucauuauuua

SEQ ID NO: 1365367 - RNA, 19 nt, Human
auaagcaucauuauuuaug

SEQ ID NO: 1365368 - RNA, 15 nt, Human
auaagcaucauuauu

SEQ ID NO: 1365369 - RNA, 14 nt, Human
auaagcaucauuau

SEQ ID NO: 1365370 - RNA, 22 nt, Human
auaagcagguggaucuauuuca

SEQ ID NO: 1365371 - RNA, 17 nt, Human
auaagcagguggaucua

SEQ ID NO: 1365372 - RNA, 12 nt, Human
auaagauucuaa

SEQ ID NO: 1365373 - RNA, 11 nt, Human
auaagauucua

SEQ ID NO: 1365374 - RNA, 20 nt, Human
auaaucuucugccuucucau

SEQ ID NO: 1365375 - RNA, 21 nt, Human
auaaucuuucacaggggacag

SEQ ID NO: 1365376 - RNA, 14 nt, Human
auaaucuuucacag

SEQ ID NO: 1365377 - RNA, 23 nt, Human
auaauucacauuguauucagagu

SEQ ID NO: 1365378 - RNA, 22 nt, Human
auaauucacuguacuaucaggu

SEQ ID NO: 1365379 - RNA, 17 nt, Human
auaauuuaguuucauau

SEQ ID NO: 1365380 - RNA, 20 nt, Human
auaauuuaguuucauauaaa

SEQ ID NO: 1365381 - RNA, 14 nt, Human
auaauuuagauggu

SEQ ID NO: 1365382 - RNA, 15 nt, Human
auaauuuuaaacaaa

SEQ ID NO: 1365383 - RNA, 14 nt, Human
auaauuucuaaugu

SEQ ID NO: 1365384 - RNA, 12 nt, Human
auaauuucuaau

SEQ ID NO: 1365385 - RNA, 12 nt, Human
auaauuuuaaau

SEQ ID NO: 1365386 - RNA, 13 nt, Human
auaauuuuaaaug

SEQ ID NO: 1365387 - RNA, 22 nt, Human
uuagauguucuaagucuuucca

SEQ ID NO: 1365388 - RNA, 15 nt, Human
uuagauguucucuau

SEQ ID NO: 1365389 - RNA, 19 nt, Human
uuagauguucucuaucauu

SEQ ID NO: 1365390 - RNA, 20 nt, Human
uuagauguucucuaucauuu

SEQ ID NO: 1365391 - RNA, 20 nt, Human
uuagauguucuaagucuuuc

SEQ ID NO: 1365392 - RNA, 13 nt, Human
uuagauguucuaa

SEQ ID NO: 1365393 - RNA, 22 nt, Human
uuagauguuccaguaaucuaau

SEQ ID NO: 1365394 - RNA, 21 nt, Human
uuagauguuccaguaaucuaa

SEQ ID NO: 1365395 - RNA, 14 nt, Human
auaauuuuaaauuc

SEQ ID NO: 1365396 - RNA, 14 nt, Human
auaauuuuaaaugu

SEQ ID NO: 1365397 - RNA, 20 nt, Human
aucuuugaaauuauguaaau

SEQ ID NO: 1365398 - RNA, 19 nt, Human
aucuuugaaauuauguaaa

SEQ ID NO: 1365399 - RNA, 17 nt, Human
aucuuugaaauuaugua

SEQ ID NO: 1365400 - RNA, 16 nt, Human
aucuuugaaauuaugu

SEQ ID NO: 1365401 - RNA, 22 nt, Human
aucuuugaaagguuagagaaua

SEQ ID NO: 1365402 - RNA, 21 nt, Human
aucuuugaaagguuagagaau

SEQ ID NO: 1365403 - RNA, 15 nt, Human
aucuuucuuucuuag

SEQ ID NO: 1365404 - RNA, 17 nt, Human
aucuuucuuucuuagaa

SEQ ID NO: 1365405 - RNA, 20 nt, Human
aucuuucuuucuuagaaauu

SEQ ID NO: 1365406 - RNA, 21 nt, Human
aucuuucuuucuuagaaauuu

SEQ ID NO: 1365407 - RNA, 21 nt, Human
uuggcucgaaucucugugccu

SEQ ID NO: 1365408 - RNA, 20 nt, Human
uuggcucgaaucucugugcc

SEQ ID NO: 1365409 - RNA, 17 nt, Human
uuggcucgaaucucugu

SEQ ID NO: 1365410 - RNA, 18 nt, Human
uuggcucacacucgacau

SEQ ID NO: 1365411 - RNA, 23 nt, Human
aucuuuugauaugcauauuuguu

SEQ ID NO: 1365412 - RNA, 14 nt, Human
aucuuuucauacau

SEQ ID NO: 1365413 - RNA, 17 nt, Human
uuggcuauuuaaaacuu

SEQ ID NO: 1365414 - RNA, 16 nt, Human
uuggcuauuuaaaacu

SEQ ID NO: 1365415 - RNA, 17 nt, Human
uuggccugaucagacca

SEQ ID NO: 1365416 - RNA, 16 nt, Human
uuggccucucucuagg

SEQ ID NO: 1365417 - RNA, 21 nt, Human
uuggagucacucuuaugcugu

SEQ ID NO: 1365418 - RNA, 23 nt, Human
uuggaguccccucaccuccucua

SEQ ID NO: 1365419 - RNA, 13 nt, Human
uuggagucacucu

SEQ ID NO: 1365420 - RNA, 18 nt, Human
uuggagaguuuccugaaa

SEQ ID NO: 1365421 - RNA, 16 nt, Human
uuggagaguuuccuga

SEQ ID NO: 1365422 - RNA, 15 nt, Human
uuggagaguuuccug

SEQ ID NO: 1365423 - RNA, 22 nt, Human
uuggagacugucuggccccccu

SEQ ID NO: 1365424 - RNA, 16 nt, Human
uuggugcacagcacaa

SEQ ID NO: 1365425 - RNA, 22 nt, Human
uuggugcacagcacaaauuagu

SEQ ID NO: 1365426 - RNA, 20 nt, Human
uuggggaguuaagaccuggc

SEQ ID NO: 1365427 - RNA, 19 nt, Human
uuggggaguuaagaccugg

SEQ ID NO: 1365428 - RNA, 17 nt, Human
uuggggaguuaagaccu

SEQ ID NO: 1365429 - RNA, 14 nt, Human
uuggugagaaccug

SEQ ID NO: 1365430 - RNA, 21 nt, Human
uuggggaguuaagaccuggca

SEQ ID NO: 1365431 - RNA, 14 nt, Human
uuggggauauuuuu

SEQ ID NO: 1365432 - RNA, 20 nt, Human
uuggggacacauguauuugg

SEQ ID NO: 1365433 - RNA, 14 nt, Human
uuggggacacaugu

SEQ ID NO: 1365434 - RNA, 18 nt, Human
uuggggaagggccugccc

SEQ ID NO: 1365435 - RNA, 23 nt, Human
uuggggaagagagccugcaggau

SEQ ID NO: 1365436 - RNA, 22 nt, Human
uuggggaagagagccugcagga

SEQ ID NO: 1365437 - RNA, 11 nt, Human
uuggggaagag

SEQ ID NO: 1365438 - RNA, 17 nt, Human
augaauuacauuuguau

SEQ ID NO: 1365439 - RNA, 16 nt, Human
augaauuacauuugua

SEQ ID NO: 1365440 - RNA, 21 nt, Human
augaauauuuaguguucauaa

SEQ ID NO: 1365441 - RNA, 15 nt, Human
augaauguaaauuug

SEQ ID NO: 1365442 - RNA, 13 nt, Human
augaauguaaauu

SEQ ID NO: 1365443 - RNA, 12 nt, Human
augaauguaaau

SEQ ID NO: 1365444 - RNA, 21 nt, Human
augaauguaaauuuguacuau

SEQ ID NO: 1365445 - RNA, 19 nt, Human
augaauguaaauuuguacu

SEQ ID NO: 1365446 - RNA, 16 nt, Human
augaauguaaauuugu

SEQ ID NO: 1365447 - RNA, 15 nt, Human
augaauuacauuugu

SEQ ID NO: 1365448 - RNA, 16 nt, Human
aucuuuuguauuaaga

SEQ ID NO: 1365449 - RNA, 13 nt, Human
aucuuuuguauua

SEQ ID NO: 1365450 - RNA, 13 nt, Human
augaacuugagga

SEQ ID NO: 1365451 - RNA, 15 nt, Human
augaacuugaggaca

SEQ ID NO: 1365452 - RNA, 16 nt, Human
augaauauuuaguguu

SEQ ID NO: 1365453 - RNA, 18 nt, Human
augaacuuguaaaggaau

SEQ ID NO: 1365454 - RNA, 16 nt, Human
augaacuugaggacac

SEQ ID NO: 1365455 - RNA, 17 nt, Human
augaacuugaggacaca

SEQ ID NO: 1365456 - RNA, 18 nt, Human
augaacuugaggacacau

SEQ ID NO: 1365457 - RNA, 19 nt, Human
augaacuugaggacacaug

SEQ ID NO: 1365458 - RNA, 20 nt, Human
augaacuugaggacacaugu

SEQ ID NO: 1365459 - RNA, 21 nt, Human
augaacuugaggacacauguc

SEQ ID NO: 1365460 - RNA, 22 nt, Human
augaacuugaggacacaugucc

SEQ ID NO: 1365461 - RNA, 14 nt, Human
aucuguccucagcc

SEQ ID NO: 1365462 - RNA, 18 nt, Human
aucugucccccuuuagau

SEQ ID NO: 1365463 - RNA, 15 nt, Human
aucugucccccuuua

SEQ ID NO: 1365464 - RNA, 22 nt, Human
aucugucugccaaccuaaaacu

SEQ ID NO: 1365465 - RNA, 23 nt, Human
aucugucugccaaccuaaaacuc

SEQ ID NO: 1365466 - RNA, 19 nt, Human
aucugucugccaaccuaaa

SEQ ID NO: 1365467 - RNA, 21 nt, Human
aucuguccucagccuugccag

SEQ ID NO: 1365468 - RNA, 18 nt, Human
aucuguccucagccuugc

SEQ ID NO: 1365469 - RNA, 17 nt, Human
aucuguccucagccuug

SEQ ID NO: 1365470 - RNA, 16 nt, Human
aucuguccucagccuu

SEQ ID NO: 1365471 - RNA, 15 nt, Human
aucuguccucagccu

SEQ ID NO: 1365472 - RNA, 19 nt, Human
aucugucuguggcaaaagu

SEQ ID NO: 1365473 - RNA, 15 nt, Human
aucugucuguggcaa

SEQ ID NO: 1365474 - RNA, 16 nt, Human
aucugucugguggccc

SEQ ID NO: 1365475 - RNA, 14 nt, Human
aucugucugguggc

SEQ ID NO: 1365476 - RNA, 18 nt, Human
aucuguauacccucuguu

SEQ ID NO: 1365477 - RNA, 12 nt, Human
aucugccucccu

SEQ ID NO: 1365478 - RNA, 16 nt, Human
aucugccuuuauugug

SEQ ID NO: 1365479 - RNA, 16 nt, Human
aucugcgugacaauaa

SEQ ID NO: 1365480 - RNA, 19 nt, Human
aucugccuuuauuguguuu

SEQ ID NO: 1365481 - RNA, 21 nt, Human
aucugccuuuauuguguuugu

SEQ ID NO: 1365482 - RNA, 22 nt, Human
aucugccuuuauuguguuuguc

SEQ ID NO: 1365483 - RNA, 23 nt, Human
aucugcgugacaauaaaacauua

SEQ ID NO: 1365484 - RNA, 22 nt, Human
aucugcgugacaauaaaacauu

SEQ ID NO: 1365485 - RNA, 21 nt, Human
aucugcgugacaauaaaacau

SEQ ID NO: 1365486 - RNA, 17 nt, Human
aucugcgugacaauaaa

SEQ ID NO: 1365487 - RNA, 18 nt, Human
aucugcuaccaaaacagu

SEQ ID NO: 1365488 - RNA, 15 nt, Human
aucugcgugugugca

SEQ ID NO: 1365489 - RNA, 23 nt, Human
aucugcccaccucagccucccaa

SEQ ID NO: 1365490 - RNA, 15 nt, Human
aucugcccaccucag

SEQ ID NO: 1365491 - RNA, 16 nt, Human
aucugccaagggccga

SEQ ID NO: 1365492 - RNA, 15 nt, Human
aucugccacaaaaac

SEQ ID NO: 1365493 - RNA, 23 nt, Human
uugccaaaaagugaaauaaugug

SEQ ID NO: 1365494 - RNA, 19 nt, Human
uugccaaaaagugaaauaa

SEQ ID NO: 1365495 - RNA, 18 nt, Human
uugccaaaaagugaaaua

SEQ ID NO: 1365496 - RNA, 18 nt, Human
uugcauuuguuuuguuua

SEQ ID NO: 1365497 - RNA, 22 nt, Human
uugcauuuguuuuguuuacaga

SEQ ID NO: 1365498 - RNA, 20 nt, Human
uugcauuuguuuauguaauu

SEQ ID NO: 1365499 - RNA, 14 nt, Human
uugcauuuguuuau

SEQ ID NO: 1365500 - RNA, 22 nt, Human
uugcauuuaaaacagacacugg

SEQ ID NO: 1365501 - RNA, 15 nt, Human
uugcauuuauaugua

SEQ ID NO: 1365502 - RNA, 20 nt, Human
uugcauuuauauguaccgua

SEQ ID NO: 1365503 - RNA, 19 nt, Human
uugcuauucugucccuagg

SEQ ID NO: 1365504 - RNA, 17 nt, Human
uugcuauucugucccua

SEQ ID NO: 1365505 - RNA, 16 nt, Human
uugcuauucugucccu

SEQ ID NO: 1365506 - RNA, 15 nt, Human
uugcuauucuguccc

SEQ ID NO: 1365507 - RNA, 14 nt, Human
uugcuauucugucc

SEQ ID NO: 1365508 - RNA, 13 nt, Human
uugcuauucuguc

SEQ ID NO: 1365509 - RNA, 12 nt, Human
uugcuauucugu

SEQ ID NO: 1365510 - RNA, 19 nt, Human
aucuugucauguguauaaa

SEQ ID NO: 1365511 - RNA, 23 nt, Human
aucuugucucaaugcucauaacg

SEQ ID NO: 1365512 - RNA, 17 nt, Human
aucuuguccccaacacc

SEQ ID NO: 1365513 - RNA, 13 nt, Human
aucuugucucaau

SEQ ID NO: 1365514 - RNA, 14 nt, Human
aucuuguccccaac

SEQ ID NO: 1365515 - RNA, 17 nt, Human
aucuugucauguguaua

SEQ ID NO: 1365516 - RNA, 16 nt, Human
aucuugucauguguau

SEQ ID NO: 1365517 - RNA, 14 nt, Human
aucuugucucaaug

SEQ ID NO: 1365518 - RNA, 15 nt, Human
aucuugucucaaugc

SEQ ID NO: 1365519 - RNA, 16 nt, Human
aucuugucucaaugcu

SEQ ID NO: 1365520 - RNA, 20 nt, Human
aucuugucucaaugcucaua

SEQ ID NO: 1365521 - RNA, 15 nt, Human
aucuugucaugugua

SEQ ID NO: 1365522 - RNA, 14 nt, Human
aucuugucaugugu

SEQ ID NO: 1365523 - RNA, 12 nt, Human
aucuugucaugu

SEQ ID NO: 1365524 - RNA, 11 nt, Human
aucuugucaug

SEQ ID NO: 1365525 - RNA, 20 nt, Human
aucuugguuugccuuccaga

SEQ ID NO: 1365526 - RNA, 17 nt, Human
aucuugguuugccuucc

SEQ ID NO: 1365527 - RNA, 14 nt, Human
aucuugguuugccu

SEQ ID NO: 1365528 - RNA, 20 nt, Human
uugcuucuuucuagaaagag

SEQ ID NO: 1365529 - RNA, 17 nt, Human
uugcuucuuucuagaaa

SEQ ID NO: 1365530 - RNA, 12 nt, Human
uugcuucuuucu

SEQ ID NO: 1365531 - RNA, 19 nt, Human
uugcucacccagugcccuc

SEQ ID NO: 1365532 - RNA, 12 nt, Human
uugcucacccag

SEQ ID NO: 1365533 - RNA, 13 nt, Human
uugcucacccagu

SEQ ID NO: 1365534 - RNA, 11 nt, Human
uugcuccuccu

SEQ ID NO: 1365535 - RNA, 19 nt, Human
aucuuaguguaugauuacu

SEQ ID NO: 1365536 - RNA, 16 nt, Human
aucuuaguguaugauu

SEQ ID NO: 1365537 - RNA, 15 nt, Human
aucuuaguguaugau

SEQ ID NO: 1365538 - RNA, 14 nt, Human
aucuuaguguauga

SEQ ID NO: 1365539 - RNA, 13 nt, Human
aucuuaguguaug

SEQ ID NO: 1365540 - RNA, 19 nt, Human
aucuguuuugaaggcaaaa

SEQ ID NO: 1365541 - RNA, 18 nt, Human
aucuguuuugaaggcaaa

SEQ ID NO: 1365542 - RNA, 17 nt, Human
aucuguuuugaaggcaa

SEQ ID NO: 1365543 - RNA, 22 nt, Human
aucugucuguggcaaaaguuua

SEQ ID NO: 1365544 - RNA, 21 nt, Human
aucuugguuugccuuccagaa

SEQ ID NO: 1365545 - RNA, 21 nt, Human
aucuugguugaugccaaaaaa

SEQ ID NO: 1365546 - RNA, 20 nt, Human
aucuugguugaugccaaaaa

SEQ ID NO: 1365547 - RNA, 23 nt, Human
aucuugcuaccaguauuuagaag

SEQ ID NO: 1365548 - RNA, 19 nt, Human
aucuugcuaccaguauuua

SEQ ID NO: 1365549 - RNA, 16 nt, Human
aucuugcuaccaguau

SEQ ID NO: 1365550 - RNA, 14 nt, Human
aucuugcuaccagu

SEQ ID NO: 1365551 - RNA, 19 nt, Human
aucuugcccgcucaggcug

SEQ ID NO: 1365552 - RNA, 18 nt, Human
aucuugcauuaugcaauu

SEQ ID NO: 1365553 - RNA, 14 nt, Human
aucuugcauguaac

SEQ ID NO: 1365554 - RNA, 13 nt, Human
aucuugcauguaa

SEQ ID NO: 1365555 - RNA, 24 nt, Human
aucuugcaccccaaagcuuuccug

SEQ ID NO: 1365556 - RNA, 17 nt, Human
aucuugaugucuuuguu

SEQ ID NO: 1365557 - RNA, 16 nt, Human
aucuuauaauuguucu

SEQ ID NO: 1365558 - RNA, 14 nt, Human
aucuuauaauuguu

SEQ ID NO: 1365559 - RNA, 14 nt, Human
aucuuauaauuuaa

SEQ ID NO: 1365560 - RNA, 18 nt, Human
aucguuuucuuaaagugc

SEQ ID NO: 1365561 - RNA, 17 nt, Human
aucguuuucuuaaagug

SEQ ID NO: 1365562 - RNA, 14 nt, Human
aucguuuucuuaaa

SEQ ID NO: 1365563 - RNA, 14 nt, Human
aucguugcccccau

SEQ ID NO: 1365564 - RNA, 18 nt, Human
aucguucucucuuugcau

SEQ ID NO: 1365565 - RNA, 19 nt, Human
aucuaaaaauagacuuaaa

SEQ ID NO: 1365566 - RNA, 13 nt, Human
aucuaaauggaac

SEQ ID NO: 1365567 - RNA, 17 nt, Human
aucuaaauggaaccacu

SEQ ID NO: 1365568 - RNA, 18 nt, Human
aucuaaauggaaccacuc

SEQ ID NO: 1365569 - RNA, 19 nt, Human
aucuaaauggaaccacucu

SEQ ID NO: 1365570 - RNA, 20 nt, Human
auccucuguaaacuuuuugu

SEQ ID NO: 1365571 - RNA, 13 nt, Human
auccucuggcuug

SEQ ID NO: 1365572 - RNA, 11 nt, Human
auccuccugca

SEQ ID NO: 1365573 - RNA, 14 nt, Human
auccuccucccacc

SEQ ID NO: 1365574 - RNA, 17 nt, Human
auccucuggagccagcc

SEQ ID NO: 1365575 - RNA, 20 nt, Human
auccucucuuccucuucccc

SEQ ID NO: 1365576 - RNA, 18 nt, Human
auccucugagugugacca

SEQ ID NO: 1365577 - RNA, 17 nt, Human
auccucucuuccucuuc

SEQ ID NO: 1365578 - RNA, 16 nt, Human
auccucucuuccucuu

SEQ ID NO: 1365579 - RNA, 15 nt, Human
auccucucuuccucu

SEQ ID NO: 1365580 - RNA, 13 nt, Human
auccucucuuccu

SEQ ID NO: 1365581 - RNA, 21 nt, Human
auccucuccacagcugccucu

SEQ ID NO: 1365582 - RNA, 15 nt, Human
uugaauccucucucu

SEQ ID NO: 1365583 - RNA, 15 nt, Human
uugaaucacaugaau

SEQ ID NO: 1365584 - RNA, 23 nt, Human
uugaaucaauaauauauuuucug

SEQ ID NO: 1365585 - RNA, 17 nt, Human
uugaauaaaugucacuu

SEQ ID NO: 1365586 - RNA, 15 nt, Human
uugaauaaggaaaug

SEQ ID NO: 1365587 - RNA, 14 nt, Human
uugaauaaauguca

SEQ ID NO: 1365588 - RNA, 13 nt, Human
uugaauaaauguc

SEQ ID NO: 1365589 - RNA, 10 nt, Human
uugaaucaau

SEQ ID NO: 1365590 - RNA, 23 nt, Human
uugaauauuauuccucaaaaaau

SEQ ID NO: 1365591 - RNA, 18 nt, Human
uugaauacuuugaaugug

SEQ ID NO: 1365592 - RNA, 17 nt, Human
uugaauacuuugaaugu

SEQ ID NO: 1365593 - RNA, 15 nt, Human
uugaauacuuugaau

SEQ ID NO: 1365594 - RNA, 22 nt, Human
uugaaucaauaauauauuuucu

SEQ ID NO: 1365595 - RNA, 14 nt, Human
uugaaucaauaaua

SEQ ID NO: 1365596 - RNA, 17 nt, Human
uugaaggcaaaauugca

SEQ ID NO: 1365597 - RNA, 15 nt, Human
uugaaggcaaaauug

SEQ ID NO: 1365598 - RNA, 12 nt, Human
uugaaggcaaaa

SEQ ID NO: 1365599 - RNA, 15 nt, Human
uugaagccacugccu

SEQ ID NO: 1365600 - RNA, 12 nt, Human
uugaaggcuuaa

SEQ ID NO: 1365601 - RNA, 11 nt, Human
uugaaggcuua

SEQ ID NO: 1365602 - RNA, 17 nt, Human
uugaagggaaauuucag

SEQ ID NO: 1365603 - RNA, 14 nt, Human
aucuacacacggug

SEQ ID NO: 1365604 - RNA, 23 nt, Human
aucuaauauggccacaguagucu

SEQ ID NO: 1365605 - RNA, 16 nt, Human
aucuaauauggccaca

SEQ ID NO: 1365606 - RNA, 15 nt, Human
uugauaccccccucu

SEQ ID NO: 1365607 - RNA, 13 nt, Human
uugauaccccccu

SEQ ID NO: 1365608 - RNA, 15 nt, Human
uugauacuaagcauu

SEQ ID NO: 1365609 - RNA, 15 nt, Human
uugauacuacaguuu

SEQ ID NO: 1365610 - RNA, 19 nt, Human
uugaguuuucaguggggca

SEQ ID NO: 1365611 - RNA, 14 nt, Human
uugaguuuucagug

SEQ ID NO: 1365612 - RNA, 23 nt, Human
uugaguuugucgcucaugugugc

SEQ ID NO: 1365613 - RNA, 11 nt, Human
uugaguuuguc

SEQ ID NO: 1365614 - RNA, 20 nt, Human
uugaguugguuacuucauau

SEQ ID NO: 1365615 - RNA, 21 nt, Human
uugagauggagucuugcucug

SEQ ID NO: 1365616 - RNA, 23 nt, Human
uugagagaaauaugaagaacuga

SEQ ID NO: 1365617 - RNA, 16 nt, Human
uugagauguguucaca

SEQ ID NO: 1365618 - RNA, 14 nt, Human
uugagucugugcca

SEQ ID NO: 1365619 - RNA, 16 nt, Human
uugagucaaaaaaucu

SEQ ID NO: 1365620 - RNA, 22 nt, Human
uugacuuuccccaccagaugcu

SEQ ID NO: 1365621 - RNA, 23 nt, Human
uugacuuuccccaccagaugcug

SEQ ID NO: 1365622 - RNA, 19 nt, Human
uugacuuuccccaccagau

SEQ ID NO: 1365623 - RNA, 13 nt, Human
uugacuuucccca

SEQ ID NO: 1365624 - RNA, 18 nt, Human
uugacuuauaguacauga

SEQ ID NO: 1365625 - RNA, 19 nt, Human
uugcaagggaaaagucucu

SEQ ID NO: 1365626 - RNA, 13 nt, Human
uugcaagggaaaa

SEQ ID NO: 1365627 - RNA, 17 nt, Human
uugauuauucaguguca

SEQ ID NO: 1365628 - RNA, 15 nt, Human
uugauuauucagugu

SEQ ID NO: 1365629 - RNA, 21 nt, Human
uugauuauccauauugaguca

SEQ ID NO: 1365630 - RNA, 17 nt, Human
uugauuacagugcagug

SEQ ID NO: 1365631 - RNA, 14 nt, Human
uugauuacagugca

SEQ ID NO: 1365632 - RNA, 14 nt, Human
uugauuaaagauga

SEQ ID NO: 1365633 - RNA, 14 nt, Human
uugauuaaauucuu

SEQ ID NO: 1365634 - RNA, 13 nt, Human
uugauuaaagaug

SEQ ID NO: 1365635 - RNA, 13 nt, Human
aucugacccagug

SEQ ID NO: 1365636 - RNA, 12 nt, Human
aucugacccagu

SEQ ID NO: 1365637 - RNA, 13 nt, Human
uugauuaaauucu

SEQ ID NO: 1365638 - RNA, 23 nt, Human
uugauguuuuaaggaugcuugua

SEQ ID NO: 1365639 - RNA, 20 nt, Human
aucugaauuuuuaaacaagu

SEQ ID NO: 1365640 - RNA, 19 nt, Human
aucugaauuuuuaaacaag

SEQ ID NO: 1365641 - RNA, 18 nt, Human
aucugaauuuuuaaacaa

SEQ ID NO: 1365642 - RNA, 14 nt, Human
aucugaauuuuuaa

SEQ ID NO: 1365643 - RNA, 12 nt, Human
aucugaauuuuu

SEQ ID NO: 1365644 - RNA, 21 nt, Human
uugcauuuaaaacagacacug

SEQ ID NO: 1365645 - RNA, 20 nt, Human
uugcauuuaaaacagacacu

SEQ ID NO: 1365646 - RNA, 15 nt, Human
uugcauuuaaaacag

SEQ ID NO: 1365647 - RNA, 19 nt, Human
uugcauugacuuuccccac

SEQ ID NO: 1365648 - RNA, 13 nt, Human
uugcauugacuuu

SEQ ID NO: 1365649 - RNA, 21 nt, Human
uugcauugaccgcgacuaauu

SEQ ID NO: 1365650 - RNA, 23 nt, Human
uugcauugaacacaaacuguaaa

SEQ ID NO: 1365651 - RNA, 22 nt, Human
uugcauugaacacaaacuguaa

SEQ ID NO: 1365652 - RNA, 18 nt, Human
uugcauugaacacaaacu

SEQ ID NO: 1365653 - RNA, 15 nt, Human
uugcauugaacacaa

SEQ ID NO: 1365654 - RNA, 14 nt, Human
uugcauugaacaca

SEQ ID NO: 1365655 - RNA, 22 nt, Human
uugcaucacuuaacggaccaaa

SEQ ID NO: 1365656 - RNA, 23 nt, Human
uugcauaguaccaaucauuuuaa

SEQ ID NO: 1365657 - RNA, 22 nt, Human
uugcaagggaaaagucucuugu

SEQ ID NO: 1365658 - RNA, 14 nt, Human
aucucuucuuuuaa

SEQ ID NO: 1365659 - RNA, 23 nt, Human
aucuccaagcagcuuagaguugg

SEQ ID NO: 1365660 - RNA, 17 nt, Human
aucuccaagcagcuuag

SEQ ID NO: 1365661 - RNA, 15 nt, Human
aucuccaagcagcuu

SEQ ID NO: 1365662 - RNA, 23 nt, Human
aucuagaggcuuccuucauuucc

SEQ ID NO: 1365663 - RNA, 19 nt, Human
aucuagaggcuuccuucau

SEQ ID NO: 1365664 - RNA, 17 nt, Human
aucuagaggcuuccuuc

SEQ ID NO: 1365665 - RNA, 21 nt, Human
aucuagaacacaggcaaaauc

SEQ ID NO: 1365666 - RNA, 23 nt, Human
aucuacuucuguaauugugugga

SEQ ID NO: 1365667 - RNA, 20 nt, Human
aucuacuucuguaauugugu

SEQ ID NO: 1365668 - RNA, 19 nt, Human
aucuacuucuguaauugug

SEQ ID NO: 1365669 - RNA, 19 nt, Human
aucuacuuccaaacuaauu

SEQ ID NO: 1365670 - RNA, 15 nt, Human
aucuacuuccaaacu

SEQ ID NO: 1365671 - RNA, 13 nt, Human
aucuacuuccaaa

SEQ ID NO: 1365672 - RNA, 23 nt, Human
aucucaugccccuggcugggacg

SEQ ID NO: 1365673 - RNA, 21 nt, Human
aucucaugccccuggcuggga

SEQ ID NO: 1365674 - RNA, 18 nt, Human
aucucaguaugaauuauu

SEQ ID NO: 1365675 - RNA, 22 nt, Human
aucucaguaugaauuauucaau

SEQ ID NO: 1365676 - RNA, 20 nt, Human
aucucauuggacccuuccau

SEQ ID NO: 1365677 - RNA, 19 nt, Human
aucucauuggacccuucca

SEQ ID NO: 1365678 - RNA, 15 nt, Human
aucucauuggacccu

SEQ ID NO: 1365679 - RNA, 14 nt, Human
aucucauuggaccc

SEQ ID NO: 1365680 - RNA, 17 nt, Human
aucucauugcuuacaag

SEQ ID NO: 1365681 - RNA, 16 nt, Human
aucucauugcuuacaa

SEQ ID NO: 1365682 - RNA, 14 nt, Human
aucucauuuccaag

SEQ ID NO: 1365683 - RNA, 14 nt, Human
aucuccaaaauaaa

SEQ ID NO: 1365684 - RNA, 17 nt, Human
aucuccaaaauaaaacu

SEQ ID NO: 1365685 - RNA, 20 nt, Human
aucuccaaaauaaaacuuuu

SEQ ID NO: 1365686 - RNA, 21 nt, Human
aucuccaaaauaaaacuuuuu

SEQ ID NO: 1365687 - RNA, 19 nt, Human
uucugcccccugcagaacc

SEQ ID NO: 1365688 - RNA, 15 nt, Human
uucugcccugcccac

SEQ ID NO: 1365689 - RNA, 16 nt, Human
uucugcccccugcaga

SEQ ID NO: 1365690 - RNA, 13 nt, Human
uucugccaggaga

SEQ ID NO: 1365691 - RNA, 22 nt, Human
uucugaacucaaacugaggaau

SEQ ID NO: 1365692 - RNA, 18 nt, Human
uucugaacucaaacugag

SEQ ID NO: 1365693 - RNA, 17 nt, Human
uucugaacucaaacuga

SEQ ID NO: 1365694 - RNA, 16 nt, Human
uucugaacucaaacug

SEQ ID NO: 1365695 - RNA, 19 nt, Human
uucucuuguauaagauccu

SEQ ID NO: 1365696 - RNA, 22 nt, Human
uucugaacuaaagugcugcacu

SEQ ID NO: 1365697 - RNA, 22 nt, Human
uucucuugggaacugaacucac

SEQ ID NO: 1365698 - RNA, 17 nt, Human
uucucuugggaacugaa

SEQ ID NO: 1365699 - RNA, 21 nt, Human
uucugggagggcagcagggcu

SEQ ID NO: 1365700 - RNA, 14 nt, Human
uucugggagggcag

SEQ ID NO: 1365701 - RNA, 15 nt, Human
uucuggcuguuugag

SEQ ID NO: 1365702 - RNA, 14 nt, Human
uucugccuggagac

SEQ ID NO: 1365703 - RNA, 10 nt, Human
uucuccugga

SEQ ID NO: 1365704 - RNA, 22 nt, Human
uucuccugcugcucccucagac

SEQ ID NO: 1365705 - RNA, 21 nt, Human
uucuccugcugcucccucaga

SEQ ID NO: 1365706 - RNA, 20 nt, Human
uucuccugcugcucccucag

SEQ ID NO: 1365707 - RNA, 19 nt, Human
uucuccugcugcucccuca

SEQ ID NO: 1365708 - RNA, 16 nt, Human
uucuccugcugcuccc

SEQ ID NO: 1365709 - RNA, 23 nt, Human
aucaguaguucacauacaaauca

SEQ ID NO: 1365710 - RNA, 23 nt, Human
uucuccugcugcucccucagacu

SEQ ID NO: 1365711 - RNA, 21 nt, Human
uucuccuuguguuacuaaguu

SEQ ID NO: 1365712 - RNA, 16 nt, Human
aucaguaguucacaua

SEQ ID NO: 1365713 - RNA, 18 nt, Human
aucaguagccagcaucug

SEQ ID NO: 1365714 - RNA, 23 nt, Human
aucaguaagagguguuauuugga

SEQ ID NO: 1365715 - RNA, 17 nt, Human
aucaguaagagguguua

SEQ ID NO: 1365716 - RNA, 18 nt, Human
aucaguaaauaacuggaa

SEQ ID NO: 1365717 - RNA, 14 nt, Human
aucaguaaauaacu

SEQ ID NO: 1365718 - RNA, 14 nt, Human
aucagguuuuuccc

SEQ ID NO: 1365719 - RNA, 13 nt, Human
uucucuugccuca

SEQ ID NO: 1365720 - RNA, 20 nt, Human
uucucuuccuuuuaucagua

SEQ ID NO: 1365721 - RNA, 20 nt, Human
uucucuaguuugauuaaauu

SEQ ID NO: 1365722 - RNA, 12 nt, Human
uucucuaggaaa

SEQ ID NO: 1365723 - RNA, 15 nt, Human
uucucuaguuugauu

SEQ ID NO: 1365724 - RNA, 17 nt, Human
uucucuaguuugauuaa

SEQ ID NO: 1365725 - RNA, 21 nt, Human
uucuggggcaggcugggccau

SEQ ID NO: 1365726 - RNA, 20 nt, Human
uucuggggcaggcugggcca

SEQ ID NO: 1365727 - RNA, 19 nt, Human
uucuggggcaggcugggcc

SEQ ID NO: 1365728 - RNA, 18 nt, Human
uucuggggcaggcugggc

SEQ ID NO: 1365729 - RNA, 17 nt, Human
uucuggggcaggcuggg

SEQ ID NO: 1365730 - RNA, 16 nt, Human
uucugggcuucaucug

SEQ ID NO: 1365731 - RNA, 15 nt, Human
uucugggccugacca

SEQ ID NO: 1365732 - RNA, 22 nt, Human
aucauuuugcaaucccuuaaua

SEQ ID NO: 1365733 - RNA, 21 nt, Human
auccaagcaccaccaaacaca

SEQ ID NO: 1365734 - RNA, 15 nt, Human
aucccaaaguuguug

SEQ ID NO: 1365735 - RNA, 20 nt, Human
aucccaaaggacagccgccu

SEQ ID NO: 1365736 - RNA, 16 nt, Human
aucccaaaggacagcc

SEQ ID NO: 1365737 - RNA, 16 nt, Human
aucccagcccccugac

SEQ ID NO: 1365738 - RNA, 14 nt, Human
aucccagcccccug

SEQ ID NO: 1365739 - RNA, 22 nt, Human
aucccaaaguuguuguaaccug

SEQ ID NO: 1365740 - RNA, 20 nt, Human
aucccaaaguuguuguaacc

SEQ ID NO: 1365741 - RNA, 19 nt, Human
aucccagcccccugaccac

SEQ ID NO: 1365742 - RNA, 24 nt, Human
aucccagcccccugaccacucaga

SEQ ID NO: 1365743 - RNA, 13 nt, Human
aucccagcugccu

SEQ ID NO: 1365744 - RNA, 14 nt, Human
aucccagcugccua

SEQ ID NO: 1365745 - RNA, 16 nt, Human
auccacauuucuaaaa

SEQ ID NO: 1365746 - RNA, 15 nt, Human
auccacauuucuaaa

SEQ ID NO: 1365747 - RNA, 16 nt, Human
auccaguucaugagaa

SEQ ID NO: 1365748 - RNA, 21 nt, Human
auccagugauccuuacaaguu

SEQ ID NO: 1365749 - RNA, 16 nt, Human
auccagugauccuuac

SEQ ID NO: 1365750 - RNA, 18 nt, Human
auccaguuuugucaaugc

SEQ ID NO: 1365751 - RNA, 20 nt, Human
auccauauugagucaaaugg

SEQ ID NO: 1365752 - RNA, 18 nt, Human
auccauauugagucaaau

SEQ ID NO: 1365753 - RNA, 14 nt, Human
auccaucaucaugu

SEQ ID NO: 1365754 - RNA, 13 nt, Human
uucuucugaacuc

SEQ ID NO: 1365755 - RNA, 17 nt, Human
uucuuaacuucuugcuu

SEQ ID NO: 1365756 - RNA, 16 nt, Human
uucuuaacuucuugcu

SEQ ID NO: 1365757 - RNA, 13 nt, Human
uucuuaacuucuu

SEQ ID NO: 1365758 - RNA, 11 nt, Human
aucccucaucu

SEQ ID NO: 1365759 - RNA, 23 nt, Human
aucccaucgucucggccuucaca

SEQ ID NO: 1365760 - RNA, 21 nt, Human
aucccaucgucucggccuuca

SEQ ID NO: 1365761 - RNA, 20 nt, Human
uucuuuggaaaguacacucu

SEQ ID NO: 1365762 - RNA, 16 nt, Human
uucuuuggaaaguaca

SEQ ID NO: 1365763 - RNA, 18 nt, Human
uucuuugggaauauuuga

SEQ ID NO: 1365764 - RNA, 20 nt, Human
uucuuugggaauauuugaau

SEQ ID NO: 1365765 - RNA, 16 nt, Human
uucuucuugaggggaa

SEQ ID NO: 1365766 - RNA, 14 nt, Human
uucuucuucucguc

SEQ ID NO: 1365767 - RNA, 22 nt, Human
uucuucuuccaacguggcccag

SEQ ID NO: 1365768 - RNA, 23 nt, Human
uucuucugaacucaaacugagga

SEQ ID NO: 1365769 - RNA, 20 nt, Human
uucuucugaacucaaacuga

SEQ ID NO: 1365770 - RNA, 16 nt, Human
uucuuuuuuuagagaa

SEQ ID NO: 1365771 - RNA, 23 nt, Human
uucuuuuuuggccaucugcuccu

SEQ ID NO: 1365772 - RNA, 22 nt, Human
uucuuuuuugauauagaaguau

SEQ ID NO: 1365773 - RNA, 23 nt, Human
uucuuuuuguagcuggggcuuug

SEQ ID NO: 1365774 - RNA, 21 nt, Human
uucuuuuugggagagacuugu

SEQ ID NO: 1365775 - RNA, 19 nt, Human
uucuuuuugggagagacuu

SEQ ID NO: 1365776 - RNA, 23 nt, Human
uucuuuuuugauauagaaguaua

SEQ ID NO: 1365777 - RNA, 13 nt, Human
uucuuugggccag

SEQ ID NO: 1365778 - RNA, 22 nt, Human
uucuuugggaauauuugaaucu

SEQ ID NO: 1365779 - RNA, 15 nt, Human
uucuuuguaaugaaa

SEQ ID NO: 1365780 - RNA, 18 nt, Human
uucuuuuugggagagacu

SEQ ID NO: 1365781 - RNA, 22 nt, Human
uucuuugguuucccaagagcua

SEQ ID NO: 1365782 - RNA, 16 nt, Human
uucuuuguaaugaaaa

SEQ ID NO: 1365783 - RNA, 15 nt, Human
auccuagauccuaag

SEQ ID NO: 1365784 - RNA, 16 nt, Human
auccuacccccugugc

SEQ ID NO: 1365785 - RNA, 18 nt, Human
auccuaagcaucuaaguu

SEQ ID NO: 1365786 - RNA, 22 nt, Human
auccuaccacaaugcagugccu

SEQ ID NO: 1365787 - RNA, 21 nt, Human
auccuaccacaaugcagugcc

SEQ ID NO: 1365788 - RNA, 14 nt, Human
auccuacccccugu

SEQ ID NO: 1365789 - RNA, 11 nt, Human
auccuccuccc

SEQ ID NO: 1365790 - RNA, 11 nt, Human
auccuccucau

SEQ ID NO: 1365791 - RNA, 16 nt, Human
auccuagauccuaagg

SEQ ID NO: 1365792 - RNA, 21 nt, Human
auccgucuuuggccuccucca

SEQ ID NO: 1365793 - RNA, 22 nt, Human
auccggcaacaucaacccgagu

SEQ ID NO: 1365794 - RNA, 13 nt, Human
auccggaaagaag

SEQ ID NO: 1365795 - RNA, 14 nt, Human
auccgccaauauua

SEQ ID NO: 1365796 - RNA, 17 nt, Human
auccuaagcaucuaagu

SEQ ID NO: 1365797 - RNA, 14 nt, Human
auccuaaacaucau

SEQ ID NO: 1365798 - RNA, 17 nt, Human
auccgacugcuuuggac

SEQ ID NO: 1365799 - RNA, 20 nt, Human
uugaacguuuucuaauugcu

SEQ ID NO: 1365800 - RNA, 19 nt, Human
uugaacguuuucuaauugc

SEQ ID NO: 1365801 - RNA, 18 nt, Human
uugaacguuuucuaauug

SEQ ID NO: 1365802 - RNA, 17 nt, Human
uugaacguuuucuaauu

SEQ ID NO: 1365803 - RNA, 16 nt, Human
uugaacguuuucuaau

SEQ ID NO: 1365804 - RNA, 19 nt, Human
uugaaccuuugugcccuau

SEQ ID NO: 1365805 - RNA, 17 nt, Human
uugaaccuuugugcccu

SEQ ID NO: 1365806 - RNA, 19 nt, Human
uugaaccugaugaaaauaa

SEQ ID NO: 1365807 - RNA, 20 nt, Human
uugaaccugaugaaaauaaa

SEQ ID NO: 1365808 - RNA, 18 nt, Human
uugaaccugaugaaaaua

SEQ ID NO: 1365809 - RNA, 18 nt, Human
uugaaauugaaccuuugu

SEQ ID NO: 1365810 - RNA, 17 nt, Human
uugaaauuguauuacaa

SEQ ID NO: 1365811 - RNA, 20 nt, Human
uugaaauguaaggcugugua

SEQ ID NO: 1365812 - RNA, 17 nt, Human
uugaaauguaaggcugu

SEQ ID NO: 1365813 - RNA, 11 nt, Human
uugaaauguaa

SEQ ID NO: 1365814 - RNA, 22 nt, Human
uugaaagguuuuuuuucaguug

SEQ ID NO: 1365815 - RNA, 21 nt, Human
uugaaagguuuuuuuucaguu

SEQ ID NO: 1365816 - RNA, 21 nt, Human
uugaaagggguugugaagagg

SEQ ID NO: 1365817 - RNA, 20 nt, Human
uugaaauuaagaaggcaaaa

SEQ ID NO: 1365818 - RNA, 21 nt, Human
uugaaauguaaggcuguguaa

SEQ ID NO: 1365819 - RNA, 18 nt, Human
uugaaauuaaccucucac

SEQ ID NO: 1365820 - RNA, 17 nt, Human
uugaaauuaugugacau

SEQ ID NO: 1365821 - RNA, 20 nt, Human
uugaaauuaugugacauuuu

SEQ ID NO: 1365822 - RNA, 14 nt, Human
aucaacauuucuca

SEQ ID NO: 1365823 - RNA, 13 nt, Human
aucaagcccuuua

SEQ ID NO: 1365824 - RNA, 21 nt, Human
aucaaauuuguaggguuucua

SEQ ID NO: 1365825 - RNA, 16 nt, Human
aucaacaaaaauuguc

SEQ ID NO: 1365826 - RNA, 22 nt, Human
auauuuuuaucuuuauaugaag

SEQ ID NO: 1365827 - RNA, 20 nt, Human
auauuuuuaucuuuauauga

SEQ ID NO: 1365828 - RNA, 15 nt, Human
auauuuuuaucuuua

SEQ ID NO: 1365829 - RNA, 14 nt, Human
auauuuuuaucuuu

SEQ ID NO: 1365830 - RNA, 19 nt, Human
uuccugucuuauccuccac

SEQ ID NO: 1365831 - RNA, 21 nt, Human
uuccuguccucuuucagcucc

SEQ ID NO: 1365832 - RNA, 24 nt, Human
uuccuguccucuuucagcuccuga

SEQ ID NO: 1365833 - RNA, 20 nt, Human
uuccuguccucuuucagcuc

SEQ ID NO: 1365834 - RNA, 19 nt, Human
uuccuguccucuuucagcu

SEQ ID NO: 1365835 - RNA, 13 nt, Human
uuccuguggcucc

SEQ ID NO: 1365836 - RNA, 18 nt, Human
aucacugaguuuuccaug

SEQ ID NO: 1365837 - RNA, 17 nt, Human
aucacugaguuuuccau

SEQ ID NO: 1365838 - RNA, 16 nt, Human
aucacugaguuuucca

SEQ ID NO: 1365839 - RNA, 15 nt, Human
aucacugaguuuucc

SEQ ID NO: 1365840 - RNA, 18 nt, Human
aucacgcuuuuugaaaaa

SEQ ID NO: 1365841 - RNA, 18 nt, Human
aucacgcuuuccugaauc

SEQ ID NO: 1365842 - RNA, 14 nt, Human
aucacgcuuuccug

SEQ ID NO: 1365843 - RNA, 18 nt, Human
aucaaucuugcauguaac

SEQ ID NO: 1365844 - RNA, 17 nt, Human
aucaaucuugcauguaa

SEQ ID NO: 1365845 - RNA, 16 nt, Human
aucaaucuugcaugua

SEQ ID NO: 1365846 - RNA, 21 nt, Human
aucaaucuguaaaacuaagaa

SEQ ID NO: 1365847 - RNA, 22 nt, Human
aucaaucuuuaaaccaauugcu

SEQ ID NO: 1365848 - RNA, 22 nt, Human
aucaaggccuuauuggaaagca

SEQ ID NO: 1365849 - RNA, 18 nt, Human
aucaaggccuuauuggaa

SEQ ID NO: 1365850 - RNA, 16 nt, Human
aucaaggguacacugc

SEQ ID NO: 1365851 - RNA, 15 nt, Human
auagcaaagaauuga

SEQ ID NO: 1365852 - RNA, 14 nt, Human
auagcaaagaauug

SEQ ID NO: 1365853 - RNA, 22 nt, Human
auagcaaagcgacguuagucgu

SEQ ID NO: 1365854 - RNA, 13 nt, Human
auagcaaagaauu

SEQ ID NO: 1365855 - RNA, 19 nt, Human
auagcaaaagaagaaguuu

SEQ ID NO: 1365856 - RNA, 18 nt, Human
auagcaaaagaagaaguu

SEQ ID NO: 1365857 - RNA, 17 nt, Human
auagcaaaagaagaagu

SEQ ID NO: 1365858 - RNA, 16 nt, Human
auagcaaaagaagaag

SEQ ID NO: 1365859 - RNA, 15 nt, Human
auagcaaaagaagaa

SEQ ID NO: 1365860 - RNA, 21 nt, Human
uucccucaccuuggcaccaga

SEQ ID NO: 1365861 - RNA, 18 nt, Human
uuccgugacgucacugga

SEQ ID NO: 1365862 - RNA, 21 nt, Human
uuccgucaccacgacuggcca

SEQ ID NO: 1365863 - RNA, 18 nt, Human
uuccggccccuccccucc

SEQ ID NO: 1365864 - RNA, 21 nt, Human
uuccggccccuccccuccaaa

SEQ ID NO: 1365865 - RNA, 14 nt, Human
uuccguuaaaauac

SEQ ID NO: 1365866 - RNA, 16 nt, Human
uuccguuaaaauacca

SEQ ID NO: 1365867 - RNA, 17 nt, Human
uuccggccccuccccuc

SEQ ID NO: 1365868 - RNA, 13 nt, Human
uuccggccccucc

SEQ ID NO: 1365869 - RNA, 22 nt, Human
uuccggcauggacaauggaccg

SEQ ID NO: 1365870 - RNA, 22 nt, Human
uuccggauccuaagcaucuaag

SEQ ID NO: 1365871 - RNA, 19 nt, Human
uucccucccagaggagcca

SEQ ID NO: 1365872 - RNA, 21 nt, Human
uucccucacucgucuccccca

SEQ ID NO: 1365873 - RNA, 20 nt, Human
uucccucacucgucuccccc

SEQ ID NO: 1365874 - RNA, 19 nt, Human
uuccguagguuauuuucag

SEQ ID NO: 1365875 - RNA, 19 nt, Human
uuccugaagaaccaguccc

SEQ ID NO: 1365876 - RNA, 16 nt, Human
uuccugaagaaccagu

SEQ ID NO: 1365877 - RNA, 15 nt, Human
uuccugaagaaccag

SEQ ID NO: 1365878 - RNA, 15 nt, Human
uuccugaacaggaua

SEQ ID NO: 1365879 - RNA, 14 nt, Human
uuccugaacaggau

SEQ ID NO: 1365880 - RNA, 17 nt, Human
uuccguguccaccccca

SEQ ID NO: 1365881 - RNA, 15 nt, Human
uuccguguccacccc

SEQ ID NO: 1365882 - RNA, 20 nt, Human
uuccuaaauauauuuuaaga

SEQ ID NO: 1365883 - RNA, 24 nt, Human
uucuagaucagaugcuccaagauu

SEQ ID NO: 1365884 - RNA, 23 nt, Human
uucuaagguccgguguucuaaga

SEQ ID NO: 1365885 - RNA, 21 nt, Human
uucuaagguccgguguucuaa

SEQ ID NO: 1365886 - RNA, 20 nt, Human
uucuaagguccgguguucua

SEQ ID NO: 1365887 - RNA, 20 nt, Human
uucuaaggcucugagagucu

SEQ ID NO: 1365888 - RNA, 18 nt, Human
uucuaaggcucugagagu

SEQ ID NO: 1365889 - RNA, 17 nt, Human
uucuaaggcucugagag

SEQ ID NO: 1365890 - RNA, 16 nt, Human
uucuaaggcucugaga

SEQ ID NO: 1365891 - RNA, 13 nt, Human
uucuaaggcucug

SEQ ID NO: 1365892 - RNA, 12 nt, Human
uucuaaggcucu

SEQ ID NO: 1365893 - RNA, 22 nt, Human
uucuaaggccuaggauucuaaa

SEQ ID NO: 1365894 - RNA, 21 nt, Human
uucuaaggccuaggauucuaa

SEQ ID NO: 1365895 - RNA, 20 nt, Human
uucuaaggccuaggauucua

SEQ ID NO: 1365896 - RNA, 21 nt, Human
uucuaagacuuacucuaagau

SEQ ID NO: 1365897 - RNA, 20 nt, Human
uucuaagacuuacucuaaga

SEQ ID NO: 1365898 - RNA, 22 nt, Human
uucuaagacucaaauguucuaa

SEQ ID NO: 1365899 - RNA, 21 nt, Human
uucuaagacucaaauguucua

SEQ ID NO: 1365900 - RNA, 20 nt, Human
uucuaagacucaaauguucu

SEQ ID NO: 1365901 - RNA, 16 nt, Human
uucuaagacucaaaug

SEQ ID NO: 1365902 - RNA, 13 nt, Human
uucuaagacucaa

SEQ ID NO: 1365903 - RNA, 12 nt, Human
uucuaagacuca

SEQ ID NO: 1365904 - RNA, 22 nt, Human
uucuagaugauuaaauaagauu

SEQ ID NO: 1365905 - RNA, 12 nt, Human
uucuagaugauu

SEQ ID NO: 1365906 - RNA, 19 nt, Human
uucuagcaugaagacagag

SEQ ID NO: 1365907 - RNA, 16 nt, Human
uucuagcgcaguuuuu

SEQ ID NO: 1365908 - RNA, 22 nt, Human
uucgcuucuugccucugugcug

SEQ ID NO: 1365909 - RNA, 14 nt, Human
uucgcucuuugaga

SEQ ID NO: 1365910 - RNA, 20 nt, Human
uucggacaguuuauuuguug

SEQ ID NO: 1365911 - RNA, 19 nt, Human
uucggacaguuuauuuguu

SEQ ID NO: 1365912 - RNA, 16 nt, Human
aucacugcucacacug

SEQ ID NO: 1365913 - RNA, 17 nt, Human
uucggccccauguaucu

SEQ ID NO: 1365914 - RNA, 20 nt, Human
uucuaaaggcuaccuuugua

SEQ ID NO: 1365915 - RNA, 21 nt, Human
uucuaaaggcuaccuuuguau

SEQ ID NO: 1365916 - RNA, 21 nt, Human
uucuaaaugaauguuuacacu

SEQ ID NO: 1365917 - RNA, 18 nt, Human
uucuaaaugaauguuuac

SEQ ID NO: 1365918 - RNA, 15 nt, Human
uucuaaaugaauguu

SEQ ID NO: 1365919 - RNA, 12 nt, Human
uucuaaaugaau

SEQ ID NO: 1365920 - RNA, 16 nt, Human
uucuaaagguccacag

SEQ ID NO: 1365921 - RNA, 13 nt, Human
uucuaaaggucca

SEQ ID NO: 1365922 - RNA, 18 nt, Human
uucggccccauguaucuc

SEQ ID NO: 1365923 - RNA, 13 nt, Human
uucuaaaguaaaa

SEQ ID NO: 1365924 - RNA, 21 nt, Human
uucuaaaucuccaaaauaaaa

SEQ ID NO: 1365925 - RNA, 18 nt, Human
aucacuuguacaaaauaa

SEQ ID NO: 1365926 - RNA, 17 nt, Human
aucacuuguacaaaaua

SEQ ID NO: 1365927 - RNA, 16 nt, Human
aucacuuguacaaaau

SEQ ID NO: 1365928 - RNA, 14 nt, Human
aucacuuguacaaa

SEQ ID NO: 1365929 - RNA, 19 nt, Human
uucucagguguugccaaau

SEQ ID NO: 1365930 - RNA, 17 nt, Human
uucucagguguugccaa

SEQ ID NO: 1365931 - RNA, 16 nt, Human
uucucagguguugcca

SEQ ID NO: 1365932 - RNA, 19 nt, Human
aucagaauagccacauuug

SEQ ID NO: 1365933 - RNA, 19 nt, Human
aucagaagucaucuugcua

SEQ ID NO: 1365934 - RNA, 16 nt, Human
aucacuuucucaguuu

SEQ ID NO: 1365935 - RNA, 21 nt, Human
aucacuuguacaaaauaaaca

SEQ ID NO: 1365936 - RNA, 22 nt, Human
aucacuugucaauaaaauccau

SEQ ID NO: 1365937 - RNA, 15 nt, Human
uucucacuaaaucuu

SEQ ID NO: 1365938 - RNA, 15 nt, Human
uucucacuaauuugu

SEQ ID NO: 1365939 - RNA, 23 nt, Human
uucucaggacacaggccugugua

SEQ ID NO: 1365940 - RNA, 22 nt, Human
uucucaggacacaggccugugu

SEQ ID NO: 1365941 - RNA, 20 nt, Human
uucucaggacacaggccugu

SEQ ID NO: 1365942 - RNA, 19 nt, Human
uucucaggacacaggccug

SEQ ID NO: 1365943 - RNA, 18 nt, Human
uucucaggacacaggccu

SEQ ID NO: 1365944 - RNA, 16 nt, Human
uucucaggacacaggc

SEQ ID NO: 1365945 - RNA, 18 nt, Human
uucucacaggucccaaau

SEQ ID NO: 1365946 - RNA, 19 nt, Human
uucucacagugggagccag

SEQ ID NO: 1365947 - RNA, 21 nt, Human
uucucacagugggagccaggg

SEQ ID NO: 1365948 - RNA, 22 nt, Human
uucucacagugggagccagggc

SEQ ID NO: 1365949 - RNA, 23 nt, Human
uucuaggacugaauuaugaaacu

SEQ ID NO: 1365950 - RNA, 16 nt, Human
uucuaggacugaauua

SEQ ID NO: 1365951 - RNA, 12 nt, Human
uucuaggaaaau

SEQ ID NO: 1365952 - RNA, 16 nt, Human
uucuaggaaaauaaaa

SEQ ID NO: 1365953 - RNA, 11 nt, Human
uucuaggaaaa

SEQ ID NO: 1365954 - RNA, 22 nt, Human
uucuagcuuaucuacuuccaaa

SEQ ID NO: 1365955 - RNA, 14 nt, Human
uucuaggacugaau

SEQ ID NO: 1365956 - RNA, 13 nt, Human
uucuaggacugaa

SEQ ID NO: 1365957 - RNA, 21 nt, Human
aucagcaaaccggggccuacu

SEQ ID NO: 1365958 - RNA, 23 nt, Human
aucagaugcuccaagauucuaga

SEQ ID NO: 1365959 - RNA, 22 nt, Human
aucagaugcuccaagauucuag

SEQ ID NO: 1365960 - RNA, 21 nt, Human
aucagaugcuccaagauucua

SEQ ID NO: 1365961 - RNA, 19 nt, Human
aucagaauaucacagaaaa

SEQ ID NO: 1365962 - RNA, 22 nt, Human
aucagaauagccacauuuggaa

SEQ ID NO: 1365963 - RNA, 13 nt, Human
aucagcacgauuu

SEQ ID NO: 1365964 - RNA, 22 nt, Human
aucaggcuuucuuuuuuuucuu

SEQ ID NO: 1365965 - RNA, 14 nt, Human
aucaggcuuucuuu

SEQ ID NO: 1365966 - RNA, 22 nt, Human
aucaggcuuucuuaaagugaga

SEQ ID NO: 1365967 - RNA, 14 nt, Human
aucaggcuuucuua

SEQ ID NO: 1365968 - RNA, 20 nt, Human
aucagguccucagagaauuu

SEQ ID NO: 1365969 - RNA, 16 nt, Human
aucagguccucagaga

SEQ ID NO: 1365970 - RNA, 23 nt, Human
aucagguaacuaacugcauacac

SEQ ID NO: 1365971 - RNA, 20 nt, Human
aucagggguaggaauggaaa

SEQ ID NO: 1365972 - RNA, 18 nt, Human
aucagggaggucauuuug

SEQ ID NO: 1365973 - RNA, 16 nt, Human
aucaggcuuuuguuuc

SEQ ID NO: 1365974 - RNA, 17 nt, Human
aucaggguuaguauugu

SEQ ID NO: 1365975 - RNA, 19 nt, Human
auggcguaaguacagagaa

SEQ ID NO: 1365976 - RNA, 18 nt, Human
auggcguaaguacagaga

SEQ ID NO: 1365977 - RNA, 17 nt, Human
auggcguaaguacagag

SEQ ID NO: 1365978 - RNA, 23 nt, Human
auggccccucugaccugcacugg

SEQ ID NO: 1365979 - RNA, 18 nt, Human
auggccccucugaccugc

SEQ ID NO: 1365980 - RNA, 11 nt, Human
auggccccucu

SEQ ID NO: 1365981 - RNA, 22 nt, Human
auggcguaaguacagagaagcc

SEQ ID NO: 1365982 - RNA, 23 nt, Human
auggcguaaguacagagaagcca

SEQ ID NO: 1365983 - RNA, 21 nt, Human
auggcguaaguacagagaagc

SEQ ID NO: 1365984 - RNA, 20 nt, Human
auggcguaaguacagagaag

SEQ ID NO: 1365985 - RNA, 13 nt, Human
auggcuauuuuau

SEQ ID NO: 1365986 - RNA, 19 nt, Human
auggcuauguuuuuaaugu

SEQ ID NO: 1365987 - RNA, 12 nt, Human
auggcucccagg

SEQ ID NO: 1365988 - RNA, 18 nt, Human
augggagacccuugacac

SEQ ID NO: 1365989 - RNA, 17 nt, Human
augggagacccuugaca

SEQ ID NO: 1365990 - RNA, 22 nt, Human
augggagcugguuagaaaugca

SEQ ID NO: 1365991 - RNA, 20 nt, Human
augggagcugguuagaaaug

SEQ ID NO: 1365992 - RNA, 23 nt, Human
augggaggcucacccccuucucc

SEQ ID NO: 1365993 - RNA, 21 nt, Human
augggagcugguuagaaaugc

SEQ ID NO: 1365994 - RNA, 18 nt, Human
augggagggaggcucagg

SEQ ID NO: 1365995 - RNA, 20 nt, Human
auggccccagcacagcuuga

SEQ ID NO: 1365996 - RNA, 18 nt, Human
auggccccagcacagcuu

SEQ ID NO: 1365997 - RNA, 17 nt, Human
auggccccagcacagcu

SEQ ID NO: 1365998 - RNA, 15 nt, Human
auggccccagcacag

SEQ ID NO: 1365999 - RNA, 14 nt, Human
auggccccagcaca

SEQ ID NO: 1366000 - RNA, 15 nt, Human
auggcccauccugug

SEQ ID NO: 1366001 - RNA, 22 nt, Human
auggccauggaguguacaagua

SEQ ID NO: 1366002 - RNA, 17 nt, Human
auggcaugagaaauaca

SEQ ID NO: 1366003 - RNA, 15 nt, Human
auggcaugagaaaua

SEQ ID NO: 1366004 - RNA, 16 nt, Human
auggcauccuccagcc

SEQ ID NO: 1366005 - RNA, 17 nt, Human
auggcauaaccugucuc

SEQ ID NO: 1366006 - RNA, 16 nt, Human
auggcauaaccugucu

SEQ ID NO: 1366007 - RNA, 15 nt, Human
auggcaguuauauuu

SEQ ID NO: 1366008 - RNA, 24 nt, Human
auggcaggggguggaauuauuacu

SEQ ID NO: 1366009 - RNA, 17 nt, Human
auggcaggggguggaau

SEQ ID NO: 1366010 - RNA, 22 nt, Human
auggcagggggcugcugcuggg

SEQ ID NO: 1366011 - RNA, 20 nt, Human
auggcagggggcugcugcug

SEQ ID NO: 1366012 - RNA, 19 nt, Human
auggcagggggcugcugcu

SEQ ID NO: 1366013 - RNA, 17 nt, Human
auggcagggggcugcug

SEQ ID NO: 1366014 - RNA, 16 nt, Human
auggcagggggcugcu

SEQ ID NO: 1366015 - RNA, 15 nt, Human
auggcagggggcugc

SEQ ID NO: 1366016 - RNA, 18 nt, Human
auggcagcuuuuaaaaga

SEQ ID NO: 1366017 - RNA, 17 nt, Human
auggcaggaaggcuugu

SEQ ID NO: 1366018 - RNA, 13 nt, Human
auggcagcagggg

SEQ ID NO: 1366019 - RNA, 11 nt, Human
auggcagcagg

SEQ ID NO: 1366020 - RNA, 21 nt, Human
auggcagauguaggagggacu

SEQ ID NO: 1366021 - RNA, 20 nt, Human
auggcagauguaggagggac

SEQ ID NO: 1366022 - RNA, 19 nt, Human
auggcagauguaggaggga

SEQ ID NO: 1366023 - RNA, 14 nt, Human
auggcagauguagg

SEQ ID NO: 1366024 - RNA, 16 nt, Human
auggcacuaguauuuc

SEQ ID NO: 1366025 - RNA, 14 nt, Human
auggcacuaguauu

SEQ ID NO: 1366026 - RNA, 14 nt, Human
auggagaaggaagg

SEQ ID NO: 1366027 - RNA, 15 nt, Human
auggagaaggaaggc

SEQ ID NO: 1366028 - RNA, 12 nt, Human
uuuccaucuuua

SEQ ID NO: 1366029 - RNA, 19 nt, Human
uuuccauccauggccagca

SEQ ID NO: 1366030 - RNA, 23 nt, Human
uuuccaugcacccucauacacag

SEQ ID NO: 1366031 - RNA, 19 nt, Human
uuuccaugcguguuucuga

SEQ ID NO: 1366032 - RNA, 18 nt, Human
uuucccccuagccugccu

SEQ ID NO: 1366033 - RNA, 21 nt, Human
uuucaaauuggagcuucaugg

SEQ ID NO: 1366034 - RNA, 20 nt, Human
uuucaaauagggucuaacuc

SEQ ID NO: 1366035 - RNA, 19 nt, Human
uuucaaauagggucuaacu

SEQ ID NO: 1366036 - RNA, 17 nt, Human
uuucaaagcuuuuucca

SEQ ID NO: 1366037 - RNA, 19 nt, Human
uuucaaagaugcugugagu

SEQ ID NO: 1366038 - RNA, 14 nt, Human
uuucaaagaugcug

SEQ ID NO: 1366039 - RNA, 13 nt, Human
uuucaaagaugcu

SEQ ID NO: 1366040 - RNA, 19 nt, Human
uuucaacagugaagacaga

SEQ ID NO: 1366041 - RNA, 22 nt, Human
uuucauuaaauaaauuugacuu

SEQ ID NO: 1366042 - RNA, 21 nt, Human
uuucauuaauacagggcauuu

SEQ ID NO: 1366043 - RNA, 20 nt, Human
uuucaacagugaagacagaa

SEQ ID NO: 1366044 - RNA, 17 nt, Human
uuucaacagugaagaca

SEQ ID NO: 1366045 - RNA, 15 nt, Human
auggagaaagcugac

SEQ ID NO: 1366046 - RNA, 14 nt, Human
auggagaaagcuga

SEQ ID NO: 1366047 - RNA, 13 nt, Human
auggagaaagcug

SEQ ID NO: 1366048 - RNA, 12 nt, Human
auggagaaagcu

SEQ ID NO: 1366049 - RNA, 23 nt, Human
auggagaaagcugacuuggcugg

SEQ ID NO: 1366050 - RNA, 16 nt, Human
auggagaaagcugacu

SEQ ID NO: 1366051 - RNA, 12 nt, Human
auggagaaggaa

SEQ ID NO: 1366052 - RNA, 13 nt, Human
auggagaaggaag

SEQ ID NO: 1366053 - RNA, 14 nt, Human
auggacucuguccu

SEQ ID NO: 1366054 - RNA, 13 nt, Human
auggacucugucc

SEQ ID NO: 1366055 - RNA, 15 nt, Human
auggacucuguccug

SEQ ID NO: 1366056 - RNA, 16 nt, Human
auggacucuguccuga

SEQ ID NO: 1366057 - RNA, 14 nt, Human
auggacugcucagg

SEQ ID NO: 1366058 - RNA, 19 nt, Human
auggaauuuugcaaagauu

SEQ ID NO: 1366059 - RNA, 19 nt, Human
uuucccggacuuagaaaac

SEQ ID NO: 1366060 - RNA, 15 nt, Human
auggacaauggaccg

SEQ ID NO: 1366061 - RNA, 13 nt, Human
auggacaauggac

SEQ ID NO: 1366062 - RNA, 15 nt, Human
auggacacuacaccc

SEQ ID NO: 1366063 - RNA, 16 nt, Human
auggacacuacaccca

SEQ ID NO: 1366064 - RNA, 17 nt, Human
auggacacuacacccag

SEQ ID NO: 1366065 - RNA, 18 nt, Human
auggacacuacacccagc

SEQ ID NO: 1366066 - RNA, 19 nt, Human
auggacacuacacccagca

SEQ ID NO: 1366067 - RNA, 22 nt, Human
auggacuaucugucugguggcc

SEQ ID NO: 1366068 - RNA, 21 nt, Human
auggacuaucugucugguggc

SEQ ID NO: 1366069 - RNA, 20 nt, Human
auggacuaucugucuggugg

SEQ ID NO: 1366070 - RNA, 17 nt, Human
auggacuaucugucugg

SEQ ID NO: 1366071 - RNA, 13 nt, Human
auggacuaucugu

SEQ ID NO: 1366072 - RNA, 22 nt, Human
auggacacuacacccagcaaua

SEQ ID NO: 1366073 - RNA, 17 nt, Human
uuucaaacauauauaac

SEQ ID NO: 1366074 - RNA, 16 nt, Human
uuucaaacuuuacuau

SEQ ID NO: 1366075 - RNA, 22 nt, Human
uuucaaacuuuacuauggcccu

SEQ ID NO: 1366076 - RNA, 15 nt, Human
uuucaaaaugcuuuu

SEQ ID NO: 1366077 - RNA, 13 nt, Human
uuucaaaaugcuu

SEQ ID NO: 1366078 - RNA, 12 nt, Human
uuucaaaaugcu

SEQ ID NO: 1366079 - RNA, 21 nt, Human
uuucaaaaccagguccaauga

SEQ ID NO: 1366080 - RNA, 16 nt, Human
uuucaaacauauauaa

SEQ ID NO: 1366081 - RNA, 22 nt, Human
uuucaaaauuguuacaaauugu

SEQ ID NO: 1366082 - RNA, 20 nt, Human
uuuauuuuguguuuaggaac

SEQ ID NO: 1366083 - RNA, 12 nt, Human
uuuauuuuucau

SEQ ID NO: 1366084 - RNA, 17 nt, Human
uuuauuuuucuugucuu

SEQ ID NO: 1366085 - RNA, 17 nt, Human
uuuauuuuucauuuagu

SEQ ID NO: 1366086 - RNA, 13 nt, Human
uuucaaaaccagg

SEQ ID NO: 1366087 - RNA, 12 nt, Human
uuucaaaaccag

SEQ ID NO: 1366088 - RNA, 18 nt, Human
uuucaaaaccuuuugaaa

SEQ ID NO: 1366089 - RNA, 13 nt, Human
uuucaaaagaaag

SEQ ID NO: 1366090 - RNA, 23 nt, Human
augcuucuaaguaaauacaauuu

SEQ ID NO: 1366091 - RNA, 22 nt, Human
augcuucuaaguaaauacaauu

SEQ ID NO: 1366092 - RNA, 21 nt, Human
augcuucuaaguaaauacaau

SEQ ID NO: 1366093 - RNA, 20 nt, Human
augcuucuaaguaaauacaa

SEQ ID NO: 1366094 - RNA, 19 nt, Human
augcuguucaugaaagauu

SEQ ID NO: 1366095 - RNA, 14 nt, Human
augcugugugacuc

SEQ ID NO: 1366096 - RNA, 23 nt, Human
augcuguucaugaaagauucaau

SEQ ID NO: 1366097 - RNA, 19 nt, Human
augcuucuaaguaaauaca

SEQ ID NO: 1366098 - RNA, 15 nt, Human
augcuucuaaguaaa

SEQ ID NO: 1366099 - RNA, 15 nt, Human
augcuuccucccagc

SEQ ID NO: 1366100 - RNA, 16 nt, Human
augcuucccuuuccug

SEQ ID NO: 1366101 - RNA, 19 nt, Human
augcugcuggggaagacag

SEQ ID NO: 1366102 - RNA, 18 nt, Human
augcugcuggggaagaca

SEQ ID NO: 1366103 - RNA, 17 nt, Human
augcugcuggggaagac

SEQ ID NO: 1366104 - RNA, 16 nt, Human
augcugcuggggaaga

SEQ ID NO: 1366105 - RNA, 14 nt, Human
augcugcuggggaa

SEQ ID NO: 1366106 - RNA, 13 nt, Human
augcugcugggga

SEQ ID NO: 1366107 - RNA, 20 nt, Human
augcugcuggggaagacagu

SEQ ID NO: 1366108 - RNA, 21 nt, Human
augcugcuggggaagacagug

SEQ ID NO: 1366109 - RNA, 18 nt, Human
augcugugcgcccagggc

SEQ ID NO: 1366110 - RNA, 21 nt, Human
augcuguggcaugggugaaga

SEQ ID NO: 1366111 - RNA, 20 nt, Human
augcugugcgcccagggcug

SEQ ID NO: 1366112 - RNA, 17 nt, Human
augcuguucaugaaaga

SEQ ID NO: 1366113 - RNA, 13 nt, Human
uuuauuaaucuua

SEQ ID NO: 1366114 - RNA, 17 nt, Human
uuuauuaauauauauua

SEQ ID NO: 1366115 - RNA, 19 nt, Human
uuuauuaauauauauuauc

SEQ ID NO: 1366116 - RNA, 17 nt, Human
uuuauuaaugcacuuuc

SEQ ID NO: 1366117 - RNA, 12 nt, Human
uuuauuaaugca

SEQ ID NO: 1366118 - RNA, 19 nt, Human
uuuauuaaucuuaguguau

SEQ ID NO: 1366119 - RNA, 13 nt, Human
augcuaucucugu

SEQ ID NO: 1366120 - RNA, 14 nt, Human
augcuagguucuac

SEQ ID NO: 1366121 - RNA, 13 nt, Human
augcuagguucua

SEQ ID NO: 1366122 - RNA, 20 nt, Human
augcuccaagauucuagaug

SEQ ID NO: 1366123 - RNA, 22 nt, Human
augcuccagauuagagccugua

SEQ ID NO: 1366124 - RNA, 19 nt, Human
augcuccaagauucuagau

SEQ ID NO: 1366125 - RNA, 18 nt, Human
augcuccaagauucuaga

SEQ ID NO: 1366126 - RNA, 17 nt, Human
augcuccaagauucuag

SEQ ID NO: 1366127 - RNA, 16 nt, Human
augcuccaagauucua

SEQ ID NO: 1366128 - RNA, 17 nt, Human
augcuaacaucuaaaaa

SEQ ID NO: 1366129 - RNA, 16 nt, Human
augcuaacaucuaaaa

SEQ ID NO: 1366130 - RNA, 14 nt, Human
augcuaacaucuaa

SEQ ID NO: 1366131 - RNA, 19 nt, Human
augcuaacaucuaaaaaua

SEQ ID NO: 1366132 - RNA, 18 nt, Human
augcuaagagaaguagaa

SEQ ID NO: 1366133 - RNA, 22 nt, Human
augcuaagagaaguagaaauca

SEQ ID NO: 1366134 - RNA, 17 nt, Human
augcuaagagaaguaga

SEQ ID NO: 1366135 - RNA, 16 nt, Human
augcuaagagaaguag

SEQ ID NO: 1366136 - RNA, 15 nt, Human
augcuaagagaagua

SEQ ID NO: 1366137 - RNA, 13 nt, Human
uuuauauguugua

SEQ ID NO: 1366138 - RNA, 22 nt, Human
uuuauauugauaagaucuuuua

SEQ ID NO: 1366139 - RNA, 16 nt, Human
uuuauauuacacuaca

SEQ ID NO: 1366140 - RNA, 14 nt, Human
uuuauauuuaaaug

SEQ ID NO: 1366141 - RNA, 16 nt, Human
uuuauauuguaaauau

SEQ ID NO: 1366142 - RNA, 14 nt, Human
uuuauauuguaaau

SEQ ID NO: 1366143 - RNA, 19 nt, Human
uuuauauuguaaauauugu

SEQ ID NO: 1366144 - RNA, 22 nt, Human
uuuaucaaacccuagccuugcu

SEQ ID NO: 1366145 - RNA, 21 nt, Human
uuuaucaaacccuagccuugc

SEQ ID NO: 1366146 - RNA, 23 nt, Human
uuuaucaugcauguccuguaaag

SEQ ID NO: 1366147 - RNA, 22 nt, Human
uuuaucaugcauguccuguaaa

SEQ ID NO: 1366148 - RNA, 16 nt, Human
uuuaucaugcaugucc

SEQ ID NO: 1366149 - RNA, 17 nt, Human
uuuaucaugugaaauca

SEQ ID NO: 1366150 - RNA, 12 nt, Human
uuuaucauuuuc

SEQ ID NO: 1366151 - RNA, 17 nt, Human
uuuaucauucaagugua

SEQ ID NO: 1366152 - RNA, 15 nt, Human
uuuaucauucaagug

SEQ ID NO: 1366153 - RNA, 14 nt, Human
uuuaucauucaagu

SEQ ID NO: 1366154 - RNA, 18 nt, Human
uuuaucaugugaaaucau

SEQ ID NO: 1366155 - RNA, 21 nt, Human
uuguuccaaauacuaaugaaa

SEQ ID NO: 1366156 - RNA, 15 nt, Human
uuguucauagcccag

SEQ ID NO: 1366157 - RNA, 13 nt, Human
uuguguuacuaag

SEQ ID NO: 1366158 - RNA, 15 nt, Human
uuguguuacuaaguu

SEQ ID NO: 1366159 - RNA, 20 nt, Human
uuguguuacuaaguuuuuau

SEQ ID NO: 1366160 - RNA, 16 nt, Human
uuguugaaaaaguuug

SEQ ID NO: 1366161 - RNA, 22 nt, Human
uuguugaaaaaguuuguuuuug

SEQ ID NO: 1366162 - RNA, 15 nt, Human
uuguucuuguauuua

SEQ ID NO: 1366163 - RNA, 14 nt, Human
uuguucuuguauuu

SEQ ID NO: 1366164 - RNA, 16 nt, Human
uuguuccccacuggag

SEQ ID NO: 1366165 - RNA, 12 nt, Human
augauaaugaac

SEQ ID NO: 1366166 - RNA, 15 nt, Human
augauaaugaacaga

SEQ ID NO: 1366167 - RNA, 19 nt, Human
augauaauagauucucuug

SEQ ID NO: 1366168 - RNA, 15 nt, Human
augauaauagauucu

SEQ ID NO: 1366169 - RNA, 18 nt, Human
uuguugagcuauugcugu

SEQ ID NO: 1366170 - RNA, 20 nt, Human
uuguugacauucugaaugcu

SEQ ID NO: 1366171 - RNA, 17 nt, Human
uuguugacauucugaau

SEQ ID NO: 1366172 - RNA, 16 nt, Human
uuguugacauucugaa

SEQ ID NO: 1366173 - RNA, 15 nt, Human
uuguugacauucuga

SEQ ID NO: 1366174 - RNA, 12 nt, Human
uuguugacauuc

SEQ ID NO: 1366175 - RNA, 12 nt, Human
uuguugacauua

SEQ ID NO: 1366176 - RNA, 15 nt, Human
augauaacuggaaac

SEQ ID NO: 1366177 - RNA, 13 nt, Human
augaucccugugu

SEQ ID NO: 1366178 - RNA, 14 nt, Human
augauuacuggccu

SEQ ID NO: 1366179 - RNA, 18 nt, Human
augauuaaguaaugauaa

SEQ ID NO: 1366180 - RNA, 14 nt, Human
augauuaaguaaug

SEQ ID NO: 1366181 - RNA, 19 nt, Human
augauacuaauaaacuaau

SEQ ID NO: 1366182 - RNA, 15 nt, Human
augauacauccaaag

SEQ ID NO: 1366183 - RNA, 17 nt, Human
augauacagcagagcua

SEQ ID NO: 1366184 - RNA, 17 nt, Human
augauacuugaaaauua

SEQ ID NO: 1366185 - RNA, 18 nt, Human
augauacuucgacacugu

SEQ ID NO: 1366186 - RNA, 16 nt, Human
augauacuucgacacu

SEQ ID NO: 1366187 - RNA, 21 nt, Human
augauacuugaaaauuaacau

SEQ ID NO: 1366188 - RNA, 21 nt, Human
augauccaacuaaugccuuac

SEQ ID NO: 1366189 - RNA, 23 nt, Human
augauaugcuuguaacuaaaaua

SEQ ID NO: 1366190 - RNA, 17 nt, Human
augauaugcuuguaacu

SEQ ID NO: 1366191 - RNA, 23 nt, Human
augauacuucgacacuguucuua

SEQ ID NO: 1366192 - RNA, 17 nt, Human
uuuaaaguuguuugugc

SEQ ID NO: 1366193 - RNA, 22 nt, Human
uuuaaaguuaguaucuuuugau

SEQ ID NO: 1366194 - RNA, 22 nt, Human
uuuaaagugacuaauggcauga

SEQ ID NO: 1366195 - RNA, 18 nt, Human
uuuaaagucucaguuucu

SEQ ID NO: 1366196 - RNA, 23 nt, Human
uuuaaagagucuagauucaaagg

SEQ ID NO: 1366197 - RNA, 21 nt, Human
uuuaaagagucuagauucaaa

SEQ ID NO: 1366198 - RNA, 18 nt, Human
uuuaaagagucuagauuc

SEQ ID NO: 1366199 - RNA, 17 nt, Human
uuuaaagagucuagauu

SEQ ID NO: 1366200 - RNA, 16 nt, Human
uuuaaagagucuagau

SEQ ID NO: 1366201 - RNA, 15 nt, Human
uuuaaagagucuaga

SEQ ID NO: 1366202 - RNA, 13 nt, Human
uuuaaagagucua

SEQ ID NO: 1366203 - RNA, 18 nt, Human
uuuaaagacaauguuaaa

SEQ ID NO: 1366204 - RNA, 12 nt, Human
uuuaaagaauug

SEQ ID NO: 1366205 - RNA, 13 nt, Human
uuuaaagaauugu

SEQ ID NO: 1366206 - RNA, 13 nt, Human
uuuaaagaaagug

SEQ ID NO: 1366207 - RNA, 16 nt, Human
uuuaaagaaaguguau

SEQ ID NO: 1366208 - RNA, 14 nt, Human
uuuaaagaaagugu

SEQ ID NO: 1366209 - RNA, 17 nt, Human
uuuaaaaauagacacuc

SEQ ID NO: 1366210 - RNA, 14 nt, Human
uuguuuuggaugcc

SEQ ID NO: 1366211 - RNA, 22 nt, Human
uuguuuuggcugaaauucuccu

SEQ ID NO: 1366212 - RNA, 20 nt, Human
uuguuuugcacacuuugcca

SEQ ID NO: 1366213 - RNA, 23 nt, Human
augcaccuaaagaaaaacaaacu

SEQ ID NO: 1366214 - RNA, 18 nt, Human
augcaccuaaagaaaaac

SEQ ID NO: 1366215 - RNA, 16 nt, Human
augcaccuaaagaaaa

SEQ ID NO: 1366216 - RNA, 15 nt, Human
augcaccuaaagaaa

SEQ ID NO: 1366217 - RNA, 14 nt, Human
augcaccuaaagaa

SEQ ID NO: 1366218 - RNA, 20 nt, Human
augcacccucauacacagaa

SEQ ID NO: 1366219 - RNA, 13 nt, Human
augcaccuggaau

SEQ ID NO: 1366220 - RNA, 15 nt, Human
augcaaccauuugaa

SEQ ID NO: 1366221 - RNA, 13 nt, Human
augcaagaaggag

SEQ ID NO: 1366222 - RNA, 14 nt, Human
augcaagaaggagg

SEQ ID NO: 1366223 - RNA, 23 nt, Human
augauucuauuuauauguacaug

SEQ ID NO: 1366224 - RNA, 22 nt, Human
augauucuauuuauauguacau

SEQ ID NO: 1366225 - RNA, 22 nt, Human
augauuagaaauuaccugugga

SEQ ID NO: 1366226 - RNA, 22 nt, Human
augauuacuggccuuuuucauu

SEQ ID NO: 1366227 - RNA, 19 nt, Human
augauuacuggccuuuuuc

SEQ ID NO: 1366228 - RNA, 15 nt, Human
augauuacuggccuu

SEQ ID NO: 1366229 - RNA, 22 nt, Human
augauuccuugauggagauauu

SEQ ID NO: 1366230 - RNA, 19 nt, Human
augauugaauuauauguuc

SEQ ID NO: 1366231 - RNA, 14 nt, Human
augccucccugagc

SEQ ID NO: 1366232 - RNA, 19 nt, Human
augcgguuaauuuugaagu

SEQ ID NO: 1366233 - RNA, 21 nt, Human
augcgguagccagcacacagg

SEQ ID NO: 1366234 - RNA, 20 nt, Human
augcgguagccagcacacag

SEQ ID NO: 1366235 - RNA, 18 nt, Human
augcgguagccagcacac

SEQ ID NO: 1366236 - RNA, 15 nt, Human
augcgguagccagca

SEQ ID NO: 1366237 - RNA, 14 nt, Human
augcgguagccagc

SEQ ID NO: 1366238 - RNA, 21 nt, Human
augcguauuauaccaaaaugu

SEQ ID NO: 1366239 - RNA, 21 nt, Human
augcgguuauaaaaaaugguu

SEQ ID NO: 1366240 - RNA, 20 nt, Human
augcgugcauaccacuuuug

SEQ ID NO: 1366241 - RNA, 16 nt, Human
augcccuucuccuuau

SEQ ID NO: 1366242 - RNA, 12 nt, Human
augcccuucacu

SEQ ID NO: 1366243 - RNA, 19 nt, Human
augccgauauacucuagau

SEQ ID NO: 1366244 - RNA, 23 nt, Human
augcccugugcaaccucuuggcc

SEQ ID NO: 1366245 - RNA, 13 nt, Human
augcccugugcaa

SEQ ID NO: 1366246 - RNA, 12 nt, Human
augcccugugca

SEQ ID NO: 1366247 - RNA, 23 nt, Human
augcccugcucugaacacgaagc

SEQ ID NO: 1366248 - RNA, 16 nt, Human
augccauuuguacuga

SEQ ID NO: 1366249 - RNA, 12 nt, Human
augccacauuca

SEQ ID NO: 1366250 - RNA, 14 nt, Human
augccaugaugccu

SEQ ID NO: 1366251 - RNA, 15 nt, Human
augccacauucaaaa

SEQ ID NO: 1366252 - RNA, 19 nt, Human
augccacagcccugucagc

SEQ ID NO: 1366253 - RNA, 18 nt, Human
augccacagcccugucag

SEQ ID NO: 1366254 - RNA, 17 nt, Human
augccacagcccuguca

SEQ ID NO: 1366255 - RNA, 15 nt, Human
augccacagcccugu

SEQ ID NO: 1366256 - RNA, 14 nt, Human
augccacagcccug

SEQ ID NO: 1366257 - RNA, 13 nt, Human
augccacagcccu

SEQ ID NO: 1366258 - RNA, 19 nt, Human
augccacaaggacuuccug

SEQ ID NO: 1366259 - RNA, 16 nt, Human
augccacaaggacuuc

SEQ ID NO: 1366260 - RNA, 22 nt, Human
augccaauuagcaauugacugu

SEQ ID NO: 1366261 - RNA, 17 nt, Human
augccaauauuaaaucu

SEQ ID NO: 1366262 - RNA, 19 nt, Human
augccaaaaaaaaauacau

SEQ ID NO: 1366263 - RNA, 18 nt, Human
augccaaaaaaaaauaca

SEQ ID NO: 1366264 - RNA, 17 nt, Human
augccaaaaaaaaauac

SEQ ID NO: 1366265 - RNA, 23 nt, Human
augcauuuuguuugguauuguau

SEQ ID NO: 1366266 - RNA, 22 nt, Human
augcauuuggguccaggaggaa

SEQ ID NO: 1366267 - RNA, 20 nt, Human
augcauuuggguccaggagg

SEQ ID NO: 1366268 - RNA, 19 nt, Human
augcauuuggguccaggag

SEQ ID NO: 1366269 - RNA, 18 nt, Human
augcauuuggguccagga

SEQ ID NO: 1366270 - RNA, 17 nt, Human
augcauuuggguccagg

SEQ ID NO: 1366271 - RNA, 15 nt, Human
augcauuugggucca

SEQ ID NO: 1366272 - RNA, 19 nt, Human
augcauuuuguuugguauu

SEQ ID NO: 1366273 - RNA, 22 nt, Human
augcauuuuguuugguauugua

SEQ ID NO: 1366274 - RNA, 13 nt, Human
augcaguucugaa

SEQ ID NO: 1366275 - RNA, 20 nt, Human
uuuacaaauguuaaaaugug

SEQ ID NO: 1366276 - RNA, 21 nt, Human
uuuacaaauguuaaaaugugu

SEQ ID NO: 1366277 - RNA, 15 nt, Human
uuuacaaacugaaga

SEQ ID NO: 1366278 - RNA, 16 nt, Human
uuuacaaacugaagag

SEQ ID NO: 1366279 - RNA, 14 nt, Human
uuuacaaacugaag

SEQ ID NO: 1366280 - RNA, 13 nt, Human
uuuacaaacugaa

SEQ ID NO: 1366281 - RNA, 19 nt, Human
uuuacaaaacuacaugaga

SEQ ID NO: 1366282 - RNA, 18 nt, Human
uuuacaaaacaaacucau

SEQ ID NO: 1366283 - RNA, 16 nt, Human
uuuacaaaaauauaaa

SEQ ID NO: 1366284 - RNA, 15 nt, Human
uuuacaaaaauauaa

SEQ ID NO: 1366285 - RNA, 16 nt, Human
uuuaauuugaaauaug

SEQ ID NO: 1366286 - RNA, 18 nt, Human
uuuaauuuaguaaaccaa

SEQ ID NO: 1366287 - RNA, 22 nt, Human
uuuaauuuaguaaaccaauccu

SEQ ID NO: 1366288 - RNA, 16 nt, Human
augcagcuuauacgaa

SEQ ID NO: 1366289 - RNA, 21 nt, Human
augcagcuuauacgaaauaau

SEQ ID NO: 1366290 - RNA, 15 nt, Human
augcagcuuauacga

SEQ ID NO: 1366291 - RNA, 15 nt, Human
augcagcuguggcag

SEQ ID NO: 1366292 - RNA, 13 nt, Human
augcagcucaaga

SEQ ID NO: 1366293 - RNA, 21 nt, Human
uuuaauguuuaaaacaucauu

SEQ ID NO: 1366294 - RNA, 17 nt, Human
uuuaauguuuaaaacau

SEQ ID NO: 1366295 - RNA, 16 nt, Human
uuuaauguuuaaaaca

SEQ ID NO: 1366296 - RNA, 20 nt, Human
uuuaauguauaguaaaucac

SEQ ID NO: 1366297 - RNA, 20 nt, Human
uuuaauuaauugggccagcu

SEQ ID NO: 1366298 - RNA, 14 nt, Human
uuuaauuagugcua

SEQ ID NO: 1366299 - RNA, 22 nt, Human
uuuaauuaauugggccagcuuu

SEQ ID NO: 1366300 - RNA, 14 nt, Human
uuuaauuaauuggg

SEQ ID NO: 1366301 - RNA, 15 nt, Human
uuuaauuagugcuaa

SEQ ID NO: 1366302 - RNA, 17 nt, Human
uuuaauuagugcuaagu

SEQ ID NO: 1366303 - RNA, 19 nt, Human
uuuaauuagugcuaagugu

SEQ ID NO: 1366304 - RNA, 20 nt, Human
uuuaauuagugcuaagugug

SEQ ID NO: 1366305 - RNA, 23 nt, Human
uuuaauuauuauucuucauaaca

SEQ ID NO: 1366306 - RNA, 14 nt, Human
uuuaauuauuauuc

SEQ ID NO: 1366307 - RNA, 21 nt, Human
uuuaauuagugcuaaguguga

SEQ ID NO: 1366308 - RNA, 22 nt, Human
uuuaauuagugcuaagugugaa

SEQ ID NO: 1366309 - RNA, 23 nt, Human
uuuaauuauuauuuauauaugua

SEQ ID NO: 1366310 - RNA, 17 nt, Human
uuuaagugaaaaugguc

SEQ ID NO: 1366311 - RNA, 15 nt, Human
uuuaagugaaaaugg

SEQ ID NO: 1366312 - RNA, 15 nt, Human
uuuaagucucucgua

SEQ ID NO: 1366313 - RNA, 18 nt, Human
uuuaaguauuuagguuuu

SEQ ID NO: 1366314 - RNA, 13 nt, Human
uuuaaguauuuag

SEQ ID NO: 1366315 - RNA, 18 nt, Human
uuuaaauauaugcuaagu

SEQ ID NO: 1366316 - RNA, 20 nt, Human
uuuaaauacagucuuccauu

SEQ ID NO: 1366317 - RNA, 17 nt, Human
uuugauguuccuuccag

SEQ ID NO: 1366318 - RNA, 15 nt, Human
uuugauguuccuucc

SEQ ID NO: 1366319 - RNA, 12 nt, Human
uuugauguaaua

SEQ ID NO: 1366320 - RNA, 13 nt, Human
uuugauuaaauuc

SEQ ID NO: 1366321 - RNA, 18 nt, Human
uuugauuaaauucuugca

SEQ ID NO: 1366322 - RNA, 21 nt, Human
uuugauuaaauucuugcaaag

SEQ ID NO: 1366323 - RNA, 23 nt, Human
uuugauuaaauucuugcaaagua

SEQ ID NO: 1366324 - RNA, 20 nt, Human
uuugauguaaagauguucug

SEQ ID NO: 1366325 - RNA, 12 nt, Human
uuugacucuuuu

SEQ ID NO: 1366326 - RNA, 19 nt, Human
uuugacuagaugauggaug

SEQ ID NO: 1366327 - RNA, 19 nt, Human
uuugaccuuuuauguagua

SEQ ID NO: 1366328 - RNA, 19 nt, Human
uuugacgggaaacaaaacu

SEQ ID NO: 1366329 - RNA, 16 nt, Human
uuuggcaauuuugugg

SEQ ID NO: 1366330 - RNA, 17 nt, Human
uuuggcaaugccaucau

SEQ ID NO: 1366331 - RNA, 15 nt, Human
uuugcuggaauaagu

SEQ ID NO: 1366332 - RNA, 22 nt, Human
uuugcugcugcccauguuucaa

SEQ ID NO: 1366333 - RNA, 20 nt, Human
uuugcugcuaauauuuuccu

SEQ ID NO: 1366334 - RNA, 19 nt, Human
uuugcugagcauguacuga

SEQ ID NO: 1366335 - RNA, 12 nt, Human
uuugcugagacu

SEQ ID NO: 1366336 - RNA, 20 nt, Human
uuugcucuucaagaaaucug

SEQ ID NO: 1366337 - RNA, 18 nt, Human
uuugcucuucaagaaauc

SEQ ID NO: 1366338 - RNA, 14 nt, Human
uuugccuguaacaa

SEQ ID NO: 1366339 - RNA, 13 nt, Human
uuugccuguaaca

SEQ ID NO: 1366340 - RNA, 21 nt, Human
uuugccuguaacaagccagau

SEQ ID NO: 1366341 - RNA, 12 nt, Human
uuugccuguaac

SEQ ID NO: 1366342 - RNA, 17 nt, Human
uuugccucuuccagucu

SEQ ID NO: 1366343 - RNA, 23 nt, Human
uuugccucaaauaaaaagugcuu

SEQ ID NO: 1366344 - RNA, 14 nt, Human
uuugcaaccucgcu

SEQ ID NO: 1366345 - RNA, 15 nt, Human
uuugcaaccaggaac

SEQ ID NO: 1366346 - RNA, 14 nt, Human
uuugcaaccaggaa

SEQ ID NO: 1366347 - RNA, 14 nt, Human
uuugcaaagugcaa

SEQ ID NO: 1366348 - RNA, 20 nt, Human
uuugauucauaguaacuucu

SEQ ID NO: 1366349 - RNA, 15 nt, Human
uuugauucauaguaa

SEQ ID NO: 1366350 - RNA, 14 nt, Human
uuugccucaaauaa

SEQ ID NO: 1366351 - RNA, 21 nt, Human
uuugcaaggugcauuuuuacu

SEQ ID NO: 1366352 - RNA, 21 nt, Human
uuugcaagggaaaagucucuu

SEQ ID NO: 1366353 - RNA, 20 nt, Human
uuugcaagggaaaagucucu

SEQ ID NO: 1366354 - RNA, 15 nt, Human
uuugccguuauuaaa

SEQ ID NO: 1366355 - RNA, 17 nt, Human
uuugcaacuuaauacuc

SEQ ID NO: 1366356 - RNA, 23 nt, Human
uuugcaaccaggaacagcaaaug

SEQ ID NO: 1366357 - RNA, 14 nt, Human
uuugcaagccagau

SEQ ID NO: 1366358 - RNA, 20 nt, Human
auguaguaacacuaauauau

SEQ ID NO: 1366359 - RNA, 18 nt, Human
auguaguaauugacaugu

SEQ ID NO: 1366360 - RNA, 17 nt, Human
auguaguaauugacaug

SEQ ID NO: 1366361 - RNA, 16 nt, Human
auguaguaauugacau

SEQ ID NO: 1366362 - RNA, 13 nt, Human
auguaguaauuga

SEQ ID NO: 1366363 - RNA, 22 nt, Human
auguaguaacacuaauauauuu

SEQ ID NO: 1366364 - RNA, 17 nt, Human
auguaguaacacuaaua

SEQ ID NO: 1366365 - RNA, 16 nt, Human
auguaguaacacuaau

SEQ ID NO: 1366366 - RNA, 15 nt, Human
auguaguaacacuaa

SEQ ID NO: 1366367 - RNA, 14 nt, Human
auguaguaacacua

SEQ ID NO: 1366368 - RNA, 13 nt, Human
auguaguaacacu

SEQ ID NO: 1366369 - RNA, 12 nt, Human
auguaguaacac

SEQ ID NO: 1366370 - RNA, 13 nt, Human
auguaggagggac

SEQ ID NO: 1366371 - RNA, 13 nt, Human
uuugacaguguuu

SEQ ID NO: 1366372 - RNA, 19 nt, Human
uuugacaguguugaaaaug

SEQ ID NO: 1366373 - RNA, 18 nt, Human
uuugacaguguugaaaau

SEQ ID NO: 1366374 - RNA, 20 nt, Human
uuugacauugcguuugaccu

SEQ ID NO: 1366375 - RNA, 18 nt, Human
uuugaccucugcagcaau

SEQ ID NO: 1366376 - RNA, 12 nt, Human
uuugaccucugc

SEQ ID NO: 1366377 - RNA, 19 nt, Human
auguagcaugcuuguugca

SEQ ID NO: 1366378 - RNA, 14 nt, Human
auguagcaugcuug

SEQ ID NO: 1366379 - RNA, 21 nt, Human
auguagcaaaauacaugacau

SEQ ID NO: 1366380 - RNA, 12 nt, Human
auguaggaggga

SEQ ID NO: 1366381 - RNA, 21 nt, Human
auguagcucuuugucagggag

SEQ ID NO: 1366382 - RNA, 14 nt, Human
auguaggaaguagg

SEQ ID NO: 1366383 - RNA, 22 nt, Human
auguagcucuuugucagggagu

SEQ ID NO: 1366384 - RNA, 12 nt, Human
auguagcucuuu

SEQ ID NO: 1366385 - RNA, 19 nt, Human
auguagccccucuccugga

SEQ ID NO: 1366386 - RNA, 14 nt, Human
auguagaaaauuug

SEQ ID NO: 1366387 - RNA, 19 nt, Human
auguagauaacaagaccuc

SEQ ID NO: 1366388 - RNA, 18 nt, Human
auguacugagccuuguaa

SEQ ID NO: 1366389 - RNA, 19 nt, Human
auguacuguauauuacaga

SEQ ID NO: 1366390 - RNA, 16 nt, Human
auguacuucaugcugu

SEQ ID NO: 1366391 - RNA, 18 nt, Human
auguacggauuuucaguu

SEQ ID NO: 1366392 - RNA, 18 nt, Human
auguacccucugaaauac

SEQ ID NO: 1366393 - RNA, 17 nt, Human
auguacccucugaaaua

SEQ ID NO: 1366394 - RNA, 21 nt, Human
auguacccaccgggccacucc

SEQ ID NO: 1366395 - RNA, 21 nt, Human
auguaccauguacaugaagaa

SEQ ID NO: 1366396 - RNA, 15 nt, Human
auguaccauguacau

SEQ ID NO: 1366397 - RNA, 20 nt, Human
auguacccaccgggccacuc

SEQ ID NO: 1366398 - RNA, 16 nt, Human
auguacccaccgggcc

SEQ ID NO: 1366399 - RNA, 16 nt, Human
auguaccguaggcuuu

SEQ ID NO: 1366400 - RNA, 20 nt, Human
augucuccuaagcaccugua

SEQ ID NO: 1366401 - RNA, 18 nt, Human
augucuccuaagcaccug

SEQ ID NO: 1366402 - RNA, 15 nt, Human
augucuccuaagcac

SEQ ID NO: 1366403 - RNA, 14 nt, Human
augucuccuaagca

SEQ ID NO: 1366404 - RNA, 23 nt, Human
auguccuugugaugugcacguaa

SEQ ID NO: 1366405 - RNA, 16 nt, Human
auguccuucugagccc

SEQ ID NO: 1366406 - RNA, 14 nt, Human
auguccuguaaagg

SEQ ID NO: 1366407 - RNA, 13 nt, Human
auguccuguaaag

SEQ ID NO: 1366408 - RNA, 22 nt, Human
auguccugccuauuaucuguca

SEQ ID NO: 1366409 - RNA, 21 nt, Human
auguccugccuauuaucuguc

SEQ ID NO: 1366410 - RNA, 20 nt, Human
auguccugccuauuaucugu

SEQ ID NO: 1366411 - RNA, 16 nt, Human
auguccugccuauuau

SEQ ID NO: 1366412 - RNA, 12 nt, Human
auguccaggaaa

SEQ ID NO: 1366413 - RNA, 15 nt, Human
augucagugcugaug

SEQ ID NO: 1366414 - RNA, 14 nt, Human
auguauguuaccaa

SEQ ID NO: 1366415 - RNA, 13 nt, Human
auguauguuacca

SEQ ID NO: 1366416 - RNA, 12 nt, Human
auguauguuacc

SEQ ID NO: 1366417 - RNA, 22 nt, Human
auguauuacaguggggaaugaa

SEQ ID NO: 1366418 - RNA, 18 nt, Human
uuuggcaucccugggccu

SEQ ID NO: 1366419 - RNA, 16 nt, Human
uuuggcaucccugggc

SEQ ID NO: 1366420 - RNA, 19 nt, Human
auguaugcauguugucuaa

SEQ ID NO: 1366421 - RNA, 15 nt, Human
auguaugcauguugu

SEQ ID NO: 1366422 - RNA, 19 nt, Human
auguaugaggaauuucugu

SEQ ID NO: 1366423 - RNA, 23 nt, Human
uuuggcaucccugggccuugggc

SEQ ID NO: 1366424 - RNA, 13 nt, Human
uuuggcaggugca

SEQ ID NO: 1366425 - RNA, 13 nt, Human
uuuggcagaguuc

SEQ ID NO: 1366426 - RNA, 22 nt, Human
augugauuguggaauggagauu

SEQ ID NO: 1366427 - RNA, 17 nt, Human
augugauuguggaaugg

SEQ ID NO: 1366428 - RNA, 15 nt, Human
augugauuguggaau

SEQ ID NO: 1366429 - RNA, 14 nt, Human
augugauuguggaa

SEQ ID NO: 1366430 - RNA, 21 nt, Human
augugauguucuaaggcucug

SEQ ID NO: 1366431 - RNA, 20 nt, Human
augugauguucuaaggcucu

SEQ ID NO: 1366432 - RNA, 19 nt, Human
augugauguucuaaggcuc

SEQ ID NO: 1366433 - RNA, 17 nt, Human
augugauguucuaaggc

SEQ ID NO: 1366434 - RNA, 16 nt, Human
augugauguucuaagg

SEQ ID NO: 1366435 - RNA, 15 nt, Human
augugauguucuaag

SEQ ID NO: 1366436 - RNA, 14 nt, Human
augugauguucuaa

SEQ ID NO: 1366437 - RNA, 19 nt, Human
uuuguaauaauaaagaaua

SEQ ID NO: 1366438 - RNA, 18 nt, Human
augugcaauagaagguga

SEQ ID NO: 1366439 - RNA, 13 nt, Human
augugcaauagaa

SEQ ID NO: 1366440 - RNA, 15 nt, Human
augugcaaguuuauc

SEQ ID NO: 1366441 - RNA, 21 nt, Human
augugacucuuuccaaccggc

SEQ ID NO: 1366442 - RNA, 17 nt, Human
augucucuucugagcua

SEQ ID NO: 1366443 - RNA, 16 nt, Human
augucucuucugagcu

SEQ ID NO: 1366444 - RNA, 13 nt, Human
augucucuucuga

SEQ ID NO: 1366445 - RNA, 15 nt, Human
augucucuuccuggu

SEQ ID NO: 1366446 - RNA, 16 nt, Human
augucucuuccuggua

SEQ ID NO: 1366447 - RNA, 16 nt, Human
augugacauuuuacau

SEQ ID NO: 1366448 - RNA, 16 nt, Human
augugacucuuuccaa

SEQ ID NO: 1366449 - RNA, 12 nt, Human
augugacucuuu

SEQ ID NO: 1366450 - RNA, 19 nt, Human
augugaccacucugucuug

SEQ ID NO: 1366451 - RNA, 18 nt, Human
augugacauuuuacauua

SEQ ID NO: 1366452 - RNA, 21 nt, Human
uuuguaguguuggagaagaac

SEQ ID NO: 1366453 - RNA, 19 nt, Human
uuuguaguguuggagaaga

SEQ ID NO: 1366454 - RNA, 15 nt, Human
uuuguaguugaauau

SEQ ID NO: 1366455 - RNA, 14 nt, Human
uuuguaguugaaua

SEQ ID NO: 1366456 - RNA, 12 nt, Human
uuuguauaaaag

SEQ ID NO: 1366457 - RNA, 22 nt, Human
uuuguaauuaaaagcaaaucau

SEQ ID NO: 1366458 - RNA, 23 nt, Human
uuuguaauuaaaagcaaaucauu

SEQ ID NO: 1366459 - RNA, 14 nt, Human
uuuguaauuaaaag

SEQ ID NO: 1366460 - RNA, 23 nt, Human
uuuguaaugucuugagcucuauu

SEQ ID NO: 1366461 - RNA, 21 nt, Human
uuuguaauaauaaagaauagc

SEQ ID NO: 1366462 - RNA, 13 nt, Human
uuuguaaugaaaa

SEQ ID NO: 1366463 - RNA, 14 nt, Human
uuuguaaugaaaac

SEQ ID NO: 1366464 - RNA, 17 nt, Human
uuugugaagcaaaauuu

SEQ ID NO: 1366465 - RNA, 18 nt, Human
uuugugaauagaacucug

SEQ ID NO: 1366466 - RNA, 20 nt, Human
uuugugaagguggaaauaaa

SEQ ID NO: 1366467 - RNA, 22 nt, Human
uuugugaauuaggcuguaacua

SEQ ID NO: 1366468 - RNA, 15 nt, Human
uuugugaauuaggcu

SEQ ID NO: 1366469 - RNA, 21 nt, Human
augguucagaauuaaacuuuu

SEQ ID NO: 1366470 - RNA, 20 nt, Human
augguucagaauuaaacuuu

SEQ ID NO: 1366471 - RNA, 22 nt, Human
augguuaccaugucuuucucuc

SEQ ID NO: 1366472 - RNA, 17 nt, Human
augguuaccaugucuuu

SEQ ID NO: 1366473 - RNA, 23 nt, Human
augguuaagaguccaagaaucca

SEQ ID NO: 1366474 - RNA, 18 nt, Human
augguuaagaguccaaga

SEQ ID NO: 1366475 - RNA, 13 nt, Human
augguuaacuaau

SEQ ID NO: 1366476 - RNA, 22 nt, Human
augguguucuccugcugcuccc

SEQ ID NO: 1366477 - RNA, 22 nt, Human
augguguagaacacuaauucau

SEQ ID NO: 1366478 - RNA, 19 nt, Human
augguguagaacacuaauu

SEQ ID NO: 1366479 - RNA, 18 nt, Human
augguguagaacacuaau

SEQ ID NO: 1366480 - RNA, 16 nt, Human
augguguagaacacua

SEQ ID NO: 1366481 - RNA, 18 nt, Human
auggugucucuucuuuag

SEQ ID NO: 1366482 - RNA, 15 nt, Human
augguguucuccugc

SEQ ID NO: 1366483 - RNA, 13 nt, Human
auggugcugggag

SEQ ID NO: 1366484 - RNA, 16 nt, Human
auggugccuucauuug

SEQ ID NO: 1366485 - RNA, 14 nt, Human
auggugccuucauu

SEQ ID NO: 1366486 - RNA, 14 nt, Human
augguggagggcca

SEQ ID NO: 1366487 - RNA, 13 nt, Human
augguggagggcc

SEQ ID NO: 1366488 - RNA, 20 nt, Human
augguggacucgccuguaau

SEQ ID NO: 1366489 - RNA, 22 nt, Human
auggugccccaggaccagcuca

SEQ ID NO: 1366490 - RNA, 21 nt, Human
auggugccccaggaccagcuc

SEQ ID NO: 1366491 - RNA, 20 nt, Human
auggugccccaggaccagcu

SEQ ID NO: 1366492 - RNA, 19 nt, Human
auggugccccaggaccagc

SEQ ID NO: 1366493 - RNA, 18 nt, Human
auggugccccaggaccag

SEQ ID NO: 1366494 - RNA, 17 nt, Human
auggugccccaggacca

SEQ ID NO: 1366495 - RNA, 16 nt, Human
auggugccccaggacc

SEQ ID NO: 1366496 - RNA, 15 nt, Human
auggugccccaggac

SEQ ID NO: 1366497 - RNA, 14 nt, Human
auggugccccagga

SEQ ID NO: 1366498 - RNA, 19 nt, Human
auggugcauuacgugggca

SEQ ID NO: 1366499 - RNA, 17 nt, Human
augggugcccacagugu

SEQ ID NO: 1366500 - RNA, 15 nt, Human
auguaaaacauuuau

SEQ ID NO: 1366501 - RNA, 14 nt, Human
auguaaaacauuua

SEQ ID NO: 1366502 - RNA, 13 nt, Human
auguaaaacauuu

SEQ ID NO: 1366503 - RNA, 18 nt, Human
augguuuuugagauauua

SEQ ID NO: 1366504 - RNA, 17 nt, Human
augguuuuugagauauu

SEQ ID NO: 1366505 - RNA, 21 nt, Human
augguuuucuccaagagcuac

SEQ ID NO: 1366506 - RNA, 20 nt, Human
augguuuucuccaagagcua

SEQ ID NO: 1366507 - RNA, 14 nt, Human
augguuuucuccaa

SEQ ID NO: 1366508 - RNA, 15 nt, Human
augguuucagcacua

SEQ ID NO: 1366509 - RNA, 19 nt, Human
augguucuggcuguuugag

SEQ ID NO: 1366510 - RNA, 18 nt, Human
augguucuggcuguuuga

SEQ ID NO: 1366511 - RNA, 21 nt, Human
augguucccuugaugaagaag

SEQ ID NO: 1366512 - RNA, 22 nt, Human
augguuucagcacuagccaaac

SEQ ID NO: 1366513 - RNA, 14 nt, Human
augguuucagcacu

SEQ ID NO: 1366514 - RNA, 13 nt, Human
augguuucagcac

SEQ ID NO: 1366515 - RNA, 18 nt, Human
augguuguauuagauguu

SEQ ID NO: 1366516 - RNA, 21 nt, Human
augguuguauuagauguucuc

SEQ ID NO: 1366517 - RNA, 13 nt, Human
augguuguacaua

SEQ ID NO: 1366518 - RNA, 12 nt, Human
augguuguauua

SEQ ID NO: 1366519 - RNA, 13 nt, Human
augguuguauuag

SEQ ID NO: 1366520 - RNA, 14 nt, Human
augguuguauuaga

SEQ ID NO: 1366521 - RNA, 16 nt, Human
augguuguauuagaug

SEQ ID NO: 1366522 - RNA, 16 nt, Human
auguaaagcuugucug

SEQ ID NO: 1366523 - RNA, 14 nt, Human
auguaaagcuuguc

SEQ ID NO: 1366524 - RNA, 14 nt, Human
auguaaagccaugc

SEQ ID NO: 1366525 - RNA, 13 nt, Human
auguaaagccaug

SEQ ID NO: 1366526 - RNA, 17 nt, Human
auguaaagaucaauaaa

SEQ ID NO: 1366527 - RNA, 21 nt, Human
auguaaagauauuuuuaucuu

SEQ ID NO: 1366528 - RNA, 14 nt, Human
auguaaagauauuu

SEQ ID NO: 1366529 - RNA, 19 nt, Human
auguaaagacaaaaaacua

SEQ ID NO: 1366530 - RNA, 13 nt, Human
auguaaagacaaa

SEQ ID NO: 1366531 - RNA, 14 nt, Human
auguaaacugugca

SEQ ID NO: 1366532 - RNA, 23 nt, Human
auguaaaaucuugucauguguau

SEQ ID NO: 1366533 - RNA, 22 nt, Human
auguaaaaucuugucaugugua

SEQ ID NO: 1366534 - RNA, 21 nt, Human
auguaaaaucuugucaugugu

SEQ ID NO: 1366535 - RNA, 20 nt, Human
auguaaaaucuugucaugug

SEQ ID NO: 1366536 - RNA, 16 nt, Human
auguaaaaucuuguca

SEQ ID NO: 1366537 - RNA, 15 nt, Human
auguaaaaucuuguc

SEQ ID NO: 1366538 - RNA, 14 nt, Human
auguaaaaucuugu

SEQ ID NO: 1366539 - RNA, 13 nt, Human
auguaaaaucuug

SEQ ID NO: 1366540 - RNA, 12 nt, Human
auguaaaaucuu

SEQ ID NO: 1366541 - RNA, 21 nt, Human
auguaaaagguauuaaauuga

SEQ ID NO: 1366542 - RNA, 17 nt, Human
auguaaaagaaaaucca

SEQ ID NO: 1366543 - RNA, 21 nt, Human
auguaaaacauuuauuuugac

SEQ ID NO: 1366544 - RNA, 20 nt, Human
auguaaaacauuuauuuuga

SEQ ID NO: 1366545 - RNA, 14 nt, Human
auguacauuaauua

SEQ ID NO: 1366546 - RNA, 13 nt, Human
auguaaauuugua

SEQ ID NO: 1366547 - RNA, 12 nt, Human
auguaaauuugu

SEQ ID NO: 1366548 - RNA, 23 nt, Human
auguaaauuaucaggcaaauuug

SEQ ID NO: 1366549 - RNA, 14 nt, Human
auguaaauuaugua

SEQ ID NO: 1366550 - RNA, 17 nt, Human
auguaaauaauacauua

SEQ ID NO: 1366551 - RNA, 20 nt, Human
auguaaaggagucaaaacua

SEQ ID NO: 1366552 - RNA, 23 nt, Human
auguaaauauuuuaaagaauugu

SEQ ID NO: 1366553 - RNA, 21 nt, Human
auguaaauauuuuaaagaauu

SEQ ID NO: 1366554 - RNA, 20 nt, Human
auguaaauauuuuaaagaau

SEQ ID NO: 1366555 - RNA, 19 nt, Human
auguaaauauuuuaaagaa

SEQ ID NO: 1366556 - RNA, 15 nt, Human
auguaaauauuuuaa

SEQ ID NO: 1366557 - RNA, 13 nt, Human
auguaaauauuuu

SEQ ID NO: 1366558 - RNA, 14 nt, Human
uuucuuugaauaaa

SEQ ID NO: 1366559 - RNA, 15 nt, Human
uuucuuugaauaaau

SEQ ID NO: 1366560 - RNA, 13 nt, Human
uuucuuugaauaa

SEQ ID NO: 1366561 - RNA, 21 nt, Human
uuucuuugaaaaaaaauaaau

SEQ ID NO: 1366562 - RNA, 20 nt, Human
uuucuuugaaaaaaaauaaa

SEQ ID NO: 1366563 - RNA, 13 nt, Human
uuucuuucuuucu

SEQ ID NO: 1366564 - RNA, 14 nt, Human
uuucuguucuaguu

SEQ ID NO: 1366565 - RNA, 13 nt, Human
uuucuuucuuaga

SEQ ID NO: 1366566 - RNA, 15 nt, Human
uuucuuucuuagaaa

SEQ ID NO: 1366567 - RNA, 22 nt, Human
uuucuguuccaaauucaguuuc

SEQ ID NO: 1366568 - RNA, 20 nt, Human
uuucuguuccaaauucaguu

SEQ ID NO: 1366569 - RNA, 16 nt, Human
uuucuguuccaaauuc

SEQ ID NO: 1366570 - RNA, 15 nt, Human
uuucuguuccaaauu

SEQ ID NO: 1366571 - RNA, 14 nt, Human
uuucuguuccaaau

SEQ ID NO: 1366572 - RNA, 12 nt, Human
uuucuguuccaa

SEQ ID NO: 1366573 - RNA, 9 nt, Human
uuucuguuc

SEQ ID NO: 1366574 - RNA, 17 nt, Human
uuucugugccugaauau

SEQ ID NO: 1366575 - RNA, 20 nt, Human
uuucugguggucuguuggca

SEQ ID NO: 1366576 - RNA, 17 nt, Human
uuucugguggucuguug

SEQ ID NO: 1366577 - RNA, 15 nt, Human
uuucugguggucugu

SEQ ID NO: 1366578 - RNA, 16 nt, Human
uuucugggauaaguaa

SEQ ID NO: 1366579 - RNA, 23 nt, Human
uuucugggagacagaaaacaugu

SEQ ID NO: 1366580 - RNA, 23 nt, Human
uuucuguaauucagguuuuuccu

SEQ ID NO: 1366581 - RNA, 19 nt, Human
uuucuguaauucagguuuu

SEQ ID NO: 1366582 - RNA, 22 nt, Human
uuucuguaagaaaccuacugcc

SEQ ID NO: 1366583 - RNA, 22 nt, Human
uuucugguucuuguguuggcug

SEQ ID NO: 1366584 - RNA, 21 nt, Human
uuucugguuguuaugugauca

SEQ ID NO: 1366585 - RNA, 15 nt, Human
uuucugguucuaaca

SEQ ID NO: 1366586 - RNA, 15 nt, Human
uuucuguaccaguua

SEQ ID NO: 1366587 - RNA, 14 nt, Human
uuucuguaccaguu

SEQ ID NO: 1366588 - RNA, 17 nt, Human
uuucuguauauacuuuu

SEQ ID NO: 1366589 - RNA, 17 nt, Human
uuucuguauaaaugucu

SEQ ID NO: 1366590 - RNA, 15 nt, Human
uuucuggcuaugcau

SEQ ID NO: 1366591 - RNA, 16 nt, Human
uuucuggcuaugcauu

SEQ ID NO: 1366592 - RNA, 18 nt, Human
uuucuggcuaugcauuug

SEQ ID NO: 1366593 - RNA, 19 nt, Human
uuucuggcuaugcauuuga

SEQ ID NO: 1366594 - RNA, 21 nt, Human
uuucucccccauguucugucc

SEQ ID NO: 1366595 - RNA, 14 nt, Human
augggauucuggac

SEQ ID NO: 1366596 - RNA, 17 nt, Human
augggauucuggacagg

SEQ ID NO: 1366597 - RNA, 18 nt, Human
augggaugguggagggcc

SEQ ID NO: 1366598 - RNA, 23 nt, Human
augggggaaagcaaagcacagag

SEQ ID NO: 1366599 - RNA, 21 nt, Human
augggggaaagcaaagcacag

SEQ ID NO: 1366600 - RNA, 22 nt, Human
auggggccagauccagccuggg

SEQ ID NO: 1366601 - RNA, 21 nt, Human
auggggccagauccagccugg

SEQ ID NO: 1366602 - RNA, 19 nt, Human
auggggccagauccagccu

SEQ ID NO: 1366603 - RNA, 15 nt, Human
auggggccagaucca

SEQ ID NO: 1366604 - RNA, 14 nt, Human
auggggccagaucc

SEQ ID NO: 1366605 - RNA, 13 nt, Human
auggggccagauc

SEQ ID NO: 1366606 - RNA, 18 nt, Human
augggggagggggcagaa

SEQ ID NO: 1366607 - RNA, 21 nt, Human
augggggaacucagauccagg

SEQ ID NO: 1366608 - RNA, 19 nt, Human
augggggaacucagaucca

SEQ ID NO: 1366609 - RNA, 18 nt, Human
augggggaacucagaucc

SEQ ID NO: 1366610 - RNA, 14 nt, Human
augggggugcauuu

SEQ ID NO: 1366611 - RNA, 13 nt, Human
augggucacagga

SEQ ID NO: 1366612 - RNA, 14 nt, Human
augggucacaggaa

SEQ ID NO: 1366613 - RNA, 12 nt, Human
augggucacagg

SEQ ID NO: 1366614 - RNA, 17 nt, Human
auggguaggguaaauca

SEQ ID NO: 1366615 - RNA, 16 nt, Human
auggguaggguaaauc

SEQ ID NO: 1366616 - RNA, 12 nt, Human
auggguagggua

SEQ ID NO: 1366617 - RNA, 15 nt, Human
augggguggaaggca

SEQ ID NO: 1366618 - RNA, 17 nt, Human
auggggucuguaaaauc

SEQ ID NO: 1366619 - RNA, 18 nt, Human
auggggucuguaaaaucu

SEQ ID NO: 1366620 - RNA, 16 nt, Human
auggggucuguaaaau

SEQ ID NO: 1366621 - RNA, 14 nt, Human
auggggguaaaguu

SEQ ID NO: 1366622 - RNA, 14 nt, Human
auggggguuucacc

SEQ ID NO: 1366623 - RNA, 15 nt, Human
augggggugcauuug

SEQ ID NO: 1366624 - RNA, 19 nt, Human
uuugaaaacauguuuauuu

SEQ ID NO: 1366625 - RNA, 17 nt, Human
uuugaaaacauguuuau

SEQ ID NO: 1366626 - RNA, 20 nt, Human
uuugaaaaagcgaaaaaauc

SEQ ID NO: 1366627 - RNA, 23 nt, Human
uuugaaaaagcgaaaaaaucagg

SEQ ID NO: 1366628 - RNA, 15 nt, Human
uuugaaaaagcgaaa

SEQ ID NO: 1366629 - RNA, 16 nt, Human
uuugaaaaaaaauaaa

SEQ ID NO: 1366630 - RNA, 15 nt, Human
uuucuuuuuugauau

SEQ ID NO: 1366631 - RNA, 17 nt, Human
uuucuuugggaauauuu

SEQ ID NO: 1366632 - RNA, 19 nt, Human
uuucuuugggaauauuuga

SEQ ID NO: 1366633 - RNA, 21 nt, Human
uuucuuugggaauauuugaau

SEQ ID NO: 1366634 - RNA, 23 nt, Human
uuucuuugggaauauuugaaucu

SEQ ID NO: 1366635 - RNA, 21 nt, Human
auggggcauccucuuuuucca

SEQ ID NO: 1366636 - RNA, 23 nt, Human
auggggcaggccaccuggcucuc

SEQ ID NO: 1366637 - RNA, 17 nt, Human
auggggcaggccaccug

SEQ ID NO: 1366638 - RNA, 15 nt, Human
auggggcaggccacc

SEQ ID NO: 1366639 - RNA, 21 nt, Human
uuugaaauuauguaaauuaug

SEQ ID NO: 1366640 - RNA, 22 nt, Human
uuugaaauuaugugacauuuua

SEQ ID NO: 1366641 - RNA, 17 nt, Human
uuugaaauuauguaaau

SEQ ID NO: 1366642 - RNA, 16 nt, Human
uuugaaauuauguaaa

SEQ ID NO: 1366643 - RNA, 18 nt, Human
uuugaaauuaaccucuca

SEQ ID NO: 1366644 - RNA, 15 nt, Human
uuugaaauuauguga

SEQ ID NO: 1366645 - RNA, 17 nt, Human
uuugaaauuaugugaca

SEQ ID NO: 1366646 - RNA, 14 nt, Human
auugucucagagca

SEQ ID NO: 1366647 - RNA, 12 nt, Human
auugucucagag

SEQ ID NO: 1366648 - RNA, 17 nt, Human
auuguccuuuugcaaag

SEQ ID NO: 1366649 - RNA, 18 nt, Human
auuguccuuuugcaaaga

SEQ ID NO: 1366650 - RNA, 16 nt, Human
auuguccuuuugcaaa

SEQ ID NO: 1366651 - RNA, 15 nt, Human
auuguccuuuugcaa

SEQ ID NO: 1366652 - RNA, 13 nt, Human
auugucuagugaa

SEQ ID NO: 1366653 - RNA, 19 nt, Human
auuuaaagaacacccuaua

SEQ ID NO: 1366654 - RNA, 20 nt, Human
auuuaaacuauaagcaagaa

SEQ ID NO: 1366655 - RNA, 19 nt, Human
auuuaaacuauaagcaaga

SEQ ID NO: 1366656 - RNA, 12 nt, Human
auuuaaacuaua

SEQ ID NO: 1366657 - RNA, 24 nt, Human
auuuaaaccgcuaaaagaaacuuu

SEQ ID NO: 1366658 - RNA, 23 nt, Human
auuuaaaccgcuaaaagaaacuu

SEQ ID NO: 1366659 - RNA, 22 nt, Human
auuuaaaccgcuaaaagaaacu

SEQ ID NO: 1366660 - RNA, 21 nt, Human
auuuaaaccgcuaaaagaaac

SEQ ID NO: 1366661 - RNA, 20 nt, Human
auuuaaaccgcuaaaagaaa

SEQ ID NO: 1366662 - RNA, 19 nt, Human
auuuaaaccgcuaaaagaa

SEQ ID NO: 1366663 - RNA, 18 nt, Human
auuuaaaccgcuaaaaga

SEQ ID NO: 1366664 - RNA, 15 nt, Human
auuguuuuacaauag

SEQ ID NO: 1366665 - RNA, 17 nt, Human
auuguuuuacaauaguu

SEQ ID NO: 1366666 - RNA, 18 nt, Human
auuguuuuacaauaguuc

SEQ ID NO: 1366667 - RNA, 17 nt, Human
auuuaaaagauacaguu

SEQ ID NO: 1366668 - RNA, 14 nt, Human
auuuaaaagauaca

SEQ ID NO: 1366669 - RNA, 16 nt, Human
auuuaaaagauacagu

SEQ ID NO: 1366670 - RNA, 16 nt, Human
auuguggguguuaauu

SEQ ID NO: 1366671 - RNA, 13 nt, Human
auuguuuuacaau

SEQ ID NO: 1366672 - RNA, 14 nt, Human
auuguuuuacaaua

SEQ ID NO: 1366673 - RNA, 21 nt, Human
auugcuuuguauuguauauua

SEQ ID NO: 1366674 - RNA, 21 nt, Human
auugauuuccguuaaaauacc

SEQ ID NO: 1366675 - RNA, 16 nt, Human
auugauuguauuguug

SEQ ID NO: 1366676 - RNA, 13 nt, Human
auugauuguauug

SEQ ID NO: 1366677 - RNA, 18 nt, Human
auugacuuuuuauggcac

SEQ ID NO: 1366678 - RNA, 13 nt, Human
auugacuuuuuau

SEQ ID NO: 1366679 - RNA, 11 nt, Human
auuggauauuu

SEQ ID NO: 1366680 - RNA, 22 nt, Human
auuggauauuuuuuacuuuaga

SEQ ID NO: 1366681 - RNA, 14 nt, Human
auuggacccuucca

SEQ ID NO: 1366682 - RNA, 17 nt, Human
auuggacaaagaaccuu

SEQ ID NO: 1366683 - RNA, 18 nt, Human
auuggaauguucucagau

SEQ ID NO: 1366684 - RNA, 13 nt, Human
auuggaaacaagu

SEQ ID NO: 1366685 - RNA, 19 nt, Human
auuggacaguaaaauccac

SEQ ID NO: 1366686 - RNA, 18 nt, Human
auugguuuaaagaaagug

SEQ ID NO: 1366687 - RNA, 17 nt, Human
auugguuuaaagaaagu

SEQ ID NO: 1366688 - RNA, 15 nt, Human
auugguuuaaagaaa

SEQ ID NO: 1366689 - RNA, 19 nt, Human
auugguguuuuuuucuaug

SEQ ID NO: 1366690 - RNA, 22 nt, Human
auuggguuuuuggacuucuggg

SEQ ID NO: 1366691 - RNA, 19 nt, Human
auuggguuuuuggacuucu

SEQ ID NO: 1366692 - RNA, 21 nt, Human
auugggagcuugggaauggau

SEQ ID NO: 1366693 - RNA, 18 nt, Human
auugggagcuugggaaug

SEQ ID NO: 1366694 - RNA, 23 nt, Human
auuggauuuccuaauacugucau

SEQ ID NO: 1366695 - RNA, 22 nt, Human
auuggauuuccuaauacuguca

SEQ ID NO: 1366696 - RNA, 15 nt, Human
auuggauuuccuaau

SEQ ID NO: 1366697 - RNA, 14 nt, Human
auuggauuuccuaa

SEQ ID NO: 1366698 - RNA, 20 nt, Human
auuggcaccuaauccaggca

SEQ ID NO: 1366699 - RNA, 18 nt, Human
auuggcaccgaagcccag

SEQ ID NO: 1366700 - RNA, 19 nt, Human
auuggcaccgaagcccaga

SEQ ID NO: 1366701 - RNA, 19 nt, Human
auuucccaggacccugaag

SEQ ID NO: 1366702 - RNA, 16 nt, Human
auuucccaggacccug

SEQ ID NO: 1366703 - RNA, 14 nt, Human
auuucccaggaccc

SEQ ID NO: 1366704 - RNA, 13 nt, Human
auuucccaggacc

SEQ ID NO: 1366705 - RNA, 12 nt, Human
auuucccaggac

SEQ ID NO: 1366706 - RNA, 19 nt, Human
auuucccaacacaaagauu

SEQ ID NO: 1366707 - RNA, 18 nt, Human
auuucccaacacaaagau

SEQ ID NO: 1366708 - RNA, 20 nt, Human
auuuccaacucgaaucugug

SEQ ID NO: 1366709 - RNA, 19 nt, Human
auuuccaacucgaaucugu

SEQ ID NO: 1366710 - RNA, 16 nt, Human
auuuauuuaaaauagc

SEQ ID NO: 1366711 - RNA, 14 nt, Human
auuuauuuaaaaua

SEQ ID NO: 1366712 - RNA, 21 nt, Human
auuuauuugaaugauuuuucu

SEQ ID NO: 1366713 - RNA, 13 nt, Human
auuuauuugaaug

SEQ ID NO: 1366714 - RNA, 15 nt, Human
auuuauuuccucccu

SEQ ID NO: 1366715 - RNA, 17 nt, Human
auuuauuuccucccucu

SEQ ID NO: 1366716 - RNA, 12 nt, Human
auuuauuuccuc

SEQ ID NO: 1366717 - RNA, 13 nt, Human
auuuauuuccuag

SEQ ID NO: 1366718 - RNA, 18 nt, Human
auuuauuuccuaguucug

SEQ ID NO: 1366719 - RNA, 23 nt, Human
auuuauuuccuaguucuguagaa

SEQ ID NO: 1366720 - RNA, 16 nt, Human
auuuauuugaaugauu

SEQ ID NO: 1366721 - RNA, 23 nt, Human
auuucauuuuucaauagcacaua

SEQ ID NO: 1366722 - RNA, 17 nt, Human
auuuauuuuaauaaugu

SEQ ID NO: 1366723 - RNA, 14 nt, Human
auuuauuuuaauaa

SEQ ID NO: 1366724 - RNA, 14 nt, Human
auuucuucuuacca

SEQ ID NO: 1366725 - RNA, 23 nt, Human
auuucuuccuaccaagucaaacu

SEQ ID NO: 1366726 - RNA, 16 nt, Human
auuugaaaauuuugau

SEQ ID NO: 1366727 - RNA, 20 nt, Human
auuucuuccuaccaagucaa

SEQ ID NO: 1366728 - RNA, 19 nt, Human
auuucuuccuaccaaguca

SEQ ID NO: 1366729 - RNA, 17 nt, Human
auuucuauagccaaaaa

SEQ ID NO: 1366730 - RNA, 20 nt, Human
auuucuugagguaaaagcau

SEQ ID NO: 1366731 - RNA, 18 nt, Human
auuugaaacacuuugcau

SEQ ID NO: 1366732 - RNA, 19 nt, Human
auuucuagguaggaaaugu

SEQ ID NO: 1366733 - RNA, 20 nt, Human
auuucuagguaggaaaugug

SEQ ID NO: 1366734 - RNA, 11 nt, Human
auuucuaggua

SEQ ID NO: 1366735 - RNA, 23 nt, Human
auuucuaggacugaauuaugaaa

SEQ ID NO: 1366736 - RNA, 20 nt, Human
auuucuaggacugaauuaug

SEQ ID NO: 1366737 - RNA, 16 nt, Human
auuucccuuccuuccu

SEQ ID NO: 1366738 - RNA, 20 nt, Human
auuucccuuccuuccucucc

SEQ ID NO: 1366739 - RNA, 14 nt, Human
auuucccucucuca

SEQ ID NO: 1366740 - RNA, 18 nt, Human
auuucuaggacugaauua

SEQ ID NO: 1366741 - RNA, 17 nt, Human
auuucuaggacugaauu

SEQ ID NO: 1366742 - RNA, 23 nt, Human
auuugugaagguggaaauaaacu

SEQ ID NO: 1366743 - RNA, 16 nt, Human
auuuuaaaagaaugau

SEQ ID NO: 1366744 - RNA, 18 nt, Human
auuugugaagguggaaau

SEQ ID NO: 1366745 - RNA, 21 nt, Human
auuugugaagguggaaauaaa

SEQ ID NO: 1366746 - RNA, 22 nt, Human
auuuuaaccuaugauauuuucu

SEQ ID NO: 1366747 - RNA, 13 nt, Human
auuuuaaaaucag

SEQ ID NO: 1366748 - RNA, 23 nt, Human
auuuuaaaauagcguucuuguaa

SEQ ID NO: 1366749 - RNA, 22 nt, Human
auuuuaaaauagcguucuugua

SEQ ID NO: 1366750 - RNA, 20 nt, Human
auuuuaaaauagcguucuug

SEQ ID NO: 1366751 - RNA, 18 nt, Human
auuuuaaaauagcguucu

SEQ ID NO: 1366752 - RNA, 23 nt, Human
auuuuaaaagaaugauuaugaau

SEQ ID NO: 1366753 - RNA, 18 nt, Human
auuugggaagugaagacu

SEQ ID NO: 1366754 - RNA, 14 nt, Human
auuugggaagugaa

SEQ ID NO: 1366755 - RNA, 19 nt, Human
auuuggcuugacaaaggca

SEQ ID NO: 1366756 - RNA, 16 nt, Human
auuugacuuuucugua

SEQ ID NO: 1366757 - RNA, 15 nt, Human
auuugacuuuucugu

SEQ ID NO: 1366758 - RNA, 23 nt, Human
auuugggccugcuccagaccuga

SEQ ID NO: 1366759 - RNA, 22 nt, Human
auuugggccugcuccagaccug

SEQ ID NO: 1366760 - RNA, 21 nt, Human
auuugggccugcuccagaccu

SEQ ID NO: 1366761 - RNA, 19 nt, Human
auuugggccugcuccagac

SEQ ID NO: 1366762 - RNA, 19 nt, Human
auuugggagacaugugaca

SEQ ID NO: 1366763 - RNA, 17 nt, Human
auuugggagacauguga

SEQ ID NO: 1366764 - RNA, 17 nt, Human
auuuguaaaucugccac

SEQ ID NO: 1366765 - RNA, 16 nt, Human
auuuguaaaucugcca

SEQ ID NO: 1366766 - RNA, 12 nt, Human
auuuguaaaucu

SEQ ID NO: 1366767 - RNA, 23 nt, Human
auuuguaacccacugagaggaca

SEQ ID NO: 1366768 - RNA, 19 nt, Human
auuugucaugcugggauuu

SEQ ID NO: 1366769 - RNA, 13 nt, Human
auuugucaacaaa

SEQ ID NO: 1366770 - RNA, 15 nt, Human
auuugucaacaaagu

SEQ ID NO: 1366771 - RNA, 15 nt, Human
auuuguauaaaauaa

SEQ ID NO: 1366772 - RNA, 14 nt, Human
auuuguauaaaaua

SEQ ID NO: 1366773 - RNA, 22 nt, Human
auuuguaguguuggagaagaac

SEQ ID NO: 1366774 - RNA, 14 nt, Human
auuuuggaauuugc

SEQ ID NO: 1366775 - RNA, 19 nt, Human
auuuuguauuguuucaauu

SEQ ID NO: 1366776 - RNA, 16 nt, Human
auuuuguaucuugaug

SEQ ID NO: 1366777 - RNA, 23 nt, Human
auuuuguaauguaucaaauacau

SEQ ID NO: 1366778 - RNA, 20 nt, Human
auuuuguaauguaucaaaua

SEQ ID NO: 1366779 - RNA, 22 nt, Human
auuuuguaauaauaaagaauag

SEQ ID NO: 1366780 - RNA, 19 nt, Human
auuuuguaauaauaaagaa

SEQ ID NO: 1366781 - RNA, 14 nt, Human
auuuuguaauaaua

SEQ ID NO: 1366782 - RNA, 12 nt, Human
auuuuguaaguu

SEQ ID NO: 1366783 - RNA, 19 nt, Human
auuuuguaacgaagacaca

SEQ ID NO: 1366784 - RNA, 18 nt, Human
auuuuguaacgaagacac

SEQ ID NO: 1366785 - RNA, 20 nt, Human
auuuuguaaacucaaaauau

SEQ ID NO: 1366786 - RNA, 11 nt, Human
auuuuggaauu

SEQ ID NO: 1366787 - RNA, 12 nt, Human
auuuuggaauuu

SEQ ID NO: 1366788 - RNA, 12 nt, Human
auuuugcuuugu

SEQ ID NO: 1366789 - RNA, 18 nt, Human
auuuugcuuugugauuuu

SEQ ID NO: 1366790 - RNA, 20 nt, Human
auuuugcuuugugauuuuug

SEQ ID NO: 1366791 - RNA, 20 nt, Human
auuuuguguaagaaauacag

SEQ ID NO: 1366792 - RNA, 18 nt, Human
auuuuguguaagaaauac

SEQ ID NO: 1366793 - RNA, 17 nt, Human
auuuuguguaagaaaua

SEQ ID NO: 1366794 - RNA, 16 nt, Human
auuuuguguaagaaau

SEQ ID NO: 1366795 - RNA, 23 nt, Human
auuuugugguuuucgagauuauc

SEQ ID NO: 1366796 - RNA, 17 nt, Human
auuuugugaugcaaaua

SEQ ID NO: 1366797 - RNA, 21 nt, Human
auuuuguuggcauagcucugg

SEQ ID NO: 1366798 - RNA, 15 nt, Human
auuuuguuggcauag

SEQ ID NO: 1366799 - RNA, 23 nt, Human
auuuuguugcuguuuugauuugu

SEQ ID NO: 1366800 - RNA, 19 nt, Human
auuuuguugcuguuuugau

SEQ ID NO: 1366801 - RNA, 12 nt, Human
auuuuguuuaca

SEQ ID NO: 1366802 - RNA, 11 nt, Human
auuuuguuuac

SEQ ID NO: 1366803 - RNA, 16 nt, Human
auuuuguuucagugca

SEQ ID NO: 1366804 - RNA, 18 nt, Human
auuuugugaugcaaauaa

SEQ ID NO: 1366805 - RNA, 17 nt, Human
auuuuguguuuaggaac

SEQ ID NO: 1366806 - RNA, 18 nt, Human
auuuugcaaggugcauuu

SEQ ID NO: 1366807 - RNA, 21 nt, Human
auuuugcaaucccuuaauauc

SEQ ID NO: 1366808 - RNA, 21 nt, Human
auuuugcaaagauuuaaucug

SEQ ID NO: 1366809 - RNA, 16 nt, Human
auuuugcaaagauuua

SEQ ID NO: 1366810 - RNA, 13 nt, Human
auuuugcaaagau

SEQ ID NO: 1366811 - RNA, 19 nt, Human
auuuugccaagggcauaaa

SEQ ID NO: 1366812 - RNA, 14 nt, Human
auuuugcuggaaua

SEQ ID NO: 1366813 - RNA, 20 nt, Human
auuuugccaagggcauaaau

SEQ ID NO: 1366814 - RNA, 18 nt, Human
auuuugauguaaagaugu

SEQ ID NO: 1366815 - RNA, 17 nt, Human
auuuugauguaaagaug

SEQ ID NO: 1366816 - RNA, 15 nt, Human
auuuugauguuuuaa

SEQ ID NO: 1366817 - RNA, 17 nt, Human
auuuugauguuuuaagg

SEQ ID NO: 1366818 - RNA, 19 nt, Human
auuuuccuguugucaagaa

SEQ ID NO: 1366819 - RNA, 23 nt, Human
auuuuccuguccucuuucagcuc

SEQ ID NO: 1366820 - RNA, 22 nt, Human
auuuuccuguccucuuucagcu

SEQ ID NO: 1366821 - RNA, 21 nt, Human
auuuuccuguccucuuucagc

SEQ ID NO: 1366822 - RNA, 19 nt, Human
auuuuccuguccucuuuca

SEQ ID NO: 1366823 - RNA, 16 nt, Human
auuuuccuguccucuu

SEQ ID NO: 1366824 - RNA, 23 nt, Human
auuuuccuggugccaauuucaag

SEQ ID NO: 1366825 - RNA, 22 nt, Human
auuuuccuggugccaauuucaa

SEQ ID NO: 1366826 - RNA, 18 nt, Human
auuuuccuggugccaauu

SEQ ID NO: 1366827 - RNA, 14 nt, Human
auuuucuauaauuu

SEQ ID NO: 1366828 - RNA, 15 nt, Human
auuuucuauaauuua

SEQ ID NO: 1366829 - RNA, 12 nt, Human
auuuuaauaaug

SEQ ID NO: 1366830 - RNA, 18 nt, Human
auuuuaauaaaaauaauu

SEQ ID NO: 1366831 - RNA, 15 nt, Human
auuuuaauaaaaaua

SEQ ID NO: 1366832 - RNA, 15 nt, Human
auuuuaauaaacacu

SEQ ID NO: 1366833 - RNA, 16 nt, Human
auuuuaauaaacacuc

SEQ ID NO: 1366834 - RNA, 17 nt, Human
auuuuaauaaacacucu

SEQ ID NO: 1366835 - RNA, 18 nt, Human
auuuuuuaaaaagcaaaa

SEQ ID NO: 1366836 - RNA, 16 nt, Human
auuuuuuaaaaagcaa

SEQ ID NO: 1366837 - RNA, 15 nt, Human
auuuuuuaaaaagca

SEQ ID NO: 1366838 - RNA, 20 nt, Human
auuuuuuaaaaaagcuuaaa

SEQ ID NO: 1366839 - RNA, 19 nt, Human
auuuuuuaaaaaagcuuaa

SEQ ID NO: 1366840 - RNA, 18 nt, Human
auuuuuuaaaaaagcuua

SEQ ID NO: 1366841 - RNA, 17 nt, Human
auuuuuuaaaaaagcuu

SEQ ID NO: 1366842 - RNA, 14 nt, Human
auuuuuuaaaaaag

SEQ ID NO: 1366843 - RNA, 21 nt, Human
auuuuuguuuuguuuuuacaa

SEQ ID NO: 1366844 - RNA, 13 nt, Human
auuuuuuaaauuc

SEQ ID NO: 1366845 - RNA, 13 nt, Human
auuuuuuaaaugc

SEQ ID NO: 1366846 - RNA, 14 nt, Human
auuuuuuaaaugca

SEQ ID NO: 1366847 - RNA, 12 nt, Human
auuuuuguaauu

SEQ ID NO: 1366848 - RNA, 15 nt, Human
auuuuuguaguagcg

SEQ ID NO: 1366849 - RNA, 22 nt, Human
auuuuugugauuuugugauuga

SEQ ID NO: 1366850 - RNA, 23 nt, Human
auuuuuuccuucaaaguuuaaua

SEQ ID NO: 1366851 - RNA, 21 nt, Human
auuuuuuccuucaaaguuuaa

SEQ ID NO: 1366852 - RNA, 20 nt, Human
auuuuuuccuucaaaguuua

SEQ ID NO: 1366853 - RNA, 14 nt, Human
auuuuuuccaaaau

SEQ ID NO: 1366854 - RNA, 23 nt, Human
auuuuuuccaaaaucucccauuu

SEQ ID NO: 1366855 - RNA, 13 nt, Human
auuuuuuccaaaa

SEQ ID NO: 1366856 - RNA, 12 nt, Human
auuuuuuccaaa

SEQ ID NO: 1366857 - RNA, 22 nt, Human
auuuuuucaguauuauauguac

SEQ ID NO: 1366858 - RNA, 15 nt, Human
auuuuuucaguauua

SEQ ID NO: 1366859 - RNA, 21 nt, Human
auuuuuuaucaugcauguccu

SEQ ID NO: 1366860 - RNA, 16 nt, Human
auuuuuuaucaugcau

SEQ ID NO: 1366861 - RNA, 14 nt, Human
auuuuuuaauaauu

SEQ ID NO: 1366862 - RNA, 21 nt, Human
auuuuuuaagugaaaauauag

SEQ ID NO: 1366863 - RNA, 17 nt, Human
auuuuuuauaaaauaca

SEQ ID NO: 1366864 - RNA, 14 nt, Human
auuuuuuaggaaau

SEQ ID NO: 1366865 - RNA, 13 nt, Human
auuuuuuaggaaa

SEQ ID NO: 1366866 - RNA, 20 nt, Human
auuuuuuaauuauuauuuau

SEQ ID NO: 1366867 - RNA, 15 nt, Human
auuuuuuaauuauua

SEQ ID NO: 1366868 - RNA, 17 nt, Human
auuuuuuguugacauua

SEQ ID NO: 1366869 - RNA, 21 nt, Human
auuuuuuguugacauuagucu

SEQ ID NO: 1366870 - RNA, 16 nt, Human
auuuuuuguugacauu

SEQ ID NO: 1366871 - RNA, 14 nt, Human
auuuuuuguugaca

SEQ ID NO: 1366872 - RNA, 12 nt, Human
auuuuuuguuga

SEQ ID NO: 1366873 - RNA, 16 nt, Human
auuuuuuguauaauug

SEQ ID NO: 1366874 - RNA, 15 nt, Human
auuuuuuguauaauu

SEQ ID NO: 1366875 - RNA, 14 nt, Human
auuuuuuguauaau

SEQ ID NO: 1366876 - RNA, 22 nt, Human
auuuuuugggcagcaauuuaaa

SEQ ID NO: 1366877 - RNA, 23 nt, Human
auuuuuucucuaggaaauauuua

SEQ ID NO: 1366878 - RNA, 20 nt, Human
auuuuuucucuaggaaauau

SEQ ID NO: 1366879 - RNA, 16 nt, Human
auuuuuugaaaagcag

SEQ ID NO: 1366880 - RNA, 19 nt, Human
auuuuuugaaaagcagaca

SEQ ID NO: 1366881 - RNA, 18 nt, Human
auuuuuggagguuuauua

SEQ ID NO: 1366882 - RNA, 18 nt, Human
auuuuuggucauuguaau

SEQ ID NO: 1366883 - RNA, 19 nt, Human
auuuuuggcagucugaauu

SEQ ID NO: 1366884 - RNA, 21 nt, Human
auuuuuggggggaguaaagaa

SEQ ID NO: 1366885 - RNA, 19 nt, Human
auuuuuggagguuuauuac

SEQ ID NO: 1366886 - RNA, 17 nt, Human
auuuuuggagguuuauu

SEQ ID NO: 1366887 - RNA, 23 nt, Human
auuuuuggaagaggacuccuuaa

SEQ ID NO: 1366888 - RNA, 15 nt, Human
auuuuugcugagacu

SEQ ID NO: 1366889 - RNA, 21 nt, Human
auuuuugccucuuccagucuu

SEQ ID NO: 1366890 - RNA, 18 nt, Human
auuuuugccucuuccagu

SEQ ID NO: 1366891 - RNA, 12 nt, Human
auuuuugccucu

SEQ ID NO: 1366892 - RNA, 19 nt, Human
auuuuugauacuaagcauu

SEQ ID NO: 1366893 - RNA, 21 nt, Human
auuuuugauacuaagcauuga

SEQ ID NO: 1366894 - RNA, 21 nt, Human
auuuuugauaaagccucaagg

SEQ ID NO: 1366895 - RNA, 15 nt, Human
auuuuugacaguguu

SEQ ID NO: 1366896 - RNA, 16 nt, Human
auuuuucuuuacaaaa

SEQ ID NO: 1366897 - RNA, 15 nt, Human
auuuuucuuuacaaa

SEQ ID NO: 1366898 - RNA, 14 nt, Human
auuuuucuuuacaa

SEQ ID NO: 1366899 - RNA, 13 nt, Human
auuuuucuuuaca

SEQ ID NO: 1366900 - RNA, 16 nt, Human
auuuuucuuuaacugc

SEQ ID NO: 1366901 - RNA, 15 nt, Human
auuuuucuuuaacug

SEQ ID NO: 1366902 - RNA, 14 nt, Human
auuuuucuucuuga

SEQ ID NO: 1366903 - RNA, 22 nt, Human
auuuuucuuagggaaggauaca

SEQ ID NO: 1366904 - RNA, 13 nt, Human
auuuuuccaacua

SEQ ID NO: 1366905 - RNA, 18 nt, Human
auuuuucaugauaaugaa

SEQ ID NO: 1366906 - RNA, 20 nt, Human
auuuuucaauagcacauaug

SEQ ID NO: 1366907 - RNA, 15 nt, Human
auuuuucacuucaaa

SEQ ID NO: 1366908 - RNA, 19 nt, Human
auuuuucuaacuacaaagg

SEQ ID NO: 1366909 - RNA, 12 nt, Human
auuuuucuaacu

SEQ ID NO: 1366910 - RNA, 10 nt, Human
auuuuuccua

SEQ ID NO: 1366911 - RNA, 21 nt, Human
auuuuuccaacuacuaauaga

SEQ ID NO: 1366912 - RNA, 21 nt, Human
auuuuucuuagggaaggauac

SEQ ID NO: 1366913 - RNA, 22 nt, Human
auuuuucaauagcacauaugga

SEQ ID NO: 1366914 - RNA, 21 nt, Human
auuuuuauuuuugcugagacu

SEQ ID NO: 1366915 - RNA, 18 nt, Human
auuuuguuuuuccuucca

SEQ ID NO: 1366916 - RNA, 20 nt, Human
auuuuguuugguauuguauu

SEQ ID NO: 1366917 - RNA, 21 nt, Human
auuuuguuugguauuguauuu

SEQ ID NO: 1366918 - RNA, 22 nt, Human
auuuuguuugguauuguauuua

SEQ ID NO: 1366919 - RNA, 14 nt, Human
auuuuguuugguau

SEQ ID NO: 1366920 - RNA, 17 nt, Human
auuuuguuugguauugu

SEQ ID NO: 1366921 - RNA, 18 nt, Human
auuuuguuugguauugua

SEQ ID NO: 1366922 - RNA, 19 nt, Human
auuuuguuugguauuguau

SEQ ID NO: 1366923 - RNA, 21 nt, Human
auucucauuggaaauuuagca

SEQ ID NO: 1366924 - RNA, 11 nt, Human
auucucauugg

SEQ ID NO: 1366925 - RNA, 18 nt, Human
auucucauuaaaagaaua

SEQ ID NO: 1366926 - RNA, 19 nt, Human
auucucauuaaaagaauau

SEQ ID NO: 1366927 - RNA, 12 nt, Human
auucucauuaaa

SEQ ID NO: 1366928 - RNA, 16 nt, Human
auucuccacagcaacc

SEQ ID NO: 1366929 - RNA, 14 nt, Human
auucuccacagcaa

SEQ ID NO: 1366930 - RNA, 13 nt, Human
auucuccacagca

SEQ ID NO: 1366931 - RNA, 23 nt, Human
auucucauuggaaauuuagcauu

SEQ ID NO: 1366932 - RNA, 22 nt, Human
auucucauuggaaauuuagcau

SEQ ID NO: 1366933 - RNA, 17 nt, Human
auucugccucucuagga

SEQ ID NO: 1366934 - RNA, 16 nt, Human
auucugccucucuagg

SEQ ID NO: 1366935 - RNA, 15 nt, Human
auucugccucucuag

SEQ ID NO: 1366936 - RNA, 16 nt, Human
auucugccuuugccag

SEQ ID NO: 1366937 - RNA, 19 nt, Human
auucugccuuugccaggug

SEQ ID NO: 1366938 - RNA, 23 nt, Human
auucugguuccagggucccucug

SEQ ID NO: 1366939 - RNA, 22 nt, Human
auugacuuuccccaccagaugc

SEQ ID NO: 1366940 - RNA, 14 nt, Human
auugacuuguauau

SEQ ID NO: 1366941 - RNA, 14 nt, Human
auugaccuggaugg

SEQ ID NO: 1366942 - RNA, 21 nt, Human
auugacgacaagugcugaaca

SEQ ID NO: 1366943 - RNA, 22 nt, Human
auugacgacaagugcugaacag

SEQ ID NO: 1366944 - RNA, 18 nt, Human
auugacacaguaccauuu

SEQ ID NO: 1366945 - RNA, 17 nt, Human
auugacacagaaaaugu

SEQ ID NO: 1366946 - RNA, 17 nt, Human
auugacaacaguuacau

SEQ ID NO: 1366947 - RNA, 18 nt, Human
auugaaccuuugugcccu

SEQ ID NO: 1366948 - RNA, 23 nt, Human
auugaaccuuugugcccuaucac

SEQ ID NO: 1366949 - RNA, 14 nt, Human
auugacacagaaaa

SEQ ID NO: 1366950 - RNA, 12 nt, Human
auugacacagaa

SEQ ID NO: 1366951 - RNA, 17 nt, Human
auugacaacacccauuu

SEQ ID NO: 1366952 - RNA, 14 nt, Human
auugaaauguaagg

SEQ ID NO: 1366953 - RNA, 18 nt, Human
auugaaaaaauagagccu

SEQ ID NO: 1366954 - RNA, 14 nt, Human
auugaaaaaauaga

SEQ ID NO: 1366955 - RNA, 22 nt, Human
auugaaaaaauagagccugagg

SEQ ID NO: 1366956 - RNA, 19 nt, Human
auugaaaaaauagagccug

SEQ ID NO: 1366957 - RNA, 23 nt, Human
auucuuccaucugauugugaugu

SEQ ID NO: 1366958 - RNA, 15 nt, Human
auucuuccaucugau

SEQ ID NO: 1366959 - RNA, 14 nt, Human
auucuuccaucuga

SEQ ID NO: 1366960 - RNA, 13 nt, Human
auucuuccaucug

SEQ ID NO: 1366961 - RNA, 19 nt, Human
auucuuccuaguuuucucc

SEQ ID NO: 1366962 - RNA, 17 nt, Human
auucuuccuaguuuucu

SEQ ID NO: 1366963 - RNA, 21 nt, Human
auucuucccuaucuuugccac

SEQ ID NO: 1366964 - RNA, 12 nt, Human
auucuuccuagu

SEQ ID NO: 1366965 - RNA, 20 nt, Human
auucuucccuaucuuugcca

SEQ ID NO: 1366966 - RNA, 20 nt, Human
auuaguuuccuuuuuaauau

SEQ ID NO: 1366967 - RNA, 18 nt, Human
auuaguuuccuuuuuaau

SEQ ID NO: 1366968 - RNA, 17 nt, Human
auuaguuuccuuuuuaa

SEQ ID NO: 1366969 - RNA, 12 nt, Human
auuaguuuccuu

SEQ ID NO: 1366970 - RNA, 12 nt, Human
auuaguuauaua

SEQ ID NO: 1366971 - RNA, 18 nt, Human
auuagugcuaagugugaa

SEQ ID NO: 1366972 - RNA, 20 nt, Human
auuagugcuaagugugaacu

SEQ ID NO: 1366973 - RNA, 22 nt, Human
auuagugcuaagugugaacugg

SEQ ID NO: 1366974 - RNA, 15 nt, Human
auuauauuuacaaau

SEQ ID NO: 1366975 - RNA, 20 nt, Human
auuauauuauuaguuuugau

SEQ ID NO: 1366976 - RNA, 14 nt, Human
auuauauuaugaag

SEQ ID NO: 1366977 - RNA, 16 nt, Human
auuauaccaaaauguu

SEQ ID NO: 1366978 - RNA, 15 nt, Human
auuauaccaaaaugu

SEQ ID NO: 1366979 - RNA, 20 nt, Human
auuauaccaaaauguugcug

SEQ ID NO: 1366980 - RNA, 19 nt, Human
auuauaccaaaauguugcu

SEQ ID NO: 1366981 - RNA, 18 nt, Human
auuauaccaaaauguugc

SEQ ID NO: 1366982 - RNA, 14 nt, Human
auuauacuuguaau

SEQ ID NO: 1366983 - RNA, 14 nt, Human
auuauacgcuggca

SEQ ID NO: 1366984 - RNA, 18 nt, Human
auuauacuuguaauuaug

SEQ ID NO: 1366985 - RNA, 17 nt, Human
auuauauguuguaagca

SEQ ID NO: 1366986 - RNA, 17 nt, Human
auuauacuuguaauuau

SEQ ID NO: 1366987 - RNA, 16 nt, Human
auuauacuuguaauua

SEQ ID NO: 1366988 - RNA, 18 nt, Human
auuauauguucagauuau

SEQ ID NO: 1366989 - RNA, 14 nt, Human
auuaucuaauuuau

SEQ ID NO: 1366990 - RNA, 13 nt, Human
auuaucuaauuua

SEQ ID NO: 1366991 - RNA, 21 nt, Human
auuauguuaaaacugggacag

SEQ ID NO: 1366992 - RNA, 14 nt, Human
auuaucuagauacu

SEQ ID NO: 1366993 - RNA, 18 nt, Human
auuaucuagauacuguau

SEQ ID NO: 1366994 - RNA, 22 nt, Human
auuauauuucuauuuuauuaug

SEQ ID NO: 1366995 - RNA, 23 nt, Human
auuauauuucuauuuuauuauga

SEQ ID NO: 1366996 - RNA, 22 nt, Human
auuauauguacccucugaaaua

SEQ ID NO: 1366997 - RNA, 20 nt, Human
auuaucguuuucuuaaagug

SEQ ID NO: 1366998 - RNA, 18 nt, Human
auuauauuuauuacugua

SEQ ID NO: 1366999 - RNA, 15 nt, Human
auuauauuuauuacu

SEQ ID NO: 1367000 - RNA, 17 nt, Human
auuauuacuuguaaaua

SEQ ID NO: 1367001 - RNA, 16 nt, Human
auuauuacuuguaaau

SEQ ID NO: 1367002 - RNA, 14 nt, Human
auuauuacuuguaa

SEQ ID NO: 1367003 - RNA, 13 nt, Human
auuauuacuugua

SEQ ID NO: 1367004 - RNA, 21 nt, Human
auuauuacuuauuuuugacag

SEQ ID NO: 1367005 - RNA, 20 nt, Human
auuauuacuuauuuuugaca

SEQ ID NO: 1367006 - RNA, 12 nt, Human
auuauguuaaac

SEQ ID NO: 1367007 - RNA, 13 nt, Human
auuauguuaaacu

SEQ ID NO: 1367008 - RNA, 14 nt, Human
auuauguuaaacua

SEQ ID NO: 1367009 - RNA, 22 nt, Human
auuauguuaaacuagcauaucu

SEQ ID NO: 1367010 - RNA, 23 nt, Human
auuauguuaaacuagcauaucug

SEQ ID NO: 1367011 - RNA, 22 nt, Human
auuauuaguuuugauuuaaugu

SEQ ID NO: 1367012 - RNA, 17 nt, Human
auuauuagaaucaaaca

SEQ ID NO: 1367013 - RNA, 23 nt, Human
auuauuagaaucaaacauuuuga

SEQ ID NO: 1367014 - RNA, 15 nt, Human
auuauuacuuuugcu

SEQ ID NO: 1367015 - RNA, 14 nt, Human
auuauuacuuuugc

SEQ ID NO: 1367016 - RNA, 22 nt, Human
auuauuacuuguaaauauaaag

SEQ ID NO: 1367017 - RNA, 23 nt, Human
auuauuacuuguaaauauaaaga

SEQ ID NO: 1367018 - RNA, 20 nt, Human
auuauuacuuguaaauauaa

SEQ ID NO: 1367019 - RNA, 19 nt, Human
auuauuacuuguaaauaua

SEQ ID NO: 1367020 - RNA, 15 nt, Human
auuauuauucuucau

SEQ ID NO: 1367021 - RNA, 15 nt, Human
auuauuauuuggccc

SEQ ID NO: 1367022 - RNA, 16 nt, Human
auucacaucucauuuu

SEQ ID NO: 1367023 - RNA, 15 nt, Human
auucacaucucauuu

SEQ ID NO: 1367024 - RNA, 18 nt, Human
auucacaucgcagauucu

SEQ ID NO: 1367025 - RNA, 20 nt, Human
auucacaucuaaccucaucu

SEQ ID NO: 1367026 - RNA, 17 nt, Human
auucacaucuaaccuca

SEQ ID NO: 1367027 - RNA, 23 nt, Human
auucacaguucuuugggccagac

SEQ ID NO: 1367028 - RNA, 12 nt, Human
auuauuuuguga

SEQ ID NO: 1367029 - RNA, 12 nt, Human
auuauuuugaug

SEQ ID NO: 1367030 - RNA, 11 nt, Human
auuauuugcau

SEQ ID NO: 1367031 - RNA, 15 nt, Human
auuauuauuuguguu

SEQ ID NO: 1367032 - RNA, 16 nt, Human
auuauuauucuucaua

SEQ ID NO: 1367033 - RNA, 17 nt, Human
auucaggaaaaggccug

SEQ ID NO: 1367034 - RNA, 20 nt, Human
auucagacagaugaggcuuu

SEQ ID NO: 1367035 - RNA, 14 nt, Human
auucagacagauga

SEQ ID NO: 1367036 - RNA, 21 nt, Human
auucaggaaaaggccuggggu

SEQ ID NO: 1367037 - RNA, 19 nt, Human
auucaggaaaaggccuggg

SEQ ID NO: 1367038 - RNA, 18 nt, Human
auucaggaaaaggccugg

SEQ ID NO: 1367039 - RNA, 13 nt, Human
auucagacagaug

SEQ ID NO: 1367040 - RNA, 18 nt, Human
auucagaagaaaaagaag

SEQ ID NO: 1367041 - RNA, 17 nt, Human
auucagaagaaaaagaa

SEQ ID NO: 1367042 - RNA, 16 nt, Human
auucagaagaaaaaga

SEQ ID NO: 1367043 - RNA, 14 nt, Human
auucagaagaaaaa

SEQ ID NO: 1367044 - RNA, 23 nt, Human
auucagaaccccaacuacugugu

SEQ ID NO: 1367045 - RNA, 13 nt, Human
auucagaaaugag

SEQ ID NO: 1367046 - RNA, 13 nt, Human
auucacauuguau

SEQ ID NO: 1367047 - RNA, 20 nt, Human
auucacauuguauucagagu

SEQ ID NO: 1367048 - RNA, 23 nt, Human
auucuaaugaugaucaauuauag

SEQ ID NO: 1367049 - RNA, 23 nt, Human
auucuaagacuuacucuaagauc

SEQ ID NO: 1367050 - RNA, 15 nt, Human
auucuaagugaaauu

SEQ ID NO: 1367051 - RNA, 22 nt, Human
auucuaagacuuacucuaagau

SEQ ID NO: 1367052 - RNA, 20 nt, Human
auucuaagacuuacucuaag

SEQ ID NO: 1367053 - RNA, 12 nt, Human
auucuaagacuu

SEQ ID NO: 1367054 - RNA, 18 nt, Human
auucuaacggucuguucu

SEQ ID NO: 1367055 - RNA, 21 nt, Human
auucccuagaaacuuccaaau

SEQ ID NO: 1367056 - RNA, 20 nt, Human
auucccuagaaacuuccaaa

SEQ ID NO: 1367057 - RNA, 17 nt, Human
auucccuagaaacuucc

SEQ ID NO: 1367058 - RNA, 23 nt, Human
auucccguuuugucacuuuuucu

SEQ ID NO: 1367059 - RNA, 21 nt, Human
auucccguuuugucacuuuuu

SEQ ID NO: 1367060 - RNA, 18 nt, Human
auucccguuuugucacuu

SEQ ID NO: 1367061 - RNA, 16 nt, Human
auucccguuuugucac

SEQ ID NO: 1367062 - RNA, 15 nt, Human
auucccgcaguggga

SEQ ID NO: 1367063 - RNA, 22 nt, Human
auuccccucugcugcugucccu

SEQ ID NO: 1367064 - RNA, 15 nt, Human
auuccccucugcugc

SEQ ID NO: 1367065 - RNA, 13 nt, Human
auuccccucugcu

SEQ ID NO: 1367066 - RNA, 23 nt, Human
auucccagguaggccaagguguc

SEQ ID NO: 1367067 - RNA, 19 nt, Human
auucccagguaggccaagg

SEQ ID NO: 1367068 - RNA, 19 nt, Human
auucccagagcaaaauaau

SEQ ID NO: 1367069 - RNA, 17 nt, Human
auucccagagcaaaaua

SEQ ID NO: 1367070 - RNA, 12 nt, Human
auucccagcucu

SEQ ID NO: 1367071 - RNA, 14 nt, Human
auuccagccccucu

SEQ ID NO: 1367072 - RNA, 13 nt, Human
auuccagccccuc

SEQ ID NO: 1367073 - RNA, 20 nt, Human
auucaggaaaaggccugggg

SEQ ID NO: 1367074 - RNA, 17 nt, Human
auuccagagcacugcuc

SEQ ID NO: 1367075 - RNA, 14 nt, Human
caauuaaaggcaaa

SEQ ID NO: 1367076 - RNA, 23 nt, Human
caaugucuugaugcaugcacugu

SEQ ID NO: 1367077 - RNA, 21 nt, Human
caaugucuugaugcaugcacu

SEQ ID NO: 1367078 - RNA, 11 nt, Human
caaugucuuga

SEQ ID NO: 1367079 - RNA, 20 nt, Human
caaugucuggagaccaccag

SEQ ID NO: 1367080 - RNA, 21 nt, Human
caaugucuggagaccaccagg

SEQ ID NO: 1367081 - RNA, 16 nt, Human
caaugucuggagacca

SEQ ID NO: 1367082 - RNA, 15 nt, Human
caaugucuggagacc

SEQ ID NO: 1367083 - RNA, 14 nt, Human
caaugucuggagac

SEQ ID NO: 1367084 - RNA, 13 nt, Human
caaugucuggaga

SEQ ID NO: 1367085 - RNA, 19 nt, Human
caaugccacagcccuguca

SEQ ID NO: 1367086 - RNA, 17 nt, Human
caaugccacagcccugu

SEQ ID NO: 1367087 - RNA, 16 nt, Human
caaugccacagcccug

SEQ ID NO: 1367088 - RNA, 15 nt, Human
caaugccacagcccu

SEQ ID NO: 1367089 - RNA, 19 nt, Human
caaugcaguugucucuguu

SEQ ID NO: 1367090 - RNA, 20 nt, Human
caaugcaguugucucuguuu

SEQ ID NO: 1367091 - RNA, 18 nt, Human
caaugcaguugucucugu

SEQ ID NO: 1367092 - RNA, 17 nt, Human
caaugcaguugucucug

SEQ ID NO: 1367093 - RNA, 18 nt, Human
caauucauccucacucag

SEQ ID NO: 1367094 - RNA, 23 nt, Human
caauucagacaggcaaauaaaag

SEQ ID NO: 1367095 - RNA, 15 nt, Human
caauucagacaggca

SEQ ID NO: 1367096 - RNA, 14 nt, Human
caauucagacaggc

SEQ ID NO: 1367097 - RNA, 13 nt, Human
caauucagacagg

SEQ ID NO: 1367098 - RNA, 20 nt, Human
caauucacaucuaaccucau

SEQ ID NO: 1367099 - RNA, 13 nt, Human
caauucaaagcug

SEQ ID NO: 1367100 - RNA, 17 nt, Human
caauucaaaaguuccaa

SEQ ID NO: 1367101 - RNA, 15 nt, Human
caauucaaaaguucc

SEQ ID NO: 1367102 - RNA, 21 nt, Human
caauuuuaucccucaccugua

SEQ ID NO: 1367103 - RNA, 22 nt, Human
caauuccaacaguuuaaugaag

SEQ ID NO: 1367104 - RNA, 21 nt, Human
caauuccaacaguuuaaugaa

SEQ ID NO: 1367105 - RNA, 19 nt, Human
caauuccaacaguuuaaug

SEQ ID NO: 1367106 - RNA, 18 nt, Human
caauuccaacaguuuaau

SEQ ID NO: 1367107 - RNA, 15 nt, Human
caauuccaacaguuu

SEQ ID NO: 1367108 - RNA, 20 nt, Human
cacaaagacccuggcuuuca

SEQ ID NO: 1367109 - RNA, 17 nt, Human
cacaaagacccuggcuu

SEQ ID NO: 1367110 - RNA, 16 nt, Human
cacaaagacccuggcu

SEQ ID NO: 1367111 - RNA, 15 nt, Human
cacaaagacccuggc

SEQ ID NO: 1367112 - RNA, 17 nt, Human
cacaaacuguaauacaa

SEQ ID NO: 1367113 - RNA, 19 nt, Human
cacaaacuuuuauacucuu

SEQ ID NO: 1367114 - RNA, 23 nt, Human
cacaaacuguaaauaaaaagaaa

SEQ ID NO: 1367115 - RNA, 15 nt, Human
cacaaacuguaaaua

SEQ ID NO: 1367116 - RNA, 16 nt, Human
cacaaaacccagaccu

SEQ ID NO: 1367117 - RNA, 14 nt, Human
cacaaacuguaaau

SEQ ID NO: 1367118 - RNA, 19 nt, Human
caauuuucuggaauacaug

SEQ ID NO: 1367119 - RNA, 23 nt, Human
cacaacagccugacaacauuucu

SEQ ID NO: 1367120 - RNA, 20 nt, Human
cacaaauuauuaaugaaaau

SEQ ID NO: 1367121 - RNA, 17 nt, Human
cacaaauuauuaaugaa

SEQ ID NO: 1367122 - RNA, 15 nt, Human
cacaaauuaucuuaa

SEQ ID NO: 1367123 - RNA, 21 nt, Human
cacaaauucugucucuggauu

SEQ ID NO: 1367124 - RNA, 21 nt, Human
caaguguaaaauauuuugaau

SEQ ID NO: 1367125 - RNA, 16 nt, Human
caaguguaaaauauuu

SEQ ID NO: 1367126 - RNA, 15 nt, Human
caaguguaaaauauu

SEQ ID NO: 1367127 - RNA, 18 nt, Human
caauaugggggccuuuug

SEQ ID NO: 1367128 - RNA, 17 nt, Human
caauagucaaauugugu

SEQ ID NO: 1367129 - RNA, 20 nt, Human
caauccuauguuuuuguuca

SEQ ID NO: 1367130 - RNA, 14 nt, Human
caauccuauguuuu

SEQ ID NO: 1367131 - RNA, 22 nt, Human
caauccuaugcaugguuucagc

SEQ ID NO: 1367132 - RNA, 20 nt, Human
caauccuaugcaugguuuca

SEQ ID NO: 1367133 - RNA, 18 nt, Human
caauccuaugcaugguuu

SEQ ID NO: 1367134 - RNA, 16 nt, Human
caauccuaugcauggu

SEQ ID NO: 1367135 - RNA, 14 nt, Human
caauccuaugcaug

SEQ ID NO: 1367136 - RNA, 12 nt, Human
caauccuaugca

SEQ ID NO: 1367137 - RNA, 17 nt, Human
caauccuagguaggguu

SEQ ID NO: 1367138 - RNA, 17 nt, Human
caaugaacaucccuuuu

SEQ ID NO: 1367139 - RNA, 23 nt, Human
caaugaaaugaauuaaaguggac

SEQ ID NO: 1367140 - RNA, 21 nt, Human
caaugaaaugaauuaaagugg

SEQ ID NO: 1367141 - RNA, 11 nt, Human
caauccuggac

SEQ ID NO: 1367142 - RNA, 15 nt, Human
caauccucccagaaa

SEQ ID NO: 1367143 - RNA, 23 nt, Human
caauccuaugcaugguuucagca

SEQ ID NO: 1367144 - RNA, 18 nt, Human
caauccucccacuucagc

SEQ ID NO: 1367145 - RNA, 22 nt, Human
caauccucccacuucagccucc

SEQ ID NO: 1367146 - RNA, 16 nt, Human
caaugcaguugucucu

SEQ ID NO: 1367147 - RNA, 16 nt, Human
caaugcagugccuuuc

SEQ ID NO: 1367148 - RNA, 21 nt, Human
caaugauggcaauuuuguaac

SEQ ID NO: 1367149 - RNA, 16 nt, Human
caaugauggcaauuuu

SEQ ID NO: 1367150 - RNA, 13 nt, Human
caaugauggcaau

SEQ ID NO: 1367151 - RNA, 21 nt, Human
caaugaugaaugagaaucuac

SEQ ID NO: 1367152 - RNA, 16 nt, Human
caaugacaaagcagau

SEQ ID NO: 1367153 - RNA, 15 nt, Human
caaugacaaagcaga

SEQ ID NO: 1367154 - RNA, 14 nt, Human
caaugacaaagcag

SEQ ID NO: 1367155 - RNA, 23 nt, Human
caaugaauuuuauaaucugcagc

SEQ ID NO: 1367156 - RNA, 22 nt, Human
caaugaauaaaaacucaaggag

SEQ ID NO: 1367157 - RNA, 21 nt, Human
caaugaauaaaaacucaagga

SEQ ID NO: 1367158 - RNA, 20 nt, Human
caaugaauaaaaacucaagg

SEQ ID NO: 1367159 - RNA, 13 nt, Human
caaugacaugaau

SEQ ID NO: 1367160 - RNA, 12 nt, Human
caaugacaugaa

SEQ ID NO: 1367161 - RNA, 20 nt, Human
caaugagguguccaacuggc

SEQ ID NO: 1367162 - RNA, 15 nt, Human
caaugacaugaauuu

SEQ ID NO: 1367163 - RNA, 14 nt, Human
caaugacaugaauu

SEQ ID NO: 1367164 - RNA, 14 nt, Human
caaugaugaaugag

SEQ ID NO: 1367165 - RNA, 19 nt, Human
caaugauccuguauucaga

SEQ ID NO: 1367166 - RNA, 20 nt, Human
caaugacaugaauuuuagcu

SEQ ID NO: 1367167 - RNA, 20 nt, Human
caaugaucaccgacugaaaa

SEQ ID NO: 1367168 - RNA, 23 nt, Human
cacaacucacuccuuuuaaagaa

SEQ ID NO: 1367169 - RNA, 20 nt, Human
cacaccagggccagccucua

SEQ ID NO: 1367170 - RNA, 19 nt, Human
cacaccagggccagccucu

SEQ ID NO: 1367171 - RNA, 18 nt, Human
cacaccagggccagccuc

SEQ ID NO: 1367172 - RNA, 15 nt, Human
cacaccagggccagc

SEQ ID NO: 1367173 - RNA, 22 nt, Human
cacaccaggcuugccugcaggc

SEQ ID NO: 1367174 - RNA, 21 nt, Human
cacaccaggcuugccugcagg

SEQ ID NO: 1367175 - RNA, 13 nt, Human
cacaccagagaac

SEQ ID NO: 1367176 - RNA, 19 nt, Human
cacaccacuagccucaggg

SEQ ID NO: 1367177 - RNA, 14 nt, Human
cacaccacuagccu

SEQ ID NO: 1367178 - RNA, 18 nt, Human
cacacagcuacucucccc

SEQ ID NO: 1367179 - RNA, 22 nt, Human
cacaccuccuucccucucugga

SEQ ID NO: 1367180 - RNA, 19 nt, Human
cacaccuccuucccucucu

SEQ ID NO: 1367181 - RNA, 22 nt, Human
cacaccuuuuauugacacagaa

SEQ ID NO: 1367182 - RNA, 16 nt, Human
cacaccuguagcacuu

SEQ ID NO: 1367183 - RNA, 23 nt, Human
cacaccuuuuauugacacagaaa

SEQ ID NO: 1367184 - RNA, 17 nt, Human
cacaccccacucccaca

SEQ ID NO: 1367185 - RNA, 12 nt, Human
cacaccccacuc

SEQ ID NO: 1367186 - RNA, 21 nt, Human
cacacccuguacuguucugug

SEQ ID NO: 1367187 - RNA, 15 nt, Human
cacacagacuauuuu

SEQ ID NO: 1367188 - RNA, 22 nt, Human
cacacacauugcugugaacagg

SEQ ID NO: 1367189 - RNA, 18 nt, Human
cacacacaugcuucccuu

SEQ ID NO: 1367190 - RNA, 22 nt, Human
cacaacucacuccuuuuaaaga

SEQ ID NO: 1367191 - RNA, 19 nt, Human
cacaacucacuccuuuuaa

SEQ ID NO: 1367192 - RNA, 11 nt, Human
cacaacuagga

SEQ ID NO: 1367193 - RNA, 13 nt, Human
cacaacuauauug

SEQ ID NO: 1367194 - RNA, 14 nt, Human
cacaacgugcauug

SEQ ID NO: 1367195 - RNA, 17 nt, Human
cacaacgugcauugugc

SEQ ID NO: 1367196 - RNA, 19 nt, Human
cacaacgugcauugugcuu

SEQ ID NO: 1367197 - RNA, 17 nt, Human
cacagagauucugaacu

SEQ ID NO: 1367198 - RNA, 10 nt, Human
cacagagagu

SEQ ID NO: 1367199 - RNA, 16 nt, Human
cacagaguuguuacau

SEQ ID NO: 1367200 - RNA, 17 nt, Human
cacagaguuguuacauu

SEQ ID NO: 1367201 - RNA, 14 nt, Human
cacagacuauuuuu
